United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 92

SEQ ID NO: 4142157 - RNA, 65 nt, Human
gccuggcagauggagaagcagcaggugcuguggugugacgggaccuugcuucccaucauguacgc

SEQ ID NO: 4142158 - RNA, 69 nt, Human
gccuggcagcuaccuggcagcucuccuccagccaagacaauggaagaggugguucagguagagcccagc

SEQ ID NO: 4142159 - RNA, 66 nt, Human
gccuggcagggcccggacggcagaugcgcuucggugcugcugugagucuugugcucugccuuaggc

SEQ ID NO: 4142160 - RNA, 68 nt, Human
gccuggcauaaagcaggugcucagugaccaguggguaucaguuggucccuugcugcuuugaguugggc

SEQ ID NO: 4142161 - RNA, 66 nt, Human
gccuggccaacguggugaaaccuugucucuacuaaaaauacaaaaauucgcugggaguggccaggc

SEQ ID NO: 4142162 - RNA, 58 nt, Human
gccuggcugggcugaaugcuuaucaccuaauuauaucaagcauagagcaccagaaggc

SEQ ID NO: 4142163 - RNA, 57 nt, Human
gccuggcugucuggcaagguucuuccaaggaaccuccaccaugaaagccaugaaugc

SEQ ID NO: 4142164 - RNA, 105 nt, Human
gccugggaaugucggggccuccaccugccuggagcugaguguggagcuugcaacgcgcagacucugacaucucuuggggcagcugcuggcuguggaagccggggu

SEQ ID NO: 4142165 - RNA, 69 nt, Human
gccugggaccacacuuuggaaaucacgauuaugaacaggaaucagaauuucugaagauguggccugggc

SEQ ID NO: 4142166 - RNA, 60 nt, Human
gccugggcucagcccaugcugucccgcuaagccacgcggaggacugggugcgggccuggc

SEQ ID NO: 4142167 - RNA, 68 nt, Human
gccugggcugcagcgggagcgacgcgccggccgccggguggggguggagccccgccgcggccccaggu

SEQ ID NO: 4142168 - RNA, 62 nt, Human
gccuggggacagagggaggucagagucacgucccaccugcucugauaacucuggccccaggc

SEQ ID NO: 4142169 - RNA, 66 nt, Human
gccuggggcagggagagaggcagagagugaguuccuugagcccagcuucuccucccgcucccaggc

SEQ ID NO: 4142170 - RNA, 118 nt, Human
gccuggggcucccagggagauguuaggaugaggggugccguccucugcugcagcugcucuuauguucagauuccaguuuguggcuccccucuuucucauauccuuggauguuccuugc

SEQ ID NO: 4142171 - RNA, 117 nt, Human
gccuggggggcuaucaccggcccucagcucccugugggaacuccugaguugggggccacccacagggcuucucauggggugcagagcugggcagggaugggggagggcagcuuaggc

SEQ ID NO: 4142172 - RNA, 58 nt, Human
gccugggguucuaagcccuuguuagaugacugucccaagagcuucuaggacgcugggc

SEQ ID NO: 4142173 - RNA, 58 nt, Human
gccugggugauuccacaguacagugaggcugagacuccuggcucuguugucacccggc

SEQ ID NO: 4142174 - RNA, 55 nt, Human
gccuggucuauauagacagagaccaugucucauuuguuuagguagcaccauuugc

SEQ ID NO: 4142175 - RNA, 85 nt, Human
gccuggucuccuccagauguuuauaacucaugagugccaggacuagaccugguacuaggaagcagcugcauuggauuuaccaggc

SEQ ID NO: 4142176 - RNA, 61 nt, Human
gccuggugcaccaaguaaggguggaaaagucagucuuuauacucucagcggagcaucaugc

SEQ ID NO: 4142177 - RNA, 98 nt, Human
gccuggugggacagguagcauuuuuccucuuucccagcugaaaauugaaguucagagagauuaaaugacuuguccaaguucaccugaaaaaauaaggc

SEQ ID NO: 4142178 - RNA, 57 nt, Human
gcccauccugcggggagcagagggcaucagggugcccuugaguuggcccaggagggu

SEQ ID NO: 4142179 - RNA, 64 nt, Human
gcccaucuuauuuucuucuagugcucuuuuacuuggagaaacagaauacgaaagcuaagagggc

SEQ ID NO: 4142180 - RNA, 58 nt, Human
gcccaugagguugaggcuguagugagcugugaucaugccacugcacuucagccugggc

SEQ ID NO: 4142181 - RNA, 87 nt, Human
gcccauggacuuuggucuguccauccugccuucccuuucccaagagacaggccaggccacagguggaagccagagaauccagaccgc

SEQ ID NO: 4142182 - RNA, 77 nt, Human
gcccauguagcacuuggauauacaaaugaaguagcaucauuuuauuucccuguaauaaucccaguuuucucaugggc

SEQ ID NO: 4142183 - RNA, 68 nt, Human
gcccauuaagcagcaggugugcuuuuaaugagaaucuaaaucauuucuuccuugcuugcugcuuaggu

SEQ ID NO: 4142184 - RNA, 57 nt, Human
gcccauugcccugaccagcugggauaauacucugcuugcugucccaggccaaagggc

SEQ ID NO: 4142185 - RNA, 80 nt, Human
gcccauuuauuuucuccuucccauuaccuucugcucucuagaugagcaaggcaugcacaagaagggggaggugggugagc

SEQ ID NO: 4142186 - RNA, 73 nt, Human
gccccaaagcaggcucccuucucggaauucuugcccagagagcccaguuguacccugaagggagccugguugc

SEQ ID NO: 4142187 - RNA, 84 nt, Human
gccccaccagcccugaaucgaggcuccacaggguuggaaggaugcuuaccagggccaagagaccucgagguggggcugcggggc

SEQ ID NO: 4142188 - RNA, 107 nt, Human
gccccacccuuaugacuucauuuaaccuuaauuaccuccugaagacccugucucuggguaugguaacguugggguuuagggguucuacauaugaauuugggggaggc

SEQ ID NO: 4142189 - RNA, 75 nt, Human
gccccagaaguguccuagagcaggagucuccgagaagucuuggaacagcuggggcuuugcucuggguucuagggu

SEQ ID NO: 4142190 - RNA, 72 nt, Human
gccccagacccuuugacuugugacauuacugguuugcagacauaauaacuacacucagaggaccauggaggc

SEQ ID NO: 4142191 - RNA, 123 nt, Human
gccccagaguccaaaggcuagagaaccuggaguucugcuguccaagggcaggggaagaagggagucccagcuccaagggacagcgaauucacuguuccucugacguuuuguucuaccuggggc

SEQ ID NO: 4142192 - RNA, 80 nt, Human
gccccagauccaucuggaagccagauacucagugugugggcauaaaacugucuucuguuccaggugcugucucugguggc

SEQ ID NO: 4142193 - RNA, 57 nt, Human
gccccaggcugugcaaggccagcacacagacauaucugagccaaccacagcaggagc

SEQ ID NO: 4142194 - RNA, 60 nt, Human
gccccagggugcuaauuaaauaugcuaagaguaagauucucguaucuggcaucuuguagc

SEQ ID NO: 4142195 - RNA, 81 nt, Human
gccccaggucaacaacagcuuagccagucaagcucucccaucgggauggcaagaucuuggcugagcaucuugacaugaggc

SEQ ID NO: 4142196 - RNA, 80 nt, Human
gccccagguccuuagccaccagaaagguuuucaggggaagugugcacccucagcagcugcugcuggugggcaggaugggc

SEQ ID NO: 4142197 - RNA, 119 nt, Human
gccccaguccagcccagaagaaggagcacaggcuuugguggacaccaggggcuuccacccagcuguguuacgucccgacugugccaccccagccuggcugccugggcucccuggccugc

SEQ ID NO: 4142198 - RNA, 67 nt, Human
gccccauagcuggagauaggcuaacuccugagcaggugcucuacagccaucauccugcugcuggggc

SEQ ID NO: 4142199 - RNA, 58 nt, Human
gccccaucccuccagaugcugccggagauccaagauucgcgggccuggaggguggggu

SEQ ID NO: 4142200 - RNA, 111 nt, Human
gccccauuggaauguuagccucugagccaguuuagugggcaguguagagcacagaugucucaggcauucccacauagaaucauuaguagaaagugcacugcauccaaaggc

SEQ ID NO: 4142201 - RNA, 57 nt, Human
gcccccagaagggccacagauucuugaguagaaagagccugguccugacugaggggu

SEQ ID NO: 4142202 - RNA, 76 nt, Human
gcccccauggaggcuccuucaaagcaccuggcuccucucaggagagcaaaggguuacggaggaggcuccaggaggc

SEQ ID NO: 4142203 - RNA, 76 nt, Human
gccccccaaguaacuaggauuacaagcgugcgccaccacaccuggcuaauuuuugcauuuuuaguagagaaggggc

SEQ ID NO: 4142204 - RNA, 96 nt, Human
gccccccaagugacauggauccgauugcacauuccugaagccugagucauuccuggguccugcucaggcucaggaauguguuuaugcucauggggc

SEQ ID NO: 4142205 - RNA, 82 nt, Human
gccccccuuccuggucucugcucacauggcuccaugcaggccucccggcccuggugcugcucuguguggcagaaagaugggu

SEQ ID NO: 4142206 - RNA, 80 nt, Human
gcccccguccaugcagucaccuccagcuccaaaccuguuauuugucagacagagcuguccugggacguggauuugggggc

SEQ ID NO: 4142207 - RNA, 57 nt, Human
gcccccgucugccugccacuugaugguauugccaugggcugaguggaaugagggggc

SEQ ID NO: 4142208 - RNA, 110 nt, Human
gcccccucuucuguggcugcagcguccccuccagagcaggcagccucccguucuccuuggccaggggcggguggcgaggcuucucggggcgcggccagcaggacgggggc

SEQ ID NO: 4142209 - RNA, 69 nt, Human
gcccccugaggguggcuccucccugggcccgucccuauuggcuccccaggcugguccccucgcuugggc

SEQ ID NO: 4142210 - RNA, 96 nt, Human
gcccccuggucugucuggagcagcugcagccgcagcuguggccugggccucaccuuccagcgccaggagcugcugcggccuccucugccagggggc

SEQ ID NO: 4142211 - RNA, 66 nt, Human
gcccccugguucccacgggcagaugugguugguugguuugaauauuuccaaggccugucagggggc

SEQ ID NO: 4142212 - RNA, 89 nt, Human
gccccgacccgcgccggguucacagcaugcggaggggccgaggccgggcugcuccucugcuccaggcuggacuuccgcguggguggggc

SEQ ID NO: 4142213 - RNA, 65 nt, Human
gccccgccgccuuugggacgccccgccugggguaggggaggggagucucccaaagccggucgggc

SEQ ID NO: 4142214 - RNA, 77 nt, Human
gccccgggagagucagcaaauguaugcucauuuuucucuuauuauaaaauggccauaucauugcagagccauggggu

SEQ ID NO: 4142215 - RNA, 79 nt, Human
gccccuaaggaucuugugcauuuguucauuggcuucuguuuuccucucugcccaacuagacugcaggcuccuugagggc

SEQ ID NO: 4142216 - RNA, 80 nt, Human
gccccucacccuuccuagccaggcugcagcugauccgaggugguuccuugauccuggagucugaagggacauugaggggc

SEQ ID NO: 4142217 - RNA, 60 nt, Human
gccccuccuauguaccaggcugugguaagcccuggggauacagccaggaacaugaggggc

SEQ ID NO: 4142218 - RNA, 89 nt, Human
gccccuccucacagagugcacaucccuggcaggcgcuucugcucacaggugaggggagggcucccugggaguggaugggaggagggagc

SEQ ID NO: 4142219 - RNA, 57 nt, Human
gccccuccugcagcaccuuucuuagguugauucagggagggaagcugugggaggagu

SEQ ID NO: 4142220 - RNA, 62 nt, Human
gccccuccugugcucaccuggaggccucugugcucagggcaccccugagacaaaggaggggc

SEQ ID NO: 4142221 - RNA, 94 nt, Human
gccccugcccacuugggucugucuggccagaugcaucuguuaauguuuaaugauaguuuaccuuccagauggcuuacccacuguggguaagggc

SEQ ID NO: 4142222 - RNA, 69 nt, Human
gccccugcugaggucagccacccaauccccaaggaagcucauguugggucuuauggcuggaguaggggc

SEQ ID NO: 4142223 - RNA, 63 nt, Human
gccccugcugguccauguguccaaaaugguuaaagcaacuuuggguccauggaacagaggugc

SEQ ID NO: 4142224 - RNA, 64 nt, Human
gccccuggauuuggguugucacugugguucuccugccagugcuauaauccagugucguaggugc

SEQ ID NO: 4142225 - RNA, 71 nt, Human
gccccuggccgacuugaagucugcaucuaaggcagggccuuagacauggcagcuccaaguguuucaugggc

SEQ ID NO: 4142226 - RNA, 70 nt, Human
gccccuggcugccuuguguugaucucuggccuagguaaugaccagaaaucucacuggcaggcaggcaggc

SEQ ID NO: 4142227 - RNA, 62 nt, Human
gccccuggcuugggcuuaacuguagguucagagaacagaacggaaagcccacgcccucuggc

SEQ ID NO: 4142228 - RNA, 59 nt, Human
gccccuuccaucaugugaggacacagagagaaggugccgucuauaaaucaggaaggggc

SEQ ID NO: 4142229 - RNA, 85 nt, Human
gccccuuugccccgcgaaauuccaacaccauggcggcggcugcccuggcugcccccagccugggcuucgauggggugauuggggu

SEQ ID NO: 4142230 - RNA, 76 nt, Human
gcccgcccccugacucggcgcgcucccgucgcgcagccaaucgggacgaggggugagcccgggugggcggggcggc

SEQ ID NO: 4142231 - RNA, 63 nt, Human
gcccgcggugcugcgacguugacccgccuggccucaggcucagggcggcgggcagcccagggc

SEQ ID NO: 4142232 - RNA, 81 nt, Human
gcccgcugcccuuugcagcucuagguggaagcacaagcuugcuaggcucggcacgcucagagcugcaggaaggcggucagc

SEQ ID NO: 4142233 - RNA, 80 nt, Human
gcccggacugcugucacaguccagccuaguauguauaccauaugguuugauacuggguguggacaaaguagucagugggc

SEQ ID NO: 4142234 - RNA, 130 nt, Human
gcccggagccgagcauggagcccggccgaggccugucucggaaguauccucuguggcccucccugugcccgagcagagugagccgaggcugcucuccagcggcugcaccucagugcuguggcuccguggc

SEQ ID NO: 4142235 - RNA, 79 nt, Human
gcccggagggucagaguucaggucgagggccccaagaacaugcccuuacuaugaccuggaccucagccaagaccagggc

SEQ ID NO: 4142236 - RNA, 57 nt, Human
gcccggccggagccgcgggggugagucuagccccagcuccgagcuccgagccguggu

SEQ ID NO: 4142237 - RNA, 75 nt, Human
gcccgggucacucagccugccugguuccucuaaccuggcaugacagagaccguugcaggcugaguguaugugugu

SEQ ID NO: 4142238 - RNA, 61 nt, Human
gcccggguuguccgcgcguccggccgccccuccgcggcugcggcucugcgggcagcugggc

SEQ ID NO: 4142239 - RNA, 80 nt, Human
gcccggugaguggggccacacugaucucccagagcagaccguggucugacugggcugugguguggcccaaaucucccagc

SEQ ID NO: 4142240 - RNA, 63 nt, Human
gcccguagguagaaagaggaccugucuuggaccugagccccugaguuucuuucugccuggggc

SEQ ID NO: 4142241 - RNA, 72 nt, Human
gcccuaaaaaggccaucuuuggaauuuggagaacccuccagcuguaguggauuugagauggucacguugggu

SEQ ID NO: 4142242 - RNA, 71 nt, Human
gcccuaagaacauuuucggaaagauaugcaagaaauuaaucuuaauuaucuuugagaaaugaacuaggugu

SEQ ID NO: 4142243 - RNA, 75 nt, Human
gcccuaagaugcauccaaagcuuuggguaggaaugggagggucacucuuuccuucccaaguagcugcugcauggc

SEQ ID NO: 4142244 - RNA, 80 nt, Human
gcccuacccaccagcccccaggugaggcuuccagcugggaccugcccagacaggcugagccugggcgugguggguggggu

SEQ ID NO: 4142245 - RNA, 55 nt, Human
gcccuaccucaguccagaucugagucagggucuggaaagagcugagguucagggu

SEQ ID NO: 4142246 - RNA, 63 nt, Human
gcccuacucagaaaggugccauuuauguagauuuuaugucacuggcuccuuucuggguagagc

SEQ ID NO: 4142247 - RNA, 68 nt, Human
gccuggugggagguguuuggaucauggggguugauaccuaaugaauggcuuggcaccaucuccuuggu

SEQ ID NO: 4142248 - RNA, 67 nt, Human
gccugguggugugcucaaguggcuuuaggcugaagcagcaugacugauagcacauccucaaccaggc

SEQ ID NO: 4142249 - RNA, 112 nt, Human
gccuguacagcucugugauuuaugaugacaucacguccuuucagagauaacacuauuaugucacugaaccugaaguggugaggucagaaguacaugugaaguaauuaugggc

SEQ ID NO: 4142250 - RNA, 61 nt, Human
gccuguaggagguagcuuaaucucacguacuguuggaacuugguaccaccuucugaagggc

SEQ ID NO: 4142251 - RNA, 72 nt, Human
gccugucacugcgcugcuucgugaugcaguuguaacuggagcacagccucaugauuuuuagcccauugcggc

SEQ ID NO: 4142252 - RNA, 81 nt, Human
gccugucagccuuuuuaauauuuauauaauuuucuuugaaagagcuuagugaaguuauuuccugguguuggaggcuggggc

SEQ ID NO: 4142253 - RNA, 88 nt, Human
gccugucaucuuggaguuuggcucugggugccugugcagccccugggugagcgcggugcccccaagaggccagggucccuggcggugu

SEQ ID NO: 4142254 - RNA, 76 nt, Human
gccugucugggauuuuauagacaugcucucucucucuguuuauugugauggcaguuugcacaauuccucuucaggc

SEQ ID NO: 4142255 - RNA, 108 nt, Human
gccugugaaaagcuggcugcugccaccagagguaggcagggugacuuggcuucaugcagggaggccaagauagucacuuuccugcugugcagccugcuguuuaugggc

SEQ ID NO: 4142256 - RNA, 75 nt, Human
gccugugaggcugacagcagagggagggaugguaccauuuuaugagccucaaaucugagucuguccagccucggc

SEQ ID NO: 4142257 - RNA, 82 nt, Human
gccugugcggcggcaggaagcgucuugaggcuccccaagacuaccugaggggccgcccaagcacuucagaagcccaaggagc

SEQ ID NO: 4142258 - RNA, 72 nt, Human
gccugugcugcugucacggugcuaaggggccuggcaagcacggggucuuucuugcuggacggaggcacaggu

SEQ ID NO: 4142259 - RNA, 74 nt, Human
gccuguggcucaaaaucccaugauacugaagauaaaucugaaaauuggcauuaugcauuuugcccuacagcagc

SEQ ID NO: 4142260 - RNA, 64 nt, Human
gccuguguccagcugggugucaucugggguccauguccucaugggguuuggcuggaugucaggc

SEQ ID NO: 4142261 - RNA, 64 nt, Human
gccugugugugugauaccacaugugaauguaugucugcauauguguauguaucuaugcauaggu

SEQ ID NO: 4142262 - RNA, 62 nt, Human
gccuguguucguccucaccuugccgccagucgcggaucuggggccaaggaggagaaacaggc

SEQ ID NO: 4142263 - RNA, 59 nt, Human
gccuguguuuuccugcccaccucugaugcuaaaugcacccugaggccugagaaccaggu

SEQ ID NO: 4142264 - RNA, 81 nt, Human
gccuguuaagcccaucuugccuucucuccucuggacaagaaguaaaugggagugaaagguaaguugagcuuagccuuuggc

SEQ ID NO: 4142265 - RNA, 65 nt, Human
gccuguucugcccugagagccuucucugcuaggagguagguugacugacucagggagaagggugc

SEQ ID NO: 4142266 - RNA, 61 nt, Human
gccuguuuacuuugccgcaggaggagaagguccucuggaggugcuggacaggguggcgggu

SEQ ID NO: 4142267 - RNA, 61 nt, Human
gccuguuucuggagugaucugugcuuucagccccuggaaugcaggcuccaugaggacaggc

SEQ ID NO: 4142268 - RNA, 57 nt, Human
gccuguuuggcugcugacauuggcaguaaggagccaugauccaggcagagggcaggc

SEQ ID NO: 4142269 - RNA, 59 nt, Human
gccuguuuucucuugggguggagcagccuugguguuggaucacaggagggaaggcaggu

SEQ ID NO: 4142270 - RNA, 102 nt, Human
gccuuaaggccaguuggcaauugccucagagucuucagugaaacaggggccaggguaaaucuuaacucucugaggacuugggguugccuguugcuuuaaggu

SEQ ID NO: 4142271 - RNA, 81 nt, Human
gccuuagaaaugcuuauaccuaaugaucuugugaugcacaugguuuuuagagaauauagguuauuaguuucuugucuuggu

SEQ ID NO: 4142272 - RNA, 61 nt, Human
gccuuaggcaggauaagaaguuguaaacucacccaucagcagcugccuccacuucugaggc

SEQ ID NO: 4142273 - RNA, 79 nt, Human
gccuuagugcaaacauucaggaguacaggagccacgacccagauucaauugccuccuuguacuugaauguuugcaaggu

SEQ ID NO: 4142274 - RNA, 86 nt, Human
gccuuaguguugggagggacccugaugacugaggagccugguagcuccaggucgcccacacuuucaggucucuugcaccagaaggu

SEQ ID NO: 4142275 - RNA, 74 nt, Human
gccuuauaguaacagguuuauuuuacaggaagugaacgucacacuuccagaaaacucugccugguaugaaaggu

SEQ ID NO: 4142276 - RNA, 83 nt, Human
gccuuauuuuauggaauauagucuuauaucucaaagcauuuauugcauaguaggggagauaagacauguccugugauaauggu

SEQ ID NO: 4142277 - RNA, 81 nt, Human
gccuucacguugaaagcuuuucauuuaguuuguuugacauuuaauaauacaaccuagcuagauaaaagcuuuuauuaaggc

SEQ ID NO: 4142278 - RNA, 57 nt, Human
gccuucagagaugaaaaguggagacugggagccucacccuucacuuucauuucaagc

SEQ ID NO: 4142279 - RNA, 81 nt, Human
gccuucaucuguucaacaagucuuuuuucacugccuuggaauacagcagcgaccagacugugaacuugaggauaagaaggc

SEQ ID NO: 4142280 - RNA, 81 nt, Human
gccuucauuccaaagauuauggagaaauaauuagaagcagaccuuuuaagauauuuucuguaaauuuagaugaauaaaggc

SEQ ID NO: 4142281 - RNA, 64 nt, Human
gccuuccagcagcgugggagaaguauuugccauggcaacuauugcaucauccugcagggguggc

SEQ ID NO: 4142282 - RNA, 106 nt, Human
gccuuccagccccuccacagaauccagaauugcugaggugccaguuaauucuucauucugcaccuccccucaccaaucugguuuucugggagggcucuggcagggc

SEQ ID NO: 4142283 - RNA, 61 nt, Human
gccuuccucccagaugugcccaauggagucugaacucugguucuaauuuguggaggugggu

SEQ ID NO: 4142284 - RNA, 71 nt, Human
gccuuccucuacaacaccaggcacggaguggcugaaccauugcuaggcccuggcuugagcucagggaaggc

SEQ ID NO: 4142285 - RNA, 63 nt, Human
gccuuccuuccucuccugaugucucaggccucuagaccuagacugggguucuggcaaggaggc

SEQ ID NO: 4142286 - RNA, 59 nt, Human
gccuucucugugagcuccuaggagaucuucccaugacaaucuaggggauagugaagagc

SEQ ID NO: 4142287 - RNA, 88 nt, Human
gccuucuguggcccuaauguguuggacagcuucuacugugaccuuccucggcuucucagacuagccuguaccgacaccuacagauugc

SEQ ID NO: 4142288 - RNA, 56 nt, Human
gccuucuucuugcaagggaaugucagagagcaugaaccccccuggcaaagaauggc

SEQ ID NO: 4142289 - RNA, 87 nt, Human
gccuugaaagugaauuguuugcaugaccugauuuccuucagucuggucauugcaguggcaaaucacagcgccucaauuuccacuggu

SEQ ID NO: 4142290 - RNA, 77 nt, Human
gccuugaaagugcugaccagggucacucacagggcuguuaaacagcugcugcgccucacccuggcagcaaacaaggc

SEQ ID NO: 4142291 - RNA, 92 nt, Human
gccuugaaguuaccuggaaggugaugguacagcaggucgcacccagcagccugugcuguaccaaugccuucaaugcaggugaugucugaggu

SEQ ID NO: 4142292 - RNA, 71 nt, Human
gccuugagaaucaauuagauucuaugaguuuuauaguaaaagccucauauaacaugauuggucuauaaggc

SEQ ID NO: 4142293 - RNA, 70 nt, Human
gccuugcaugugcuaacgacaagcaaugacuuacaugcauagcuuguacaucacuggcagaugggauggc

SEQ ID NO: 4142294 - RNA, 60 nt, Human
gccuugcugugaugcucacauugaaaauaugaauuuguuccaaugugacuaucagggagc

SEQ ID NO: 4142295 - RNA, 56 nt, Human
gccuuggcccacagugcuccuggcuuggauuuagccagguccucaccgccagaggc

SEQ ID NO: 4142296 - RNA, 59 nt, Human
gccuuggcugaugugcgaaugaaagcaguccucggcugguuuauacaauagccagaagc

SEQ ID NO: 4142297 - RNA, 70 nt, Human
gccuugggaaguaauaugguggucucacacacucuacugacaggccuucaucucaugugacuccuuaggc

SEQ ID NO: 4142298 - RNA, 66 nt, Human
gccuugggacagccagcuucagacaggagugaauuugaugcucauucucugggauugacccaaggc

SEQ ID NO: 4142299 - RNA, 107 nt, Human
gccuugucaaacugcuuggcucugaucagauguccagugugauccuugauucugaacaccaacuggugacugauucugggagccagauuaaggcaggcgguaagagc

SEQ ID NO: 4142300 - RNA, 66 nt, Human
gccuugucauugacuuugcuguaaggauuuucucgacaacuccaugcaaguguuucugacaguggc

SEQ ID NO: 4142301 - RNA, 82 nt, Human
gccuuguuaagguccugcuuuaaugagugaauaauggugauugauuuaugauuuacacaucaaagcagcagguuagcaaggu

SEQ ID NO: 4142302 - RNA, 73 nt, Human
gccuuuagaaugcuguauaucuuagcuaaugagaaugaucuaaucucacacugagaggugacagcgugcuggc

SEQ ID NO: 4142303 - RNA, 77 nt, Human
gccuuuaguauauggauauuggccaaacucauuuguuucugcugcaauuggguuuucagauguccuccuacuguggc

SEQ ID NO: 4142304 - RNA, 67 nt, Human
gccuuuaugucugaaaaucagcauugaguccaaucuuggcugucgauuuuaaggcuuauuuaaaggc

SEQ ID NO: 4142305 - RNA, 84 nt, Human
gccuuucagcccucucucgugcaggccuugcucggagucccaggagauccacagguccggcaugaacagugagaggucagaggu

SEQ ID NO: 4142306 - RNA, 117 nt, Human
gccuuuccaaaaccuaagucucuuaacccagaaguccaggccucuuucuaauggugcuggaggaaugauuggcaagccugagauccgggaguggagauuauagggaacgguacaggu

SEQ ID NO: 4142307 - RNA, 86 nt, Human
gccuuucuacccaucugcuguucuucacagcuugucucugggcucagccccaagccuggaggggcaguaaauggauucagaguugc

SEQ ID NO: 4142308 - RNA, 125 nt, Human
gccuuucugucauuucuccuuuauucccucaugguucauuuagauguaaacacuuuccagaguagaaaauuacaguuaaugugacuaaccagcgagggcugaaacgggaacaugggcucagaggu

SEQ ID NO: 4142309 - RNA, 61 nt, Human
gccuuugaaugcaggacauacagaagugacaucucacugcuggaugugcugauucacuggc

SEQ ID NO: 4142310 - RNA, 62 nt, Human
gccuuugagcagcagucugcaggcccugggaaacacugggcugagagugacuguucuguugc

SEQ ID NO: 4142311 - RNA, 82 nt, Human
gccuuugcuauuguaaauagugccacaauaaacauaugugugcgugugucuuuauaguagcaugauuuauaauccuuagggu

SEQ ID NO: 4142312 - RNA, 82 nt, Human
gccuuugcuauugugaauaaugccgcaauaaacauaugugugcaugugucuuuauagcagcaugauuuauaguccuuugggu

SEQ ID NO: 4142313 - RNA, 87 nt, Human
gccuuuggcauggauuucugaugcagcaucaauaaauuuucuauuagcaagaucugcaaagaagcaacauccuugucuuaauuaggc

SEQ ID NO: 4142314 - RNA, 63 nt, Human
gccuuugucauucuguguauuuaaauccaguggucuaaaugucaguacagaaugacagagugu

SEQ ID NO: 4142315 - RNA, 112 nt, Human
gccuuuuagauauacauaggaagauaaaugaccagaaauacagcuguggugcggggcuguguacuguacugucuuuuuugcuguucauuuuuaugcuauagguaugaugggc

SEQ ID NO: 4142316 - RNA, 96 nt, Human
gccaggaaccucgguguccugccuuccagccuugggcucugccuccuucagagcccccagggaaggcaggcagugagaaagugggucaauccuggc

SEQ ID NO: 4142317 - RNA, 80 nt, Human
gccaggaaggaguucuuugaggagguauggcuuaagagcuguaagaugagcugugcagagcggggaagagcaccccuggc

SEQ ID NO: 4142318 - RNA, 91 nt, Human
gccaggaaggucuugaucuccugaccucgugauccgccugcuuuggccucccaaagugcugggauuacaggcaugagccaccgcgcccggc

SEQ ID NO: 4142319 - RNA, 57 nt, Human
gccaggaaugaaaggucaggguuggagaccucaugagucuggguuuucauuugaggu

SEQ ID NO: 4142320 - RNA, 65 nt, Human
gccaggacuuggucccaggcagagggcucgacccccaagcccugcugcccuagacccaguccugc

SEQ ID NO: 4142321 - RNA, 55 nt, Human
gccaggagacuccauucauuuggucuggaaugguccagggagggacacuuuuggc

SEQ ID NO: 4142322 - RNA, 58 nt, Human
gccaggagagcgcccucccggccccuuccaugaggggugugaagcgcccucugcuggc

SEQ ID NO: 4142323 - RNA, 93 nt, Human
gccaggagaggggaugcuuccaaggcuaagacaagaccccuucauuugugggcuuaaauaguuuguuuuaugagaaauaugcccuccucuggc

SEQ ID NO: 4142324 - RNA, 66 nt, Human
gccaggaggggcggguucuuggcacauggaauuccugaguagcacaaguaucugcuuuuccucagc

SEQ ID NO: 4142325 - RNA, 91 nt, Human
gccaggauggccucaaucuccugaccucaugauccaccugccuuggccucccaaagugcugggauuauaggcaugagccaccaugccuggc

SEQ ID NO: 4142326 - RNA, 91 nt, Human
gccaggauggucucgaucuccugaccucgugauccagccgcuucggccucccaaagugcugggauuacaggugucggccaucgcgccuggc

SEQ ID NO: 4142327 - RNA, 91 nt, Human
gccaggauggucucgaucuccugaccuugugauccaccugccuuggccucccaaagugcugggauuacaggugucagccaccgugccuggc

SEQ ID NO: 4142328 - RNA, 91 nt, Human
gccaggaugguuuugaucucucgaccuugugauccaccuaccuugaccucucaaagugcugagauuacaagcgugagccaccgcaccuggc

SEQ ID NO: 4142329 - RNA, 63 nt, Human
gccaggauugggaagcccucaucuuagcuguguccaggggagaguccuuuccaguucccuggu

SEQ ID NO: 4142330 - RNA, 66 nt, Human
gccaggcaaaggcuuccacugcauccuuccaggcauguggaggauaaacacggagcuuccccuggc

SEQ ID NO: 4142331 - RNA, 66 nt, Human
gccaggcacaaugagcgccaucuuuuccugcugcaagaaugagguuuggguucauugcuggcuggu

SEQ ID NO: 4142332 - RNA, 63 nt, Human
gccaggcacagaguuauucauuuauucaauaaauauuuacugaaugccuacuaugugccaggc

SEQ ID NO: 4142333 - RNA, 69 nt, Human
gccaggcacugagaggucugcagaacacauggcgguaagguccugcccucagaggccucauagucuggc

SEQ ID NO: 4142334 - RNA, 71 nt, Human
gccaggcacuguguuaggcacuguguauccaacaggacauaacagugaauaagacaugugcuuucccuggc

SEQ ID NO: 4142335 - RNA, 67 nt, Human
gccaggcagccacccucugcgaagcccagcccagcuggauguaugugaugggugggcuguggauggc

SEQ ID NO: 4142336 - RNA, 58 nt, Human
gccaggcccugaggauucggcggggaagaaagcugggaccuguccucucagggcuggc

SEQ ID NO: 4142337 - RNA, 72 nt, Human
gccaggcuuacccagcccugcccagauguggcuacagugcagggugcaggcggggguggguaauaggcuggc

SEQ ID NO: 4142338 - RNA, 55 nt, Human
gccagggaauucauaagcccccuuuugcuguggccugggagcugaggucuuuggu

SEQ ID NO: 4142339 - RNA, 57 nt, Human
gccagggacagucuggcuggaaauauuauuauucauacuggacagcugguuccuggc

SEQ ID NO: 4142340 - RNA, 77 nt, Human
gccagggagcugcgggcggcagcaggacauuagccuggggacaggcagauguucugggguguuuguggcucucaggc

SEQ ID NO: 4142341 - RNA, 76 nt, Human
gccagggccagcagguugucaaggagcugagcugccccaggugucugguggggcuccugggcagcugcucccuggc

SEQ ID NO: 4142342 - RNA, 83 nt, Human
gccagggccuggggccgcggccuucccucgaggagcagcgcaggucucagggugcgauccugggcuguggccccgggcagggc

SEQ ID NO: 4142343 - RNA, 61 nt, Human
gccagggcuuacuggaggcugcuuuggcaaacagaggccagcuaguccaggaagucugagc

SEQ ID NO: 4142344 - RNA, 56 nt, Human
gccagggcuucucccucacagcagcugccuccuacuggagucagaaaugccuuggu

SEQ ID NO: 4142345 - RNA, 72 nt, Human
gccagggcuuggugaccgauuagcacuagagcuuaggggaagaaaggugcugaggacaccuagccuucuggc

SEQ ID NO: 4142346 - RNA, 75 nt, Human
gccaggggcugggacagagccaagcuccugcaaucggcugacuguuugggucccucugucccacugcccaagggc

SEQ ID NO: 4142347 - RNA, 55 nt, Human
gccaggguuggggaggagggcgauuggcugucucucuuuuucuccagcucugagc

SEQ ID NO: 4142348 - RNA, 57 nt, Human
gccaggguuuugaaugccaugauggccaaaugaaggcuauaaauucagagcuuuggu

SEQ ID NO: 4142349 - RNA, 99 nt, Human
gccagguaacacuuacugggaaauuuuagguuugucucggaagccaaucccuaucauuuugacacaaaagaggauuuucuuuuaucugagcaucuuggc

SEQ ID NO: 4142350 - RNA, 92 nt, Human
gccaggucaggguaaaugugguuucagacagacucgaacucucuuugccagucugaguaucucugagccagauucuuugcggagggcuuggu

SEQ ID NO: 4142351 - RNA, 67 nt, Human
gccagguccucacuuccugcccugggugcacacaugaauggggcagccagcaggaagcgggagaggc

SEQ ID NO: 4142352 - RNA, 60 nt, Human
gccaggugauucugauauagcuaaaguuugaaaacuagugcagucggguaaucgccaggc

SEQ ID NO: 4142353 - RNA, 57 nt, Human
gccaggugccuccagucacagugcagacucaaccccugcuuggugcuugcccuuggc

SEQ ID NO: 4142354 - RNA, 59 nt, Human
gccagguggacuugauuugaauacuggcuccacuguuuuuagguuguguccccuuaggc

SEQ ID NO: 4142355 - RNA, 60 nt, Human
gccagguggucuggcuccagagccugcacuuuuaaccuccucuugagcauuucauuuggu

SEQ ID NO: 4142356 - RNA, 78 nt, Human
gccagguuguaauuugcaaauguauugucuggcccuuagggguuggcagcuaacaauuguuugcagaaggagccuagc

SEQ ID NO: 4142357 - RNA, 69 nt, Human
gccagguuuuauuuuacauaaagucuuuuccagaagaagaccauaauguaagaugaauuuguacuaggu

SEQ ID NO: 4142358 - RNA, 81 nt, Human
gccagguuuuuuagugacauugugguuauuaaauguuuaaauuaauuugauacauaugacagcuuaagucacuuauuuggu

SEQ ID NO: 4142359 - RNA, 86 nt, Human
gccaguccugaccgagcccagccggauucccaguucccgccguccggggccagggaaguuuuggcggggagggguagagcgcuggc

SEQ ID NO: 4142360 - RNA, 73 nt, Human
gccagugacagugaguucaucaagacaugaucagucauuuucuucaggugaacuuauuuaucagaauccuggc

SEQ ID NO: 4142361 - RNA, 87 nt, Human
gccaguggagacuuuuuaaucacuaagguccucauguaacccaugucugagguuacaggggacauuggggacaucagucucaguggc

SEQ ID NO: 4142362 - RNA, 60 nt, Human
gccaguggaugucucauagugugaugagccucugucaccuguuggauguauacugucagc

SEQ ID NO: 4142363 - RNA, 130 nt, Human
gccaguggcuuuugugcccagucuguuuuuccugcaaugcuuuggauuucugauuugagcuccauuucuggaacucuguguaggaaccaggucauguaugagaggagcuaaggggaccuugccaacuggu

SEQ ID NO: 4142364 - RNA, 62 nt, Human
gccaguguggcuccaaagcaugggccccugagcaggggccucucaugcccagagccaagggc

SEQ ID NO: 4142365 - RNA, 74 nt, Human
gccaguuuucugcuggauguuuaagaagcuuacacauauacaaauguauuuuaugcauauagcagauacgaggc

SEQ ID NO: 4142366 - RNA, 64 nt, Human
gccauagaccccccaggacucccucacacuaaugaggggugcugcagggaagucgggggguggu

SEQ ID NO: 4142367 - RNA, 84 nt, Human
gccauaugacuugagaaggcuggaguuaggaaaagauaagguauuuauuccugauuccuggcuugauguucuuugugugugugu

SEQ ID NO: 4142368 - RNA, 90 nt, Human
gccauaugguucuguuucugccuuccuucuacucccuucuugcuaauuggaaucaggucaagauggugagggcagaaguaaccauggggc

SEQ ID NO: 4142369 - RNA, 125 nt, Human
gccauauguggcacuuuagguuggcauauaucugaaauggcauguuuaauguacuguauuacuaggauuaguaauuuuacaguggaaggcugcuacuuuuaugauauagucuccugcugcugggc

SEQ ID NO: 4142370 - RNA, 103 nt, Human
gccaucaaguacuucuaagacaaaccuggcaugccuugggugccucugggcucauaccuaggaguucagagagguuggcuaggauguuugaauagaucuaggc

SEQ ID NO: 4142371 - RNA, 62 nt, Human
gccaucaauacagugcuaauaaaugcucaauaauuucuucuuauuguacuucuguugauggu

SEQ ID NO: 4142372 - RNA, 66 nt, Human
gccaucaauucuuaggaaaauagcugcaucaacaagucagcuaugcaguuccuuaaggauuugggc

SEQ ID NO: 4142373 - RNA, 119 nt, Human
gccaucagcagagguuguccucccagagcauguggcuuuggcaugugccccuuguagcagagaaggggcuggggcaugugcccaacccaccaguugggaggcacccacucugcuauggc

SEQ ID NO: 4142374 - RNA, 69 nt, Human
gccaucauaaaccacuuuguaaucugcauucaauuaucuuuugcagugcucugguuuuugugaacuggu

SEQ ID NO: 4142375 - RNA, 70 nt, Human
gccaucauggcaggaggcugcuggcagagcuucaccugguuuccacugccagucccuuaugcccaguggc

SEQ ID NO: 4142376 - RNA, 57 nt, Human
gccaucauuauagguuucuugcuucuuaucacaacagcaaggcuucuuugauggggu

SEQ ID NO: 4142377 - RNA, 62 nt, Human
gccauccagaccgugccaugcugccauuuggcguaaggccucuggucucggaauucccuggc

SEQ ID NO: 4142378 - RNA, 79 nt, Human
gccauccuuuagacacuugagcucgggcaauggguucccccaagccuggcacauuggagucugcugggaauuuucuggc

SEQ ID NO: 4142379 - RNA, 119 nt, Human
gccaucuccuccaugugucuggggaacaaggcuagccuagccuucaccagcguaguggcuuucgcucugccauggaaguggccagaccuagccaugggucccuaaacacaggguguggc

SEQ ID NO: 4142380 - RNA, 63 nt, Human
gccaucucggagcuaucaaaggaacugauuucuggaggucaccuucgaaggugcugggauggu

SEQ ID NO: 4142381 - RNA, 56 nt, Human
gccaucuucaacaucagaaguuuugaagaauuuuugauaaauugaggaauaauggc

SEQ ID NO: 4142382 - RNA, 57 nt, Human
gccaucuugagacaugaaagguguccaaauugggaugaauucagcacugaagauggu

SEQ ID NO: 4142383 - RNA, 59 nt, Human
gccaucuuggaagccaauauugcugguuuuaaaggaaaccagauaaauggcuccagggc

SEQ ID NO: 4142384 - RNA, 77 nt, Human
gccaugaacugaagccuuguguggccucucuagcaaccuagguuugauggggagugugaugaggguuucagcagggc

SEQ ID NO: 4142385 - RNA, 66 nt, Human
gccaugagguucucuuuaaucauucugauaguuucauuagaaaauuuagaacugaacuucuucggu

SEQ ID NO: 4142386 - RNA, 64 nt, Human
gcagggucgcucuaggagaucagcacaaagcuggguuuguuucaguggggcuacuugacccugc

SEQ ID NO: 4142387 - RNA, 95 nt, Human
gcagggugugaggggagguggccagggcaccugguguucagcagguugaugacucuggcccaggucucucugagcccucuaaugcuguauccugc

SEQ ID NO: 4142388 - RNA, 93 nt, Human
gcagguaguggaaccggucguaguucuucagcagguacuugggcgcauacaugugcucgcuggggucugcaggcggguacuccugcugcgugc

SEQ ID NO: 4142389 - RNA, 65 nt, Human
gcaggucacauauauccaaagcaagaacauguauuaauugcuucuggauagggguauggagcugu

SEQ ID NO: 4142390 - RNA, 56 nt, Human
gcaggucuagaagcugccucugaaccacaucacacugugcaugcuuguggaguugu

SEQ ID NO: 4142391 - RNA, 56 nt, Human
gcaggugagagaagguuucccugagcaaggccagggcuucauuuuaauucagcugc

SEQ ID NO: 4142392 - RNA, 59 nt, Human
gcagguggggcaacccagagccaugggggcuacccaugggaauugggaggucccaaggc

SEQ ID NO: 4142393 - RNA, 93 nt, Human
gcagguggguguaagaaacagcuagaaagccauugggaaccuagaauguccucuuucuagcccuuguuuuucuuucuuugcagacugacuugc

SEQ ID NO: 4142394 - RNA, 56 nt, Human
gcaggugguccccguggagugggcaaguguauuccucugacaaugaugucaccugc

SEQ ID NO: 4142395 - RNA, 67 nt, Human
gcagguggugggagagcuugcuuugaugcucccaaagaaaguguugcccagguucucuccugcuugu

SEQ ID NO: 4142396 - RNA, 55 nt, Human
gcaggugguuaaggucccauguguuacaacaaaauacaggggucaaagcacuugc

SEQ ID NO: 4142397 - RNA, 90 nt, Human
gcagguugacuuguuccaggugcuuccaacaggugauuucucagcgagccugagccaguagucagggacaaacaggaagguuaaccuugc

SEQ ID NO: 4142398 - RNA, 93 nt, Human
gcagguuggaugcuugaugaaaggaacaaaugagaaaauaugguaaacauuuaaaaaauuguuauuuguccuuauuaagaucuguucacuugc

SEQ ID NO: 4142399 - RNA, 57 nt, Human
gcagguugguuucuucugaggccucucuccuggccuugcagauggccaccuacuugc

SEQ ID NO: 4142400 - RNA, 82 nt, Human
gcaguagaaggcucuguguguccacacauacauacauauuuauaugucuuugcugugugcugggcccaacccagagaacugu

SEQ ID NO: 4142401 - RNA, 68 nt, Human
gcaguaguauuagcaaugccucaugucccagcacuuugcgguuuagaagcauuauuuaauuuuacugc

SEQ ID NO: 4142402 - RNA, 81 nt, Human
gcaguauaaaugucaaguagaacuauaaugaugucuaauagggcauuuaucauuuuauauuggaauuauuuauaugacugc

SEQ ID NO: 4142403 - RNA, 84 nt, Human
gcaguaucuauuguucccauguuaauuuucaugugugcuuaauguuuagcuccaacauauacaugggaauauguggaguuuugc

SEQ ID NO: 4142404 - RNA, 68 nt, Human
gcaguaugaguguuuuagacaucauuuaaaguagacaucauuaaggaaaauguugauauucaugcugc

SEQ ID NO: 4142405 - RNA, 55 nt, Human
gcaguauucagcacaauuuggccaauacguauguguuccaagcugcuggauaagc

SEQ ID NO: 4142406 - RNA, 57 nt, Human
gcagucaaugggacugcccuguuuuuaccuaauagauguuuucuccuaauuggcugc

SEQ ID NO: 4142407 - RNA, 76 nt, Human
gcagucacuggaauagcugaggauaauacagaaguugauuauacuccucucugccuccuucagucuagaugauugu

SEQ ID NO: 4142408 - RNA, 57 nt, Human
gcagucagacaggaggagcucccucuuaccugugggaaggucagccuguuuuacugu

SEQ ID NO: 4142409 - RNA, 65 nt, Human
gcagucauggaaaaauguauaccuacagaggcaggagcagggggaagauauuuuuucaauguugc

SEQ ID NO: 4142410 - RNA, 81 nt, Human
gcagucauuauguggggcuuacaaaggcagaucaucugggcaaaugacucucuacugguacugagucccaaagaugagugu

SEQ ID NO: 4142411 - RNA, 63 nt, Human
gcagucuccagauggccacaggaugcaggccuugcuuccugagaugcugauuucgggggcugu

SEQ ID NO: 4142412 - RNA, 100 nt, Human
gcagucuccucccuuguggcccagacccagcugggucccuuccuccuaggcagcugagggaaggacugcuggguuggccacgggccugggaaggggaagc

SEQ ID NO: 4142413 - RNA, 62 nt, Human
gcagugacacucaguggcucugucccaugcauguuaaaugggaagagccuggggugucaggc

SEQ ID NO: 4142414 - RNA, 65 nt, Human
gcagugacauggcccaaaugauauuuuagcagauucaaguggcugcuauguuaagaauagacugc

SEQ ID NO: 4142415 - RNA, 98 nt, Human
gcagugagagcuguggccucuggagucacagugaccugagucagaguccagcuuugcuacugucuaucugugcuucucuagguggcagauuuaacugc

SEQ ID NO: 4142416 - RNA, 118 nt, Human
gcagugauggugccaaagcaauagaggguaagacuguuggugccuuagcaugaaucaagauaguggcaccaaacuugacuaguuaucacuguauucuuugcuaucacauacucacugu

SEQ ID NO: 4142417 - RNA, 71 nt, Human
gcagugcagcuccuucaaucucaccauggccucugccagaaugcagauccugggagucguccugacacugc

SEQ ID NO: 4142418 - RNA, 61 nt, Human
gcagugcauugcaguaggaacuaaguaaauaauauauucaaaguccuagugaaaugccugu

SEQ ID NO: 4142419 - RNA, 122 nt, Human
gcagugcccuggacguggccucgaaccgcgugcccuggcucuucuuguuccacacguggacagcauagguggcacugagcagccgcggcagcuccucgggguugauguccucaaaguacuuc

SEQ ID NO: 4142420 - RNA, 77 nt, Human
gcagugccuacuuuaaaugcaaauguaagggugggaucauagaaauuauccaauuugcauuuucuaguucaugcugu

SEQ ID NO: 4142421 - RNA, 81 nt, Human
gcagugccuggcuaggacucauccuguuucuucucuuaagugaguggagcuauggagauuccuaugcuuauaugcaacugc

SEQ ID NO: 4142422 - RNA, 62 nt, Human
gcagugccugguuugaaagagcccuuccaugggucugccggaagagcugucaggaaggcugc

SEQ ID NO: 4142423 - RNA, 61 nt, Human
gcagugcuggagggaggcagguucagaauugaccuuagagcuaccucccugccagcaaugc

SEQ ID NO: 4142424 - RNA, 55 nt, Human
gcagugcuugcucaggcuucauagccaagacuugcccaggccugcccagcacugu

SEQ ID NO: 4142425 - RNA, 100 nt, Human
gcaguggcagucgaacaauggcugggcuggagucuucugaaagccaaacucaucugauggcccagauggcuccucccaucacagauuugacaguugaugc

SEQ ID NO: 4142426 - RNA, 64 nt, Human
gcaguggcaugaguauaggcuucucacucacaugguguuugguaguuucuucuugagccaaugc

SEQ ID NO: 4142427 - RNA, 86 nt, Human
gcagugggggaagagcuuguuaaaguaaacgauccaaaaacuacaaaaaugcuggaggacuuuugugcaggucucucccaagcugc

SEQ ID NO: 4142428 - RNA, 64 nt, Human
gcaguggggucuguccucuucugggugcucgucagucacuuagaugaagucacagaacccaugc

SEQ ID NO: 4142429 - RNA, 57 nt, Human
gcagugguggagcuuacauaucauaccuuugaaaaugacucugaguaccacuuuugc

SEQ ID NO: 4142430 - RNA, 88 nt, Human
gcagugguuaucuauuggaaagaagaaugauagaagguggggucggcaugacaugacuauuucccucaucaucuuccacuagcccugu

SEQ ID NO: 4142431 - RNA, 67 nt, Human
gcaguguggccccaguaucacgcagagccuaaccacuuucuauguggcccucgugggcucguacugc

SEQ ID NO: 4142432 - RNA, 61 nt, Human
gcaguguggcguggggaccuaaagcaucauuuaucuggucuacaaaaugccagccaugggc

SEQ ID NO: 4142433 - RNA, 69 nt, Human
gcagugugucagaggcucagggucucagggacaauauccaggcucuaggucaccuuugacuuuaccugc

SEQ ID NO: 4142434 - RNA, 56 nt, Human
gcaguguguguccccacacuggcagagggacugucugugaacaaugacagcacugc

SEQ ID NO: 4142435 - RNA, 63 nt, Human
gcaguguuacuuggaguacuaauggcccagguggccucaauacagcauuucaaauaacucugc

SEQ ID NO: 4142436 - RNA, 65 nt, Human
gcaguuagucagaagggccaguggauuugaguauuucagaucagauucugccuuugugacacugc

SEQ ID NO: 4142437 - RNA, 80 nt, Human
gcaguuccacaaagcuguagaaucaucuuaauauggggagcaaaaauaugauaagauggucaauuauagucauucacugc

SEQ ID NO: 4142438 - RNA, 59 nt, Human
gcaguuccacugaggcuagccaaggaaaagggcuuggcugcaaucacagggacucaagc

SEQ ID NO: 4142439 - RNA, 70 nt, Human
gcaguuccugaggccagcugcagagcucuaaccuggagaaggggcagagccacggcaggccuaggaaagc

SEQ ID NO: 4142440 - RNA, 68 nt, Human
gcaguucuagcaugccuuuuagcacauacuuacugauuaugugccagaaaauaugcugaggauacagc

SEQ ID NO: 4142441 - RNA, 64 nt, Human
gcaguugaagauccgugaggugcccagaagaucaugcagucaucagucccacggagcagcccgc

SEQ ID NO: 4142442 - RNA, 58 nt, Human
gcaguuguaauaugaugugaggucugcaauagaaauacacacacgauguuaggauugc

SEQ ID NO: 4142443 - RNA, 77 nt, Human
gcaguuuauuuaaagguucuacuuuuaaagaauaucuaagguauucuuaggacuuaggacguuucaaagucacuagu

SEQ ID NO: 4142444 - RNA, 74 nt, Human
gcaguuuuacaguccuuguuucggucagauguguuccauucaacugcuguuuagcaaggcugacuaagaugagc

SEQ ID NO: 4142445 - RNA, 81 nt, Human
gcauaaaaccuugaacaccuuuuauucgccaggcacauaaaaagaaucuuuugaguguugauaaugggguagguugugugu

SEQ ID NO: 4142446 - RNA, 63 nt, Human
gcauaaaggacuauaaggaucaaaaagcaagcagaaaugaauccacauucuaguccuuuaugc

SEQ ID NO: 4142447 - RNA, 104 nt, Human
gcauaaaugaaaauggaagcuguagcagaaucagugcuacagagcacuaaagagacugugaagcauagauucuguagagaugcacuuucguuucauacuuuagc

SEQ ID NO: 4142448 - RNA, 74 nt, Human
gcauaaaugaugaaccgcuucauggugccuguagaggccucuugcagagcacccugcagugguaugguuugugu

SEQ ID NO: 4142449 - RNA, 76 nt, Human
gcauaacuuagugucagcaucucauugagcuaggcaucucauuguggcuuauaauguucugugacacugucggugu

SEQ ID NO: 4142450 - RNA, 55 nt, Human
gcauaagggcauauugacgggugagugggggguccacacaguggagugcccuugc

SEQ ID NO: 4142451 - RNA, 55 nt, Human
gcauaaucagaguuaguucaguguuaauuauuuugagagaugaacucugauaugu

SEQ ID NO: 4142452 - RNA, 66 nt, Human
gcauacauguauguguacgugcauguguacgcgugugugugugugugugugugugugugugugugu

SEQ ID NO: 4142453 - RNA, 125 nt, Human
gcauaccgacuugaagucaaauuuuacucugaaaauaguagcugaggaacuuucauugagguucuaaccuccugaagucucuguuuucucauuugcuaaauggauaaaauaacuucaaaaauugc

SEQ ID NO: 4142454 - RNA, 61 nt, Human
gcauacgugcaugcugccgcccucgacuguuggagaccccgggccagcugaugcacgaugc

SEQ ID NO: 4142455 - RNA, 58 nt, Human
gcauacuucuugcugcuuucagggccacaguccaagcccagccagccagcagguaugc

SEQ ID NO: 4142456 - RNA, 92 nt, Human
gcauacuugaagucuugagucuuauuuucugucuacuaaaguuaugccaaauacuuguggagaacagugagugagugaggagaauaguuugc

SEQ ID NO: 4142457 - RNA, 62 nt, Human
gccaugauugauucuacuuaaaacauauggagaucuaugaaauuguuggugaaucuaauggc

SEQ ID NO: 4142458 - RNA, 105 nt, Human
gccaugauuggcauguucuuuuucuucgugugaaauguuuugacaaugcaauucaugcauugcaacugacagaucauuuugaaguaguuaauauugaaucauggu

SEQ ID NO: 4142459 - RNA, 93 nt, Human
gccaugcaggcaggggcagcuaguuuaagaaagaggauggcuuucuuccaguuguauuuauccuuucaggcaagcucccugcuaguauuuggc

SEQ ID NO: 4142460 - RNA, 60 nt, Human
gccaugcugaugugccagguuugcccugcacacaggcaacagaccauugcaugagcaggu

SEQ ID NO: 4142461 - RNA, 85 nt, Human
gccauggacuugugagcuccuccugacuugugagccccuccuacaguguuuccauucuaggaacagucagccuuacaguccuagc

SEQ ID NO: 4142462 - RNA, 79 nt, Human
gccauggaggcugugcucagagcuccagcucuccucgucugguagagguggggggagcuugggagcugccaacaguggc

SEQ ID NO: 4142463 - RNA, 77 nt, Human
gccauggccucccuccacugcccugagcuccagguggaguagaaagaaggcacugggcccugggcaggcacauaggc

SEQ ID NO: 4142464 - RNA, 60 nt, Human
gccauggccuccuucuccuggccacaggcaugcucugcuccugagccagggaggccaugc

SEQ ID NO: 4142465 - RNA, 62 nt, Human
gccauggcgacugcaguggcucggccccuugcagcaaggccagaggcucagguugccauggc

SEQ ID NO: 4142466 - RNA, 98 nt, Human
gccaugggccuaugaggccuccccaucucuccuucagcugaggccccgagguuggggcuaggacacggagggguggggugggcuuggcaguucguggu

SEQ ID NO: 4142467 - RNA, 69 nt, Human
gccauggugccuuauacauaauuagugcuuauacuuacuaagcauuaauuaugcaaaaggccccauggc

SEQ ID NO: 4142468 - RNA, 116 nt, Human
gccaugguugucccgcuuguuguagauugcugacaaggggcaauaacauucaagugauccagucucacaaugugguuugucaucuuuucaguuccuauugucugaccuaucauggc

SEQ ID NO: 4142469 - RNA, 67 nt, Human
gccauguaaaggagaccuggagagauuggaauugagaugcaauuaggacuccaggacucugcguggc

SEQ ID NO: 4142470 - RNA, 70 nt, Human
gccauguauuauucagucugucuagggaguuaagucccuuuguuuucacucccacugagugaaacauugc

SEQ ID NO: 4142471 - RNA, 104 nt, Human
gccaugugcagucaggugggccugggcuugcaucugugcugggugaccagagccaagucacucagcuccucagagccucaguuuucccaccucuacaaugaggc

SEQ ID NO: 4142472 - RNA, 72 nt, Human
gccaugugcgucaaagggcagacgaggcgucagcaugggcaccuuuugugucugcguuuguggcgaaauggc

SEQ ID NO: 4142473 - RNA, 68 nt, Human
gccauguuccaaguguauaaagugccauaucuacugagauuauuuguauaaauuggagcaauguuggc

SEQ ID NO: 4142474 - RNA, 61 nt, Human
gccauucaguauuucauuuauucacuacauaaugagugccuaccaagugcuggauacuggc

SEQ ID NO: 4142475 - RNA, 76 nt, Human
gccauuccacagagaccaguuacagcguccagguagguaaaaaggcaggauccugaagacugggcucuugaauugc

SEQ ID NO: 4142476 - RNA, 111 nt, Human
gccauucucacucuggugauacuauuaguuaacuuucaggugcauguuugcauucuagugcaaauaugcugacaguuggauauaauuggaauuuucagaagagacuguggc

SEQ ID NO: 4142477 - RNA, 80 nt, Human
gccauugaauccuugcagaggucucgccucucccaugggcagggacccggugcugaggccuuggcagggagggugguggc

SEQ ID NO: 4142478 - RNA, 64 nt, Human
gccauugcgcuugggcaaaucgcuuagacuuucugggccucaguuugcuuaauguguagagggc

SEQ ID NO: 4142479 - RNA, 75 nt, Human
gccauuggagauaugucauguaaggugagcugcugaaaucagcuacucaaggacuauugcaugacucccaagagu

SEQ ID NO: 4142480 - RNA, 62 nt, Human
gccauuggguccucaguaaaugacucugaaaaauguuuuuauuaauuagugacccaaugagu

SEQ ID NO: 4142481 - RNA, 69 nt, Human
gccauuuacaguacaccacuguguacaguacaccacuguguacaguacaccacuguguacaguacaggc

SEQ ID NO: 4142482 - RNA, 80 nt, Human
gccauuucaggauggcacccaagcucuuaguagucaucccaagauggcauccaaguucuggguggccauuccaagauggc

SEQ ID NO: 4142483 - RNA, 59 nt, Human
gccauuuucuucaggccagaaaagcugagaccucagcacuuugcaggaaggaaauaggu

SEQ ID NO: 4142484 - RNA, 113 nt, Human
gcccaaagcccaccagggcaccugccgucugcagccuccaggaguucacacagagaucugggauugcuggggcaggcuguagcccacggaugucgccuccugaguuucugggc

SEQ ID NO: 4142485 - RNA, 65 nt, Human
gcccaaagggggaugcacuagcauauuccuaaguuacuuggugcccauguaucccuucacugggc

SEQ ID NO: 4142486 - RNA, 92 nt, Human
gcccaaauuucgggacaguuacauuaaacaaaaggaucagaaaauggaaaucuauuccuuugaaauggcuguaauuggcugaauguugaggc

SEQ ID NO: 4142487 - RNA, 130 nt, Human
gcccaacagaacuaccuggagagugcuuauuuuauuuauauucguugaaauucagaucugaaggcucugcgagaucugagcuagaaaguaugcccuagaaaucagcauucaaguaguguguacuuugggc

SEQ ID NO: 4142488 - RNA, 119 nt, Human
gcccaacuguaggccaauguaaauguuguaaguacaucuaagguaugucaggcuaagcuauagacguuugguagguuagauguauuaagugcauuuucaacuugugaauuauagugggu

SEQ ID NO: 4142489 - RNA, 101 nt, Human
gcccaagaagccaacuuuaaggaggcacucaucucccagugcuagccuuguacuugcaaagccccaagagugagugcuuccuuaaaacaugcauccugggc

SEQ ID NO: 4142490 - RNA, 107 nt, Human
gcccaagcacagcgcugagcauaggacacagaggugugaggggccacaccuuccacacccacucagcaccugccugcugccugcugcuugccugcuacaugcugggc

SEQ ID NO: 4142491 - RNA, 88 nt, Human
gcccaaggcccaguacuuugugaguagauaaggcacaagucacacucuggcuuucugacucuacaacccucaaacguagcacuugggc

SEQ ID NO: 4142492 - RNA, 82 nt, Human
gcccaaugacaauagaguucucauaggacaccguuacuacugccuauuuggugucuccucagugaagucauuguguuguggc

SEQ ID NO: 4142493 - RNA, 56 nt, Human
gcccacaggcaggugcaugggcuggucccgccagcaccugcaaccuucuugugcgc

SEQ ID NO: 4142494 - RNA, 129 nt, Human
gcccacaucagagccaaacuagaguucugucuguacugagaguucugucucuacaccuguuuauacauagcuccaagaucaugcagagauuucaguaacagcaggguuuugcucugucgugucccaggc

SEQ ID NO: 4142495 - RNA, 71 nt, Human
gcccaccgcccccacucucauggccucuggugcagccacagggccuugguaaugggggacuguuggggggc

SEQ ID NO: 4142496 - RNA, 101 nt, Human
gcccaccucggccucccaaagugcuggaauuacaggugugagccaccacgccuggccuccuuccacuucuguucuuuggguuuaggcuggugguaaagggc

SEQ ID NO: 4142497 - RNA, 77 nt, Human
gcccacgacgcauuagcaucugcuguaagcuuauuaaucaccuaacaggcaauuagcaagcuguuacuguuugaggc

SEQ ID NO: 4142498 - RNA, 64 nt, Human
gcccacucguagcuccacccacucacagcacggccagcugcaagggugacagguugcucugggc

SEQ ID NO: 4142499 - RNA, 66 nt, Human
gcccacucucagaccacacagccccugccuuacucuggaagugggcaguucaauucugggaggggu

SEQ ID NO: 4142500 - RNA, 64 nt, Human
gcccacugcuugucaauucgcuugguaccucuguguaccagacacugugaagacaggcauuggc

SEQ ID NO: 4142501 - RNA, 65 nt, Human
gcccagaaagacugccuaacaggccacuacacaauauccacucuguuuggcuugguauucagggc

SEQ ID NO: 4142502 - RNA, 55 nt, Human
gcccagacaucuguugggaccugacccccggucauugguuaccagugugucuggc

SEQ ID NO: 4142503 - RNA, 61 nt, Human
gcccagacugagugugcuugguguuucuccauuaaacagaugaggcccaucagucugaggc

SEQ ID NO: 4142504 - RNA, 55 nt, Human
gcccagagagacacgacagcuagugcgaugaggcaugcuggauggauccuggagu

SEQ ID NO: 4142505 - RNA, 86 nt, Human
gcccagagcgcucugcuggcggcagaggcggcggcgaggcuggcgcgcuugccgccgucugcucgccccgcggaggcgaccugggc

SEQ ID NO: 4142506 - RNA, 77 nt, Human
gcccagagggcacugucugagcuggugauuagagacacaaaaacaagggucuccagacugucuggcccuuuuugggu

SEQ ID NO: 4142507 - RNA, 56 nt, Human
gcccagcacagcuggaagagucaacuggucacagaagguuugggcugauguugggc

SEQ ID NO: 4142508 - RNA, 61 nt, Human
gcccagcacuaaaagcuuugcugguuuuucuauccccacagcagagguucucuggcugggc

SEQ ID NO: 4142509 - RNA, 56 nt, Human
gcccagcaggggauggcagcucugcagagagacagggggccuucaucuugccgggu

SEQ ID NO: 4142510 - RNA, 67 nt, Human
gcccagcggggcccuuagcagagccucuccaauccucggcgccuccccuacacaggguucgcugggc

SEQ ID NO: 4142511 - RNA, 68 nt, Human
gcccagcucuguguauuuuccccacauuuggaugaaugagguaaugugcuacuuacagggagcuuggu

SEQ ID NO: 4142512 - RNA, 64 nt, Human
gcccagcuggcguggagugauugcaggccagguggugugagggccugcccaggccagguugggc

SEQ ID NO: 4142513 - RNA, 58 nt, Human
gcccagcuggugucggaggacguggacaaggacgugcuccuuccccacccgcugaggu

SEQ ID NO: 4142514 - RNA, 59 nt, Human
gcccaggaaggccaaggcugcagugagcccugauggugccacugcacuugaccuugggc

SEQ ID NO: 4142515 - RNA, 58 nt, Human
gcccaggaggcagagguuguggugagcugagaucucaccacugcacuccugccugggc

SEQ ID NO: 4142516 - RNA, 67 nt, Human
gcccaggaggcugaauugggguucuaggugugcagccuugguuucccuuuuggccucuccuuugggc

SEQ ID NO: 4142517 - RNA, 72 nt, Human
gcccaggauaaccauggagcuuugguugaaaguguaagcacucacagggcauuauggcuccagggucagggc

SEQ ID NO: 4142518 - RNA, 62 nt, Human
gcccaggcccuugcagagcgggcuuggagggaacagccucugccugcgcucacggggccggc

SEQ ID NO: 4142519 - RNA, 57 nt, Human
gcccaggccucccucugcaccuccccaagggccuugugcagagcaagggcugagggc

SEQ ID NO: 4142520 - RNA, 58 nt, Human
gcccaggcuagagagcaguggcaugauuacagcucccugcaaccucugccucccgggu

SEQ ID NO: 4142521 - RNA, 81 nt, Human
gcccaggcuggagugcaauggcgugaucucagcucacugcaaccuuugccuccugaguucaagccauucuccugccucagc

SEQ ID NO: 4142522 - RNA, 62 nt, Human
gcccaggcuggagugcaguggugcgaucucggcucacugcaaccucugccucccuccugggu

SEQ ID NO: 4142523 - RNA, 58 nt, Human
gcccaggcuggagugcaguggugugaucucagcucacugcaaccuccaccucccgggu

SEQ ID NO: 4142524 - RNA, 81 nt, Human
gcccaggcuggagugcaguugcaugaucucaccucacuguuaccucugugucccggguucaagcaauucuccugccucggc

SEQ ID NO: 4142525 - RNA, 58 nt, Human
gcccaggcuggagugcaguugugcaaucucuguucacugcaaccuccgccucccgggu

SEQ ID NO: 4142526 - RNA, 91 nt, Human
gcauagcucugauccacaaauucaaauuucaucaguguauaauguauaugagcugguagauuuuguaauuuagauuuugaaagagcuuugc

SEQ ID NO: 4142527 - RNA, 83 nt, Human
gcauagcuuugagacuucuuucaauaagguucugcucuuagggaaaucggggguagggugauugugaaguaaguuugcugugc

SEQ ID NO: 4142528 - RNA, 59 nt, Human
gcauagcuuugaugcugccuuaauauuacacuaaugauaccuugggccaaggcuacugc

SEQ ID NO: 4142529 - RNA, 63 nt, Human
gcauaguacauggguguccucacacaguccucccaagcugugugugugugugugugugugugu

SEQ ID NO: 4142530 - RNA, 58 nt, Human
gcauagucaguaggauucucaauucuuaaguuuggagguugggauuucuguugaaugc

SEQ ID NO: 4142531 - RNA, 80 nt, Human
gcauagucugagaggauuuagaaggugucauugacuuggaauuacaguucuuuguuacagaaugaauuuccggaccaugc

SEQ ID NO: 4142532 - RNA, 89 nt, Human
gcauauaaagguagaugagguaagaauguaacaccucugugaucuuauucugaaaccagguguuuucuuuccuccuaucauaaguaugc

SEQ ID NO: 4142533 - RNA, 60 nt, Human
gcauauacguguguguguauguguguguguguguguguguguacacauauauguaugugu

SEQ ID NO: 4142534 - RNA, 112 nt, Human
gcauauggucggugcacaaaaauaaguaugcuuuauauaacagagacugcuauguacguuaaagugauggugauguuauaguaaacaacuuuacaaauuguugcacauaugc

SEQ ID NO: 4142535 - RNA, 72 nt, Human
gcauaugugcacacauauauaugagcauguacaugugugugggugcauguaugugugugugcauccaugugu

SEQ ID NO: 4142536 - RNA, 64 nt, Human
gcauaugugcaggcuucauuuuaccccaaaggcugcuuguaauuuugucccccugcacauaugu

SEQ ID NO: 4142537 - RNA, 75 nt, Human
gcaucauagcagcgagacuucaucucuacgaaaaauuuaaaaauuagcccaggaggucaaggcugcagugauugc

SEQ ID NO: 4142538 - RNA, 82 nt, Human
gcaucaucacagaauguuauuggacagcaguggucaauuuugucacccuuguuaaauaagauacugagacugagaaugaugu

SEQ ID NO: 4142539 - RNA, 70 nt, Human
gcaucaugaaaaugacagauagucuucauuugcuuucuuuggccaaaugugcacucugcagucaugaugu

SEQ ID NO: 4142540 - RNA, 62 nt, Human
gcaucaugagaaguggccuucaaaaagagaguuggaacuuuuugcaagcuucuucucugugu

SEQ ID NO: 4142541 - RNA, 95 nt, Human
gcauccaugugggcugugcaugcaugugcauaugugcauggauauggauguucauguucauauguguauaucaguggcugcccacgcuugaaugc

SEQ ID NO: 4142542 - RNA, 76 nt, Human
gcaucccacugggucucuuuagggugccguauguagcucauguuagaauuugaguaugguaccuuagaagacaugc

SEQ ID NO: 4142543 - RNA, 55 nt, Human
gcaucccauuaccagcgcauugugagcgaaaugacuugcauguguaugugggagu

SEQ ID NO: 4142544 - RNA, 59 nt, Human
gcauccgggcugucggggcugggcgaagguaggcucagcguggcuccgacgggccgugc

SEQ ID NO: 4142545 - RNA, 130 nt, Human
gcauccucauccugagcguagcagcugcaaggggccuuacacagaacggauaaucaauauucauuguagguugaaugaugguguguucuugccuuuuccaguccguuuuguucguuagagaaaaggaugc

SEQ ID NO: 4142546 - RNA, 77 nt, Human
gcauccugacccugagcaaaagcaguucucucccuaagaaacaccggugacuuuuguucauggcacuccauggaugc

SEQ ID NO: 4142547 - RNA, 109 nt, Human
gcaucgauauuaccuaggagcuuguuagaaaugcagaaucucaggucccacuuuuaauuugcugaguuagaaucuacauuuuaacaagaugcccaggugauuuacaugc

SEQ ID NO: 4142548 - RNA, 77 nt, Human
gcaucgauauuccugggauugaacugcuuccaagccagaaauaauccucaagcuuucaaaacuggaaaaucagaugc

SEQ ID NO: 4142549 - RNA, 68 nt, Human
gcaucuaaauuccaccaugggguucaaauuuuuuaaaugaaaucuuagacccuugguagaaaaagagc

SEQ ID NO: 4142550 - RNA, 58 nt, Human
gcaucuacacugauuaggugaacauacaagaggggucuguucauauuagugaggaugc

SEQ ID NO: 4142551 - RNA, 94 nt, Human
gcaucuaguaucuucccuggcacauaauaggaccucaguaaaugauacuaauauuuauugagcacaugcuaugugccaaggcacuguucuaugc

SEQ ID NO: 4142552 - RNA, 78 nt, Human
gcaucuauagauugaguucucaaguuacaguagaauaaugcuggaguaacaagacacucagacacugaagauccaggc

SEQ ID NO: 4142553 - RNA, 74 nt, Human
gcaucucagauauugaauuuaaauuguuuguguuguaacagugauacaaaaauguucaauagcucuuugaaugc

SEQ ID NO: 4142554 - RNA, 62 nt, Human
gcaucuccaggauuuucacacucagagaugaccacucuuaugaguagaacuccuggagaugu

SEQ ID NO: 4142555 - RNA, 63 nt, Human
gcaucucugugccugcggcucuuuccccaggacucagggaagcaagcugcagaccagaagugc

SEQ ID NO: 4142556 - RNA, 84 nt, Human
gcaucugagagggauccagagaccagugauuaaaggcacaugcugagggcccugggaaugcugauuucaggaacucugggaugc

SEQ ID NO: 4142557 - RNA, 61 nt, Human
gcaucugagcuucugccugcugcaagaccgagucuggccccggcaucugaagcucauuagc

SEQ ID NO: 4142558 - RNA, 62 nt, Human
gcaucugauguucuguccgagucacauuccuugugugccugaccucuggagaacaauagugc

SEQ ID NO: 4142559 - RNA, 72 nt, Human
gcaucuggaaacuucugugcucuccuuggccucuguguucuucaucuccagguuuagggagcacccgggugc

SEQ ID NO: 4142560 - RNA, 56 nt, Human
gcaucugggcccagcaagaguucagagguuugguagucucugcuugguccauaugc

SEQ ID NO: 4142561 - RNA, 91 nt, Human
gcaucuggggacuuguaagaaaugcagaaccugagaccauaccucgcaccuaaugaaucagaaucugcauuuuaacuaaaccucuaggugc

SEQ ID NO: 4142562 - RNA, 68 nt, Human
gcaucugucaccauggcaaugagccagaugaaccaccucagcaccauugcaaauauggcagcagcagc

SEQ ID NO: 4142563 - RNA, 69 nt, Human
gcaucuuauuuagagaggacuagagaaauugucuaacacugcuuuccagaccuuuuuaaaucaagaagc

SEQ ID NO: 4142564 - RNA, 77 nt, Human
gcccuugcaucagggagagcccagccuugagugaaacugccugggagacaggcugggcgcuuccugcggcagucggc

SEQ ID NO: 4142565 - RNA, 57 nt, Human
gcccuuggaagcggcagguagcacaugacccucacacccucuucugcuuccaaaggc

SEQ ID NO: 4142566 - RNA, 61 nt, Human
gcccuuggggugucuguaauaaaggcuggaugagagaauuuaaacuaacaauugcaagggc

SEQ ID NO: 4142567 - RNA, 77 nt, Human
gcccuuggugcccuccgugcccucaucugcacuucauccuuugauaguuuaaugccacggcagggaacagcuggggc

SEQ ID NO: 4142568 - RNA, 81 nt, Human
gcccuugucucccguuuggaaaggaugcagcauuuuauugagggagcggcagcauccccaggcagcagggcaagacagggc

SEQ ID NO: 4142569 - RNA, 103 nt, Human
gcccuuucuaccccaaacguagugcuuccugggacaccuaacucuaugcacagcccugagcuggaugcugguuucccaggaagcucacaguuuggggggaggc

SEQ ID NO: 4142570 - RNA, 67 nt, Human
gcccuuuguaugugccuuuugcggaaguagacuguauuucuucaauuuuccauauacugcaaauggc

SEQ ID NO: 4142571 - RNA, 79 nt, Human
gccgaauuugacacuaagaugcaguuauacuguguagaaaaugcacaauuuguuugcucuuagucaggaacaguuuggu

SEQ ID NO: 4142572 - RNA, 57 nt, Human
gccgacaagcaaagaaucuuaggcugcauuaauggagucaggauaugccuugugggc

SEQ ID NO: 4142573 - RNA, 58 nt, Human
gccgacccuaugucacacgcugucugugacagguccaggauuuguggggucuuaaggc

SEQ ID NO: 4142574 - RNA, 79 nt, Human
gccgagcuccucaaaaauguaccaauuacauuuuugcuaacuaaacguaaagauguuuuaauauuucgaggaguugugu

SEQ ID NO: 4142575 - RNA, 74 nt, Human
gccgaggugagaggaucauuugagccuaggaguuugagaacagccugggcaacauagugagaccccaucucggc

SEQ ID NO: 4142576 - RNA, 72 nt, Human
gccgaguucuccuuggcuaggcagcggcuguccuggcugacagggcagcgcccucgucaugagcuacuuggu

SEQ ID NO: 4142577 - RNA, 59 nt, Human
gccgauggccucagugcccaaaggagaacgcuucuuacuggccuauggaagccacuggc

SEQ ID NO: 4142578 - RNA, 67 nt, Human
gccgcaaguucucacucuccuccauggggcagccugcagaaaggaggggugggaaugcagagcaggc

SEQ ID NO: 4142579 - RNA, 87 nt, Human
gccgcacugaggggcacuccacaccacgggggccgccgcggccgacagccagccaggcggcuguggugggggugaggcuggggcggc

SEQ ID NO: 4142580 - RNA, 72 nt, Human
gccgccgccgcugugcaauuuagcagaaauccgacaggggccgcguuugcugagcgcauccggcggccgggc

SEQ ID NO: 4142581 - RNA, 129 nt, Human
gccgccucccacuugcgcuuggugaucugagcugccauguccgccgcgguccaggagcgcagguccucguucagagcgauguaauccuugccgucguaggcgugcuguucauacccgcagaggaagcgc

SEQ ID NO: 4142582 - RNA, 101 nt, Human
gccgcgccccgcaguccccagggccuggcuggcuccaccugcugccagggaagacccucggccggagagccaagugcugcugggagguggccgggcguggc

SEQ ID NO: 4142583 - RNA, 68 nt, Human
gccgcgcgggcuccucacugcauccccaggcugaggggguuggggauggggucgggacccugcucggc

SEQ ID NO: 4142584 - RNA, 90 nt, Human
gccgcgcuucaggagcccuucagcccgcagcugcaccgugggagccccucucugugcuggcugaggccugagcgggcucccucugccggc

SEQ ID NO: 4142585 - RNA, 86 nt, Human
gccgcgggaguggggagagcgggaggugccacagcgcggaccugcgaacugaggugauggcccguuuuccuuaacucuccugcagc

SEQ ID NO: 4142586 - RNA, 99 nt, Human
gccgcggucagcuugccagcccggcgcgcuuuguucucagguagcugggcuccagcagaggcagccggggaaaaggacugggaagccgugggaucuggc

SEQ ID NO: 4142587 - RNA, 94 nt, Human
gccgcugcuuugucuuuguccuggggcgacuuggggcccaggaaacagacucagaauucagggcucccgucucuagggcaggaauaucaggggu

SEQ ID NO: 4142588 - RNA, 84 nt, Human
gccgcugguguuuagugcuuaggaaauggggaaauggccaugucagaggucccacagcaugaguaacucucaaaugccaguggc

SEQ ID NO: 4142589 - RNA, 73 nt, Human
gccggcagacgggcccauggacacccaagugccagcacugcuguccuccaggucuccggggcagucugugggc

SEQ ID NO: 4142590 - RNA, 67 nt, Human
gccggcugccuuggggguugucauuacaugcuaggcaugagaugaugcaggccccaagguagggagc

SEQ ID NO: 4142591 - RNA, 129 nt, Human
gccgggacugggagaggcaagcaaggggacuagagcucaggauuuaaaggggcacucacucuuaaaguuguggagugccuccuugaaaucugugcucugguugccucauuggccucaucuaguccuggc

SEQ ID NO: 4142592 - RNA, 58 nt, Human
gccgggagaguggaaccaagaggaaaaaugcaaaugccuaggccuuacuuuccugugc

SEQ ID NO: 4142593 - RNA, 86 nt, Human
gccgggaugcggccgguacccgcuccccgccgggaacaaccucuccacucuuccugcagggagcuggugccagccgacagccgcgc

SEQ ID NO: 4142594 - RNA, 115 nt, Human
gccgggcagcggcagcauccaaccugcuuuauuccuccugccugcagcgccacagcgagcgagcgagcgaggagggggagagagggagucugucugcaaagugcugcucccuggu

SEQ ID NO: 4142595 - RNA, 123 nt, Human
gccgggcuuccuucacggaccuugcgaaccugcagcuccagccgacuguaagaaggaagugccuuuuugcagguggggucggggaaguagggccgcgaaggccucugggaaauguaguucggc

SEQ ID NO: 4142596 - RNA, 57 nt, Human
gccgggggccugcugcagguucaggaugcugucgauggcgcucugcaggugcucggu

SEQ ID NO: 4142597 - RNA, 72 nt, Human
gccgguccuugcugggcuguuccuguccaugugccuggucacggugcuggggaaccugcucaucauccuggc

SEQ ID NO: 4142598 - RNA, 83 nt, Human
gccguaugccagcucugguccagggagggcaccaccugcuggcuagacugaguuccuucccaccccagggcggggccuacggc

SEQ ID NO: 4142599 - RNA, 74 nt, Human
gccguauuaagcugcuuuaaagauuuauguuguacccaaucuuagaguguuuuugaagcuagcucaaggacggc

SEQ ID NO: 4142600 - RNA, 96 nt, Human
gccguccuccccuacucuggacagggacacagccagugagguggaugaccuggagccugacagcgugucccuggcccuggaaauggggggcucggc

SEQ ID NO: 4142601 - RNA, 55 nt, Human
gccguggggcgcccagccggagccucuguccucugccuguucccgauuccauggc

SEQ ID NO: 4142602 - RNA, 67 nt, Human
gccgugucuguggagcgaggcugguuuuucucucagcgacaacagaaugccaggcuccauagccggc

SEQ ID NO: 4142603 - RNA, 82 nt, Human
gccguuagacgaagcuaaauaucagagcaccuacucugccguauauucuuaauaggguuccuguacuuagcuauguaacagc

SEQ ID NO: 4142604 - RNA, 59 nt, Human
gccguucuugguaguucugagagcugucagaacauucaaagagcugccagaacugaggc

SEQ ID NO: 4142605 - RNA, 75 nt, Human
gccguugcgcccaauaggagccuucgccgucccgcuuccgugccggcugggcucgcugauuggcugcgcuggggc

SEQ ID NO: 4142606 - RNA, 61 nt, Human
gccguuuucuguuacaaaguacagcgauaguuuuuuccugugcucuuuagccgaggaccgc

SEQ ID NO: 4142607 - RNA, 83 nt, Human
gccuaaagcccccggugggaaggggccagugugcggcaaggcggcccaggcagagggauccccauccuaggcagggggcaggc

SEQ ID NO: 4142608 - RNA, 87 nt, Human
gccuaaauggcaggaucaguuucugcaucuuucucugcuugaaccaaagacauuuuaauagugcagggcuauaacuccauucugggc

SEQ ID NO: 4142609 - RNA, 58 nt, Human
gccuaauaguuaagcaacuuuuuccagauaauggaauccuuguuuagaauuauagggu

SEQ ID NO: 4142610 - RNA, 67 nt, Human
gccuaaugcucacccugcaucaggcuugggcugacucagccaaauggaauccaggugacgcauuugu

SEQ ID NO: 4142611 - RNA, 66 nt, Human
gccuaaugugaucgcuuuagaagcuuggugguuuuuacauaggcauaugaauugaucaaauugagc

SEQ ID NO: 4142612 - RNA, 64 nt, Human
gccuaauucuuccaaccauugcauagucagcaguaaacuaugcaagagggaaaaggaaauaggc

SEQ ID NO: 4142613 - RNA, 72 nt, Human
gccuacaggaauucagacugucuaaaugguuucaaugagaaucuuugaaaugacauuaggauccugcauggu

SEQ ID NO: 4142614 - RNA, 59 nt, Human
gccuaccacagugauauuuugcauaugacuuccuucaguuagcaaaauguuuuugaggc

SEQ ID NO: 4142615 - RNA, 76 nt, Human
gccuagaaauaucuacauuuguuuucucucaucaauauuaucagcuucugagggaucaaaaaauguacaugcaggc

SEQ ID NO: 4142616 - RNA, 65 nt, Human
gccuagagcagcaaacgggauuuuaauugccuacggcuauuucucuagugccuugcucucuaggu

SEQ ID NO: 4142617 - RNA, 67 nt, Human
gccuagagcuccucccaggguagcacuggucucugcuccagugccuagaggugaagagcuaucuggc

SEQ ID NO: 4142618 - RNA, 60 nt, Human
gccuagggaugacaaauauucuucucagauucuagcaguagaguuacugucauccuaggu

SEQ ID NO: 4142619 - RNA, 55 nt, Human
gccuagggcagagugacucacacucuggacagaguccagacagcaccugccuggu

SEQ ID NO: 4142620 - RNA, 85 nt, Human
gccuaguacaauuccuagcacauaacuuagaauaguuuaaaaaguuuaggagauauauguguguguguaggggaguacauagagu

SEQ ID NO: 4142621 - RNA, 70 nt, Human
gccuauaaucaggaggauaaggggguccagcauucgacagugggacucccagcaaccucucagauugggc

SEQ ID NO: 4142622 - RNA, 72 nt, Human
gccuauacccauugcaaguaguuguuagaaggacaaucaccuuauucaacagcuuacucaauggugauuugc

SEQ ID NO: 4142623 - RNA, 111 nt, Human
gccuauauuuuucuucuugaccacaggauauuaugagagaccuugcuaagugccuugcugaagucccaagcuaauagccaguuuucuuccuguggagucaagaagaagggc

SEQ ID NO: 4142624 - RNA, 60 nt, Human
gccuccccuccuuaggucuucuagccaccagagaggagggcagagguaggagagggaugc

SEQ ID NO: 4142625 - RNA, 70 nt, Human
gccucccuacccuccccgcaacacacccucuaggacccuaggcuaggcuuggaggcaaugggaaggaggc

SEQ ID NO: 4142626 - RNA, 63 nt, Human
gccucccuuggccauagccagccuaggugguugagaugaagaugggcuggaggccaagggggc

SEQ ID NO: 4142627 - RNA, 95 nt, Human
gccuccucagugccccaggcugaguuagaggugucuucugggccccuuuggcccccagugauucccaugaucacagcccugagcacuguagcggu

SEQ ID NO: 4142628 - RNA, 119 nt, Human
gccuccugccuucagaaggucucuggcuugugugggaaaggagauauuggagagugaaaagggcuuuuccucugcuuugcacugacuccuuccuguacccaccaucagaggcuggaggu

SEQ ID NO: 4142629 - RNA, 80 nt, Human
gccuccugcuagcuccucgcaguugugcugaggcccacagcccagcuccacugucagaugagaaacagaagcacggaggc

SEQ ID NO: 4142630 - RNA, 61 nt, Human
gccuccuucagagcugcugccggaaaaggugauuguuuccacugcagcuucugauggaagc

SEQ ID NO: 4142631 - RNA, 60 nt, Human
gccuccuugcugcugaucucguccugccuaggcaggcagucagcccugcuagggucuggc

SEQ ID NO: 4142632 - RNA, 66 nt, Human
gccucgcagugcucucacucagacagcgcaggaucagacucccucugagugauuagccucuggggu

SEQ ID NO: 4142633 - RNA, 55 nt, Human
gccucgcccgccagcagcacguugcccaggugcgagauguagcuggaggccaggc

SEQ ID NO: 4142634 - RNA, 128 nt, Human
gccucgcgcccaccgcgcucggcaguggcugcucgggcuccggccccgcgccaggcgggcggaagcgggucgcggccccgggcuggggcuccgggcgccggaaccccgggcgggcgcggcgccgaggc

SEQ ID NO: 4142635 - RNA, 56 nt, Human
gccucgcucagcugagguuuccugacaggaggggaagcugccagcugagcugaggc

SEQ ID NO: 4142636 - RNA, 61 nt, Human
gccucgcuuucaccgggaaauuaucguugcuuguaaaacagaagaagccgggaaggcaggc

SEQ ID NO: 4142637 - RNA, 58 nt, Human
gccucggagguugaggcugcagugagcugugauggcucuucugcacuccagccugggc

SEQ ID NO: 4142638 - RNA, 81 nt, Human
gccucggccucccaaagugcugagauuacaggugugagccaccacgccuggcuaauuuuuguauuuuaguagagauggggu

SEQ ID NO: 4142639 - RNA, 63 nt, Human
gccucggcggcugcugccaccacagcccggagucggggccugggagggcagcagugugggggc

SEQ ID NO: 4142640 - RNA, 62 nt, Human
gccucgguggccuccaaggcuuaaugggccugagucuauuugucuaagaggcugacagaggc

SEQ ID NO: 4142641 - RNA, 111 nt, Human
gccucucacgauaugcuaaccacaauuaaucacuuuucucuaauguagcugagcugcuuuauaacaccggcuacacaaaaggagagugaguuaaaguaaggaacuaaaggc

SEQ ID NO: 4142642 - RNA, 62 nt, Human
gccucucagcagagcucugacuguucucaggcugcaguaucagacagaggcuguaugagggc

SEQ ID NO: 4142643 - RNA, 77 nt, Human
gccucucagucccagcaccugcccaggcuuuggaugaccgaccacuggcucaggagcugggagagcuacuugagggc

SEQ ID NO: 4142644 - RNA, 63 nt, Human
gccucuccucuuaauaccauuacauuggggauaaaguuucaacauaugaauuuggagagaggc

SEQ ID NO: 4142645 - RNA, 57 nt, Human
gccucucucauuuuguucuccugaguucauugcaaccggaacaugaaugugaguggc

SEQ ID NO: 4142646 - RNA, 61 nt, Human
gccucugaauugagauaggaucagucucaaauucuugagauaaauucauuaauucaccggc

SEQ ID NO: 4142647 - RNA, 83 nt, Human
gccucugacaacucuggggagggagagcaacuggucagauccccaaagacuuggccuuauuuccacagaaugauuuucuaggc

SEQ ID NO: 4142648 - RNA, 70 nt, Human
gccucugacacgccgugcccuggacccgaaaugcccgccccacuccuggagccuccggugugugagaggc

SEQ ID NO: 4142649 - RNA, 68 nt, Human
gccucugagccaugggucuaagcacuccauccccuaccuugaagugacacaugguggcucuaaggggc

SEQ ID NO: 4142650 - RNA, 57 nt, Human
gccucuggaagugggaagggguaggaaggaaggcucuuuuccuggagcuuccggggc

SEQ ID NO: 4142651 - RNA, 59 nt, Human
gccucuggccacaugggacauagggaggagugaggcccuguggacaggggcgcagaggu

SEQ ID NO: 4142652 - RNA, 62 nt, Human
gccucugggaucagcaguagugaugauuuuuuacaaggucagaaccagcuggugcccagggc

SEQ ID NO: 4142653 - RNA, 64 nt, Human
gccucugguuagccugugaccuuggggaagucaguaaggucugugaggcuguuuguccaggugu

SEQ ID NO: 4142654 - RNA, 87 nt, Human
gccucuguagaauaaauguacacaucuguuuaacauuuggaguuauugaaaucagaccuguugugcauuugccaucuauuaagaggc

SEQ ID NO: 4142655 - RNA, 76 nt, Human
gccucuguccuaaaccuguuaauagagcgaugcguuacugguuuugguuagcaaguuuuaacauuuuagaagaggu

SEQ ID NO: 4142656 - RNA, 77 nt, Human
gccucugucugcaagcagguuugcuauuuucuuuucuuuagagagggggccagcugcaccuggguucaggcagaggc

SEQ ID NO: 4142657 - RNA, 66 nt, Human
gccucuuaccaaauucuaaaccaucacaaccuuacccuguggguguuggaacauggugagauuggu

SEQ ID NO: 4142658 - RNA, 78 nt, Human
gccucuuacguggccuuuauggugaguugugcuuggccacugaagcauuaguugcucacuacaagguuauucagaggc

SEQ ID NO: 4142659 - RNA, 83 nt, Human
gccucuucucagccaucuaggauuugaaugcacaguagcugcugcauuguggacccaaauccuagauggcugaggagguuggu

SEQ ID NO: 4142660 - RNA, 57 nt, Human
gccucuucugaaaaauaucagccaaucuggucacacugggcugaaauuuuucauggc

SEQ ID NO: 4142661 - RNA, 65 nt, Human
gccucuuggagaauucugaaggcaaaaguuaucugcuagggcuguuaguaauucucagaugaggc

SEQ ID NO: 4142662 - RNA, 82 nt, Human
gccucuugggaaacagcucuuuggggcugucuguccuucucccuucaaggacuacaggagcugcuguuuacccaugucaggc

SEQ ID NO: 4142663 - RNA, 62 nt, Human
gccucuuguaugugugcagugcuuuugccuucaggcaacagaauaguugauguacaguaggc

SEQ ID NO: 4142664 - RNA, 104 nt, Human
gccucuugucuccacaguaggaaauuuucugcccauucuuagagucuagggaaauacuuggauguuaugaggugguagacuaagauggugaggggcagagaggc

SEQ ID NO: 4142665 - RNA, 56 nt, Human
gccucuuugaugauuaggcaauuuuuuaaaaauuggaaaaugaggcacagagaggu

SEQ ID NO: 4142666 - RNA, 65 nt, Human
gccucuuuggguucagauuuggucucuucuuuccugccagucaucuccugagaacccacaguggu

SEQ ID NO: 4142667 - RNA, 59 nt, Human
gccugaacucugcucaucuggucugagacagagcccagcaguaagauuagagauuaggu

SEQ ID NO: 4142668 - RNA, 73 nt, Human
gccugacucccggaaauguagagggcgugccuccugggaccgucuucacauccuucccaugggaaaggcaggc

SEQ ID NO: 4142669 - RNA, 58 nt, Human
gccugagaggcugagguugcagugagcugaaaucacgauacugcacuucagccugggc

SEQ ID NO: 4142670 - RNA, 76 nt, Human
gccugagaucuugccuugagaucugauuggacuuaacugagcauuugugauuugaucaucuuaagguaucucaagc

SEQ ID NO: 4142671 - RNA, 55 nt, Human
gccugagauuggacauuauuuaaaagcaauuuggagaguuuucuccauuucaggc

SEQ ID NO: 4142672 - RNA, 79 nt, Human
gccugaggcacagcugccuguauuguccucaucuguucugacugaaggauggaggugcugaauaaauuaggccucaggc

SEQ ID NO: 4142673 - RNA, 58 nt, Human
gccugaggcaucugggcacagaaguggucaacagcacacacgucccauggugccaggc

SEQ ID NO: 4142674 - RNA, 67 nt, Human
gccugaggggaaggagaagaucaauguuccacucagggagugaggcagaaguucccuuuuacuuggc

SEQ ID NO: 4142675 - RNA, 62 nt, Human
gccugaggggcgcuggcagguuccuuggggacaguggagguugcaggcagccccuucugggc

SEQ ID NO: 4142676 - RNA, 74 nt, Human
gccugaguguuauuuacagagggguuuuacagguauuauaaacacuggaaagauuucuuuggaguccacugggc

SEQ ID NO: 4142677 - RNA, 62 nt, Human
gccugaugcagggauucagggagcccuuggaaucucucugcucccugucccugcacuuaggc

SEQ ID NO: 4142678 - RNA, 66 nt, Human
gccugaugcuuacagcucuccugggaguaaaguggcaagccccaguaguguugcugagugucaggc

SEQ ID NO: 4142679 - RNA, 68 nt, Human
gccugcaaagcugaaucaaguuaaguucagccaccauguagaacacugagaaagucagcuuuacaggc

SEQ ID NO: 4142680 - RNA, 66 nt, Human
gccugcaacaaagcuuagaccuaagagaugcauuuaacguagaauuucaaucucucuaaggcaggc

SEQ ID NO: 4142681 - RNA, 100 nt, Human
gccugcagaggucccugggaggaguuguauacacuuaggcagauagaugguuaaaugacugccuugauuaucagcuaacaccuuccagggccuugugggc

SEQ ID NO: 4142682 - RNA, 118 nt, Human
gccugcagcagaaagacccugggccagaauggguugugccaucugucaccagauauugccaagguagaucuggcugacuuugugggacagcuuguuucucaauaaucacuuugcaggc

SEQ ID NO: 4142683 - RNA, 76 nt, Human
gccugcagcucccuggcuuuuacaguguaacugcuuuguccagcucugcaaguuggagccugggaagcuggcgggu

SEQ ID NO: 4142684 - RNA, 81 nt, Human
gccugcaggagaaaacuggacccaggacgccccagauuuggccacaccagcagggcaguuaaaggguccuuucuugcuggu

SEQ ID NO: 4142685 - RNA, 77 nt, Human
gccugcagugcugaacuauaaaaagcuuucguugucaggggacccagaaacuauuuuaguaguugggccaagcaggu

SEQ ID NO: 4142686 - RNA, 60 nt, Human
gccugcaguucugugcuaggcagcaagaaagcuccacagcugguggccagugcugcaggc

SEQ ID NO: 4142687 - RNA, 65 nt, Human
gccugcccugggccaggaagcggccaugguacaagucucugggcugccacagggcucaggcaggu

SEQ ID NO: 4142688 - RNA, 64 nt, Human
gccugccgcgcgcccagguuagguguguccgcucuuuucacacucgcggccggcgcgcgcgggc

SEQ ID NO: 4142689 - RNA, 73 nt, Human
gccugccugugcuagugcagggaaaucuuuggaacucuuucaaauguucccuguacuggccggacaaccaggc

SEQ ID NO: 4142690 - RNA, 88 nt, Human
gccugcuacaucaugaagcauuacaggaugacagcagccgagaccauugcguggguaaggaucugcagaccuggcuuggugaucgggc

SEQ ID NO: 4142691 - RNA, 90 nt, Human
gccugcucaaaauaguauuaucauugguaauauggucuguaucuugucugacccggaugaugugucccaagaaguaggguuugagaaggu

SEQ ID NO: 4142692 - RNA, 58 nt, Human
gccugcucugagugugggggguccuggaaccuguggaagaccccugacuccugcaggc

SEQ ID NO: 4142693 - RNA, 61 nt, Human
gccugcugccccugagcucagccugucacaguaguggggcagggcagagggagcagagggc

SEQ ID NO: 4142694 - RNA, 115 nt, Human
gccugcugggaccccaggggcaccugaucugccuuuggggcuuuggggcaccccuccuccuggggcucuuggaccagggucccagaguaugacaggggugcuuggggaagcaggc

SEQ ID NO: 4142695 - RNA, 55 nt, Human
gccacucugauuucaagggagauaauugaagauuuccagugcaauccugagaggu

SEQ ID NO: 4142696 - RNA, 99 nt, Human
gccacugaccuucacagaauugucuugacuggagguagcaagaaugugcucgcugucugggugccaguccaggccauggauuuuggagaggugggcggc

SEQ ID NO: 4142697 - RNA, 63 nt, Human
gccacugauaauuuuggaguaggggugaaugcuagaauuccuuuuaacuagaguaucagcugc

SEQ ID NO: 4142698 - RNA, 55 nt, Human
gccacugauuccaagucaauuucugggccucagauuuauugggugagucauuggc

SEQ ID NO: 4142699 - RNA, 75 nt, Human
gccacugcagccaugggaacaccaugucgagcgaugaauguucaucuggaaguucccaaggcugaguuccauggc

SEQ ID NO: 4142700 - RNA, 106 nt, Human
gccacugccaagucuagcugucagguuggucucagagcucugucuugauccccaccaggucgcccagccugcgaucccaccuggccugcucuaucuuucugugugc

SEQ ID NO: 4142701 - RNA, 79 nt, Human
gccacugcucuggccaucuugaggugccagucugaggggcaaucugagcagaggcaccaucuggaacagccaugguggc

SEQ ID NO: 4142702 - RNA, 62 nt, Human
gccacuguauuaguuguauuaguuuucuuugcuggauagaaaauaaccacuaauauaguggc

SEQ ID NO: 4142703 - RNA, 71 nt, Human
gccacuguccugugccugugcuuccagcacaaaauagacaugggccaaggacagggaacaggacaggaggc

SEQ ID NO: 4142704 - RNA, 100 nt, Human
gccacuuaacuugcaguuccuuuuuuuuacuauaguccagcccuuuuucuguugagaaagggcuauuuugagguagaagcaauugcaauuguuuauuggc

SEQ ID NO: 4142705 - RNA, 55 nt, Human
gccacuugugucagugacgucugcugugcaagcaugaugucuuggucacaguggc

SEQ ID NO: 4142706 - RNA, 76 nt, Human
gccacuuuucagagucaauguccaagaagcuaaagaaauuuaacuuugauuuugucauuauucuuggagguguggc

SEQ ID NO: 4142707 - RNA, 93 nt, Human
gccacuuuucuguaggauuucuaccugguuucuguuuggaaacuguauuuaacuaccaauuagaaaccucagggaaaucuuugggguaguagc

SEQ ID NO: 4142708 - RNA, 88 nt, Human
gccagaaauaaaacagaacuggaagagucagccaucugucuggaagcacacacagucccagauggcauuuccuuucuggcuuucuggu

SEQ ID NO: 4142709 - RNA, 89 nt, Human
gccagaagcaucuucugccaggaaagccuugaguuugacaauaaacuuuggaagccagggauuccugagggagauguuugcuucuaggu

SEQ ID NO: 4142710 - RNA, 70 nt, Human
gccagaagggguggauccaggccucugacaccaaguccaaguccucugucugcguuuccacaccucuggu

SEQ ID NO: 4142711 - RNA, 61 nt, Human
gccagaccacaggaucugauguuggccaagaggccauggccacaggcuuucugaggcuggc

SEQ ID NO: 4142712 - RNA, 69 nt, Human
gccagagaccuaagauugcaaacucucuccaggcuccuuggggagagcuccaaucuuuggaguccuggu

SEQ ID NO: 4142713 - RNA, 58 nt, Human
gccagagagauggaaaagcuuaacagaccuucuaguuugcauuucuuuuucauuuggc

SEQ ID NO: 4142714 - RNA, 55 nt, Human
gccagagcagaauagaguggccuaagacaucugggaucucuggaaugacucuggc

SEQ ID NO: 4142715 - RNA, 58 nt, Human
gccagagcaucgcacccuccauggccgacaugugggagcuggagauugcgcuacuggu

SEQ ID NO: 4142716 - RNA, 68 nt, Human
gccagaggacuugggggcugaaugugagggugguaagaggaacagucagggugucccggguuucuggc

SEQ ID NO: 4142717 - RNA, 61 nt, Human
gccagaggcuccucggugccucgugcgaguccccgccgucagccccgaggagccuccuggc

SEQ ID NO: 4142718 - RNA, 94 nt, Human
gccagagguaagauauuggagcuuucugagaucuuuccagguguguccuaaauauccaggaauagaucagagauuucccaaugucccuaugggc

SEQ ID NO: 4142719 - RNA, 62 nt, Human
gccagagguucaacaacugucuguauugugccaucacaggaggucagaguggauuucauggc

SEQ ID NO: 4142720 - RNA, 81 nt, Human
gccagauaucucaguguguacacugagcauuuguguagcuugucacaaauuucuuggguacaguguacauauuagccuggc

SEQ ID NO: 4142721 - RNA, 56 nt, Human
gccagaucuagagcuuuuccaucuaugcaaaacaggugagauugcuuuagucuggc

SEQ ID NO: 4142722 - RNA, 58 nt, Human
gccagaucugacauaguggaagcaacccuagcacuuucauccucuguccugguguggc

SEQ ID NO: 4142723 - RNA, 72 nt, Human
gccagauuagcuccccagcuuagcccuggcugccacauucuugugacaguuguagaacuggagagcaucggc

SEQ ID NO: 4142724 - RNA, 74 nt, Human
gccagauucagcauuuggacagcggcucuggggcgcagucggcccagcgaguuugccggugaacagccucgggc

SEQ ID NO: 4142725 - RNA, 66 nt, Human
gccagauucugggaguggggugauuagagggccuggaagccacuuagccuggcacccggggcuggc

SEQ ID NO: 4142726 - RNA, 66 nt, Human
gccagcacugcuucgcagccagggauucugacccugcuggaaacccuacggcagagcagugauggc

SEQ ID NO: 4142727 - RNA, 73 nt, Human
gccagcaguuaaacugaaaggcucguucacuugcaggagagcugggugacucagggcgucaguaacaacuggc

SEQ ID NO: 4142728 - RNA, 129 nt, Human
gccagcauuucauccugaggggcagggagcaauggagggcaaacuccugaccucaggcuagccacugggaagugugcaggccacaggccagggcugccccagcucucaaugcccuuguuggaguauggc

SEQ ID NO: 4142729 - RNA, 55 nt, Human
gccagccagaguccaucugagaguuuguuuugugaaaggaggaccugagcugugu

SEQ ID NO: 4142730 - RNA, 69 nt, Human
gccagcccuuguuucuaaagcugcaacuuggagccuuuccauuagggcagccaagagaccagggcaggc

SEQ ID NO: 4142731 - RNA, 70 nt, Human
gccagcguucacaagcuggguuucugcacccccuuucuagaagguguggguucccuggcuugacacuggu

SEQ ID NO: 4142732 - RNA, 66 nt, Human
gccagcucagacccucagcuuuuauaaugcagagcuggauagaaaggcuggggacugaggaagggc

SEQ ID NO: 4142733 - RNA, 130 nt, Human
gccagcucgucgcucucuguagccugaaagcuguacagggccacggacuccaugccgcugcucggggcuccagcagcugggcucagagcugggccgacagcuuccugcuuccucugcagucgaggacggu

SEQ ID NO: 4142734 - RNA, 58 nt, Human
gccagcucuguggcuguacuugugcccagagagacagguggcagcggcagaguuaggc

SEQ ID NO: 4142735 - RNA, 66 nt, Human
gccagcugaagggaagcuccuggcugagccccagcacccucuguuggagcuucuggucagccuggc

SEQ ID NO: 4142736 - RNA, 58 nt, Human
gccagcugacaccuugauuuugaccuugugauacccagagcugaggauccagcugagc

SEQ ID NO: 4142737 - RNA, 78 nt, Human
gccagcugcuggaacagcgcgagcaacugcaccgcgagcacgaggacacgcgggaccuggcgcgugugcacggcuggc

SEQ ID NO: 4142738 - RNA, 73 nt, Human
gccagcuguguccuuuccgggccuggaggcuuggccccuccucucccaagccuggcaggggcacuggcccggc

SEQ ID NO: 4142739 - RNA, 130 nt, Human
gccagcuugaccucuaggcagggcgucugcacgaggcuggagaguccgugcucuguccaccuccaacaaaaacaggcugcugacuucauccagcuuccaguccuuucccagacaggucccagcucucggc

SEQ ID NO: 4142740 - RNA, 74 nt, Human
gccaggaaaugcaggcugugucauuuagugauuccaaugagugaaaugaucugauacuugcauuuaaaucuggc

SEQ ID NO: 4142741 - RNA, 58 nt, Human
gccaggaaggaccguccagaucaggccugccugguuccaggauggaucuuucccaggc

SEQ ID NO: 4142742 - RNA, 58 nt, Human
gccaggaaguugggccagucuauauucaauuccuucaggacugugcuuucaauuuggc

SEQ ID NO: 4142743 - RNA, 61 nt, Human
gccaggagaauuaggaacucaagauaaccaaucaguuauuugcuaguggaauuuuccuggu

SEQ ID NO: 4142744 - RNA, 64 nt, Human
gccaggagauuggcagaugacucaagagccuaaaacuuguuuuauucugcaauuucccuguggc

SEQ ID NO: 4142745 - RNA, 82 nt, Human
gccaggagcaucaugcagagucugggcuucagccuauaggcagugagagcccuggaagauuuugccaagugaaugcucaggu

SEQ ID NO: 4142746 - RNA, 74 nt, Human
gccaggagcuguauuuagggagucccuuuacaauacuucucuggacccacccuacuagcagugucccacguggc

SEQ ID NO: 4142747 - RNA, 60 nt, Human
gccaggaggcugcuguguaggcaggaacgucugccuuugaauuugcuagccuaaccuggc

SEQ ID NO: 4142748 - RNA, 95 nt, Human
gccaggagucgagggacauaaacguugcuauuuacugcaagagcuuauccugagcuuggccugcaggcagcagcgcaugugccgauuaaacccgc

SEQ ID NO: 4142749 - RNA, 69 nt, Human
gccaggagugucaauaauugauagauauuggccauauuauuuccacuuucuaucaaguauuggguuggu

SEQ ID NO: 4142750 - RNA, 65 nt, Human
gccaggaguucagaugcauguuuaccuccuugaauccuuugggacuuuugcaucuaauaucuggu

SEQ ID NO: 4142751 - RNA, 91 nt, Human
gccaggauggucucgaucccccgaccuugugauccacccaccuuggccucccaaaguguugggauuacaggugugagccaccgugccuggc

SEQ ID NO: 4142752 - RNA, 91 nt, Human
gccaggauggucucgaucuccugaccucaugauccaccugccuuggccucccaaagugcugggauuagaggugugagccaccgugccuggc

SEQ ID NO: 4142753 - RNA, 91 nt, Human
gccaggauggucucgaucuccugaccucgugaucugccggccuuggacucccaaagugcugggauuacaggcaugagccaccacaccuggc

SEQ ID NO: 4142754 - RNA, 91 nt, Human
gccaggauggucucgaucucuugaccucgugaucugccggccuuggcuucccaaagugcugggauuacaggcaugagccaccacuccuggc

SEQ ID NO: 4142755 - RNA, 62 nt, Human
gccaggcacaguucuaggugcuggggauauugcucugaguacaacagaaucuuugcuuuggu

SEQ ID NO: 4142756 - RNA, 63 nt, Human
gccaggcaggugaggagggcucagggaaugccaagcuggucacuccuccaccugcuuuacggc

SEQ ID NO: 4142757 - RNA, 65 nt, Human
gccaggcccuaccauuuugaggauggagagacucuugucacucagcuucaagguguaggccaagc

SEQ ID NO: 4142758 - RNA, 68 nt, Human
gccaggcccugcgauuagguggcagggccucugcccugcuccaggccgcaugggugucugaacuuggc

SEQ ID NO: 4142759 - RNA, 59 nt, Human
gccaggcucaguagcgauuccuccugcguuugaaugcccuuugcucuuguggcucuggu

SEQ ID NO: 4142760 - RNA, 63 nt, Human
gccaggcuccccggaucccuggaccaccuccacuccagaccagacaauggggaagcugcuggu

SEQ ID NO: 4142761 - RNA, 57 nt, Human
gccaggcugaauauguuccagggucacccaacucuguccuuguacaguuagccaggc

SEQ ID NO: 4142762 - RNA, 80 nt, Human
gccagggcagagauucagccgucugcagucagcaggaccuacugugaggccuagacagccugggagcacucugcucuggc

SEQ ID NO: 4142763 - RNA, 78 nt, Human
gccagggcccgccucccagcugccccggccgccggggggccuggcggugacggcggcgccuggcggcggggauuuggc

SEQ ID NO: 4142764 - RNA, 113 nt, Human
gccagggccugcguguccugccauccccccuccuggggggcacuucagcacaaugggcuuggcggccccguggcuucccaggcggaugugauggcaaauagcaggcacuuggc

SEQ ID NO: 4142765 - RNA, 76 nt, Human
gcuaaguuuugggggguggagguggucucuuugucccugaagggauucauccuuaccaguccccgguucaaagagc

SEQ ID NO: 4142766 - RNA, 79 nt, Human
gcuaauaccuuccauuuuagauguuuguuauagugcuuacuuuucgguacuaguucucauaugaaauaaggaagauggc

SEQ ID NO: 4142767 - RNA, 61 nt, Human
gcuaauagaacaauaauuguaaacuucaugaagggguauguacuaguuauuguucugaagc

SEQ ID NO: 4142768 - RNA, 67 nt, Human
gcuaauaugauuccacuauuguaugggagaggcaucaugugaauuagugggaaucaccuuuauuagu

SEQ ID NO: 4142769 - RNA, 64 nt, Human
gcuaaucucccaguugcucuguuccuugucacuggaaguggucagagcuguugcggggcuuggc

SEQ ID NO: 4142770 - RNA, 127 nt, Human
gcuaaugaaggaaguaggaccucagcaggugcuuuguuuacuccuggaacaucucaaacauaagcauuccagagugagagaggagguggugaacauuugcaucugcucccugcugaccuauccuagu

SEQ ID NO: 4142771 - RNA, 94 nt, Human
gcuaaugugcaaaagacucugggcuuaucauaauuuuaaaagauuucaucuauaucuauuuugaaauaugugaugagagaguacacgauuuagu

SEQ ID NO: 4142772 - RNA, 97 nt, Human
gcuaauuaccuuuuccaaagaacugggguaccauguaaugucuucgaaaagguaauuuagugaaugaugcccuguuaucuuggaagaguuaauaugc

SEQ ID NO: 4142773 - RNA, 91 nt, Human
gcuaauugugacaacugagugggagguuugugugaugauuaucuguccaagcagaauuacacuaaaaccccccaacucauuucacagcagc

SEQ ID NO: 4142774 - RNA, 105 nt, Human
gcuaauuuugcugauugcuaaauaugugaaugauaucacuuuguuuuauucuuacaacauucugcaaagcugacaucauuacauuuucuaugagcaaaccaaggc

SEQ ID NO: 4142775 - RNA, 103 nt, Human
gcuacacauggugccuagggaagaugugggcccacuccagagcucaggccaccugcaguguuauuugagaugugcucccauucuuuucuuccacuaucugugc

SEQ ID NO: 4142776 - RNA, 114 nt, Human
gcuacagagguauacaaauaggagagucauagaaaauugcuggcagccuuuauucaagcccuuauggagaaaggaugccaugauugaaggccucaguuugucaauccaaguggu

SEQ ID NO: 4142777 - RNA, 86 nt, Human
gcuacagauaguguuaugcaugaagauccuguauguuuuuguauuaauuacagaaauuuauaucuuggugauuaucuuauuguagc

SEQ ID NO: 4142778 - RNA, 79 nt, Human
gcuacauucaaccaauguuugcuauuauuauaugggccuggcaaaaggcaaauggcuagacagguuguaaaaugaaugc

SEQ ID NO: 4142779 - RNA, 130 nt, Human
gcuacauucaggucugauuuaggcauucgagacuguguggcagggaguugaagagcugugauuaugacccauuuauacagcuuuugcagcuguuuugcuaaguugugauaugugagauggaaaacugaac

SEQ ID NO: 4142780 - RNA, 59 nt, Human
gcuacauugugucucuaucuagucuggguauuucagauaaaaggaaucauauauguggc

SEQ ID NO: 4142781 - RNA, 114 nt, Human
gcuacauuguugaauuggaaacaaaggagcacuggcuaaaaaagaggcagaaggauauauuauuucucugccuucuuuuagucaucuuguuaccuaugcuucugguaucaaagc

SEQ ID NO: 4142782 - RNA, 57 nt, Human
gcuacccuuucagaaguguacggguaaauauauucauaagcacuucacagggauagu

SEQ ID NO: 4142783 - RNA, 76 nt, Human
gcuaccuauauauacaccugcuauguguguggauauguauuuacacauacacauaucagguguauacauacguagc

SEQ ID NO: 4142784 - RNA, 67 nt, Human
gcuaccuucuucuaucuuagaugacuguaaggaauuagggcuuucagcacaagacuagacagguggc

SEQ ID NO: 4142785 - RNA, 70 nt, Human
gcuaccuugacagauuggagaauuggauugaggguuaaugacucagugagcuccugucugucccuggagc

SEQ ID NO: 4142786 - RNA, 55 nt, Human
gcuacucagaagccuugauuaucuagagugaagcauucagaaggugucugagagc

SEQ ID NO: 4142787 - RNA, 63 nt, Human
gcuacugcugagcauggugggagcaucguuuccuguucuuacuaguauguuucagcagcuagc

SEQ ID NO: 4142788 - RNA, 63 nt, Human
gcuacuggaagugggagaaauuagcucuaguuggauagauuggggaagguuuuacugacuagc

SEQ ID NO: 4142789 - RNA, 55 nt, Human
gcuagaaacuguuuaaucucuuuuauaugaaaguaggauugaacuauuucucagc

SEQ ID NO: 4142790 - RNA, 79 nt, Human
gcuagaaaucgacuucagaauuugugagacuagggggaaaauaacccauucaaaacuauucuagaaguuguuuuuuggc

SEQ ID NO: 4142791 - RNA, 66 nt, Human
gcuagaagaggcaggaugaggacuagaaccgaggucuguagaucccaaaucaccugcuuauuaugc

SEQ ID NO: 4142792 - RNA, 78 nt, Human
gcuagagagcuacagaaagccuucaaguagauguaaggugugaucugaccuauguuuuagaaaggcaguucuauuggc

SEQ ID NO: 4142793 - RNA, 72 nt, Human
gcuagcaauaaucuagaacauaugagagcauggacauccuuucugcaugcucgaaguucuggauuaaauagu

SEQ ID NO: 4142794 - RNA, 69 nt, Human
gcuagcauacuaugagcauagcgcauagcaaaaacacgguguccuuugagcuaagcuauguuaugcagc

SEQ ID NO: 4142795 - RNA, 65 nt, Human
gcuagccaauagauugaagcuauguuggcacaauauccuacauccucccgaucuacuggcugagc

SEQ ID NO: 4142796 - RNA, 61 nt, Human
gcuagccuaguucuagccaccaauguaauguuaauacaagaugguaaggcagcuggcaggc

SEQ ID NO: 4142797 - RNA, 70 nt, Human
gcuagccucuggaauccuuucucuugaccuguggaagagagaacauuuucaggguuucaggggcuauggc

SEQ ID NO: 4142798 - RNA, 87 nt, Human
gcuagcuaagauuucagagcuuugcagcuaauuacuauguaccuuacaggacaguuaaauugaaguugaguccucugucuuugcugc

SEQ ID NO: 4142799 - RNA, 76 nt, Human
gcuagcucuccgccucuucagcaaaguucggcccccuguuggggguaucucuguuaaggagcauuuugagguuagu

SEQ ID NO: 4142800 - RNA, 66 nt, Human
gcuagcuugcucuagauguucagagcugccuucaguaugauuaucuagcaaguucuucaauauagc

SEQ ID NO: 4142801 - RNA, 55 nt, Human
gcuaggaaggacugcagcauuugguccccaagggccaacaucaguucugccuggc

SEQ ID NO: 4142802 - RNA, 56 nt, Human
gcuaggaguaaggagaccuucauuugccucaugcaauugacuuuggcacuuuuggc

SEQ ID NO: 4142803 - RNA, 61 nt, Human
gcuaggaucccagaguuccuucuggccugagagaggcuccuuauggcuuugggguuccagc

SEQ ID NO: 4142804 - RNA, 62 nt, Human
gcuaggcacagucaccauucaaauucauagccagaucuguaucauuugaaagcugugcuugc

SEQ ID NO: 4142805 - RNA, 85 nt, Human
gcuaggcagaauuaaaagaccuguugagguuaguggucauuaauugaauuuagcagugcuuuuuucuaguuuguucugcucuggu

SEQ ID NO: 4142806 - RNA, 61 nt, Human
gcuaggcucuuccaucagggcaaacacguuugugaguggggucaggugggaguagccuagu

SEQ ID NO: 4142807 - RNA, 79 nt, Human
gcuagggucaguuuugagaaagcgugcauccaauugugucaugcacagaauuuucucuuuacaaugaacuggacccagu

SEQ ID NO: 4142808 - RNA, 59 nt, Human
gcuagggugugccggggcuggagcuccccguggacacggcuccuggaggcaccacuggu

SEQ ID NO: 4142809 - RNA, 111 nt, Human
gcuagguagagaaggauuaaaucagaugauuucaaucaacaucuauggguugcgcccuauauuaugugcaaacuauucugcuugaaauuauucucuugaaaauccaccagc

SEQ ID NO: 4142810 - RNA, 75 nt, Human
gcuaggugccugcguccacggcugggagacgggccguagccgagccgcucccuguuugggcggaggaaccauggc

SEQ ID NO: 4142811 - RNA, 74 nt, Human
gcuagguugucagacuacuugugggcugggcugugacaucuguuggguccuccagugguacuggccaauucugc

SEQ ID NO: 4142812 - RNA, 74 nt, Human
gcuagguuuuccaauuugguagucaucggacucauguagcuaguggcuaccauauuggacaucagagcucuagc

SEQ ID NO: 4142813 - RNA, 76 nt, Human
gcuaguaggggguaggggagaauuucaacucagguggcuggacuccaagagccauccucucuccaucccacugugc

SEQ ID NO: 4142814 - RNA, 77 nt, Human
gcuaguuaaaggacaucccacagguuugauuaaaacuuugaagauuaaaucuguucucaugucuguaugaaacuggc

SEQ ID NO: 4142815 - RNA, 79 nt, Human
gcuaguuccucaggcuuaacuugucuugauauaaagggaaugacuucauggaggcagguuagccagacgaaguucuagc

SEQ ID NO: 4142816 - RNA, 69 nt, Human
gcuauaagccaggaagagagccuucaccagaaaccaaauugguucgcaucuugaucauggacuucuagc

SEQ ID NO: 4142817 - RNA, 130 nt, Human
gcuauacaagugaguuguaggaguguaguaugguguugagagagucaaggaacugcaaagccaaggugucauugcuuccuugagcucuccaaucccagccuaggucagcccuacuuacuccagcuguagc

SEQ ID NO: 4142818 - RNA, 82 nt, Human
gcuauaccaguucuuucucuguuucuggaauauuuuuucugucugugucaaauucuaguuacauaaaguggacuguuguggc

SEQ ID NO: 4142819 - RNA, 77 nt, Human
gcuauauguaaauuucccgggccauuuaaauuaucuucauguccugguguuuaaauggagggggaaauacguuaagu

SEQ ID NO: 4142820 - RNA, 57 nt, Human
gcuaucccaccaaggucccagugcaaagaugucccucccaggcgccugguggggagc

SEQ ID NO: 4142821 - RNA, 90 nt, Human
gcuaucuaaauaucaccuggaauuguuacaccaugcagugaauguuuaagaaaugagaguggacgauuuugguugaugguuuuaguuagc

SEQ ID NO: 4142822 - RNA, 70 nt, Human
gcuaucucuucugauugcagggcaaguaauuaagugagaaaugugagcccugcagucagggugagauggu

SEQ ID NO: 4142823 - RNA, 60 nt, Human
gcuaucugguggcgugacuaagacuuugauagucagaucauagguguguuaccaguuagu

SEQ ID NO: 4142824 - RNA, 105 nt, Human
gcuaucuuuuaguggagcuuugaaauuauguuucagacaacuucgauucaguucuagaauguuugacucagcaaauucacaggcucaucuuucuaacuugauggu

SEQ ID NO: 4142825 - RNA, 61 nt, Human
gcuaugaacagacagcugugggguugugucuagaccacacaauguaagaguuuguucaugu

SEQ ID NO: 4142826 - RNA, 69 nt, Human
gcuaugagacuguggcugcguguaaggaacuaagcagguucuucuuaccucagccauauuucucaaagu

SEQ ID NO: 4142827 - RNA, 130 nt, Human
gcuaugauacaagauaacaauauacaucagcaguacccaguuauuuugucuuuguaguuuuauuagaaaauaauuucuuggcugguaaaguuccugcugguauaccuuguuucucugugauuagaucugc

SEQ ID NO: 4142828 - RNA, 83 nt, Human
gcuaugauagcaaauauuuuaaugagcacuguuuuuguauauacaguaauuuuuguucuauugaauuauuuugcugagauagc

SEQ ID NO: 4142829 - RNA, 62 nt, Human
gcuauggaaggcccuguuuguagaaggucuugaaugccaaucucagcagggccauccugagc

SEQ ID NO: 4142830 - RNA, 62 nt, Human
gcuauggcuuguugaagugacuugcuaugugguuugcuuaaguccuucagcaaguuaguggc

SEQ ID NO: 4142831 - RNA, 60 nt, Human
gcuauguguguuuugcugcagcucuauucuccaugccugcaacagcauccgacacauagu

SEQ ID NO: 4142832 - RNA, 75 nt, Human
gcuauguugcaguugcauaugccccuacagauugauauuucccaauaguauuaacauagcaagcugacaaucugc

SEQ ID NO: 4142833 - RNA, 71 nt, Human
gccuaucaaguggcagcaaaugccuggacuaaaucccucuguggaauggagcaggacugcugcccucaggu

SEQ ID NO: 4142834 - RNA, 75 nt, Human
gccuauuuuguacuuguuuguguuaaucaauguuaauuacaaagcaagcacagggguuaacgaauuauaaugggc

SEQ ID NO: 4142835 - RNA, 67 nt, Human
gccucaaaauuugguuuuucuuucucaugaugaccuaaucugucaggaagcuaccaauuuuguaggc

SEQ ID NO: 4142836 - RNA, 84 nt, Human
gccucaaauaugucuuuauuagcagcaugagaaugggcuaauacagugugugcccugcaguuguuagauguuuauguauuaggu

SEQ ID NO: 4142837 - RNA, 61 nt, Human
gccucaagagacgggcaaggcaagagcccuagagccugucuaacccaugucucugcagggc

SEQ ID NO: 4142838 - RNA, 66 nt, Human
gccucaaucccugcccucagugcacccggcagcaggcgcugggggagcuggcgggcaggcucaggc

SEQ ID NO: 4142839 - RNA, 59 nt, Human
gccucacagcugcuucaggauccagcauuaugcuggaaagguaugggggagcugugagc

SEQ ID NO: 4142840 - RNA, 78 nt, Human
gccucacuaggacacagacugauugcagcauuucugcacauuuucugcaguucugcuugcuccacuuuccugugaggu

SEQ ID NO: 4142841 - RNA, 88 nt, Human
gccucacugaggaaugagggagauguuggugcauuugaggaacucagaggcauguaccaacaucccccucauuccucaaucuuuaggc

SEQ ID NO: 4142842 - RNA, 73 nt, Human
gccucacugccuguagcccugagaugugggacccagaccaagaagaaccacagccaggagccaugggcagggc

SEQ ID NO: 4142843 - RNA, 67 nt, Human
gccucagaaucuuugcugagcucuggaguuuccaaagcuccagucucuuucggagacacugaguugc

SEQ ID NO: 4142844 - RNA, 65 nt, Human
gccucagagaguucucaugcuuuccaguguggcacaggaagcaguagaacuuuuccuuauguggc

SEQ ID NO: 4142845 - RNA, 64 nt, Human
gccucagcaucaacauucucagcucuggucacauuguagaguugucuagugugaucuccauggc

SEQ ID NO: 4142846 - RNA, 68 nt, Human
gccucagcaugcagccccuggcagcuccugccgugugugagggcagccaagggugugugcccacuggc

SEQ ID NO: 4142847 - RNA, 57 nt, Human
gccucaggacuggcauacucauacucacuggacaaagaggaugccauccugaauggu

SEQ ID NO: 4142848 - RNA, 105 nt, Human
gccucaggaggaaaaggggggcacggagcuugucacuggggggcagagggagaagcaagccccugcccccagcucucaagcucaaaggccuuccugagcugaggc

SEQ ID NO: 4142849 - RNA, 72 nt, Human
gccucaggcuagcuggcuguggauuccaugccaagacacaccgcccagacacaucuccagccagcaggaggc

SEQ ID NO: 4142850 - RNA, 55 nt, Human
gccucaggugcaucucucauuccaagugucuggaaggaguaacugaaucagaggc

SEQ ID NO: 4142851 - RNA, 56 nt, Human
gccucagugauaugugggacaauaucaaguggucucacucauauauaauugaaggc

SEQ ID NO: 4142852 - RNA, 58 nt, Human
gccucaguguccuccuccaugugacggucaugucccuguggguggauggcagugaggc

SEQ ID NO: 4142853 - RNA, 61 nt, Human
gccuccacagagaugcugauuguacgcaugcugcguaagccucagauuuuucuguucaggc

SEQ ID NO: 4142854 - RNA, 58 nt, Human
gccuccagaagcgggagagaagacauuccuguuguuuuaaacuccccuaguugguggu

SEQ ID NO: 4142855 - RNA, 78 nt, Human
gccuccagcaaggcuuauagcuuauauuuaaggcuuauagcccugaaacauaggcucuaagcagagaguggcuggggc

SEQ ID NO: 4142856 - RNA, 76 nt, Human
gccuccagccagugugaccgaggaggacaguaugagauggcagggcccuguuuucagcuaagucacacgcugaggu

SEQ ID NO: 4142857 - RNA, 55 nt, Human
gccuccagcgcgauccacuccggggcgcagcggccuccccggagcgcuaggaggc

SEQ ID NO: 4142858 - RNA, 76 nt, Human
gccuccagcucugcuguacuuuugcaggucacagcccgugcacgguguuugguuugcaguacaggagucugugggu

SEQ ID NO: 4142859 - RNA, 58 nt, Human
gccuccaggucggucuuucucuuuccgguuugcugaugaggaaacuuauacuuggagc

SEQ ID NO: 4142860 - RNA, 77 nt, Human
gccuccauggugcuggguguucacccgaggcgcucccucgaggacagugcuuucccugaaaccuucccaguggaggu

SEQ ID NO: 4142861 - RNA, 77 nt, Human
gccucccauggugccugaauccccucugaggcugcaccucgcugaaggagucucuaggaucagacacccaggcaggc

SEQ ID NO: 4142862 - RNA, 88 nt, Human
gccucccuccgugggucccgcagggugggccugucuggccauguguccaccacagagcuggcggcccgcccuccccaggcagggaggc

SEQ ID NO: 4142863 - RNA, 87 nt, Human
gccucccuggccucugaguguccuggugggggcccugcaggagcagaugcuagagcccuuccuuagacagcaggauccagggcaggc

SEQ ID NO: 4142864 - RNA, 66 nt, Human
gccucccugggagacugguacuauuauucccauuuuacagaugaugaaaugcuggcucagggaggu

SEQ ID NO: 4142865 - RNA, 129 nt, Human
gccucccugggcccugaggacggagcggguuacacaggcucccuggaauguuggcugcccccaggaguagccgccuguucuugggaauucugugcugaccgcggcagccccgcaggggcccgggguugc

SEQ ID NO: 4142866 - RNA, 78 nt, Human
gccucccuuuuauuuccuacuuucuuucccaagaggugggagcugaguccacgggauugaggguggggguuagggggc

SEQ ID NO: 4142867 - RNA, 82 nt, Human
gccuccgccuagaagugacucacauugcucauauuucuguaucccagacuaguaacaugaguuuuucuaauggcaaggaggc

SEQ ID NO: 4142868 - RNA, 82 nt, Human
gccuccgcuagagggcuggcuugggaaggagguggaaagcuuccauaaugagauucccagcccggcucagucaagcagaggc

SEQ ID NO: 4142869 - RNA, 108 nt, Human
gccuccuaacugcccccggcugggaguggccugccugggagcagcaggggcaagagggcaaggccuguuggaagguguaggcccccagcagggcgcugugcaggaggc

SEQ ID NO: 4142870 - RNA, 86 nt, Human
gccuccuagaagucacuuucuacuugguuucucaaguucuuuguccuugcuacuuaagaaucaaagagaaauacuuugaaggaggc

SEQ ID NO: 4142871 - RNA, 130 nt, Human
gccuccucaacuuuccacaacccaucucuggaacugacucauaaaauagaaaccacugcucaaacucuaacaggguuacagcaacagguuuauuaucuuaugacuguaguucuccagaaauuguagaggu

SEQ ID NO: 4142872 - RNA, 97 nt, Human
gccuccucuauuuguuuauuuuacuguauauauuuaaggcacguaacaugaggcuuugauauaaguauacauagugaaaugguuacuagagucaggu

SEQ ID NO: 4142873 - RNA, 83 nt, Human
gccuccuguuaacccuguagcagcugaccuggcuaagggagcucaggcccugccaucuccccuguuacacuaggucacugagc

SEQ ID NO: 4142874 - RNA, 60 nt, Human
gccuccuguuguggcucuagccucaguggcgcugagcuacaguugcccucagcaggaugc

SEQ ID NO: 4142875 - RNA, 63 nt, Human
gccuccuuccacagcucacacuggucugccccuucucaugccagugauugccuggaaggaggu

SEQ ID NO: 4142876 - RNA, 61 nt, Human
gccuccuugcugcucccaagaggcagcugcaaacuguugcacugcggaguagcgagguagc

SEQ ID NO: 4142877 - RNA, 80 nt, Human
gccuccuuugugucagauuaauagcaauaauaagugauaaucacuugcuacaucuaaaucugacuaaagcagguggaggc

SEQ ID NO: 4142878 - RNA, 64 nt, Human
gccuccuuuuugaaauagacuuauaaaggauacaacucuauuauuuucuccucagaaagugggc

SEQ ID NO: 4142879 - RNA, 84 nt, Human
gccucgcuuccggucuuccucugcggcgccgggcgcgggcccgcggcggccagcgcuuccggucggcaggaggcggggcgaggc

SEQ ID NO: 4142880 - RNA, 80 nt, Human
gccucggcauucuggugccuggcuggagguuggggguugcacuccugcagaccucagucaggucuccucuguucuuaggc

SEQ ID NO: 4142881 - RNA, 112 nt, Human
gccucgggcccagggugggggcauuccaggggccuccucacccugcucaggcaggccggcugggccagcagcugugggguggccagaugccccaccccuggcgccuuuaggc

SEQ ID NO: 4142882 - RNA, 130 nt, Human
gccucuaaugugugcuauuucucaugaggaaccugacacuauaugacacuucaguuaaagcuucugaaauauugcaauggcauaauugacagguuuuuugguguggugacuuucuuguacauguaaacuc

SEQ ID NO: 4142883 - RNA, 77 nt, Human
gccucuacagcagaucagaacauuugcaggauguuaaugaccauuuccuguucauuuuuugacucugcagugaaggc

SEQ ID NO: 4142884 - RNA, 69 nt, Human
gccucuacugccggcgccugcgguuccuccuggccccaaggcaccgcugcaggcgccugcggucucugc

SEQ ID NO: 4142885 - RNA, 70 nt, Human
gccucuagaacuguagagaauacauuucugucuuuuguaggauacugagauuuacauguucuaguagagc

SEQ ID NO: 4142886 - RNA, 130 nt, Human
gccucuagccuuuuguucaguuucuccugcuuagggcaccuuucaucccaucuagaugugucucucuuuaacuauucuaggaguugauaaaagggcuaggaaguaggaaguugggaagaaggggaggggc

SEQ ID NO: 4142887 - RNA, 63 nt, Human
gccucuauuuuuucucugaagugggaggcaagaccaucugcugagaaugaggggguagaaggu

SEQ ID NO: 4142888 - RNA, 69 nt, Human
gccucucccgaguguccgugcagccccagaccugagcgcucgucuuccgggacggacacgcggcacggc

SEQ ID NO: 4142889 - RNA, 58 nt, Human
gccucucucuacccaguaugaugcuuggauuggcaaucaaaggauguagagaagaagc

SEQ ID NO: 4142890 - RNA, 74 nt, Human
gccucucucugccaccuccuuggagcguuuugagcagcugcacgagaugugccuccaaggggugcacuaguggc

SEQ ID NO: 4142891 - RNA, 92 nt, Human
gccucucugcaucugcguguccagccucuccugcgugccagaaguucccaggcaggaguguggugggacauccggcugggguaaggacaggc

SEQ ID NO: 4142892 - RNA, 59 nt, Human
gccucugaagcagggagugucugcauuaaaaaugaccuguaguucucugcuucauaggu

SEQ ID NO: 4142893 - RNA, 56 nt, Human
gccucugaggcagugaguguucuugagguggaaagcccaggugcagccucugaggc

SEQ ID NO: 4142894 - RNA, 57 nt, Human
gccucugaugaugaucgagcuguggugauccuaucagccaagcagccaucaucuggu

SEQ ID NO: 4142895 - RNA, 61 nt, Human
gccucugcacuguggcacaccacugacauuaaauccagucauggccuaaguggcaugaggc

SEQ ID NO: 4142896 - RNA, 78 nt, Human
gccucugcaggugcgguuaucccuggaggcgcuuccauuaaguccagucagccucccucuuacccauuuugcacaggc

SEQ ID NO: 4142897 - RNA, 60 nt, Human
gccucuggagcuuguuucagaugguggcacugcccagcacuaucuggcaagcugcagggc

SEQ ID NO: 4142898 - RNA, 64 nt, Human
gccucuggcugucccgaugagcagagauuuaagauccuguucuccauaaagauggcuagauagc

SEQ ID NO: 4142899 - RNA, 80 nt, Human
gccucuggcuucccacucugccgggcugccucucauuaucucauuuguugcucacaguaucccugggaggucagaagggc

SEQ ID NO: 4142900 - RNA, 128 nt, Human
gccucugguggugggaccuacuuaagucugacggaccuguccuguccaggccagugcccagggaaggugugggaggcccuuugagccuggccugcagagaccauccguguccccucccaccuucaugc

SEQ ID NO: 4142901 - RNA, 64 nt, Human
gccugcugugcccacucggggccaguguccuuggcagcuggaacccgggugggcagcggggggu

SEQ ID NO: 4142902 - RNA, 108 nt, Human
gccuggacacaaaagccaugagucccuggccagccugucgaugcccucccucaggucagguguguaccgcaggcugcccuuguguggcuuggacuuuuggucacaggu

SEQ ID NO: 4142903 - RNA, 64 nt, Human
gccuggagaaaggaaggugggaaggccaggacucggacuuaccaccugacuccuacuccagugc

SEQ ID NO: 4142904 - RNA, 55 nt, Human
gccuggagagcacugugcgcuugcugcacagaaguacacugcagagucuccaggc

SEQ ID NO: 4142905 - RNA, 61 nt, Human
gccuggagcaggagcugcagaggaggggcuccaggagcccagcuggccauuugcuucaggu

SEQ ID NO: 4142906 - RNA, 61 nt, Human
gccuggagcucggcugagggcgcaaacacggacguggggcgccaccugcgggugcccgggc

SEQ ID NO: 4142907 - RNA, 56 nt, Human
gccuggaggggcccaggcccaagaggauucuuuaccccuggaagagcuccccaggc

SEQ ID NO: 4142908 - RNA, 79 nt, Human
gccuggaguucagcaugucugggccggugcacccugggcccuggacucagucuggccugcccagagcagcucugcaggu

SEQ ID NO: 4142909 - RNA, 112 nt, Human
gccuggaugaauuaauuguuauaguuuccaaggagucuuaaguuacauugguguucaaacuuguuugcaugauagaaaggacacuuggugauuaugauguuguuuucagagc

SEQ ID NO: 4142910 - RNA, 81 nt, Human
gccuggcaagagcagcucacaccucaucaggguggggccaguaggugccccaggaauuuuggugucugcugcugccauggc

SEQ ID NO: 4142911 - RNA, 71 nt, Human
gccuggcacagaggaaggcucugggaauguuugggccggauggaucugggagccucuuuugcaugccaagc

SEQ ID NO: 4142912 - RNA, 66 nt, Human
gccuggcaggaaucuggcgccccuagugacucugaggauggcaaaggggcuuauguuucuccaggc

SEQ ID NO: 4142913 - RNA, 60 nt, Human
gccuggcaggggaggugcuugcuuagaggguggaacgucuagcucuguacaaccugaggc

SEQ ID NO: 4142914 - RNA, 69 nt, Human
gccuggcccuggagcuagacuaggacauuggcgccuagagccugugucuggucugcccagguucugggu

SEQ ID NO: 4142915 - RNA, 84 nt, Human
gccuggcucagugagcugucugagucucuuggcuuuagggccaaggggccuuuagacacuauauaggaaagcagugggcuuggc

SEQ ID NO: 4142916 - RNA, 68 nt, Human
gccuggcuccaggucaugcacucaccucuaacauaagagaugcuugagaugcggccuggagugaaggu

SEQ ID NO: 4142917 - RNA, 56 nt, Human
gccuggcugccggccuuggcaauauucccaaugcguuccugaggcuucgccagugu

SEQ ID NO: 4142918 - RNA, 82 nt, Human
gccuggcugcugcugugacagagucucauggaggcggcacugccuccagcagccacaccucuggacacggaaggcagucugc

SEQ ID NO: 4142919 - RNA, 72 nt, Human
gccuggcuuuaaacacuggggguuaaugcagaaucuggagagagcugucaaacucccaguuugauacguggc

SEQ ID NO: 4142920 - RNA, 56 nt, Human
gccuggcuuuuguuuauaaauucucaagggaguucuccuucaacaggagccaaggu

SEQ ID NO: 4142921 - RNA, 77 nt, Human
gccugggaaggggguugggcuguggucugauuguuuugcuaucagagccaggcccagcccagcccuucgauccuggc

SEQ ID NO: 4142922 - RNA, 69 nt, Human
gccugggaccagggaaaggggagccaagcgucagccuggucucucuagugccaugaaaguccuccaggc

SEQ ID NO: 4142923 - RNA, 64 nt, Human
gccugggagauuaauuaggaaggaugccaagaaaauaucucagccuauguucuaaucucucagc

SEQ ID NO: 4142924 - RNA, 55 nt, Human
gccugggauagaggcaaugcauggacccaacagccuguguuccucuccccaaggc

SEQ ID NO: 4142925 - RNA, 68 nt, Human
gccugggcaccaagcacuaggacuucagucucuagggccacagaggggguccuucugcuuagccaggc

SEQ ID NO: 4142926 - RNA, 69 nt, Human
gccuggggaacgcagcgagcagcgccggccgggcagacucucaccagugcgcaugcguggcucuccggc

SEQ ID NO: 4142927 - RNA, 62 nt, Human
gccuggggagccgccugagcccccgaugcugggaugcggcgguggggccggcucacccaggc

SEQ ID NO: 4142928 - RNA, 69 nt, Human
gccuggggauaggagauugggaguguuucuguccgaggaacacuuuuuccuccugucugguuauuaggu

SEQ ID NO: 4142929 - RNA, 96 nt, Human
gccuggggcaggggaaugggagagaggaaggcucugaguacuacuggaagacacacauacccaggcuuuucucuugccccauccucuauuccaggu

SEQ ID NO: 4142930 - RNA, 99 nt, Human
gccugggggcccaucagugcucugggcugccugacaugaggcccuugggucucugugccucaguguccucgaguuccaguugagaugggugcccauggc

SEQ ID NO: 4142931 - RNA, 64 nt, Human
gccuggguaggagacaaaagguguguauccacagcacagaacgaccuacuguauccacccaguc

SEQ ID NO: 4142932 - RNA, 67 nt, Human
gccuggucccugauagguggcugggcugacaccaggcacugggcucaguccuguaggggcuccaggu

SEQ ID NO: 4142933 - RNA, 59 nt, Human
gccuggugauucacucuauaaugaggcagaacacaaugucucgagucaagacacuaggc

SEQ ID NO: 4142934 - RNA, 78 nt, Human
gccuggugcuuuauggagcccaucucauuccauccucaacagccugaaugaggcagauguugcaugaggcccugaggc

SEQ ID NO: 4142935 - RNA, 59 nt, Human
gccuggugucuccccaaggaaguggugggacagggucuucaugggggcaggccccaggc

SEQ ID NO: 4142936 - RNA, 62 nt, Human
gccuggugugauugagcccaggugguggcaauuaaucccuaagaagcaaagugauaccaggc

SEQ ID NO: 4142937 - RNA, 86 nt, Human
gccugguuccuuuuucucacacaacgaaccaaaauaaguguguauaugugcauguaggaauguuuguguaugggaaaaggucuggc

SEQ ID NO: 4142938 - RNA, 71 nt, Human
gccugucaggauggggcugugggcaaagccugcugacuuaggcaccagcucagaccccacccuggcagagc

SEQ ID NO: 4142939 - RNA, 91 nt, Human
gccuguccgggagccccagaacccgguggaggcagugggaugcugcaguaucuccaguccugguuuccuggaugggguggcugguacgggc

SEQ ID NO: 4142940 - RNA, 63 nt, Human
gccuguccuggaugcucugcaaccaggugcccugcacugccaacaugcaugccaggacagcgc

SEQ ID NO: 4142941 - RNA, 56 nt, Human
gccugucuccuccuuaaaaggugacaaacucaggcuccuucagggaggggccaggc

SEQ ID NO: 4142942 - RNA, 57 nt, Human
gccugucucuuggaacuugguacuacgagaguccuuacuuccuucucagagacaggu

SEQ ID NO: 4142943 - RNA, 57 nt, Human
gccugugaugcccccauaaguaucccuggacacuaacaaaaugggaggcacagaggc

SEQ ID NO: 4142944 - RNA, 66 nt, Human
gccugugcugugggaucugcuccagagggaaaagaguguuugggcccugcagauucuagugcaggu

SEQ ID NO: 4142945 - RNA, 76 nt, Human
gccuguggccugucgggaggcgcucccuucuuguggaggaaggaaggucaagaaggagcucccggcagaccagggu

SEQ ID NO: 4142946 - RNA, 73 nt, Human
gccugugguuuaggcaauaagccucaacugucuuucucgaggauauguucccaggugguuguacuccaugggc

SEQ ID NO: 4142947 - RNA, 97 nt, Human
gccuguguuauuuaucagauuuacgaccgcuaguagcacuuaucaaaagugacguuuauugggugugaaauguucucauuuguuagauaacacaagc

SEQ ID NO: 4142948 - RNA, 96 nt, Human
gccuguguucuccauccucuauccuauucaucauuaaaagaacaaaaaguuuugauuuugaucaugaagaggauaaacugaaaaggguacacacgc

SEQ ID NO: 4142949 - RNA, 82 nt, Human
gccuguguugcccaggcuguuuucaaacuugggcccaagcaguccugcugccucagccuccagaauagcugggauuacaggc

SEQ ID NO: 4142950 - RNA, 74 nt, Human
gccuuaaagaacugaagcucuagucagggacacagauaaguuauucaaugauuagaguuuagugugauaagugu

SEQ ID NO: 4142951 - RNA, 60 nt, Human
gccuuaauuaguaacagaccauuacuggguuccuaucacguggcuguuguaauguuaggc

SEQ ID NO: 4142952 - RNA, 60 nt, Human
gccuuagccugcacuuccuguuuuaaagccucaagguuagcagaggugagagcuuagagc

SEQ ID NO: 4142953 - RNA, 74 nt, Human
gccuuauaaacauaaauauagcuguucuuagccacagaucucuuuuggccaagaaugauaugugaagguagggu

SEQ ID NO: 4142954 - RNA, 63 nt, Human
gccuucaagagcugaaguggcuugcucuggucauaaaacuagagggcagcaagcucugaaggc

SEQ ID NO: 4142955 - RNA, 104 nt, Human
gccuucaagcucuggcauuccaguaagggcugacuuggaacugucacagagaaacugggggacaguaaaugcagucuagcacuuguuuggaacuagagcauggc

SEQ ID NO: 4142956 - RNA, 130 nt, Human
gccuucaccuucauuggcugccgguccugccacuccagacccugcucuggggcucugccuuucgccgcagguucucccgcagagggggucauuggucugggaaggagauugaagaguggggguuggaggc

SEQ ID NO: 4142957 - RNA, 59 nt, Human
gccuucagaggucagcccccagcucucauccugauauggggaucuaggcuuaugagggc

SEQ ID NO: 4142958 - RNA, 58 nt, Human
gccuucaggaaaucaguccuugaauaugaagcccaagucaccaacugaguucugaggc

SEQ ID NO: 4142959 - RNA, 61 nt, Human
gccuucaguaguauccucaugaaccugcgucaugguguuguuagguguaauuaaugaaggu

SEQ ID NO: 4142960 - RNA, 82 nt, Human
gccuucauucugagagucuugaguccgugaguccacaaaugauucugugauucuggaauucuaagauucugugaaagggagc

SEQ ID NO: 4142961 - RNA, 57 nt, Human
gccuucauugccuucccuuucaaagcauggcuugccuuuggacugagguagucaggc

SEQ ID NO: 4142962 - RNA, 56 nt, Human
gccuucccugugcaugucuccucucuuuugaccaaacacaugacaacaggggaggc

SEQ ID NO: 4142963 - RNA, 67 nt, Human
gccuuccugcagcucugagcgugccgagccuagcaagcuugugcuuccaccuagagcugcaaagggc

SEQ ID NO: 4142964 - RNA, 80 nt, Human
gccuucucauugcauggcuucuuggaauggagguugaacaaacaucccgagugccaggaagcauaauguagugggggggu

SEQ ID NO: 4142965 - RNA, 83 nt, Human
gccuucuccugcuguggguuaagacacuguccccaggagucccuuugugcaauacacagugcugaacgacauggaaggauggc

SEQ ID NO: 4142966 - RNA, 95 nt, Human
gccuucugcaaguucuccugaccuucacuggcacugggugagauuagagggagcagaaccuugauuacaauguuccagaggcagagauaggaggc

SEQ ID NO: 4142967 - RNA, 72 nt, Human
gccuucugcugcagagcugcgggugccuggggugagccagugugcaguugcacucugugcccagcagagggc

SEQ ID NO: 4142968 - RNA, 75 nt, Human
gccuucuguagacaauggcugcaggguucuuaugcccaccccacccuguagcuccagccugucuacacagaaggu

SEQ ID NO: 4142969 - RNA, 69 nt, Human
gccuucugucccaggagcuguaagacacugcaccuguggcugucuuaccuuccagcuucuggggagggu

SEQ ID NO: 4142970 - RNA, 89 nt, Human
gccuugaaacuaaaugauggauuuaaacuuucuaaaggaguuccauuuuaauagucuauagagaguucugaaauuaucuuuacucaggu

SEQ ID NO: 4142971 - RNA, 56 nt, Human
gccuugagcugcacggccaggugcaggcugcgcgcccgccgcugauagcucugggc

SEQ ID NO: 4142972 - RNA, 89 nt, Human
gccaggggcucuucucccaggagguguagcugcguggcuugaguguauagcagaggccugaguugggcuuucuggguucgaauccuggc

SEQ ID NO: 4142973 - RNA, 116 nt, Human
gccaggguugucagggagggccauucugagggggugacacuucagcagagacaugaauaaaaacugguagucaacccugggggaagagcuuuccaaacagagaggacagccagggc

SEQ ID NO: 4142974 - RNA, 114 nt, Human
gccagguauuaauccagcuagcuaugccccaguuuccuuacuaaguaauaccuacuuaugcaggugcuuuaguagaaugauacagggcagaaggugguuaagacaauacauggc

SEQ ID NO: 4142975 - RNA, 57 nt, Human
gccaggucgucuccauguccaaacgucaagcacggggaugaguggggagacccuggc

SEQ ID NO: 4142976 - RNA, 56 nt, Human
gccaggugcaccugcccuggccaaugguggacagguggccauggcaucgccugagc

SEQ ID NO: 4142977 - RNA, 67 nt, Human
gccagguguccucacagugaggccuugggcuuacagaccugaguacuucccaugggagauaccuggu

SEQ ID NO: 4142978 - RNA, 74 nt, Human
gccagguuaucaaggucaacauugacagugauaagugauaacauguacccucgauaugaucugaugaaaauggc

SEQ ID NO: 4142979 - RNA, 61 nt, Human
gccaguacuuugugcaacaaauguaauaguaaauaaauuuuauuuguugaaggugcuuggc

SEQ ID NO: 4142980 - RNA, 80 nt, Human
gccagucacucuucuaagcacuuugugaggauuauuacaagacaucaucauaacaggcugagaggauuuaggugacuugc

SEQ ID NO: 4142981 - RNA, 77 nt, Human
gccagucauaaaaauuuauuauguacaggcacuauaccuuuucauguauaggucacuagcauguaaaugaaacuggc

SEQ ID NO: 4142982 - RNA, 68 nt, Human
gccagucucccucaguccucugggccggccgaagcccagacaccuucacaggaugauggagacuuggc

SEQ ID NO: 4142983 - RNA, 73 nt, Human
gccagucuguguacuggguuucuguaaauccucccugagauauggauccucucaguauagugguaaaauuggu

SEQ ID NO: 4142984 - RNA, 61 nt, Human
gccagugaccccuuccuggccuccccacccaggguccccggagggcagagggauuacaggc

SEQ ID NO: 4142985 - RNA, 84 nt, Human
gccagugagaccaguggaggccuugggaccuuuucuuucugguaagcaauagguccaaggagaggucuuuuuugucccuuuggc

SEQ ID NO: 4142986 - RNA, 67 nt, Human
gccagugauacagucaucugauggugcugaaagauucacuuccagacucacucaugugacuauuggc

SEQ ID NO: 4142987 - RNA, 82 nt, Human
gccagugguauucugcuuuaaauaugaauuagcauuagcacuugcagagguuuucuuguuucaaagaugaauuagcccuggc

SEQ ID NO: 4142988 - RNA, 118 nt, Human
gccagugucuggcauguaggaaagucucaaguguuaguauuauucugcuucuauguaagacugagggauaaacacugaugauauggggcuuuugaaguccugaaauguaaaagcuggu

SEQ ID NO: 4142989 - RNA, 60 nt, Human
gccaguguuuauagcagugagggcacugugaucaaauccuccaaaagcuguaaugcuggc

SEQ ID NO: 4142990 - RNA, 59 nt, Human
gccaguuccuguggagucagagagaucuuagcucagaagugcugacagcaggggcuggc

SEQ ID NO: 4142991 - RNA, 65 nt, Human
gccaguugauccagcaauggccuuuguagaaaaauaucuaaucagaaccuugggucauaacuggu

SEQ ID NO: 4142992 - RNA, 58 nt, Human
gccaguuucccaagccauuggcucugcagagaccugccaggaguggguagacuaaugc

SEQ ID NO: 4142993 - RNA, 77 nt, Human
gccauaaauauuucaccucacccaggagaaucaaagcauuuucacauugguucuuacuggggaguugagauaugggu

SEQ ID NO: 4142994 - RNA, 69 nt, Human
gccauagccugggcccugccucuucucugcgcuuugcagaaaucauauucucaguccuucagcuguggc

SEQ ID NO: 4142995 - RNA, 71 nt, Human
gccauagcuuagggguuaaacucacagacauuuaagucacauguucuugaguucaaguccaaguugcuggc

SEQ ID NO: 4142996 - RNA, 72 nt, Human
gccauaggcaggaguaugcagcuaugguuuagcuauccuguggcagccauguauauuguugcagucuuuggu

SEQ ID NO: 4142997 - RNA, 55 nt, Human
gccauaguagcauuuggaaaaauuggagcuacccaagcuucuaaugcugcugagc

SEQ ID NO: 4142998 - RNA, 59 nt, Human
gccaucacuucuguagacuaagucauugaauguuuggguuaaaaugaggaagugguggc

SEQ ID NO: 4142999 - RNA, 68 nt, Human
gccaucacuugggacaaagcuucugcucuagacugcugucuuagcucuuuugcucuccaaguuuuggu

SEQ ID NO: 4143000 - RNA, 61 nt, Human
gccaucagcagcccugugggugacaccacaaacucgcugagcccacagagcaugcugaggc

SEQ ID NO: 4143001 - RNA, 69 nt, Human
gccaucagcuuuaguaacccacugcucuguggacaagaaacaagagcagugugggggcgaagguagggc

SEQ ID NO: 4143002 - RNA, 79 nt, Human
gccaucauauuuuagcccacacaaaucauggggagaaaucguuucucuuucaauuuuguugggaagaagucuuugaggu

SEQ ID NO: 4143003 - RNA, 65 nt, Human
gccauccgcauaguacaggaguccccagccucccuggggacgagaucuuggcagugugggaaggc

SEQ ID NO: 4143004 - RNA, 57 nt, Human
gccauccugaugacaggccacucguuguggccuuauggcaaagucaguugauagggc

SEQ ID NO: 4143005 - RNA, 107 nt, Human
gccaucugaacaauagguuuucauaagaagguaacauccuuaaucuuauuuuuaguuucaggauggaguaccuuuuauaacugagaaaacuucuugugacuuugugc

SEQ ID NO: 4143006 - RNA, 57 nt, Human
gccaucugaugggcuuggagucaggguuccuucuggcugcguggccuuuagcagggc

SEQ ID NO: 4143007 - RNA, 64 nt, Human
gccaucuguagaacaugguguuauauaggcauaugguagacuaguauuucacucuccagauggc

SEQ ID NO: 4143008 - RNA, 58 nt, Human
gccaucuuagucaaaacuucagagaaaacugaaaugaauuaaguuuugauauaauggc

SEQ ID NO: 4143009 - RNA, 65 nt, Human
gccaugaaggccagcagagugaaggcagccauuuugccuucauagaguguaggccuuugcagggc

SEQ ID NO: 4143010 - RNA, 68 nt, Human
gccaugaggcuccgagaagucaguuuacagagaugcaagcaagcaggcuuucuucucugucugauggc

SEQ ID NO: 4143011 - RNA, 105 nt, Human
gccaugauuugguaauggguuuucaaaggaggcagaguagccaagcucuuggcacaagagccagcuguacugccugcucaggaaaucuucucauugcuggcuggc

SEQ ID NO: 4143012 - RNA, 63 nt, Human
gccaugcaauggaauaaaaucacauguuagagaaucaugauaaaauuugaucuguuguaaggc

SEQ ID NO: 4143013 - RNA, 74 nt, Human
gccaugcaggccaagcaggaaucuggccucaggagagagccacuagaggccaugcuagaggccugggacauggu

SEQ ID NO: 4143014 - RNA, 74 nt, Human
gccaugccugaagcaaggguaggcaggucucuuauccccaauaucaccagcccugcucuuccucuggucccggc

SEQ ID NO: 4143015 - RNA, 72 nt, Human
gccaugcggauaucuagggaauagcacucuagguaugggaacagcagugcaaacucccugagguggcagggc

SEQ ID NO: 4143016 - RNA, 68 nt, Human
gccaugcuaaaccagaacauaggaguuuuccagcuaaggacacuauccauguacacuguuugccaggc

SEQ ID NO: 4143017 - RNA, 62 nt, Human
gccaugcucucuggcaacuuguguuuuggcaacucucaaccaugugcccaugagagcauggu

SEQ ID NO: 4143018 - RNA, 58 nt, Human
gccauggaaaugcuuugcgucucugccaaagaaaaguuuugaccagaguuuuccaugc

SEQ ID NO: 4143019 - RNA, 74 nt, Human
gccauggccagguccucugcagcgucucacagaacuugaggagugagacucuggaggggcugguccuauguggc

SEQ ID NO: 4143020 - RNA, 71 nt, Human
gccauggcuucgcgcguccccgcugccgcugcugacucgacacaaucggcgggucgcgcgggggccguggc

SEQ ID NO: 4143021 - RNA, 66 nt, Human
gccauggggagggcagcgccugguugcugggagggcagugacaacagugggcuuguuuuccuuggc

SEQ ID NO: 4143022 - RNA, 56 nt, Human
gccaugggucugcuggcucagcucauggaacaccugcuugauaggcagaccugggc

SEQ ID NO: 4143023 - RNA, 61 nt, Human
gccauguaaagauguguaccuugugcccuggagagcuccagggcauccucacaucgcaggc

SEQ ID NO: 4143024 - RNA, 65 nt, Human
gccauguacuuugugguaauuuguuacaguaguccuaggaaacuacuacaagugaguacaaaggu

SEQ ID NO: 4143025 - RNA, 76 nt, Human
gccaugucagccuguagucugguccaggugaaccgaggaagccuuggggcuuggaaguaggauugggagauauggc

SEQ ID NO: 4143026 - RNA, 63 nt, Human
gccaugucugcuggcuuuacucuucuauucggagacuaaaacaguggcuaguagacagaaggu

SEQ ID NO: 4143027 - RNA, 74 nt, Human
gccaugugcccagcacugugccagucaccagggaucugaugcacugggguggacaugauguggggacagagggc

SEQ ID NO: 4143028 - RNA, 62 nt, Human
gccauuauacucagucucauugccaguucccuugcucaggagacugaggcugaauauggggc

SEQ ID NO: 4143029 - RNA, 61 nt, Human
gccauuauccaggaagagguguguugggaaagauugauuucucugaacuuccuggaaaggc

SEQ ID NO: 4143030 - RNA, 77 nt, Human
gccauucaaaauuacauguacaaacaauucuuaaugccaugagaagcugcuugugcuguauuguuaggugaaguggc

SEQ ID NO: 4143031 - RNA, 72 nt, Human
gccauucgcacaggaaguuucuguuguuucucuaaauacagaacugaacagcaggcuucuaccugauaaggc

SEQ ID NO: 4143032 - RNA, 57 nt, Human
gccauuggccauccaccugaaacugcuccucugcagaggccaccuguggccacuggc

SEQ ID NO: 4143033 - RNA, 74 nt, Human
gccauuuuugggggaaucugauuguagcauuugucacacaauauuguuacaacuauagaucccaagaaaugugc

SEQ ID NO: 4143034 - RNA, 57 nt, Human
gcccaaacauucagaugcaaugguaggaguccuuguccagcaccuggauguuugggu

SEQ ID NO: 4143035 - RNA, 103 nt, Human
gcccaaauacaaaagcaacugugauguuagcucuguguuacaaggaauuucuauauagucccugucuucugccugacacagagcaaacaccauugguaugggc

SEQ ID NO: 4143036 - RNA, 79 nt, Human
gcccaagccucuucuaccuguagcccugaaagcgcuugagaaguucaagugcaaagcugcugcugugguaggaaugggc

SEQ ID NO: 4143037 - RNA, 70 nt, Human
gcccaagcugagccagacagguaagcagagacuuucacugcagugaugcuucuggcucagccccaggagc

SEQ ID NO: 4143038 - RNA, 56 nt, Human
gcccaagucuauagccuugguugaucugaggauugaggauauuaggugauuugggu

SEQ ID NO: 4143039 - RNA, 80 nt, Human
gcccaaucucauggaaguucauucuccuggugcuggagcugcacacacaugaaguugcugagcuaccaugagaagggagc

SEQ ID NO: 4143040 - RNA, 75 nt, Human
gcccaaugccccaacuccuccccagcaugccaagccucugggguuggugcauggggcgggaguaggggaaagggc

SEQ ID NO: 4143041 - RNA, 84 nt, Human
gcccacagccaaggccugcucagcugucugugcugccucuucacuggagggucacagcuuagugagcguccugagggugugagc

SEQ ID NO: 4143042 - RNA, 66 nt, Human
gcccacaggcggaguggcgggcaggagaagccccuggcuccaggcugcccccagccacccgcuggc

SEQ ID NO: 4143043 - RNA, 56 nt, Human
gcccacagguggaagccucggaagggguuccugagaggcugcuccgccugugaggu

SEQ ID NO: 4143044 - RNA, 94 nt, Human
gcuauguuucacagagugcauaauauacaugcuugauccugacucuaaaagccuuaggagaagagacugcauguuaucuuugugccuacagggc

SEQ ID NO: 4143045 - RNA, 57 nt, Human
gcuauuagacacaauuagugauucagauuccaaggaguugcuuuucgugucaauggc

SEQ ID NO: 4143046 - RNA, 64 nt, Human
gcuauuaggcuuccauuucaugcacaaaugaauuaugcagagaaugccauagcuuaguuucagc

SEQ ID NO: 4143047 - RNA, 130 nt, Human
gcuauuaucguaguuaauuaaaacauuuauugaaagcuuguuugugcaugauggugugugaagcucugugcaacauuuguacuaaagaaguucacuuuuuacuaaaaguuuauaaugugacgcuauaaac

SEQ ID NO: 4143048 - RNA, 109 nt, Human
gcuauucacuguaucuguaauauacgcugucuaauguaucuguaaggguuaaaucaaguuucuagcacauacauaauagauagaagcuauuauucacccaggugaaagc

SEQ ID NO: 4143049 - RNA, 61 nt, Human
gcuauucucagugggaagggcacaguucaggauacucaauuaucucuugccacuguuaagu

SEQ ID NO: 4143050 - RNA, 63 nt, Human
gcuauucuggcucuuugggugauuguaaauaaaucuuuugcaauguccuggaaccagaucagc

SEQ ID NO: 4143051 - RNA, 90 nt, Human
gcuauugacaucuagggccagauauuucuuuguuucagggucuguccuuugcauucuagauguuuagucuacccacuagaugccauuagc

SEQ ID NO: 4143052 - RNA, 90 nt, Human
gcuauuuccugggauuaagguggugauuuaccuuauauuaagcugugaaaguucuuauuauuuuagucaacacauuaaaccuagggaggc

SEQ ID NO: 4143053 - RNA, 62 nt, Human
gcuauuuuuaaucagcuacucuaacgccugaaagcuuagcugaguggcugauggaaagaagc

SEQ ID NO: 4143054 - RNA, 60 nt, Human
gcucaaaaugguucagaauugugguugcucaucagcuguuccuuucagaagcauuuuggc

SEQ ID NO: 4143055 - RNA, 61 nt, Human
gcucaaagaccagacagaggagcuugggauuagaguagagagccuuguuuggucuuugagc

SEQ ID NO: 4143056 - RNA, 58 nt, Human
gcucaacucuguggcugucccacaaaagcgaccagugaccagacagacaugagugagc

SEQ ID NO: 4143057 - RNA, 57 nt, Human
gcucaagcccuguugucugaugaugggaaccucccugucucccuggcauggcucagc

SEQ ID NO: 4143058 - RNA, 104 nt, Human
gcucaaggaaacucaggcaagggaguuacugagggcggggccccgagggggacgaccugccaaccucugugccuucucauucucuuuccuggccccuuaggagc

SEQ ID NO: 4143059 - RNA, 55 nt, Human
gcucaaggacacucccugcugggcauaggaugugccugcaaaaaguucccugagc

SEQ ID NO: 4143060 - RNA, 57 nt, Human
gcucacacuuucugauuuuaaaacuuacuacaaagcuacguuaaucagaaguguggc

SEQ ID NO: 4143061 - RNA, 78 nt, Human
gcucacagaugcugugggucaggacuuaaagcagaauauagcaggaauggcuuuucucuguuccacagugucuggagu

SEQ ID NO: 4143062 - RNA, 71 nt, Human
gcucacagguccuuccugcccugggguccgggcuuggcucugccccuccagcgcgggggggaguugggggc

SEQ ID NO: 4143063 - RNA, 77 nt, Human
gcucacagucugcugagugcagauguaaacaacuagauuuaaugcaagacacccugcacuauagcagcaaugugagu

SEQ ID NO: 4143064 - RNA, 61 nt, Human
gcucaccaccgaacaacaagggcaagaagaaccagccuucugcucugaaguucggcugagc

SEQ ID NO: 4143065 - RNA, 61 nt, Human
gcucacccaccucacuggauuauuguaaagagggaaaagauaaaugugagcagggcugggc

SEQ ID NO: 4143066 - RNA, 74 nt, Human
gcucacccucgcaggccgggcacugcgcuaggugcugaugcugcaccucauucaacccuggccuguggggcugc

SEQ ID NO: 4143067 - RNA, 70 nt, Human
gcucaccuguaaucucagcuaaucaagaaguucaggcagaauaaucacuugaaacugggaagcagggggu

SEQ ID NO: 4143068 - RNA, 59 nt, Human
gcucacucacacagguugaacccggguuuccccucaccuuuuucaccagugugaugggu

SEQ ID NO: 4143069 - RNA, 56 nt, Human
gcucacugaugugguguuggcaggauucaguuccucaugggcaccagacggagagu

SEQ ID NO: 4143070 - RNA, 75 nt, Human
gcucacugcacacauguuuaaguggaaaauccgauuucacaacuccuuuccauaauuguucaugugaguaggagc

SEQ ID NO: 4143071 - RNA, 88 nt, Human
gcucacugguagcuggaacuggguuuguuggagggaccaucauaaucacugccucuaaagcaaggccuuuccaaugacaguagugagu

SEQ ID NO: 4143072 - RNA, 82 nt, Human
gcucacuguggaugagggagugaacaaagauaccugacauguuuuaguggacuuuuaucacuguucucaccaucagacuagc

SEQ ID NO: 4143073 - RNA, 69 nt, Human
gcucagagccaguuagcaggugcccagggucugucuaccaccugucaagcauugcugcugccucugugc

SEQ ID NO: 4143074 - RNA, 61 nt, Human
gcucagaggccacuguuggaaaugaagcugacagcuguagguuaaugaggaggcccugggc

SEQ ID NO: 4143075 - RNA, 57 nt, Human
gcucagagguuguucuuggguuucuuucagcuaauagcuucagaauggccucugagc

SEQ ID NO: 4143076 - RNA, 63 nt, Human
gcucagagugggccuagcuguaaaaggacagggguccuucuccagccacgcccacucccgggu

SEQ ID NO: 4143077 - RNA, 97 nt, Human
gcucagaguucacuguucucuuucuguuucauaugcucagguguguugcuaaacaugagaugcugggaaacugaaaggaauacguaagaaagauggc

SEQ ID NO: 4143078 - RNA, 91 nt, Human
gcucagcccuggcuaaucagcaggaaccacugccccccugugggggcagggacaaggcagguguucugagcuugggagccagggccagggc

SEQ ID NO: 4143079 - RNA, 129 nt, Human
gcucagccugguagguagaaacagcccagagauguagagugauggcaggcaggugaguagagcccuguaagcgcagauucuggaaccagccugccuggggucacauccuggcuccaccguaggaugggu

SEQ ID NO: 4143080 - RNA, 61 nt, Human
gcucagcggagaagaaucuguggccugcugacagggaccauguguugauucucugcagagc

SEQ ID NO: 4143081 - RNA, 59 nt, Human
gcucagcucaccuguggaaugcccucaucuacuguguggcuccugggaugggacugagc

SEQ ID NO: 4143082 - RNA, 56 nt, Human
gcucagcugcaccuggagagccccaugugaguguggcacuucuguugcugcugggc

SEQ ID NO: 4143083 - RNA, 74 nt, Human
gcucagcugguccaggguguaguacagaggcaccugugggagcuccucagucaugacgcucaggacccucuggc

SEQ ID NO: 4143084 - RNA, 126 nt, Human
gcucaggaaacacuaagcaaauuccaacagauuagcaaaggugauuuagauauauuauguugauuuagauaucaacaugcuaugagagauuacuucuacugaucacagcagcuaagaagacugagu

SEQ ID NO: 4143085 - RNA, 58 nt, Human
gcucaggagcucuugguggcgcggguccgcuuccgcuucaccaucacaggcuucuggc

SEQ ID NO: 4143086 - RNA, 81 nt, Human
gcucaggaggucucaaacucuagggcuccacauuccuuuucuaggaguuuugucuguccugggguauugugaaagaugggc

SEQ ID NO: 4143087 - RNA, 66 nt, Human
gcucaggaucgcuugcccuagggaagugacccaaaccuucacaccugaagggucaggguccucagc

SEQ ID NO: 4143088 - RNA, 56 nt, Human
gcucaggcaauccaaccgcuucggccucccaaagugcuaggauuacaggcgugagc

SEQ ID NO: 4143089 - RNA, 55 nt, Human
gcucaggcccagcggcuggugucacuggggccgguggcugggagcugaacauagc

SEQ ID NO: 4143090 - RNA, 55 nt, Human
gcucaggccuggcuauccauugcugacaaagaaagcugguuugccuggccugggu

SEQ ID NO: 4143091 - RNA, 58 nt, Human
gcucaggcuggauugcaguggcacaaucuccgcucacugcaaccucuuccuccugggc

SEQ ID NO: 4143092 - RNA, 73 nt, Human
gcucaggcuuguggcgguugugggcauccgagacuguuuugugcacuuguccaaagccgacugacaucugagc

SEQ ID NO: 4143093 - RNA, 92 nt, Human
gcucagggagguuaaggaaauggcuagcuuagagucaugcuagaccuuggucuagaugagccuuuaaacuagauguccuugcucucuagagu

SEQ ID NO: 4143094 - RNA, 59 nt, Human
gcucagguguguggcucuggaccaugugggaccaggugguuccuucccugcccuucagc

SEQ ID NO: 4143095 - RNA, 65 nt, Human
gcucagguguuauacaugaaauuuacuuggguggguugcugagugacaccucaaagacaacgggc

SEQ ID NO: 4143096 - RNA, 69 nt, Human
gcucagugauagcaaauaaaauguaaccauuucccuaugguuuugcuguuauaugcuauuauagacagc

SEQ ID NO: 4143097 - RNA, 65 nt, Human
gcucaguuuagcauuuaccgugaugccuggcauaaaugagguaucuguuaugggcugaauugcgu

SEQ ID NO: 4143098 - RNA, 70 nt, Human
gcucauauuuaguguuuggagaucgggggcaacacaacuccuugguuuuugguuuaacacuauguguggc

SEQ ID NO: 4143099 - RNA, 74 nt, Human
gcucaucauguuuggaauguuuuaauauaaauuuugcuacuuugaaagaauuuaagaacauuucaggacugggc

SEQ ID NO: 4143100 - RNA, 93 nt, Human
gcucauccuggaaaugggguucagugaugccuucaggacuuguggaagguuucuggggcaaggggcauuugagcugagccuugaagggugagu

SEQ ID NO: 4143101 - RNA, 88 nt, Human
gcucaucucaauagacuaauuuucuuucacacauaggaugauggauaaacauaucugccugugguggaggaaguuucuugagaugagu

SEQ ID NO: 4143102 - RNA, 88 nt, Human
gcucaucuggccagugccugugggccccgggcagggcacugugcacagggcagagacgcagggggcccaucggcacugcugugauggc

SEQ ID NO: 4143103 - RNA, 65 nt, Human
gcucaugcacgcugccuguuuucugauuguucaacacagucugccucucagagcagcuguugggc

SEQ ID NO: 4143104 - RNA, 66 nt, Human
gcucauggccucggagaaaggcagcuccaccucccaggaggggagcugagcucugagccacgacgc

SEQ ID NO: 4143105 - RNA, 80 nt, Human
gcucaugugaagugcagagaccuggucaggcaugaagaauacagcuuuuccuacugccuuuccaggcucuggccaugggc

SEQ ID NO: 4143106 - RNA, 68 nt, Human
gcucauuaggcaagcaguucucaaguguuuuacuccucggauauacccaacagcugccuugcuugagc

SEQ ID NO: 4143107 - RNA, 56 nt, Human
gcucauuccagauuccaggugugaugucuguggugccugcugugaucuuagugagu

SEQ ID NO: 4143108 - RNA, 80 nt, Human
gcucauuguuccauacgacugaggucucggugucacucacauagccaucgucuccuguguagugugugggguagaugagc

SEQ ID NO: 4143109 - RNA, 74 nt, Human
gcucauuugcccaggcuuggcuaaucuuggcuaagcucuuucacaugucugaagccuugccugggaaacugggu

SEQ ID NO: 4143110 - RNA, 80 nt, Human
gcuccaacacagcuauucuuugugucuguccagaugagcuguccagaugagcugcacaaacacagagaauagauggcagc

SEQ ID NO: 4143111 - RNA, 58 nt, Human
gcuccacagaggcaggggacccaaggcugagccggcugugggcucugcuuccuggagu

SEQ ID NO: 4143112 - RNA, 74 nt, Human
gcuccacugcauuagccuguucauggccaggcacaaagccuggaaaugcccaaacagagcugaccagugagggc

SEQ ID NO: 4143113 - RNA, 73 nt, Human
gcuccagaugaaggcagccgugugacugcauguguacugcagcacgugaagcaggaaggcugcccaguggagc

SEQ ID NO: 4143114 - RNA, 128 nt, Human
gcuccagaugauauuuucugagauuuggguuuaauuuugcuucagauauucaauuaaguuaaagcaaaucacuuucguuugaugggguauuuugcuguuugaaucuggguuggaguuguuauagaugc

SEQ ID NO: 4143115 - RNA, 63 nt, Human
gccucugucauagcucaugugauugaguauagacaucaagggugaguguggcugagaugaggc

SEQ ID NO: 4143116 - RNA, 55 nt, Human
gccucuguuucuguuuuuguucaucuagugaauuaagaacaguagaacaguaggu

SEQ ID NO: 4143117 - RNA, 73 nt, Human
gccucuguuucuucaggaaugaaaugggauaaugagccuuaucucacacugugaagagacaagcagauaaggc

SEQ ID NO: 4143118 - RNA, 67 nt, Human
gccugaaaacucucuguagaggugggcguugggggccucaacccucacucugcacccugcagcaggc

SEQ ID NO: 4143119 - RNA, 66 nt, Human
gccugaagcacccggagcuggcacuguagcucugcucugcauuugccacucccaggugccucuggc

SEQ ID NO: 4143120 - RNA, 118 nt, Human
gccugaagccggcccaguucuuggcucagagcuacugcgucugcagcacagaucugucccugagcacagcucgcaccagcuucccugcaggccuagagcccaagcccuggccucaggc

SEQ ID NO: 4143121 - RNA, 62 nt, Human
gccugaagcuuaauuaugaccagcugcauuuuaguguccagaggucaccaugaguuucuugc

SEQ ID NO: 4143122 - RNA, 77 nt, Human
gccugacccuggggcugccuugcucucugagcaugcuguuccugcugcuucuggggacaggcugccugggucaaggc

SEQ ID NO: 4143123 - RNA, 73 nt, Human
gccugacuggccuugucgugagcuuguuuauccacugcaucugucaggaagcaauuaugauaaggccgcuggc

SEQ ID NO: 4143124 - RNA, 58 nt, Human
gccugacuuauuagacaucuucauuguguaagcaugaugaagaggcugaugauaaggu

SEQ ID NO: 4143125 - RNA, 66 nt, Human
gccugagaagcgcggcgucggcguggguccugcgcagccugccccgcgagcgcccgcugcaagugc

SEQ ID NO: 4143126 - RNA, 63 nt, Human
gccugagaaggacacagcaggucagaggcaggcccucacccuuccugcccugccuccucaggu

SEQ ID NO: 4143127 - RNA, 102 nt, Human
gccugagaauggguuggaacuggauuucauguagcuguaguucuaaaauaauuaucucucuugcugcuauagauuuuaaguuauaacucaacugcuaaaggu

SEQ ID NO: 4143128 - RNA, 82 nt, Human
gccugagguuacuguacaguguagucaugagguuacuguacacuguagucaugagguuacuguacacuguagucacaucagc

SEQ ID NO: 4143129 - RNA, 56 nt, Human
gccugagucuauucuguguguaaggugaggucuuuucaaucauuagaaucucaggc

SEQ ID NO: 4143130 - RNA, 129 nt, Human
gccugauacucaacacuuuaauaugaugauccuuaauauggaagaguucucuacugguugaggagaaaaagguaaugauagccuuguagaguuuccauuuauccaauuaaaggucacuucccucagguc

SEQ ID NO: 4143131 - RNA, 57 nt, Human
gccugaucagguccucggcauacugguaagugaggaugcuggguuugcccaucaggc

SEQ ID NO: 4143132 - RNA, 71 nt, Human
gccugcaaggcagggagguuugcugaccugguguuuguacugguagcuccugaauaucccucugugcaggc

SEQ ID NO: 4143133 - RNA, 58 nt, Human
gccugcaccccaguuuccuuauugucuuucuccuggcacuaaggcagcagugacaggc

SEQ ID NO: 4143134 - RNA, 57 nt, Human
gccugcagaacugugaggcaauacaucuguauuguuuuaagccagucugccuauggu

SEQ ID NO: 4143135 - RNA, 78 nt, Human
gccugcagagcacggagacugucagagcugggguggggccuaucguccagccccacagccugcggucucagcccgggc

SEQ ID NO: 4143136 - RNA, 61 nt, Human
gccugcagccucuucugaaaaucugguaaagacugugauucagaaugcagagacuguaggc

SEQ ID NO: 4143137 - RNA, 63 nt, Human
gccugcaugcaacagugcccuggaaucccagcccaggauuucagcucagucugugcagcaggc

SEQ ID NO: 4143138 - RNA, 77 nt, Human
gccugcauuaaaucuuuuauauggaaacuaauucauuuuucuacuccuggaaagcaggauuguuuccauugcauggc

SEQ ID NO: 4143139 - RNA, 57 nt, Human
gccugcauuucacauuuaaacuuuuauguuuaaaguuguaauggaagaaaugcuggu

SEQ ID NO: 4143140 - RNA, 60 nt, Human
gccugccacgcaugcagagucacuggaacauaugacuuggucuucaaaugcaugauaggu

SEQ ID NO: 4143141 - RNA, 58 nt, Human
gccugccacuagcuuucacaucuuugccaccagggaucuuucugaugcuguggcaugc

SEQ ID NO: 4143142 - RNA, 89 nt, Human
gccugccccacagaggucugggcccagcagagacaagacuugcuccauugcccuucuguggcugucgggcccaucucuguugagcuggu

SEQ ID NO: 4143143 - RNA, 57 nt, Human
gccugcccugcggguggaggaggccauuuggcuggaaucacaugagcuggggcaggc

SEQ ID NO: 4143144 - RNA, 59 nt, Human
gccugccuagaauugcagcuuugcagaguccacugggugcuugggcugaauucacaggc

SEQ ID NO: 4143145 - RNA, 70 nt, Human
gccugccuucuugucucaaaaccauuauuuauagccauagaaugacagagauagaagggaugucacaggu

SEQ ID NO: 4143146 - RNA, 94 nt, Human
gccugcgggccucccagaggugucauucgagcugucuugaaagaugagaaggugcuugccagacacucgaggggggcacacaaucuccgcaggu

SEQ ID NO: 4143147 - RNA, 58 nt, Human
gccugcuccgagagugauugcauuuggcacaauaugcaguuugcuucgcagcaguagc

SEQ ID NO: 4143148 - RNA, 63 nt, Human
gccugcugagcugcugugcacagccucuuccauggcugggacacacaaggucagcucuagggc

SEQ ID NO: 4143149 - RNA, 58 nt, Human
gccugcugagggaaguugggcauggcccuguuccuugcccaagccagccuucacaggc

SEQ ID NO: 4143150 - RNA, 59 nt, Human
gccugcugccgagggucuuuuggggcagucccacugaguacccgauggcugccugaggc

SEQ ID NO: 4143151 - RNA, 64 nt, Human
gccugcugggagacacccccagccucaggcagugcugucggggugggcuaccuaagcugcaggu

SEQ ID NO: 4143152 - RNA, 57 nt, Human
gccugcuuucugacuuugaaggguugguaugcuuccauuuuucauuauaaagcaggc

SEQ ID NO: 4143153 - RNA, 57 nt, Human
gccugcuuugugccugaucuuuagcuccaugugcaugagaaugggucaguggcaggu

SEQ ID NO: 4143154 - RNA, 62 nt, Human
gccuggaagucauuccucguucccuugucugaguggccuggagccgagcuguguuucugggu

SEQ ID NO: 4143155 - RNA, 72 nt, Human
gccuggacuugcugcagaaaccuuuccugauuugaguccuuccaaagcuggaggcuuucuguaucucuaggu

SEQ ID NO: 4143156 - RNA, 55 nt, Human
gccuggcacucacugaagaggcagggcacuggagcuuccuccacaggugccaggc

SEQ ID NO: 4143157 - RNA, 63 nt, Human
gccuggcaggccugggccagcaauaucuagaacacaggccuggcuccaggagaagccagaagc

SEQ ID NO: 4143158 - RNA, 91 nt, Human
gccuggcagugggaggagaccgucugggcagaguugugaugaacuggggaccgagcagccccagcucgccucggagguucccgagccgggc

SEQ ID NO: 4143159 - RNA, 76 nt, Human
gccuggcauagcugcuggauucuguuuugcacauguugguguuugcaaucagaaaguucagcgguccuuccagugu

SEQ ID NO: 4143160 - RNA, 68 nt, Human
gccuggcaugaggagcaugagguuuggggagagacccuuggccaugucguacucuuuacugccaaggc

SEQ ID NO: 4143161 - RNA, 60 nt, Human
gccuggccacaugugugcugagcauggggacacccugccuggcugugugugugcugaggc

SEQ ID NO: 4143162 - RNA, 70 nt, Human
gccuggccuaagcccaggaaugcacuucagcuccugguugagcaaugucacugaggcuugggagucgggu

SEQ ID NO: 4143163 - RNA, 68 nt, Human
gccuggcuaagcagaaggacccccucuguggcccuagagacugaaguccuagugcuuggugcccaggc

SEQ ID NO: 4143164 - RNA, 56 nt, Human
gccuggcuaauuuugguauuuuuaguaaagaugggguuuugccauguuggccaggc

SEQ ID NO: 4143165 - RNA, 58 nt, Human
gccuggcucugaguuucucuccugcagucuucaggggacagaaagcaggaguuuaggu

SEQ ID NO: 4143166 - RNA, 55 nt, Human
gccugggaaaugguggggucaguggcuggcagcucacaaucucaguuccucaggc

SEQ ID NO: 4143167 - RNA, 58 nt, Human
gcccaggaagccaccgggaaguuuugccggagcugauuucuaggggauuuucuggugc

SEQ ID NO: 4143168 - RNA, 76 nt, Human
gcccaggaaguggccuucaggcacugggguuuagaugcaggaaccucuguauaguugccuguggccacaucugggu

SEQ ID NO: 4143169 - RNA, 58 nt, Human
gcccaggaauuggaggcugcagugagccgugaucaugccacugcacuccagccugagc

SEQ ID NO: 4143170 - RNA, 71 nt, Human
gcccaggaccugccccagccccaccugccaccugaccugaggcucccagagggcagaggggccuccugggu

SEQ ID NO: 4143171 - RNA, 59 nt, Human
gcccaggagaggccagggcugagccagcauggaaauggaauugccccugccuccugggc

SEQ ID NO: 4143172 - RNA, 58 nt, Human
gcccaggaggucgaagcugcagugagcugagauuuugccacugcacuccagccugggc

SEQ ID NO: 4143173 - RNA, 56 nt, Human
gcccaggaguucaagucuagugagcuaugauugugccacugcacuuuagccugggc

SEQ ID NO: 4143174 - RNA, 56 nt, Human
gcccaggaguugaaugcagcagugagcuauuauuaccacuguacuccagccugggc

SEQ ID NO: 4143175 - RNA, 58 nt, Human
gcccaggaugguguguaguggugugauuucagcucacugcaaccugccgcuccugugc

SEQ ID NO: 4143176 - RNA, 74 nt, Human
gcccaggcaaucacauuuacauugcuaauugaagaagaaagcuacaguaagcaauagagugagaauuauuaggc

SEQ ID NO: 4143177 - RNA, 59 nt, Human
gcccaggcacccagcccagucgcacgggucccuguuaggacuuugggcugugcuuaagu

SEQ ID NO: 4143178 - RNA, 68 nt, Human
gcccaggcauuuucaacuuuaguuuccuauuagaaucacccaggcacugaaguguacuaaugcagggc

SEQ ID NO: 4143179 - RNA, 58 nt, Human
gcccaggccggagagcagugcugccaucucggcucacugcagccuccacuuucugggc

SEQ ID NO: 4143180 - RNA, 58 nt, Human
gcccaggcuagagugcaguggugugaacauggcucacugcaaccucagacuccugggc

SEQ ID NO: 4143181 - RNA, 58 nt, Human
gcccaggcuggaguauaguggcgcgaucucggcucacugcaagcuccgccucccgggu

SEQ ID NO: 4143182 - RNA, 55 nt, Human
gcccaggcuggagugcaguagcgcgaucacagcucauugcauuuuggcgcugggu

SEQ ID NO: 4143183 - RNA, 58 nt, Human
gcccaggcuggagugcaguggugccaucuuggcucacugcaagcuccgccucccgggu

SEQ ID NO: 4143184 - RNA, 60 nt, Human
gcccaggcuggagugugcaguggcgcgaucucggcucacuguaagcuccgccucccgggu

SEQ ID NO: 4143185 - RNA, 66 nt, Human
gcccagggcccuuuggacucccuggagugacagaggagucucugccuggggggaucagaacugggc

SEQ ID NO: 4143186 - RNA, 56 nt, Human
gcccagggcugguuucuggagcacagcucagcagaugccucaggaaccugucuggc

SEQ ID NO: 4143187 - RNA, 61 nt, Human
gcccaggggcagcgcauagugggacugguaccacuguugguauggugcgcuguugaugagc

SEQ ID NO: 4143188 - RNA, 63 nt, Human
gcccagguguucuuuauuauguaguuuuucuccuugggcaaagcauggcaugaagaacauggc

SEQ ID NO: 4143189 - RNA, 55 nt, Human
gcccagguuggagugcaguggcacaaucaugacucacugcagccuugaccugggc

SEQ ID NO: 4143190 - RNA, 80 nt, Human
gcccaguaagaagggccugugcugugccaagcucccaggcuugggaucaugagcacaugccagcccuucucuuuuugggu

SEQ ID NO: 4143191 - RNA, 103 nt, Human
gcccagugagggcugguuuccaaguggugagagggucauuagauucuggucuguggcucaauugccuacugacacuggagacacaauagcaccuccacuuggu

SEQ ID NO: 4143192 - RNA, 57 nt, Human
gcccagugcccuagaaugcacuugucauagagacauuugcauuaaguggcauugagc

SEQ ID NO: 4143193 - RNA, 66 nt, Human
gcccagugggggcacaccguuaguaaugagacaucuuagcaccaauaugugcuuuucacauugggc

SEQ ID NO: 4143194 - RNA, 68 nt, Human
gcccauaucugcucucugcucuggaggaggaggcauuccuccacggcccauugggcaggacgaggagc

SEQ ID NO: 4143195 - RNA, 58 nt, Human
gcccaucccuugagagagcacaaggcccugaggucuuucugcagcacaggggcagggc

SEQ ID NO: 4143196 - RNA, 95 nt, Human
gcccaucuugccuccugcuugcaauucacaacaaaaggauaugaggauugaagcagucucauuguuugauguggauucagccaaaagcugugggc

SEQ ID NO: 4143197 - RNA, 57 nt, Human
gcccaugagguggaggcugcagugagccgaggucgugcgcugcacucccgccugggc

SEQ ID NO: 4143198 - RNA, 58 nt, Human
gcccaugccaggggcugagaaggaacguccaggaaaguuggaguggucccgggugggc

SEQ ID NO: 4143199 - RNA, 72 nt, Human
gcccaugcugugccuagagagcacccaaaaggcugacuuggcuacugucucugcccuagugcgcaguggggc

SEQ ID NO: 4143200 - RNA, 61 nt, Human
gcccauggcccugguggacagacagccuaugaauugggggccaugcuccaggcccaugggc

SEQ ID NO: 4143201 - RNA, 66 nt, Human
gcccauggcccuuuauuccuucuucccucgguccacgaacaggaagaggcugaggccaugcugggc

SEQ ID NO: 4143202 - RNA, 55 nt, Human
gcccauuguuuuuguucaucagcgcugccaccaaguguggaggaaucacaauggc

SEQ ID NO: 4143203 - RNA, 110 nt, Human
gcccauuucaauuggugauguuuauauaaagauaacuuuucuucaugggauauuuugugauaaagcuauuuuuaauucuguuugacucucuuuugaaauucuccuggagc

SEQ ID NO: 4143204 - RNA, 72 nt, Human
gcccauuucucagcacuuccuaucucccaaauacucuaaaauugggagguaugagccaguugaguuuugggc

SEQ ID NO: 4143205 - RNA, 88 nt, Human
gcccauuugauggcagagaaguuucugguuugcauaggccagaacugguuugcaguaacuaggcaagcuugaagcaacucucuugggc

SEQ ID NO: 4143206 - RNA, 86 nt, Human
gccccaacagucuuaucuacuccugaauauaucuagcuagauuucacagacuaguaggagauaaaaucagagagguaacuuggggu

SEQ ID NO: 4143207 - RNA, 84 nt, Human
gccccaacccugauaugaacugugagugugaugggguagcacacagcaaugcugcauucgcucgcauugauagauggacgaggc

SEQ ID NO: 4143208 - RNA, 78 nt, Human
gccccaauucagcaggaagcaguuagagcugucauuggccaaccuccccaacagcacuuggguuuuccuguugagggc

SEQ ID NO: 4143209 - RNA, 91 nt, Human
gccccacggggcagcuuggaagagaagcugggagggaugaggggcuccacuagcauuccuuguggcuucugaguguagcugcccugggugu

SEQ ID NO: 4143210 - RNA, 100 nt, Human
gccccacucugggcugcccuguucuucuucaugcuguugcugcuuggucucgacagccagauuugcauggggcucugggacagggagccaggagaggggc

SEQ ID NO: 4143211 - RNA, 72 nt, Human
gccccagaaccugugacugugaucuuauuugcaaauaaggucuuugcagauauaauuaaguuaagaugaggu

SEQ ID NO: 4143212 - RNA, 70 nt, Human
gccccagagucaagguggcauuuagcugggccuucaguccggcaccagcaagugcucuuuaacuuggggu

SEQ ID NO: 4143213 - RNA, 59 nt, Human
gccccagcagcaaugcgguugagaaggggacccucaaacgucacuuuccugcugggugc

SEQ ID NO: 4143214 - RNA, 81 nt, Human
gccccagccucccgaguagcugggauuacaggcucccgccaccaugcccagcuaauuuuguauuuuuaguggagauggggu

SEQ ID NO: 4143215 - RNA, 75 nt, Human
gccccagcgcaguucucuugccuggugcggauaucgcuggguucccggcagcacuggcaugugaggcgguggcgc

SEQ ID NO: 4143216 - RNA, 55 nt, Human
gccccagcguggcuguguuaggaguccuuugcccaacauugugcugcacuggagc

SEQ ID NO: 4143217 - RNA, 55 nt, Human
gccccagcucaccggcucacugccccccagcugcgcuugagccgguagauggggu

SEQ ID NO: 4143218 - RNA, 57 nt, Human
gccccagggaaagaucuuggucagaguuguccaccaaaaccaggaacuucccuaggc

SEQ ID NO: 4143219 - RNA, 114 nt, Human
gcuaauauuagaagcauguucaaggagcagccucugggguuaauagaguuuaauuugcaagacaaaugaaagcuuauuuucuccuaggcucucugcucauaauucuaguagggc

SEQ ID NO: 4143220 - RNA, 78 nt, Human
gcuaauauuuucaugaggguguuuuacuucaguguaugagauacauuggucuguaguuuucuuaugucuuugucuagu

SEQ ID NO: 4143221 - RNA, 68 nt, Human
gcuaaucaguuugaucugacagauuuuaauuacauuaauuagggcuuuucugaauaggccugauuagc

SEQ ID NO: 4143222 - RNA, 65 nt, Human
gcuaaucccucaagaguucuguucuacaacaaagaaagagcaggcuuaugguugaagggaguggu

SEQ ID NO: 4143223 - RNA, 62 nt, Human
gcuaaucuauuccccaguccugggagguuugugcucucacccagggacugugauggaaaagc

SEQ ID NO: 4143224 - RNA, 97 nt, Human
gcuaauuaagcauaaauggaauaauuuugaucagaagggagcaguguuuuuuguuguuuccuuuuuaauuaaucuaauuaugagaugcuuacugggc

SEQ ID NO: 4143225 - RNA, 63 nt, Human
gcuaauucaaccccauggcuuuaaauacuaucagugugcuaaugucuccaggguugaccuagu

SEQ ID NO: 4143226 - RNA, 60 nt, Human
gcuacaaacugucauggugcuuaaaggagugggugccaaaugacuuguauguuucugagc

SEQ ID NO: 4143227 - RNA, 122 nt, Human
gcuacaaaguuaaauauuauuuggugauauguuucucaacauacuguuguuauuaaaaaggauuugcuuacuggcacuauguuggagaaaugauaacauaaaguuuauuugauccauugugc

SEQ ID NO: 4143228 - RNA, 91 nt, Human
gcuacaaggaugugccuccaugucuuuuucccucgcagugguguguaagcucugugagggucacagccaugcccacacuguucuuugcugu

SEQ ID NO: 4143229 - RNA, 60 nt, Human
gcuacacaauagcguucacuuagauuuuaguuuaagaggaaaaaaaaguuguucuguagc

SEQ ID NO: 4143230 - RNA, 66 nt, Human
gcuacagaaaccuuuuucauacaggcaaacagaugcucuccuuguaugaaaauguuuuuguguugc

SEQ ID NO: 4143231 - RNA, 84 nt, Human
gcuacagagaauaauaggacaggugauuuaugcuggcgcacuugaccuuaaucugucccuguuguucuacugaaaguugauagc

SEQ ID NO: 4143232 - RNA, 60 nt, Human
gcuacagagagagggguuaccaggucuaucagaggcagcugccacaccucuuucucuugc

SEQ ID NO: 4143233 - RNA, 62 nt, Human
gcuacagaggaaguuccuugaugagacucaaguccguucucuaggagaaacuuccuuuccgc

SEQ ID NO: 4143234 - RNA, 55 nt, Human
gcuacaggagauaaaggccucuccaugagacacugcagaggcugucaccuguagc

SEQ ID NO: 4143235 - RNA, 75 nt, Human
gcuacauacgcgagcuggcaagccgcugggcgccucuacgagccggcagagcuuccugcucagcguguccguggc

SEQ ID NO: 4143236 - RNA, 111 nt, Human
gcuacccuuggggacugcuguggcuugguucaguaggcaugccuggggcacaggaggagcuuacgggagaggcaucugaacagccaguugggggucugguucuuggguagc

SEQ ID NO: 4143237 - RNA, 96 nt, Human
gcuaccucauguugcuccgggggacuacugggaaacugcugauggaacuugagucaguagaacacuugaccacugcucccuacagcuccaugaagc

SEQ ID NO: 4143238 - RNA, 92 nt, Human
gcuaccuggaggcauagaaagaguaaaguacuuggaauacccagaacuccuggauuugcauuucauuucugcuucuuucuagcuaugguggu

SEQ ID NO: 4143239 - RNA, 83 nt, Human
gcuacggcugaucugacaggaggcagagcucagguggccaugcuugcuugccccuggcucacuuucuguugugcagccagugc

SEQ ID NO: 4143240 - RNA, 64 nt, Human
gcuacuaaguagcagaacuaagaauugaacuaggauucaguuccagauuuaaaugcuugauagc

SEQ ID NO: 4143241 - RNA, 88 nt, Human
gcuacuagagaaacaguucaaagaucaaugggucuguuaucuugaguuucauaaacagaacauggauuuuugaaguucucacaguugc

SEQ ID NO: 4143242 - RNA, 59 nt, Human
gcuacuaguacagcaaggacuacaguggacauggcuauggccuuggugguuuugguagu

SEQ ID NO: 4143243 - RNA, 75 nt, Human
gcuacucacuuaacagaggucuauucauuugugcagacuaaauuugaucaacaaauguccuuugugacugauggc

SEQ ID NO: 4143244 - RNA, 63 nt, Human
gcuacugcucaauuugagaugcuacagggacaauugucaauaguuucacaaauugucaauagc

SEQ ID NO: 4143245 - RNA, 127 nt, Human
gcuacugcugguaaauaauggagucuuccuuucuggcucugccaaguuacgcaaaguguaacugaugauggugguuacacaauauaugguacuugguuuggaugcagaauugggauggagcaggggu

SEQ ID NO: 4143246 - RNA, 69 nt, Human
gcuacugugcaaaaaugaauauuguaauauuaaaagagaaacuaauuguucaguaucauugcacauagu

SEQ ID NO: 4143247 - RNA, 59 nt, Human
gcuacuugguacucaauguccagaauaaacuagaacagguuauugaccuccaggcuggc

SEQ ID NO: 4143248 - RNA, 62 nt, Human
gcuagaaaugcucaagagaaagugaugaaaaucuagaaucauuuugcuuuugaaguuucagu

SEQ ID NO: 4143249 - RNA, 70 nt, Human
gcuagaacaaauggucauuucucuuuugugacugaacaagucacagaaugggauuugaauauuucuuggc

SEQ ID NO: 4143250 - RNA, 89 nt, Human
gcuagaaguuacagaguuuacaugcaugcaagaaugaggaacuuuaaauugauccucaaagucauggcaggcucagauugacuucuggu

SEQ ID NO: 4143251 - RNA, 88 nt, Human
gcuagaauuuccugagcccccaggauuuccugcaccgccagccgccucuuccccaggcacagggagcucugggggcacacggucuggc

SEQ ID NO: 4143252 - RNA, 58 nt, Human
gcuagacuuuaagcuccugcagaguaggauuaugcuuuguucaucauuagagucuagc

SEQ ID NO: 4143253 - RNA, 63 nt, Human
gcuagagagugucucaaggcaggaaaguguuuacaggacaaacaccggcagagugcuucuagc

SEQ ID NO: 4143254 - RNA, 74 nt, Human
gcuagagugcaugacaugaucuuggcucacugcaaccuucaccucccgggcucaagcgauuguccugccucagc

SEQ ID NO: 4143255 - RNA, 61 nt, Human
gcuagaugcugggaaggcugcugggucuuaguugucuccagcuccucuucccagugucagc

SEQ ID NO: 4143256 - RNA, 73 nt, Human
gcuagauuaugcgugggccaacuguuucuuggucuuuuggcgaagaucaaguguacuuuauguauggacuggc

SEQ ID NO: 4143257 - RNA, 70 nt, Human
gcuagcaguguucagugaagcaggaggcuccagacaauagccucagcuggccauagugaacacuucuugc

SEQ ID NO: 4143258 - RNA, 82 nt, Human
gcuagcgguggcgauuaggaguccagaugucuuggguauagccgucgccccgggaaagugggcucuagacgcaggaguuggc

SEQ ID NO: 4143259 - RNA, 78 nt, Human
gcuagcucaggugaguuuuuccaaacccauguagaacggacaaaacacaugcagugcuggagcugccacuugagcugc

SEQ ID NO: 4143260 - RNA, 65 nt, Human
gcuaggaaagggaagggcugggauucaaacacaggcaguuuggcuccagaccucccucuccuagc

SEQ ID NO: 4143261 - RNA, 64 nt, Human
gcuaggaaugcaggcacgugcaagcaagggaggguccuugaucauguagagccugcacuuuggc

SEQ ID NO: 4143262 - RNA, 58 nt, Human
gcuaggccacagggcaaaaaggaggccucaugagccuucgggcccccauggcauuggc

SEQ ID NO: 4143263 - RNA, 80 nt, Human
gcuaggucacaagcucacaucagccaaugauagcucagaaucuuuagcucagaaggaaacgaugccagcuugaucauagu

SEQ ID NO: 4143264 - RNA, 107 nt, Human
gcuaggucauagaaugccuucugugugcauuugaagguggccccuuggggcagacauacgccacaaggaccucagauggaugaacagaucacaggauagacuucagc

SEQ ID NO: 4143265 - RNA, 100 nt, Human
gcuaguaagacugccuuaugaggaaagagacugcuuuauauuguacucauugagugggaugggaggccuuuucaaggucuuugggccauucuuacuuugc

SEQ ID NO: 4143266 - RNA, 71 nt, Human
gcuagucaagggcugggcugcuuguugucacugggucuccuuuucuggcuuugcaugcccacccuugaugc

SEQ ID NO: 4143267 - RNA, 72 nt, Human
gcuagucuucacuuaccggagcgaucgccguggggugucccaaagccagcaaggugaguuucaaagacuagu

SEQ ID NO: 4143268 - RNA, 80 nt, Human
gcuagugcuggggacauagccagucuggcugauacccauaucaguacagaaagcuguccucacccacuucaugcacuagu

SEQ ID NO: 4143269 - RNA, 81 nt, Human
gcuagugggaucuuguuuaauauuguuuauuucuuguccaaggcaugaucaaaagcaguauaaagcagggaucaagauggc

SEQ ID NO: 4143270 - RNA, 78 nt, Human
gcuaguguaagcuaaacauggcuuagaacacuccuuuuuggagcauuuuauuuaugauuaguaauacugaacacuggc

SEQ ID NO: 4143271 - RNA, 57 nt, Human
gcuagugucccugcagccagcugugcguacugagagcuacugcaggaaucagcuagc

SEQ ID NO: 4143272 - RNA, 94 nt, Human
gcuaguuugauggauucacgauggcucuacucaaauaucuggcacuuuggcacagaaggccagaagacuggagucagcuggaucccucucucgc

SEQ ID NO: 4143273 - RNA, 63 nt, Human
gcuauaagacagauacugacuuuuaaagcugugcuguggcaagucagaagcuguaaauauagc

SEQ ID NO: 4143274 - RNA, 103 nt, Human
gcuauauaaaaagaggaagcgccuagagcccuguggacugucaaguuuuauaaagagaacugggcaucccauggcagagccuuggugcucccagaaauguggu

SEQ ID NO: 4143275 - RNA, 57 nt, Human
gcuauauaccaaaauaucagaaagggaggaucuuuugaaauauuugguauauauggc

SEQ ID NO: 4143276 - RNA, 88 nt, Human
gcuauauagaaguaacauuuauauaacucacuaggauaaaauuaguauaaaucugaggcugauuccagugaguuaagauguauauggu

SEQ ID NO: 4143277 - RNA, 82 nt, Human
gcuauaucauagauuugcuucacacuaaaaauguuaaagguuuacaaauauuugauuaaaauaguguugguagugugguagc

SEQ ID NO: 4143278 - RNA, 58 nt, Human
gcuaucaugaaagccaagauuucuuuucuccucagaggccuugguuaugguaugaugc

SEQ ID NO: 4143279 - RNA, 55 nt, Human
gcuaucccuggcucaucucuugguguaaugugcugagggcugagaagggacuagc

SEQ ID NO: 4143280 - RNA, 70 nt, Human
gcuaucggcaaugcacauugaaugagcaaacugcuagaugcuauucuucacucaaugugcucgcuuaagc

SEQ ID NO: 4143281 - RNA, 56 nt, Human
gcuaucuugagagacaacacagcaauaccugguauguugcaaguuuucaagauagc

SEQ ID NO: 4143282 - RNA, 72 nt, Human
gcuaugaagagagcaguggaucaccuagcacagugcuugagcucugcuaagggauaggcugccuccucaagu

SEQ ID NO: 4143283 - RNA, 70 nt, Human
gcuaugagggcguaaaacaauguaucuugcuauacaauauaaaacaggauuuauuauaugcccucauagc

SEQ ID NO: 4143284 - RNA, 55 nt, Human
gcuauggaaagagcaucuaggccuuuuacugcuacauaaauguacuguccauggc

SEQ ID NO: 4143285 - RNA, 72 nt, Human
gcuauggagcuaaauuguaaucauagcugcgacgcuauuuuuaaaauguuguuacaauuuugaguuccuggc

SEQ ID NO: 4143286 - RNA, 57 nt, Human
gcuauggagucagauggcucacagcucucuagccagagccugccugaacucuguggc

SEQ ID NO: 4143287 - RNA, 102 nt, Human
gcuauuagcuugccacuguccuggaugcugagagguaccaagcaaguacauuugaguugcuucuuagugccaaguacuggacuagggggaauagaaaauggc

SEQ ID NO: 4143288 - RNA, 127 nt, Human
gcugcuguguaacagaucacuccaaacuuagaggccugaaagaaugaucaguuuaccugucaccauucugcagguugagaauuuggucagggcucagcagggguggcucaucuguauuucauguggu

SEQ ID NO: 4143289 - RNA, 105 nt, Human
gcugcuuccauuugucugugucucugacuccaugcccuccucccccaugcagacugcagggagggcugccagguggagcgggggcgucccagugcauggagcagc

SEQ ID NO: 4143290 - RNA, 65 nt, Human
gcugcuucugugggauaaacuggucaucagauagcaccagccagggaaucaggcagaagucaagc

SEQ ID NO: 4143291 - RNA, 57 nt, Human
gcugcuuggugucccucugagucuugucuuggugaggguccagggaucaccaggugu

SEQ ID NO: 4143292 - RNA, 73 nt, Human
gcugcuuuaguaauccagccuugugcuuaauuuucacauauccauacagggaugaggaagauuacugagaagu

SEQ ID NO: 4143293 - RNA, 58 nt, Human
gcugcuuuaugauaucaucauaugaucugaauagauaguaugaagauaugugaacagc

SEQ ID NO: 4143294 - RNA, 130 nt, Human
gcugcuuucagguggcuuugcugucaccauuuaucgccccauucaaaaugggcugaccugugccuagaggaggcagcagcuccagagcccuuugaaccgaacacgcagagcaauccugaccacuugcagc

SEQ ID NO: 4143295 - RNA, 78 nt, Human
gcugcuuucggauugggauggcuugcauuugaggacuauaaguaauagucauuuaucuuagccauuauggaaagcagc

SEQ ID NO: 4143296 - RNA, 74 nt, Human
gcugcuuucugcaccccaggucgacgacgccgggcaaaaccuuggcaagauggcacugggggguggaggguugu

SEQ ID NO: 4143297 - RNA, 61 nt, Human
gcuggaacagucuuuaagcaggaauuagaccacaucacccccugccuuaacagcuuucagu

SEQ ID NO: 4143298 - RNA, 60 nt, Human
gcuggaagaugagucagggggugcaacuggggagagcagcucugaauccugcuucucagu

SEQ ID NO: 4143299 - RNA, 71 nt, Human
gcuggaaucuagucuccuuaagucuuuccauuaucagagagaauuaauuaggagcacugaaaauucacagu

SEQ ID NO: 4143300 - RNA, 119 nt, Human
gcuggaaugcaaguggugccaucauagcucacugcagccucgaacuccugggcucaagggauccuccugccucagccuucugggugacuaggaguacaggugcacccaucauccccagc

SEQ ID NO: 4143301 - RNA, 76 nt, Human
gcuggacagccuuauucuuuaguuuacaauauuuucuggcauuuguaagcuguuaagauuagugcuaaguuguagc

SEQ ID NO: 4143302 - RNA, 56 nt, Human
gcuggacaggcgcagucaaagaaauacugagaccucagcuucugcugccuuucggc

SEQ ID NO: 4143303 - RNA, 57 nt, Human
gcuggacagggccaaaccggcugaucucucuggggaugggaggaaggcccugccagc

SEQ ID NO: 4143304 - RNA, 76 nt, Human
gcuggaccauggucauuugagcauggccagucccuuggcuccaggcuuuggccaauuccagaggaucauguccagc

SEQ ID NO: 4143305 - RNA, 82 nt, Human
gcuggagacuuggccaagauggcuggaaggcuagacucagcugggacugucugcuagaacaucuauacguggccauuccagc

SEQ ID NO: 4143306 - RNA, 114 nt, Human
gcuggagagaaguaggagagguucagcuccagcucuaucucauuuccccacgucugagaggcuggaagagaaaggaguggaucuugaguuggcaacucccauuucuccaucagc

SEQ ID NO: 4143307 - RNA, 85 nt, Human
gcuggagagacuggaaugggcuguggcauugguugacugugagguugguuuguguggcagauccucucuuuguuucucucuaagc

SEQ ID NO: 4143308 - RNA, 86 nt, Human
gcuggagagcagagaacagaguugaaacaaggcuggaagguaggccagucuggaccaagcagccuucuuucaacuauguuuccagu

SEQ ID NO: 4143309 - RNA, 66 nt, Human
gcuggagagcugcaagguagggcgggagggagacuuuccccguggaccccuuuguaccucuugagu

SEQ ID NO: 4143310 - RNA, 56 nt, Human
gcuggagaggggucacucugagauacacuucaaaggugaaugaaucccucuucagc

SEQ ID NO: 4143311 - RNA, 70 nt, Human
gcuggagaugcuaugcagagggucaacauucccauuagggacucgggcuccuugguaugccaugcccagc

SEQ ID NO: 4143312 - RNA, 68 nt, Human
gcuggagauguaaucauucuauugucauccuuuuguuacuuugauuugguuccuucugcauuuucagc

SEQ ID NO: 4143313 - RNA, 62 nt, Human
gcuggagccaagcugcucuugguugaggugugaaugggagccaggaaaagcggaagucuagc

SEQ ID NO: 4143314 - RNA, 59 nt, Human
gcuggagcguugccucgguuugaacaagcgcaaaaagaaggacggcagcagcuccgugc

SEQ ID NO: 4143315 - RNA, 97 nt, Human
gcuggagcuuaauccagcucaggucauuccagggaugaccuaaagaugcuggagaaggaggguuaucccuggucugaggggauaauggagcuacagu

SEQ ID NO: 4143316 - RNA, 100 nt, Human
gcuggaggaacaagggauuggggggcaggagaaguguauuuuagucuuggcucuagcacuuguuuuauguuccugagaaagucccuuaaucucuccuggu

SEQ ID NO: 4143317 - RNA, 63 nt, Human
gcuggaggaccacagaagcuggugggguaauucagcacgagucugaaggccugaaaacccagc

SEQ ID NO: 4143318 - RNA, 64 nt, Human
gcuggaggauucagagacagguuucugcagccaaugugccuaaacugcaucucugagccucagc

SEQ ID NO: 4143319 - RNA, 90 nt, Human
gcuggagggaggcuguuaggagggacucugagcuucacaccugucugcugccaugggugcagagcccuaguccugauggccccugguggc

SEQ ID NO: 4143320 - RNA, 94 nt, Human
gcuggaggucagaaaaggguguuuguucagggcugcuugaguggguaacgagcugaaccucucugaacauggcuuccucuucacagccuccagc

SEQ ID NO: 4143321 - RNA, 58 nt, Human
gcuggaguccagugguaugaucuuggcucacuguauccucgaucuaucuggcucaagc

SEQ ID NO: 4143322 - RNA, 77 nt, Human
gcuggauauaggcagugcucugugcuucagugugcaagcguguacauggguguacuggguagccuguggagugcagc

SEQ ID NO: 4143323 - RNA, 55 nt, Human
gcuggaucaaguccuucacccauaccauucccaaggguuuaaggaucaauccagc

SEQ ID NO: 4143324 - RNA, 59 nt, Human
gcuggauccacaaauaacuuugcaugagcaggaaaucaguuuuguuguguuaauccagu

SEQ ID NO: 4143325 - RNA, 80 nt, Human
gcuggauggggcucugcggcugcuccccacuuccccagcccggcguguagggaagagaccguacccuggcccaguccagc

SEQ ID NO: 4143326 - RNA, 56 nt, Human
gcuggauucuagcucaguggcccaaguguggaguccaacaccaucugagcuccagc

SEQ ID NO: 4143327 - RNA, 129 nt, Human
gcuggcacaggagaacgaagagcugcggcggcuggugcagcucauccaggagaaccaggagcugaagcuggugcucaggaaccgcggcagcagccugggcuucugcagcuccggguuccuggcugaggu

SEQ ID NO: 4143328 - RNA, 62 nt, Human
gcuggcacggccguguguguaccuauaggcuucccgcaaguccuggcacuggccugcugagc

SEQ ID NO: 4143329 - RNA, 57 nt, Human
gcuggcacugggaaggacugaguacaauggagcccuucagaucugauacagaccagc

SEQ ID NO: 4143330 - RNA, 82 nt, Human
gcuggcacuucucugcauuugacuccugguuauugcagcugugcccaugccaggcauuuguuaggugcugggaugugccugc

SEQ ID NO: 4143331 - RNA, 63 nt, Human
gcuggcagauguauaucacagcuuaugugaacaacaugcuauaagcuguguuccacugauagc

SEQ ID NO: 4143332 - RNA, 87 nt, Human
gcuggcagcuuugcccagcuggccagguggcuuugaggggagcccaccuccugccaagccucuacccugagccagcagcugcucagc

SEQ ID NO: 4143333 - RNA, 55 nt, Human
gcuggcaggagccuuucccuuucccggguuuggguacaaagaggcuccuccuugc

SEQ ID NO: 4143334 - RNA, 106 nt, Human
gcuggcaguggcucuggguccaggucuguuugcuggcuccguuccugacgcuacaggugggcagcucuuggcaggcaguucaggaugguccuguggucagugcugc

SEQ ID NO: 4143335 - RNA, 87 nt, Human
gcuggcaucucacucccugccuggacacuugcugaauuacagaaucagcagucuugccacaggguuucaaagggagcagagccaagu

SEQ ID NO: 4143336 - RNA, 71 nt, Human
gcuggccagguguccccgucacugcagaguucuggucuuagacuggcugcacacggagacuccagggcagc

SEQ ID NO: 4143337 - RNA, 57 nt, Human
gcuggccaguguggugaccaccugcuaccuguggcuauugagcacuuaguggcuagu

SEQ ID NO: 4143338 - RNA, 113 nt, Human
gcuggccccacuggagguugugcuggacucagaguugguggcagugcuggcccuacuggacacugugcuggacucagaguugguggcugugcuggccccacuggagguugugc

SEQ ID NO: 4143339 - RNA, 67 nt, Human
gcuggccccuccucuggugcugccaacccgcugccaggcagaggggaggcccagaggagagggaagc

SEQ ID NO: 4143340 - RNA, 69 nt, Human
gcuggccgugccacuuaccugggaggaguugauuugagggacuucucuucauagguggcaauggcaagu

SEQ ID NO: 4143341 - RNA, 58 nt, Human
gcuggccucgcaggcaggauguccauacggagggucgccugcugcagcgggagccggc

SEQ ID NO: 4143342 - RNA, 59 nt, Human
gcuggccugagggccgaggcucccugaccagguaggacccaggccagccccaggccagc

SEQ ID NO: 4143343 - RNA, 82 nt, Human
gcuggccuuucauguucccacacuacacgguuguuggcucaggacugcacccaggggccugugaaggugcccaagggccggc

SEQ ID NO: 4143344 - RNA, 64 nt, Human
gcuggcgagguuucagagagcggcugcucugagcucgccuuuuuauucugaaauucuuaucagc

SEQ ID NO: 4143345 - RNA, 77 nt, Human
gcuggcgaugcaugugugugggugggagaauuuggcugcucucucuuggcagccuccaucccaugcacaaagccugc

SEQ ID NO: 4143346 - RNA, 62 nt, Human
gcuggcgccaggccucuggccacuccagcugcugucccgacugagccagggccugggucagc

SEQ ID NO: 4143347 - RNA, 77 nt, Human
gcuggcggauguagaggaaggcgugcugguaggccacacccggcuccaaggccagcagcucccucaggguccgcugc

SEQ ID NO: 4143348 - RNA, 73 nt, Human
gcuggcuacaaaauuuuuagacaaggcuuugccuccuuaaacaaucgcaaguuuaaaaaucuuugaauccagc

SEQ ID NO: 4143349 - RNA, 120 nt, Human
gcuggcuagaggggcccaguggcagguggugguggguggcggggugguuaacccuuucacuucccucuaggcguugagguccagucuccacccacuacugccccagggccugucuucagc

SEQ ID NO: 4143350 - RNA, 57 nt, Human
gcuggcuggagugagcuacccugugcucucacucccaggguucuaccccagaccagc

SEQ ID NO: 4143351 - RNA, 91 nt, Human
gcuggcuggcacguucgcacguggccaugucagcuccaaggaggaugcugacauccugcuggcuggcacguucgcacguguccauguuagc

SEQ ID NO: 4143352 - RNA, 73 nt, Human
gcuggcuugcaaacagaaacuugauguaaaaauguuacuuccaaguuuugauuuugcaguaaaaaauaauagc

SEQ ID NO: 4143353 - RNA, 55 nt, Human
gcuggcuuuaacccuacaaaccuguugguacaggucuccacugggguuggucagu

SEQ ID NO: 4143354 - RNA, 63 nt, Human
gcuggcuuuaaugucaucuuucucacuccaaaaagaguaagagcagaauaauucaagcucagc

SEQ ID NO: 4143355 - RNA, 99 nt, Human
gcuggcuuugggugggugcuggauggcagacagugaguggcuaugcuguuagcagaagccucaguggcuggcauucugugugcccaaccuaggcacagc

SEQ ID NO: 4143356 - RNA, 90 nt, Human
gcgcuuugucgguguggcagcucggacccgcggggacugcaaggaauguccuugaggcccggcaggccgagcggcggccggcaucagugc

SEQ ID NO: 4143357 - RNA, 74 nt, Human
gcggaaggacuucucggccguguggaugcgcuggugccgcaccagcgaggagcuaugccggaaggccuugccgc

SEQ ID NO: 4143358 - RNA, 66 nt, Human
gcggaaucucaaccucaacuuugaauauuguuauucaagaacuggaaauugauaugagauuacugc

SEQ ID NO: 4143359 - RNA, 127 nt, Human
gcggacggcugcugggaagccaaucagcgcgcucgagccugcagccccucugcaguaguuaugccagagcgcccuguguagagcggcugcgagcgggcagcugggcucggcugccgggagccaccgc

SEQ ID NO: 4143360 - RNA, 68 nt, Human
gcggagaaugcagggcuuccucuuggaguuaaagacucauuggcuccuggaaagcccucgcucucugc

SEQ ID NO: 4143361 - RNA, 68 nt, Human
gcggagaggcagagacuccgcgcgucgccauuucuggacuaggcugcugcuuucugugcuuuuucugc

SEQ ID NO: 4143362 - RNA, 61 nt, Human
gcggagccugcaggccucggccucauggcggccugaggcaggggccuggaggcugguccgc

SEQ ID NO: 4143363 - RNA, 112 nt, Human
gcggagcgauggacgcccgcagggccgcgcgaacccggggccuuagacgcgggugccgccagucccagggauccuccgggucgcgccucccugcaggcgcuccucgcggcgc

SEQ ID NO: 4143364 - RNA, 73 nt, Human
gcggaggggcagcauaaccccuucauaauuccuaaacugcacugugauuuccccagucuugcugcucuucugu

SEQ ID NO: 4143365 - RNA, 67 nt, Human
gcggaugcucagucuggccaccugcucaagucaaguagcaggcaggucacaugcuuggcgacuccgu

SEQ ID NO: 4143366 - RNA, 55 nt, Human
gcggcaaggguagaggcaucaguagacuggugaggaggcuuugcacucauguugu

SEQ ID NO: 4143367 - RNA, 94 nt, Human
gcggcaguucccucugccaacacuucuuugucaccugcuucgaggccaauaacucugaagaagguggcccagggguagguggaggggcugccgc

SEQ ID NO: 4143368 - RNA, 106 nt, Human
gcggcauuucucuuugggauacaagguguucuaucacuuagggaaaacugaaaaccaaagugauaaugaugggaaauaaauugauggccucaaaaggaaggguugc

SEQ ID NO: 4143369 - RNA, 87 nt, Human
gcggccaaugccccagcagcaggggcgggcuccaggccagcuccaccugccugggccuucccaccucugggcggggauggugaccgc

SEQ ID NO: 4143370 - RNA, 76 nt, Human
gcggccagagcccagggucaugcaggaugagccuagagaggaaggcaggggccuggugauccuggacuuggacugc

SEQ ID NO: 4143371 - RNA, 89 nt, Human
gcggccagaucaggccaagcugccaggccuccgcugucccccggcacuggccaggaggggagcgggggccggcccugagaaugcgcugu

SEQ ID NO: 4143372 - RNA, 65 nt, Human
gcggcccacaccaggggccacagugcacccgccacuucauggcacguggccaacaggaugggcgc

SEQ ID NO: 4143373 - RNA, 58 nt, Human
gcggccgcggcaccggaagugccccccacgggaggcugcccucggggucgcaggccgc

SEQ ID NO: 4143374 - RNA, 76 nt, Human
gcggccggggcauggcgacuuccucuucacuggccacaugcacuucggggaggcgcggcucggcugugccccacgc

SEQ ID NO: 4143375 - RNA, 114 nt, Human
gcggcggcggcggcggcggcggcggcggcugggcuguuuguucuggucucccgcagccgaggagccgaagcaguggcggcggcagcggcugcggcggcugccggcggugcccgc

SEQ ID NO: 4143376 - RNA, 57 nt, Human
gcggcuccgaagccaggccgcgcauggugaugcgcaccggcuugucucggcagccgc

SEQ ID NO: 4143377 - RNA, 64 nt, Human
gcggcuggcuguccaaacugggcccgcguccugaagugaccccagccugaucucggccagcugc

SEQ ID NO: 4143378 - RNA, 57 nt, Human
gcggcugugcagcaucuugauggcgcugugcugugcuaucagguguucagccacugc

SEQ ID NO: 4143379 - RNA, 70 nt, Human
gcggcuuccucagcugcugguguaucggguccuaguucggcuggcggcccggguccccagcagcagccgc

SEQ ID NO: 4143380 - RNA, 82 nt, Human
gcgggaaaaucugacagucucauugauuugcucucuuugccaucaccacucuugagaggaagaaaugugacuucaaacuugc

SEQ ID NO: 4143381 - RNA, 100 nt, Human
gcgggacguccucaucgguuggagagaggcgaguuaccugugcucccgguuguuuaggggagagcgagugggcuggccuuucccuaggagaggacucagc

SEQ ID NO: 4143382 - RNA, 66 nt, Human
gcgggaggcccugcaggaagcaggauguugacccggagccucccugcgcuccugcggcggccccgc

SEQ ID NO: 4143383 - RNA, 83 nt, Human
gcgggaggcuccgcggcugcgcgggcgcgugcugguggccucggcggaggcucagucccggcccgcgcccgcggcgcccccgc

SEQ ID NO: 4143384 - RNA, 61 nt, Human
gcgggcaauaagcugcccaaguaaacaaauacucuauccagcuuggcagcugagauccugc

SEQ ID NO: 4143385 - RNA, 57 nt, Human
gcgggcaggcagcccuggggaugggcagccccgcucuuucuugggccgugugcuggu

SEQ ID NO: 4143386 - RNA, 64 nt, Human
gcgggccgcgcggggggcagaagcugcggccgcccccguuuccucucuuccuccgcgccgccgc

SEQ ID NO: 4143387 - RNA, 91 nt, Human
gcgggccugggggcaaaggcucagaaucggcagacccagaccccaguugguguguuugaaagcugagccugcugguccucccgggccacgc

SEQ ID NO: 4143388 - RNA, 68 nt, Human
gcgggcuuccuccagggaagugcuuggcccuccaccaccacaggcauggccuucagggacagcugggc

SEQ ID NO: 4143389 - RNA, 66 nt, Human
gcggggaccugcuuuucccagggcucuccagggagucccugcacagcccucaagagccugcccugc

SEQ ID NO: 4143390 - RNA, 74 nt, Human
gcggggacugggaacaaggugcucagcggacacucagcaaacggccugaacgccgacgccucucccgucucugu

SEQ ID NO: 4143391 - RNA, 80 nt, Human
gcggggagaggacaggcucucagccaguuggcaggacucugccaagccugucccggccucagagccuguccuguugcugc

SEQ ID NO: 4143392 - RNA, 87 nt, Human
gcggggcagggcuggucugaggggauguuuuugacggagcggagcuccagaugcugcacauuccugaucgggucaggccugcccugc

SEQ ID NO: 4143393 - RNA, 73 nt, Human
gcgggggcagacugggcaguuccaguccugaucauugacauucugguauuccugcccagauuuuaccaccugc

SEQ ID NO: 4143394 - RNA, 58 nt, Human
gcgggggggucuucagaccucagagcacugccauucuuggucuaggggcccuucccgc

SEQ ID NO: 4143395 - RNA, 84 nt, Human
gcggggucuauuucucuaccccuugaaucugagcagggcucgugccuugcuuuggccacuagaauucagggggauggcccgugc

SEQ ID NO: 4143396 - RNA, 62 nt, Human
gcgggucaaaugauaauugcuucuaauuggcauccccagaagcaccuuaauuauuuaucugc

SEQ ID NO: 4143397 - RNA, 55 nt, Human
gcgguauugcagagaagucaaugcuauuguuuacaugacagaugcugcagaucgu

SEQ ID NO: 4143398 - RNA, 65 nt, Human
gcggucccaggcuggggccaggugaccggaggagucgaggagccgcggccgcggccuggggaggc

SEQ ID NO: 4143399 - RNA, 57 nt, Human
gcggucccgcguacccugccaccgccgccgcagagguucgggcaggugcggggccgc

SEQ ID NO: 4143400 - RNA, 117 nt, Human
gcggucccugccagaagauggccuauugaacauuuccagaaauagcacagccaagcccgucaacugcuuucuuggaaauacauucaauaaggauggcgguccuccagcagggagagc

SEQ ID NO: 4143401 - RNA, 78 nt, Human
gcggugacucggggcuguagcacagcugagcgcaggguucuccugcugggcguccucggccuccuccggguccacugc

SEQ ID NO: 4143402 - RNA, 56 nt, Human
gcgguggaggaggagauagagaggaucucaucuguucucuuggcuuugucuacugu

SEQ ID NO: 4143403 - RNA, 55 nt, Human
gcggugucuauaaauuucugcugucacugauguuagcagaacagucgagcacugc

SEQ ID NO: 4143404 - RNA, 103 nt, Human
gcgguucucacagacucuccugcaaagccucugauuucacuuguacuggcuacagcaugagcuugguccagcaggcuucaugacagggauuuguguggguggc

SEQ ID NO: 4143405 - RNA, 87 nt, Human
gcguagaugucuucagucuucccuccagugcaacugaagguaaacucgucuuuggggcccugguggaagggcuguaugucauuuggc

SEQ ID NO: 4143406 - RNA, 61 nt, Human
gcgucaauuccaucauucuucuggccauccaaaagggaaugauuagaauuaucuuugaugc

SEQ ID NO: 4143407 - RNA, 78 nt, Human
gcgucccugccuuucuucguuugcaccuuaucuccucucuucucucaaggcugguguccuugcagaaggcggcgacgc

SEQ ID NO: 4143408 - RNA, 74 nt, Human
gcgucgccccccucaguccaccagagcccggauaccucagaaauucggcucugggucuguggggagcgaaaugc

SEQ ID NO: 4143409 - RNA, 98 nt, Human
gcgucuacaguuuugacagcugaggcgggagcacgggaggcggagcugguggcagcgcagcgccccgccccggcuccagcaucagccaauggugacgc

SEQ ID NO: 4143410 - RNA, 84 nt, Human
gcgucucccaggcccaggggcuuuccuguuuauggaagagcuuauucugagagcuguagaagccuauuggauucccugucacgc

SEQ ID NO: 4143411 - RNA, 78 nt, Human
gcgugauuuuggggacugcucagcaggccagggggauguggcugguucuucgcugggcggcugcggggagaguggcgu

SEQ ID NO: 4143412 - RNA, 81 nt, Human
gcguggagggugcacagagcccagggccgcgucucucgagcacucagccugggaugcgcccagggcagcgcccccacacgc

SEQ ID NO: 4143413 - RNA, 77 nt, Human
gcguggcucugggccuccaaggucuguucuuacccacggcauccugggguguaggccucaggaccccagggcugugc

SEQ ID NO: 4143414 - RNA, 83 nt, Human
gcguggcuggcugcguucugccuggcggccuagugucaucagcccagaggcugggccacugcugcggaaggcgccggccucgc

SEQ ID NO: 4143415 - RNA, 72 nt, Human
gcgugggcugcacugcucuuuaucgcugaggcuccccugggcugcuugugggaaggagagagcaguccaggc

SEQ ID NO: 4143416 - RNA, 99 nt, Human
gcguggggucacaguucuuaggaacaaggccagugccugcugcucagggcccuggugggcuguguguccuccgugcgcuggguucccugggcucuaugc

SEQ ID NO: 4143417 - RNA, 75 nt, Human
gcguguaugcaggucugugcagugugaugugguugaguaugugagugugccguguauaugaugugugaugugugc

SEQ ID NO: 4143418 - RNA, 65 nt, Human
gcgugugucagccuccuccaccccagagucggcugcagacucaggggcaggggguggcucacugc

SEQ ID NO: 4143419 - RNA, 59 nt, Human
gcguguguguguguguguguguguguaugugaaugugcacaugagacacacauauaugu

SEQ ID NO: 4143420 - RNA, 57 nt, Human
gcguuccuuaccgcuucccgcgccugaugcgugaauuucagggucugguaggaaagc

SEQ ID NO: 4143421 - RNA, 70 nt, Human
gcguucuucagcauuagaagucaugcacaaauuaaauuuuaauaaaaaaugcucugaugcuguuaaaugu

SEQ ID NO: 4143422 - RNA, 63 nt, Human
gcguugaaagaagagaugcugucuauacacccugugugacugccgauuguccuucucucuagc

SEQ ID NO: 4143423 - RNA, 98 nt, Human
gcguuugaugcgggacguuccugugggagggagcggcuggaucacaguucggugugcggcuggcucugcucacauccucguccuuggcauuacagcgu

SEQ ID NO: 4143424 - RNA, 102 nt, Human
gcguuuggguuuaaggucagagugagcuggccccuccgcuggcugccacaucgguuugcuugggugcuggaggcugccgcccgucugacuucccuaauuggc

SEQ ID NO: 4143425 - RNA, 65 nt, Human
gcuauuaggaaaucacuuugcucaccauugaaauggugucauugggaugguuuccugugaugggc

SEQ ID NO: 4143426 - RNA, 60 nt, Human
gcuauucaaaucugccauugucgcgcaaaagcagccacagacaauauguagaugaauagc

SEQ ID NO: 4143427 - RNA, 75 nt, Human
gcuauucaccauuuuauguuuauggagugcugaacuuacacagcuuuuuauaaaauaugaaauaaaggcuuaugc

SEQ ID NO: 4143428 - RNA, 62 nt, Human
gcuauucaucaauuguucuagcccucaguuuugggaugccuaggacacauugaagugaaggc

SEQ ID NO: 4143429 - RNA, 55 nt, Human
gcuauucauggagcauguacugugugccauacacugugcugacccauugauaugc

SEQ ID NO: 4143430 - RNA, 66 nt, Human
gcuauuccagaugccuaaaucugggcaaggcugcucaagcuucagucaggauuggguacuaauagc

SEQ ID NO: 4143431 - RNA, 63 nt, Human
gcuauugacaauuugugaaacuauugacaauugucccuguagcaucucaaauugagcaguagc

SEQ ID NO: 4143432 - RNA, 70 nt, Human
gcuauugugaauagugccgcaauaaacauacgugugcaugugucuuuauaguagcaugauuuauagucgu

SEQ ID NO: 4143433 - RNA, 75 nt, Human
gcuauuucuuccuuguucacugguugucuguuuuaucucuaauguggagaacugaauagaccagacaagaauggu

SEQ ID NO: 4143434 - RNA, 58 nt, Human
gcucaaaacagcaccuagcuuccuauaguaccuuauuauuugcugacagugcuggagc

SEQ ID NO: 4143435 - RNA, 88 nt, Human
gcucaaaauaauccuuauccaaaguggcauauuauaggguagcauauucugaucuucuauaacagugugguuuggagauugauugagu

SEQ ID NO: 4143436 - RNA, 61 nt, Human
gcucaaagaggccuccaaauccuuccaggcucagcccagaccuugaaggccuuuuugcagu

SEQ ID NO: 4143437 - RNA, 64 nt, Human
gcucaaagucauaauuauaaacaucaguuauucuuguggacugauuuugguuguuacuuagggc

SEQ ID NO: 4143438 - RNA, 68 nt, Human
gcucaacagaguuaucugaguucacucagcuagaaguggcugagcugggaguagagacucuggagagu

SEQ ID NO: 4143439 - RNA, 87 nt, Human
gcucaacuuuuuuauugugaauuuggaagcaaugaucuuuccaguuuucuaggucauuccuuuauuuuuaaaguaauugaaaugggc

SEQ ID NO: 4143440 - RNA, 99 nt, Human
gcucaagaauuaguuguauuaggugaacacuuuuaggaguagaaguaagauuguuuuucaucaguuccugggaguggccauguaauguugcuuaugagc

SEQ ID NO: 4143441 - RNA, 70 nt, Human
gcucaagagagaugcaguucuuaagaugggaagauauuccaaaugccaagacuaguaucucuuuaagagu

SEQ ID NO: 4143442 - RNA, 130 nt, Human
gcucaagauucuugucuaacaggcucccaggugaugcugaugcugcuuuugcccuaccacacuguugaguagcagagcuaccgccgcaucggcauaccugugaaccugugaagaaugcagaaccuuggac

SEQ ID NO: 4143443 - RNA, 66 nt, Human
gcucaagcugaauuucagauauaaacugugaagccaacaucgggugucugugauuuaggccagggc

SEQ ID NO: 4143444 - RNA, 63 nt, Human
gcucaagucauuacugaaaugucaccucuucagugaggccugaucauuuuaaauggcaaccgc

SEQ ID NO: 4143445 - RNA, 112 nt, Human
gcucacaacagccucuguuuuuacuaugugaacucugacucucaugccugaugggcaucaaauccaaggguaugaaucagguucucuggaagggaacugaggaugcuugagc

SEQ ID NO: 4143446 - RNA, 82 nt, Human
gcucacauucugaagggugccugcuguucugcugauuacauucagaaauguuccacagauauagcaugcagucucugugugu

SEQ ID NO: 4143447 - RNA, 61 nt, Human
gcucacauucuuggucaccuuguggcccuuguugaggcccacagcuauaggguagugcagu

SEQ ID NO: 4143448 - RNA, 64 nt, Human
gcucacauuuccacucccuaugcgugauccuguguuaaguguggggcucagugggaaugugugc

SEQ ID NO: 4143449 - RNA, 71 nt, Human
gcucaccagacaguuacugcauguucaauaaauaccauuugaugacaauaaugugcuuagcugcugguagu

SEQ ID NO: 4143450 - RNA, 73 nt, Human
gcucaccagggccugcuucucugggcuuucuagagacuagaaagucuuuucagaggccaaaaagucccugggc

SEQ ID NO: 4143451 - RNA, 115 nt, Human
gcucaccaucgauuauaucuagcaacuggccucaguggcuuuaggaguucaggguagccuguccucuugcucauuggggcagaucagugaggcauugggugaaguccuggugggu

SEQ ID NO: 4143452 - RNA, 64 nt, Human
gcucaccucgcugcagguggguggcagugacggagacugcagugcgccagagcgguaggagagu

SEQ ID NO: 4143453 - RNA, 56 nt, Human
gcucaccuucguccagcagccgcucgaggugguugaagaucccgcagaaguugggc

SEQ ID NO: 4143454 - RNA, 55 nt, Human
gcucacgguauuuuccgaaguccuccguguaaaaagggcgggcggugcagugggc

SEQ ID NO: 4143455 - RNA, 60 nt, Human
gcucacugccaaccugggacuggaucacaggacucuuuccgacccauguugccagucagc

SEQ ID NO: 4143456 - RNA, 56 nt, Human
gcucacuuaauuucaugcuacaauucuuggaagaaaaguggcauaguugauugggc

SEQ ID NO: 4143457 - RNA, 55 nt, Human
gcucagaaugcaguuuucuucuuucugcagagguuagaacugaaucauuuugggu

SEQ ID NO: 4143458 - RNA, 71 nt, Human
gcucagagcugugcuagcagauguaucucuucugccaguggggagcuggguuucuggcaggcuuaugaagu

SEQ ID NO: 4143459 - RNA, 55 nt, Human
gcucagaggagcaucauaaggaaauaagagaaguccuucaaagcuccuagugagc

SEQ ID NO: 4143460 - RNA, 64 nt, Human
gcucagcaaugugauacugugcaaggugcccaaucucuguauaccggucucacauuugcuaagu

SEQ ID NO: 4143461 - RNA, 70 nt, Human
gcucagcacucuugaguggcaugcucuaaccaggcccacagcuuuguucccugaccccucaagguugagc

SEQ ID NO: 4143462 - RNA, 84 nt, Human
gcucagccuauugccaggcauucaaagaaugguaauuauuaucuuacauaguuuguauauuuugaauguagcacagugucgggc

SEQ ID NO: 4143463 - RNA, 72 nt, Human
gcucagcgccagggcuggguuugucgguguucccaaaacugggucauauuugcccccaugcccuggccuugc

SEQ ID NO: 4143464 - RNA, 61 nt, Human
gcucagcuggagagggacggguugggacgcacuguccuuuugcccuucccccuccgcgagc

SEQ ID NO: 4143465 - RNA, 58 nt, Human
gcucaggaccgaggggugggaauucaaaacuccauggagccgccaucccuuucugggc

SEQ ID NO: 4143466 - RNA, 68 nt, Human
gcucaggaccugaacuguaggcuucccucacaaugagaaguaaagcuaaguauaggugaauccugagu

SEQ ID NO: 4143467 - RNA, 57 nt, Human
gcucaggccucacuccauuuggagacaaaaauugauagaggaagugauuggucuggc

SEQ ID NO: 4143468 - RNA, 69 nt, Human
gcucaggcgaccuccauggcucaguuucagacaaguuucuaagcaggucugauggccuggggccugggc

SEQ ID NO: 4143469 - RNA, 56 nt, Human
gcucagggcugggagcuguuguugcugcuggcagcccagcugcuauguaccugggc

SEQ ID NO: 4143470 - RNA, 91 nt, Human
gcucagggugagagugggccugcagguucugagaggcugggcuggggacaguugucucccaaccccugugcccagucuucuugccaggagu

SEQ ID NO: 4143471 - RNA, 127 nt, Human
gcucaggugcuuggaaguuccccuggggucccuugggauuccugagauucuccuggcuuggaaggcgcgggagccuugggagugccagccgggcucuuggugggaggcugagaagagcagcagcagc

SEQ ID NO: 4143472 - RNA, 72 nt, Human
gcucaggugugggccuguaugggucucagauaggccuaggggaucugucugggacacaggcuccacccaagc

SEQ ID NO: 4143473 - RNA, 83 nt, Human
gcucaguaauccagcagaacaguuaaagaaaccgugagcacuuucuugagguucuugguguguuuugauuuggguuauuuugc

SEQ ID NO: 4143474 - RNA, 74 nt, Human
gcucagucauauuguaguaauaaacaacccacacauuucaguggcuugaaaauguuaacaaagguuggcugggc

SEQ ID NO: 4143475 - RNA, 55 nt, Human
gcucagucuuugugggguacgggacaugcugccaccucacuucacagaggagagu

SEQ ID NO: 4143476 - RNA, 72 nt, Human
gcucagugagguagguaccauuaucacugcuagaaagcagugaacuuauauggucuuacuguggcacugggu

SEQ ID NO: 4143477 - RNA, 61 nt, Human
gcucaguucuagaacucucagcuguguccauuuggcugaagagaaggcauagaacuugagu

SEQ ID NO: 4143478 - RNA, 69 nt, Human
gcucaucaccacauauaacaaagguauuggauuuccaaggcaaacuuugcuugaauucuugggaagagc

SEQ ID NO: 4143479 - RNA, 98 nt, Human
gcucauccgggccaggcgugguuuaguggucuuagccugguugggggaaagcucccgagccaccagagcuggcucugagcacccgcuuguccgauggc

SEQ ID NO: 4143480 - RNA, 71 nt, Human
gcucauggagagaccagaauccagcugccucaccaaaacuaggaggcagcuaaaagcuguuuucccugagc

SEQ ID NO: 4143481 - RNA, 94 nt, Human
gcucauggagccagucagugacuuuauuuucuuuuccauuuuccuacagacauggguagacugacaaagucaaugcugucuuggauaugugagc

SEQ ID NO: 4143482 - RNA, 79 nt, Human
gcucaugggcuucuugcugggggccucagugcuguccgcuaaagcaccuacugugugcccagccgagcugccccugagc

SEQ ID NO: 4143483 - RNA, 92 nt, Human
gcucauguuccauccucugucuccccacuccccucauucuuucuuucaugagcagggaggugagaagggggucagaugagaggacauuuugc

SEQ ID NO: 4143484 - RNA, 71 nt, Human
gcucauuaggugauggagaaucagggagucaggggaauuuucugacccuggcucuucaccaccugcccugc

SEQ ID NO: 4143485 - RNA, 57 nt, Human
gcucauuugugguuugugaaggacaggcaagcagucauguacaugcauaaaugaagc

SEQ ID NO: 4143486 - RNA, 60 nt, Human
gcuccaagcucccaggauacagacuaauccauuuggugaggcuccugggaacuugcuagc

SEQ ID NO: 4143487 - RNA, 56 nt, Human
gcuccacacuuuguucuuuggaauucccccagagacugaagagcauguguaggagc

SEQ ID NO: 4143488 - RNA, 68 nt, Human
gcuccacagaguggaggcuuggccugacuccuguagcuccagcuaggcucuugccuucucucugcagc

SEQ ID NO: 4143489 - RNA, 75 nt, Human
gcuccacaggagaggguccauucuuugccuuuuccagguucugguggcugguggcauuccuugacuuguggcagc

SEQ ID NO: 4143490 - RNA, 68 nt, Human
gcuccaccccgugccggugcuggugccggagcaggggcgccaaggccuugaaggcgcgggggcagagc

SEQ ID NO: 4143491 - RNA, 62 nt, Human
gcuccaccuagcaauggaggucacugaagucgcuccagagaacuccaguggcuggcggaagu

SEQ ID NO: 4143492 - RNA, 71 nt, Human
gcuccagaguaacuuucuugugacauuugggguuuuaauggauuccagaaaccugaaaguuucucugcagu

SEQ ID NO: 4143493 - RNA, 102 nt, Human
gcuccagagucggggaagcgccaugguuccugcgcagaaaggaugcggguuggggccggcagauccugccaggacuaggggccuucccuuuccaucaggagc

SEQ ID NO: 4143494 - RNA, 62 nt, Human
gcuccagauguauacuuuccaagguucugcucucagcccuuuuuaaaaguggcaucugaagu

SEQ ID NO: 4143495 - RNA, 78 nt, Human
gcuccagcuacaguguuauugcaagcaauguguauuuaaaacuaauauacagaaaaguggauagccaggggcuggagc

SEQ ID NO: 4143496 - RNA, 109 nt, Human
gcguuuuguucauuguuggugucacugauauaaauccuacaaaguauauuuuaauauucacuaaacaaauguaacugguagauuuuaaaucggagccagauauaaaugc

SEQ ID NO: 4143497 - RNA, 109 nt, Human
gcuaaaaguuaggugauucuauuacuaaaaaagaaggagagaacggaaauggagauacaaauuagcagucuccacuacuuuguuuuuggugcucucacuacacuuuagc

SEQ ID NO: 4143498 - RNA, 89 nt, Human
gcuaaaaucaaaguuugaacuaagaccuugggaguaauaaaaaauuccacuuuugugguguuuccagguuuuuucaagcauauuguagc

SEQ ID NO: 4143499 - RNA, 60 nt, Human
gcuaaacuggcauugcugcagaaagaugagauagaguugaaccagcagguagaguuuggu

SEQ ID NO: 4143500 - RNA, 80 nt, Human
gcuaaagaugcaagugagcuuuuaguaacuucccugauuacuuucaggcuuugcaaaaaagcucauauaugguauugggc

SEQ ID NO: 4143501 - RNA, 73 nt, Human
gcuaaagcaccucaauucuagccacacccgugccauagaauggucacugggaccuaggacugagcugcucugc

SEQ ID NO: 4143502 - RNA, 97 nt, Human
gcuaaauaaauuauucaauuuuaauaucagugugauaccucaccaaagaaugucugcauuuucagaggaaaucucauugagaggucaaaauuuaagc

SEQ ID NO: 4143503 - RNA, 79 nt, Human
gcuaaaucuuacucucaggccugauuccuaaagcaaagugggugacagggagaugaggcuaugaauggggagauuuggc

SEQ ID NO: 4143504 - RNA, 91 nt, Human
gcuaaaugagacaacacaaggaaauuguuugguauaacaccugacauguugugcuaagcaauuugcuuaauauuugcuauuauuuuuaagc

SEQ ID NO: 4143505 - RNA, 79 nt, Human
gcuaaauuuuaccaaggucuuuuaaguccuuuggcugaaacagguauucaggacaguauaggcuuuaggagaauauggu

SEQ ID NO: 4143506 - RNA, 96 nt, Human
gcuaacacuuguagaaaaguuugacuauauucaagccaagaacacaaggauucuuggcugucuuugaaguuagggacucaucugcaaaugugaagc

SEQ ID NO: 4143507 - RNA, 61 nt, Human
gcuaacaggcuccaugaacaacgugugugugcucgucccaccauucauagggccuggaagc

SEQ ID NO: 4143508 - RNA, 80 nt, Human
gcuaacccagccaggugugucuggccccgaaguccauccuucuuggaccuuaccugggguucauacuugguuguggaugc

SEQ ID NO: 4143509 - RNA, 60 nt, Human
gcuaacuucuugguccugagcuguuauauaaugugucagcucuagcucucagaauguagu

SEQ ID NO: 4143510 - RNA, 55 nt, Human
gcuaagaggcuauaucuuucuccucuaaagggagugguuuacagcaucucuuggu

SEQ ID NO: 4143511 - RNA, 76 nt, Human
gcuaagaucagaucugcugucaagcugcacacucugaugugggcugugcaaaugaguugcagaucaggacuuuagu

SEQ ID NO: 4143512 - RNA, 85 nt, Human
gcuaagauguuauucucuacuuacuguguugacaucugcauuuguaguaaaaagcaauggugaguaaaucugcuggcgucuuagc

SEQ ID NO: 4143513 - RNA, 106 nt, Human
gcuaagcacaugucauauauucgcuaauuuaguccuuacagugcagagucuuaccaucccccuuuuacaaaugaggagcuggagucagagaauuaagacacuuagc

SEQ ID NO: 4143514 - RNA, 64 nt, Human
gcuaaguggcuuuugaucuugcugcagagugaagaugccccacagaagccaggagccgcugggc

SEQ ID NO: 4143515 - RNA, 55 nt, Human
gcuaauaauuccuuugugaacuaugaaagaaaucuaucacugaggcuuuguuggc

SEQ ID NO: 4143516 - RNA, 92 nt, Human
gcuaaugaggacagugcugcugaggaguuucuuauaugugucuuccaguacaugugugcaaagauuucucuggggcauguuuuucagucugc

SEQ ID NO: 4143517 - RNA, 60 nt, Human
gcuaaugagguccuagagagugugugggguucaccguguacaaucuagggccucaggagc

SEQ ID NO: 4143518 - RNA, 63 nt, Human
gcuaaugucacucuguuuccucugcauacagauagagcaugcagaggacccagauguauuugu

SEQ ID NO: 4143519 - RNA, 73 nt, Human
gcuaauuaguaaccuaauuccaucuguaaugucugaucacaucagcaccuggauuaguguuugacugaauagc

SEQ ID NO: 4143520 - RNA, 62 nt, Human
gcuaauucacaguaggaaauuuuaaaaaagguuugaggaagauuuccuacugggagauuagc

SEQ ID NO: 4143521 - RNA, 83 nt, Human
gcuaauucugcccuccuuccuuccuccuccaguucugguaggauaugagauacaagaggaagaggucuggggcaaugaauggc

SEQ ID NO: 4143522 - RNA, 56 nt, Human
gcuacaaauaaaaugggugacuaauccccaguucuuggacccauuauauuuguagc

SEQ ID NO: 4143523 - RNA, 72 nt, Human
gcuacaaguucaaagcuccugguacaguagguagauuuuccuaugagucacuuaggaguuuugcccuguggu

SEQ ID NO: 4143524 - RNA, 75 nt, Human
gcuacagcccagagggaagggaaugagguaagggcguuuuauuuugcuccuguuuuuuuggagacauuuguaagc

SEQ ID NO: 4143525 - RNA, 63 nt, Human
gcuacauccuucaaaaggaauagcagguggugucccccagccuggcugaccugaagguguagu

SEQ ID NO: 4143526 - RNA, 71 nt, Human
gcuacaugaggcauagcagggaucggacgccgcagagucccugacucuuccccccuggugugucuaugagu

SEQ ID NO: 4143527 - RNA, 70 nt, Human
gcuacaugaugugucagucagcuauugcugcuuaacaaacaauuucaaagcucacuggcauauaagaagc

SEQ ID NO: 4143528 - RNA, 103 nt, Human
gcuacaugauuuccaaugguacugagucuaacauuaacauuagguuuaaacauuaacuuuuguagaucaagaauguccacuuguccuuggaaaauuauuuagc

SEQ ID NO: 4143529 - RNA, 130 nt, Human
gcuacauuugggaauuccagcuggggcugggaggaagugaaagaggaggacgguucccagaaggcgcauaacaggcauuuucagugggggcuuuccuucugccacuccgauaagccccucgaguuccugc

SEQ ID NO: 4143530 - RNA, 114 nt, Human
gcuaccagaugagacugaaaaagacacagaaguuuauuauucaacuucauguuuggaaagcaaaagcaaggggcagugaaagugugcaacuggucaagggucuaacuuuggagc

SEQ ID NO: 4143531 - RNA, 60 nt, Human
gcuacccugcccucaggcugcuucccucccaagggaaacacuaugccaagacagggaagc

SEQ ID NO: 4143532 - RNA, 82 nt, Human
gcuaccugaacuucccauguacagacuggcucucuagauuagcucagugcaacguugugcauucaaggugaauguucagagc

SEQ ID NO: 4143533 - RNA, 74 nt, Human
gcuacucucuguguuucugagaaucccaccugugcagcgcagggacuggacacuuaagaagcccagaaaacagc

SEQ ID NO: 4143534 - RNA, 77 nt, Human
gcuacucuuucuuagcuuugcuucugggagccaagaguaauuauucuguuuguaaagagucaagcaaagaagauagc

SEQ ID NO: 4143535 - RNA, 75 nt, Human
gcuacugggggcucuuccagggaagacgcuggcgggaauaggauggggcuggcagcuggggagccucgcgguggc

SEQ ID NO: 4143536 - RNA, 117 nt, Human
gcuacuguugcugugguuguauuuuauuuguugaacaauccuguacuuugaaaugauucauuuaagagccaugaaacauucaaagcaggaugugugacucacauagcaaacaguagc

SEQ ID NO: 4143537 - RNA, 79 nt, Human
gcuagaagagcugccuggagaggcagggauggcccgugguugaacagagagcuuuccuacccuuccaggcagagcuagc

SEQ ID NO: 4143538 - RNA, 78 nt, Human
gcuagaagugacuaagguuggcaguggaauugggagcuuaguaggcccaaucaacuguguggcuuucuucacuuaggc

SEQ ID NO: 4143539 - RNA, 58 nt, Human
gcuagaauauuggguaggcaaguagcagcaucuacaacagucuaaugcaguauucggu

SEQ ID NO: 4143540 - RNA, 74 nt, Human
gcuagaccguugugggauauuuuucaguguaaaaacuagcauugugcaauguuuuacaauuuauguucauuagc

SEQ ID NO: 4143541 - RNA, 55 nt, Human
gcuagagaccagaggccuugaaggaaggaagcccaagggucucuccuggcucugc

SEQ ID NO: 4143542 - RNA, 67 nt, Human
gcuagagaugcacuuucuuuucaacaguucuaagaaaugagaagguuagauaucaaggcaucucagc

SEQ ID NO: 4143543 - RNA, 55 nt, Human
gcuagaggcaacaacuuuauaggcggaaggggccuuauagaucacaucuucuagc

SEQ ID NO: 4143544 - RNA, 63 nt, Human
gcuagauggcucucccagagauaucacuuuucagauuuacgaugccugggauuauccacuggu

SEQ ID NO: 4143545 - RNA, 59 nt, Human
gcuagcaaaugucauuuggaagguaaagauaaaagcuuucagagaguacaguugcuggc

SEQ ID NO: 4143546 - RNA, 59 nt, Human
gcuagcaaguggcagaacgagguuauaaauucauagauccuggcugcacaguugcuggu

SEQ ID NO: 4143547 - RNA, 65 nt, Human
gcuaggaagauauuuggguaaaguuaauacaaggaucucuuauuaccuuggcuuagcuucuuagc

SEQ ID NO: 4143548 - RNA, 87 nt, Human
gcuaggacaagugccaauuagagacauccaucugggggccuggcaguggcagagagcugaggaggugucuauaaugguacuuccagu

SEQ ID NO: 4143549 - RNA, 78 nt, Human
gcuaggcuaacucccuuccagaggcuucagggaagaagcuguuuccuucccccuuuucagcuucuagaagcugccugc

SEQ ID NO: 4143550 - RNA, 77 nt, Human
gcuagggaagaagaacccauuuugaauuaaaaucccgugcauauuggucucauuuuaaaauguggucucucccuagu

SEQ ID NO: 4143551 - RNA, 71 nt, Human
gcuagguagugucagaaccaagcuggaaccaggggaucuggcucugggcuuggauuggcucugcuguuggc

SEQ ID NO: 4143552 - RNA, 63 nt, Human
gcuaggugaccuuggcucuuacagggugaucuucacauucugucaccgagggcauccaaaagc

SEQ ID NO: 4143553 - RNA, 68 nt, Human
gcuagguguccucguccaaagauucuguuuaauugaugauugauucuaaugggccaggaaacacuggc

SEQ ID NO: 4143554 - RNA, 56 nt, Human
gcuagguuggggaaguucuccuggauaauauccugcagaguauuuuccaacuuggu

SEQ ID NO: 4143555 - RNA, 104 nt, Human
gcuaguaaaauaaacaccccgauucucauuugugugcaauucagaauauuacccagauguugggaugaauacaaugggaucaucugugggaaaagcacauuagc

SEQ ID NO: 4143556 - RNA, 77 nt, Human
gcuaguagcagagccaggucucucuguagauccaugggcuccagagcugggucugugcucaccacauugcaacuagc

SEQ ID NO: 4143557 - RNA, 65 nt, Human
gcuagucagugggcauguauguauaguuacuuagauagauguugccuaacugcccucugaaaagu

SEQ ID NO: 4143558 - RNA, 63 nt, Human
gcuaguccacagccauccaggccguuuccucuuugucuuggcuuggaguugaauggacguagc

SEQ ID NO: 4143559 - RNA, 99 nt, Human
gcuaguccugugauggcuauuuagaguuaagcaucaauuucuuaugaguggcaucauguucucccaugcuuaacucuguacauaguuucaaggaaaagc

SEQ ID NO: 4143560 - RNA, 55 nt, Human
gcuagugagcucuuugucaucugacuguaaguuuggcaaauaugcuuucauuagc

SEQ ID NO: 4143561 - RNA, 76 nt, Human
gcuagugggccuuauuuccugugugaaacaacuuuuaucaaaauguauuugacacugggagugugggugaacuggu

SEQ ID NO: 4143562 - RNA, 61 nt, Human
gcuagugggucccaggacuuagucucuugucuacauauacucaucuucugguauccacagu

SEQ ID NO: 4143563 - RNA, 74 nt, Human
gcuaguguuuauuaaucaugagggcucuccuucuguguauuguucucagggaccuuaugaauaaaaaugcuggu

SEQ ID NO: 4143564 - RNA, 59 nt, Human
gcuaguucuuugcccugagcagaaguccuuggaaagcuacugagggcaaagagugaagc

SEQ ID NO: 4143565 - RNA, 59 nt, Human
gccccaguguccugcagggcaguagcuuuuugacauuguucaugcccugugccuggugu

SEQ ID NO: 4143566 - RNA, 91 nt, Human
gccccaucuccaggguuucuucucuguauaguuuccucuaaauccagaguuccuauuacagggaagccuugggaacauuuuagaaggaggc

SEQ ID NO: 4143567 - RNA, 65 nt, Human
gccccaugcauauugugaaaauguagauugguaugcacgaacuauugcauauuguguaccagggc

SEQ ID NO: 4143568 - RNA, 80 nt, Human
gccccaugccugccacaguaccccaagagugucugccauggcugucccugacugucaccuccugggguuggggcuggggc

SEQ ID NO: 4143569 - RNA, 55 nt, Human
gccccauuuccuuccuggggcaggguuagucauccggcccugcaggagguggggc

SEQ ID NO: 4143570 - RNA, 70 nt, Human
gccccauuuucagcccccacucguggcaguacaguaucuuccugcugggaaucgagguguggaaaggggu

SEQ ID NO: 4143571 - RNA, 75 nt, Human
gccccauuuuggaggcaccugguugcaggggaccacagcuaggugagucacaacugggugucuucaucagggggu

SEQ ID NO: 4143572 - RNA, 130 nt, Human
gcccccaaagagugcugaauuuuuguugcacaugcuuaaaaaugcagagaguaaugcugaacucaaggguuuagauguagauucucuggucauugaguauaaccgaguaaacaaagcaccuaagaugcgc

SEQ ID NO: 4143573 - RNA, 76 nt, Human
gcccccaacuuuugaaaggacuuagagagaaaaauggcaaaagugccuucugggauuuuugaagacuccugggggc

SEQ ID NO: 4143574 - RNA, 67 nt, Human
gcccccaucuccccacaggaacccgacaucauccaagucaauccugagccccagggagguugggggu

SEQ ID NO: 4143575 - RNA, 79 nt, Human
gcccccgccggagccgccccagggccgccggcaaacagagucccuuucaaguuuuccgcuggggccgccuggcgggggc

SEQ ID NO: 4143576 - RNA, 60 nt, Human
gcccccuacuguucugugcuucagcacagccugguuugucaagaggcacauaguuggggc

SEQ ID NO: 4143577 - RNA, 59 nt, Human
gcccccuccauugggccugcuucccggagcuggagccgagcaggccagugucagggggc

SEQ ID NO: 4143578 - RNA, 81 nt, Human
gcccccucuagcauaugcacgucuauuuaugaagacacuuagccaggauuuaguaaguucacugcaaagcuccaggggcgc

SEQ ID NO: 4143579 - RNA, 97 nt, Human
gcccccucuucuccagggaugcgugugugcaaaccauugccccugagaguagaugcggcuguguguguacauccuugccccugagaagagagguggc

SEQ ID NO: 4143580 - RNA, 59 nt, Human
gcccccugacacuggccugcucggcuccagcuccgggaagcaggcccaauggagggggc

SEQ ID NO: 4143581 - RNA, 73 nt, Human
gcccccuucuuuccugggcgccuuaggugguagucagccacaccacaacugccagccaggaaaggguaagggc

SEQ ID NO: 4143582 - RNA, 87 nt, Human
gcccccuuggggcccacagaggcaccaccaggcccccaaagacccauuucucugucuccagcuguggucccucuguccucauggugc

SEQ ID NO: 4143583 - RNA, 58 nt, Human
gccccgagggauugaaggcaacuaaaaauagugcauuaaauauaaucuguugaggggc

SEQ ID NO: 4143584 - RNA, 93 nt, Human
gccccggagaccuggaggacagcagugcuggcacuuggguguccaugggcccgucugccggcucugccugugcugcaaguguuggccgugggu

SEQ ID NO: 4143585 - RNA, 126 nt, Human
gccccuauuguucagcccaugugcauuuucuguccuugcuacccuauuugcuuuguuuaucacccaacugaguaagcaccgggauggucaaggaaggcaguugaaugccaucuacagauagagggu

SEQ ID NO: 4143586 - RNA, 69 nt, Human
gccccucaccuggacccugggaggagggcgggggaccgcaucugcgaagcguccgaggacaagaggggc

SEQ ID NO: 4143587 - RNA, 59 nt, Human
gccccucccugggcgugcccuggugcuacacgcaccugugggcagccucgggagugggu

SEQ ID NO: 4143588 - RNA, 91 nt, Human
gccccucuugucuuuccugggccagggugagggcugagaggucuuccuggggaagauugagcagacggcacuuuggcuggggaagaagggc

SEQ ID NO: 4143589 - RNA, 62 nt, Human
gccccucuuucuggaaggcagagugggccacagggguuuauggagacuuucagaagcggggc

SEQ ID NO: 4143590 - RNA, 55 nt, Human
gccccugaaauucauagggugauauauaaucaccaaugugaugauauuaggaggu

SEQ ID NO: 4143591 - RNA, 68 nt, Human
gccccuggccuggaggaaguuccugcuggauccuuuacuucccagaaacugcuccccugguaggcggu

SEQ ID NO: 4143592 - RNA, 68 nt, Human
gccccugggcugcccauuccacuggauggucacauuaauuugcaaccacaggaggauggcugcugggc

SEQ ID NO: 4143593 - RNA, 63 nt, Human
gccccugggggccccugcccuggcucccugaccacacacagaggcugcagggagcccuggggu

SEQ ID NO: 4143594 - RNA, 78 nt, Human
gccccuucacccaguuguugccggcucuggacuggccaaacacgaaguuguccggccgaaagaucugaccgaaggggc

SEQ ID NO: 4143595 - RNA, 82 nt, Human
gccccuuccaucagaccugcugugagcaacaaccuguggcuguggcuguggcugugacuggcagaggugucugggguggggc

SEQ ID NO: 4143596 - RNA, 66 nt, Human
gccccuucccugguagaaguuuuggaugaguugagggagagacuguccagcuccagggaggcaggc

SEQ ID NO: 4143597 - RNA, 69 nt, Human
gccccuugaacuacaucacccuauuucuguccauggugggcaguacuuuaagggaugaagcucuggggc

SEQ ID NO: 4143598 - RNA, 108 nt, Human
gccccuuucuacacucacuucccuggaacccgugauccugacuccccuccucccggaccccaagcauccaggacguguacgguauaaggggaaguuguagugggaggc

SEQ ID NO: 4143599 - RNA, 70 nt, Human
gccccuuucucuccugcuagagaauaacagcaccugcuuugagugggugugguccucuagugaaagaggu

SEQ ID NO: 4143600 - RNA, 89 nt, Human
gcccgaggcacuaucugucacucuuggugaauuugcaaaugccuaucauagaggcaguuucccaagagacagaaugguauccuuugggc

SEQ ID NO: 4143601 - RNA, 64 nt, Human
gcccgaggucccaguugcccaggucaggcagaaagugugucuggaggggaaacugaggccuggc

SEQ ID NO: 4143602 - RNA, 69 nt, Human
gcccgaguugacgggcuccccggugcgcggaugcagccaggucgugcagcggagcuggucacugcgggc

SEQ ID NO: 4143603 - RNA, 77 nt, Human
gcccgcaccagcuucucuggccgcaguguggaguugugcugugccagccgcaagcccaccauggccgaagcacgggc

SEQ ID NO: 4143604 - RNA, 66 nt, Human
gcccgcccacuguuuuccuuggugcguuucucuuuaaaugcaaauaagugcaggcgugguguuggc

SEQ ID NO: 4143605 - RNA, 60 nt, Human
gcccgcugcuugccacuucccucuccaaacgcuggcggggguggguggcagcaccgaggc

SEQ ID NO: 4143606 - RNA, 71 nt, Human
gcccggaacacgguggccauggucagguagcggccaugucgcggguugcacauggccaucauguucuuggc

SEQ ID NO: 4143607 - RNA, 78 nt, Human
gcccggauuuuggcggacugagaacgcgggccacguaggccuuggccugcgcgucugggucugucucugacucugggu

SEQ ID NO: 4143608 - RNA, 55 nt, Human
gcccggcaggagugggcccggcucccggguggcuugggcccaguucccgcugggc

SEQ ID NO: 4143609 - RNA, 56 nt, Human
gcccggcuugugauuggcugagauagcacagagcuccagccaaucagagcugaggc

SEQ ID NO: 4143610 - RNA, 82 nt, Human
gcccgggacuccccaacagcgacguccuccccaacaggccccagccucccuugacaguaccugcuggguggggccccgaggc

SEQ ID NO: 4143611 - RNA, 68 nt, Human
gcccggggcccagggcugcaaguggacgcugcagcgcuuccggcaguaccuggcguccaaacacgggc

SEQ ID NO: 4143612 - RNA, 55 nt, Human
gcccggucucucuaguuuagaccgauaaauuggucuacauugagagagcugcugc

SEQ ID NO: 4143613 - RNA, 66 nt, Human
gcccgugggccuccccuuuacgagccacggagagcuucggggcuggagggccggggccugcgaggc

SEQ ID NO: 4143614 - RNA, 56 nt, Human
gcccgugucuccugcucugugggccgaguucuugauucaccagcucaggcaggggu

SEQ ID NO: 4143615 - RNA, 88 nt, Human
gcccguucuugcuguguugugcugccuccauauccgucaggaagagccuuuccagaaugauucugggcauauacuaagaagagcaggu

SEQ ID NO: 4143616 - RNA, 82 nt, Human
gcccuaagcccagguaggagagucaacaugucccccagccaauuagggacauguugacuauccuaccuaggcuuagacaggu

SEQ ID NO: 4143617 - RNA, 130 nt, Human
gcccuaaucuguggugucucaucuuuccuccccucccuccuccuucccacugugccugaguguguauugucaaagugucaagugaggagggaaagagaaaaccaggccagauaacgcagaauugguaugc

SEQ ID NO: 4143618 - RNA, 77 nt, Human
gcccuagagaagaugugaacagaaccacaggccauuguagucuggguaggagucugucaugucaccuccuauggggu

SEQ ID NO: 4143619 - RNA, 56 nt, Human
gcccuagggagggauguuggcaugaggaaccugccaagucacauauucccccuggc

SEQ ID NO: 4143620 - RNA, 80 nt, Human
gcccuagugagauuuuauauaucaagcagggaacuucuggauuccauugcucaauauagaguuuccaauaucacgauggc

SEQ ID NO: 4143621 - RNA, 79 nt, Human
gcccuaugauuuuucagggagagaaaucacagcucuaugccaggaggugauuucuaaucaucugaauguuguaaugggc

SEQ ID NO: 4143622 - RNA, 58 nt, Human
gcccucaaccuccuuuccugcugggguucccaacucacaguaagcgggguuggagggc

SEQ ID NO: 4143623 - RNA, 78 nt, Human
gcccucacagagcucauacugggaggcacacaggcaggagacuuucagcaaacuccugugugagagcugugcuggggc

SEQ ID NO: 4143624 - RNA, 105 nt, Human
gcccucagcgccccggaaggguacggggcagccuccaggaaagcugucaggagacgcuuccucccgagguggucccggcggccaaguggggcucgguugacgggc

SEQ ID NO: 4143625 - RNA, 55 nt, Human
gcccucaguggauucuuauuguucuucaaguaaugaccaaaauccuucagagggc

SEQ ID NO: 4143626 - RNA, 69 nt, Human
gcccucaugcaaaugcuagagaauguuggaguaugaaaccagggcuucuuggcauuugcuggggagggu

SEQ ID NO: 4143627 - RNA, 67 nt, Human
gcccucccagcccccaucgagaaaaccaucuccaaagccaaaggugggacccguggggugcgagggc

SEQ ID NO: 4143628 - RNA, 78 nt, Human
gcccucccucaacugggcagcacagggggauucuguaagcagagcugcccuggcggagcugcucgggagggguggggc

SEQ ID NO: 4143629 - RNA, 65 nt, Human
gcccucccuggauccuuccgugucuguccccauugacacagcauggcaaauaucgagggcagggc

SEQ ID NO: 4143630 - RNA, 57 nt, Human
gcccuccuggccugugcagagccccgcuuggggguccugcgugggcccaggacaggc

SEQ ID NO: 4143631 - RNA, 73 nt, Human
gcccucgagucugcggaguuugcagagcgcgagccguuuaaauuuagcgcuuugggcugccuggagcgagggc

SEQ ID NO: 4143632 - RNA, 104 nt, Human
gcccucgcccggcuugcugggaguuguagucucuuaacugcucuaagccaguggcuugcagggcuacaggacuacaacucccaggaugcgccgggcgugggggc

SEQ ID NO: 4143633 - RNA, 65 nt, Human
gcccucggcugguacccugagaaguucaguuguuagcuggaaaucaggucuauacuaugagaggc

SEQ ID NO: 4143634 - RNA, 55 nt, Human
gcccucuaacgugaccuuagccuucauucaucacagguugaaaguaggugagggu

SEQ ID NO: 4143635 - RNA, 76 nt, Human
gcugggaaaaagaauucagugauauuucuccuauuugcuuuugaaagaagagaaauauggcucaguuccacccggc

SEQ ID NO: 4143636 - RNA, 127 nt, Human
gcugggaaagguugugacugcccugaggcccagccgcccugagagcuugguccuguccuuguuuucugggcugggcugugucugcauguugaagggcugucuuugaaaauggccuucacuuucuagc

SEQ ID NO: 4143637 - RNA, 56 nt, Human
gcugggaagagaugcacaugauuggcucucgugagcucgugugaaucaucuccagc

SEQ ID NO: 4143638 - RNA, 55 nt, Human
gcugggagaauauuuaaaaugccucagaagaugaagcauuuuaagcauccccagu

SEQ ID NO: 4143639 - RNA, 61 nt, Human
gcugggagcucugagccugcuaugggucuucuccaugggccuuacucuaagggcuucuggc

SEQ ID NO: 4143640 - RNA, 65 nt, Human
gcugggaugcaggacggcauggauguacagccauccuguacauggauggggccugcauccuaagc

SEQ ID NO: 4143641 - RNA, 61 nt, Human
gcugggauggcuuuccugcauuaugacacuuaccucgugguuccaagauggcugccacagc

SEQ ID NO: 4143642 - RNA, 64 nt, Human
gcugggcacagaauagauggcccauuaauacucacugauggguuuauugauuuguguguccagu

SEQ ID NO: 4143643 - RNA, 59 nt, Human
gcugggcagccccuacagagagcgcuccaaauaccaagccaaguaggguccuccccagc

SEQ ID NO: 4143644 - RNA, 63 nt, Human
gcugggcagugagugaguccuuuugaaggggcauaucuccuuccccacucacuccugcugggc

SEQ ID NO: 4143645 - RNA, 115 nt, Human
gcugggcaguucuucuggucuuggcuggguucccuccuaugcccacugaaagcugagugggagcucucgcuggguauaugagggagcgacuggcugucagcuggaacaucuuggc

SEQ ID NO: 4143646 - RNA, 62 nt, Human
gcugggcauuugcaggucaggcacccucaggauuccagggccccugggaaggcagccccagc

SEQ ID NO: 4143647 - RNA, 92 nt, Human
gcugggccagggugaggccacuuccccacagcccuggaaaugggaggucccgggcuaccuugggaggaugaauuagcccacauccugcuagc

SEQ ID NO: 4143648 - RNA, 83 nt, Human
gcugggcccaccauugagaugaugugucuuuccugccuggguacuguccacagggagcauugugacauaucacugggcccagc

SEQ ID NO: 4143649 - RNA, 66 nt, Human
gcugggccguuuggacuggcgcacggccccacgcugggccagcugcagguguuccagauggccagc

SEQ ID NO: 4143650 - RNA, 58 nt, Human
gcugggccuguggcuuggcucuagggcugcuucuggcccccuaggcacagagcccagc

SEQ ID NO: 4143651 - RNA, 91 nt, Human
gcugggcggaggcugggugaccaaggaagaggggagccagggcugggccugagggcugucugaagcuugggagucacggucucagcucagc

SEQ ID NO: 4143652 - RNA, 61 nt, Human
gcugggcuccagcccgggaccaggugcucuaggugggccugggccugggcuggggaacagu

SEQ ID NO: 4143653 - RNA, 58 nt, Human
gcugggcuguaguuugcugacccugugucuacaguauuaaucaaauuuacaacccagu

SEQ ID NO: 4143654 - RNA, 64 nt, Human
gcugggcugucccaaccccauccccugggaguuucagcacaggaugcacugggacuggccaggc

SEQ ID NO: 4143655 - RNA, 61 nt, Human
gcugggcuucucaaugcugccucugagaggagagaggugagggcauugugggugccacagc

SEQ ID NO: 4143656 - RNA, 108 nt, Human
gcugggcuuuggcauggccucuagcaugccugcuguggugugaggcucagcagcucuauugcccaugucuaacccagcuggaugcauggaggcucuggcuuucccagc

SEQ ID NO: 4143657 - RNA, 65 nt, Human
gcuggggagccuggaguuucugaugggaggaggcuaccucuacccucgcuccucgguuccccugu

SEQ ID NO: 4143658 - RNA, 57 nt, Human
gcugggggaggaggggcucuauggcugacugacggagcagcaguauccuuccccggc

SEQ ID NO: 4143659 - RNA, 64 nt, Human
gcugggguauccguuaguaagaugggcacggucccucgcugccugcucugauuuuugccccagc

SEQ ID NO: 4143660 - RNA, 89 nt, Human
gcuggggucuaggaaaugucccuacagcuauguaugcugggcuaccauauccauuuucucucuguggggucaaaauccagugccucagc

SEQ ID NO: 4143661 - RNA, 94 nt, Human
gcuggggucucuggggagcagcaagcagugcacggguucucagugcccaggacagccccugcagaugccuugugccccuuagggagacgcuggc

SEQ ID NO: 4143662 - RNA, 56 nt, Human
gcuggggucuuccuguaaaacaacucaggucccaaaccuacccaggaagacucagc

SEQ ID NO: 4143663 - RNA, 62 nt, Human
gcugggguucccugggcguaccugcaaugaucccguccauuugcuccagggcagcuuccagc

SEQ ID NO: 4143664 - RNA, 79 nt, Human
gcugggucaaagagaguuuaagugacuugccgaaggacaaacagcuaguuaaauggcagcacuugaacuugagcccagc

SEQ ID NO: 4143665 - RNA, 77 nt, Human
gcuggguccagccauguccugguccuccaccaugggcccagcccugggacucggccaggacagauggcccacuuagc

SEQ ID NO: 4143666 - RNA, 59 nt, Human
gcugggugcugccuggggagccuggaaguccguccgcauccagggcgcaggaucugagc

SEQ ID NO: 4143667 - RNA, 93 nt, Human
gcuggguggaaccuuggaugucaucuccuccagcucuccgaucucaggauggagucccagagaagggaagggauucacccagggucacccagu

SEQ ID NO: 4143668 - RNA, 57 nt, Human
gcuggguggcacuucugggguccagcagauguuucacuuggacuuccugucuccagu

SEQ ID NO: 4143669 - RNA, 67 nt, Human
gcugggugggcacccagccugggcugugggcacagggacagccaucccaggcuggggcuccuccagc

SEQ ID NO: 4143670 - RNA, 58 nt, Human
gcuggguguucaggagcugggcucaugucacaugagggcccaugugggagcacuuggc

SEQ ID NO: 4143671 - RNA, 55 nt, Human
gcuggguuucuggaucucuaggucuggaaaggcuuuccuuucuuugacacccagc

SEQ ID NO: 4143672 - RNA, 65 nt, Human
gcugguaaaugcucaacaauugccuuuccaggaauuaaaauugcuaguuuguagcauuugccagc

SEQ ID NO: 4143673 - RNA, 57 nt, Human
gcugguaagcgacaaagucagguuugacucacacagccuggcuccagaacuuccggu

SEQ ID NO: 4143674 - RNA, 99 nt, Human
gcugguacaugugcuuauucagccuuuugggcaauucagugggaccugacacauguugucauccugcccuggagaaggcugacaguugguggugccagu

SEQ ID NO: 4143675 - RNA, 58 nt, Human
gcugguauaauaauguuuuucagccugaccuuuggcaaaaggcacuaugucugcuagc

SEQ ID NO: 4143676 - RNA, 71 nt, Human
gcuggucacuaugugucccuuugaccacggguaaauauuucuauuuggucccuggaaggcacuagugaugc

SEQ ID NO: 4143677 - RNA, 122 nt, Human
gcuggucagaggcuuuuacaauguuugggcagcuguuguggauuggaaagagaacuagguuuggaauccaaagagcuucauuuccauuuauucuccuauguaagagcuguacgaccuuaggc

SEQ ID NO: 4143678 - RNA, 56 nt, Human
gcugguccugggguugcagcauccagcugggagccucuguagcuccaggauccagu

SEQ ID NO: 4143679 - RNA, 62 nt, Human
gcuggugauagauguuuguucaugcuuaucuucauauauaggaacagacauuugcaauuagc

SEQ ID NO: 4143680 - RNA, 55 nt, Human
gcugguuacuucauuagguccucucauugauugaacccugcugaagugaugcagc

SEQ ID NO: 4143681 - RNA, 58 nt, Human
gcugguuagcaucugcguuggguuggacuuuccagguuuaaaacaagggaugcccagu

SEQ ID NO: 4143682 - RNA, 72 nt, Human
gcugguuccuuccagaggcucuaggggagaauccaugucaugcuucuuuccuaguuucugguggcugccagc

SEQ ID NO: 4143683 - RNA, 59 nt, Human
gcugguugucccuggacuuagagaagguaaggcugagagagguuccagccacaaccagc

SEQ ID NO: 4143684 - RNA, 62 nt, Human
gcugguuuagugaaauaggccagagagauuucuuguugcuugaaauucacuggguccugggc

SEQ ID NO: 4143685 - RNA, 66 nt, Human
gcuguaaacccagguggacaaggcuuucacacuauaaaguaagcucaaagucuaaccuggcacagc

SEQ ID NO: 4143686 - RNA, 102 nt, Human
gcuguaaucucuagugcgggguuucucaacaguggcaccacuggugguuugaacugauaaucuucuguugugggagcuucugugcauuguaggauacuuagc

SEQ ID NO: 4143687 - RNA, 82 nt, Human
gcuguaauuaagauuuugaaugguuugaguucucacugaugugcucaauucagaaaaauucacuccuaagaucauuuauggc

SEQ ID NO: 4143688 - RNA, 67 nt, Human
gcuguacagcaggaggugaguagcaggugagcauuacuaucugagcuccgccuccugucagaucagc

SEQ ID NO: 4143689 - RNA, 67 nt, Human
gcuguacagccaugggcuucucuguguccuucccuggacucaugguagcacaggcugugugagcagc

SEQ ID NO: 4143690 - RNA, 86 nt, Human
gcuguaucaauuugaucugaaacacaaggauaauguucccagcuguggcaucuggguccuuggaaauuucaucagacagugccagc

SEQ ID NO: 4143691 - RNA, 58 nt, Human
gcuguauuaauagaguaugugguaggauauaaaauccccauacacuauucuguauagu

SEQ ID NO: 4143692 - RNA, 85 nt, Human
gcuguauuuuugaugcugagaaaccugucuggcacacagugugugcucaauaaauguuucugacugaauagauagaagauacagu

SEQ ID NO: 4143693 - RNA, 86 nt, Human
gcugucaccaugcaggcaccagacccgggcccggcaccagacacuaccucaccccgcccaggucugccagccugugggaccucagc

SEQ ID NO: 4143694 - RNA, 81 nt, Human
gcugucacugaccagguggaggugugagguccuggggcaucauggcaggaccuuggacauccacuuucucaggucugcagc

SEQ ID NO: 4143695 - RNA, 77 nt, Human
gcugucagucacaugcugugggaucuguauuguguauucuggucacaacacauuccugcagacaugaugcuugcagc

SEQ ID NO: 4143696 - RNA, 60 nt, Human
gcugucccaugguugcaagaugacugcaguucuaggaauuacaucuguaauccgggcagc

SEQ ID NO: 4143697 - RNA, 72 nt, Human
gcugucccccaggguccggauaacccugggcaggcugucccccgggguccggguaacccugggaagggcggc

SEQ ID NO: 4143698 - RNA, 60 nt, Human
gcugucccgaaccccugguaauagaauuguuuaucuuuauaccaagaaguuugggaaagc

SEQ ID NO: 4143699 - RNA, 80 nt, Human
gcugucccuguggccucuguggcuguggaccuggucugugucuuaagagaccaggcugcagcagcaguggcccaggcagu

SEQ ID NO: 4143700 - RNA, 62 nt, Human
gcugucccuuucacaagguuuugggaacuaaugcuucauuucaagcuuggggugggaacagc

SEQ ID NO: 4143701 - RNA, 63 nt, Human
gcuguccucgucucucacgcaaaccuucaguuuuugcgauaaauccaaggaggccaggagagc

SEQ ID NO: 4143702 - RNA, 83 nt, Human
gcuguccuuuaaccuugugugucuagaauuucauuuuaucuuuuagguuuauguaguugaagugcuauaaaguaaaggauggc

SEQ ID NO: 4143703 - RNA, 121 nt, Human
gcugucgagucugcucuuaggaagaggagcugagcuuuggcccuggagguuacuggggggaaaguggccaguacagcccaggccaggcuggcuccgagaaagagcuaaggcgggggacagc

SEQ ID NO: 4143704 - RNA, 95 nt, Human
gcugucgcagacagaaaggggucucaguggguggagaaguggaccugcucacagaagaagaccaccucuccaaccuggacuuccuccacgauggc

SEQ ID NO: 4143705 - RNA, 81 nt, Human
gcugucuccagcguguggugucauuccagguucagccagcagaauuaaguggacaaaugaaugaugaacaccaaagauggc

SEQ ID NO: 4143706 - RNA, 71 nt, Human
gcuccaggagcucacagcucgcuccagcuacaucacuggccuccacgcugggacguggagcucucuggggc

SEQ ID NO: 4143707 - RNA, 56 nt, Human
gcuccagucuuggcuuggucaaugucuggcacaacacagcaauuaagacugugggc

SEQ ID NO: 4143708 - RNA, 130 nt, Human
gcuccaucuugcgggccgaagcgcgagugcugcucugugacagccuccggccgcggccuucccagcugcuaccgccgcuuuucggaugggcugugauagauggaguagcagcgaagacugcuagaagagc

SEQ ID NO: 4143709 - RNA, 69 nt, Human
gcuccauuuccauguuuacugggacacaacauuguuccacuugguugcaucagaaaauaugggaagagu

SEQ ID NO: 4143710 - RNA, 78 nt, Human
gcucccaagauuuuugaucugagcaguuggagagcuagaguucccacugacugagauggaaaaagcugcgagaggagc

SEQ ID NO: 4143711 - RNA, 56 nt, Human
gcucccaaggacucacugaguacccucucaguuaacucagagaaaugucugggagc

SEQ ID NO: 4143712 - RNA, 95 nt, Human
gcucccaagucgcacccagugcgagccugugcuggccucuuggggcuagauaucccggugagccaggcaugacugccucggugcagcuuuucggc

SEQ ID NO: 4143713 - RNA, 62 nt, Human
gcucccaccuuugcuaucaguacuuaugccuaguaggccuugcugaaggcaggggagguggc

SEQ ID NO: 4143714 - RNA, 58 nt, Human
gcucccagcauugcugcugaauaagccagcccuuugguuacuucagugcagagugagc

SEQ ID NO: 4143715 - RNA, 68 nt, Human
gcucccagcccugcgugccaggggacugccuucaacaggaugguccgggauggacgcgggcugggcgu

SEQ ID NO: 4143716 - RNA, 57 nt, Human
gcucccagguccccaccugucugcugccuuggucagcagcccugggaccuggccugc

SEQ ID NO: 4143717 - RNA, 76 nt, Human
gcucccauugcuucaaagauccuccacuagaguaucagggacccucuuuaaaugggaucuuuguagaaguaagagu

SEQ ID NO: 4143718 - RNA, 61 nt, Human
gcuccccaaaagcuccaggaaaggauacuucuuggccucucuucuggcuucugguggcugc

SEQ ID NO: 4143719 - RNA, 83 nt, Human
gcuccccagggccccucaauucuccaccagugcaggucuagauauacaucugccugaaccacucuuggaguuuucuugggggu

SEQ ID NO: 4143720 - RNA, 82 nt, Human
gcucccguuaucuuugcaaucugcaaagcuguggaggcugguacccaaccuuccgcggcgcgggcgcaaggccgaggggagc

SEQ ID NO: 4143721 - RNA, 63 nt, Human
gcucccugaaauucagaugccuccaugcagugaccucaagugaugccugcauuucaggagagu

SEQ ID NO: 4143722 - RNA, 61 nt, Human
gcucccugcagcugagaguuccuucccuggaagccuauuuuauuaugcauguaaggggagu

SEQ ID NO: 4143723 - RNA, 57 nt, Human
gcucccuguucucagccaugaugucuggaucuccaauucacuuugaaggaugggagc

SEQ ID NO: 4143724 - RNA, 83 nt, Human
gcucccuuccugaaugcuguugugcuguggagcugcugucauauucaaccccacaggugcuugcauaucaguggugggugagc

SEQ ID NO: 4143725 - RNA, 60 nt, Human
gcuccgcuauuuugucuaugcugugguggccccagggcaguggcauguggguaguggugc

SEQ ID NO: 4143726 - RNA, 125 nt, Human
gcuccggccuuaggcggcacccgggccugaagggguuguuugggccucaggcggcguccagggcggccgaacuugagggccaggcggggacagagcgcccgaguagccgcgccacggccggccgc

SEQ ID NO: 4143727 - RNA, 57 nt, Human
gcuccgugacacuuucuucaugcccuccuugcuggcaauacaagacuggucaugagc

SEQ ID NO: 4143728 - RNA, 79 nt, Human
gcuccuacuagccagaggaguguggaugcuaaagaaggacuucucaucucuggcugauauuccucugcuacuccugagc

SEQ ID NO: 4143729 - RNA, 56 nt, Human
gcuccuacuucagccaagaaaacucaguccucacaggauuauguugcugaaggggc

SEQ ID NO: 4143730 - RNA, 108 nt, Human
gcuccuagaaccugaggaaggggugagaaucaaggcagcuguagggauuuggcaaaacagggacaaaugcacaggcucuccagggccuggauuccagguuuaaugagc

SEQ ID NO: 4143731 - RNA, 76 nt, Human
gcuccucagcucccaugcacccucuaagaaggaccagccuggucagauauagguggagcauggggacguguggggu

SEQ ID NO: 4143732 - RNA, 81 nt, Human
gcuccucccacugccuucaccugcccuaucagcagcuuccuccuuuuggaggccgauucgggugugggcggugggcacagc

SEQ ID NO: 4143733 - RNA, 68 nt, Human
gcuccucccagugugccccuccugcagcugccccagagcuugggagggaggccgcugugcaggggagc

SEQ ID NO: 4143734 - RNA, 66 nt, Human
gcuccucccugggaagggucucagcaguggcuugcagacgucugcuguggguccccaggagggagc

SEQ ID NO: 4143735 - RNA, 55 nt, Human
gcuccucucugggccucacgcgcccgucgggggcugagaagguguggagaugggc

SEQ ID NO: 4143736 - RNA, 60 nt, Human
gcuccucugaaaaagcaauguuuagaauugagaccugaacaaugagucauucaggugagc

SEQ ID NO: 4143737 - RNA, 55 nt, Human
gcuccucuuauuucaucagggccucugagagguuucugcucaguaguaagagugc

SEQ ID NO: 4143738 - RNA, 62 nt, Human
gcuccugaacuugugauccgcccaccuuggcuucccaaagugcugggauuacaggugugagc

SEQ ID NO: 4143739 - RNA, 96 nt, Human
gcuccugaaucccuggggacuuccagagguucucagcccugugguguuucauagcuggaagagaaccucgaaugggcaucugcaggucagggaagc

SEQ ID NO: 4143740 - RNA, 129 nt, Human
gcuccugccuuccccuaugugggauucccauuggccugccauucccuacucuaauggaagaaucugaugagcuuccuguugagagagggagggaaggagugguuccagcaagggguuaguuagcagggc

SEQ ID NO: 4143741 - RNA, 56 nt, Human
gcuccugcuuagcuucucucccggacacccugagacugagaagcucgcagugaugc

SEQ ID NO: 4143742 - RNA, 127 nt, Human
gcuccugguaauaaucucauuuuguaauuuugcucuuuagucacagggcuucauuugggacacucacauuuuuguucucuuugugauuauuugugauuaaggaguugagguuaugacuuuaaggugc

SEQ ID NO: 4143743 - RNA, 63 nt, Human
gcuccugucuuggggcacuggcuccccccacaccccugccaugcucccacccuagucaggggc

SEQ ID NO: 4143744 - RNA, 59 nt, Human
gcuccugugggauucaugacauuaauucuccagaauuuuuggguugugauuacaggagu

SEQ ID NO: 4143745 - RNA, 70 nt, Human
gcuccuuaagcuucucccgagugggcagcaccagcuuccgggcuggccugggcagaggcuaugguggggc

SEQ ID NO: 4143746 - RNA, 79 nt, Human
gcuccuuccccugagccaagcagcuucccagggcgccaccagccccgagggccgaaagcugcuuuggcucccgcagagc

SEQ ID NO: 4143747 - RNA, 61 nt, Human
gcuccuucugaggacucuaaagaggacgccuuccugcgucuuccuagcuucaggagguugu

SEQ ID NO: 4143748 - RNA, 71 nt, Human
gcuccuucuggccccuggucucugguguuugugcugugucagccucauaccaagucagaggccucaugggu

SEQ ID NO: 4143749 - RNA, 77 nt, Human
gcuccuuuuaagggauaauaagauguuuguaauguuuaugucuuccaaaugaauuguaaauuccuugaaaacugagc

SEQ ID NO: 4143750 - RNA, 108 nt, Human
gcucgaacucaggcaguucagaggcuccuagccacuggccugggcagcucugggcuccagaggcuccuagccacuggcuugggcagcucugggcugcugguggugagc

SEQ ID NO: 4143751 - RNA, 68 nt, Human
gcucgaagucaguuuaaggcagaguauugcuaucucuugcaucucaagauucugcuuucugauagagc

SEQ ID NO: 4143752 - RNA, 72 nt, Human
gcucgggcucugggccagucucggccgcucugccaccugggcaggcggcgcgcugccucgacgcgccugugc

SEQ ID NO: 4143753 - RNA, 75 nt, Human
gcucgguagagguacuccccucaaaguuaauaagaaacuaagaaauuaauuuccugucaggugccucugcccagc

SEQ ID NO: 4143754 - RNA, 70 nt, Human
gcucguuuaccugaacuggucugcugcccgguuuagaugaauucaugcagagccagucaggauaaggagc

SEQ ID NO: 4143755 - RNA, 86 nt, Human
gcucuaaaauaggacaauuuuggcauaguucuguguuugaagaacagagaguugcuaaugugcagaauaaugucgagaauuggagu

SEQ ID NO: 4143756 - RNA, 82 nt, Human
gcucuacagagaaaaucucagugaggacacccacacuaucacauguuagcaggcuguccuuuacugauugcuucuggagagc

SEQ ID NO: 4143757 - RNA, 82 nt, Human
gcucuagagaaaaaacucaagugagagacucagggcuucuuuaaauguaauugcucucacucagagauuuucuuucuagagc

SEQ ID NO: 4143758 - RNA, 98 nt, Human
gcucuagguuaaccuuuaaaugugacuuaauccuuggguggggcauaguaugaugggcagcaucccacccacuccugagaugcuaaagguugaggagc

SEQ ID NO: 4143759 - RNA, 57 nt, Human
gcucuagguuccuagccaagucaguuuccuucagaugucuggcugcaaugccagggu

SEQ ID NO: 4143760 - RNA, 92 nt, Human
gcucuauaacaaauuuccuugaaacucuguagcuaaacauaaugaucaugucauugucuuuuaauuuuaugggucagaaauuugggcagagc

SEQ ID NO: 4143761 - RNA, 89 nt, Human
gcucuaugacaauuuggcaggacuguuaaguauacagcugggagaaucagaccgccugcaugcaacucccaguucugccauuuauuagc

SEQ ID NO: 4143762 - RNA, 71 nt, Human
gcucuaugaggagcuguuuuaacugcugaaucuuagcagucuauaauaauagugccuaacacauagccagc

SEQ ID NO: 4143763 - RNA, 63 nt, Human
gcucuaugggcacagccagugugucccuaccucaugauuggagccauggcugccccauauagc

SEQ ID NO: 4143764 - RNA, 95 nt, Human
gcucucaauuaccuaugcucuaguaaucagaaauaaaaauuaguuguuuuguuaaaagugauauagugcaugggugauugcaacuuacuaggagc

SEQ ID NO: 4143765 - RNA, 79 nt, Human
gcucucacaguucuccagugccuuugagauccugaagaagggagaaccucagaaaggguugcugagggcugcagggagu

SEQ ID NO: 4143766 - RNA, 56 nt, Human
gcucucacuuuagguuggaccgauaccaagcggccacuuacaccuuuagugaaagc

SEQ ID NO: 4143767 - RNA, 83 nt, Human
gcucucacuuugguauuuccucaggcaugucggugcaauaagaugucagcaccaugacacuguuauggugagguaaggagagc

SEQ ID NO: 4143768 - RNA, 70 nt, Human
gcucucagaagagccaggcuacaacaauugcccuuuagaaaugagaucaauggccucucuuguggguggc

SEQ ID NO: 4143769 - RNA, 108 nt, Human
gcugaggcucaccucuggggccucuguuggaccuuccuggcuccugggguccagaggugggccgaggcagggagaggugugccgaggcagggagaggugugccgaggc

SEQ ID NO: 4143770 - RNA, 58 nt, Human
gcugagggcccugagucuagcugcucuucccaacggaucuagaaagccaggggccugc

SEQ ID NO: 4143771 - RNA, 63 nt, Human
gcugaggguaguuuaauuaggaagaaauuagguuucuucuaagauuucaaacuacagcucagu

SEQ ID NO: 4143772 - RNA, 56 nt, Human
gcugagguaggagguugcagugagccgagauggugccacugcucuccagccugggc

SEQ ID NO: 4143773 - RNA, 86 nt, Human
gcugaggugggcagggcuguggacacuuuggugaugggcagggcucagggcacuucggggguggacauggcucugggcacuuuggc

SEQ ID NO: 4143774 - RNA, 72 nt, Human
gcugagguuugggcuccuguugauccugucacccagagagugaacauaguacccaacaggaaguuuuucagc

SEQ ID NO: 4143775 - RNA, 61 nt, Human
gcugaguaauaacuguuugauaaaggaagcaucacaacuuccaucuacaauuauucucagu

SEQ ID NO: 4143776 - RNA, 109 nt, Human
gcugaguaggaaaagugcaucuggaaagaggauaguggguagguggggagacacuucuuuccuuuuuaccuucccagauccuuuucacuguacccaauaccucuucagc

SEQ ID NO: 4143777 - RNA, 88 nt, Human
gcugaguaucaaugucuuacauuuacugagcacuuucuucuugcgggauauugugcucagaacugugaauacaugugaacccucaagc

SEQ ID NO: 4143778 - RNA, 101 nt, Human
gcugaguauuauguggggaccaucccugggcagaguccggaagauggggguggaauccccguuuaguuuguuugcuucggggguuggcccuucagcucagc

SEQ ID NO: 4143779 - RNA, 65 nt, Human
gcugagucucuaucauagcugaacccugaggacagccucauagcucauguaucagggacuuuugc

SEQ ID NO: 4143780 - RNA, 64 nt, Human
gcugagugggagauaacuuaacagcuuguccccgauuguaauggcauguuuuuccccacuccgc

SEQ ID NO: 4143781 - RNA, 65 nt, Human
gcugagugugggggugcugaggacacggcgucugcacacugguguccaggcggcccucgcucagc

SEQ ID NO: 4143782 - RNA, 84 nt, Human
gcugaguuccuccuccagaagugucagugcaggcagcuagugugagcacacagccuucugcggaugcuggagggagcagccagc

SEQ ID NO: 4143783 - RNA, 55 nt, Human
gcugaguugaaagcagaggauaaagauuuuguuuaucgcuuugugcucaacuagc

SEQ ID NO: 4143784 - RNA, 73 nt, Human
gcugaguugacuccagacugcuuugaccaauagcacagugacccugugccaguucugggguguagcccuuagc

SEQ ID NO: 4143785 - RNA, 72 nt, Human
gcugaguuuuacuagugaaauuugcaaguaauuauuuauaaugauaugcaaauuaucaucaggcaauucagu

SEQ ID NO: 4143786 - RNA, 76 nt, Human
gcugauagauuuucuugucaucagaagucaucuuuuaucguggaaaguuacucuucuccuguaagaagaucaaagc

SEQ ID NO: 4143787 - RNA, 72 nt, Human
gcugauagggaucacugucuaaaguucuuguuugcauuuugaagucaacaauaauugcgguucucuauuagu

SEQ ID NO: 4143788 - RNA, 58 nt, Human
gcugaucacauuuccaaaacccauucguugacauagggguuuuggaaaugugaacagc

SEQ ID NO: 4143789 - RNA, 79 nt, Human
gcugaugaagacugaugcuaaaugggccgugugcuuccuguggcucuaauggaaaucauggcguguuuagcuuaauggc

SEQ ID NO: 4143790 - RNA, 64 nt, Human
gcugaugaccugguuaugggucucucagcuuggggacugggagacccccaaugccaggucucgc

SEQ ID NO: 4143791 - RNA, 96 nt, Human
gcugaugcaccaggcugagccucucaucugcaguuuucugugacuccauguuuugugcugccaagggugggggagcuugccuggcuugccaccagc

SEQ ID NO: 4143792 - RNA, 66 nt, Human
gcugauggggagugguugauggugaaaaucugucuccaagaucaccaugaagcggcucccacuugc

SEQ ID NO: 4143793 - RNA, 91 nt, Human
gcugauguuggagggcagccaggccuggugaccaaagcucuugacaguuuccugccuggucuggucucaguccuggcuuugcagccucagc

SEQ ID NO: 4143794 - RNA, 67 nt, Human
gcugauuauuacaugucuguggaagcuucuggagccagugguggagaggcagaugugaauaaucagu

SEQ ID NO: 4143795 - RNA, 80 nt, Human
gcugauucccacuggaauggauagagcagagucugccuuccccauccugacuucuuucuauuccgauccagaaagacugc

SEQ ID NO: 4143796 - RNA, 70 nt, Human
gcugauucugucuucugugaaagcagguggaaaagacguucugcugcauuccacagaagggaaaacaggc

SEQ ID NO: 4143797 - RNA, 70 nt, Human
gcugauucuguuuaaaaugaggcacuugugacacuuugaaugcacucugguucugaacaggaucuugagc

SEQ ID NO: 4143798 - RNA, 70 nt, Human
gcugauuuaaugguucauuaauuucucugcuaucauugauggagguuuuaggcugccauuauuuaucagu

SEQ ID NO: 4143799 - RNA, 88 nt, Human
gcugcaaagcugccccggaagccuuggggcuccucuguauagaagaacuggguggggcccggcgggguggugaagggcagacugcggc

SEQ ID NO: 4143800 - RNA, 66 nt, Human
gcugcaaaggugggggaggagcuggcagaaauagagucccuagcugcucacccacuuuuuagcagc

SEQ ID NO: 4143801 - RNA, 80 nt, Human
gcugcaaccgcuguugcucuugcacuugcuguggcuguaacuguugcugcuggugcauuagcugcaguucugguuucagu

SEQ ID NO: 4143802 - RNA, 68 nt, Human
gcugcacacaugugggauccgcagggcauuagagaaacccugacccaguggcccagcauguggugagc

SEQ ID NO: 4143803 - RNA, 130 nt, Human
gcugcacacucagggccuuguugaccacguccuggggcggcaccagggccuggugggucagcacgguaggcgggcccugcagccccagcaggucggugcugccugggaagagggcuuggggccccgcagc

SEQ ID NO: 4143804 - RNA, 64 nt, Human
gcugcacaguuaauaugugacagaacuaaugaaaccuaguucucaagacaauuaccugugcagu

SEQ ID NO: 4143805 - RNA, 65 nt, Human
gccuccuggaugggcucaugacugucaacaaauugcaucccacugcagcaccaugcagggcuggc

SEQ ID NO: 4143806 - RNA, 107 nt, Human
gccuccugggcaaaggcuaguuagaguggcguccuaggaaaggagggggcuaacaguguuucugguucaucuucuauccucagccccugccuagcuuguccagaggc

SEQ ID NO: 4143807 - RNA, 85 nt, Human
gccucgaaauaaauuuugguaaaaugaacuagcuuuccuuugcuguagccaaggauauuuagaaauuuugcaaauguuugagugc

SEQ ID NO: 4143808 - RNA, 116 nt, Human
gccucgcaacgucugcaccugcucgcccagggagcugcucugcuuccgugccucagauaaugccugccgggcggcauccagccguuccugggggacaggggcugauggugccuggc

SEQ ID NO: 4143809 - RNA, 87 nt, Human
gccucggagcaggccugguggugcaggaagcaucuggcugucacgccuggagcuagugugccccuggcccccggccugcuugcuggc

SEQ ID NO: 4143810 - RNA, 60 nt, Human
gccucggguacagauacccugauucuuaggagaauuuccaaauuucugucacacugaggc

SEQ ID NO: 4143811 - RNA, 70 nt, Human
gccucgguccaagucuuccuucccaaaccuuugucauuuagggauugagaagcugaguugggugaaaggu

SEQ ID NO: 4143812 - RNA, 65 nt, Human
gccucuaaaaauacaguagguaauaguucauaaagauuuuagaaauaguugacacuguuggaggc

SEQ ID NO: 4143813 - RNA, 69 nt, Human
gccucuauuggaaaauauccccccaaacagugcuaguuaguguuucugucuguuuucuacauagagugc

SEQ ID NO: 4143814 - RNA, 62 nt, Human
gccucucagagagaugaaacuuccaaagggcuggaggguuccccuauuugugaugacuaggc

SEQ ID NO: 4143815 - RNA, 128 nt, Human
gccucucaucacuccucuugccucucaccuccugaaaaagcaaguugccuagguugagaaaggaucggcaacagucaacuucuuuguccauuucccucaggagaggagaagguaugggaacuaguggc

SEQ ID NO: 4143816 - RNA, 120 nt, Human
gccucucccggcaagaugcaaagucaggcugaggaucucgggccuggacucaagcucacaucccuuccuuggcccucugcucagcuccucagcaccacugcucucugccacugggaaggu

SEQ ID NO: 4143817 - RNA, 59 nt, Human
gccucucuggaagaauacacuuagaaaggaaacucaucuuuucuuuucuuuuggggggc

SEQ ID NO: 4143818 - RNA, 75 nt, Human
gccucucuugccugccugcaucccacaguggggacugaggcccugaggccccaaggggaaguggcgggcggaugc

SEQ ID NO: 4143819 - RNA, 61 nt, Human
gccucugaaucaaagggccuauuugcuuggaacuaugcaaagcaaugcuccauucagaagc

SEQ ID NO: 4143820 - RNA, 101 nt, Human
gccucugcagcucagugaaguagauagcaucuguuuaaugagcucccacuucauuacagagcuguacuacuuacugagucauucuccuuaagcaugcaggc

SEQ ID NO: 4143821 - RNA, 63 nt, Human
gccucugcccuccugggacugcaugggaagcaggccaagugcaggaagggcuaaaguggaggc

SEQ ID NO: 4143822 - RNA, 58 nt, Human
gccucugcugacaagauggacagcaaugugugugcaucuuucaacaaugcagacuugc

SEQ ID NO: 4143823 - RNA, 83 nt, Human
gccucugcugagcugagaacacuugggcuaguccuugguuuccacauuucccugggucauuguuuuuguuucucacuagaugc

SEQ ID NO: 4143824 - RNA, 69 nt, Human
gccucuggagucagaccagcuuggguucaaacccugacaccaucgcucacgagcugugucacuuugggc

SEQ ID NO: 4143825 - RNA, 63 nt, Human
gccucuggcucaggucagacagggaguuaccaggaacccuuuccugcugccugcgggcaaggc

SEQ ID NO: 4143826 - RNA, 61 nt, Human
gccucugggccuccuccgacagccgggcaccugcgguggcgaggggggcggccgggccggc

SEQ ID NO: 4143827 - RNA, 56 nt, Human
gccucuguggccuuggaccagcuucugggaaagagccccugccuggcuacaggcgc

SEQ ID NO: 4143828 - RNA, 61 nt, Human
gccucuguuucccacaguguggagagcgaaauaaauacucucucacagucaaugcagaggu

SEQ ID NO: 4143829 - RNA, 67 nt, Human
gccucuuaggacgcccucccuuccaugcugugagccucccaagccagcaggagggugccugggcugc

SEQ ID NO: 4143830 - RNA, 76 nt, Human
gccucuuuccccagccaccccugucauugcucaaugggcucaugaauacaguggccaugguggcagggguggaggu

SEQ ID NO: 4143831 - RNA, 102 nt, Human
gccucuuuuucuagaagaguccucaugcuuggcaccaaauccuugaauuaguguuuaguuggcugaaagccaugagaccguugagaaaaaaaaguagaaggc

SEQ ID NO: 4143832 - RNA, 72 nt, Human
gccugaacaggaaagaaaugagaacaccaauucucacagaggugguacuuucagauuuuuucuguggauggu

SEQ ID NO: 4143833 - RNA, 61 nt, Human
gccugaaggagucagagagggccucaaaacagaggcauugucugagcugaguccucuaggu

SEQ ID NO: 4143834 - RNA, 55 nt, Human
gccugaaguugauugaaggacuauuaauuugcauggggagguaacaauuucaggc

SEQ ID NO: 4143835 - RNA, 64 nt, Human
gccugaaguuuagauuucaugaagacacucagaacuuguagguuuugugaaucuaggcccuggc

SEQ ID NO: 4143836 - RNA, 92 nt, Human
gccugacucuuggcaagugcuugaugaaugaucaauauuauuauuacuauuguuguuauuauuacuaagucuuccuaagaagagucaugggc

SEQ ID NO: 4143837 - RNA, 65 nt, Human
gccugacuuuuccuggguagcuccugggucaaaauuucaggcaggaucccagggaaggggcaggc

SEQ ID NO: 4143838 - RNA, 63 nt, Human
gccugagaaggcccagucaaggggcuagacaguucuguuucuccugagggccuucuuccuggu

SEQ ID NO: 4143839 - RNA, 58 nt, Human
gccugagaguugaaguucagugucacaaagccaagacuuggaggauuagcaaucaggc

SEQ ID NO: 4143840 - RNA, 57 nt, Human
gccugagauguagcgcaguggcaaaacaaacugccaucugaaaauuacauccuaggu

SEQ ID NO: 4143841 - RNA, 61 nt, Human
gccugagauuugaguuccuacugaguccccuacaggggcacagcuaugagcugaauugugc

SEQ ID NO: 4143842 - RNA, 63 nt, Human
gccugagccaggaggcagagacugcagugagccaugauugcacuacugcacuccagccugggu

SEQ ID NO: 4143843 - RNA, 57 nt, Human
gccugagcugcagccucaugauucgguuacgcuggcugaauuccaggccugcagggc

SEQ ID NO: 4143844 - RNA, 60 nt, Human
gccugaggaggucaccugaggugggaggagccaggccugucaucuccagacucccagugc

SEQ ID NO: 4143845 - RNA, 62 nt, Human
gccugaggauuguuggugcuuccaggcauauaaccccugggauacaugagugacuuuauggu

SEQ ID NO: 4143846 - RNA, 69 nt, Human
gccugagggcucuacucaccacccugcuuguccgcacauccaagcuccuugugggacuggggcuccagc

SEQ ID NO: 4143847 - RNA, 65 nt, Human
gccugaggguggccaaauuguauggccucuagagccagccaucacauccaggcuaccuccguggc

SEQ ID NO: 4143848 - RNA, 64 nt, Human
gccugagugcaucugcagacauuaugugagugguagggcuuagauggaauuagagcacugaggc

SEQ ID NO: 4143849 - RNA, 98 nt, Human
gccugaugacaccucaacuuuggacuuagccugcagaauuaugagaucauuaauaucuguuguucuaagccacccaguuuguggugcuuuguuauggc

SEQ ID NO: 4143850 - RNA, 73 nt, Human
gccugauuaugacuucccaggugguguggaguuccucuugacccagauaacuugaaggaagaagaaauuaggc

SEQ ID NO: 4143851 - RNA, 85 nt, Human
gccugauuggaaugcacacugagccugccuagggaaauuaggcuuaauucuggcucaguuuccuguauucuccuguaauacuggc

SEQ ID NO: 4143852 - RNA, 88 nt, Human
gccugauuugggccccuguuguggcuuugucuaauuauagaaauggauccuuagaguccucagcguuuugugggaccccaaaccaagc

SEQ ID NO: 4143853 - RNA, 56 nt, Human
gccugcaacauccuugcuccugagcccgcugcuuccuugagcacugguguugaggu

SEQ ID NO: 4143854 - RNA, 59 nt, Human
gccugcagagagaaccauucaaccugcucaaacgugguagauucucccaccugccaggc

SEQ ID NO: 4143855 - RNA, 72 nt, Human
gccugcagcaugcuaggucuugucaaacccucugcaccuugggcugcgcaguuaucuggacaugugccaggu

SEQ ID NO: 4143856 - RNA, 68 nt, Human
gccugcagcccuugguauuuuccgaucccagcugcucugugaggguggaaaguauuuggggaccaggc

SEQ ID NO: 4143857 - RNA, 56 nt, Human
gccugcaggcuaccuugaggccuuaacugucaacugaggcagcuggccaggcaggu

SEQ ID NO: 4143858 - RNA, 91 nt, Human
gccugcaguugguuccugggccugcauucaccaucacaucccccacuggugggcucuugggaauugacaauggcgugggaacagaucaggc

SEQ ID NO: 4143859 - RNA, 77 nt, Human
gccugcauauuuugugauucuguauauaugagauguccaggauaagcaaguuuacagagacagaaaguaguuuaggc

SEQ ID NO: 4143860 - RNA, 59 nt, Human
gccugccagcuggucugugcucauguuggcugcacucauggacuugaccggcugcuggc

SEQ ID NO: 4143861 - RNA, 65 nt, Human
gccugccaguguuugaggauuguaaaaauccacuugacaucaucuucauugacaucuggacgggc

SEQ ID NO: 4143862 - RNA, 80 nt, Human
gccugcccagcccgugggugugcagcugguggcucccugagaacauuagccacccugcaaaugcccaggaaggcagaggc

SEQ ID NO: 4143863 - RNA, 74 nt, Human
gccugcccagcugucuggcagggauggggguggcgguggcgcugcucaucccggcagcaggcagcuggggacgc

SEQ ID NO: 4143864 - RNA, 74 nt, Human
gccugcccccauggagugccugagggccagcaaacaccuguggcuuccuaggagcccgugcuuugggcaguggc

SEQ ID NO: 4143865 - RNA, 76 nt, Human
gccugcccuagguuaggcuguaugcucaauguggaguuuuccaucaugaauaagacaggccagccugggguaaggu

SEQ ID NO: 4143866 - RNA, 69 nt, Human
gccugcccuggucucuuggcugcccuaauggaaaggcuccaaguugcagcuuuagaaacaagggcuggc

SEQ ID NO: 4143867 - RNA, 69 nt, Human
gccugcccugguuacacuggaguccaaggugaagcggaugaccguguacucucaguagaccggaugggc

SEQ ID NO: 4143868 - RNA, 74 nt, Human
gccugccuuucugugaccagaguggccuuucuuggcucaggaacugagugcccucuggcacagagaugcagagc

SEQ ID NO: 4143869 - RNA, 79 nt, Human
gccugcgccuuucucccugccugccugcgccucccaugcagggccgacagcgccagccagggaagggagagacacaggc

SEQ ID NO: 4143870 - RNA, 59 nt, Human
gccugcgugccacagaccaccgugcugguuauaugaguaacuagggcuuggcagcaggc

SEQ ID NO: 4143871 - RNA, 97 nt, Human
gccugcucauuggaauugccuggagagcugguucaaagcagacucugauuccgcagaucuggaauaacccugcuuccaagugauuuccaugggcugc

SEQ ID NO: 4143872 - RNA, 55 nt, Human
gccugcuccggagagggaagcauugugugcagcucaggauucucagggcaguagc

SEQ ID NO: 4143873 - RNA, 61 nt, Human
gccugcucuggggcuuccucacguuccugauugagaaaugaaggcccuggagccacgaggc

SEQ ID NO: 4143874 - RNA, 62 nt, Human
gccugcuggcccaugaagacgcagucgaugcacugggucuuuuccuguggccaauuucaagc

SEQ ID NO: 4143875 - RNA, 58 nt, Human
gccugcuggcuggaaauucuccugagaucgguuggagucuauuugcaggcaugcaggc

SEQ ID NO: 4143876 - RNA, 67 nt, Human
gcuccuucugcccaucugcagacaugcguguccuucaagccaguguccagaaugggcaaaaaggagc

SEQ ID NO: 4143877 - RNA, 55 nt, Human
gcuccuuucuguugguggccccuucccgguugggaccaggcuugugggagggagc

SEQ ID NO: 4143878 - RNA, 59 nt, Human
gcucgaccgccagaaacuuccuucuccugacucaggccacagucuucuguguggugagc

SEQ ID NO: 4143879 - RNA, 61 nt, Human
gcucgccccggcacaguguccgucugcacagacgcccguggacgcacacgcgggggcgugc

SEQ ID NO: 4143880 - RNA, 58 nt, Human
gcucggggcaaacucgcucuuggacuugguugucuuuggucaggcaugugcccugagc

SEQ ID NO: 4143881 - RNA, 128 nt, Human
gcucguaggacgcccacagcccauggaaucaugaaugccgaggagcugcccccuucaucuuuaauucaaaugagccugaggaugacgauggcaauggcacugaugugggcugagcucuuaccacaugc

SEQ ID NO: 4143882 - RNA, 113 nt, Human
gcucuaacagagaaggagagaaaggagagagccgacccaguucuagccccaccugcuggguccugagcagaagggcuacacgggcucuccuucccucgccuccugguuggagc

SEQ ID NO: 4143883 - RNA, 77 nt, Human
gcucuaagccuagaccagucauuacucaugcccugggacaauucaggcuguguggauaauauugggguuuaguuagc

SEQ ID NO: 4143884 - RNA, 67 nt, Human
gcucuaaggccagccagcaaaucugugggagugauuuuaacccacgggggagcggcaggccuagggc

SEQ ID NO: 4143885 - RNA, 57 nt, Human
gcucuaauugaaaaauacugcacuuuaaugucugcauugcaguuucaggacgagagu

SEQ ID NO: 4143886 - RNA, 123 nt, Human
gcucuaccuaagggaagcuugaguagggcaugcuuuaguuuggacuuaugaaguauugcaugcuucauauuucaugaaguccaaacuaaagcacccccuacucaagguucccuuagcuagagu

SEQ ID NO: 4143887 - RNA, 57 nt, Human
gcucuaccucaucagaugacaaaagaauguucugcagcuuuuuggugggguggcggc

SEQ ID NO: 4143888 - RNA, 60 nt, Human
gcucuagaaagaaggaugugggauggaaauauacauaugcuuccccuucuuuuuggaugc

SEQ ID NO: 4143889 - RNA, 60 nt, Human
gcucuaggaggugugcuuagaacggaauucaagggucaucugagagcaccuccuuggagc

SEQ ID NO: 4143890 - RNA, 55 nt, Human
gcucuauaaggcccaguaaggucuccauaauagggaccuucaggaacuuaucagc

SEQ ID NO: 4143891 - RNA, 64 nt, Human
gcucuaucgucaggcauagugagacucuugucagagcaggcucacucuguuuggcucacagagu

SEQ ID NO: 4143892 - RNA, 68 nt, Human
gcucuaugaaccugaaucucacucccaaagacuucuuccuuccccguaagaacuuauguuuauggagc

SEQ ID NO: 4143893 - RNA, 58 nt, Human
gcucucaccauggcuggcagugugcggggacuucgcagccaccucccauggcgggggc

SEQ ID NO: 4143894 - RNA, 68 nt, Human
gcucucagcucuuuuuucacagaaagucuucugaaaaggacacgcuuccauggaacgaggcugggagc

SEQ ID NO: 4143895 - RNA, 81 nt, Human
gcucucaguuucuaguucucugccaaaaaagugacaugaucuugauuauaugcuuuuuuaguaguaacuuaggcagagagu

SEQ ID NO: 4143896 - RNA, 56 nt, Human
gcucucccauuuuacugauaagaaaagcaaggccacauugcaguuggguggggagu

SEQ ID NO: 4143897 - RNA, 100 nt, Human
gcucuccucaggauuggggucuggagugggugggaagccagaagaagagagccccuccacucugcugaggccuucccacuccccagagccuccggagggc

SEQ ID NO: 4143898 - RNA, 57 nt, Human
gcucuccugagccucacaagggcacugaaccacuuccuuuaugucacucuggagagc

SEQ ID NO: 4143899 - RNA, 112 nt, Human
gcucuccuugggccuuagugucagcucuaaagauuuauaaagguugcacuggaaccucuuuccaguuguuauuuuuauaaaggaucagugacauuuugaggcagauaagagc

SEQ ID NO: 4143900 - RNA, 84 nt, Human
gcucucgcucucagaauccuugcccaggugcauugcauucagacagcacucucacccagguagcaaggauuagagagggggagc

SEQ ID NO: 4143901 - RNA, 59 nt, Human
gcucucugagaccuuggcucuacaagccuuuuaaccagagagaggagucucagaugagc

SEQ ID NO: 4143902 - RNA, 58 nt, Human
gcucucugccauaugaggauacaaggagaagucaauaguauucaacuuggcagagggc

SEQ ID NO: 4143903 - RNA, 58 nt, Human
gcucucuggaagcgcagaucuguuuuaaaaguccugagcaauuucucgcaccagacgc

SEQ ID NO: 4143904 - RNA, 60 nt, Human
gcucucuggaagguaucauuaucuccauguuacaagggagaaaaugagccccacagaggc

SEQ ID NO: 4143905 - RNA, 70 nt, Human
gcucucuggauggacuaaauagggcuggcuuggaaaccgugagucagcuuccuacaaccaucucagaggc

SEQ ID NO: 4143906 - RNA, 74 nt, Human
gcucugaaaugaucacaagucugaagaaugagaaacauuuucauuuccauucaguguggucuggcagcuggagc

SEQ ID NO: 4143907 - RNA, 104 nt, Human
gcucugagaaacgaggcagcgggcacuggggcagccacauagacaacaucuaaauuuuuguugcuuuccugggucuugcccuguccuuacuguuucccuugggc

SEQ ID NO: 4143908 - RNA, 58 nt, Human
gcucugagagcuacacaggguagaccacagccccagguacccuguauggcucacaagc

SEQ ID NO: 4143909 - RNA, 55 nt, Human
gcucugagaggaugcugagcagcaacaucaacugcuuuuuuucccucuccagagc

SEQ ID NO: 4143910 - RNA, 56 nt, Human
gcucugagcugucuugcaggucaagggagaggggugcacauuggaaaguucagggu

SEQ ID NO: 4143911 - RNA, 55 nt, Human
gcucugaggagccaagaauguggaccuagguguccucuugucuuugcucaguagc

SEQ ID NO: 4143912 - RNA, 74 nt, Human
gcucugaggaggucgaagcaccuuguaugucaugugaaaaauauuuccaagcaaagugcuuugccuccagcugc

SEQ ID NO: 4143913 - RNA, 56 nt, Human
gcucugauaagcucccaaagaucaguccuuaucugaaaauuugauagaaucagagu

SEQ ID NO: 4143914 - RNA, 119 nt, Human
gcucugcaauaaagaagugacugaaaacuauagcacugguuuuucuugguuggaugaauuaaugcacauucugaaaaacaguguuuuagauuucaaguuccaggucuuccagaaggagc

SEQ ID NO: 4143915 - RNA, 65 nt, Human
gcucugcacauuuguuauuuugagguacaucaccuuggacuucaggaucaauauaugauguuagc

SEQ ID NO: 4143916 - RNA, 64 nt, Human
gcucugcaucauaaaauuuagaguugaagacagaugcuguaacuuaaaaggauugaugcugggc

SEQ ID NO: 4143917 - RNA, 61 nt, Human
gcucugcccagugcccugagaccuacugcaggagcaucagaaaggccacauggugcagagc

SEQ ID NO: 4143918 - RNA, 73 nt, Human
gcucugcccugaccugccucagagugggcuacaguacaccuuuggcaaacucaugggcagccuagggccaagc

SEQ ID NO: 4143919 - RNA, 95 nt, Human
gcucugccuuguuggggggugugugaggggcuaaucauaaagaauaauuugggagcuaguucuggacacacguucccagacugauuggguagagc

SEQ ID NO: 4143920 - RNA, 86 nt, Human
gcucugcucuucacacuacacccgugaccucuguuuccgugucuguccacggggaacggcgaugggugggugugagguggccgagc

SEQ ID NO: 4143921 - RNA, 63 nt, Human
gcucugcugagagccacguggcacaacuggggcuccauccaguugugugugccucuguagagc

SEQ ID NO: 4143922 - RNA, 98 nt, Human
gcucugcuguccugcugcuuucccugcuuguuuauaaauuggagaacaacuuucaacuuggugggagagcuguagucuaauaggaacaguaaaauggc

SEQ ID NO: 4143923 - RNA, 73 nt, Human
gcucuggauggcuggaugugagaucaagagguuaacuggugccuuuccuucugauucauccagaguccuaggc

SEQ ID NO: 4143924 - RNA, 65 nt, Human
gcucugggaaggaucguagugagaugcaggaauucacccacaaccacuaccaaccuuccaggggc

SEQ ID NO: 4143925 - RNA, 82 nt, Human
gcucugggcucagucuccugggggcuguuguugcucacauucugugaaaggcagcagagccuaggagcacucccuccacagc

SEQ ID NO: 4143926 - RNA, 59 nt, Human
gcucuggguagccacugccuggaaacaugagugucuauugguagaaccuugcccagggc

SEQ ID NO: 4143927 - RNA, 58 nt, Human
gcucuggugaguguaguucaggaaugcugacagcccuaagcaucuucacuuauuaggc

SEQ ID NO: 4143928 - RNA, 68 nt, Human
gcucuggugcaguagaaggccgacuucuccuguguggaagaaguuccccugcucugcugugggagagc

SEQ ID NO: 4143929 - RNA, 57 nt, Human
gcucuguagugggcaugugauucagccuuugccagucagguaccacauuacauuggc

SEQ ID NO: 4143930 - RNA, 69 nt, Human
gcucuguccagcgugcacagaaaguucuagaaagaacgaguacuucugagugucgcugguugaagaugc

SEQ ID NO: 4143931 - RNA, 72 nt, Human
gcucugucgcccaggcuggagugcaguggcgccaucuuggcucacugcaagcuccgccucccggguucaggc

SEQ ID NO: 4143932 - RNA, 56 nt, Human
gcucugugaaaacauaaauggaaggauggcccauucauuuaggaguucauaagagc

SEQ ID NO: 4143933 - RNA, 67 nt, Human
gcucuguguaaauguaggguccagauuggguuucagcaaaacacuagcccugcauuaacauccaggc

SEQ ID NO: 4143934 - RNA, 57 nt, Human
gcucuguguucccuccaggcuccugguugugaggaacaggaguggauggggcggggc

SEQ ID NO: 4143935 - RNA, 66 nt, Human
gcucuguugucuaggcugcaguacaguggugugaacauggcucacuguagccuugaccuccugagu

SEQ ID NO: 4143936 - RNA, 72 nt, Human
gcucuguuucccaggcuggaaugcaguggugugaucuuggcucacugcagccuccaucucugggguucaagc

SEQ ID NO: 4143937 - RNA, 75 nt, Human
gcucuuaaggaaguacccauucuuagggucaugcuugugcagucagccccugagagugagugccaccuuaagugu

SEQ ID NO: 4143938 - RNA, 68 nt, Human
gcucuuacauaauuuauggaaugguauacaacaucuacuguguacuaaacuuccauauauuacugggu

SEQ ID NO: 4143939 - RNA, 56 nt, Human
gcucuuagcagagauaccccugugagagaacaaauuggguuccucacgcuaagggc

SEQ ID NO: 4143940 - RNA, 58 nt, Human
gcucuuaggagguguuccuuaccugucacucccagguaaguaacaccacuccuggagu

SEQ ID NO: 4143941 - RNA, 102 nt, Human
gcucuuauuccucucauagguuacuguagaaauagugguugacaggacugaugucaguccagcuaacucaugauuuauugccuccuauggagagaguaaugc

SEQ ID NO: 4143942 - RNA, 69 nt, Human
gcucuucaguguccuuaguuagcuuuggggaaaauuaaucugcgggguggugcucgacacgcaggaugc

SEQ ID NO: 4143943 - RNA, 79 nt, Human
gcucuucaucuggcugccaccauccuccccccucgaaggcucccaggguaaggggagagugacggcaguggagaggggc

SEQ ID NO: 4143944 - RNA, 60 nt, Human
gcucuucccuaaucaccaucuucaguggagugucugaguuugguaucuagggggucaagc

SEQ ID NO: 4143945 - RNA, 114 nt, Human
gcucuuccucagaugcuugcgggugccuggguggaugcugacuguucugcucgggauuccccguagcugucugugaacacagcauuugucacaauagccugcgaagaggagggc

SEQ ID NO: 4143946 - RNA, 84 nt, Human
gcucuuccucucuaauccuuugucccugggugagagugcuuucugaaugcaaugcacccgggcaaggauucugagagggugagc

SEQ ID NO: 4143947 - RNA, 81 nt, Human
gcucuucucaggcuguggcuucaguucuugacuaauuaccaucaagauuaggcaaagaucaccaaguaacagucugugggc

SEQ ID NO: 4143948 - RNA, 70 nt, Human
gcuuuacugagaugacacagggcacaaaguaagugcaaacacagaccuguucauuuuccauucaggaagc

SEQ ID NO: 4143949 - RNA, 79 nt, Human
gcuuuacuuaagggaauguugugguugguuugaucuucuaucuagaccacuaaaacuuucucuauaucagcggugaggc

SEQ ID NO: 4143950 - RNA, 57 nt, Human
gcuuuagaggaaugggugaguggacaucuuaauauguagcaucucuuauuucucagc

SEQ ID NO: 4143951 - RNA, 59 nt, Human
gcuuuaggagacacgaaacagccuaaaacagcaugguuuggggcuguuucuccagaagu

SEQ ID NO: 4143952 - RNA, 73 nt, Human
gcuuuaguaguacacauuagucaagaguuugaaccaaguucagccauuuguuaacuauguguucuugggaagc

SEQ ID NO: 4143953 - RNA, 71 nt, Human
gcuuuauuagucugcaugucccaaaggaacagcaaagggacugucugccacugcaugcagaguaagaaggu

SEQ ID NO: 4143954 - RNA, 62 nt, Human
gcuuucaaauccuaauuccaacaacaacuggcuaagugacuuugggcaaguuaggaugaagu

SEQ ID NO: 4143955 - RNA, 77 nt, Human
gcuuucagaaguuacaggagaaagagaucacuucagacccagaugauccuaagauguauuuugagauaguugaaagu

SEQ ID NO: 4143956 - RNA, 58 nt, Human
gcuuucagcaacuaaagucuggauugauuuuuguggucuagauguacugcugaagagu

SEQ ID NO: 4143957 - RNA, 69 nt, Human
gcuuucagcucugcacuccacuguggcuuauuaagaaagaauaaaacucacacuggcagugcugaaggc

SEQ ID NO: 4143958 - RNA, 74 nt, Human
gcuuucaucgaguuauguauauuauuaugucaucucccuguauuugaguuaguuauuacaaacuccuugaaggc

SEQ ID NO: 4143959 - RNA, 73 nt, Human
gcuuucauuaaaugaguaaguguuucagagcuuuagcaauuauuauaguggugagcugcauuuauguggaagu

SEQ ID NO: 4143960 - RNA, 71 nt, Human
gcuuuccaagucuggauuuagaggugggccuugucuagaaagccaggucuaccuuuuuucaggcaaaaagu

SEQ ID NO: 4143961 - RNA, 76 nt, Human
gcuuuccagugaacgacuguugacuauuuggggauucucuuguucucagauccaucagaagucccacagagaaagc

SEQ ID NO: 4143962 - RNA, 55 nt, Human
gcuuucccuaagcauuuggggagucauuuacuccuuuggcugacgaggaggaggc

SEQ ID NO: 4143963 - RNA, 57 nt, Human
gcuuuccugccuuauucauucauuuccaggcaaugaggaugagcaggcaagacaagc

SEQ ID NO: 4143964 - RNA, 67 nt, Human
gcuuuccuggcccugucccugccucgcaagaagcgugggcccaagcagcggcggccgggugaagagc

SEQ ID NO: 4143965 - RNA, 73 nt, Human
gcuuuccugggaaaggggugucucugucccuaagcaaaaaggcagggaggaagagaugcuuccccagggcagc

SEQ ID NO: 4143966 - RNA, 62 nt, Human
gcuuucggggauggugucugagggagcaugauuguucugggcacacaggcccugguugaagu

SEQ ID NO: 4143967 - RNA, 68 nt, Human
gcuuucuaaucuauuuccuuacuuguuggcuggguaaguguuacauuugggaaauagaagaagaaggu

SEQ ID NO: 4143968 - RNA, 93 nt, Human
gcuuucuacuagauaugacaauuugugcuucuguucugaggccuuugaauugcacuccaaauauccucagggcagagguguuaagugagaagc

SEQ ID NO: 4143969 - RNA, 68 nt, Human
gcuuucucagcccagagccgcccccuuggugcccgcagcgaggaugaggcacuaggcccggaggaagc

SEQ ID NO: 4143970 - RNA, 78 nt, Human
gcuuucucuuuucccuuuaguuucugggcucuuuuccggaugauccgugugcuaggaagcuggggagaagucggaagc

SEQ ID NO: 4143971 - RNA, 59 nt, Human
gcuuucugauugcgaaaacaaagcuaguguuuuuggaaugugcuuuccaaauagaaagu

SEQ ID NO: 4143972 - RNA, 80 nt, Human
gcuuucugucccccuugacuugccucgggcccuaucuccucugguggggguggaaaggcaaguugucgggagcagaaggu

SEQ ID NO: 4143973 - RNA, 55 nt, Human
gcuuucuugaggcugugcuuucuucccuggcuugaagaguguacaagcagaaggc

SEQ ID NO: 4143974 - RNA, 101 nt, Human
gcuuugaaauccuaguugcugcacaaggaaauauguuaaagagacacauucucuguguuuacuuaaauguuuucauauaauguagaauugguuuucuaagc

SEQ ID NO: 4143975 - RNA, 58 nt, Human
gcuuugaagacagaucaauauaagccuaaggucuucauguuaagucuguuaucagugc

SEQ ID NO: 4143976 - RNA, 63 nt, Human
gcuuugacgacucuccggaguggugagaaacucaaucucagucacauuugggggugucaaagu

SEQ ID NO: 4143977 - RNA, 80 nt, Human
gcuuugacuccauuuauuauuuugaacaaucaagaaaaacaguuuucuugaugguggcagaagagugauauagaaaaagc

SEQ ID NO: 4143978 - RNA, 56 nt, Human
gcuuugcacaaccuuuaagacaauaauaauucuaaauugagucuuguguguaaggc

SEQ ID NO: 4143979 - RNA, 82 nt, Human
gcuuugccaggaccuguucuugggcagaacugaauauauacucaauucugaggagggaagaggaaggucauggcuaaaaggu

SEQ ID NO: 4143980 - RNA, 71 nt, Human
gcuuugcgucucauaaacucaguuuucucauccauagaauaggugguugggaggguuuaaugugacaaagc

SEQ ID NO: 4143981 - RNA, 76 nt, Human
gcuuugcugcuuguuucuccauuuuugucauuauuguucguaagcaaauagacaagauggcaggaaguaucaaagc

SEQ ID NO: 4143982 - RNA, 61 nt, Human
gcuuugcuggaaucaacgaaugugcuuaauucgaaggugucuuugucgguuacagcaaugc

SEQ ID NO: 4143983 - RNA, 76 nt, Human
gcuuugcuuauaggaacuauaugucuuaaagcuuuucugaauccuuaaagcaugaaguauaguucuggagccuugu

SEQ ID NO: 4143984 - RNA, 83 nt, Human
gcuuugcuugcuagaauuaaguggucaauaguuuccuaaaguugacguugcucagggagcgauuuaccauggcagggaaaagc

SEQ ID NO: 4143985 - RNA, 68 nt, Human
gcuuuggagccagauaagaccaggguuugaacucugauccugccagucacuaugucaccuucuaaggc

SEQ ID NO: 4143986 - RNA, 55 nt, Human
gcuuuggccaaagaaaugugaguggaaauaacacaugacauuucuaggugaaagc

SEQ ID NO: 4143987 - RNA, 57 nt, Human
gcuuuggcugucagucaaccaccaaagauuuauugaacauugacuuaacagcaaggc

SEQ ID NO: 4143988 - RNA, 84 nt, Human
gcuuugggguggcaaaugauagagccgauuaucacucugagaggaaagagaggaguggggcugugugcguuugcuagaccaagc

SEQ ID NO: 4143989 - RNA, 88 nt, Human
gcuuuggguauuuuauggccuggggccuaacuuaucuauuccccaaagaugaaagauguaguaccagguuuucugggguauguaaagc

SEQ ID NO: 4143990 - RNA, 68 nt, Human
gcuuugggugggugagcguggagcggcauaugggugauguucugcaagcccugccaccugcccuaagc

SEQ ID NO: 4143991 - RNA, 114 nt, Human
gcuuuguaaauaguaauuuuacccaguggugcauguuugagcaaacaaaaaugaugauuuaagcacacuacuuauugcaucaaauauguaccacaguaaguauaguuugcaagc

SEQ ID NO: 4143992 - RNA, 84 nt, Human
gcuuugucagcaucuguuuuucugacccaggauaagaucuuccuuuuagaucugcuggucaagggacagagcugaacucuaagc

SEQ ID NO: 4143993 - RNA, 55 nt, Human
gcuuuguccugcugaggaugugugacuggucccacaugcucuccaaggacagagc

SEQ ID NO: 4143994 - RNA, 95 nt, Human
gcuuugucuaccuaaaaccuuuuagcucuguuugacagaagaccucaaauaagagagcuuuaaacagagucugaaauguaaaggucugagagagc

SEQ ID NO: 4143995 - RNA, 59 nt, Human
gcuuugugauugauacuuaaaaaguacauaaauguguuguaaugucaaagucacaaggu

SEQ ID NO: 4143996 - RNA, 129 nt, Human
gcuuuguucuugaauggagcuaauuacagaguugucugcugcaggaugggcacucugcagucaguguguaaauagggacaauuagagcucauuuuaagcagacauggcuuccaaaaaaagaaacagagc

SEQ ID NO: 4143997 - RNA, 84 nt, Human
gcuuuguugaccuauaaucuaugugccaucccaugugcccauuuaacauguacaauucaaugguuuuuaggauauucacagagu

SEQ ID NO: 4143998 - RNA, 80 nt, Human
gcuuuuauaaauuuccuguuguguuagagucaauuccaguuugugaaauugagucucacagagggaggucaguaauuggu

SEQ ID NO: 4143999 - RNA, 59 nt, Human
gcuuuuaugucuucagagaauguaagugcagaagcgcagauuucuccagaaaacauagc

SEQ ID NO: 4144000 - RNA, 62 nt, Human
gcuuuuauuauaaugaggcagggaaaguuuugaccccgcucaucauugcacauaauggaagc

SEQ ID NO: 4144001 - RNA, 58 nt, Human
gcuuuuauuuccuccuuaauagaggaaaaaugcucugugaauugaggacaucaaaagc

SEQ ID NO: 4144002 - RNA, 97 nt, Human
gcuuuucacuuuaugguauauuuugcucuaugguggggagaugguucugggcucauguugacgccagagagaaacagaaugugcugaaaguaagagu

SEQ ID NO: 4144003 - RNA, 71 nt, Human
gcuuuucagacugcccauguuugccauuugcuguuugacugguaaauuguuuggcaagucugugccucugc

SEQ ID NO: 4144004 - RNA, 57 nt, Human
gcuuuuccaguguuuuuauugauuuuuccuggacucaggaaagaaggauuggagagc

SEQ ID NO: 4144005 - RNA, 68 nt, Human
gcuuuuccugacuuuccauuagcagaaagcuuuauaaaagcugccauuuauguaaaguacagaaaggc

SEQ ID NO: 4144006 - RNA, 63 nt, Human
gcuuuucuuacucccgcaaggcaagguuuggcagagcucuguaaagucgggagucaggaaugu

SEQ ID NO: 4144007 - RNA, 68 nt, Human
gcuuuugaauaucuagauuggugagaugcuagauuggugagauccauucauucagguauuuagugagu

SEQ ID NO: 4144008 - RNA, 56 nt, Human
gcuuuugacagugacaugucuuacaaaaugugaguagaccucacgugucagaaugc

SEQ ID NO: 4144009 - RNA, 82 nt, Human
gcuuuugaggcagugaagccagaucugaaauggacacacgguuuacuuaggguaaaggacuuuagugcuccacucaacaagc

SEQ ID NO: 4144010 - RNA, 65 nt, Human
gcuuuugugaguugcugagcucagauggcccaaaugggugggaaggcucagggaauucaggaagc

SEQ ID NO: 4144011 - RNA, 59 nt, Human
gcuuuuguuuucuuagaaaccuggccgcucuuggaauuuaggcuugagagaacagaagu

SEQ ID NO: 4144012 - RNA, 70 nt, Human
gcuuuuuacugagcugguccacugagguugaaggcuccaucaucuucuaccucuagccacugagaaaggc

SEQ ID NO: 4144013 - RNA, 60 nt, Human
gcuuuuuauucaucuccacugcugagaaaaggcaguguaaacuuaagagaauaucaaagc

SEQ ID NO: 4144014 - RNA, 78 nt, Human
gcuuuuuccuguagcacauucuuaaaauuugauuauucugaguaagaaaauauucauugagaggcucaccaggauugc

SEQ ID NO: 4144015 - RNA, 63 nt, Human
gcuuuuuccuucaccucuugagccucuuccccaauaagagacuggaagggaugaagaagaggu

SEQ ID NO: 4144016 - RNA, 66 nt, Human
ggaaaaagagagacagggauugugaaaagugggguaccuuuucaaacuucuauucucuguuuuuuc

SEQ ID NO: 4144017 - RNA, 66 nt, Human
ggaaaaagcauuacaugguacguauaacccccuucaagaguuauuucgucuuuuaauguuuuuuuc

SEQ ID NO: 4144018 - RNA, 61 nt, Human
ggaaaaagggaugucuggcucagaggguacuucuaaccccucgcucuaggcagcccugucc

SEQ ID NO: 4144019 - RNA, 122 nt, Human
ggaaaacaaucccccaagaccuuggccuucucccuguggaggaccccuuacccaccuugucauggacgucagggaccccucugaguggaggagucagauagggcuuggggggugucagggcc

SEQ ID NO: 4144020 - RNA, 64 nt, Human
ggaaaacaauucacuccagugaccccacagucacuguuucacuggcagaaugaauuaccuuucc

SEQ ID NO: 4144021 - RNA, 61 nt, Human
ggaaaacacuuugcagugaagcaaccacuuuuaaauugcugucugauucagggugauuucc

SEQ ID NO: 4144022 - RNA, 76 nt, Human
ggaaaacagggcagagacaugcuuccugaaagcuuccuugagccaucaagcagagguguucuuuuccuaguuuucu

SEQ ID NO: 4144023 - RNA, 62 nt, Human
ggaaaacaguuuaauaagcaucuuuggacauacaucuuuaugcuuaccucuggcuguuuucc

SEQ ID NO: 4144024 - RNA, 80 nt, Human
ggaaaagagagcggagggguauauuguggggucagauaaaucacagcacauuuggccagacacuaccccccuucauuucc

SEQ ID NO: 4144025 - RNA, 104 nt, Human
ggaaaagaggauguguugaaagacauggcugccuguggacacugcugaguaaauuuuggccagugugguguagucaugaagcuccaaaaacauauauuuuuucc

SEQ ID NO: 4144026 - RNA, 76 nt, Human
ggaaaagaucugagacauacauuuuaggggcaagugcuauacaacucgaggucucugaauaaugcuauucuuuuuc

SEQ ID NO: 4144027 - RNA, 74 nt, Human
ggaaaagcaauggaugagaaucugucuguucaaugcaauauuuuccuacagagauaacaaccaauugcauuucc

SEQ ID NO: 4144028 - RNA, 87 nt, Human
ggaaaagcaguugaauauauuucucuuaccuuuagcuuauucuaagaugaaggaaaauaaggagaaguaauugaaaugucagauucc

SEQ ID NO: 4144029 - RNA, 69 nt, Human
ggaaaagugaggcagcccaagggaauucaucuugugucgucuuaccuugggugccggucgcauuguucc

SEQ ID NO: 4144030 - RNA, 83 nt, Human
ggaaaaguuuuccugugcucaggucuuuuaugaauuauaaauaaccauucacuuuggaagauagcacaucauaaaauuuuuuu

SEQ ID NO: 4144031 - RNA, 75 nt, Human
ggaaaaguuuugugcagagaaggagcaguaguuaaaucuuagcucugccacuguuucugugauacgagacaagcc

SEQ ID NO: 4144032 - RNA, 77 nt, Human
ggaaaaucacaggcuuagaagauugacccugguuugaaacugggcaggcugcuucacuuuuuugagccucuguuucc

SEQ ID NO: 4144033 - RNA, 76 nt, Human
ggaaaauggaacuuaauaaguuuuguaauuauggggcaaaucuaugcaaauugcgauuuuuauuagguaauuuucc

SEQ ID NO: 4144034 - RNA, 58 nt, Human
ggaaaaugggaaccugaagccaggaggucaagccaagccaacagguguucuguuuuuc

SEQ ID NO: 4144035 - RNA, 85 nt, Human
ggaaacacaugaaaguuggugaguaaaaucuaggugaaauacaacugacaauagaaaaauacucacuugaauuugcaugguuucc

SEQ ID NO: 4144036 - RNA, 57 nt, Human
ggaaacacugugccaagccccaagaggauuacgcuuccagguguguaacguguuuuc

SEQ ID NO: 4144037 - RNA, 62 nt, Human
ggaaacagggagccuccaaagcuuucagauguuuucccaacuagcaggaggccccugcuugc

SEQ ID NO: 4144038 - RNA, 96 nt, Human
ggaaacaguaggagaggagggguaggcaggagccaggcugaggauuuagcaccucuucugguaaccuuuaucccuccucauucuuccuguguuucu

SEQ ID NO: 4144039 - RNA, 100 nt, Human
ggaaacccacauucauccuucugcuguucagaggaccucacuuauacuuauucucagagggaggugagauucuggaagugaagucaugagcagaguuuuc

SEQ ID NO: 4144040 - RNA, 84 nt, Human
ggaaacccaggccugucagagagcugccagugacccuuuacuuuucugggacacauguguggccgcuguagacaauggguuuuc

SEQ ID NO: 4144041 - RNA, 60 nt, Human
ggaaacccuugauaagaugagccauaaaccuauggugaacaguucauuuuaucauguucu

SEQ ID NO: 4144042 - RNA, 64 nt, Human
ggaaaccugucaaaucccuaaaacaaaggaccuucugggggguucugggacauugcagguauuc

SEQ ID NO: 4144043 - RNA, 88 nt, Human
ggaaacggaaguagcaguucucacguuccuggguagaugaagauggaggagagggcccagggcuggugggagaugcuggacugguucu

SEQ ID NO: 4144044 - RNA, 79 nt, Human
ggaaacgggagcuguugcgcaugcgcucggacgcuggcccguuccggggcacgggcgcacgcgcgcuccuggaguuucc

SEQ ID NO: 4144045 - RNA, 79 nt, Human
ggaaacuauuaggaugcuuaccgacuuacagugcugcuuagaugcuauagcaaguaggaaguguccuccuucaguuuuu

SEQ ID NO: 4144046 - RNA, 60 nt, Human
ggaaacuccucccacauaggacaaugggcaaguagagcccgccuuccaugggaggagccc

SEQ ID NO: 4144047 - RNA, 66 nt, Human
ggaaacuuuagcauuccaucuuggacuuguguuuugcaucaauuucaagagaugcugucagauucu

SEQ ID NO: 4144048 - RNA, 86 nt, Human
ggaaagaaauguaaccuugugagugacaguucccuugguucaaagcaauuacuagggauuacacuguauucagaaggcagaaaucc

SEQ ID NO: 4144049 - RNA, 84 nt, Human
ggaaagaagauacagauagaauuagugaguuaggaaaaucaucugaauccuugauuuaccaguuacuaucuuguaauacaaucc

SEQ ID NO: 4144050 - RNA, 77 nt, Human
ggaaagagagaaauuugucacugagagaguuagaaauuauuucaagauuuguagauaguguaauuaucucacuuucu

SEQ ID NO: 4144051 - RNA, 59 nt, Human
ggaaagaggacagcucuaacuaaagucaggacuauugcuauguuggacaugccucagcc

SEQ ID NO: 4144052 - RNA, 68 nt, Human
ggaaagaggagggacaccaauauauguucucuaggccuuuuagaaaacauggaguuguuccuuuggcc

SEQ ID NO: 4144053 - RNA, 70 nt, Human
ggaaagaggcucaaggugggccaguuuucaucauuucuccuucaggcugcccaagcgucugccuuucucc

SEQ ID NO: 4144054 - RNA, 78 nt, Human
ggaaagaguuaugucuuuguggcuaucuaggcaguuuuggggacuguucugaaaagaaacuaagucauaacucuuucc

SEQ ID NO: 4144055 - RNA, 67 nt, Human
ggaaagcagaugccaagauuuaccaaauuaacucugauguuggcaagaacugugcagucugcucgcc

SEQ ID NO: 4144056 - RNA, 107 nt, Human
ggaaaggaaaggacagugugauccugaagugcagcaugaagcacaugugacauagcagcaauaagucaucuuucugcugcacuuagcuuuagucugacucucauucc

SEQ ID NO: 4144057 - RNA, 84 nt, Human
ggaaaggaaauagaauauauuagaaauucugauuucuaauaggauguaagaaaucauguuucagaugaguuuuuuagcauuucc

SEQ ID NO: 4144058 - RNA, 69 nt, Human
ggaaaggaagcagcuguaguaggagguggggugcccucuaguggucaugcuuugguugcuguccuuucu

SEQ ID NO: 4144059 - RNA, 58 nt, Human
ggaaaggagugugaauuuucuuuggcauguuaaaugcuguacauauacauuuuuuucc

SEQ ID NO: 4144060 - RNA, 88 nt, Human
ggaaaggauucugucuuggccagccaucugggcugauugcacuccauccuucagccaggggaguggcgggccaggcaguuuccauucc

SEQ ID NO: 4144061 - RNA, 62 nt, Human
ggaaagggcagcccagaacugcugcaggugcuguccuguggggaaaggguccugcucucucc

SEQ ID NO: 4144062 - RNA, 60 nt, Human
ggaaagggcauggccuuuucacugcucccaacagcacccuagaaauggcuuggccuuucc

SEQ ID NO: 4144063 - RNA, 71 nt, Human
ggaaaguagagaauuggagcagugacaggucagggacaucccuucugauguuccucaguucucuucuguuc

SEQ ID NO: 4144064 - RNA, 91 nt, Human
ggaaagugaugcagaacaagugaugucucaugcaucuauuucucauuggcugcaucucuuauaagacaggcuuugcuguauaucacuuucc

SEQ ID NO: 4144065 - RNA, 66 nt, Human
ggaaaguggugguggaaagaggagugaaauuuacacaucucuuucaugaaacuaccccuuaacucc

SEQ ID NO: 4144066 - RNA, 68 nt, Human
ggaaaguuuuaugaauaaccaguguuuugaauauuguuuuagauaacaaugucuguucauaaaauacc

SEQ ID NO: 4144067 - RNA, 110 nt, Human
ggaaauagucaaggaaaacacaaauagcagcaucaguuuaucuccaucgauauuuuaaaggaucggagcaagaaaaaugcugcuuuuagugguuuguugccugguguucc

SEQ ID NO: 4144068 - RNA, 66 nt, Human
ggaaauauguugagucuaucuuuauggauccaucuccuuucuauaaagaagaguuaauauauuuuu

SEQ ID NO: 4144069 - RNA, 115 nt, Human
ggaaauauucucugugcucagcaauaagccagguuagacaucucucauuagacccagggauuaauuuggaucucuuguugcuaauccaaacccaauagaacuaagacuguuuacc

SEQ ID NO: 4144070 - RNA, 56 nt, Human
ggaaauauuugaucaaauuuaaggaggcauuucuuuaaccuuggucaagaauuucc

SEQ ID NO: 4144071 - RNA, 59 nt, Human
ggaaaucagaguuguguuuauauuaaggagcagggcaugcaaauacagcagcuguuucc

SEQ ID NO: 4144072 - RNA, 64 nt, Human
ggaaaucaguuggaacacaagcaguuuggggacagcccaccguugcuguuuccuacucauuucu

SEQ ID NO: 4144073 - RNA, 55 nt, Human
ggaaaucaucugauuggcuuucuggccuaugcuuccuucaguuggacugauuucu

SEQ ID NO: 4144074 - RNA, 58 nt, Human
ggaaauguaauucucuugaagauucuucccaaaggauuugacagagcauagcauuucu

SEQ ID NO: 4144075 - RNA, 63 nt, Human
ggaaauguauguauuaagcaccuggcaggcacagaaaggugcuuucacugauguaucauuucc

SEQ ID NO: 4144076 - RNA, 70 nt, Human
ggaaaugucagaggaacauauugaaagaaucugcauccuugaugucaaucaacccuuccuccauauuucc

SEQ ID NO: 4144077 - RNA, 100 nt, Human
ggaaauucggcuuugguauguacagccuuguucucuuuauccugccugcccuggccuggaagaacaagcagugcuuuccuuucaagggcuauugauuucu

SEQ ID NO: 4144078 - RNA, 64 nt, Human
ggaaauuucaggccaccagaugucuuuaugcaucugcauaaauaacagugccaugaaauugacc

SEQ ID NO: 4144079 - RNA, 59 nt, Human
ggaaauuucugauauccaacuauuuuugaccuacaagaaugguaauuugcagaaagucc

SEQ ID NO: 4144080 - RNA, 91 nt, Human
ggaaauuugguuguggccauguuguggaagugggaagggcagcugaagcagucuacacugaauuuccacagagagugaauagcaaguuucc

SEQ ID NO: 4144081 - RNA, 89 nt, Human
ggaacaagaauguugaugcaagaggcaucuuuuaaaaauaaguauuauuuugcauguguuuaguccagccucuuguuuuugcuuugucc

SEQ ID NO: 4144082 - RNA, 57 nt, Human
ggaacacaaggcauagcacacagaauuuccuuucauucuuugcauguccuuuguucc

SEQ ID NO: 4144083 - RNA, 75 nt, Human
ggaacacagugccuuacaaacugucuaaaccauacaguuuauacaguuuagacaguuuguaaggcacuguguucu

SEQ ID NO: 4144084 - RNA, 86 nt, Human
ggaacagcccacucugaggacuguaguucugaugguccuggugcugcuaucaggcaaggcccuuagagugucucaaguugaaagcc

SEQ ID NO: 4144085 - RNA, 107 nt, Human
ggaacaguaaaggcugacagcccagagggaagaggugucaucccuucaucacacaggaggaugucggaugcacacucuccccugccugguugaugcuggcuuuuucc

SEQ ID NO: 4144086 - RNA, 66 nt, Human
ggaacaguugagaugauguaccuuggugccacauaaacaagguuagaaauccugcuccacuauucc

SEQ ID NO: 4144087 - RNA, 57 nt, Human
ggaacaguugcgucaugggccugcugguacauugaccacagggccccgcggcucucc

SEQ ID NO: 4144088 - RNA, 69 nt, Human
ggaacauggaguaagccaaguuagaagagauaaagaacauuuucuggcuuauccuaacucuaacuuucc

SEQ ID NO: 4144089 - RNA, 70 nt, Human
ggaacaugggacaauuugaacacagugcucaggauaguuucuguguagcucagauauguccagccauucc

SEQ ID NO: 4144090 - RNA, 69 nt, Human
gccugcugucucugggcaggcagggggcugacaggucagcaggcugcuuuggcucagugacaucagugc

SEQ ID NO: 4144091 - RNA, 73 nt, Human
gccugcugucuguauggaggaggugcuagcccgguccaccgggcugcugcccaccccugcaugccccaguugc

SEQ ID NO: 4144092 - RNA, 69 nt, Human
gccugcugucuucccugcauguuuaugaauaaguagauacaaguucaaggaagggaggaaagccaaggc

SEQ ID NO: 4144093 - RNA, 88 nt, Human
gccugcuuaaagggauuugacuuggcugggaggagggcccuuuuguaccucccccuucuuccuccugcuguuagucuugaaugcaggc

SEQ ID NO: 4144094 - RNA, 102 nt, Human
gccugcuucuccugccuccuccucuuuggcuucuccuccucagcuccuuucuucuucucugaggguggcacaggcacaaagagagaaaacagagaagacagc

SEQ ID NO: 4144095 - RNA, 81 nt, Human
gccugcuugacuuucaggauguucaguauuaauuugcuuuuccaggugaugggagaaugcugagggaugagagaggcaggc

SEQ ID NO: 4144096 - RNA, 64 nt, Human
gccugcuugccugcaugaggagagcuggcuccaccagccagagaaagcucacaggcagugaggc

SEQ ID NO: 4144097 - RNA, 70 nt, Human
gccugcuuuaagucuguugccugacccccugacuaaauggagggaaaaaaauggaacagcucagggcagc

SEQ ID NO: 4144098 - RNA, 70 nt, Human
gccuggaaacaagcaagcacauaauuuucugcaagcccagaaauaguguuuguuugcuuguuuuucaggu

SEQ ID NO: 4144099 - RNA, 57 nt, Human
gccuggaaauugaggcacaguuccaacaccagggcggauucaggccuuuuuccaggc

SEQ ID NO: 4144100 - RNA, 58 nt, Human
gccuggaaggcggagguugcggugagcugagaucaugccacugcacuccagccuaggc

SEQ ID NO: 4144101 - RNA, 58 nt, Human
gccuggaagguggagguugcagugagcugagaucgcgcuacugcacuccagccugggu

SEQ ID NO: 4144102 - RNA, 74 nt, Human
gccuggacaagcacugugccucauaucugaugguaagauucauaguuuguaagagcacaggguuggagccaggc

SEQ ID NO: 4144103 - RNA, 55 nt, Human
gccuggacagaaaccaguccuggggggauggcuuccuuucuggggcuguccuggc

SEQ ID NO: 4144104 - RNA, 77 nt, Human
gccuggacgggugcuuguucccgcugcuuccggcuauggcugagagccuggccugggcaggcacaugccacaaaggc

SEQ ID NO: 4144105 - RNA, 93 nt, Human
gccuggacuagcucuugaaguuguagucagaugucaguuacagcugcaguuagcugaaagcuugacuggggcuugaggauccauguccaaggu

SEQ ID NO: 4144106 - RNA, 61 nt, Human
gccuggagaagauggaacuagcacagcacucuagugaggacucaggaccuucuucccgggc

SEQ ID NO: 4144107 - RNA, 78 nt, Human
gccuggagauuuuacaaacugcaggacccaacugaggaucugaaaacaauugagucuggcauauuguugacugcaggc

SEQ ID NO: 4144108 - RNA, 130 nt, Human
gccuggaggaucuacuuucaagagaccucacgcacggcuggcauauuggcgcuggcuucugcuaggagcccagccagagcugugugaugggggucucuauuuucuccaagugggcuucuucaggacuguc

SEQ ID NO: 4144109 - RNA, 64 nt, Human
gccuggagggucccucucuggagguauauguggcggccacaccauggagcauggcucacuaggc

SEQ ID NO: 4144110 - RNA, 55 nt, Human
gccuggaggguugagguuuuguuuuaauaaagaaaaucccauuuucuuccagugc

SEQ ID NO: 4144111 - RNA, 57 nt, Human
gccuggaguagcauggcaagccuacagcucacuaggaaagugcagcugcucccaggc

SEQ ID NO: 4144112 - RNA, 106 nt, Human
gccuggauguguucagguucugggcucuggagagccauaggcccuuguugggaguggccauccuagagggauggcugccagggcccugaccuagcaccaugugggc

SEQ ID NO: 4144113 - RNA, 62 nt, Human
gccuggcacaguagggacccaauaaaauaugugaaaacacaagugucccugaugggccaggc

SEQ ID NO: 4144114 - RNA, 65 nt, Human
gccuggcagugaugucuuuuggaucucagagccuuuaucugguuguaaaauuaucaugcucaggc

SEQ ID NO: 4144115 - RNA, 65 nt, Human
gccuggcauuaaaggguaaauuaaaauuacgacuauauuugguguucaucuuuuaguggcauggu

SEQ ID NO: 4144116 - RNA, 56 nt, Human
gccuggccaacguggugaaaccccgccucaacuaaaaauacaaaaauuggccaggc

SEQ ID NO: 4144117 - RNA, 55 nt, Human
gccuggcccagggcucuuguuggcacacucugcaggggcaaggcucaggccaggc

SEQ ID NO: 4144118 - RNA, 82 nt, Human
gccuggcccuaggucuuccagcccuagacucuaugcugucacgcuucagcagggucuccugagagaagaugcugggggcagc

SEQ ID NO: 4144119 - RNA, 82 nt, Human
gccuggcggcagcgcggccugcgccgcguagggcacguaggcgggcgcgcagcuggcgggcagagccgccaugcucgagggc

SEQ ID NO: 4144120 - RNA, 56 nt, Human
gccuggcuaauuuugguauuuuuaguagagacgagguuucaccaucuuggccaggc

SEQ ID NO: 4144121 - RNA, 56 nt, Human
gccuggcucgggcacucgccaggauggagauuucucaggcggcucgaaggucaggc

SEQ ID NO: 4144122 - RNA, 82 nt, Human
gccuggcuucaggucccugugagccuuggacucucuccucucucuuuggaguguccuuggcuugaggcaccucaugcugggc

SEQ ID NO: 4144123 - RNA, 78 nt, Human
gccugggaauuugggauacaucuugcugagccuagagacagaaaagagcuucuaggcugccuucccugagccccgggc

SEQ ID NO: 4144124 - RNA, 79 nt, Human
gccugggauagaaauuuagaacaagguuggauguuggugaucauauaaaaauagauuuguucuuuuuugucauuagagc

SEQ ID NO: 4144125 - RNA, 113 nt, Human
gccugggcuugagacuccagguuuucuguggucagagcuugagcuuauaacuauuggguuuuccuguuaaaucugggcacaguguagaaucuucaccuucuuauaagccuggc

SEQ ID NO: 4144126 - RNA, 61 nt, Human
gccuggguccacccugugaaguagaauccacugucaucuccuccacauggucaccccaugc

SEQ ID NO: 4144127 - RNA, 99 nt, Human
gccugggugaauuugauccuaaacuugcacugaccucaaaacagucagaaacucagccgcuuuuugucugugucagugccaguucauucauucacuggc

SEQ ID NO: 4144128 - RNA, 59 nt, Human
gccugguccaaagacaagaguucagguccccacuaagaagcucuaugacuuggccaggu

SEQ ID NO: 4144129 - RNA, 75 nt, Human
gccuggugagucugagcccccgggaagcugggcugagugcuccagagcuccagggcuacagaaggcacagaaggc

SEQ ID NO: 4144130 - RNA, 78 nt, Human
gccugguggagccuaggcuaagucuacaaaaauacggagcucagagcuccuaccuagauuucuuugcuuuauucaggc

SEQ ID NO: 4144131 - RNA, 56 nt, Human
gccuggugguauccuggcaagaauggcucgcuuaccgugguugugggaucccaggc

SEQ ID NO: 4144132 - RNA, 60 nt, Human
gccuggugguucaggagaauggcuucucuuaaggccaacuccucuaaccucuaucuuggc

SEQ ID NO: 4144133 - RNA, 74 nt, Human
gccuguacaugugugcgagcaggccaggugcauguaugugugugcaugcugugagugugccgcagagggcaggc

SEQ ID NO: 4144134 - RNA, 71 nt, Human
gccuguagaaagagggggcuguacauguugcagaaaugguugcaaauuugagcagacuguucaagacaggc

SEQ ID NO: 4144135 - RNA, 76 nt, Human
gccugucauuuucugguuaguuaaucauaaauaguuagugauggcuuguugauuaauuaacaggaaaaaugaaagc

SEQ ID NO: 4144136 - RNA, 70 nt, Human
gccuguccucuuccgccugucuguccuuuguguccaggaauuccccagacaguggggaaggaggagaggc

SEQ ID NO: 4144137 - RNA, 117 nt, Human
gccugugacucuccuccugucaccaacccacuaugauuguccucaugguugaauaggaagcuuaugaggccacaguuauagauuuaguuucugggaaggcuggauagaguuccaggu

SEQ ID NO: 4144138 - RNA, 71 nt, Human
gccugugcaaauuguguuugcuuuucucuuucaugacaggccaugcagagacucaaaacagugugaaaggc

SEQ ID NO: 4144139 - RNA, 69 nt, Human
gccugugcauagcagcggacucccuuagacguguguuuauuuuucacuguaguucguugcagcucaggc

SEQ ID NO: 4144140 - RNA, 84 nt, Human
gccugugggaagaugcuggcaaggugcuggagggcccuggaggcaaagggccugccucgaccuugccccccauaacccacaagc

SEQ ID NO: 4144141 - RNA, 95 nt, Human
gccugugggagggagugggcucugguggcaacauugcuggaguggggaaaucugaguucucuaguccugaccuugccaccagccaucucuagggc

SEQ ID NO: 4144142 - RNA, 85 nt, Human
gccugugucagcuguggcaggcugcggccgugugagcauucuguaaugcaacgcccucggcugugccuccgaggcuugcacaggc

SEQ ID NO: 4144143 - RNA, 72 nt, Human
gccuguguggcaaggugagaagugggcagggugaggagcggccaacccaccauuguuuugccuggcauaggu

SEQ ID NO: 4144144 - RNA, 71 nt, Human
gccugugugucuggaagcucagggagcagcugugaccugcacgugggauuccugagcucccaugaacaggc

SEQ ID NO: 4144145 - RNA, 55 nt, Human
gccuguuccuuaguggcuucaccgcuguauugucaguccccacagggcaaggggc

SEQ ID NO: 4144146 - RNA, 82 nt, Human
gccuguucucucucuugccuggguggugccugcugggaaccacaggguguuggcagccacccauggcuccagagaggugggc

SEQ ID NO: 4144147 - RNA, 99 nt, Human
gccuguugcaaguggagaggcagcccugagauaggacucugcuggcucagcccuccuccugagucuugaugccucucuccucauugcuuccacucaggc

SEQ ID NO: 4144148 - RNA, 57 nt, Human
gccuguuggguaacagaguucacugucugucucgcugcacuguuguucccagcaggu

SEQ ID NO: 4144149 - RNA, 81 nt, Human
gccuguuucacuuacccuuccuucagagugugaauucuaccacuaauuaggcugaggagugggugggcagugagaggaggu

SEQ ID NO: 4144150 - RNA, 85 nt, Human
gccuguuucagucagugaccucacuucuuaggauuguguagucuggagaaagcagucugggagaaggugagauuagugaccuggc

SEQ ID NO: 4144151 - RNA, 60 nt, Human
gccuguuucccugacgcuuacacaagcuaaggcaaggugaagcagcagcagggagaaggc

SEQ ID NO: 4144152 - RNA, 60 nt, Human
gccuguuucuaaucucauuucuuuauuauaacuugagagaaaaugggaugagaaaagggu

SEQ ID NO: 4144153 - RNA, 59 nt, Human
gccuguuucuagcuguaggaagcugagugguucacuuagccucaucagcagaauggggc

SEQ ID NO: 4144154 - RNA, 72 nt, Human
gccuguuuguuugcaaaggagccaaguagauguuccuaaagcuauucgaacugcuuugcagaccgagcaggu

SEQ ID NO: 4144155 - RNA, 71 nt, Human
gccuguuuuccugcugugguugggagacauucaauccagacaacuccuccuccacagcagcugacaauggc

SEQ ID NO: 4144156 - RNA, 62 nt, Human
gccuguuuuugcuucguuuaaguuauauuugguggcuaaguuuucgcaggcagauaauaggc

SEQ ID NO: 4144157 - RNA, 83 nt, Human
gccuuaaguucuuugugaguaauacagagcguuccaguguuccaggaagggacagaucugugcagacuggcagggucagaggc

SEQ ID NO: 4144158 - RNA, 79 nt, Human
gccuuacaccuaguggaggggagggacagggcauuagagaaugguugccagagaaucaccucuccuuccaggauggggc

SEQ ID NO: 4144159 - RNA, 74 nt, Human
gccuuacgcguccuugcccagggccuuucugaauuuuagaagcugccaccagcccagggcaggaucagggaggc

SEQ ID NO: 4144160 - RNA, 65 nt, Human
gcucuucuuuuccuaguguaagagaaaagugacccuucuuaugccuaaacacagggagagggagc

SEQ ID NO: 4144161 - RNA, 66 nt, Human
gcucuuggaaaagcacccagcuccugcaggacuuuccucucagugccugugggcuucuuccaaggc

SEQ ID NO: 4144162 - RNA, 63 nt, Human
gcucuuguccccagaaaggugaggcaggaugagcaccuccugucagcccuuuggggugagagu

SEQ ID NO: 4144163 - RNA, 102 nt, Human
gcucuugucgcccaggcuggagugcaauggcuugaucuuggcucacuacaaccucagucucccagguucaagcgauucuccugccucagccucccgaguagc

SEQ ID NO: 4144164 - RNA, 68 nt, Human
gcucuuucccacagugguuguggcauguggucauuaugauuucuguuuuaccacuguggcaucagagu

SEQ ID NO: 4144165 - RNA, 58 nt, Human
gcucuuucugucuugcagagaccaccuuuucacuguguucucauauggcagagagagu

SEQ ID NO: 4144166 - RNA, 87 nt, Human
gcucuuuggcuucuguuuuggcucuguucuuaggcuaguuuauugaagggcagagaaauagaugccgacaauaucuggauuuagagc

SEQ ID NO: 4144167 - RNA, 89 nt, Human
gcucuuugggaggccaaggcaggcggcugggaggugguuguagcgagccgagaucacgccacugcacuccagccuuggcaccauugagc

SEQ ID NO: 4144168 - RNA, 106 nt, Human
gcucuuuguuuacuugguucuaagccuuaaggauucagcccuauggaauggggguccaucugugcucugcacccccaaacaucaagggcugaccuggcucaaaggc

SEQ ID NO: 4144169 - RNA, 119 nt, Human
gcucuuuucucaugccaauguaagcagucaaucccuguuaaagaauagugccccuauugcugaaguaauaagucuguuguuuaauuggguauuugucacagaggauggaaaaacagggu

SEQ ID NO: 4144170 - RNA, 84 nt, Human
gcucuuuugguggguuugguuagguaucuuuggaauuugggugcuccaauaacaucuaaaaacuuauaaaaacuuagaaagagu

SEQ ID NO: 4144171 - RNA, 74 nt, Human
gcucuuuuucucuucauaugugaacucagugaugucugcaaccuaaaaggcaacauauugugggaugagagagc

SEQ ID NO: 4144172 - RNA, 65 nt, Human
gcugaaaacuguucuuguaacacuuaaauuguggugagcaguuuaaauuaugugagcaguuuagc

SEQ ID NO: 4144173 - RNA, 77 nt, Human
gcugaaaagagcuuuagaaaucucagaguuguccccucccacugcagcuuuagagagagaugaguucacauuuucgc

SEQ ID NO: 4144174 - RNA, 63 nt, Human
gcugaaacaggugugagaacaugccuuguggaaacaggugugagaacacgccuuguggucagc

SEQ ID NO: 4144175 - RNA, 66 nt, Human
gcugaaaguuuggauucuaagcuugagagaaaaaucaagcauagagacacaaauuugggaauaagc

SEQ ID NO: 4144176 - RNA, 79 nt, Human
gcugaaauacaaauuggaggaaauugcuuuugugggaaaacauuuccucuccucaguggauuucucuuuuguguucugc

SEQ ID NO: 4144177 - RNA, 63 nt, Human
gcugaaaucccagcauuccccaugccccagcccaucucagccaggacagagugcuggcucagc

SEQ ID NO: 4144178 - RNA, 62 nt, Human
gcugaaauguuuaauuugggaguaaacaucaacuuuaaagcaaccagguaaaauauuuuagu

SEQ ID NO: 4144179 - RNA, 61 nt, Human
gcugaacacaugcuuagauuucaguggauuccuucauccaugcaccuaacauuuguugagc

SEQ ID NO: 4144180 - RNA, 99 nt, Human
gcugaacacuguuuccuccucuucuuucacuuucaccuguaccucugcccgagaggcugugcagaguagugaggggacagagguacagacagaaccagc

SEQ ID NO: 4144181 - RNA, 55 nt, Human
gcugaacucuggacuuagcaggcuucccuauggucagugugcauuuagagucugc

SEQ ID NO: 4144182 - RNA, 65 nt, Human
gcugaauacagcaugccuuaugcuacgaaauuaaugcuuucauaaggcauuuuuucuguaucagu

SEQ ID NO: 4144183 - RNA, 85 nt, Human
gcugaauagggaaauugggaaguauuaagucucuccucaaacauuucgaauuaagaggccuguaguuccucuuuccauuuuuagu

SEQ ID NO: 4144184 - RNA, 78 nt, Human
gcugaaucguuuuuaaucagauauuggcaggcauauuaccaucucugccaguuagaaacugguuagacacuauaaagc

SEQ ID NO: 4144185 - RNA, 67 nt, Human
gcugaaugaggcgccagcuugcaucuagaggucaauucucuguauucaagcuucugcccaaacaagu

SEQ ID NO: 4144186 - RNA, 63 nt, Human
gcugaauugaguuggggagcuaccaagguagaaagcacuuggaaaguuuuuacugaagacagc

SEQ ID NO: 4144187 - RNA, 87 nt, Human
gcugacaagcugcuuagacuaauacuuaggacuagcgcagugucacuuuuccuaaguucaguuggucgaaguagucacagacucagc

SEQ ID NO: 4144188 - RNA, 58 nt, Human
gcugacagcaaggggcugcccucagauucuagaggcugcuugcaguuuccugucaugu

SEQ ID NO: 4144189 - RNA, 82 nt, Human
gcugacaggguugcgugcugaugucucacagcugccucuuucuuugaagugcugcucucagccaccaggaacuacuguuagc

SEQ ID NO: 4144190 - RNA, 89 nt, Human
gcugacaucucucccugaaagguuuccagugauauuguggcacaauuuguuggccagaauccuagagacccagggauggagaugccagu

SEQ ID NO: 4144191 - RNA, 61 nt, Human
gcugacaugaaaugauauuugggugggcuguccagucccucuucccuuuuuuucugucugu

SEQ ID NO: 4144192 - RNA, 122 nt, Human
gcugaccagauacaauuucccucucacuggucuuccaugcaguuucccaucaccugucuaaucagagaaggaaagcugacaugggcacagacuuuucaguacagagaagagaauauuccagc

SEQ ID NO: 4144193 - RNA, 93 nt, Human
gcugaccaggaggccaagaugagcuggcuccauggaugacccgguggggaagccuguggagacucguucacuugaaugccaccuagugccagc

SEQ ID NO: 4144194 - RNA, 57 nt, Human
gcugaccauuaggaggacgauacaagagaccuuugucucuuucucccaauggccagc

SEQ ID NO: 4144195 - RNA, 61 nt, Human
gcugacccacagacuccugagucacgaucaccgauuguuucaggaugguuuguuacacagc

SEQ ID NO: 4144196 - RNA, 65 nt, Human
gcugaccucccuguguguacaggcuggcacacguguguacacauccugacccaugggaggggagc

SEQ ID NO: 4144197 - RNA, 55 nt, Human
gcugaccuguggcagaagcucaaauugaaacaagaaauuaugaccccaggucggc

SEQ ID NO: 4144198 - RNA, 83 nt, Human
gcugacguuuaugugguugaagaauuacaucuaaguaauauuugaauauaugcgauuuuugacuucauaauaauugacgcagu

SEQ ID NO: 4144199 - RNA, 62 nt, Human
gcugacuauuuauauauuugauuccuuaaaagcaaugaggaauacaaagcagaugguccagc

SEQ ID NO: 4144200 - RNA, 80 nt, Human
gcugacucaugcuauuccagaauguaaauuauuccgcaggaaccagguuaaacacuuuggaaguggcgaugccaguuggu

SEQ ID NO: 4144201 - RNA, 79 nt, Human
gcugacugcagccucgaccuccccaggcucaggugauccucccaccucagccucccgaguaguugagacuacaggcagc

SEQ ID NO: 4144202 - RNA, 78 nt, Human
gcugacugucaucuggccuggccuuguguuuauccuucauuagcggaacgggcauggccagggcagauggcaggcagc

SEQ ID NO: 4144203 - RNA, 72 nt, Human
gcugagaacaaagaguuaauauuuaccugucaagaaagccagcauuuuaggacagugagcuauuaucuuggc

SEQ ID NO: 4144204 - RNA, 69 nt, Human
gcugagaaggucccgagauaccaggcugacuggaagcucccacacagcccauuucugggaccugagggc

SEQ ID NO: 4144205 - RNA, 70 nt, Human
gcugagaaucgugugaugugucuagcacagugccuggcauuguggcuagacagucacaauaaaugguagc

SEQ ID NO: 4144206 - RNA, 64 nt, Human
gcugagagggaacaagcuccuggccgggccuaauggguuccaggugugcucugugcccugcagc

SEQ ID NO: 4144207 - RNA, 58 nt, Human
gcugagaguggguuuaguuuggguucaugucuaaauuuacuaaucauccagucacagu

SEQ ID NO: 4144208 - RNA, 106 nt, Human
gcugagaugggcacgccagucuugagcaguggcagacaguagacuuucaagcaucauuccaaagaauuguuuccauugcagacugugucuaaauccauaaggcagc

SEQ ID NO: 4144209 - RNA, 61 nt, Human
gcugagcauuggaucaaaugacuugcccaaggucacagggcaggaaugaaccaaagccagc

SEQ ID NO: 4144210 - RNA, 64 nt, Human
gcugagccuggccagggugcgaucgugguggcucucgcagccguaggugcccuggucggccagu

SEQ ID NO: 4144211 - RNA, 66 nt, Human
gcugagcgccaguggcagcuggaacaggcaucccaaggggguuggcagcagcaaucacuggugagc

SEQ ID NO: 4144212 - RNA, 93 nt, Human
gcugagcggccagcauggcaagaccaacugcauuuccagcuuucuucuuuucuuuguggacauuggcaguuggguuugaacuguggcccuagc

SEQ ID NO: 4144213 - RNA, 70 nt, Human
gcugagcucaugucugcuuucagggaagcuuaaagccuccaaagucuggagcagcagagcaagaaucagc

SEQ ID NO: 4144214 - RNA, 94 nt, Human
gcugagcuccaaguucggggcugaaggcccggaggacagggcagagggcucccugccuacaggguuuucuuuuccauauuugagaaauguuugc

SEQ ID NO: 4144215 - RNA, 60 nt, Human
gcugagcucccagcaguaucuggcuuuaucaucaguagcuucacugcugucuggcuaagc

SEQ ID NO: 4144216 - RNA, 79 nt, Human
gcugagcuggcugcuggacaggccacauggaggagaaucgaggcauuccaccagcagccugucagccucuggcugcagc

SEQ ID NO: 4144217 - RNA, 59 nt, Human
gcugagcugggccuggacgggcagaucugagcuccagacuggccaagcccggcuccugc

SEQ ID NO: 4144218 - RNA, 87 nt, Human
gcugaggaagaauugagugggaagauacugagaggugacagcgugcuggcaacccucgcucacucucagugccuccucggccucagc

SEQ ID NO: 4144219 - RNA, 90 nt, Human
gcugaggacacugaugaggcucagagugguuaaauaacuuuuucaaaguuacuuaacaagacuugaguccaagguaucaaaugucaaagc

SEQ ID NO: 4144220 - RNA, 60 nt, Human
gcugaggaccagugagucuggcaagugguaaugcccacugccugugcacuggucuuuugu

SEQ ID NO: 4144221 - RNA, 59 nt, Human
gcugaggacgccaggcccuaaguaaacaccucauucaaacuaggcccuagcucugcagu

SEQ ID NO: 4144222 - RNA, 72 nt, Human
gcugaggauaacuugcuguuagucagcugugauuguuacagugcagcuauuacaacaguguacuuucccagc

SEQ ID NO: 4144223 - RNA, 61 nt, Human
gcugaggcaagaguuugauuagagacaacauaucaucacuaaagaacuuuuaggccucagu

SEQ ID NO: 4144224 - RNA, 107 nt, Human
gcugaggcaggagaauugcuuuaacccuggaggcggagguugcagugagucaagauugugccacugcacucuagccugggcgacagagcgagacuccgucucauagc

SEQ ID NO: 4144225 - RNA, 94 nt, Human
gcugaggcgggcugaucgcuugagcucaggaguuugagaacagccugggcaacaaggaugagacccugccucuacaaaaaauauaaaaauuagc

SEQ ID NO: 4144226 - RNA, 116 nt, Human
gcugaggcucagagagguuaaugaacuaagccaaggcucacuguuaauaaauagcaaagguaaaauuaaauuccauaucugcuugagauagaggccuugcuccuaauagcugcagc

SEQ ID NO: 4144227 - RNA, 84 nt, Human
gcugagggauucccuuggauggcaggacaaggacccagggccugugcucuucucauucuguuauucaaugccuaacccucaagu

SEQ ID NO: 4144228 - RNA, 60 nt, Human
gcugagggcauguguggcgacugaagggcugggcuauagcuagugcgcaugcgccucagu

SEQ ID NO: 4144229 - RNA, 59 nt, Human
gcugcacuucaauguagcagcuauuggcccuguguugcuacuggcugccuggaaugcgc

SEQ ID NO: 4144230 - RNA, 56 nt, Human
gcugcagaccucugagguccaugcugauucuucucuccaggccucuggucugcugu

SEQ ID NO: 4144231 - RNA, 56 nt, Human
gcugcagccuguuguaccagccugugcugaccugcaggcuucucaauagguucggc

SEQ ID NO: 4144232 - RNA, 75 nt, Human
gcugcagcugcugguggcugaaagagagagagagagagagagaccuccucuuaggccacuucccagagcuguggc

SEQ ID NO: 4144233 - RNA, 86 nt, Human
gcugcagcuuuuuacucuuccauuucuacuucacaguuccugugcaccagggguaugugggacagagaggaggaguagagcucagc

SEQ ID NO: 4144234 - RNA, 73 nt, Human
gcugcagggagcuggaaggcucccagcaacacagccugcccccucugggcagccaaccagcagccuguucagc

SEQ ID NO: 4144235 - RNA, 80 nt, Human
gcugcauuuuacuuaccuguuaguugccugucucuccaacuaggcuguaaagagcuaggaggaagaaugugaauugcagc

SEQ ID NO: 4144236 - RNA, 120 nt, Human
gcugccaacccugugccaggggguggugucuucagcacaggagcugcagugguuggacaggacacugcuggugagguccuugcuggacucagccaccucccgcacagggugggaaucagc

SEQ ID NO: 4144237 - RNA, 64 nt, Human
gcugccacaaggcugggaagcugagcagagcuggcaacagguucagaggcuacagucugggagu

SEQ ID NO: 4144238 - RNA, 66 nt, Human
gcugccaccuaguggucuuuagucgcuucgcaugucuauggugucuaggcuacgaagggggcaagu

SEQ ID NO: 4144239 - RNA, 78 nt, Human
gcugccacgaucucugcuguaguuggggcuguaaaaugcuuuccccgugagaaaugcaagcaggaagugguggacagc

SEQ ID NO: 4144240 - RNA, 55 nt, Human
gcugccagcccagcaaggugugcccuggcacccucucaucuuccuggggggcagc

SEQ ID NO: 4144241 - RNA, 55 nt, Human
gcugccagcucacucuccugagaacuggcugacuuggaguacuugagcuggaagc

SEQ ID NO: 4144242 - RNA, 70 nt, Human
gcugccauuuggaccuaacugggcuagucagagaaacugaugggaagagccagcaguauguccuggcagu

SEQ ID NO: 4144243 - RNA, 56 nt, Human
gcugcccaccccgaggcaggaaggggcucacuucccucuccucgaagguggccagc

SEQ ID NO: 4144244 - RNA, 100 nt, Human
gcugcccccauccccaugccagugcucuaaaaucagugcucucaaacaagggcagauggcgcaguggaaguucuggcaagaggggacugugaggggaagu

SEQ ID NO: 4144245 - RNA, 57 nt, Human
gcugcccucccagggcaagcuugcugcuucccaggagguaugucccccgagugcagc

SEQ ID NO: 4144246 - RNA, 65 nt, Human
gcugcccugagaaauagcaucauuuuuggguuuugguagaaaugaaagcagugcuucaaagcagc

SEQ ID NO: 4144247 - RNA, 67 nt, Human
gcugccuccucuuugccaaggucaugggugacuauuggcuggauaucaggcaagggggcaggagugc

SEQ ID NO: 4144248 - RNA, 68 nt, Human
gcugccuccugaaagcgcucugguuagguaagacaagccauuccguuaauguguuacaggagugcagc

SEQ ID NO: 4144249 - RNA, 88 nt, Human
gcugccugaggaauggguagguggucugcuauguaaaaaagagaacuggguuuacagcuagacauaccugaguucaaaucucagcagc

SEQ ID NO: 4144250 - RNA, 60 nt, Human
gcugccugccugcauuuaauccauaaagcaauagugcuguuugauagauggggaggcagc

SEQ ID NO: 4144251 - RNA, 98 nt, Human
gcugccuuaccggccuggcacuggcuuugaucagagugaccuuuuccuuccaaacgagagcacuuucgagagccggagaggaugcugguaauaguggc

SEQ ID NO: 4144252 - RNA, 56 nt, Human
gcugccuugccaggggcagaaacaaauagauggagaaguccccugagcgaugcagu

SEQ ID NO: 4144253 - RNA, 60 nt, Human
gcugccuugcgguguauuucugggcagagcagcucaccacaggaaccuccgcgaaacacc

SEQ ID NO: 4144254 - RNA, 68 nt, Human
gcugccuuugugagccaaggggagguuucucacucuuuaaaacuccugugggcuuaaaggaagguagc

SEQ ID NO: 4144255 - RNA, 71 nt, Human
gcugcgagccgcgcgcgcacggggagccauaggcuucgggguccaagcgcgugucguuuugggggagcagc

SEQ ID NO: 4144256 - RNA, 73 nt, Human
gcugcgcggccucugugaaauccgugggagucccagggggcaccucaaagcgguaugcagacggcucugcagc

SEQ ID NO: 4144257 - RNA, 107 nt, Human
gcugcgggcagcuguggguccaggcuggcuggcaggggacacagagcauugggaaacuaggggaugaugacucacccugcuggggcagccccuacccacgccucagc

SEQ ID NO: 4144258 - RNA, 90 nt, Human
gcugcgugugacccaugggagacagugcagggcgggaagaaggggaggccagcgucucucccucacucugccuccugggguuuccgcagc

SEQ ID NO: 4144259 - RNA, 66 nt, Human
gcugcuaaaaagugggugagcagcuagggacucuauuucugccagcuccucccccaccuuugcagc

SEQ ID NO: 4144260 - RNA, 64 nt, Human
gcugcuaagggugggaacuaccagugaaaugcuacgugcugcagggucagccccaccuggcagc

SEQ ID NO: 4144261 - RNA, 71 nt, Human
gcugcucacugguggauggacucucgggggcccugcuggccaggacacccccgggcauccacaagggcggu

SEQ ID NO: 4144262 - RNA, 61 nt, Human
gcugcucagugggccugagccugaagcuguauuaaggagucuaggcuucauccugggcagc

SEQ ID NO: 4144263 - RNA, 74 nt, Human
gcugcucaucgugguuugccaugcagccaggaaggaggggaccgccugccuucccugugggcgcccugagcagc

SEQ ID NO: 4144264 - RNA, 55 nt, Human
gcugcuccaguguucugucuagaaagcaacuucuggacaggauagugcaguacgc

SEQ ID NO: 4144265 - RNA, 62 nt, Human
gcugcucucccugcuguccucagccucucccaccaccggcuguggaccagguccugggcagc

SEQ ID NO: 4144266 - RNA, 77 nt, Human
gcugcucugaggccagagcugaccuaucaaugaagacuagagaggaucgcauuggugggggcuuggagaggggcagc

SEQ ID NO: 4144267 - RNA, 58 nt, Human
gcugcucuuugaaauccaucacugcuuuguaccaagacuaugccuuucgaggggcugc

SEQ ID NO: 4144268 - RNA, 96 nt, Human
gcugcucuuuguuauuucagccacagagugcaagaaagaccuuuugccguuuuauuagugugccaugcugaacgauauuagagguuuccuagcagc

SEQ ID NO: 4144269 - RNA, 55 nt, Human
gcugcugcugagaaugccucagguacaauugacacucuugguugcucagugcagc

SEQ ID NO: 4144270 - RNA, 72 nt, Human
gcugcugcuggcuuccugcuguuuugaggccucugaugcuggaagaacaggaggaagccagcuccccacagc

SEQ ID NO: 4144271 - RNA, 62 nt, Human
gcugcuggccgcccagcuucuccccgaucugggagaugcucggcucugggcggccaaacagc

SEQ ID NO: 4144272 - RNA, 58 nt, Human
gcugcugggauccugggucucagccguggcuggggcugcaucagcaggacccggcagc

SEQ ID NO: 4144273 - RNA, 73 nt, Human
gcugcugggccccuugaaaggcgucucccugggccugggaaugucuggacggcucuaagggggccagugaagc

SEQ ID NO: 4144274 - RNA, 62 nt, Human
gcugcugguagauucagcaucuggugaaguuugcuuccuggaucauagcgucuucuugcagc

SEQ ID NO: 4144275 - RNA, 71 nt, Human
gcugcugguccucagagcucaucucgaauagcaagaguaaaagauaagaaagacuggagggaccaaacagc

SEQ ID NO: 4144276 - RNA, 74 nt, Human
gcugcugguucgcagauggccuugcacaagccuuggcugcucagagcuuugcacuccagcuguggcccagcagu

SEQ ID NO: 4144277 - RNA, 66 nt, Human
gcugcugugccccaucugcagauuuccauuuuuaagaugcuucgggaauucucgcaggccaguagu

SEQ ID NO: 4144278 - RNA, 126 nt, Human
gcugcugugcccggaaauccauggccaccuuugcacucaggccacucuucccaucagugaaugaguguggcagggauacugaggcaggcugguuccagagagacccagggugcaucgaacggcagu

SEQ ID NO: 4144279 - RNA, 60 nt, Human
gcugcuguuccuccaguggauccaccauuuggcugcugucccugcuuggaacuggccagc

SEQ ID NO: 4144280 - RNA, 74 nt, Human
gcugcuguuuuggucauggaaucagaugucuuuuacuauucugaggcccaaagagcccagggugaaauagcagc

SEQ ID NO: 4144281 - RNA, 101 nt, Human
gcugcuuaauuaaagccugcuggcagaggggguuacucacuucagcaaguugcugaccccagaguaucccacuuggcugccagcagauugaaaggaguggc

SEQ ID NO: 4144282 - RNA, 64 nt, Human
gcugcuuagaaccauauuuaaaguuaucccauuacggaagagaaggagguguguuucuaggagc

SEQ ID NO: 4144283 - RNA, 81 nt, Human
gcugcuucaggcuggaacaacaugcuggaaaauuguggucugccaugcauuuccuuugauguuauuccaugccagaucagc

SEQ ID NO: 4144284 - RNA, 106 nt, Human
gcugcuuccaaaauggcaccuucuuccugccucuucauauggagaaaggaacaaaugcuguguccucauguggcagagaguggaaggggagaaagugccaggcagc

SEQ ID NO: 4144285 - RNA, 94 nt, Human
gcugcuuggaaaacauugcuggaacacugggauccacugagggagauucuuccagaaguguccugugucccagacugugacuuuucuaaccagc

SEQ ID NO: 4144286 - RNA, 67 nt, Human
gcugcuugggcccucugugccucaguuuccucaucuguaaccuacagaaguggcuucaaagagcagu

SEQ ID NO: 4144287 - RNA, 67 nt, Human
gcugcuuguuuucuuccuaauugcucauuucuuuuaaaugccaauugcaggaagaaaacuaaacagu

SEQ ID NO: 4144288 - RNA, 80 nt, Human
gcugcuuucugauuacucacauucuguuucuugcuuuuaaaaaaacaguaaagacaagaguguuggaccaguauugcagu

SEQ ID NO: 4144289 - RNA, 75 nt, Human
gcugcuuugacauccauucagugcaaaucacauugagucacuccucucugugaacuuuggaugguucugagcagc

SEQ ID NO: 4144290 - RNA, 62 nt, Human
gcuggaaaaggaggcaaaauauacuuccuacaaaauggcaaauuuugucuucuuuucuacgc

SEQ ID NO: 4144291 - RNA, 63 nt, Human
gcuggaagggaggcccagccggcagccaccaccuccuccuccaaccuguccucccauccacgc

SEQ ID NO: 4144292 - RNA, 64 nt, Human
gcuggacaucagcaggugcugguggagaccacucacugguuguuggcugguugcugagaucagc

SEQ ID NO: 4144293 - RNA, 65 nt, Human
gcuggacauggaaaucggcuugcuccauuggugguggggcauagagagguucaugucagcccagc

SEQ ID NO: 4144294 - RNA, 90 nt, Human
gcuggacgaacauucuggauguuugaggacucagaagacgcacaucccugugcccuucuuuuuuaaacaauuauuugaagacagucuagc

SEQ ID NO: 4144295 - RNA, 85 nt, Human
gcuggacuguaaaugaggcucauuugaggcuggggauacgugaaugugcuuguugugcugggcccagggagccucugggcacagc

SEQ ID NO: 4144296 - RNA, 67 nt, Human
gcuggacuuucucaguuccaucuagagccugaaacucaaaauccagaaaccacugaagagauccagu

SEQ ID NO: 4144297 - RNA, 101 nt, Human
gcuggagaaacuagaaaagauuaguaucaggcaugucuucugcacuguaagaacgcuuaggcaauagaauaugccugagggucugguuuaggaaucuaagc

SEQ ID NO: 4144298 - RNA, 63 nt, Human
gcuggagagcaaugaggggcaggcugugaacuccaaacgccuccuccaucauugcuucauggc

SEQ ID NO: 4144299 - RNA, 77 nt, Human
gcuggagagguuaugagacuugucuguggucucaaucaggcgagugcagaaccaguccucagacccaauuguccagc

SEQ ID NO: 4144300 - RNA, 84 nt, Human
ggaaccaaaaguguccagauuaugaagaaauacuguuuuaauaaguuaucucucuucaguauuuggauaacauuuugagggccc

SEQ ID NO: 4144301 - RNA, 78 nt, Human
ggaaccagaggccacauguggcugcucguauuuaaguuaauuaaaauggaacgauggccgggugugguggcucacacc

SEQ ID NO: 4144302 - RNA, 61 nt, Human
ggaaccuggaaucuauuacaaggugcucccagcuaagcucucaggguaacagccaggugcc

SEQ ID NO: 4144303 - RNA, 63 nt, Human
ggaacuaacuauucaagugcucauucagaacacucugacugaaagcuuaaauggaaaggaucc

SEQ ID NO: 4144304 - RNA, 82 nt, Human
ggaacucaucgagugccugguauguagguagcggaguggaauucaaaccccaggcuucugauuccaggcaccauguucuucc

SEQ ID NO: 4144305 - RNA, 119 nt, Human
ggaacuccucucuagaaaaauauccaauuaaaauucacaguggcagguguggguuguggaccuggucaaaaggcauaaaccaccaacccacccugugauuguuuuagcagaggauuucc

SEQ ID NO: 4144306 - RNA, 70 nt, Human
ggaacucucauauauuguuggugggaauauaaaauggcaaaaccauguuguaaaacagugugacgguucc

SEQ ID NO: 4144307 - RNA, 94 nt, Human
ggaacugacugcugggucaugggguagaagcauguuuauuuacugccauaagaaacugcuagacacaucuucauccacaaugauaaagaguucc

SEQ ID NO: 4144308 - RNA, 93 nt, Human
ggaacugcaaaagcuauuuauuacagagaaugcauauaagcucuuuuucacaugccaacuguauucuauugguaagugcuugcugcagcaucc

SEQ ID NO: 4144309 - RNA, 62 nt, Human
ggaacugcauucuuuaucccacaacccucacaggguuugcuuuaugaaagaggauguaaucc

SEQ ID NO: 4144310 - RNA, 77 nt, Human
ggaacugugguccucucaacugaagguugaaucuacuuccaagcuuccuuaccugguuguugacaggacucaguucc

SEQ ID NO: 4144311 - RNA, 77 nt, Human
ggaacuuaaagcacaggagaguucaguaacuugcucaaggucauguuguuguggacuaacuccuggucccaagcucc

SEQ ID NO: 4144312 - RNA, 86 nt, Human
ggaacuuauacuguaacagccagguuagugcuaauuguagacuuacaguaaagccuucugguugacagucacuacaccagaguucc

SEQ ID NO: 4144313 - RNA, 59 nt, Human
ggaacuuauuuggauaauacagcacagauguaccuuguuguacucaacagaugaauucc

SEQ ID NO: 4144314 - RNA, 87 nt, Human
ggaacuuguugggaacuggagcaaaagugacuccucuuaugguuuaacaaacagacuggaggcauuuugcuccugcccuagagaucu

SEQ ID NO: 4144315 - RNA, 72 nt, Human
ggaacuuuuguuucauuuacucauuaagcuuucugaaaugggagcuuuggcaaugaaacacaagaaaauucc

SEQ ID NO: 4144316 - RNA, 65 nt, Human
ggaagaaacccagcagaucagaggggcuauuggaagaacaaaagccccucauaucugcuuucucu

SEQ ID NO: 4144317 - RNA, 63 nt, Human
ggaagaaagaacguugguuaucuuagauaucucagucauaggaagguccaugucuuaucuucc

SEQ ID NO: 4144318 - RNA, 130 nt, Human
ggaagaaagagcuaggcuaaaaaauaaaaagagagacuuaugaaugagagaauaguggagcaacacaauugcuucagauucuuuucaugucuuuagguaucucucuuuucccaaauuaacuuuauuuucc

SEQ ID NO: 4144319 - RNA, 60 nt, Human
ggaagaaagguggacaacagguggccagcagugguccaccugugguuauuuuacucuucc

SEQ ID NO: 4144320 - RNA, 82 nt, Human
ggaagaacacuucaugauucauuucucaacuaagagaauagugcucuuauuuuucuagugaucagcuugaaguaguuuuuuu

SEQ ID NO: 4144321 - RNA, 78 nt, Human
ggaagaagaagagcaaggagucaaugcuucuguuaaacauaaauuaccagaauaaaaacuccuaugucucucucgucc

SEQ ID NO: 4144322 - RNA, 115 nt, Human
ggaagaaugcuuugaaaacagcagggcucuauagagguuagauguucuccagaugggaggcauuacuacuugucacuuccagaacauuccaugugcccugcccagagcacauucc

SEQ ID NO: 4144323 - RNA, 66 nt, Human
ggaagacauggcuguugugaggaucaaauggaaggauccaugagugcuuagaacaguccugggucc

SEQ ID NO: 4144324 - RNA, 71 nt, Human
ggaagagagagacgagugggguuuggccuuguggggucgccuaccacagccccccgcucaguuuccaaacc

SEQ ID NO: 4144325 - RNA, 71 nt, Human
ggaagagagggcugggccucaaacaaagccuguggugccucaggugagaccuccuagcccucugucauucc

SEQ ID NO: 4144326 - RNA, 68 nt, Human
ggaagagcugcuuaguuuugauuuucauuaagauaagaaugcugugucaaagccaggcaacucucucc

SEQ ID NO: 4144327 - RNA, 62 nt, Human
ggaagaggccacuauuuuuagggauugguagcacagaacuuccuugaauugugccacuuacc

SEQ ID NO: 4144328 - RNA, 57 nt, Human
ggaagaggcugagccaggucccuguaacugcauuugccugagucacauagcuucucc

SEQ ID NO: 4144329 - RNA, 60 nt, Human
ggaagaggguacuccuuuccuccugcuuuucuuacuaggauuuaucaggaacucucuucu

SEQ ID NO: 4144330 - RNA, 57 nt, Human
ggaagaggugucguagauuauucucaaguuccacuuugaagccuggcaccuucuucc

SEQ ID NO: 4144331 - RNA, 70 nt, Human
ggaagauagaaguucaaaaguuaucggugcaaaaggagugauacacaaaagacuucaauuucuaucuuuu

SEQ ID NO: 4144332 - RNA, 78 nt, Human
ggaagaugaggcuguuagggccugagguagcuggugcuuaagaagcagcugaccugaaaugacagucuuaguacuucc

SEQ ID NO: 4144333 - RNA, 76 nt, Human
ggaagaugggugguccuuacaggaggcuuacucauaggugugaagugaccucauuacggggccugcuccaucuuuc

SEQ ID NO: 4144334 - RNA, 63 nt, Human
ggaagauucagcauauaugagugggccuuuggccucggguuacuuaugaucugguugucuuuc

SEQ ID NO: 4144335 - RNA, 58 nt, Human
ggaagauuucugaugaguuacuugaugcuucugugccaaguaaaucagagaaauaacc

SEQ ID NO: 4144336 - RNA, 110 nt, Human
ggaagcagaaaggugguuuuagagucacucagauguuaaagggcuuuuuuugcaccaggaagccaagccucuagaagacccuauacucagugacccacccgucagccucc

SEQ ID NO: 4144337 - RNA, 75 nt, Human
ggaagcagagcagauggucuucauaaguuuuaagcaaaggugcuaagaaaacacaaaguuuacuuuucuacuucc

SEQ ID NO: 4144338 - RNA, 71 nt, Human
ggaagcagcaugcucugguacacaugggaaugaguuggaacacaggugugucuaggcucaugcuugcuucu

SEQ ID NO: 4144339 - RNA, 59 nt, Human
ggaagcagcuguuuccaggcguuguugccuuccuuggagcaaugcacacagcugcuucu

SEQ ID NO: 4144340 - RNA, 80 nt, Human
ggaagcauagggcauuauuaacuggaggaaaagugaugacuuuucccuuuuuguucauucuuaauaaauuaugugcuuuc

SEQ ID NO: 4144341 - RNA, 64 nt, Human
ggaagccaugagggacaguucuaguuacacugaguacaggaacucuaaugacccugaugguucc

SEQ ID NO: 4144342 - RNA, 66 nt, Human
ggaagccgcgggucaggucuaggcuagggccuucuuagacauuccugggcauuggcugcagcuucu

SEQ ID NO: 4144343 - RNA, 66 nt, Human
ggaagcuaugguaaucauccaccaagcccaguuucucauggcuugaguguuauccccagggcuacc

SEQ ID NO: 4144344 - RNA, 56 nt, Human
ggaagcugccaguccaccagcugcagaucaccugagcccuggggcuggugcuuacc

SEQ ID NO: 4144345 - RNA, 56 nt, Human
ggaagcuggcauauguaauccuagcccugggcaaccauguugucagcuaaaaaucc

SEQ ID NO: 4144346 - RNA, 83 nt, Human
ggaagcuggcugugcuguaaaaauggccuaaaucuguuuuucaccuucagaucauuggccuuucugcagugcacacaagcucu

SEQ ID NO: 4144347 - RNA, 72 nt, Human
ggaagcugguaugaacaggauaggaagggaguaagacauuucauucccucaucccaucauggccaguggucc

SEQ ID NO: 4144348 - RNA, 67 nt, Human
ggaagcuucagaagcugagguuccaggagccccaguccagcuccugaccuauuuuucucagcugccc

SEQ ID NO: 4144349 - RNA, 58 nt, Human
ggaagcuuucucuguuuccuuacuuuugacaugugggguugugaauuugagagcuucc

SEQ ID NO: 4144350 - RNA, 59 nt, Human
ggaaggaaagucugguuccaguuauuucaucaugguuggaagcagaaguuucaauaucc

SEQ ID NO: 4144351 - RNA, 57 nt, Human
ggaaggaagaggaccgagcuggugcaaagccagcuucucucaggguaucuuucuucc

SEQ ID NO: 4144352 - RNA, 82 nt, Human
ggaaggagacacaccaggaacucacccgcagaggccagcagccccucagcacagguggggccugggucacuguguuccuucu

SEQ ID NO: 4144353 - RNA, 82 nt, Human
ggaaggagccaaucaaaagcuuaccuuuucagucuuuguuauuguucaaggaugauugguaaugacacuaucuucuccuuuc

SEQ ID NO: 4144354 - RNA, 71 nt, Human
ggaaggagggaagggggaagagagcuggccguagacccgucuccggcccccgccucccccuuuccuccucc

SEQ ID NO: 4144355 - RNA, 118 nt, Human
ggaaggaucgggagagaugggaacauaggaaugaggcagagggcugugccggcugaggagaaagagccgggugagcccugcugcuucuuguauuuuacccacuugaugagaucugucc

SEQ ID NO: 4144356 - RNA, 70 nt, Human
ggaaggcagcaguggcugcuauugucucauuuucagauaugaaugggugguuugcccacuguugcccucc

SEQ ID NO: 4144357 - RNA, 56 nt, Human
ggaaggcagugaguucagcccuguacccgacauguggggcagagcuccugcuuucu

SEQ ID NO: 4144358 - RNA, 97 nt, Human
ggaaggccauguuagacggcaaaaugguuuucuagaacaugaaauggaauauacauugcccucauuucuauaaaccaggacucuaacaagggcuucc

SEQ ID NO: 4144359 - RNA, 64 nt, Human
ggaaggcugugaggggcccgcaugccagcccugugcggcagcccaggucucucucacuccuucu

SEQ ID NO: 4144360 - RNA, 80 nt, Human
ggaagggaaaauucauggguccagagcccugggcuuuguucccaaggcuccugggaaaggcuggacacauuuuucuuucc

SEQ ID NO: 4144361 - RNA, 85 nt, Human
ggaagggaugaggcaggagcggggacccugcccugcaagacuccaaagcccagguuuaggggucccuccuccucgccucccuucc

SEQ ID NO: 4144362 - RNA, 67 nt, Human
ggaagggcaggcacccacccucaccuguaaauucaggucuggggguccgggugccugcuccgaugcc

SEQ ID NO: 4144363 - RNA, 107 nt, Human
ggaagggcccugagccaggggccagcuuuggggccagguggcugcaggucccaccccggcucugcuaagccucugcuuucuggcccugggcaugucacugccuuucc

SEQ ID NO: 4144364 - RNA, 63 nt, Human
ggaagggcuggcuccguuaccuugaccuugucaaagauggugaggggguggagccaggccgcc

SEQ ID NO: 4144365 - RNA, 57 nt, Human
ggaaggggaaaacgucagaagaaaucuucuugguuuucaucugcuucuuccuauucc

SEQ ID NO: 4144366 - RNA, 78 nt, Human
ggaaggggaaggggccgggugguggcgggucugcgccagcgcucugcggcagcagccuccacucgccccacccuggcc

SEQ ID NO: 4144367 - RNA, 69 nt, Human
ggaaggggaagguuguauucagaaucaggugauccccgugcacagucagaggacuaccuucuccagucc

SEQ ID NO: 4144368 - RNA, 78 nt, Human
ggaagguauuagaaucuuuagaugaggacucuaaaauucgggaaaguuaagucacuuaucuaaagacacauaucuacc

SEQ ID NO: 4144369 - RNA, 64 nt, Human
ggaaggucagagggccaaaguuuucuaguaauucaucuaggaaauuaaccaccuuuggcuuuuc

SEQ ID NO: 4144370 - RNA, 55 nt, Human
gcugagggucuguucauguugcucugaauuuguaaggcuaagugaaccccuuagc

SEQ ID NO: 4144371 - RNA, 61 nt, Human
gcugagguacauaauaaaaauaacagcucagcaguaauugaguauuuauuaugugccaggc

SEQ ID NO: 4144372 - RNA, 55 nt, Human
gcugagguggagauugcagugagcugagaucgcaccauugcacuccagccugggc

SEQ ID NO: 4144373 - RNA, 72 nt, Human
gcugaguacuccagcugccuucugcgggaagucauuuaaugauguucuguucuaggauagguggcacucggu

SEQ ID NO: 4144374 - RNA, 78 nt, Human
aaaaugcugauuccagggccucauccucagagauuugaauucaacaggucuagaguggggccuggaaauaugcauuuu

SEQ ID NO: 4144375 - RNA, 91 nt, Human
aaaauggagcaucacaucuccuagguuauugaugcagagguaugucacaaggcccucuguagaaagagcccaggugguagucucccauuuu

SEQ ID NO: 4144376 - RNA, 75 nt, Human
uggguuauauuucucauauggugaucaguuauauuugaacaauaacuagaaaucauuuagaaguauugaaaccua

SEQ ID NO: 4144377 - RNA, 70 nt, Human
uggguucucacagguugggggaguugauaagaaacgggauucucagucauuucccucaccugcaauucca

SEQ ID NO: 4144378 - RNA, 60 nt, Human
uggguucuccagagcagacagagccaggguuuagguugcuggauguuuaugaaggaccca

SEQ ID NO: 4144379 - RNA, 62 nt, Human
uggguugcuguagauuuuuaaagucucauucuuauguuaaauuagaacaucaacagcaccua

SEQ ID NO: 4144380 - RNA, 74 nt, Human
uggguuggccuggaaggacagcgugauggcagucacagaagauaucacccccaucuuucuagauucccagccca

SEQ ID NO: 4144381 - RNA, 67 nt, Human
uggguugguaguugcagauauugucagaaaaguguauugcuaauucuuaagacugcaaaucaaccca

SEQ ID NO: 4144382 - RNA, 60 nt, Human
uggguuucauccugacucccacuggccagacauuguccacugggcaugaugagucaccua

SEQ ID NO: 4144383 - RNA, 63 nt, Human
uggguuucuuuccauguacuuuaguggcuugucagagcaguuguagucauggaaaauuuccca

SEQ ID NO: 4144384 - RNA, 80 nt, Human
ugguaaaguuaaaaagcagaaggggaauaauauuuugaccucacuaauuuguuuuccccuuuugcugacccagcuuucua

SEQ ID NO: 4144385 - RNA, 105 nt, Human
ugguaacucuugaauauuugucagguaauugcuaagugcaagggaguaugggaaaagauuacauucuacucugugguguauuugcauugacauaaauaguagcca

SEQ ID NO: 4144386 - RNA, 76 nt, Human
ugguaacuuuggacaucacuucuaccugaaagagaccuucgagcaauucuucucagguaaaaggguaucuacucca

SEQ ID NO: 4144387 - RNA, 66 nt, Human
ugguaagauuucaaguauaaguaaggucagaggaaagaaaguuuugcaaauacagaggucuugcua

SEQ ID NO: 4144388 - RNA, 80 nt, Human
ugguaaggaugagggaaagaugaaaaucuaggagucugcucucagauuucuuugcccauguuuccuaagcucuuuaucca

SEQ ID NO: 4144389 - RNA, 72 nt, Human
ugguacauaaucaucucccuaauuaugacucaucuccagacaauucgagauaguugaagagaugaaugacca

SEQ ID NO: 4144390 - RNA, 121 nt, Human
ugguacccaaauuuuuuuuucuuuuuaauuuaagaacuaagaagugcugaauugaauauguauucauuugaauauuuugcucaggcuucuaagaaaguugcagaagaggcuuuuggggcca

SEQ ID NO: 4144391 - RNA, 81 nt, Human
ugguaccuucuguaggugccaucucuaccucugacacagacugucugccucgaggcugagaaggcacagggcaaggagcca

SEQ ID NO: 4144392 - RNA, 82 nt, Human
ugguacugaaaaauaggucaaccguguaugauucgucacaaauaaagcgaaggcaacacggauaaccuaucuucaaguacca

SEQ ID NO: 4144393 - RNA, 81 nt, Human
ugguacuuggagagaggcuggccgugaugaauucgauucaucaaagcgagucauacacggcucuccucucuuuuaguguca

SEQ ID NO: 4144394 - RNA, 94 nt, Human
ugguacuuugucaaaaaugaauugacuguaaauguguggauugauuuguagguuaucuauuauguucuaugugucuguuuuuauggcaguacca

SEQ ID NO: 4144395 - RNA, 75 nt, Human
ugguagagacuugccuaaggucaugcaacuaguaauuaguggagcuaguauuugaccucaggaaguagaacuccg

SEQ ID NO: 4144396 - RNA, 80 nt, Human
ugguagaggugaggcaggaggguugagcagggucuaggaccuccaggcugaggagcucagacucuggccugaugauacca

SEQ ID NO: 4144397 - RNA, 88 nt, Human
ugguagagucaauacauacaaacuguuauuauuauuguggcgccaacaaccaaauuaggauggcaguuuugauaugcuuagccugcca

SEQ ID NO: 4144398 - RNA, 75 nt, Human
ugguagcugggucccucugcugaugggcacagcauuaaacggcguggccacucagcacaguggaugcagccucca

SEQ ID NO: 4144399 - RNA, 68 nt, Human
ugguagcuuuagugaaaaauaucagauuaugaugauuauaauuuuggugaugauacuaauagcuacca

SEQ ID NO: 4144400 - RNA, 65 nt, Human
ugguagugcuuaacaguuauucacuguaugaaugaaugaaugaaugauuucuuaggcaauugcca

SEQ ID NO: 4144401 - RNA, 73 nt, Human
ugguauaauguggcuugucgauauuagcaauuguuuauaucauguuaauaucugauaaugucccuugugacua

SEQ ID NO: 4144402 - RNA, 64 nt, Human
ugguauaauuauuccauguuccuaaguacuauuauaauuagggacauggaagagaaauuaacca

SEQ ID NO: 4144403 - RNA, 86 nt, Human
ugguaucuuucagaguacaaagugauuuuggaauugaaagaauuucuuuggguuaaaguuugucacugacuuguguuccugaacca

SEQ ID NO: 4144404 - RNA, 76 nt, Human
ugguaugccugucaccugccagcauacccaugauguacuucccuggugcuggguacugagccaggugacaugacca

SEQ ID NO: 4144405 - RNA, 127 nt, Human
ugguauguuguuaacagucagguagugguuaaguucugugccgugaucugcaucaacccuaaccucaaguagcgagaacggcaaugaaaauaauguauuuccuucuacaguacuuaauugugugcca

SEQ ID NO: 4144406 - RNA, 75 nt, Human
ugguauuaaaauauaccuucuuuuaugaaacaacuguaaaaguugauggucauauuuggggguguguguuuauua

SEQ ID NO: 4144407 - RNA, 64 nt, Human
ugguauuugcaggaauugugauuuuggaacuuuauuuaaauaaucaauuuuuguagauaugcca

SEQ ID NO: 4144408 - RNA, 75 nt, Human
uggucaaugcagcuacaaauacuuuuguaugcuucaggagguucucaugcuguguguuuuagcuccaucagauca

SEQ ID NO: 4144409 - RNA, 90 nt, Human
uggucacacuuuaucaauauucaaaaaucagcacggagacaacaacaacaaaucuguguugguuuuugaauauugauaaagugggguuca

SEQ ID NO: 4144410 - RNA, 55 nt, Human
uggucacaugcggggcuguagccugugagugcaggaagcuguuccuguguggcca

SEQ ID NO: 4144411 - RNA, 80 nt, Human
uggucaccuuuggaaugagcucaaauggcaagguugcauuacugaaugaaccuuugaggggagcucuuucagaggucuca

SEQ ID NO: 4144412 - RNA, 82 nt, Human
uggucagaacacguuggaguuguggauuaggucaaagcuaaaaugaaaugucuaauuccaccuuuuuccaacuuucaaucca

SEQ ID NO: 4144413 - RNA, 76 nt, Human
uggucagaaucccagaucuuucccaucaagcacagaauuuccccuggguuugcugggcaugucuuaauucuuccua

SEQ ID NO: 4144414 - RNA, 69 nt, Human
uggucaggccugagucuugugccccacccuggggcuagagaagaggcucagccagccaugccugaacca

SEQ ID NO: 4144415 - RNA, 55 nt, Human
uggucaguugugacuagaacacagaaucuuaauguuacacugucacagauggcca

SEQ ID NO: 4144416 - RNA, 74 nt, Human
uggucauaucauucugauguauaucuucaaaucacaacugaaaauauguaaagaauugguaaccucagugacca

SEQ ID NO: 4144417 - RNA, 59 nt, Human
uggucauucacaaguucagggaugccagaaauggcauuuagugaccugaacugaaacca

SEQ ID NO: 4144418 - RNA, 57 nt, Human
uggucauuucuaauacaggauuuaaaaauacaaaucuuguuuugaaagcaguggcca

SEQ ID NO: 4144419 - RNA, 70 nt, Human
ugguccagugucuucuacauaacaaauacucaguaaaccauaucuguuaugagaaagacauuagguaaca

SEQ ID NO: 4144420 - RNA, 65 nt, Human
ugguccaugcccacggaaugugugguuuccaagacaaccaugacccucuacauugggcugaguca

SEQ ID NO: 4144421 - RNA, 72 nt, Human
uggucccaggagaauaggugcaaaauguuucuucuacauuuucagccauuuagcagucuuucuuugggacua

SEQ ID NO: 4144422 - RNA, 63 nt, Human
uggucccuauugugguaagugggccuccauccugcuuggcucucuuagaaacuauagagauua

SEQ ID NO: 4144423 - RNA, 57 nt, Human
uggucccuuugacugcccgccacaagggaagauccaaaguguggcagagagugacca

SEQ ID NO: 4144424 - RNA, 58 nt, Human
ugguccucccuuaacuugucauguguggauuucaugauucuaaacuuaagggggagca

SEQ ID NO: 4144425 - RNA, 66 nt, Human
ugguccuggagcugaggaauagcuuugauuuuggggaaaauuagugaguccacaguuuucugauca

SEQ ID NO: 4144426 - RNA, 58 nt, Human
ugguccuucugucuuccgcaccucacaccaguguguggcacauacacaggagggcaca

SEQ ID NO: 4144427 - RNA, 98 nt, Human
uggucuaaagauuugcaauggauugaagaagguaagguuauuuccuauaacuuucaagaacuucuuuaauguacauuuugcaaagcuuacagagagua

SEQ ID NO: 4144428 - RNA, 80 nt, Human
uggucuauaaaaucauuuuguagacaaagugauauuuguuuguuucuuaaauauuucugcagaaugguuuuaaaaggcua

SEQ ID NO: 4144429 - RNA, 59 nt, Human
uggucuccaugacaucacaguggagugaaacaccuccuagaauagugugucuggagcca

SEQ ID NO: 4144430 - RNA, 85 nt, Human
uggucuccuaaaauaugguacugacuuacugguaaucaaagaaaugcaaauugaagcaguaaugagguacuauuugggcuuauca

SEQ ID NO: 4144431 - RNA, 55 nt, Human
uggucucugacucugaagacccaagagggccugaggguagagaguagagagacca

SEQ ID NO: 4144432 - RNA, 81 nt, Human
uggucucugugacacuccugugagguagguggcaauggcuuuguggugaguugaccuuucauggugagugaucauaaacca

SEQ ID NO: 4144433 - RNA, 76 nt, Human
uggucugggugcggugcauuucuguggcauggagagccugggcucagucccugggggagucaccagcauccaacua

SEQ ID NO: 4144434 - RNA, 61 nt, Human
uggucuuagcuggaaggagggauggggaagaaaaggcaaucucucgcucucacugguacca

SEQ ID NO: 4144435 - RNA, 69 nt, Human
uggucuuauucuuggaucugagucucugaguuucagcucagcugcaguaaagcucuccagggcacgcca

SEQ ID NO: 4144436 - RNA, 69 nt, Human
uggucuucaauuuuugguaugauggaaagucuauuauucucuuuuuauauauggcaaaauugaggcuca

SEQ ID NO: 4144437 - RNA, 71 nt, Human
uggucuugaauuauuuaauaccuuguuccacacugucacuuaugagcaaugucuuuugcaguucaagauua

SEQ ID NO: 4144438 - RNA, 59 nt, Human
uggucuuugaccagggucugaucacuucucucuggucaguccuacacgcucagggacca

SEQ ID NO: 4144439 - RNA, 62 nt, Human
uggugaacaaauaauugcaguuuucccauuauuuucaaugaacugcaauaacuugugcacca

SEQ ID NO: 4144440 - RNA, 55 nt, Human
uggugacaccccaucucuaaagauacaaaaauuagcgggcgugguggugauccca

SEQ ID NO: 4144441 - RNA, 69 nt, Human
uggugacgucuccauguuguauugucucaagcacauauggcuggacagcaaacauggagagaaucauga

SEQ ID NO: 4144442 - RNA, 66 nt, Human
uggugacugcuucaauuuauuuucuaggggaaauaauggcuucuaauaugaauugagcacuuacua

SEQ ID NO: 4144443 - RNA, 73 nt, Human
uggugacuucuuaaauuggauugcuauuggacaagauuuucaguauuuaucccauugauuuaaggagacacca

SEQ ID NO: 4144444 - RNA, 60 nt, Human
uggugagauagagaaguuaaguaaaugcauuuacauuauguagauuucucuguuuuucca

SEQ ID NO: 4144445 - RNA, 92 nt, Human
uggugagccaauaagucucugccaagggucaacacuuuaaacauauaguuauaagacauuuuagagugugacuggccuuuuggaaaacacca

SEQ ID NO: 4144446 - RNA, 59 nt, Human
uggugagcucuggcagucuguggcucaccuugcucagucuagauacccaaugcucauca

SEQ ID NO: 4144447 - RNA, 74 nt, Human
uggugaggacuauuuuugagcugacacucccucuuaguuucuucaugucaccuuucguccugguuccuccgcca

SEQ ID NO: 4144448 - RNA, 64 nt, Human
uggugaugaggaaaugccugcugaguuguguaaagauucuaaaaugguguuucuucauuuucca

SEQ ID NO: 4144449 - RNA, 67 nt, Human
uggugcaaaaguaauugcaauuuuguagcugaaaggaauugcaaaaaccacaauuacuuuugcacca

SEQ ID NO: 4144450 - RNA, 69 nt, Human
uggugcacguagacagguuauaaaucagugaggugcccuuacauguuuguuuucucucucugagcauca

SEQ ID NO: 4144451 - RNA, 75 nt, Human
uggugcaugcagcuuguauuaguuaaugacugaggcauuagaaacucaguaaguuaauacaagcauaugcacaca

SEQ ID NO: 4144452 - RNA, 58 nt, Human
uucuuacuacauuugcaggcuaacuguugaaaaaacaguauuuuguuugugggaagaa

SEQ ID NO: 4144453 - RNA, 72 nt, Human
uucuuacugcagcagcccauggacaccuagagauggaaacagugcuggguccuuggcuguggcuguaaugga

SEQ ID NO: 4144454 - RNA, 130 nt, Human
uucuuagacuaacuauugucugauuuuagaagcuucaagauauuugguauuucaguuaaauacagaauaaagcgugaagcuuccaauauaauguaaaaaaugauaauaguaaaaauaauaauagcuaaca

SEQ ID NO: 4144455 - RNA, 85 nt, Human
uucuuagccaugucaaucaaugucaugacaauaguauaucaaagcaguguacuuccguggacuaauuguucugcaugguuaugaa

SEQ ID NO: 4144456 - RNA, 73 nt, Human
uucuuaguggaguauaaauuauuaggaucauuuaguuuuaugccuagauuaucccugauuuguccacugggag

SEQ ID NO: 4144457 - RNA, 98 nt, Human
uucuuauuuauuauguguauguagguauuuugugugugugaaaaguauauuaauauuuagaacagacaauagaaaaguauauagauugauagaaagaa

SEQ ID NO: 4144458 - RNA, 55 nt, Human
uucuucaaugugcccuguuuucuuuuauuggagaauaguuuuagaaauuggagaa

SEQ ID NO: 4144459 - RNA, 81 nt, Human
uucuucacaagauuuaaugcaacccaagcucuaccugaauuagucaggacucuucugguugcagaaauccaaguggcagaa

SEQ ID NO: 4144460 - RNA, 56 nt, Human
uucuucacauuugcccuuaugugugucaggaagauacaauccuagauguggaagaa

SEQ ID NO: 4144461 - RNA, 70 nt, Human
uucuucagaguuauugcauugggaauuauguaggaaaacaaauccauuucagaaugcauucuuugaagga

SEQ ID NO: 4144462 - RNA, 62 nt, Human
uucuucagguguauugaugucugugauuguucauuacagcaucaaagcugccuucuuaagaa

SEQ ID NO: 4144463 - RNA, 72 nt, Human
uucuucauucaucaguucaugucuagcugcuucaugucagaacgcuagaacucuguacgaugccuugcagaa

SEQ ID NO: 4144464 - RNA, 69 nt, Human
uucuuccaucuacacuaucauugauuaggaaagcaaugugguucaaaaugacagugugugauugaagaa

SEQ ID NO: 4144465 - RNA, 80 nt, Human
uucuuccugaugcucuggauguagucaagaacuuaaaauuguuggagauuggaaauugacacauuagagcuuguaaagaa

SEQ ID NO: 4144466 - RNA, 71 nt, Human
uucuucucaggaacagcugaccugacaauggggccuuucucucaacuugucauuuaguucuuucggaagaa

SEQ ID NO: 4144467 - RNA, 61 nt, Human
uucaaauaucaucugcaaagcacaucuagaaauuuagcuggugaugcagauaauguaugaa

SEQ ID NO: 4144468 - RNA, 94 nt, Human
uucaaaugggguguuuaaugucucagauaacauguauucuaaagccaauccaaauuuuagagugcagaauuugcaguuaaaauacuucauugaa

SEQ ID NO: 4144469 - RNA, 69 nt, Human
uucaaaugggguucauagacucuuagauacuccaaggaggagcauuaggaggucuauggacauccugaa

SEQ ID NO: 4144470 - RNA, 129 nt, Human
uucaacauucuauuucaacacugagaaugaauaauaugcuuaugaugucucaaguuuauuaccagcgaauaauucugguugacuaaagaugucuaaauauauuguuccuauuaaguguauacaugugaa

SEQ ID NO: 4144471 - RNA, 60 nt, Human
uucaacauuuuugaguuuagguuccucucagaaaugcuaggaugacucaauggaugugaa

SEQ ID NO: 4144472 - RNA, 63 nt, Human
uucaaccacuggucagcaugguagaccagcccccaggggcuucuccugacaggccauggugaa

SEQ ID NO: 4144473 - RNA, 78 nt, Human
uucaagagagugagugagaaggaagucacaaugccuuuuaugaccucucaggaaucucacaugcucacuucuguugaa

SEQ ID NO: 4144474 - RNA, 75 nt, Human
uucaagcacaggauuaguggauuugucuugcugaacaugguagagaugaaaaauacuggucugcaacagcuugga

SEQ ID NO: 4144475 - RNA, 62 nt, Human
uucaaggaaaccagcauuuggucagcaccuucaaugcaaaucauugcucuagguuccuugga

SEQ ID NO: 4144476 - RNA, 76 nt, Human
uucaagggcgucauggggggaaacauuacugcuuuugaucaaaagauacuguuuuaaucucccauugcucucugag

SEQ ID NO: 4144477 - RNA, 55 nt, Human
uucaagguaugguagcuggucacacauucuggaaaauaguuugcugugcuuugaa

SEQ ID NO: 4144478 - RNA, 66 nt, Human
uucaaguaaugagcaauauuuugggaaagauuauucucuuccucaugaauucucguaucgcuugaa

SEQ ID NO: 4144479 - RNA, 57 nt, Human
uucaagucaaggaaagaggucugagaagaacaacucugccaucaccuugaucuugga

SEQ ID NO: 4144480 - RNA, 66 nt, Human
uucaaugacccacagccagguuuuaggagagacaacauauaggauaaggcauaaagguacauugga

SEQ ID NO: 4144481 - RNA, 59 nt, Human
uucaaugggaggggagaauuauugcauuuuuaggcaagaauagcuaccucccauaugga

SEQ ID NO: 4144482 - RNA, 73 nt, Human
uucaauuacacaaagcuccccaaauaguaggucauucagccuugccuauaaccagagcuuuuguagacuugag

SEQ ID NO: 4144483 - RNA, 70 nt, Human
uucaauucauaagaaagacacacaucacaagcaagguccccaugcuugcuuggacuuuugcgugauugag

SEQ ID NO: 4144484 - RNA, 68 nt, Human
uucacaaagggaauguguaggacauguuuucuuuugacagaccagcuuucauucccuuuguucacgaa

SEQ ID NO: 4144485 - RNA, 61 nt, Human
uucacaaccaaucugugggguacgguuaccaugugucccaggccagaacuugguugcugag

SEQ ID NO: 4144486 - RNA, 70 nt, Human
uucacaagcaguuacuauuuacuauuauauuacucccuugggaacuauaauggaguguggcugcuucgag

SEQ ID NO: 4144487 - RNA, 70 nt, Human
uucacaagugugaaggcagagccccagagcccccaugugaucaggugcugagccaagugcacuugaugaa

SEQ ID NO: 4144488 - RNA, 102 nt, Human
uucacaaucauuuagguagacaggacuuugcaugggucugaaggcuugcauggcagauggaggcaaagagccagcaaaucugguuguaaaugucaaugugaa

SEQ ID NO: 4144489 - RNA, 58 nt, Human
uucacacagcaacuguaugaauugguuccuaccauuaucugcauuuugcugaugugga

SEQ ID NO: 4144490 - RNA, 67 nt, Human
uucacaccaugcuuuguggaacccggggucuagagaggugcuuugggggcugcagugcguguguggg

SEQ ID NO: 4144491 - RNA, 127 nt, Human
uucacacuggucagaagccuuaugagugcagugaaugugggaaaucuuuugcugcaagcuccuaucucacuagucacaggagaguucacacuggucagaagccuuaugagugcagugaaugugggaa

SEQ ID NO: 4144492 - RNA, 57 nt, Human
uucacagaacacaaaugccacuuucuucacuccuugggcaagaggcuguucuguggg

SEQ ID NO: 4144493 - RNA, 121 nt, Human
uucacagauagaaugcaucuucaccagagacaagcaaauaauaacuuauucccuuuauuugagcuugugucccuuugaugacucuuccuaaaaugacuaagaugacucuuccuucaguuaa

SEQ ID NO: 4144494 - RNA, 64 nt, Human
uucacaggaugagugauguugaagaagguuaugaaccuuuauauaucaacuucuccacagugaa

SEQ ID NO: 4144495 - RNA, 58 nt, Human
uucacagguugaagccuaauccuacaauguaacuguauuuggaaacagggccugugag

SEQ ID NO: 4144496 - RNA, 55 nt, Human
uucacauguuggacauagaggaaaggauaugcaccaguccucugccaacugugga

SEQ ID NO: 4144497 - RNA, 56 nt, Human
uucacauuagccaagagauggaaucaacuuggguauccauuaauggcucaauggaa

SEQ ID NO: 4144498 - RNA, 77 nt, Human
uucacauuccucugacuuaaaucucucuauucucuuucuuuuugcgagggugugggggcaaguuugagauguguggg

SEQ ID NO: 4144499 - RNA, 76 nt, Human
uucaccacucucuaagguagguacuauaauuuccucuauuuuauguaugaggaaacugaagcccagagagggugga

SEQ ID NO: 4144500 - RNA, 75 nt, Human
uucaccagaguuggaauaauuuugaccaaagcauuuuuacuuauaaacauagggucaaaguguucuuuuguugaa

SEQ ID NO: 4144501 - RNA, 55 nt, Human
uucaccauuucccacuaaaccauuggagggccaagcggaaggugacaguggugaa

SEQ ID NO: 4144502 - RNA, 58 nt, Human
uucacccugagccccaccucugccucuucuauaacagacuggcuuggcucuggcugaa

SEQ ID NO: 4144503 - RNA, 62 nt, Human
uucacgaggugacuuugguuuagacauuucugucucugggccucaguuuucucagcugugaa

SEQ ID NO: 4144504 - RNA, 62 nt, Human
uucacugaggauucccauacuugcaagguaaguccaaaauugcaaaaugagucuugagugaa

SEQ ID NO: 4144505 - RNA, 55 nt, Human
uucacugccaacuaacauggaauuuguuuuguugcauggccucguuugcggugga

SEQ ID NO: 4144506 - RNA, 127 nt, Human
uucacuggaggauuauacaucccuuucugacugacaucagaaauagucauguuacuuuuuuugcugaugaaguguggaugaauauauuauaugucaugucuagguagaaucuguaauagccagugga

SEQ ID NO: 4144507 - RNA, 71 nt, Human
uucacuggggaugcuagaaauugcucccgguuuuucagccaagauaaaaucagcauuccaagcagagugaa

SEQ ID NO: 4144508 - RNA, 59 nt, Human
uucacugugaauaaaggcucccaaugaauucucaugaguuuuuaauggucauagcugag

SEQ ID NO: 4144509 - RNA, 95 nt, Human
uucagaaaggaacacaguggcauugggaugagaagugcgaggguugaaugaaucagcuuuaggaaaaccuucauuuuucucucuccauucuagaa

SEQ ID NO: 4144510 - RNA, 56 nt, Human
uucagacaaggaaaguuuucccagcagaagcccugagaugacucuuauugucugaa

SEQ ID NO: 4144511 - RNA, 56 nt, Human
uucagacaauaagagucaucucagggcuucugcugggaaaacuuuccuugucugaa

SEQ ID NO: 4144512 - RNA, 64 nt, Human
uucagaccaaguacuaauggcauuaauguuuugcuagugcugugcaucauaguguuuggcugaa

SEQ ID NO: 4144513 - RNA, 78 nt, Human
uucagacucauacaacuaagaguuucagaaucucucaggaacaugauguugugaaugucuagguuuuaugucauugaa

SEQ ID NO: 4144514 - RNA, 64 nt, Human
uucagagaacuucauggaagagaucauuuugagcugagccuugaggaaaugaggauuuucugag

SEQ ID NO: 4144515 - RNA, 60 nt, Human
uucagagaugaucccugaguuucauaguaucauauagaaauucaguccuucaacucugag

SEQ ID NO: 4144516 - RNA, 59 nt, Human
uucagagccagcaacacuaggcugauuucuucucacacugcugucucuguggcucugag

SEQ ID NO: 4144517 - RNA, 56 nt, Human
uucagauuuuuuaauagguaaugugguuaccugaaguugcuauuaaagaaucuggg

SEQ ID NO: 4144518 - RNA, 69 nt, Human
uucagcacugacugagugguuaaguugauuaaaagcugauagagccagugcccucauguacaggcugga

SEQ ID NO: 4144519 - RNA, 74 nt, Human
uucagcagaacuuucaaggaaccugggaaccuaucaugaggcaugguuguccugcagcuccuguucuugcuggg

SEQ ID NO: 4144520 - RNA, 58 nt, Human
uucagccaucauuacgaaaucaaaaaccacuuuuuaagaugguuguagauggacugaa

SEQ ID NO: 4144521 - RNA, 80 nt, Human
uucagcccuaguguauccuggccuaaaaauacagaacaaucaaguugauuguuggaaaugagaggcuaggcaggguugga

SEQ ID NO: 4144522 - RNA, 59 nt, Human
uucagccuguuucaaagaagucaguggauguuaacaucugauucauugaaaugggugaa

SEQ ID NO: 4144523 - RNA, 79 nt, Human
uucagcgauucuuucugcaaaugcuggaaaaacucccuccugugaaucuccagagguauguagagaguauauguaagaa

SEQ ID NO: 4144524 - RNA, 56 nt, Human
uucagcuaugcgcuuugggcaaacuuuacuuuuuuugccucagucugcugccugaa

SEQ ID NO: 4144525 - RNA, 71 nt, Human
uucagcuauuauacccacuuuucaggcauguaggaguaagggcaaaggaaaagucggggaugcuagcugaa

SEQ ID NO: 4144526 - RNA, 65 nt, Human
uucagcugagagggugcugggcgaagcugguggguaggacucaaauccagcacccucacagagaa

SEQ ID NO: 4144527 - RNA, 83 nt, Human
uucagcuguuuauggugaugcuacauuuugguuuauaaauauguuugugguauaaaaaaaugaguauaaccauagguuuugaa

SEQ ID NO: 4144528 - RNA, 83 nt, Human
uucagcuuugggaaagcagauacuuauuacagugaaaugacuuuuuacaacagacaggaauaagauuugcuuaagaagcugaa

SEQ ID NO: 4144529 - RNA, 64 nt, Human
uucaggaaagcugcggucaccugugguuugagaaaugcccucucccagagcagugguuccugaa

SEQ ID NO: 4144530 - RNA, 75 nt, Human
uucaggacaacacuucauuccagcuauagguggcaaaagaugcuauggcagggaauacagauguuuaaauaugaa

SEQ ID NO: 4144531 - RNA, 76 nt, Human
uucaggaugcugccauacuauaaggcugucaaguggugagacuagaccaaguuucuggguaaggaaguaaucugag

SEQ ID NO: 4144532 - RNA, 72 nt, Human
uucaggcaggugugagaaacgugaccaguugguggagucgcuuaacuggggugucuucagacugagccugag

SEQ ID NO: 4144533 - RNA, 76 nt, Human
uucaggccuguugcaggcccagggagggagaccaaguguccucgguucccagccuggcccugcuagaggccccgaa

SEQ ID NO: 4144534 - RNA, 75 nt, Human
uucaggcucuugggauguaaccuuuguuccgugacagccuuuaauggggccuaaggacuacucucagaccaugag

SEQ ID NO: 4144535 - RNA, 69 nt, Human
uucaggcugauaaaugacaguaauuguucuuaaguugaagagcugguuuaauaugcugucuggccuggg

SEQ ID NO: 4144536 - RNA, 59 nt, Human
uucagggacuuugauguaucagacuuuaaaaggaguugacaggucacauggucucugaa

SEQ ID NO: 4144537 - RNA, 76 nt, Human
uucagggcacucugacauuuugagaaugacauguuuguuguauguuguuuguucucuugucaguccuucccuagag

SEQ ID NO: 4144538 - RNA, 61 nt, Human
uucagggccuuguucaggagugaagaaugucauucaugauugacuaucaagagcaccagag

SEQ ID NO: 4144539 - RNA, 56 nt, Human
uucuucucccugccucuguucugugcucugggggcacugccaggcaggguggggaa

SEQ ID NO: 4144540 - RNA, 65 nt, Human
uucuucuccgaggagggcuggugcagguugagguugagguuggaccaguaggaguuggagaggaa

SEQ ID NO: 4144541 - RNA, 66 nt, Human
uucuucugacugagguuauugcaauaaaauauuuacuauuauaagcaauagcauucaaaugaagga

SEQ ID NO: 4144542 - RNA, 72 nt, Human
uucuugagggcuaggacaguuaggacaacugacuucuuuuaggaggucaggcucaagcugggcccugaagaa

SEQ ID NO: 4144543 - RNA, 87 nt, Human
uucuuggagaaacaccucuuacauauagcaugaguacauacuauuguguucagguuaauaugcucagcaauguguaaguuucaagaa

SEQ ID NO: 4144544 - RNA, 86 nt, Human
uucuuggaggaugugcggcugcccgagcuggauguaggcgauuggcuggucuuccccuccaugggugccuacauguccuccaugag

SEQ ID NO: 4144545 - RNA, 56 nt, Human
uucuugguugucacguggucuuggagaaaugcacggccauguuuccuuacuaagag

SEQ ID NO: 4144546 - RNA, 59 nt, Human
uucuuguacuggagauacaugauaugcaacauuaaauauugguguccuagagauaagag

SEQ ID NO: 4144547 - RNA, 129 nt, Human
uucuuguccauguccgaccgggccccugugcucaccccccgcgccaggcccaggcagugcggcgcugcuuccggucugggccaggcgagccgagggcgggagcggggcccgcgaggccccucucgagaa

SEQ ID NO: 4144548 - RNA, 88 nt, Human
uucuuguccuacagggaaaagccugcacauacuaaaguuaucuagguuaucuuggaaaguuuuagcuguccaguucccaggacaagaa

SEQ ID NO: 4144549 - RNA, 74 nt, Human
uucuugucugcuugaugagugugccaagcaauaaucucuuguuuugguguuuucaucuaagcuguugagaagag

SEQ ID NO: 4144550 - RNA, 82 nt, Human
uucuugucugguuugcucaucuuuuacuuggagacaagagcuguucaccuugcucugauuagguggaaacaagacaguagaa

SEQ ID NO: 4144551 - RNA, 80 nt, Human
uucuugucuguggcuacuauuauucugucaucaguacucuacuaguuaggaugcacaggaaguguccccauuugacagaa

SEQ ID NO: 4144552 - RNA, 63 nt, Human
uucuuguuuuccuguuucuugcaagcccuugacaaauggcagcuaggggcagggaauucagaa

SEQ ID NO: 4144553 - RNA, 64 nt, Human
uucuuguuuugugcugcucaaagaagggauuccucagugaucggugagcaccaagaaucaagaa

SEQ ID NO: 4144554 - RNA, 57 nt, Human
uucuuuacucccaggaugugccugcaaacuuggcccaggauggugugagugugagga

SEQ ID NO: 4144555 - RNA, 114 nt, Human
uucuuuacuugcaucugcagcccugauuagaaugacagaaaugaggccaaaggccguuuucaacuuugcauucuauuauuuagccuggcguaguauaagugcuuaguaaaagaa

SEQ ID NO: 4144556 - RNA, 83 nt, Human
uucuuuagauagaugugaaaauagacauuauuucucuaugauuaaccaucagagagaaauaguuuuugacacauuucaaggaa

SEQ ID NO: 4144557 - RNA, 55 nt, Human
uucuuuagguagauccaguuuuucaucugauaucauuugccuucugccugaagaa

SEQ ID NO: 4144558 - RNA, 56 nt, Human
uucuuuauggaauggugauagugauacugcugacucgccagggaugcuguaaggaa

SEQ ID NO: 4144559 - RNA, 74 nt, Human
uucuuuauguuaacaguaaagaauugugcaaggaagcuucuaacugggccaguucuuuacucguccauaaggaa

SEQ ID NO: 4144560 - RNA, 106 nt, Human
uucuuucaugauauugaaaagaacuggaagaagugaaagcuuugccacauugcuugcauucauaguguuuccuuccagugugagucuuuucaugucuaugaaagga

SEQ ID NO: 4144561 - RNA, 108 nt, Human
uucuuucccaggagucagugcuuaugucuguauguggagagggguugauauucagaucaacugaucuaugaacaguauccauacugcccaaaacuucugaggauagaa

SEQ ID NO: 4144562 - RNA, 73 nt, Human
uucuuuccugccagaagguuccugcugcagcucuccugcuaguuuagcuuagccuucugguuuaagggaugag

SEQ ID NO: 4144563 - RNA, 67 nt, Human
uucuuuccuugccucagugaaguuuuacagucaaugcgggguuccauauuuaaggcaggggguagaa

SEQ ID NO: 4144564 - RNA, 130 nt, Human
uucuuucgaaaaguaugaauaagccauuagaauuuaaaauuuacagaugcauugcaguggaaugggagaaagacauccuuguacaacguuuuaaauuugacaguucucaguugauucagaugcagagaga

SEQ ID NO: 4144565 - RNA, 76 nt, Human
uucuuucuauuaccagggggaguagaaaaaugaauaaauccuauccauaccacuacuucccuuucacuggagugag

SEQ ID NO: 4144566 - RNA, 86 nt, Human
uucuuucuuauaauuagaaucuuauuuggggaaggcaaaaaucaaguguuuauuaaaggagauuuugacuuuugguuaagagagaa

SEQ ID NO: 4144567 - RNA, 63 nt, Human
uucuuugaggacauuuuagaaaguuguuaaauuuaauagcagcauauugugucuucauaagga

SEQ ID NO: 4144568 - RNA, 56 nt, Human
uucuuugcugugucuggcuuucucuuuccuaugaauaaagucucaacagcugagaa

SEQ ID NO: 4144569 - RNA, 62 nt, Human
uucuuuggugucauguuggacccuucagacuuugauugcuggaaaucagcauacacagagaa

SEQ ID NO: 4144570 - RNA, 81 nt, Human
uucuuuguacuucacuucacaagaggcuggagauauuccaaucucaacaucagaauggaaucucuagguucuaacaaggaa

SEQ ID NO: 4144571 - RNA, 96 nt, Human
uucuuugucccugcuuauauuugucaacuuuacaauccuuuuauuaccagcaaaagcuuugggaagcuacaaauaaaagcagggauuauaaaagga

SEQ ID NO: 4144572 - RNA, 64 nt, Human
uucuuugugcauccaauuuucucccugagaacgugaacccaggggaguggaacguacacaagaa

SEQ ID NO: 4144573 - RNA, 63 nt, Human
uucuuuuagcaaguacugaagucugccagccauaugccacugcaucaguaacuuuuaagagga

SEQ ID NO: 4144574 - RNA, 77 nt, Human
uucuuuuagugcuucuguccaaauauaugaagauugaaauaaauaguaaaauauauuugauugaaaaauuagaggag

SEQ ID NO: 4144575 - RNA, 129 nt, Human
uucuuuuauaagggugccaaauucuagacagcaggagccuucauaugcuguaauuaugucugugguaaucuuauauuuagagcaugaauguuucuguuguaauuuuaaggcaguaagaagguagaggga

SEQ ID NO: 4144576 - RNA, 81 nt, Human
uucuuuuccaauccugguaauugauuauauggagucaaauaagccauagcaauuaagcuccagaauucacuggggaaagaa

SEQ ID NO: 4144577 - RNA, 61 nt, Human
uucuuuuccuacacagcgauuuaacccuuuacuaggguaaaggauaguuauaggauaagaa

SEQ ID NO: 4144578 - RNA, 62 nt, Human
uucuuuugaaaauaucacaggagcagcuguuccucagcuauuuugaguggauuuucugagaa

SEQ ID NO: 4144579 - RNA, 61 nt, Human
uucuuuuuauauugacaaaagguaugcagacauuaccuuuaagauagcauuguagagagaa

SEQ ID NO: 4144580 - RNA, 129 nt, Human
uucuuuuugucagaaaagcuuuugcuuaauuggaagccucauucagauuugugccuguguaucuucauuagcauauugcagggacagucuggauaaaaaccaguugacaaagaauugacauuuaaagaa

SEQ ID NO: 4144581 - RNA, 82 nt, Human
uucuuuuuuccaugugaacagguaugucauuccuucccaagguaguaaacauagaauguucuuccuaccuggauugagagaa

SEQ ID NO: 4144582 - RNA, 129 nt, Human
uucuuuuuuuuuuuuuuuugagaugaagucuagcucugucacccaggcuggauugcaguggcucgaucucggcucacggcaaccuccgccucccggguucaagugauucuucugucucagucuccugaa

SEQ ID NO: 4144583 - RNA, 78 nt, Human
uugaaacaagauccacagacuuggcugaaaucaugggaaagauuuuggaacaucacaagucauggauuggaguuucag

SEQ ID NO: 4144584 - RNA, 74 nt, Human
uugaaacuacggauuccuggacccucguauguuaagcuucagucugggaugaggcccaggaaucuguauuuuga

SEQ ID NO: 4144585 - RNA, 103 nt, Human
uugaaacuuuaaccucuccuauuaaaacuuuugucuauuucuacugcugugcacacacaguuuugagugacuaaagguuuuaauggcugcaguuaaguuuuag

SEQ ID NO: 4144586 - RNA, 96 nt, Human
uugaaagcauugaaagcugggagcaaguacucaucuuugggaauuucauccuugcaggauuggggacuuagaguugccagauguucuuauuuucaa

SEQ ID NO: 4144587 - RNA, 60 nt, Human
uugaaauucaguguucuucccguaacccaguuagggaucaagaaaacuacugaguugcag

SEQ ID NO: 4144588 - RNA, 80 nt, Human
uugaacagcucugaagcaguaaaugaaauauugacugaguuacuugucauuuaauuugcaaugauuucagugcuuuucaa

SEQ ID NO: 4144589 - RNA, 62 nt, Human
uugaaccuaguuaguucugggucauccugacucaggaauccuggacuauuaacuugguucaa

SEQ ID NO: 4144590 - RNA, 61 nt, Human
uugaacucuggcugggaaguauaagggcagagucuuucuacuuucucaaaucagacuuuaa

SEQ ID NO: 4144591 - RNA, 72 nt, Human
uugaagaaacuucuugcaauuuucaucuuauuucaaagaacaucagguggguuuugaagaaacuucuugcaa

SEQ ID NO: 4144592 - RNA, 84 nt, Human
uugaagaacacugcauugagguuucauacuuccuuaaaugcucauaaaucuucuaggaauuauccuuaaugcaguaagcuacaa

SEQ ID NO: 4144593 - RNA, 65 nt, Human
uugaagaaccaucugugccacuggcauauugacacagcgucauccagauacagugguuucuuuag

SEQ ID NO: 4144594 - RNA, 84 nt, Human
uugaagaagaggguuagauuuuaagaaagaaagugugcuuauuucacucaugucuuugcagaauuuaacuuugcuuuacuuuaa

SEQ ID NO: 4144595 - RNA, 55 nt, Human
uugaagcaaauucugugcaguacuaauaugugagaagcauggaauugugcuuuag

SEQ ID NO: 4144596 - RNA, 59 nt, Human
uugaaggcccuaucuccauauacauuuauauucagagguacuggggcuuggggcuucaa

SEQ ID NO: 4144597 - RNA, 84 nt, Human
uugaagguagggaacucugucuucacucaugaguaccuuccaacacgagcucucaggaguaaagacagaguucccuaccuucaa

SEQ ID NO: 4144598 - RNA, 59 nt, Human
uugaagguuugauccuuauuuauaagcuucuugcuugugaauagaagucagaccuacaa

SEQ ID NO: 4144599 - RNA, 59 nt, Human
uugaaguucuaagccccaguaccucaaaauguaacuguauuuggggauagagucuucaa

SEQ ID NO: 4144600 - RNA, 96 nt, Human
uugaaguugcuaaaugaguuuugugcuuucaaaguuaaguaaaagaaacuuucuuuuacuuugugucaagucaagaaaacuaauagguaauuucag

SEQ ID NO: 4144601 - RNA, 81 nt, Human
uugaauaacuuugcauaaaggagcauuucuccaugauuguuuuagagaaaacuuuggcuucuuuagugcuaggcuauuuga

SEQ ID NO: 4144602 - RNA, 79 nt, Human
uguacuccuucuacauucuggaauuuuauugaucaaaacaaaacuuaggugagguauuaguaaauuccaugggaguaua

SEQ ID NO: 4144603 - RNA, 70 nt, Human
uguacugauaaauguguaacaaccagcucucuggggggagaacgggaauguaugcacauauauagguaca

SEQ ID NO: 4144604 - RNA, 63 nt, Human
uguacugggcauugcuguggaccugauaccacccuccaucacucuguaggcuguccaugugca

SEQ ID NO: 4144605 - RNA, 58 nt, Human
uguacuuacuaucuaccucauccaauuauugcaaggauggaaugcgguaguaugugca

SEQ ID NO: 4144606 - RNA, 122 nt, Human
uguacuuuauuuggugcuuuuggaaagagaucaagcaagauagaguugcaaauauucagccuuuauugaguguugugaguuuucuccuguucucugacaucaagaguacugcacaggguaua

SEQ ID NO: 4144607 - RNA, 75 nt, Human
uguacuuugcaaaugaagcucugaggagguaacuaccuucuucaaaguaauagagacuauauuaaugcagauaua

SEQ ID NO: 4144608 - RNA, 63 nt, Human
uguagaaauguugguauuaacauuuuaauugaugauagaaauguugguauuaacauuuuaaca

SEQ ID NO: 4144609 - RNA, 65 nt, Human
uguagaaauuaggaaaguaacacuuaugugacacucagaggugccauugcuugccaguuuguaua

SEQ ID NO: 4144610 - RNA, 68 nt, Human
uguagaaguaggagucaucucauugauugucuugaguaaaaggaaauggcucaugcaucuuuucuaca

SEQ ID NO: 4144611 - RNA, 125 nt, Human
uguagacguuucuguguguggugugcguacaugucugucauauguaugaucucuguacaugucaauauguguauaugugauguacauguacaugccugugugaugagcauacacgucugucugca

SEQ ID NO: 4144612 - RNA, 130 nt, Human
uguagagaaauagauuugugcuauaccucauguaugaauaaauggggcuguuccucucagccagacagaggugaauagauccucauuuauugauuuaucuggaguguuuuuguuuguuugcuuuugguua

SEQ ID NO: 4144613 - RNA, 78 nt, Human
uguagagcaacuguauuggaaauauagcaaaaugcuugccuuugcugugaauccauuacugucaccuccuguucccca

SEQ ID NO: 4144614 - RNA, 68 nt, Human
uguagaggggugucaauauuaccaaaguuacuugcuuuggggacugagaggugauagugacauuuaca

SEQ ID NO: 4144615 - RNA, 129 nt, Human
uguagauuuauugaacauauuuuauaaauaucaaauaauguuaguauguaaucuuaucagggaugcaaauauaaucaugauauauagagcuagauguuaaagugauauuuguuaaaaauaaguccuaca

SEQ ID NO: 4144616 - RNA, 71 nt, Human
uguagcaccuagaguauuuuaucacugcucaaggaaacauuugacuuguugugcggugcuuuggguuuaca

SEQ ID NO: 4144617 - RNA, 70 nt, Human
uguagcacguuaguguuagagccaagugcuaaaccccaacucugcccgaauucagcauagaugugcugca

SEQ ID NO: 4144618 - RNA, 61 nt, Human
uguagcagcuaaguagcgcaguuaagagucuggacucuggaucugaacgcuugggugcaca

SEQ ID NO: 4144619 - RNA, 79 nt, Human
uguagcaucacaaggagaagucuguugagauugcugccccucacagcuucaacaguuugauuucugucuuuucacuaua

SEQ ID NO: 4144620 - RNA, 90 nt, Human
uguagcaugugguuguauuaaugaacguuacaggagagcuuuauaaucauuuauaaaucuguaacauucaauaaagaaacacauguugca

SEQ ID NO: 4144621 - RNA, 82 nt, Human
uguagccuucagcauggcucuggccucagugugaguuaccaguauugugaguacgcuggagcagggcuagcagugggguaua

SEQ ID NO: 4144622 - RNA, 70 nt, Human
uguagcuacuguuuacuguguaauauaacccugaagauuagguuacaguuaccacuuagcaguuacuaca

SEQ ID NO: 4144623 - RNA, 79 nt, Human
uguagcuccaaaccuguuaucuauaaucaguacacuuuacuggauuuaacagaauaccagguucaacuuggaacugaca

SEQ ID NO: 4144624 - RNA, 80 nt, Human
uguagcuuuuggugguuaguggagggaaaccuuuuaugauuuaaauacuuuuacuccacugauugguuaccaucacugca

SEQ ID NO: 4144625 - RNA, 89 nt, Human
uguagcuuuuguuggugguguuauuuuuuggcuuugucauaucauuugugaaaguuaggauguaguaauugacaagauuaaaagguaca

SEQ ID NO: 4144626 - RNA, 69 nt, Human
uguaggaauggauucuagaaggaagaugaagaaaugagaaagcaugguaauucuagaacuguucucuca

SEQ ID NO: 4144627 - RNA, 57 nt, Human
uguaggaauguuuuuaaguuggcuguuuuuccccagucuacucuuacuguuucuaca

SEQ ID NO: 4144628 - RNA, 76 nt, Human
uguaggcaacuguaacacaaugguaucuguguaaucuaaacauagaacagauaauacauugugcuacaauguaaca

SEQ ID NO: 4144629 - RNA, 84 nt, Human
uguaggcuuucuccaaauauucaucuacuucugcaaugaaacagagguuguugcugggauuagaaaguguuugaaaggccugca

SEQ ID NO: 4144630 - RNA, 78 nt, Human
uguagggcagcugcaucaggcacuauucccacauguuucacauuguauguagcucagugucugagugcaggcugugca

SEQ ID NO: 4144631 - RNA, 66 nt, Human
uguagucccagcuacucaggaggcuaaagugggaggauugcuugagcccaggaguuggaggcugca

SEQ ID NO: 4144632 - RNA, 57 nt, Human
uguagugaggaaagacugguuguauuaacuguucugagccacaguuuucucacugca

SEQ ID NO: 4144633 - RNA, 55 nt, Human
uguaguggcagugguagugucugcuccauaaagguaaacacagccucucuuuaca

SEQ ID NO: 4144634 - RNA, 74 nt, Human
uguaguuaccagccuuugcaucccccaucugcucaagcaaauugaagagaagaggcaagugguuggcuucugca

SEQ ID NO: 4144635 - RNA, 65 nt, Human
uguaguuagugaagcaggugaagugcuuaaaacagaauuugacacauuaaaugcucacaaacaca

SEQ ID NO: 4144636 - RNA, 89 nt, Human
uguaguucauuucugauacagucccaacacaaauggcuguccuauuuagauggcauuggucaagacugauaucaagauagguaacuaua

SEQ ID NO: 4144637 - RNA, 79 nt, Human
uguaguugcaugugacucuauuuaugcauaauaaaguaauggagccuauguaagggugaugguuauaugcaaguuuaca

SEQ ID NO: 4144638 - RNA, 57 nt, Human
uguaguugccagcccaagggcugauuuccugucaguuccugugugguuugcacuaca

SEQ ID NO: 4144639 - RNA, 112 nt, Human
uguauaagcauuccauguuaacagaacuugcaguggcaguuagaaaauauuccagucaaauuucugguuuuggagcugaguuuauugccuguuuguuguuugaucuuauuca

SEQ ID NO: 4144640 - RNA, 71 nt, Human
uguauacuggguugggcuuuugaguugauucgaaguuccguauuuccuucaucagccuauccuguuauaca

SEQ ID NO: 4144641 - RNA, 55 nt, Human
uguauaggaaguguagugcuuggaaucgaguuuuacggcauuuuacuuucugaca

SEQ ID NO: 4144642 - RNA, 79 nt, Human
uguauauagaauacacagggaaaguuugagaagugaaggacugaccccuccaacugccguucugucuauuuuauacuca

SEQ ID NO: 4144643 - RNA, 95 nt, Human
uguauauauacaugcauguaacugcauguguguggcaugauacaugaugaaauaugaaugcaugugcauacaugcacaguguauguguauaugca

SEQ ID NO: 4144644 - RNA, 65 nt, Human
uguauaugucuuuauaaauguauaauguauuugguaaugugcaguagcauguaauaaagacagca

SEQ ID NO: 4144645 - RNA, 64 nt, Human
uguaucuaauggagcauguaugguguugaguuucauguagaucaccauaaauguacaagauaca

SEQ ID NO: 4144646 - RNA, 75 nt, Human
uguaucuccugauuguuuaaugcuguguaaaaagcacccagaagaaaggcacaguacagugcagaggaagauaua

SEQ ID NO: 4144647 - RNA, 127 nt, Human
uguaucuguuaggaggcacaguuguuucuaagaggguguagaaaagcauaacuugcugcacauagugggggcugucaguaucuugugucccucccaguagacagcugggugccccaugugcggugca

SEQ ID NO: 4144648 - RNA, 62 nt, Human
uguaucuuauucaucacugaaucccagcacauguagguguucaggaaaugaauacagacaca

SEQ ID NO: 4144649 - RNA, 70 nt, Human
uguaucuuggaucuugaugcuccaagagugaaacuguuucuuucaacuauggaguucagaucuugagcca

SEQ ID NO: 4144650 - RNA, 55 nt, Human
uguaugcaggaccccaaaacucugacgcuuucauagaguccaggggccuguagca

SEQ ID NO: 4144651 - RNA, 66 nt, Human
uguaugcauuuuugagguuaacucaauggagaguagccucccuuagugaaccuggaagaugccaca

SEQ ID NO: 4144652 - RNA, 62 nt, Human
uguauggcuagacuguugugaucuacauccucauaaaauuuaucacaauaugagcucauaca

SEQ ID NO: 4144653 - RNA, 86 nt, Human
uguauguauaugucuauuugugugugcauguguguguggguuugaguuugugugugcaugugagcacaaguuugcaugugugugca

SEQ ID NO: 4144654 - RNA, 105 nt, Human
uguaugugggaccaaauaggacagaaugugugcaagcaaguguguuaugcugcacguuugauauaaguuuuucgcauaucugagcucuuacguuccccaaaugca

SEQ ID NO: 4144655 - RNA, 82 nt, Human
uguaugugggauguguguauauauguauguauauauaaauauauauauaaacagcauaaaauacgcuuaagaaaaacaugca

SEQ ID NO: 4144656 - RNA, 75 nt, Human
uguauguguaaaacuucaguaggagccaaccucuuuuaacauaagguguugguuacuaaggaggaaaucacagca

SEQ ID NO: 4144657 - RNA, 60 nt, Human
uguauguguauguacauaugcauacauauauacuuguauguguauguacauaugcauaca

SEQ ID NO: 4144658 - RNA, 65 nt, Human
uguauguucuuugaaauauuuuagaaagauaucaugagcuguuugaaguaauuuaaagaaagaca

SEQ ID NO: 4144659 - RNA, 71 nt, Human
uguauuaagugcccauacagcucaauggguauucauugugcucauugagcuguauggacacaaugaguaca

SEQ ID NO: 4144660 - RNA, 57 nt, Human
uguauuagauuguacagacaucuuucaagagggaagcauuucuguuuaucuaucgca

SEQ ID NO: 4144661 - RNA, 57 nt, Human
uguauugaauuguguuauaucugcuuaugugcaaugauaaaagauacaauucaguca

SEQ ID NO: 4144662 - RNA, 63 nt, Human
uguauugguuacuugauuuuauguucugagguuguuagggccaguauuaagguaauuaauaca

SEQ ID NO: 4144663 - RNA, 76 nt, Human
uguauuguauugggaugagcucuaagucuaaugauuggugugcuuaugagaagagagacauuuggauacagaaaca

SEQ ID NO: 4144664 - RNA, 59 nt, Human
uucaggggaggggcuguguugcagagaccacagucacagcaaagacacucucaacugaa

SEQ ID NO: 4144665 - RNA, 77 nt, Human
uucaggggauauuugaggaaacuuacaaggcagaaggggcagucucuuucuugucucuuuuucacucagccccugga

SEQ ID NO: 4144666 - RNA, 92 nt, Human
uucaggucaugagguggcacacacuuccugccccacccaccccuauuguguggucaauaggcagaauugaaaugugucacuucuggacugag

SEQ ID NO: 4144667 - RNA, 57 nt, Human
uucaggucaugauccauuggugaguggugagaucaacuuaguaagucaugaccugaa

SEQ ID NO: 4144668 - RNA, 85 nt, Human
uucaguacaacauuagaguaucuuaugccaaacuccuucuaauucccagggaaacauuaggaaacuacuauuauguuguagagaa

SEQ ID NO: 4144669 - RNA, 72 nt, Human
uucaguccaucaggcguggcauaguucaaauuaccaagucagcaugaaaagucccacucuaaauggacugaa

SEQ ID NO: 4144670 - RNA, 86 nt, Human
uucaguccuugaaccuuuuccuucccuggaugagaagucuguuuaauauacucucaauggggaaagaguuggugagagacacugag

SEQ ID NO: 4144671 - RNA, 89 nt, Human
uucagugacuacaacaauggcuuugugcuaagaaauaaaugaaucaaaauuuaaaauaagacaaaguuaacaguuggauaguuaaugaa

SEQ ID NO: 4144672 - RNA, 86 nt, Human
uucaguucuuggccaugacaggacaggaagucagacauaccucccuguaccucccucccucuuaugguuuagacccaacaacugaa

SEQ ID NO: 4144673 - RNA, 66 nt, Human
uucaguuguuuauucuucagcaacaucugaguauccucgagaaaugaguggaaugaaccgcuagag

SEQ ID NO: 4144674 - RNA, 64 nt, Human
uucaguuugccaguauuuuauugaugauuuucacaucaguguucaucagggguauuggccugaa

SEQ ID NO: 4144675 - RNA, 64 nt, Human
uucaguuugccaguguuuuauugaugauuuucacauugauguucaucagggauauuggccugaa

SEQ ID NO: 4144676 - RNA, 80 nt, Human
uucuccucguggcugcagcggcuguggagaaaccagguguggccagugucuuagugcggcugcugcagccacaaggagaa

SEQ ID NO: 4144677 - RNA, 79 nt, Human
uucuccugcauuuagcgccaugugaggagcagagaggguugcuuuucccugugccuaguuggccuaaagugcaguugaa

SEQ ID NO: 4144678 - RNA, 80 nt, Human
uucuccuggaguuuucaacauauugaaguuacaguauugcaguuuuacuauaguacauacuucaaauguacuuaagggaa

SEQ ID NO: 4144679 - RNA, 62 nt, Human
uucuccugggagggguugcccaaagucuuaucaccggagugggucagcugccuccaggacaa

SEQ ID NO: 4144680 - RNA, 79 nt, Human
uucuccuuauccucaaagguauuuagaugcacauacaugguggcccaugguccagaaacugcugagauaagaaagggaa

SEQ ID NO: 4144681 - RNA, 85 nt, Human
uucuccuuccugcuccuggaagcagcugguacugaggucaucccuggagccacaaagcccucccugcgccagagaggaaggggaa

SEQ ID NO: 4144682 - RNA, 83 nt, Human
uucucgcgggaguuuuggaagccgcggcugggcaucagcaaacagcucuugcacagggcaguggcucccgaggagacgcagaa

SEQ ID NO: 4144683 - RNA, 90 nt, Human
uucucgucccugaccucucuccuagccaagcaagcuucuucaccaagauaggauaagagagauguggcugagagaagacggggaagagaa

SEQ ID NO: 4144684 - RNA, 130 nt, Human
uucucguuucccugcugcuuccuaaaacugugucuuuccuguaacugcuguucaaaaaauguuuuuugaaugaauaaugcagugggaaacauaaagccauuuaauaaagcaaggaagggauauugaugaa

SEQ ID NO: 4144685 - RNA, 65 nt, Human
ugugacuauuucaugucuaaugucuauggaguaucuacaaugcaccaggcaugauguggagcaca

SEQ ID NO: 4144686 - RNA, 55 nt, Human
ugugacuggaguccagcccacuggggagcaauccauuugguugugaccugucgca

SEQ ID NO: 4144687 - RNA, 88 nt, Human
ugugagaaggaugagauuugggaggggccaggggcagaaugauauggucuggcucuguguccccacccaagucucauuuugaauugua

SEQ ID NO: 4144688 - RNA, 72 nt, Human
ugugagaauuguuccucauaggccuucuggaagauaguacuuaacaggcuucaguagggagcaugucucaca

SEQ ID NO: 4144689 - RNA, 56 nt, Human
ugugagacguaggccaucgaggauggugaaccaauuuucauggucuuaguuucaca

SEQ ID NO: 4144690 - RNA, 60 nt, Human
ugugagacguguuagaacaguguuuuauauuuaaacacccccauucauacgcaucucaca

SEQ ID NO: 4144691 - RNA, 60 nt, Human
ugugagcucagaggcgucuuuguccaaagaaacuuugaaggcagauuccuugagcucuca

SEQ ID NO: 4144692 - RNA, 96 nt, Human
ugugaggacacacaaugaagacuggaaggaacagaguuugaaacaaucucacaugcuuuccacucuguucucuuugaaucuuucgcuguuuuuaca

SEQ ID NO: 4144693 - RNA, 85 nt, Human
ugugagggcaugagaugugggaggggccaggggcagaaugauaugguuuggcucuguccccacccaaaucucaucuugaauugua

SEQ ID NO: 4144694 - RNA, 86 nt, Human
ugugagggccagcucaggguccuugggcugcugauagggacaccaaggcuaggcucagggucccuuggugcugguccuaagccaca

SEQ ID NO: 4144695 - RNA, 95 nt, Human
ugugagugcauguauguauguguguaugugccuauaucuauguaacaaguauguauaauacauauacacaucaucuauauaaguaacaacucaua

SEQ ID NO: 4144696 - RNA, 82 nt, Human
ugugaguuuuuaaagagaaugugaaggaguucuuuugaugaacuuuuuucuuacuuuacaaagucuuuuuagagccaucaca

SEQ ID NO: 4144697 - RNA, 84 nt, Human
ugugauaaggauuaaguagcacacugcauaugaagauugcuuagcaaucuguaaaguacuguguaaauacaagggcuuauuaca

SEQ ID NO: 4144698 - RNA, 60 nt, Human
ugugauccugggccugguaccugaagcugaggacucaguuccagugcccacccuagcaca

SEQ ID NO: 4144699 - RNA, 79 nt, Human
ugugaugcuuuucuaguagaaaccaacuggcaugugagaaaucugaccauccugaaaccuucaugcuagagaggccaca

SEQ ID NO: 4144700 - RNA, 78 nt, Human
ugugauggacaguuauugaggugcuuagcugggggcuccacucuagucuuaaucugagcagcccucaaggaaaucaua

SEQ ID NO: 4144701 - RNA, 65 nt, Human
ugugaugggcugauuaauagcagcacaaguggcugcuccuugagauuaauuaaucaccugucaua

SEQ ID NO: 4144702 - RNA, 130 nt, Human
ugugcaagaugagggagacaucaggagucaagauuggcucugaaguuucuaucuuaguaaaccgggcgucugugaugcuucuugagauagaaacaccaauugacuaucugaaagauuuccauaaugugca

SEQ ID NO: 4144703 - RNA, 77 nt, Human
ugugcaauuaaugagcuucugcacucauagaccuaguaguccagugagggagguagauuucaucaaauaauuacaca

SEQ ID NO: 4144704 - RNA, 94 nt, Human
ugugcacagcuuccagaacacagaaugcagagaugcccagaauuaauggucuggcagcaagucuguuucucauguuuuccaaucugaauguaua

SEQ ID NO: 4144705 - RNA, 68 nt, Human
ugugcagacuucuuugugagcauuuucugacccaucagaaaauuauaucuuuuagggaacuuaacaca

SEQ ID NO: 4144706 - RNA, 65 nt, Human
ugugcagcacuagugcagggccugcagcacuguguccuugcuggcccaguacuaaugucugcaua

SEQ ID NO: 4144707 - RNA, 63 nt, Human
ugugcauauccuuuguguaggcaauuucaaucauagaaauuaguuuuaagaaggauuuguuca

SEQ ID NO: 4144708 - RNA, 57 nt, Human
ugugcauguccuauaacucagucauuucacaucuagagacacaagaagacaugcaca

SEQ ID NO: 4144709 - RNA, 69 nt, Human
ugugccgaucaggaguuucuauuguuccaaaauuaaacagaaauuuuggcuugaaacuuacugggcgca

SEQ ID NO: 4144710 - RNA, 67 nt, Human
ugugccucaucuucacagacaacgggccauccugcugagagaugucccuugucugugaugucugcca

SEQ ID NO: 4144711 - RNA, 58 nt, Human
ugugccugauggucacguggccacaugcacccuuggcuagaucaccauccaggccaca

SEQ ID NO: 4144712 - RNA, 99 nt, Human
ugugccuucauuauauucuucaucuggacguuuguaaagcucuucaacaguacgauacgcuucuaaggagcgcuccagaaaaaauauugagagugcaca

SEQ ID NO: 4144713 - RNA, 55 nt, Human
ugugccuucccucugcugauuugauccggaggauggcagcaagaaugaaggcaua

SEQ ID NO: 4144714 - RNA, 84 nt, Human
ugugccuuuuaaguucaagucuuggauauaaccagucagaaccucuguuauaauuaugaguuggggauggggauagaaggcaua

SEQ ID NO: 4144715 - RNA, 79 nt, Human
ugugcgcuaaauuuucacugagaauacuugaucugaaucuagauuucauaaaauuuucaguugaaaaaguugguucaca

SEQ ID NO: 4144716 - RNA, 59 nt, Human
ugugcgugguucccggggccauguucacaagcggacacggaggcgcacacacacgcaca

SEQ ID NO: 4144717 - RNA, 76 nt, Human
ugugcuacaacuuuagcaauguuaguauaugucucguuacacuggacuuaauuagcucuuguucuaguucuagcca

SEQ ID NO: 4144718 - RNA, 79 nt, Human
ugugcuagcugcagguauagucaaguaugcuugcacagaugugcagguacaaagcuacugccugacaacagcgaguaca

SEQ ID NO: 4144719 - RNA, 57 nt, Human
ugugcuauuugacuguuugcuagguuucuaugacaucuaccaacagcaggaagcaua

SEQ ID NO: 4144720 - RNA, 119 nt, Human
ugugcucuaggccagugaccaugugauccaucauggggcccaugugcuccaagccagccuccaugccugcaagcaccaugugcuccauguucaggcccacguguucgauggcagggcca

SEQ ID NO: 4144721 - RNA, 55 nt, Human
ugugcucugaagagugcaugucacaauacuguccugacacaccugccauagcaca

SEQ ID NO: 4144722 - RNA, 76 nt, Human
ugugcucuggugucaggcuguccucggccucauggguggauuggcugagggcccugaagcuuggcauuuaggucca

SEQ ID NO: 4144723 - RNA, 81 nt, Human
ugugcugauagacuggauggaaggaggauaguauuagagcagguucugugcaucuuucuauucucuagucuuuggggcaca

SEQ ID NO: 4144724 - RNA, 85 nt, Human
ugugcugccccuuuuucaacagaaaacaguuugcuugcaaucugccugcaggcugcccucuuguguugaaauagggaaaugcaua

SEQ ID NO: 4144725 - RNA, 66 nt, Human
ugugcugccugucuugauugaaugguacaccugggaucagagcaugucaucagauagguuaguaca

SEQ ID NO: 4144726 - RNA, 76 nt, Human
ugugcuggugcuaauggauggcgaauuagagugaaguggccagaccagaucccuguuugccucuggccccagcuca

SEQ ID NO: 4144727 - RNA, 86 nt, Human
ugugcuguauucauaaauuugcuuagagccaaucuugauuguuucuucauuucaauuaagagagaguugaagcaagaaauagcaga

SEQ ID NO: 4144728 - RNA, 86 nt, Human
ugugcuucuaugugcguguauuggucuguguuaauguauuuaaauacaaguuuauuugauuagaacacuaaacguuuaggaagcca

SEQ ID NO: 4144729 - RNA, 86 nt, Human
ugugcuucugcgccuagccucagguuuacuauguauaaaugaagucuaaauaaccaccuggugggcuagugcaaguauuaagcaca

SEQ ID NO: 4144730 - RNA, 63 nt, Human
ugugcuucuugcagcuccuguaccccuuacccuggggcagccaguaugaaugcaugaggcaca

SEQ ID NO: 4144731 - RNA, 119 nt, Human
ugugcuugguugcuucacucuugacagagguaggacuccucagagagcagcuuggggugucucugugccuggacuguguccuguggucagagcccugcuuccaggaaagggccaagcca

SEQ ID NO: 4144732 - RNA, 63 nt, Human
uguggaaaaaccacaaguuugggggugagagagaccuuuguuugaaaucugguuuuugccaca

SEQ ID NO: 4144733 - RNA, 89 nt, Human
uguggaaacaagggaaguuucagaguuagugcuggcugagcucucacugcuuccagucucuacucugagauaauaacuugacugccuca

SEQ ID NO: 4144734 - RNA, 63 nt, Human
uguggaagacacugaauaugcaacuacugaccuugugccugggcaucuugaaggucuuccaca

SEQ ID NO: 4144735 - RNA, 68 nt, Human
uguggaauuucuuucagguauguagugggacauagcuguccacaguauagcuaaaggaaauacccaca

SEQ ID NO: 4144736 - RNA, 61 nt, Human
uguggacaccaagccagcuuaccaaaaccagaggcagaaagcugaggguucgguguccaca

SEQ ID NO: 4144737 - RNA, 59 nt, Human
uguggaccugauggaaauuaauaguguugagcauuauucuagaaguccaccagucuaua

SEQ ID NO: 4144738 - RNA, 127 nt, Human
uguggagaaacuggaacccucauacacugcugguggaauuguaaaauaguguggccgcuuuggaaaacagucuggccauucaucaacugauagccauagaguuaacauaugacacagaaauuccaca

SEQ ID NO: 4144739 - RNA, 130 nt, Human
uguggagauucagcauuaccuaggaauguauaagaagaacucugggcuucaagucagauuugcuaagucacaaacucuggggguggagcccagcaaacugaaccuuaacaagccuccgggaaauuccaua

SEQ ID NO: 4144740 - RNA, 64 nt, Human
uguggagauugagaugguucacauguguuucaggaugucauuugaaccacucagaacucauuca

SEQ ID NO: 4144741 - RNA, 59 nt, Human
uguggagcagcgucacagccuuccaaaggaagauggaugguggcuggcuugcucacaca

SEQ ID NO: 4144742 - RNA, 81 nt, Human
uguggagcccuuuaagugacuccuguauguaugggcagaauaucgauccuugcucugggaccgucauuaaaauuuuucaca

SEQ ID NO: 4144743 - RNA, 75 nt, Human
uguggagcuccagcaucuggguuaaaauuccggcuguauccuuuacuggcuguguaaccucaggcaaguuccuca

SEQ ID NO: 4144744 - RNA, 90 nt, Human
uguggaggcagccgagucagauugcagacagggcuugaccuucaccaaugggguagccuugggcaauuuggacacugggcuguuucuuca

SEQ ID NO: 4144745 - RNA, 57 nt, Human
uguggaggcauuugccucuucuggucuccuuacacaggcuaggcaugugcuaccaca

SEQ ID NO: 4144746 - RNA, 124 nt, Human
uguggagggaacaagaaggcucuucuuuggagagguuuaaggaggagaugaaaauacauaaguccaagagauccugaagcucucuuaaggaaagagguuaaaaaaagaagguucuuaauacaca

SEQ ID NO: 4144747 - RNA, 62 nt, Human
uguggaguggucugaaggcucccauggccuuuccuugcuggggucuucaggaugacuugaua

SEQ ID NO: 4144748 - RNA, 76 nt, Human
uguggcuuucaagaagucauuuagccucucagacuauuuuucaucugugaaaugaagauaauucuugucugcuuca

SEQ ID NO: 4144749 - RNA, 90 nt, Human
ugugggaaaauaaguagaaaucaggauuugggaggagguuucaaaggagacuuuaguccuuccuuccugaaauuuuaguguuuuuuuuca

SEQ ID NO: 4144750 - RNA, 63 nt, Human
ugugggacaaggaugaagauauuaaaaacgcugaccucuaguuuacaauguccuuggaccaca

SEQ ID NO: 4144751 - RNA, 56 nt, Human
ugugggagucagacagccugagauuguagugauuguggaucugucuguuuccucca

SEQ ID NO: 4144752 - RNA, 55 nt, Human
ugugggaguuacuuguacuagccuuuuaagagguucuauacaaagauuucucaca

SEQ ID NO: 4144753 - RNA, 57 nt, Human
ugugggauaaucaggaaggugccaacuucauaauuggcaccuggcugacugucucca

SEQ ID NO: 4144754 - RNA, 74 nt, Human
uguggggaacagaggaggguguugcugauaucugaggucaugggagacccaagcuucgccuuccuuucucugca

SEQ ID NO: 4144755 - RNA, 71 nt, Human
uguggggacggggcaggaauggcaugugccaccugaggaauggcucagugacauuccucccacaucccaca

SEQ ID NO: 4144756 - RNA, 64 nt, Human
uguggggaggaggcagagucuagaggggacaaacuaaucacagaaaucuguuuuuucuauugca

SEQ ID NO: 4144757 - RNA, 71 nt, Human
uguggggaguuggaaguugacagggccaagucagaaaacuacgaucccuuguuaacuuuccugccccuaca

SEQ ID NO: 4144758 - RNA, 114 nt, Human
ugugggguuuuauagccucagaacacaauggcgugugccacagauugcucuuuccauuuguauuuuguguguaguacacagccaauguccugcuugcuguaaccuuuccucuca

SEQ ID NO: 4144759 - RNA, 79 nt, Human
uguggguuccuuggagucaugauggagguggacuauauagucuugucucuggccucuaaugauucacaucauucccaca

SEQ ID NO: 4144760 - RNA, 78 nt, Human
ugugguacggugggcuuccuggagccugugcucucuaauugucuuaguggcuaagagcaucaggaguuugcagccaca

SEQ ID NO: 4144761 - RNA, 78 nt, Human
ugugguaucauggcaagaauauuggaccagaagucaggaaagacuguguuacgaaguuguugugaaugugauauuaua

SEQ ID NO: 4144762 - RNA, 65 nt, Human
uguggucaguagaauguuuugcuuucuuauagucacaacagcauagaacagucuucugagccaca

SEQ ID NO: 4144763 - RNA, 56 nt, Human
uguggucauucucugucuucacacccuccugcagaagacaccagagacuggccuca

SEQ ID NO: 4144764 - RNA, 74 nt, Human
uguggucccagccugucugucuccaaagcugagcucuuacucaucuuccaaggcuggagaggagaggggcugua

SEQ ID NO: 4144765 - RNA, 75 nt, Human
uguggugacucuauccuugugugcacaaacaggccacagcaguuuagauccuaagcacagggacagaucaucaca

SEQ ID NO: 4144766 - RNA, 64 nt, Human
uguggugauggaugcacaauucuguauauauacuaaaacccacugaaauguacacauuaccaca

SEQ ID NO: 4144767 - RNA, 77 nt, Human
uguggugggcccuggggccgggggugggaugcaggcaucccggcugauuucuacccugcggucuuggggcaccuaca

SEQ ID NO: 4144768 - RNA, 69 nt, Human
uguggugggcuucauggaguucuacaccaaggagguacuugggggacgaccagggagcccccuaccgca

SEQ ID NO: 4144769 - RNA, 89 nt, Human
uguggugggguguuucuggcaucuaguggguagaaguccaagaaggauucuucuaacauccuacaaugcaaacaacagcccccaccaca

SEQ ID NO: 4144770 - RNA, 96 nt, Human
ugugguguggggagcgguccugugcauugcaggguguucagcagcaucccuggugucuauccagucagugccgguagcaccccuccagucaucaca

SEQ ID NO: 4144771 - RNA, 60 nt, Human
ugugguguuggcauagcauguaucauagcauauagcuaugcuagcugugccaacaccaua

SEQ ID NO: 4144772 - RNA, 86 nt, Human
ugugguuccaguguuacuaccgugggucuucacuagguauuacuaaaauggagccuggaggggccagggugguaauggaugccaca

SEQ ID NO: 4144773 - RNA, 123 nt, Human
ugugguugccccgaaguggagcaggcaagguaacacuugaagccauuuuugcagagaauugcacaaacagcagcgggugucauagacucagugguuccacuucggaucgagaaaacacccaca

SEQ ID NO: 4144774 - RNA, 71 nt, Human
ugugguuguaggauugagguccugcugggauugcuguuggugccugcagaccacacucaguccuggcuaca

SEQ ID NO: 4144775 - RNA, 62 nt, Human
ugugguuuccuucauggggugauaacuauaccuacauuacacauggauuaaaugagaccaca

SEQ ID NO: 4144776 - RNA, 70 nt, Human
uguguaaaccagagcgcucaagccuucccuccagggggaguugggaaggcagugucugguugaaagcaca

SEQ ID NO: 4144777 - RNA, 72 nt, Human
uguguaacucauuauguuuacucauuuggcuuaacuucuaagaagcucagaguuaaauauagugcucaaaca

SEQ ID NO: 4144778 - RNA, 65 nt, Human
uguguaacuguauauuaagguggccccugauauuccagggucgcuuaauauauguuuaaaacaca

SEQ ID NO: 4144779 - RNA, 57 nt, Human
uguguacauugccuuuuaaaggugggucaaaggcaccauccuuggcacguuuauaca

SEQ ID NO: 4144780 - RNA, 74 nt, Human
uguguaccuucucucucuucuuuguaggggcccuuuuaggcuugggcucuggcuuuggaggagcagguuuagca

SEQ ID NO: 4144781 - RNA, 60 nt, Human
uguguaggggcagucuaggauaccuccauuucuuggcacauccuagcuucucucuguaca

SEQ ID NO: 4144782 - RNA, 70 nt, Human
uguguaucuccuauugguucuguuucuuuggagaacccagacuaauugaacaaguaauagaagaguacca

SEQ ID NO: 4144783 - RNA, 81 nt, Human
uguguaugaaaguguuuuguaaacagaaaaguauauacaaguguaggacauuuauuuuuguuucaaaacauguaucacaca

SEQ ID NO: 4144784 - RNA, 79 nt, Human
uguguauuauuugcucaguguuuuccagggucuacugaaggaauuuaguggccgcaaauauucagacaagcaauacaua

SEQ ID NO: 4144785 - RNA, 106 nt, Human
uguguauucuauggcuaauggacucagcauccaagugccuuuuagagcccugaugcucuaacaaggcaauuugugauccugcgauuauccucagccaagucauaca

SEQ ID NO: 4144786 - RNA, 71 nt, Human
ugugucaaugauagacaagaucuaagguaccuuuggggagccauuaccacuuuuccaucagauuuggcaca

SEQ ID NO: 4144787 - RNA, 58 nt, Human
ugugucagugucuccuccccaucacgagcaucgggggugguggugagucacgggcuca

SEQ ID NO: 4144788 - RNA, 79 nt, Human
ugugucccccgcuuuccugggaagacugugaggacaggagcuugucccuguucauauccccagcacagugccuggcaca

SEQ ID NO: 4144789 - RNA, 60 nt, Human
uguguccuaggcacuaaaugugagucagcacugcugaagcaaaacgugcucuaggaggca

SEQ ID NO: 4144790 - RNA, 61 nt, Human
uguguccugggguggggaugggugacaaacgguagcaucaggccagcaaucccugggcaca

SEQ ID NO: 4144791 - RNA, 65 nt, Human
ugugucugaacaugcuuuguaaaugggaauaucaucuguuaauucuagagcacuguacagauaua

SEQ ID NO: 4144792 - RNA, 103 nt, Human
ugugugaauguucauugcaguauuauucauaauaaccaaaaaguggaaacgacccaaauguccaucagcuggugaguggauagacaaaaaugauaugcauaca

SEQ ID NO: 4144793 - RNA, 61 nt, Human
ugugugaggauguauuuuaucagagucucaucaugaccugggugaaauaguccucaagaca

SEQ ID NO: 4144794 - RNA, 92 nt, Human
ugugugaggcaugucaauccucaacuauucuguuaauacucucacacuuuggcugaauuacuuauuaguggggaugaccugagcuuugcaca

SEQ ID NO: 4144795 - RNA, 81 nt, Human
ugugugauaaugcaaggcuuugugaauuuuaaaugauucugcagaugaauuugagauacaguaaagccuucauuagauaua

SEQ ID NO: 4144796 - RNA, 65 nt, Human
ugugugaucuuagacaacucacuguaugucccagagacacauauugacuugccuaagaucacaca

SEQ ID NO: 4144797 - RNA, 81 nt, Human
ugugugaugcguagguucucuggccuaacaauccaugguccuuuucacuuugguuaaaggacagagcccuaguuucauaca

SEQ ID NO: 4144798 - RNA, 80 nt, Human
ugugugcauaaaggauuugaagagacagcagaaagaccaacuaggaauucauugcaguucuucagguuacaauggacaca

SEQ ID NO: 4144799 - RNA, 88 nt, Human
ugugugcaugcccuaugccacugacauggacaauuuuagcuaaaagcuaaaagccucccagguuaugaguaaacagggugcuuacaca

SEQ ID NO: 4144800 - RNA, 102 nt, Human
ugugugcccacaagcuugguggccaggagacauuugucaaaggaaugccugauugcaugaaugaacagaugccuucucccaugaauugccuuggugccuaca

SEQ ID NO: 4144801 - RNA, 63 nt, Human
ugugugcccugcauuaggugacuuccaguucacaaacucagucucugcaugaugcagcacaca

SEQ ID NO: 4144802 - RNA, 130 nt, Human
ugugugccugccaaggccuggcaggugaagggaggcgggggccacaucagggcugcuugggggucucuggggagagggucccaugccugagcccccgcccgcccugccucccagggucuggcgugcguca

SEQ ID NO: 4144803 - RNA, 129 nt, Human
ugugugcuauuuccagauugucuccaaguaguuggcugcuggguaugauuaugaaacugaaugaugggccauggaguguuucaugccauuuccagauugcccccaaguauuuguggacauguucacaca

SEQ ID NO: 4144804 - RNA, 56 nt, Human
ugugugcucgauggcccugcagcccuccucaguggggcacgcagguggggcgcgca

SEQ ID NO: 4144805 - RNA, 61 nt, Human
ugugugcugacuuggaguggacggacccaucaaagucaugucugcccuuggcucagccaua

SEQ ID NO: 4144806 - RNA, 57 nt, Human
ugugugcuuaagggcugaaccugacggaagagaauggguucauggccuggccacaca

SEQ ID NO: 4144807 - RNA, 100 nt, Human
uguguggaaagagcacucugcuccugauguuggggaugucaugccacccacguacaucacuguccucagcauuccagcacucuugccuauucuccgugca

SEQ ID NO: 4144808 - RNA, 94 nt, Human
uguguggaugcaguguuuguccagcugaaggcagccucacucggcugacuaccugaugagugauuuuccccaagcugacagcugcuccaacaca

SEQ ID NO: 4144809 - RNA, 60 nt, Human
ugugugggugguugaugcuagcugucagcuggaaccucagcuggccagaacgccuacaca

SEQ ID NO: 4144810 - RNA, 75 nt, Human
uguguguaaagagaagagcacaguauugauacuaguuaggcaaacaguaaauggugguuuuuaucauuacucaua

SEQ ID NO: 4144811 - RNA, 86 nt, Human
ugugugucuugagggcagugaaucugagagccugggaugcauguuuaucuggcuuaucucauuagauucuuugaucaaaacucaca

SEQ ID NO: 4144812 - RNA, 64 nt, Human
uuggccaggucuggguagcagaggauggguucccaguccagguggaggccuuagacuuggaagg

SEQ ID NO: 4144813 - RNA, 97 nt, Human
uuggccaggugcgguggcucacaccuguaaucccagcacuucaggaggcugaggcagguggauuacaaggucaagaguucgaaaccagccuggccaa

SEQ ID NO: 4144814 - RNA, 97 nt, Human
uuggccagguuggucucgaacuccugaccuugugauccacccgccuuggcuucccaaagugcugggauuacaagugugagacaccgcaccuggccaa

SEQ ID NO: 4144815 - RNA, 69 nt, Human
uuggccaguggacuaaguucugacauguugcaugacaccuucccagaacuugguuucaaacacgguuga

SEQ ID NO: 4144816 - RNA, 56 nt, Human
uuggcccacaguaccaugcugucaacugcauaugacauggguuauugugagguuaa

SEQ ID NO: 4144817 - RNA, 73 nt, Human
uuggccugacuuauucuuccgcaaagcuugcaaguaaugucaaguaacagcaggagggaaugaaguuagacaa

SEQ ID NO: 4144818 - RNA, 78 nt, Human
uuggccuguuguggcuucuuccucucugaugugggacaaguucccucaggagcuggauaggaccacaauacagguuga

SEQ ID NO: 4144819 - RNA, 71 nt, Human
uuggccuugauuaugccaguagauaauggguaugugacaguuuuagcuucucuggccuuugaucagguuga

SEQ ID NO: 4144820 - RNA, 56 nt, Human
uuggcgcccaggacgccgccgcuguacuccccggcggccgcguccagggccgccag

SEQ ID NO: 4144821 - RNA, 113 nt, Human
uuggcuaagaauugguguauaucacaucucuggcuuggauuaugguuggaaguggcccagugccugucaaaccucaucucucacugaauauaacaccaucuaauacaugccaa

SEQ ID NO: 4144822 - RNA, 103 nt, Human
uugagacggugccuugcucuguuucccaggcuggaaugcaguggugugaucuuggcucacugcagccuccaucucugggguucaagcgauucuuccgccucag

SEQ ID NO: 4144823 - RNA, 94 nt, Human
uugagacuggaugcuuccuuaccagaagaugaagaguccucacagccugugccggauuucucacuuucugugggaaugugucucccuguuucag

SEQ ID NO: 4144824 - RNA, 93 nt, Human
uugagagacaugaagccagacaguuaagggaaucugacgauacaucugggccuauccaaucauuguaaaugguuuuguuuggcuuccuuuuaa

SEQ ID NO: 4144825 - RNA, 58 nt, Human
uugagagaggaaacauagucucagcagccauuaguggagacugaguguagcugcucag

SEQ ID NO: 4144826 - RNA, 55 nt, Human
uugagagccuaccauaugccaggcacugugugcuggcagugguaccggcucucag

SEQ ID NO: 4144827 - RNA, 93 nt, Human
uugagagcuagaaggaagcauuucuagaaggagagaaacaagguguagguugaccaaacauuugccuggguguguuaucuuccuuguucucaa

SEQ ID NO: 4144828 - RNA, 82 nt, Human
uugagaggauauaagaaaguaauuuugucugaguuuuagguuuuggccaugauugaaacaaguugcuuucuauuccuuacag

SEQ ID NO: 4144829 - RNA, 69 nt, Human
uugagauaauucagcacagaggaaccaguacaggucucugauagcuguaccaagugcugauuaacucaa

SEQ ID NO: 4144830 - RNA, 64 nt, Human
uugagauccccaggaaggacaaccugccucauauaacaugcugcuguuucagccugggucucaa

SEQ ID NO: 4144831 - RNA, 65 nt, Human
uuaaagucaauuucuuuuaaugucuggcuuucaguagauuguagcuagcuuugggaggauuuuaa

SEQ ID NO: 4144832 - RNA, 90 nt, Human
uuaaagugcaguuaaagucuuuauacagaaauauaugcccuauaaacacagaguauaucuuuuuaaggacugaugaaauagucacuuuaa

SEQ ID NO: 4144833 - RNA, 62 nt, Human
uuaaaguguuaacugaagcuuaggugggggcuaccuucuguauguaacaguggacauuuuag

SEQ ID NO: 4144834 - RNA, 74 nt, Human
uuaaaucaguaggcuacuccuuaaaaugacuuccuaaaauaucuuugucaaacauuuggaagccuuugguuuaa

SEQ ID NO: 4144835 - RNA, 63 nt, Human
uuaaaucauuucccuuuagaucacaaagguaccuuuggggcuuauugggacaaugcaauuuaa

SEQ ID NO: 4144836 - RNA, 129 nt, Human
uuaaaugagagaccuuagggaggcagcuuuguugccauguggcuuaucacauuguccauggaggaaguaauguuccuccuuuaagugguguagccugagagaaagauggccuccaagaucuuuaauuaa

SEQ ID NO: 4144837 - RNA, 127 nt, Human
uuaaaugaguuaaagcauauaaaaccuucaacauaguaccuggcacauaauaguggcucacacuuguugagauuugcuaugugccagguaguguuuuagcauucuguacauguauuuacuuauguaa

SEQ ID NO: 4144838 - RNA, 65 nt, Human
uuaaaugcuaucgcauaaaaccuggaacauguauuccauagguugcuuugaugauaagcagauaa

SEQ ID NO: 4144839 - RNA, 76 nt, Human
uuaaauuacugcagauuguguggagcaaagaaauauuauugaagcauuucaaaauuccaggcaagccugaauuuaa

SEQ ID NO: 4144840 - RNA, 83 nt, Human
uuaaauuacuuuuaacuuuacagaauaagaauacuggcgacccuaucaggucccaauuuuuccuuuuuuggagugugauuuga

SEQ ID NO: 4144841 - RNA, 84 nt, Human
uuaaauuccugugccugacuaggugaaucaauauggaaaagauauuauaaaaauauuguuuccuccuuugucagguagguuuaa

SEQ ID NO: 4144842 - RNA, 94 nt, Human
uuaaauugauuuuauuuugguaaauguuugccuggacucagcauuuuauaugagaaaaacagggacaucuaccaaaguacaaaauguuauuuaa

SEQ ID NO: 4144843 - RNA, 130 nt, Human
uuaaauuuacugaggcuugcuuuauggaguaacauauggucuacucucgugaacauaccauauguaauugaaaauguuuauuuugcagaguaggguauacuauaaauaucaauuaggucacgguaguuga

SEQ ID NO: 4144844 - RNA, 68 nt, Human
uuaaccugcaacagaucugucuugccacaacaaacugggucaagaccaagaaauguuagucugguuag

SEQ ID NO: 4144845 - RNA, 63 nt, Human
uuaaccuguuaugcccccagagcccucaguggagcgcccguacuuugccggcaugacguuuga

SEQ ID NO: 4144846 - RNA, 57 nt, Human
uuaaccuuuuguguguuugaauuggggugcuaauaauaucaaaacacaaaugguuga

SEQ ID NO: 4144847 - RNA, 99 nt, Human
uuaacuaauuuuuguugaguauuuucuuaugagcaagacucuauauuaguuacugaaauaguaaauuaucguggagagaaugcugggaaacuugguuga

SEQ ID NO: 4144848 - RNA, 109 nt, Human
uuaacugcugggaggcucuauuucaucuuauguaaacuacagauaauaccuacucaccucaaggguguaucaaggguuuauguaagcuaaauuuguagaaagcaguuag

SEQ ID NO: 4144849 - RNA, 61 nt, Human
uuaacuggggaagcauuucaugguuauguagccuuuggcuuggaaagucucacccaguuga

SEQ ID NO: 4144850 - RNA, 117 nt, Human
uuaacuuuaaagaucaaugaguccguaaaacuagaccgugagucuaaaagaaccuuaauguccucagucuuuuaguaccuuuucugucuggauuucauggguuggucugauaguuga

SEQ ID NO: 4144851 - RNA, 69 nt, Human
uuaacuuugagaagcaauuuccaacugugcuguguucagcgguugagcguguuuacuccccuaaguuag

SEQ ID NO: 4144852 - RNA, 84 nt, Human
uuaagaaaguguaaaguuuuaugggaagaugugcaauuaauucaaccacuugcaguccuaaauauauagcuggauacuucuuaa

SEQ ID NO: 4144853 - RNA, 70 nt, Human
uuaagaagaaguaaaacuuuauguuuguuuuagauuggagaaaugaugcaaauucuuugcuucuucuuga

SEQ ID NO: 4144854 - RNA, 129 nt, Human
uuaagaauugauuuaguguaaagauaauauagcaagauuuuguuuagguuauggaugcucucuaaaaaugcauaauacuuguuugccuaaaauuuugauuauguuuuaucuuauuuugucacaguuaaa

SEQ ID NO: 4144855 - RNA, 69 nt, Human
uuaagacauuuuuggagauuaugaaacaaaauuuucugauggucaauauaaucuucgaaaauguauuag

SEQ ID NO: 4144856 - RNA, 75 nt, Human
uuaagaucacaagguccugguggauagaaaauauauauuauuucuguacucaucacagugacuuggcagucuuga

SEQ ID NO: 4144857 - RNA, 108 nt, Human
uuaagaugugucuucaauuuguauaaaaugguguuuucauguaaauaaauacauucuuggaggagcaccauugugcuggugugaaugauuccauaguaacaaucuuga

SEQ ID NO: 4144858 - RNA, 98 nt, Human
uuaagauuaccauaguauaucuucagaaauuauagguaacuaaagaaacugcaguaugaucaauggagauguaacuugucuaucugaaguaauuuuga

SEQ ID NO: 4144859 - RNA, 106 nt, Human
uuaagcagugcauugugaauaacuuucuauguuaauacacauauuuccugaauaucauuuuuaauaguuaacauaggaguuuguuguaugguuguacauuguuuaa

SEQ ID NO: 4144860 - RNA, 85 nt, Human
uuaagcuauuuaauucuacuucagaaauacuaucuccuuguuuauucaguggcugugcgucuggaguggaguuugaacugcuuaa

SEQ ID NO: 4144861 - RNA, 67 nt, Human
uuaagcugacuuuaauagcuucugugcuuuguaaagaaagcaagaaaguguggagagccuagcuuaa

SEQ ID NO: 4144862 - RNA, 58 nt, Human
uuaaggagcacaguguauuaaucuguucuuuuucagaugugcacuuuuuguaucuuaa

SEQ ID NO: 4144863 - RNA, 61 nt, Human
uuaaggggacagauuuugucagguucagaccuuggcuccaacacuaaauguguuuccuuga

SEQ ID NO: 4144864 - RNA, 79 nt, Human
uuaaguacaaguuucaguaugauuccuccaguagccgaccaaaggcggauuuuaaacuaagaaacacaccuguauuuag

SEQ ID NO: 4144865 - RNA, 109 nt, Human
uuaaguacuggcugaauaggguagucugugugccguuugugagaauguuuccuaacaggaggaagucugcaacgcacugcaaaaccuaaccugaucauacaguauuuga

SEQ ID NO: 4144866 - RNA, 67 nt, Human
uuaaguucugggguaaugagaauugccuggcuaauggcuagugaaugcuuauaacguuagaauguga

SEQ ID NO: 4144867 - RNA, 82 nt, Human
uuaaguugggcucucaucagggaugccucggugcuuuggcucugggagugaaaagccaugcauaccuaagagcucaggguaa

SEQ ID NO: 4144868 - RNA, 62 nt, Human
uuaaguuugagugccucugggauuuccagguagagauucccagugggugacuggaggcuugg

SEQ ID NO: 4144869 - RNA, 90 nt, Human
uuaauacaauuagcuuuagggaggacaguuacaacaggaagcaaauuccuugcagcauccgguccucucuuagccauguuaguugauuaa

SEQ ID NO: 4144870 - RNA, 78 nt, Human
uuaauacaccuguauaccuaauugcuguugugaaacacauuucugcacaaauuuuagguuauagguuuucuguguuga

SEQ ID NO: 4144871 - RNA, 64 nt, Human
uuaauacagucuccagaaguaauugagccauuaacugguuuauacacugauuagauuguguuaa

SEQ ID NO: 4144872 - RNA, 125 nt, Human
uuaauacauuagaacauuauucugguggauuaguuuggccagcaugaaucuauccuuugaauaauaguacacucugagccaaaacuaauucgcuuucuaaaccagaaaaauuagaaugugcuuaa

SEQ ID NO: 4144873 - RNA, 71 nt, Human
uuaauacuggauugauucacaacacuagcugaccccaaauauaagaugagcuaguguuaacccaguguugg

SEQ ID NO: 4144874 - RNA, 88 nt, Human
uuaauauaggagugcagauccugauugcaguucuuuuagauaaauagagaagugggauugcaggaucuuaggguaguucuguuuuuaa

SEQ ID NO: 4144875 - RNA, 129 nt, Human
uuaauaugagugagaugcuuguuucuauaaugaauuugcaaauauguguuucuauuucaaaaaguaguguauucaugugugcaggugucagcuggauaaauauauauaacagcuuuuuaaguauuauag

SEQ ID NO: 4144876 - RNA, 87 nt, Human
uuaaucaauauuucauugacacugaucuucauaauguagaccucagaauaauuugugaggcauuaaagggaggucaaauuugauuaa

SEQ ID NO: 4144877 - RNA, 88 nt, Human
uuaaucaugcugguugcaaacuuuuguugaaagaagauggugcauuuuggcagccaucucugaaaucaaagcuguccuagauauuuaa

SEQ ID NO: 4144878 - RNA, 64 nt, Human
uuaaucucccccucucucaagcccgggagaaacagacauucccauggcuuaggagggaguguga

SEQ ID NO: 4144879 - RNA, 86 nt, Human
uuaaucucuagcagcuucuauuuucuugguuuauaaaacaucugagcuauuuaaaaggaaguggagugagcuggcauagcuauuga

SEQ ID NO: 4144880 - RNA, 79 nt, Human
uuaaucuuugaugcaaguuguuguguuauuacagaauccaucauaaugaaguaaugaccccacugugcucagagguuaa

SEQ ID NO: 4144881 - RNA, 69 nt, Human
uuaaugcugugaaaaauccaacuuguagcagugaacuguuuauagaaggagcauucacuuagcaguuaa

SEQ ID NO: 4144882 - RNA, 78 nt, Human
uuaaugggcuugcaucacaguaucucuguaaugcucaauccugguauugugcagaacugcuggugugagccgcauuga

SEQ ID NO: 4144883 - RNA, 67 nt, Human
uuaauuaaagggacuuuugcuggcucuuugcagauugcugcuggcgccccauauaguucuuaauuaa

SEQ ID NO: 4144884 - RNA, 71 nt, Human
uuaauucguauuuauauucucaauaccugccagauacuaggcuagguauugggacuauaaagacgcauuag

SEQ ID NO: 4144885 - RNA, 63 nt, Human
uuaauuguaaaguuugccuguuuaaugcucagggcagugaccagaguaucccuuuagaauuaa

SEQ ID NO: 4144886 - RNA, 68 nt, Human
uuaauuucagacugcuuuuauaaaggacauaacuaguagcaugguaaaagugcaguccaugaaauuaa

SEQ ID NO: 4144887 - RNA, 75 nt, Human
uuacaaaaacauugugcuaucuccucggagaaucugucauacagacaguucccacuuggugcacuaugauuguga

SEQ ID NO: 4144888 - RNA, 82 nt, Human
uuacaaaguuuaagguggcacugcuaaagaucauuuauuuuagacauuccuaucuuaauaagugcccuuuacaacuucuuga

SEQ ID NO: 4144889 - RNA, 73 nt, Human
uuacaacuugcagaggauguugcuuuagagacaaaauaaguauguggggaguaaaucccugccauuguuguaa

SEQ ID NO: 4144890 - RNA, 89 nt, Human
uuacaagggaauucaaaucugaauaaauuucuuuuagucuuauuauaaagaugacucaaagacagcuucagguggaauuauucuuguga

SEQ ID NO: 4144891 - RNA, 56 nt, Human
uuacaagggucaguguguuugugcuguacuuggcauuuucacaaauuacucuguag

SEQ ID NO: 4144892 - RNA, 69 nt, Human
uuguuuuaugccuccucaaaucugccacaaggaagccacaugugagaccugaggaggcaaucuaaacag

SEQ ID NO: 4144893 - RNA, 92 nt, Human
uuguuuucauugacaugauagcuuuuugucauagagucuuagugaaggaggcucucaaauaagcuguuaaauuauguuauaugaucagacaa

SEQ ID NO: 4144894 - RNA, 74 nt, Human
uuguuuucggccacaaugaguccuuuagugccauuguggacucacaaugcacauggacaucaggcugugaauga

SEQ ID NO: 4144895 - RNA, 55 nt, Human
uuguuuugauagcugguaacuuugaacuaaagggacauuacuguuaucaaaacag

SEQ ID NO: 4144896 - RNA, 75 nt, Human
uuguuuuguuuugagauggagucuugcucugucgcccaggcuggagugcaguggcgccaucucagcucacagcaa

SEQ ID NO: 4144897 - RNA, 130 nt, Human
uuguuuuuaccaccuuagaacugcaauuguaucucauagaaugauuuguuuguuuagugaucuagauuagaaacuagccacacagaauacaccuggaggcauaacuaaguaaaaacaauaaauaaaacaa

SEQ ID NO: 4144898 - RNA, 58 nt, Human
uuguuuuuggauguuguaugugcauauguuuacguauugcaagcaauuccaaaaggaa

SEQ ID NO: 4144899 - RNA, 76 nt, Human
uuguuuuugugccaagacuauauugugcuuuguccuuugugaaacauggagcccaauauaaucuuagcaauagcaa

SEQ ID NO: 4144900 - RNA, 91 nt, Human
uuuaaaaacaaguccuggugagguagugggagggaaaggaccuagaccuucaccuccuucuaacugcuagaggcuaccaauauuuuuuaaa

SEQ ID NO: 4144901 - RNA, 69 nt, Human
uuuaaaacaggcuugcaacauguuuucuuaaguaauagcuagaacaaaucgauggaagccuggcuuaga

SEQ ID NO: 4144902 - RNA, 77 nt, Human
uuuaaauguggcaauggaaaagugaaaauagcuuuuaagauaaagcaauugucucugaauuuucagcugcaucuaaa

SEQ ID NO: 4144903 - RNA, 76 nt, Human
uuuaacauuggcaaacucacauuauuagagaaugcaacacuaguuuaacugaaugaaugguuugucuuauguuaga

SEQ ID NO: 4144904 - RNA, 85 nt, Human
uuuaacuggaauucccuacaagauuuuuaaaacuguauuuuuaaacuauauaauccaaaagguuuugugggggaaguuaguaaaa

SEQ ID NO: 4144905 - RNA, 77 nt, Human
uuuaacuggucuccugcugcuucccuuguccccacuugcucuguucucaacauggcagccagggugauccauuuaaa

SEQ ID NO: 4144906 - RNA, 128 nt, Human
uuuaagaaaccacuuuucuugcuaugcccugauaaucuugccucuugaauaacucauuuccaucaagagcaggacagaaucagaacagcauggacaaggauaaucucuaaaaugugguuucaaaugga

SEQ ID NO: 4144907 - RNA, 61 nt, Human
uuuaagaacauaaauucauacgggcaggaaaugagaaacugcucuuugaaaugcucuuggg

SEQ ID NO: 4144908 - RNA, 123 nt, Human
uuuaagagaguuggggagggguccugagagaaugaagaaucugaggacagucauucuuccuugugagugacuugcauuggaauguuugucucaucuucuccucuggauuauaagcuccuuaaa

SEQ ID NO: 4144909 - RNA, 62 nt, Human
uuuaagagcauauuaauaguggagaaauuuuauuuucuucugugaaauaagugcuucuuaaa

SEQ ID NO: 4144910 - RNA, 80 nt, Human
uuuaagauuguuuaagacauuggcauugacuguaacaccuggcuguuagaggucuuuccaauuuuauggguucucuugga

SEQ ID NO: 4144911 - RNA, 55 nt, Human
uuuaagcagagaaaugauguauuugauaugcagguaccucuuucuucugugugag

SEQ ID NO: 4144912 - RNA, 79 nt, Human
uuuaaggaacaccguuuacaccacuaccgcuuauuccguaguuuguuauaacuguaguuaauguguacgguaccuuaag

SEQ ID NO: 4144913 - RNA, 70 nt, Human
uuuaagggauuuggagaccaaggcuucauacacaugcaaucagaggcuucuggugucaguauucuuugaa

SEQ ID NO: 4144914 - RNA, 96 nt, Human
uuuaaggguuuguacaaauuuugacaucuaggaaagguacaugacgaaauugccaaaacauucugugaugucauaaguuaaggacuuccauuuaaa

SEQ ID NO: 4144915 - RNA, 59 nt, Human
uuuaaggugggagaaaacucuuaggucauccaccuccuggauuuuccuuccaccuugaa

SEQ ID NO: 4144916 - RNA, 63 nt, Human
uuuaaguaaagauucccuguucucuucaauuuauuugaagguauuggggaauauuugacuaaa

SEQ ID NO: 4144917 - RNA, 57 nt, Human
uuuaauaaguugucagcacauaaaucaucagagaucaggccauggcagcuuguuaag

SEQ ID NO: 4144918 - RNA, 71 nt, Human
uuuaauauuuggugacugcucuaaggaaaacauaguaauuuggggcagcauaacaaucacugaauguuaga

SEQ ID NO: 4144919 - RNA, 93 nt, Human
uuuaaucuguggagccuuagucuuuggauuuuaaaaauacuuugaaacacccuaguauuuauaaucugccaaagagagaguucacuuguugaa

SEQ ID NO: 4144920 - RNA, 68 nt, Human
uuuaauuagcaagccagagagcuaacaauuaucucaccugucagcucucuugacagcuugcuguugaa

SEQ ID NO: 4144921 - RNA, 77 nt, Human
uuuaauuuccucagaugcugaauauuagccucaugauccuuugucagggguaaauguaguauacuugaggaauugaa

SEQ ID NO: 4144922 - RNA, 65 nt, Human
uuuacaacauaggccccaagaagaaggcuuuguuggacuugacucugugcggucuguguuaugaa

SEQ ID NO: 4144923 - RNA, 55 nt, Human
uuuacaagucagggacuguucuggauuuaauucccccaguccgauguguuguaaa

SEQ ID NO: 4144924 - RNA, 59 nt, Human
uuuacaauagggucugaaugaagugugaagauaccuuauuuuaaaugccuaauuguaaa

SEQ ID NO: 4144925 - RNA, 62 nt, Human
uuuacacuuauuaugaagcuuuuccugugaaguuauacaaccugaguuuuaaugaguguaaa

SEQ ID NO: 4144926 - RNA, 57 nt, Human
uuuacacuuuccugggaacaucuggaacgcaaauuucuauccccagggaaguuugag

SEQ ID NO: 4144927 - RNA, 84 nt, Human
uuuacagauuuaaguugcguggguuugaauccaguccugcagcccacuacuggggaucugggccucacacacauuaucuguaaa

SEQ ID NO: 4144928 - RNA, 74 nt, Human
uuuacagcuaugucuugguguucucugguuaaacaacuucacagaacagcaacaucagacaaaguuacugugaa

SEQ ID NO: 4144929 - RNA, 58 nt, Human
uuuacagugagagcuuagugagucacuuaaccugugccucaguuuucucaccuguaaa

SEQ ID NO: 4144930 - RNA, 73 nt, Human
uuuacauacaugacacugggcuacagguccuacugugugucuuccuuuugucacccgguguuauguucauaaa

SEQ ID NO: 4144931 - RNA, 55 nt, Human
uuuaccaggucugugcaggugucaaucagcuuuugcaugggugcagccugauaga

SEQ ID NO: 4144932 - RNA, 90 nt, Human
uuuaccgugacguccuagagcaggguuggggcagcgugcacuagcagaagaagugugggugcugccuccuuccugccaggagaagguaga

SEQ ID NO: 4144933 - RNA, 72 nt, Human
uuuaccuacuguuuucuuuauaguacagcagauuuuuaaauuaguuuguaauggagcaaacagguuggugaa

SEQ ID NO: 4144934 - RNA, 62 nt, Human
uuuacgaauggggugacaacuuaugauaaaaacuagagcuagugaauuagccuauuuguaaa

SEQ ID NO: 4144935 - RNA, 92 nt, Human
uuuacugagacaggguacacaguaguaggacaauaugugguggaaaaaacagccacauuuuucugcuccugaacagugcaugaucuaguaaa

SEQ ID NO: 4144936 - RNA, 88 nt, Human
uuuacugauuucguuaacaagagguaaagcucucauuuaauaucaggcccaccugggaagagagaauuugcugacauuaaugugugaa

SEQ ID NO: 4144937 - RNA, 67 nt, Human
uuuacuguuacaccuaccuucuuggaaagggcuaugaacucaagacaugggugagagugacagugaa

SEQ ID NO: 4144938 - RNA, 77 nt, Human
uuuacuuaauauucugaauuuuucuugggucgcuguuagucaaauagagauaacuagauuacagaagaauaaguaga

SEQ ID NO: 4144939 - RNA, 128 nt, Human
uuuacuuacuguguuuuuucccaucuauaauccaagcuucaggaggucggucuccuuuuuguauuguuuuguauucacaaguggacccuucauggugccuggcauguaguaggcaccacaggaaugaa

SEQ ID NO: 4144940 - RNA, 105 nt, Human
uuuagaaagaagaggcacaucuugauaacaugcugagaacugaggcaacugaugucuuuaggcucuuauagucccagcauguuuuuaagagcuacugaauuugaa

SEQ ID NO: 4144941 - RNA, 74 nt, Human
uuuagaaaugcgauaacauuuguauagcgcuuuguaaagggcaaagcgcuauauaaauguuaacuguuauuaga

SEQ ID NO: 4144942 - RNA, 81 nt, Human
uuuagaaguuguagcuguucauuguaagucauuuugcaauuuuacaaugaguuauuuaauagaaaggcagcauauuuuaag

SEQ ID NO: 4144943 - RNA, 117 nt, Human
uuuagaaucagugaauaaaaacagcgaauauaaacuuuuauaaagcugcagauauggguugaaucuggaucaauucuguuuuguaaaaguuuauaacuauuugucacugacuuuaaa

SEQ ID NO: 4144944 - RNA, 108 nt, Human
uuuagaaucuuggaucucuuccacucacacuaggauguuguuucuagaaaucucccugaaguaugguacugacucuuggugguaaaaguggagaggcuuagaacugaa

SEQ ID NO: 4144945 - RNA, 90 nt, Human
uuuagaauggucucgccaucagcuuuggcgcugagcaugaagucgagugugcugugccaugccgcugccauagugaggcgagacccugag

SEQ ID NO: 4144946 - RNA, 62 nt, Human
uuuagacccugggagauugacuggcuuauaaaguccuauguuggcaauuucaauggucugaa

SEQ ID NO: 4144947 - RNA, 129 nt, Human
uuuagacgagcaucucgacggcaggggcucuuguucacuuauguucucccauugugaguagcauaaugccuggaauaccguaagugcugaagaaagguuugugggguugauuaauuauugaacucugaa

SEQ ID NO: 4144948 - RNA, 107 nt, Human
uuuagagaaagcaugucugaaucuauauauagugggaauuacgauauacuggagcaaccauguaauauuaucuuacucuguuauuagugauucagcaugguccugaa

SEQ ID NO: 4144949 - RNA, 60 nt, Human
uuuagagagaauuuucaaagugcuccuuugaugauggaguuugugauaguucauuuuaag

SEQ ID NO: 4144950 - RNA, 72 nt, Human
uuuagagauuugucugauaguagaaugugaaaauugaaugucuuaauuauuuauuucagaaagguuucuaga

SEQ ID NO: 4144951 - RNA, 57 nt, Human
uuuagaggaggaagaaauuuuggcaauucucuaagccagcugccuucauuuucuaga

SEQ ID NO: 4144952 - RNA, 115 nt, Human
uuuagaguaccucccucacuuccugaaggauuuguccauugcuuauuucuacuuugccaguaugcaaccguugaauauuuguauggcacuuucaaagauccuggaguacucugaa

SEQ ID NO: 4144953 - RNA, 59 nt, Human
uuguuucccuggaucuagagcugccgccucaaucagcgacuggcauucaggugaggcag

SEQ ID NO: 4144954 - RNA, 77 nt, Human
uuguuuccuacggugacuuuuauucaauugaauuuaaaaccccagaugaaagugaauacaugucacucagcaggcaa

SEQ ID NO: 4144955 - RNA, 65 nt, Human
uuguuuccuuuuauaaggcuugagguguuuuugacuuuauuucugcuuccuugagaaggagauag

SEQ ID NO: 4144956 - RNA, 128 nt, Human
uuguuucuccccaucaaacuugccuucccacagacaugcugcucuggcuggagcaaugacuuggccaucuauccaagcauauggcacagagcagcugccagggcagggugggauggaggugggggcag

SEQ ID NO: 4144957 - RNA, 60 nt, Human
uuguuucugagugaguguaggccugacccuugggcauggcugaacauuacucauagucaa

SEQ ID NO: 4144958 - RNA, 70 nt, Human
uuguuucugugaggcuuuauguaagggugcaguauucugccuugauauaaaacugucucccaugauauaa

SEQ ID NO: 4144959 - RNA, 64 nt, Human
uuguuugagauuuucugccauugcagcacuuuguuauucaaaagugagcagaaaagucaaggga

SEQ ID NO: 4144960 - RNA, 76 nt, Human
uuguuugagcccaggaggucgaagcugcaguaagcuacaaucaugccacugcacuccagccugggagacaaagcaa

SEQ ID NO: 4144961 - RNA, 77 nt, Human
uuguuugauuuuugagacagaguuucacucuugucacccaggcuggagugcaaccucugccuccuggguucaagcaa

SEQ ID NO: 4144962 - RNA, 58 nt, Human
uuguuuggaacuuggugccacccugccaucguagcuggcuugcuaauguuccaaauaa

SEQ ID NO: 4144963 - RNA, 74 nt, Human
uuguuuguuuugagauggagucuugcucuguugcccaggguguagugcaguggcucgauuucagcucaccgcaa

SEQ ID NO: 4144964 - RNA, 74 nt, Human
uuuaucauuuuuucucaguucuaauuaauaggaguaaugaucauuguuaguguguuuaggacugaaaagauaga

SEQ ID NO: 4144965 - RNA, 62 nt, Human
uuuauccacaguauccaaaaucuggccccugguggguaccuuuugaauagcugcuggauaaa

SEQ ID NO: 4144966 - RNA, 60 nt, Human
uuuauccauucaccaguugaacauuugggcuauuugcaguuuuugguggucauggauaga

SEQ ID NO: 4144967 - RNA, 116 nt, Human
uuuauccuugagcuuaugcaaaacacuuccaggagacuuccagaaauauugggguggggaguccuuuauaggaaauaggucuucugugaacuugugauguuuccucuguggauaaa

SEQ ID NO: 4144968 - RNA, 79 nt, Human
uuuaucucauuuaauuccaaaauauuaauccagucagucauucucuugaauaggguuaguugguaguuaauugaauaga

SEQ ID NO: 4144969 - RNA, 59 nt, Human
uuuaucuguauaucucaaguguugauguaugugacacuuugauagauaaugcagguaaa

SEQ ID NO: 4144970 - RNA, 55 nt, Human
uuuaucuuauuccaccaccuugggaucucaccguaguggguuggaagggaaugaa

SEQ ID NO: 4144971 - RNA, 125 nt, Human
uuuaugacaguucuacuucuuuguccucuggguaaaaguguauauaugacuuauaaaagugauauucauguuuauaguauaugcuauucugagcuagaagcaaaauggagaaacuuuguuauaaa

SEQ ID NO: 4144972 - RNA, 68 nt, Human
uuuaugauuaugguagaaacaagaagugagauuuucacucuguguuuagugcugccauucuuugugaa

SEQ ID NO: 4144973 - RNA, 129 nt, Human
uuuauggaugcccccucagaaaaauaugcaaagggguaacuggcuuggaaauggguauuuaugcauaguaaaucccacucacgaguuuugccuauuugaagcuucucucaaugacagugcaucugugaa

SEQ ID NO: 4144974 - RNA, 84 nt, Human
uuuaugggacauuaugaucucuguggcauccacucaacuuugacauugcgguacagaaguggccauagacaauauguaaaugaa

SEQ ID NO: 4144975 - RNA, 66 nt, Human
uuuaugggauauaguaaaacaugaauugggucucugaaaaccaauuuagauuuauguuaccauaaa

SEQ ID NO: 4144976 - RNA, 74 nt, Human
uuuaugggguggugggaaccaaguaguggcaucucacugggguuuuguuauucucuacucaucacuccuauaga

SEQ ID NO: 4144977 - RNA, 66 nt, Human
uuuaugggucaugcacucuguugcaacuauucaauucugcugcuguaacuagaaagcacccaugga

SEQ ID NO: 4144978 - RNA, 76 nt, Human
uuuauguaauuuuggaguuucugcugaggaaaccugagugaacucauuucagaugcauuuagaauauuugcauaaa

SEQ ID NO: 4144979 - RNA, 58 nt, Human
uuuauguccuuguuuuggugacacuauacuaguggcucccucagacaagguauauaaa

SEQ ID NO: 4144980 - RNA, 84 nt, Human
uuuauuaagcaauucagcaaaccuagaaacauauauuuuguuguuguuguuguuguuagggaauucacugaaaugcugaauaga

SEQ ID NO: 4144981 - RNA, 56 nt, Human
uuuauuaaucuguuuaugcugucaaggaggaaacuugaccagugcagauaagugag

SEQ ID NO: 4144982 - RNA, 122 nt, Human
uuuauuaaugaguguaaccuccuacacaauacaucaacaugauuucaugcauuuagaggauaaaaauuuccuaguuaaguggaaaauuguggagauggcuucuggaggaccuucauucuaaa

SEQ ID NO: 4144983 - RNA, 68 nt, Human
uuuauuagauuaucaaagaggugagaccaaaaaaagauuaagggacugcuucuugagaaucugguaaa

SEQ ID NO: 4144984 - RNA, 129 nt, Human
uuuauucacuuaaugagcuucuauuggcagacuacugugucguugaacagagaggauaaagacaagaaacuuuuucuuuguaaagccacaguccuugucucacgacccaugguucaugguggaagcaua

SEQ ID NO: 4144985 - RNA, 68 nt, Human
uuuauucaucaucuguucauauuaagccacacauaagcauuugugugguggcagcagaggugagugaa

SEQ ID NO: 4144986 - RNA, 115 nt, Human
uuuauugagcaucaccuagaugucaagaacuauacauuacucauugagucacagaaacaacuuugagugauaagugugauuaucuucauuuuacagaagguugaaguucaacaga

SEQ ID NO: 4144987 - RNA, 64 nt, Human
uuuauugagcaucuacuaugaacugggcacugugaaagacagugcaaguguagaaacuaauaag

SEQ ID NO: 4144988 - RNA, 80 nt, Human
uuuauuguguaccugcuaugugagauacauuauguaaagcacugagcaugaugucucucacauagaagguaaggcaugaa

SEQ ID NO: 4144989 - RNA, 76 nt, Human
uuuauuuauuagccacaugcagacuuucaugguuugcuuuuuguucuggauguuuguguguguggaaauacauaaa

SEQ ID NO: 4144990 - RNA, 89 nt, Human
uuuauuucauuagagaagaauuguaaguaccagcaugcuauuuauacucucaaaaagcuuugccugcugacauucugugcuggaauaaa

SEQ ID NO: 4144991 - RNA, 100 nt, Human
uuuauuucuauuaugugcagaguaaggcagcuguuaaaugccauuaagauguuaauuuccuggcugaagacauugccaaaugugacacaaauaaaaugaa

SEQ ID NO: 4144992 - RNA, 58 nt, Human
uuuauuucuccagaaugcugucuguggcauucuccaaggcagauuuaggagaaaagaa

SEQ ID NO: 4144993 - RNA, 84 nt, Human
uuuauuuggcagcugucuucuggaugaauguggaagggaacccuuggacacaggaaagucagccagaagauuaagccagguaag

SEQ ID NO: 4144994 - RNA, 57 nt, Human
uuuauuuggcaucucugccaagagacacuaaaagucuauggcauugguccagauaaa

SEQ ID NO: 4144995 - RNA, 59 nt, Human
uuuauuugguggucaggcagcccuggguucaaauccuggcucgauugcuaccaauuaag

SEQ ID NO: 4144996 - RNA, 72 nt, Human
uuuauuuuccuagaaccaugcucaggaaggaaauguugccuccuguuuaggcuguggucugggaucugugaa

SEQ ID NO: 4144997 - RNA, 71 nt, Human
uuucaaaagaacccucaggcagaauguauucucuuauuaaaugaaugugagggaucugccugcucuugaaa

SEQ ID NO: 4144998 - RNA, 80 nt, Human
uuucaaaagauucgagcgauguauaaaaucucuuguuuuacuagguguggaguuuuguaaaggccugaauuucaguggaa

SEQ ID NO: 4144999 - RNA, 89 nt, Human
uuucaaacaugcuguucuguauugauucuguuaggcauugggaauccaaaugcacugauuuuaguuaauuagcucagauaugcaagaaa

SEQ ID NO: 4145000 - RNA, 61 nt, Human
uuucaaacugcuaccuuuuaugugcagcacucacagcugccacuugaagcucaguuugaag

SEQ ID NO: 4145001 - RNA, 67 nt, Human
uuucaaacuuuacucuugaaucuucuuuuccuugucagggaacucuucaaggguggauguccuggaa

SEQ ID NO: 4145002 - RNA, 60 nt, Human
uuucaaagguggaagagugaauaaguauaguaauucagucacuaagcacgccuauuggaa

SEQ ID NO: 4145003 - RNA, 68 nt, Human
uuucaaaguuuccuagaucaguguucuuaauguugccacacauuugaaucaccugggaagcucugaaa

SEQ ID NO: 4145004 - RNA, 74 nt, Human
uuucaaauauuuaaaggaauuauuauaaguggguaucuuuuaucaauaaucuuucuuuuccagauaguuugaaa

SEQ ID NO: 4145005 - RNA, 120 nt, Human
uuucaaaucccugcuugggaaugaugggggcaauuugccaaaaugcagauuccugggucccagugauucugacucaguacaucuggaguuggccccagaauucaaguugguuuuuugaga

SEQ ID NO: 4145006 - RNA, 57 nt, Human
uuaguguaaauaacugccuagacaaguaaauuauucuugcuagguaaccugcacuag

SEQ ID NO: 4145007 - RNA, 63 nt, Human
uuaguucacauucuagaauguuaucguggauuaaacauauggugacuccuaaaugugaaauaa

SEQ ID NO: 4145008 - RNA, 112 nt, Human
uuaguucacugcuccuuccccagugucaagcuuagccaggugcucauuaaagaauuacaaaaugagcaaaugguuacuugacucgugagguaggauaagacaaugagacuga

SEQ ID NO: 4145009 - RNA, 77 nt, Human
uuaguucuccaaauugacuauguucucuggaucaucuugucuuuucuucuagaaacucucaaucugggauguacuaa

SEQ ID NO: 4145010 - RNA, 93 nt, Human
uuaguuggccucuaaaauuuagucugaaagggugaacauugaaggaaauagacuaaagaauguguacuuuuucaugcucagaugguguauuaa

SEQ ID NO: 4145011 - RNA, 71 nt, Human
uuaguuucacagccacacuagcuacauuugaagagcucagucacuauauguggcuaguggcuaugaucuga

SEQ ID NO: 4145012 - RNA, 129 nt, Human
uuauaaaaaguaaggacaauguuaacgucuaucugacagugcugucaaauauguuuucauauaugaaauacuuaaaacauuguuuggcaguagguaaguacuugauaaauauuaucuucucuuuuauga

SEQ ID NO: 4145013 - RNA, 64 nt, Human
uuauaaagaaaugauuuccagaagcccaagaagccugguauucugagguaucauuucuuuguga

SEQ ID NO: 4145014 - RNA, 55 nt, Human
uuauaaagaugguuuaaucucuagagauggagacugagcauuaguauuuuuauaa

SEQ ID NO: 4145015 - RNA, 69 nt, Human
uuauacauuaaacaggcuuuuggaaaguuacauuuaaauggaauuuuugaaaagcuguaauauguguaa

SEQ ID NO: 4145016 - RNA, 99 nt, Human
uuauaccaaauuaaauguugaauguuuuaguccauccaggcugcuauaacaaaauaccacagucugggaggcuuauaaacagaaauuuauuugucauag

SEQ ID NO: 4145017 - RNA, 81 nt, Human
uuauagacacuggccugugcugucucaccuuucuuuuuauauaugaaaaugaacaguacaaagcacagacccaggucuuaa

SEQ ID NO: 4145018 - RNA, 64 nt, Human
uuauagaugugucuaguuugagcaccuaaagguugauaacucaggaaaggcagagugucuguaa

SEQ ID NO: 4145019 - RNA, 86 nt, Human
uuauauagcaguguaugaaaagcuuucuagcuauguucuacagcuguguggaguucaguagcuugaaagcaccauaauuuauauaa

SEQ ID NO: 4145020 - RNA, 80 nt, Human
uuauauaguuuuagaauguuuaaaaaugguuaugauggaguucccaagaauaaagauuuuuaggcauuucuucuauguga

SEQ ID NO: 4145021 - RNA, 64 nt, Human
uuauaucuaaguguauguaagagggugaagggaagugggugcaucuuuuuacaaguagguguga

SEQ ID NO: 4145022 - RNA, 56 nt, Human
uuauaugauugaagugcauaagacauacuuuuagguuuuggcacugagugguauaa

SEQ ID NO: 4145023 - RNA, 74 nt, Human
uuauauguugaagcccuaauacacaguaccucaggaugugacuguauuugaaguuagggccuuacaauauguaa

SEQ ID NO: 4145024 - RNA, 121 nt, Human
uuauauucaucauauuuuauuuucaaccuaucuuggauaagcaugaaaauaggucugauagucauaaggcuaucacuacacuucagcuuuaagaaguuguuagguuuaugaggacuuguaa

SEQ ID NO: 4145025 - RNA, 88 nt, Human
uuaucaucaccaguaucaucugcaaagcauuuugauaaauaccugguuuuacaugacugcccuugucagggccugcugguguagauaa

SEQ ID NO: 4145026 - RNA, 65 nt, Human
uuaucaucacuggauggaaauauacagcuuacugcuaagaucauauuuccagguuagugagguaa

SEQ ID NO: 4145027 - RNA, 90 nt, Human
uuaucauuucauuuaauccucacagcagcucugcgagauacaugacuuuauuuauuuauuuuugcuguggugauuuuaaaaugaggauaa

SEQ ID NO: 4145028 - RNA, 55 nt, Human
uuauccaggucugcuuuuccugccuaggcuagauuagaaauggcagaauggauag

SEQ ID NO: 4145029 - RNA, 81 nt, Human
uuauccuccauugguuauaguaauugcauggauuuacugguauuucagauucacaaugauacauaagcgauagagagauga

SEQ ID NO: 4145030 - RNA, 81 nt, Human
uuaucuaaaacacaguuucucuaugagaguucagugaaaauuccccuucccaaacugauucuaugaaugacuguuagauaa

SEQ ID NO: 4145031 - RNA, 61 nt, Human
uuaucucucacuuuuaaggacaauuuuuaaaaagauucauguuuuuucaaguggggaauga

SEQ ID NO: 4145032 - RNA, 81 nt, Human
uuaucucuuccuuucuaaaauccuaaugacaaguuuaguucagcauggauuuaacuauucaugagguuugggaauagguag

SEQ ID NO: 4145033 - RNA, 85 nt, Human
uuaucuguuuugcuuuuugagcuuccccacgagguuuuauuucaagaagaccaucugcugcuacaaaaagcuugagaacaauuga

SEQ ID NO: 4145034 - RNA, 74 nt, Human
uuaucuuuuucuacucuaacauuuguuagauguucacucaggugaagucagcaguuuguuggggugauggguag

SEQ ID NO: 4145035 - RNA, 80 nt, Human
uuaucuuuuuggcuuacuuguaguuuguaauguuucaacaauaaguauggauaauuaacaagauagggauaaaaagauaa

SEQ ID NO: 4145036 - RNA, 67 nt, Human
uuuggagcuguggcuuucuguuucuguuuuugguuuaaucuguauugagagccacagcgugcacaga

SEQ ID NO: 4145037 - RNA, 122 nt, Human
uuuggauguaauguaaugaauaaauguuacuaacaacuccucucuggaguuaugcagaguauguuugugaaaagccuaugacacacccagagagagcuguauuugauacauaauauaccaaa

SEQ ID NO: 4145038 - RNA, 77 nt, Human
uuuggauugcuuggaugcuucgaacagccaugaaaaguagccugccuguggcauuuagaggccaagcaauugacaga

SEQ ID NO: 4145039 - RNA, 67 nt, Human
uuuggauuucauuuuaauuucacugggaagccauuggagggcuugaugaaagaaggugcagucugaa

SEQ ID NO: 4145040 - RNA, 71 nt, Human
uuuggcaaagucuuagcaacuaucgcuuuauccuguggaaaaagcucaaggguguugcagagaccuccaaa

SEQ ID NO: 4145041 - RNA, 78 nt, Human
uuuggcagagucuuuugucaguaauguuagagaugggaguggacaaccagagacaacugagcagaggaaaugaccaag

SEQ ID NO: 4145042 - RNA, 87 nt, Human
uuuggcagucuggguggcugagcuacagcgaagcaaaucugaaucugccauaugcguuguccucaggaugcucagagucuagccaga

SEQ ID NO: 4145043 - RNA, 62 nt, Human
uuuggccugguaccacauagauuuagguuuaauuuaaauuuuacccucguacacaggucaaa

SEQ ID NO: 4145044 - RNA, 74 nt, Human
uuuggcuauugauagcagcaaagacauuuuuccuucccuuuugggaaacagucaugguugcuguucaagcuaag

SEQ ID NO: 4145045 - RNA, 59 nt, Human
uuuggcucuucccguaccauaagaauuguaaaagcuuguaucuauauggggagaccaaa

SEQ ID NO: 4145046 - RNA, 64 nt, Human
uuuggcugcuagcuaauuuuuauuagcccgucaccaggguuucuuuagguucugacaguccaaa

SEQ ID NO: 4145047 - RNA, 68 nt, Human
uuuggcuguguuaccacuucaugucuacccuccaggagaguuuauaaggguuggcugggacagccgag

SEQ ID NO: 4145048 - RNA, 70 nt, Human
uuuggcuucucuguuuuaguauuuccagugguuuacacaagagguuagcuauuagcaggcgaucguuaaa

SEQ ID NO: 4145049 - RNA, 67 nt, Human
uuuggcuuggggucauaaagaggaaaaaaacuuuaaauuuuuuuuccaacuuaagacuucagugaaa

SEQ ID NO: 4145050 - RNA, 88 nt, Human
uuugggaaagucuucuaaauuaccaagacaauacuguauuaagagagauuuuguauuugguguauuuaaugagcaagcaacucccaaa

SEQ ID NO: 4145051 - RNA, 79 nt, Human
uuugggaagucugcagauacugaugauaagcacucuuuaaagaagaauguaguuuagaaguaaggucagauuucuggag

SEQ ID NO: 4145052 - RNA, 107 nt, Human
uuugggagaaagaaaaggagacagauugcuguggaaauauaagauguuauuucugcgaaaauacuuguaucuuuaccaauuuuaaaugucgguuuucuucucccaaa

SEQ ID NO: 4145053 - RNA, 64 nt, Human
uuugggagccacugguugccucuuucuguucccucuugcccagggacaagccacagcucccaga

SEQ ID NO: 4145054 - RNA, 72 nt, Human
uuugggcaaagcuagaaggaaauuuuauguucuuguugcaaccucauugaauccuuccuucagaaguccaag

SEQ ID NO: 4145055 - RNA, 74 nt, Human
uuugggcauuaagauagcucgaucuuucauuuggcuuaauuuucaaaguuaucuggcuuucuuaaugacuuaaa

SEQ ID NO: 4145056 - RNA, 56 nt, Human
uuugggccugaccggugucucuggcuaacuuucugcugccaggucuuggguccagg

SEQ ID NO: 4145057 - RNA, 59 nt, Human
uuugggcguuaucucuccugcuaccuagggagaggucagcaaggcucuuaaugcccaaa

SEQ ID NO: 4145058 - RNA, 100 nt, Human
uuuggggaggaaaaagagaaagggaaagaagucagccacagugggagaaggggcuccuuuucuucauuucuugucuuccccuuucucuccccacccuaag

SEQ ID NO: 4145059 - RNA, 130 nt, Human
uuuggggaugaggccaugauucugaggucagugccaugccauggucuaauaaaguuugcauucaaugcuguuuguuucuguaugaucaauauuguaaagucagucucuuugucauggacucagcuuugga

SEQ ID NO: 4145060 - RNA, 59 nt, Human
uuugggggcuuacuugugagauucaguuuucacugguuagaagaaguaagcacuccggg

SEQ ID NO: 4145061 - RNA, 59 nt, Human
uuugggugcuaagggugugggcuccaagaaauaaucacacaucuuccagaguagcuaaa

SEQ ID NO: 4145062 - RNA, 63 nt, Human
uuuggguuuugcuugauauaaaugaagccagagaucucuuaugaaacucaagccagauccaag

SEQ ID NO: 4145063 - RNA, 75 nt, Human
uuugguauucccauuuccuagcacguugcucucuagagcuucauaucaacagcaggugguagagaaaaauccaga

SEQ ID NO: 4145064 - RNA, 86 nt, Human
uuugguauuuaaaagguagauuuuccuucuaugguuacguguuugaugguuaaucauagaggaaaauccacguuuucaguaucaaa

SEQ ID NO: 4145065 - RNA, 86 nt, Human
uuuggucucuuuacauacuucuuggaaguuuuguucauugaagauuuuaauuaggaaacaaagcuuagcaggagaggagagccaga

SEQ ID NO: 4145066 - RNA, 92 nt, Human
uuuggugagaagaacaaaugaacauauaagcuugaauuaaaaauaaauauaaaauuuaaaaaguaaguuacauuuggaacuuuugguccaag

SEQ ID NO: 4145067 - RNA, 80 nt, Human
uuuggugaugcauuucugcaaacuuccacgucucgcucuggggccaggagacugguguuugcugggcuguuucuuccaag

SEQ ID NO: 4145068 - RNA, 65 nt, Human
uuuggugcauuucucacugagcagauaaaagagcuauuuuuauccauucagugagagguaucaaa

SEQ ID NO: 4145069 - RNA, 72 nt, Human
uuugguguccuaaauauagugauucauguaacuggacagguccaaaggcauuggcuccugugggacaugaaa

SEQ ID NO: 4145070 - RNA, 75 nt, Human
uuugguuauauccaaaguuucucagaaacuggauauaaacuucuucaguucugaaaaacuuuggauauaaccaga

SEQ ID NO: 4145071 - RNA, 87 nt, Human
uuuguaaagcuauagaguccaaaguaugaauaugcuacaauuuaugcauauacuuuccuccuuugguaagcuuuugguuuucacaaa

SEQ ID NO: 4145072 - RNA, 63 nt, Human
uuuguaaagucacagagcaggugcaaguggguuuugcuuccuggaugugacuuuguuggcaaa

SEQ ID NO: 4145073 - RNA, 76 nt, Human
uuuguaaauaugaaggauacaccucugauuuucauuuuauuggguugagaacagggcaguuccuuauaguggcagg

SEQ ID NO: 4145074 - RNA, 77 nt, Human
uuuguaaauuuguacugccagauauuaaacauauugcaagguuacaguaaaugcuuuggugcugguacagaaacaga

SEQ ID NO: 4145075 - RNA, 57 nt, Human
uuuguaacacucccacucuucuuccaaagaggcaagaagaggugacaggguuauggg

SEQ ID NO: 4145076 - RNA, 124 nt, Human
uuuguaaguauuagaaucaccugguggucuugauaaaguacguaggcccaggccuagccuacuucaaagagccugguccuguagcacuugauuaguucuccaggugaugccaauacccuccaaa

SEQ ID NO: 4145077 - RNA, 84 nt, Human
uuuguaauaucuacuccagaugauaagggacaguaacccuauggaaggcuacugccccuuaucaucuggaguagacaucacaaa

SEQ ID NO: 4145078 - RNA, 56 nt, Human
uuuguacuagucaguaaauaguaguauugugacuacaaaugacuauuugguacagg

SEQ ID NO: 4145079 - RNA, 84 nt, Human
uuuguagagacaagguuucaccauguugcccggguugaucucaaacuccugggcucaagugauccacccaccuuggccuccaaa

SEQ ID NO: 4145080 - RNA, 61 nt, Human
uuuguauucuagccacuguugaugucugucugcacccagaccaggaggccuggagcacaaa

SEQ ID NO: 4145081 - RNA, 130 nt, Human
uuugucaaaaugcuacuuuauaaauauugauaauuaauuucaguaaucuccuuagguuuacaguaauauacuaugugguacaugggacauugacauuaauuauuaagauuauaaugcaaauuuugacuga

SEQ ID NO: 4145082 - RNA, 80 nt, Human
uuugucaacaaaggcccacagcugugagggucacuuguagaaaacaauggagauuugagaacaguugagggcuagacaga

SEQ ID NO: 4145083 - RNA, 78 nt, Human
uuugucagaaggaagaagcauguggugauggcacuggguaauuggcgaugucauuuaugcuucuucagugcuuacaaa

SEQ ID NO: 4145084 - RNA, 63 nt, Human
uuugucagcuguauaaugcagguaacuuuaucuaccuuauagaauugugcagcccuuggcaga

SEQ ID NO: 4145085 - RNA, 70 nt, Human
uuugucauuuaauagcuuuugucuuuuuucuaugggaaagacaagguuguacuauuaaaauagugauaaa

SEQ ID NO: 4145086 - RNA, 68 nt, Human
uuugucuuggccccaccugugccagcccuaggauggaacugcugacacuguugggaagcccagacaga

SEQ ID NO: 4145087 - RNA, 59 nt, Human
uuugucuuuaguugcguuaucuuacuuuuccaaaaggggaucuguaaguugaagacaaa

SEQ ID NO: 4145088 - RNA, 84 nt, Human
uuugucuuuauguagcuuauaguugagugcacaaaauaaauauggaauacaucugugucauacaacaauaaguaccgagaugaa

SEQ ID NO: 4145089 - RNA, 118 nt, Human
uucauuagguuuguuuaguuuccauugcuucagggguguuaguuuuguguucccaacuagauuauaaacuccucuugcauuccugauggcagugacuugaaggcauuuauuugaagaa

SEQ ID NO: 4145090 - RNA, 116 nt, Human
uucauuauaaaguuaucauaaaguuaucuagaaaagcauagcaaaggacuuuguaaaaguagguuagcucauuuacaaagaguguucuuuuccaguuuuuuagcaaugacaaugaa

SEQ ID NO: 4145091 - RNA, 56 nt, Human
uucauugaaauuaagcccaacuggccaauuuggugagugcuugauuugucaaagaa

SEQ ID NO: 4145092 - RNA, 73 nt, Human
uucauugaauccaguagcuauuuaugauacucauguuagugauaugagguaugauaauagcuugggauaugag

SEQ ID NO: 4145093 - RNA, 77 nt, Human
uucauugcugucuucacuuccugguuucucaaaguauagauaaguggauucagaaagggagugaagaugguauagaa

SEQ ID NO: 4145094 - RNA, 77 nt, Human
uucauuuaauaaaguucugcuggcauauaugauguuucucuaaauugguugcuacuuaggagcuuuauucuaaugga

SEQ ID NO: 4145095 - RNA, 77 nt, Human
uucauuuauuuauccagcagcuauucaaaagguacccaccaggggccagauuuuggauacuguggauaaaauaggaa

SEQ ID NO: 4145096 - RNA, 96 nt, Human
uucauuuccaaauguugccauucauuauucucuuuaauguucuggaagacgcauacuuuaggacuaauuucaggggauauaugaggucagaaugaa

SEQ ID NO: 4145097 - RNA, 62 nt, Human
uucauuuccugaucuguaaaauagcgaccugccucagagagcuguugcaaggauugaaugag

SEQ ID NO: 4145098 - RNA, 69 nt, Human
uucauuugugacuacggaggaaaguccaccagugggcuuucuggacccuucugugagugaacaaaugaa

SEQ ID NO: 4145099 - RNA, 88 nt, Human
uucauuuugaaauggaauuucugguauguauaugcuuuuauuaacauuuuuauugcaaagaaauacaugcuuaccauagaaaaaugag

SEQ ID NO: 4145100 - RNA, 65 nt, Human
uucauuuugugcacuuaaccaugacugcgugcugcacaagacaauggguaaguguaacauaugag

SEQ ID NO: 4145101 - RNA, 72 nt, Human
uucauuuuguuuagcugucuggccaggccuagcucauaggucaaguuuagauagaguuaaaauacuagugaa

SEQ ID NO: 4145102 - RNA, 87 nt, Human
uuccaaagacuuucgaacuuaaugguuccuaaaauguguaauugucuuucccaaccaccuuuuuaaagaucauugaacuugauggaa

SEQ ID NO: 4145103 - RNA, 77 nt, Human
uuccaaagagaagaaauauggauuauagauucgcaguuuagaaucuguagagacgaauguguuauuuuccucuggaa

SEQ ID NO: 4145104 - RNA, 59 nt, Human
uuccaaagcacuugauguaaaguaauaaaacuacuguacauaaagguuugacuuuggag

SEQ ID NO: 4145105 - RNA, 62 nt, Human
uuccaaagcauuugaauuuuggaaauguaacauauauguuuccaugcaguagagcuuaggga

SEQ ID NO: 4145106 - RNA, 60 nt, Human
uuccaaaguguuaaguucaguucaggguagcuucccugcucuguuaauuaaacuuuggaa

SEQ ID NO: 4145107 - RNA, 59 nt, Human
uuccaacuugcuucuuaaaugaguuuuuagauauagagcauuuagaggggcaggaggaa

SEQ ID NO: 4145108 - RNA, 119 nt, Human
uuccaagaaagauccauuuuuaaaagaugauuugcugacacuucagaucuugaauccaaggugcugauucaugcaguuugaaguucagggaauugcuuaaaguuauagcuuccuaggaa

SEQ ID NO: 4145109 - RNA, 102 nt, Human
uuucuuuuuggacuugauggggggcgccauggucucuuggucacuuucccccucguaguccuccaggcugcuguugguguccgccucguagccaaacagagg

SEQ ID NO: 4145110 - RNA, 55 nt, Human
uuugaaacucccuuuugucuaguagacugugcccuacaguagaagggauuucaaa

SEQ ID NO: 4145111 - RNA, 85 nt, Human
uuugaacaaaugugguuucucagcauucucugugcaagaugcccauuuugaaugauuccugagagauccuaaacuuguguucaaa

SEQ ID NO: 4145112 - RNA, 79 nt, Human
uuugaacaaguuuuccuuuauugaguaccaacccauguaaugguaaccuggacuuuaauaaaagggaaaugaguuugaa

SEQ ID NO: 4145113 - RNA, 68 nt, Human
uuugaacccaggaggcagagguuacagugagccgagauugcaccacugcacuucagccccaucucaaa

SEQ ID NO: 4145114 - RNA, 71 nt, Human
uuugaacucaggcagucugacuccggaggcuauauacauuuacccuccuugguacacugcuuuuuuucaaa

SEQ ID NO: 4145115 - RNA, 58 nt, Human
uuugaagccuuguagauuuacguaguaaagaaaccuguguaaaucuguauucuucaaa

SEQ ID NO: 4145116 - RNA, 89 nt, Human
uuugaauggggccaguauuagguaaaggacuugcaggcuggagccaagccuaggacccucccugaugucaaggcugcauccauaucaga

SEQ ID NO: 4145117 - RNA, 104 nt, Human
uuugaauggggguacuggaauaaauagcuccggauaaauuuuaaaaucacuaaugaauuuuggaaugcccauggacuggucauguucuauuaccagaauuuaga

SEQ ID NO: 4145118 - RNA, 75 nt, Human
uuugacacaaaaaaauagggaauuuguauagagaaguuucccucuuauaaaaggacucccauuugauuguucgaa

SEQ ID NO: 4145119 - RNA, 86 nt, Human
uuugacagcuugagggcuagauguauauaccugguguggaaugcaaagaccauucuccaauauaacauuugguaccuccgaucaag

SEQ ID NO: 4145120 - RNA, 56 nt, Human
uuugacaguccccugauguuugcauguagaagugcagggauuauuacacugacaaa

SEQ ID NO: 4145121 - RNA, 62 nt, Human
uuugacagugaugauauauacagaaagguauauagccugcuaauauguuuucacuguauaaa

SEQ ID NO: 4145122 - RNA, 82 nt, Human
uuugacauacauauuaaaucaagaauaucagcuugucagcuuguuaaugaaugagaaguuuuguugaaugugugaagucaga

SEQ ID NO: 4145123 - RNA, 66 nt, Human
uuugacaucagaauuugauuccugggauauucagauguagccagagauacagauucucauuacaaa

SEQ ID NO: 4145124 - RNA, 59 nt, Human
uuugacauugccaauuugcucacagucauugacugcugaaacagaugccaaugaucaag

SEQ ID NO: 4145125 - RNA, 58 nt, Human
uuugaccuuugccagggauaaccagauauucucuuauuucugaauccaaaaggucaga

SEQ ID NO: 4145126 - RNA, 64 nt, Human
uuugacucugggugcuuuuucggauacauuuucuucaacacuguuaaggggccucacugucaga

SEQ ID NO: 4145127 - RNA, 59 nt, Human
uuugacuugauggcuuacauccaaaaugaugucauacaugcuugagcuacauggucaaa

SEQ ID NO: 4145128 - RNA, 71 nt, Human
uuugagaaguaaauaacagagaaaaugggaagagcaauucuuccccauugucuuuauuauuuccuuccaaa

SEQ ID NO: 4145129 - RNA, 57 nt, Human
uuugagacaauauuaaccuaucuuugccuucaggaaagaggacauaucugucucaaa

SEQ ID NO: 4145130 - RNA, 85 nt, Human
uuugagccaggucagcccuugauguuugggggugcagagcacagauggacccccauuccauagggcugaauccuuaaggcuuaga

SEQ ID NO: 4145131 - RNA, 92 nt, Human
uuugaggaaauugcugagggccagaaaguuauugagauaacuugguauuugauggaucucaugaauuuuuagugcuuucuacauuucccaaa

SEQ ID NO: 4145132 - RNA, 60 nt, Human
uuugaggaguuuuucuagagcuaaguaugaaaagauucaguuauagaaauacuuuuugga

SEQ ID NO: 4145133 - RNA, 64 nt, Human
uuugaggcagcuggacauaacuaaccuggaaagaauuuagguaaaugugauggcugucuacaaa

SEQ ID NO: 4145134 - RNA, 70 nt, Human
uuugaggccgcuauaagauugguuaguauggacguaguaacugacaaaacagucucuguagugccugaga

SEQ ID NO: 4145135 - RNA, 76 nt, Human
uuugagugguuuaugcuuccugauuggacucugacuaauauguuaggaagggucccaggagauaaacccacacaga

SEQ ID NO: 4145136 - RNA, 79 nt, Human
uuugaguuauaagguggugauuagguuuucagguuuagagaagugugagacaaccuaauuaaacaccuuuuugcugaaa

SEQ ID NO: 4145137 - RNA, 76 nt, Human
uuugaguucacaguguuugauuuaggggccacucuuuauuggauggcaccaauauuucagacuauugauauucaga

SEQ ID NO: 4145138 - RNA, 75 nt, Human
uuugaguuuaggguggagacuggaagcaggggagcccuggcccucugcaggucacgcuccagccuggaacccagg

SEQ ID NO: 4145139 - RNA, 113 nt, Human
uuugauaaacacuauucagcaccuauaauucauucauucuguaaguaacuauugagcacauacaauaugccaagcaagugaaaguagugggacuaugauggugacacgucaga

SEQ ID NO: 4145140 - RNA, 71 nt, Human
uuugauacguauucugggccgauuacaaaacuuccagaacuagucuuuguaaaugccuagcauaauucaga

SEQ ID NO: 4145141 - RNA, 111 nt, Human
uuugauauuuuaagggagcuauuuauuccucacauucgagugauguguauggguaguuauuuguacaaauuuuucacauugaauggaagaauagaguccuuuguauucaag

SEQ ID NO: 4145142 - RNA, 62 nt, Human
uuugaucccagauuucugugauugcaaauuucaguuuguuuauuacaguucuuggaauugaa

SEQ ID NO: 4145143 - RNA, 69 nt, Human
uuugaucuguugcugaagggaaggucuugaaugccaagcuguuggcaagcuacuuucagaauuaucaaa

SEQ ID NO: 4145144 - RNA, 125 nt, Human
uuugaugcugcuggggcauaauuagcagagccuuucuggagggcacuugguaaucuguaccaagagcuuuagaaaugcucauucauuuuuaccuguugauucuacuuccagaaauugguaucaga

SEQ ID NO: 4145145 - RNA, 65 nt, Human
uuugauggaaggagaaauaagcauuccaucuauaucugauugguccuuccuuuuccuucgucaaa

SEQ ID NO: 4145146 - RNA, 78 nt, Human
uuugauggaauuuguuguugcuccccuaagagaggacaccagcggccugucucugggaguugagcagcagccaucaag

SEQ ID NO: 4145147 - RNA, 60 nt, Human
uucccacacucccaguuaaacacagugauuuuccugguguucaagugucaaguguuggaa

SEQ ID NO: 4145148 - RNA, 63 nt, Human
uucccacaguucagaacaaaggguuuaaaucagucagcucuuguuaucugugcuugugaggaa

SEQ ID NO: 4145149 - RNA, 80 nt, Human
uucccacucuuggaucucgaagacuaagcaucucugaucaagcaucucugaucaagcaucuuggucuacgauccugggag

SEQ ID NO: 4145150 - RNA, 99 nt, Human
uucccagaacaaagauucugauugauucaguuuauaccuguugauuaucuacccuugguucaauuggcuauggaguggcaugcaggaucugaaguggaa

SEQ ID NO: 4145151 - RNA, 56 nt, Human
uucccagaaugaauggauggaggcauuuagacccccaucccaugucauucagggga

SEQ ID NO: 4145152 - RNA, 66 nt, Human
uucccagcagagccagcaagccgaacgccuccagcgcggccgggacggaggagcggcucuggggaa

SEQ ID NO: 4145153 - RNA, 60 nt, Human
uucccagcuguccuuuguccuauaagaaguugagcuuuuuagcaugaagcagcuggagaa

SEQ ID NO: 4145154 - RNA, 85 nt, Human
uucccauagaaggcuuugugcguagugaguggucaaugaauacuaauggcuacuguuuauguacagcagcuguucacuuugggaa

SEQ ID NO: 4145155 - RNA, 71 nt, Human
uucccaucugagcaggagaugccccuggugacuuucuguucacuggcugaucaccugccucaggccgggaa

SEQ ID NO: 4145156 - RNA, 55 nt, Human
uuccccacccaaaagaacuguuguuccccguucacaguuccacauggcuggggag

SEQ ID NO: 4145157 - RNA, 56 nt, Human
uuccccagagaccuuaaaacuugcacaucgugagacuuuaagaaguuucugaggaa

SEQ ID NO: 4145158 - RNA, 62 nt, Human
uuccccaggggcuccugccuuuggauucaggccccccacagcgcaggagcuucccuggggaa

SEQ ID NO: 4145159 - RNA, 57 nt, Human
uuccccaguagugacaaucaaaacuguguccagacguugccaguguccacuggggga

SEQ ID NO: 4145160 - RNA, 82 nt, Human
uuccccaucugccuuuggugacaggcaugugugggcauuccuuaccucccccaccagccugaucaucaaagcaacaagggaa

SEQ ID NO: 4145161 - RNA, 68 nt, Human
uuccccauggccuguccuauuccugucugucucacacugacacguuugaaccaggauagaccagggaa

SEQ ID NO: 4145162 - RNA, 70 nt, Human
uucccccacagguuugucugauguaaugauauauucaguguuaauuaacaauagagaacccauuugggaa

SEQ ID NO: 4145163 - RNA, 79 nt, Human
uuccccuggauccuccaccaauaaagcugaugaagcuacuugcugccacuggcucaauggugcagggagccgaggggga

SEQ ID NO: 4145164 - RNA, 88 nt, Human
uucccuaacugccuaagaagacucagaaauucaccaagaaucaaagguuuucuuugaauuucugacugucuuugucacagccagggga

SEQ ID NO: 4145165 - RNA, 77 nt, Human
uucccuaucuccaaauucagucacagucugagaugccaaagguuagggcuucaacagaugaauuugggggaggagag

SEQ ID NO: 4145166 - RNA, 87 nt, Human
uucccucaguguguauuguagcuagguuuuuguagaacauagcaauguuuaaagccaaaguaguacaaccuauacauugguuuggag

SEQ ID NO: 4145167 - RNA, 57 nt, Human
uucccucuccuacucaggaaaggacuggaaacugaucuuccuggaugugagaggcaa

SEQ ID NO: 4145168 - RNA, 90 nt, Human
uucccugauuaauuaugaucagcaaagugcuucagugggagcuuagcaggagcugacauaagcacuuucuaaccauagauuucaguggaa

SEQ ID NO: 4145169 - RNA, 127 nt, Human
uucccugccugagagagcucugggcuuuuucuaagaacauaacagaagcugugugggggagaaccucaaagcugggcuagguuuguuucagaaagagcagagaguauauauguaaaagagcagggaa

SEQ ID NO: 4145170 - RNA, 72 nt, Human
uucccugcugcagaucagcugaguccuggccacucucagugacauggcccagaaguuuggaaaggcaaggaa

SEQ ID NO: 4145171 - RNA, 59 nt, Human
uucccugggacuggccugcaccucuugucgcuugcuggugcugugcccucugcugggaa

SEQ ID NO: 4145172 - RNA, 76 nt, Human
uucccugggcugacuccuuccagcagagcuagguuagcccacccagcuuugcagcugugggaggagacucagggag

SEQ ID NO: 4145173 - RNA, 55 nt, Human
uucccuuaaccguaggacagucuguggggucacaggaagucuuuucuuaggggaa

SEQ ID NO: 4145174 - RNA, 77 nt, Human
uucccuuuggcuuuaagguuuauuuagaauucaugaaguugugucugugcugaaaagcuuugaaccguuaaagggaa

SEQ ID NO: 4145175 - RNA, 86 nt, Human
uucccuuugugaauggggcucuaagacuuagaaaggggaggugaauucccugagacagugcagaguacauuuguggcaaagcggaa

SEQ ID NO: 4145176 - RNA, 66 nt, Human
uuccgcucugaccugccauguccagugcacaccauuccugcuacacagccagaagucaggguggga

SEQ ID NO: 4145177 - RNA, 55 nt, Human
uuccgcugaaaaaucuauaggcauucccaauuccuguggaguuccaucaggggag

SEQ ID NO: 4145178 - RNA, 66 nt, Human
uuccggggccuagcugcacacccuccuguccguacucaccggagagcucugcacuaggcccuggga

SEQ ID NO: 4145179 - RNA, 108 nt, Human
uuccuaaagaucaauaaguugguggucuuuaauuacuagggucguuccguguuucuccccuuccuguuucaaagacagccauauuuguccuuuucuggucuuuaggga

SEQ ID NO: 4145180 - RNA, 95 nt, Human
uuccuaaggacccagcauuugaggccuugugccucaacccuuuucgucaaagagggaaagguagugaggucacaaucgcuuuugccuuuagagaa

SEQ ID NO: 4145181 - RNA, 70 nt, Human
uuccuacuuucauggguuuucuuuaucuauaucuaauguucagcagacaagaaauacugugaaaguugaa

SEQ ID NO: 4145182 - RNA, 66 nt, Human
uuccuagacaccugcguguguaagucccaauucucaaaacggggaaugcaaggccagggucaggag

SEQ ID NO: 4145183 - RNA, 80 nt, Human
uuccuagggcuuaaaguuuucuagaauaaguuuuucauagcaaaggauuuguuugcccacaacuauuaagccacagagaa

SEQ ID NO: 4145184 - RNA, 95 nt, Human
uuugcuucuucucuaauugaaucuaagcauguuaaaauauuguuuuuccucagugaaggcagcuuaauggauugaauuagcaauacagagguaaa

SEQ ID NO: 4145185 - RNA, 93 nt, Human
uuugcuuugccucuguacauggaacaagaacucagauuuacuucuuugguacaugaaggauuaguuccaugcugucagucuaggagaagcaaa

SEQ ID NO: 4145186 - RNA, 64 nt, Human
uuugcuuuucccugucucugauuugguacuuagcacugggucauauaccacagggaagaccaaa

SEQ ID NO: 4145187 - RNA, 130 nt, Human
uuugcuuuuccuuuacucaaaaccaggaugggcauuucuuccccaagugaauuuuaacgcagcugcugcaggcugcagaauaaaaccccgcuggagaaagaugcuccauuaaaguaagauugaagccaaa

SEQ ID NO: 4145188 - RNA, 95 nt, Human
uuuggaaaagugcaguaacuugcccaagucaaccaacuguuaaaugugcaucuggauucaaauaugggccugggugacugacuuucaaguccaag

SEQ ID NO: 4145189 - RNA, 60 nt, Human
uuuggaaauaauuccaucucauuaugcauauuugcauuugguaauggaguuauuuuuaaa

SEQ ID NO: 4145190 - RNA, 70 nt, Human
uuuggaagcuucucugccagccuguaaaaggaacuucucaggcaaucaguguagaguaacaguuuucaaa

SEQ ID NO: 4145191 - RNA, 86 nt, Human
uuuggaaggcugaggcgggcgcaucaccugaggucaggaguucgagaccagccugaccaacguggugaaaccccgucucuucuaaa

SEQ ID NO: 4145192 - RNA, 75 nt, Human
uuuggaagugaauuacuccucccagcaccauuaagagauagccuugugcccugaaagaguuaauucacuuccaga

SEQ ID NO: 4145193 - RNA, 56 nt, Human
uuuggagccuugggggcuuugaggauuuccugcucuucauuucuugggguuccaag

SEQ ID NO: 4145194 - RNA, 56 nt, Human
uuuggaggaguagacacaaaccuuucaggcauuugcuuaugucuacucugacuaaa

SEQ ID NO: 4145195 - RNA, 77 nt, Human
uuuggaguccuuuuagucuccucuaaguagaagacacuuauuugaggaagaucggagggaaacugcauaacuuugaa

SEQ ID NO: 4145196 - RNA, 57 nt, Human
uuuggaugaggacuaucguuguuuugaacugaaaaggcuagaagugccucaucuaga

SEQ ID NO: 4145197 - RNA, 86 nt, Human
uuuggauuugggauuuuuucagauuugggaauaugugcauuauauaccggguugagcaucccaaaucugaaaguccaaaaucugaa

SEQ ID NO: 4145198 - RNA, 113 nt, Human
uuuggauuuuaaaauuaagaaaaugacuguguaggugauaucagcaagauggcaguauaggaauuucuagcccugauucccucacagaaacauuaauuugacaaugaaccaaa

SEQ ID NO: 4145199 - RNA, 63 nt, Human
uuuggcagaaauguggcugggagcuucauugcugauuuuuucaguuuuaauauugcuguggaa

SEQ ID NO: 4145200 - RNA, 71 nt, Human
uuuggcagagaacacacaugauucccccaaauauguuucuggaaacggaauugagucuguucugugcugag

SEQ ID NO: 4145201 - RNA, 65 nt, Human
uuuggcaggcugcuugggucaugucugcucuucaguuggacauaccuaaggcaggaccugaagaa

SEQ ID NO: 4145202 - RNA, 57 nt, Human
uuuggcauuuaauaggugaucaggaucuauuaauucucuuuuuccuuuaaugccaag

SEQ ID NO: 4145203 - RNA, 130 nt, Human
uuuggccaguuggaggcauuuaguaagagauaggaagagcuggaaaagaguaaggucacaguacuuauuccugcagcccacuuucugccagcucaccaugggucuauugagugccuguccaguggucaag

SEQ ID NO: 4145204 - RNA, 75 nt, Human
uuuggccuuugguugguaguuucuguuuccuuucccuagguaaggauuuacaaugauucuagguaagugugcaaa

SEQ ID NO: 4145205 - RNA, 59 nt, Human
uuuggcguguuauaguuggguuggguggcugugccucucccugaacaugacacaccaga

SEQ ID NO: 4145206 - RNA, 99 nt, Human
uuuggcuugagcugcuguauucaucacaggguccuucuguuccugagcaacuauugugggguuuaugagcccuggaaggaauagcaaguuagagcugga

SEQ ID NO: 4145207 - RNA, 69 nt, Human
uuuggcuuuucaggaaaucagaacucaaguggggaggcuugcuuccuacucacugguuuucuggcuggg

SEQ ID NO: 4145208 - RNA, 63 nt, Human
uuugggaaagccuuucacagggugauagaaucuauuuuauucagcucucuagaggcacucaga

SEQ ID NO: 4145209 - RNA, 59 nt, Human
uuugggaaauaguagaaaaugugauuaaaggcauacauaaucugagcuguguucccaga

SEQ ID NO: 4145210 - RNA, 127 nt, Human
uuugggaacuguccccaccccugaggccaaucugguucugaaccuucucuuccuugccuugggcagcuuugggggaggguuagcaaaggcacagaacagaaaggcccugggcugugcaggcuccaaa

SEQ ID NO: 4145211 - RNA, 75 nt, Human
uuugugagcuuaauguggaccugguuucuaguucuaauaaacauagauauggacauuucaacauuagguuucaaa

SEQ ID NO: 4145212 - RNA, 99 nt, Human
uuugugaggugaugagugcuggggagauaggaagagaguggggaccauguuucuaaucugauucuccuaccgacgaccagcucaguuguuauuuacaaa

SEQ ID NO: 4145213 - RNA, 92 nt, Human
uuugugauggaauuucaggcaggaagggaggacuuguuuugacagacagaagccugguccucugucuugucugcaacugcugccauaacaaa

SEQ ID NO: 4145214 - RNA, 130 nt, Human
uuugugcauaauuaaguaguugaugcuuuugagcugcuucuuauaaugugucucuuguguuaaggugcaucuagugcaguuagugaagcagcuuagaaucuacugcccuaaaugccccuucuggcacagg

SEQ ID NO: 4145215 - RNA, 88 nt, Human
uuugugcaugcauaugucaacugugcugguuaauaaucacauuacaaauuauuaaucauacugcaagucaaugaaaugugaguacaaa

SEQ ID NO: 4145216 - RNA, 81 nt, Human
uuugugcccuucuacccuuggcuguguugccugcccucugguagagacagcaauggcaacagcaagcaaagaaggcccaga

SEQ ID NO: 4145217 - RNA, 72 nt, Human
uuugugcucuuagucauuuuuauucuaucucuacacugauugagguuguuacaugaauacugagagcacaaa

SEQ ID NO: 4145218 - RNA, 60 nt, Human
uuugugcuggaaucuggcugccaccgcaauauccugcaggaagcaaccagguccaacaaa

SEQ ID NO: 4145219 - RNA, 73 nt, Human
uuuguggcagauguaaucugacagcuggagugaaguuacgagauuuucuaguguaguuugcaccuugagcaga

SEQ ID NO: 4145220 - RNA, 56 nt, Human
uuugugggggagaaaugugacauuuagaacaaaugucauagcauuucuucaauaaa

SEQ ID NO: 4145221 - RNA, 62 nt, Human
uuuguguaccuuguacauuuguauugucaacuucacuagcgaacagauucauggugcacaga

SEQ ID NO: 4145222 - RNA, 60 nt, Human
uuuguguucugauuuuucuacaaugaauaugaauuacuuguguggaaaaacagaagcaga

SEQ ID NO: 4145223 - RNA, 74 nt, Human
uuuguguuguguuaccauugucuaggucauuguuacuuaaguacaguacuugccauaugguauucaaguacaaa

SEQ ID NO: 4145224 - RNA, 91 nt, Human
uuuguguuuugauuuuucauuuguccaaauacuauguagggauaugauuuucuaaagacaaauauagugaccagguggaacaagggacaaa

SEQ ID NO: 4145225 - RNA, 59 nt, Human
uuuguuaggguuucagcuagccaaaaaugguauuuucauuugcugaaauucuaaacaaa

SEQ ID NO: 4145226 - RNA, 70 nt, Human
uuuguuauuucauuuugguuaugccauaaauaacacccaauuuuagcauuccugggaugauuuaggcaag

SEQ ID NO: 4145227 - RNA, 68 nt, Human
uuuguucaaauuuuccuaucuggguucuaaggaauguucuauuuucagguagaaauagauuuggcaaa

SEQ ID NO: 4145228 - RNA, 83 nt, Human
uuuguucauuuaacaaauauuuguugaguucuuaugaugugccaaacacuguucuaggagccaagaauauagaaaugaauaaa

SEQ ID NO: 4145229 - RNA, 97 nt, Human
uuuguuccuucuaaggauuccagugagggaguuggguguauaggaaggaaaucuuauuguccaaguuucccuuugaaaccucuuagaauggaauaaa

SEQ ID NO: 4145230 - RNA, 64 nt, Human
uuuguugaaugaauagguguccagaugggaggaaggucucagccccuauucaauucaaaccaaa

SEQ ID NO: 4145231 - RNA, 64 nt, Human
uuuguuguguguguauaugguaucuggaacauggaccugugauuaccagccugacaccaacaaa

SEQ ID NO: 4145232 - RNA, 64 nt, Human
uuuguuuauagauggccacaaugacagaguugcauaguugugucagaaacaucugguaagcaaa

SEQ ID NO: 4145233 - RNA, 60 nt, Human
uuuguuucaucagcuccagguuaggcaaacacaaguagcucuggccugcagugaagcaag

SEQ ID NO: 4145234 - RNA, 84 nt, Human
uuuguuucugaaugccaggcucuguguucagccuagcagaaaggccucuuauccuuuugggcucccacaggcuuguggaauaaa

SEQ ID NO: 4145235 - RNA, 55 nt, Human
uuuguuuuauuggggaaaaugauuuuuguucauguucuuuuucugauaaaacaag

SEQ ID NO: 4145236 - RNA, 88 nt, Human
uuuguuuuguuuuuaccgaguacuuaaaaauuaucaaaguggaaagcuuuuuuuacuugaauguuuugggugucuggaauaaagcaaa

SEQ ID NO: 4145237 - RNA, 55 nt, Human
uuuguuuuuggaaguccccuuaggguuucaaggccccaaggcuucaaagaguaga

SEQ ID NO: 4145238 - RNA, 129 nt, Human
uuuuaacaagaagcccuggaaagaaaugcugguuuaauaauuaguuauugaucguggcuaaugccaucgugaauaccacuggauuagucagagaccaguaaaucggagcacgggcauuucccuugucaa

SEQ ID NO: 4145239 - RNA, 64 nt, Human
uuuuaacaaggaucaacuuuuaggcaaaucauagaagacuugucuaugguuacauccuagaaga

SEQ ID NO: 4145240 - RNA, 130 nt, Human
uuuuaacuaagggaaccaaccagcugcuuauaaccauggauguauguuuuacgcuuguacaguaaaaguacaaaguaauguauaauaucgacucugacuguuaaggaaugcuuguauccagaaguuuuaa

SEQ ID NO: 4145241 - RNA, 67 nt, Human
uuuuaacuuuaccauuucuucaguuguaaaaugaugcaccaacugacagugugcccggagguuagaa

SEQ ID NO: 4145242 - RNA, 93 nt, Human
uuuuaaggacguaugaauauggaguuuacuuaguguaauauuuguguuacacccacaaaaaauuccaaauugcagauguuuuauaccuuaaag

SEQ ID NO: 4145243 - RNA, 57 nt, Human
uuuuaaggugcuuacuguguguguuguauuucauuuccacaguauucuuccuuaaaa

SEQ ID NO: 4145244 - RNA, 92 nt, Human
uuuuaaucuuauuucuccauccagagucauggcuagaauaaggaagagagacagcauuugguacugacucacaguggagaaagagguagaga

SEQ ID NO: 4145245 - RNA, 59 nt, Human
uuuuaauugcaauuauggucccuuaugaguccccugggagggcaugauugcaauuaaaa

SEQ ID NO: 4145246 - RNA, 77 nt, Human
uuuuacaagaggcuuuucuucagguaucaauagucucaucccauuuuaucgaauugcacuaggagcuucuuguagaa

SEQ ID NO: 4145247 - RNA, 66 nt, Human
uuuuacaagcugagucguuaaaacaaaugguuaaauucaucuggacuagcuccuucagcuguaaaa

SEQ ID NO: 4145248 - RNA, 64 nt, Human
uuuuacacuucgguugugugcauacacuuguguauuugauguuuuaugcaacaaaaguguaaga

SEQ ID NO: 4145249 - RNA, 75 nt, Human
uuuuacugacuuaauauagauuggcuauggaauugacccaagguuuacauuauagucuauauugugaaaguaaaa

SEQ ID NO: 4145250 - RNA, 90 nt, Human
uuuuacugucagauuucucaucaccagcuuuaacaggaaccuuuggauggaaacccugggagggagaaaucagagcugacccaaguagaa

SEQ ID NO: 4145251 - RNA, 92 nt, Human
uuuuagaagaaaagucucccuuuaagaccauuauauaugaugagauauugucuggguuauaguuaguaggucauuaaagggauugucugaaa

SEQ ID NO: 4145252 - RNA, 60 nt, Human
uuuuagaagugccuauccuaugccaaggagaggcauaggauacuauucucauuuuugaaa

SEQ ID NO: 4145253 - RNA, 78 nt, Human
uuuuagaguccuugcauaucugaaaauguuucuuccagacugugaaacaugagucugugugaaagugauucauugaga

SEQ ID NO: 4145254 - RNA, 119 nt, Human
uuuuagcacugaauaauauuccacagucuggaugcaccaaaguuguugucuuuuuuuccuccauucaccuacuaaaggacaucuugguugcuuccaaguuuuggcaauuaggacuaaag

SEQ ID NO: 4145255 - RNA, 84 nt, Human
uuuuagcagcuguuuuuccagucucuggaaggcuauugucuucucaucugaugcuggagcuggaagaguaggcaguugguaaga

SEQ ID NO: 4145256 - RNA, 80 nt, Human
aaaaaaauuauuucauugauuggcuucuauacauguuuucuugggaauaugugggugcuaaucaaaaugaugauuuuuuu

SEQ ID NO: 4145257 - RNA, 74 nt, Human
aaaaaagugugaauuuuagagucaggagauauuccagaaucauuucacucuuggcuuucucauuuaccugguuu

SEQ ID NO: 4145258 - RNA, 60 nt, Human
aaaaaccuuucauugcaaauguuugugccuggauggauuuagaauugcagaaagguuuuu

SEQ ID NO: 4145259 - RNA, 57 nt, Human
aaaaacucugugcgagcuaugagaguguaagcuuuauaguuauauacagauguuuuu

SEQ ID NO: 4145260 - RNA, 88 nt, Human
aaaaagacacagcuaaguuuagagagaauggggacaggcacuaggaguuuccaaguuuucuuugagcucacacauagauugccuuuuu

SEQ ID NO: 4145261 - RNA, 92 nt, Human
aaaaagcagcauguacuuggauaagacaaaccuagggcuuccuucgaguuaaggaacagucuuggaagucuuguuauaguuaaugguuuuuu

SEQ ID NO: 4145262 - RNA, 125 nt, Human
aaaaagucuaaacuaugugaaggaagugguuuuacaaagagaaagaucaauugccuacacaauucaaauuuucuagugaauuuuuuaauuugugguuuacuuuauucauuuuggaguuacuuuuu

SEQ ID NO: 4145263 - RNA, 78 nt, Human
aaaaagucugauuuauguuaggagaauuuagcuugcccuuuggucucucaguuuuuaaaugauauaauuagacuuuuu

SEQ ID NO: 4145264 - RNA, 57 nt, Human
aaaaaucuuggagauuuaugugggaaauaacaucuacugaacauccauaagauuuuu

SEQ ID NO: 4145265 - RNA, 64 nt, Human
aaaaauuaggccagaggagcagcuuuggaguuuauuuucuccaagguuuucuggcacuauuuuu

SEQ ID NO: 4145266 - RNA, 99 nt, Human
aaaacacaaauagaaagcuucaaauuaguggaauaauaaugaucaaugaaacugaaaauauuacugaauuauuaauuuguguugugucuguuuuguuuu

SEQ ID NO: 4145267 - RNA, 80 nt, Human
aaaacagaggugccugggcccauccuagaucaauuaacucaaagucucugcaguuggagcccagacacuggcauuguuuu

SEQ ID NO: 4145268 - RNA, 69 nt, Human
aaaacaugcuggauuuagaauauaaccaacaaccuaacuaggucaugagauguucugagucaauguuuu

SEQ ID NO: 4145269 - RNA, 130 nt, Human
aaaacauguauaggagaaucuaaauaaaaguuacuuggaugaaaaaugagaauuuucccucugaagcagaacuagagagaagacguguuucauucauuuguucuuugauucauucauuuauucaacagcu

SEQ ID NO: 4145270 - RNA, 65 nt, Human
aaaaccacuuccuugcuauugggcuguugcaaaagauaauagauaauaguuucagaaguuguuuu

SEQ ID NO: 4145271 - RNA, 104 nt, Human
aaaaccagaaccaaguuaauuagguuuacugaauuaguggaacaucuaaauuggauuccauuccgcuguuuaguugaaguuuaucuuagcuuggagcugauuuu

SEQ ID NO: 4145272 - RNA, 59 nt, Human
aaaaccagaaucaguaucucccacacucacaacugaguucuggaugugauuuugguuuu

SEQ ID NO: 4145273 - RNA, 129 nt, Human
aaaacuaaaggguggaguauccagaacuuuggguagaacuuucagaaauuccaaagaaagacugacauucuuuggguacucgaaaaguugaacugagaugcuucuggaaacuuaauuucauuauuauuu

SEQ ID NO: 4145274 - RNA, 114 nt, Human
aaaacuacugaauuuugauauuuccagcucuuuauugccaauauucuugggugauaaacuugggaaagcccauugacaaagaagugauuguauuaaaaggaaacagaaaguuuu

SEQ ID NO: 4145275 - RNA, 88 nt, Human
aaaacucuauugcuauuauucuguugcuuuuacaguauguaguauauuauguuuacuggaagaaaaaauggaaaaacaauggaguuuu

SEQ ID NO: 4145276 - RNA, 56 nt, Human
aaaacugaaauacgauccaauggcagauccgccugcaaggaaggugauucaguuuu

SEQ ID NO: 4145277 - RNA, 62 nt, Human
aaaacugacuucuugaaauggaaggccgauguguguucccauguuaccaaggagucacuuuu

SEQ ID NO: 4145278 - RNA, 68 nt, Human
aaaacugggcagcuguaucagggagugugacuuuguaccauauucucuuuuuauaccuguucauuuuu

SEQ ID NO: 4145279 - RNA, 76 nt, Human
aaaagaaaaaaaauucuggcaaaauucacaagaaauggcaaauuagugaauuguugcccauguuuuuauuucuuuu

SEQ ID NO: 4145280 - RNA, 129 nt, Human
aaaagaaaacuuuccaaaucuaaaguauucguucucaaagucgaccaagaggaaucaguuacauacuaugacugcauucauuugguuggcauugucauacuuacuuaugauugaugauaaaucucuuuu

SEQ ID NO: 4145281 - RNA, 129 nt, Human
aaaagaaacagaugaggaaagaguagcaaaaucaagacugucccaggaagugagugucagucaaagguuuugaaaucccucaaauaguuacuucugcugucuugguuuuguccaccucccuucuuuuuu

SEQ ID NO: 4145282 - RNA, 92 nt, Human
aaaagacggacaagcagaaguaauagccuaauagucacccauaaucccaccauggggagauaacaugguuaguguuuuuaugucuguguuuu

SEQ ID NO: 4145283 - RNA, 74 nt, Human
aaaagaucaugcuacgaauggugauggaguccagucacacccgucucucuccagagucaucgagcauuccuuuu

SEQ ID NO: 4145284 - RNA, 80 nt, Human
aaaagauuaaugauguuguagauugugugcugacaaauuggagccuccaaugcacauaacugaccacaucuaaaacuuuu

SEQ ID NO: 4145285 - RNA, 91 nt, Human
aaaagauuuuaucuggaagaauauggaaguuaccugacuucagccauggcuggaucuagggguuuucauaauuuuauugggauucucuuuu

SEQ ID NO: 4145286 - RNA, 77 nt, Human
aaaagcacucguuaguauuucugcaaacccaaggauuugguacuccuggcaaagcagggcuauuuggagguguuuuu

SEQ ID NO: 4145287 - RNA, 85 nt, Human
aaaaggggaucaguaagugaauaaugaguaaagcugucuaauauaaacaauuauaaucauuauuuucuuguauugacuaccuuuu

SEQ ID NO: 4145288 - RNA, 55 nt, Human
aaaagucugcucucauuucagauggacaaguaaaucagaaagaagguagauuuuu

SEQ ID NO: 4145289 - RNA, 78 nt, Human
aaaaguuacacgacuauuuaugugacauggagucguauuaguagugacgugcccacauaaauagcacugugaauuuuu

SEQ ID NO: 4145290 - RNA, 63 nt, Human
aaaaguuacaguuggaacugugaaaaaguggauacgcuuauuuuacaccaccuagucauuuuu

SEQ ID NO: 4145291 - RNA, 56 nt, Human
aaaggggaucgaugcacucuggggccagagacccugagcugcaccuugaccuguuu

SEQ ID NO: 4145292 - RNA, 77 nt, Human
aaaggguagagguuugauauguggaauauuuaucucagauuauugagauggagaaugacaauuaagguuuuccuuuu

SEQ ID NO: 4145293 - RNA, 60 nt, Human
aaaggguugcagcauagaaguuuccaggcaaauuggugauugaaugcuugcuaacacuuu

SEQ ID NO: 4145294 - RNA, 93 nt, Human
aaagguaaagguuauaaagguuaggggaaagggaagaauugagcaugaaccccaggcuucuagccuugaugacugggagagugagaugccuuu

SEQ ID NO: 4145295 - RNA, 130 nt, Human
aaagguaagggcagggcugugggcaggaugagggguaaaggcguauugggagugggauggggagacucuaacgccauuccacauaggccuucaugacaccugcuuggguuagccgcuaaccccauuccuu

SEQ ID NO: 4145296 - RNA, 57 nt, Human
aaagguaguacuucuagaagggaggcgaucagaguccaauuaggagauauuacuuuu

SEQ ID NO: 4145297 - RNA, 77 nt, Human
aaagguauaaguucaucuuuuuuugcauguggauauucaauuggaccagugaccauuuguugaaaagauuauccuuu

SEQ ID NO: 4145298 - RNA, 59 nt, Human
aaaggucccuugucggagggggaugggaggaauucauuauuuugucagaagggacuuuu

SEQ ID NO: 4145299 - RNA, 65 nt, Human
aaagguggugaguacaguuagguguggcaauuaaugagccaccaucugcugaaacaucacacuuu

SEQ ID NO: 4145300 - RNA, 62 nt, Human
aaagguuuauuuguugcucacaucuugacccaguacaggucagcugagcagaguaaggcuuu

SEQ ID NO: 4145301 - RNA, 55 nt, Human
aaagguuuuauucugagcucugggcccauauuccaauugcuuuguggaagccuuu

SEQ ID NO: 4145302 - RNA, 58 nt, Human
aaaguaauuggcaggauucagucucugguuguuacagauucuaaguccuaguuauuuu

SEQ ID NO: 4145303 - RNA, 87 nt, Human
aaaguaguggcagagucaauaauuuuauggagagaauugggaauuuugaauccucucccuuuguuguuucaagaaaugcacugcuuu

SEQ ID NO: 4145304 - RNA, 129 nt, Human
aaaguauugcacugaaaauaacacacuugaggggaaagauuauggguugaagcagcaagucuauggaucacaucacuguucugccaacuuugguuaccaaauuaggugaguucaauucaacaaaucuuu

SEQ ID NO: 4145305 - RNA, 81 nt, Human
aaagucacaguuagaaagugucugcuuggguccugaaucuaucuaauuccuagcccagugccuauucuacacauugacuuu

SEQ ID NO: 4145306 - RNA, 55 nt, Human
aaagucacgcugaugggaaauggcaacaucaggauucccacccaagugugucuuu

SEQ ID NO: 4145307 - RNA, 55 nt, Human
aaagucagaaauuguguaaagugguagcccauucaacuuugcauuuccugauuuu

SEQ ID NO: 4145308 - RNA, 55 nt, Human
aaagucauugcuguuaucaaugcugcacaucuccagaguggcagccuuuggcuuu

SEQ ID NO: 4145309 - RNA, 62 nt, Human
aaagucccuugugccauguaagaugauuuaugcacagguucuggcauuuguacagggacuuu

SEQ ID NO: 4145310 - RNA, 90 nt, Human
aaagucuagcuaaaaucagugcuguaaacaaaaggaaacauuuacguuuguuucuguuugccauauauaguagccuugauuuuuuacuuu

SEQ ID NO: 4145311 - RNA, 104 nt, Human
aaagucuuuguaauugggcuaagugugcuuucaugaugauucuauucuccccaaggaagaaucauccugcaagagucuccucagccauuaugcaaacagauuuu

SEQ ID NO: 4145312 - RNA, 74 nt, Human
aaagugaagagaugauggcagccagagggccagaaccuucucaggccacuuggaggaugccgcauucugacuuu

SEQ ID NO: 4145313 - RNA, 115 nt, Human
aaagugauacugaaagaagaaguuucugcucaugguauacagacuugcuaagauauuuagugccaccuuccaaguaucaugagcaaaaacauuguucuucuucuaggacuacuuu

SEQ ID NO: 4145314 - RNA, 58 nt, Human
aaagugauuuagucuuauaaaggggaucauuucacgaccucaaagucugagucacuuu

SEQ ID NO: 4145315 - RNA, 65 nt, Human
aaagugcaucaaaugacuucccccaccuuucccaugaauuagggugaaacuguuuggggcauuuu

SEQ ID NO: 4145316 - RNA, 69 nt, Human
aaagugcugggauuacaagugugagccacugugcccagcucacaccuauaaucccagucccagcauuuu

SEQ ID NO: 4145317 - RNA, 55 nt, Human
aaagugcugggauuacagacgugagccaccacgccuggccuaucauaagcauuuu

SEQ ID NO: 4145318 - RNA, 79 nt, Human
aaagugugagcuggaaagguaggauuucaagaccagcugagucuauaagaggucaucaaaucuaccugcuccccacuuu

SEQ ID NO: 4145319 - RNA, 55 nt, Human
aaaguuaagaaagggaugcuuaagggcucuuuggagcauccaugacuuuggcuuu

SEQ ID NO: 4145320 - RNA, 56 nt, Human
aacacauauuuuugcugagcaugguucugaaaaccacagaagcaaaaguagguguu

SEQ ID NO: 4145321 - RNA, 130 nt, Human
aacaccccaugaauuaugaaguuuuccagucuggcugguaggaauaggcacaauucccagacuugugugagugcuggguacuguucccauuaacacuuucaggugguucuuuuccuaacuuuggguuguu

SEQ ID NO: 4145322 - RNA, 57 nt, Human
aacacugcugcuggguucuguguguuugugccucacauaggauuccagaacacuguu

SEQ ID NO: 4145323 - RNA, 80 nt, Human
aacacuuacuugugcaucugagauuuuaaauaauaugguauucuggaauguuugaagcuccgguguauaggaaugguguu

SEQ ID NO: 4145324 - RNA, 66 nt, Human
aacacuucucaucacugcaagccauagcuuuaaauggcggugaggucugcaguuguagaagauguu

SEQ ID NO: 4145325 - RNA, 56 nt, Human
aacacuuuggaugcagaaccaagacaauuuccauuugguaugcaucccaagguguu

SEQ ID NO: 4145326 - RNA, 64 nt, Human
aacagaaaauuuccguugcccagguguuggguuuaucaccuggaagauaugcugauucucuguu

SEQ ID NO: 4145327 - RNA, 64 nt, Human
aacagaaagaggaugcagaucucauuuuuauuuggaggaugcagaucacauuuuucugucuguu

SEQ ID NO: 4145328 - RNA, 57 nt, Human
aacagaaaugagcgugucugggccuauacaaagaaccccagaagcacucuucauguu

SEQ ID NO: 4145329 - RNA, 79 nt, Human
aacagaacccgagugugaaucuuucaccacuggauuugcguuuccuccauaaaacuucaugcuuaacaggguuucuguu

SEQ ID NO: 4145330 - RNA, 64 nt, Human
aacagacagaaaaaugugaucugcauccuccaaauaaaaaugagaucugcauccucuuucuguu

SEQ ID NO: 4145331 - RNA, 67 nt, Human
aacagagcugguaagugguagaggccuaaauucaacucuagaaaucugugcuuucaaccagucuguu

SEQ ID NO: 4145332 - RNA, 130 nt, Human
aacagauaaugaauuauugucagccuacucuccuccagcugugcaagacgccauagacucugucuucaugcaccucacagcuaggugggagugcugggaaauaaacguaaaaauaaauuauuugucauuu

SEQ ID NO: 4145333 - RNA, 77 nt, Human
aacaggaauaguggagcaacaagauagauugacacugucaaauccucaugccuaucuuugguugacuacauccuguu

SEQ ID NO: 4145334 - RNA, 76 nt, Human
aacaggcggaagcaagucccacccugcccuuccaggggauggggcccggcugggcagaggggcgcuucccucuguu

SEQ ID NO: 4145335 - RNA, 55 nt, Human
aacaggcuaaauuguccauuucuccagcaguuuugaggcagacaaggagucuguu

SEQ ID NO: 4145336 - RNA, 78 nt, Human
aacagggagaacugccuucugcucaggguucagucaccggacugagggcccaagcaaggcgggcucacguccucuguu

SEQ ID NO: 4145337 - RNA, 87 nt, Human
aacagggcagguuggaugcuguagugaugacaaaguuaaaggaaagucacucuucaguucagcaucagacagccaaauugcucuguu

SEQ ID NO: 4145338 - RNA, 88 nt, Human
aacaguaaaagagacaguuacuuaaguuugcuuuguaaauaacuuaaauuuuacaaggaaaaucuugaaguacagaauucuuacuguu

SEQ ID NO: 4145339 - RNA, 55 nt, Human
aacaguacauaaugcgcaaaaccgggucugaucgugguggaguguuauguguguu

SEQ ID NO: 4145340 - RNA, 60 nt, Human
aacaguggucuggggaguggagguggcuagauugaauguccuccagaaaagaccucuguu

SEQ ID NO: 4145341 - RNA, 57 nt, Human
aacauaggucugagagcauccugguuaagaggaaccuggcuucuuuacaucuguguu

SEQ ID NO: 4145342 - RNA, 62 nt, Human
aacauauaaacucuuaaguucagagacguaaguucauggaacuuuuagaguuuaacaguguu

SEQ ID NO: 4145343 - RNA, 85 nt, Human
aacauaugacaucauuacaaaggacagcagaaaaauaauuggaauuauauuguugugagguucuuauauguggugguguaauguu

SEQ ID NO: 4145344 - RNA, 64 nt, Human
aacaucagagccauuuaaagucaguuuuugccgcuuaagaacacuuuuaaauggcuuguaaguu

SEQ ID NO: 4145345 - RNA, 89 nt, Human
aacaucaggaucugcaaauaggggugugaauaaggacgaaucgauaggcucuaauuuauggcauauuccucauuguagaguucucuguu

SEQ ID NO: 4145346 - RNA, 72 nt, Human
aacaucauagacacaucaaggaucaguuuugccagcuggcaaggacuggaaaagguguaguguguguguguu

SEQ ID NO: 4145347 - RNA, 65 nt, Human
aacaucuaguaauucaguuuucagaucguuacgaguuugaguuuuaccuguauuacuggcauguu

SEQ ID NO: 4145348 - RNA, 55 nt, Human
aacaucucucucacuucuuuucuguugacuucaauauggcaguggagggguaguu

SEQ ID NO: 4145349 - RNA, 62 nt, Human
aacaucugggcccugauuuugggcauccucacgaccauucugcucaucgucaucccaguguu

SEQ ID NO: 4145350 - RNA, 67 nt, Human
aacaucuugucuaaugucagcuaccaccaccucaauggggcacaccuuuggcauuuagacaagaguu

SEQ ID NO: 4145351 - RNA, 62 nt, Human
aacaugaaaguugcuaagugcagugaagguucucccugcuccuuucauccaauucucauguu

SEQ ID NO: 4145352 - RNA, 55 nt, Human
aacaugagauguucaguuacuguggaagagcuuccacagaauauacauuuuaguu

SEQ ID NO: 4145353 - RNA, 77 nt, Human
aacaugagguauaguucuauuagaugacauccugguggcuuuauucauuuagugcuauacuaaggauuucucauguu

SEQ ID NO: 4145354 - RNA, 62 nt, Human
aacaugauguauuuucuugucuguggguuguuggcuuccaaagucauggaaaacaucauguu

SEQ ID NO: 4145355 - RNA, 128 nt, Human
aacaugcaggaggcaaugggaacaaacuacggggaaauagagcuggaaccuugaucaggcugcaccugaagacugauuuuccacuaggcuuuuccauauacaguuguuccuuauuauuccuuuuuguu

SEQ ID NO: 4145356 - RNA, 65 nt, Human
aacauggaggcagacagacguggguucaaauuccaagucuguuccacguucgucugucccauguu

SEQ ID NO: 4145357 - RNA, 70 nt, Human
aacauucaaguucugguuuaugggacucagugagcuucuuuuggauaaauauggacuauagcuuguuguu

SEQ ID NO: 4145358 - RNA, 116 nt, Human
aacauuccugagaucucagggaaacggucacccauguuuuaguuuugucucauacuauauaaauuagaagcaaaguaaauuucugcauguguacuccccugagaccagacaauguu

SEQ ID NO: 4145359 - RNA, 61 nt, Human
aacauucuuuagcucuuccugcacuuccucaccguguaggcuccaugauggcagagauguu

SEQ ID NO: 4145360 - RNA, 85 nt, Human
aacauuuauuucucugggucuuuacuagauuucacauaaacacacacugaaaacauuagagaugcccuagcugaaguacuguguu

SEQ ID NO: 4145361 - RNA, 66 nt, Human
aacauuucauaacuugacuuuucucuggacuauauuccaaugagauuuucauguggugcagauguu

SEQ ID NO: 4145362 - RNA, 74 nt, Human
aacauuuccuuuggucuugaugaacuguuaggucaguuuaccucaaacuguuuuuuggccuaaggaaaucuguu

SEQ ID NO: 4145363 - RNA, 85 nt, Human
aacauuuugaauauagcagaggcaaggaugugaauguuugcuuggcgcuauuuaucaggaagugcuucugcuuguuuauuauguu

SEQ ID NO: 4145364 - RNA, 59 nt, Human
aaccacaugaaaagaguaauauguguuuauagaguauauauauauguaugcgugugguu

SEQ ID NO: 4145365 - RNA, 66 nt, Human
aaccagacauggaaauuuaguguuacgagcuaaauugugaccucccaaaauuccuauguugacguu

SEQ ID NO: 4145366 - RNA, 109 nt, Human
aaccagaccuuuuuuuuuguugagcauuauauuauaaaagacgugaaucauaacuucaaauguguuucugagaguuguaguguauccacucucaaagugucguuugguu

SEQ ID NO: 4145367 - RNA, 66 nt, Human
aagaaucuaugguacauccaagaggucggcaaauagucaaauuaucuggauguaucuggaugucuu

SEQ ID NO: 4145368 - RNA, 69 nt, Human
aagaaugccaauaagacacacaacugucaaggggaacaaacacuucugcuugcuggucaggguauucuu

SEQ ID NO: 4145369 - RNA, 74 nt, Human
aagaauguaagaguacuuuaguaggcaaauuaaaaauguuuaauuucuagggacuaaggugcuauaacuuucuu

SEQ ID NO: 4145370 - RNA, 77 nt, Human
aagaaugugauuuguuuauaguuauaagaaaacguugaauuuuuuuuagcaaaacauuaugucugugacacauucuu

SEQ ID NO: 4145371 - RNA, 63 nt, Human
aagacagagaaagggugaauuccuucucccuucuggagcagggcuauuucuuuuucugcucuu

SEQ ID NO: 4145372 - RNA, 57 nt, Human
aagacagagugcccaaggaguuuggucccucccugggguuccuggcucuucuguuuu

SEQ ID NO: 4145373 - RNA, 60 nt, Human
aagacaggcucggcacuagccucagccccucccuaugcugaggaagccaaaggcugucuu

SEQ ID NO: 4145374 - RNA, 103 nt, Human
aagacagucuaggaggaggaggagguagggugugaaacagccaggcucucuccaaaucccaaguguugacacagccaucuugucccaucccuggaagccucuu

SEQ ID NO: 4145375 - RNA, 78 nt, Human
aagacauuuauggcuguguuacccaaggucaggaaaauguuaaaaccuccuuggcuaguacuggccagcuugugucuu

SEQ ID NO: 4145376 - RNA, 56 nt, Human
aacagagcuggugacuccagguagccauagcaacugugagguaacgcugcucuguu

SEQ ID NO: 4145377 - RNA, 77 nt, Human
aacagaguggauguggcacaugcugcugcuucugggcgcaaguuuuaagagccauugugcauaccaccagcucuguu

SEQ ID NO: 4145378 - RNA, 57 nt, Human
aacagcacauaagccgaagacuguguguguguguugcacagguacauuauggcuguu

SEQ ID NO: 4145379 - RNA, 72 nt, Human
aacagcacuuuugauauccuauacaaguaaaggaaccccucuauuuguucucaggaucauccuaggucuguu

SEQ ID NO: 4145380 - RNA, 62 nt, Human
aacagcagggggaccugcuggucaccagauuuguccacccccgugcaggugccacugcuguu

SEQ ID NO: 4145381 - RNA, 81 nt, Human
aacagcuguucugcagagaagcaauugggaaguucuggucucugccaauauuuucuaaguguguuucauaggacacuaguu

SEQ ID NO: 4145382 - RNA, 64 nt, Human
aacagcuguuggccagaauccaggaggucaaaacuggccagcuguaucuuuggccagcaguguu

SEQ ID NO: 4145383 - RNA, 80 nt, Human
aacaggauugaauugaguucuacauaaccugcucuauuuuagccugucaacuguguauaacucuuaauucauuagcuguu

SEQ ID NO: 4145384 - RNA, 93 nt, Human
aacaggcaccucugaaguuauauauguugaaaauuuaugagcagggacaguagaaccuacacuauuuuggaauaugugacuuuccucccuguu

SEQ ID NO: 4145385 - RNA, 73 nt, Human
aacagguuuaaugauggucauggcaacuuuuuggcacagugaaaaauaucgcccaugaucaacguguucuguu

SEQ ID NO: 4145386 - RNA, 80 nt, Human
aacaguaaaagcauccagaugggccagggguuuguucauguacuuacagaacaucuagguucucaucgauauuuucuguu

SEQ ID NO: 4145387 - RNA, 96 nt, Human
aacaguaauguaccagccuggcucaguuaggucagaaacagaucaaaaagcagaaaagucggcuguuuccuaacugagcugcuuugcuuagcuguu

SEQ ID NO: 4145388 - RNA, 84 nt, Human
aacaguaggccauaaacaugcauuacaauugcauaguauuauugauauuauugucaggugauguguguaggagucucaauuguu

SEQ ID NO: 4145389 - RNA, 65 nt, Human
aacaguaggguacagcccuggauucgcacugugaguucagauccuggcucugccacucauuuguu

SEQ ID NO: 4145390 - RNA, 55 nt, Human
aacagucuuccuacggccauuaucauaugaagugugguggaaaguaaagaguguu

SEQ ID NO: 4145391 - RNA, 82 nt, Human
aacagugagccacugcuguguacuggcugugcugcuaggaucuggggcugagccaugggcacugcagaguagcuuuccuguu

SEQ ID NO: 4145392 - RNA, 56 nt, Human
aacaguuggaagggccuggaucuuuagcucugggucuuuggacuuuccaauuuguu

SEQ ID NO: 4145393 - RNA, 76 nt, Human
aacaguugucaccagcugcuccucaggaacugcuugacuucuuagcaaaucuuuaagaucacuuggugagauuguu

SEQ ID NO: 4145394 - RNA, 76 nt, Human
aacauauaaguuucccuuaaauuauggcaucuauuugguaaacaguauagaauaaucugaggaaaugcuauguguu

SEQ ID NO: 4145395 - RNA, 57 nt, Human
aacauauuugguuaacugcugagucaacuuucuguuuagaucuuaggcaaauguguu

SEQ ID NO: 4145396 - RNA, 58 nt, Human
aacaucaagccauaauggcagccaguggcuagauauacugggcuguuacuugacuguu

SEQ ID NO: 4145397 - RNA, 62 nt, Human
aacauccauguuuuuaagauuuuaucuuagguaaguagaauugguuggggaauguggaaguu

SEQ ID NO: 4145398 - RNA, 76 nt, Human
aacaucucaagucaaaccuugcucacaggagggaauaaacccaucaggagcaacaucuuugaaucaugaguauguu

SEQ ID NO: 4145399 - RNA, 65 nt, Human
aacaugagcauucuugugcuugcuuccuggugcuaggucauaaagaaugagaauguucaacuguu

SEQ ID NO: 4145400 - RNA, 66 nt, Human
aacaugaggcucucaggggagcuguauugguaaaugauggucucuccacaggggcaucucguuguu

SEQ ID NO: 4145401 - RNA, 59 nt, Human
aacaugcccgcuguaugccauuccuacuggacaggaguccucgcugucagcugcauguu

SEQ ID NO: 4145402 - RNA, 91 nt, Human
aacaugcuauuggagugauuaaagcuaggauaaaauggauuugaaucaauuuuuauaauaguuugguuuucagauuacccaguuucauguu

SEQ ID NO: 4145403 - RNA, 103 nt, Human
aacauuauauucuucagucagggccgcauugguggacaugugguagcuaucauucuguaugcuacacucaaucagugcuauuaggcagacugaaauaucuguu

SEQ ID NO: 4145404 - RNA, 105 nt, Human
aacauuauuauuacuuaacagcuuuuaugggaccagccauuccugagauuaaaugagaaacuaaagugagucccugguuagaagguugugaucuaauacauugcu

SEQ ID NO: 4145405 - RNA, 59 nt, Human
aacauugagcugguggagaggaguauaaacaucaucccuuccaucacuuugcuuauguu

SEQ ID NO: 4145406 - RNA, 107 nt, Human
aacauuggguucuuuuguguucuaccuucaaaacaaucuguuugcauuugaaauauaaguguuuaagcuuuuuaggaguuaguguaauaagagaaugugaauauguu

SEQ ID NO: 4145407 - RNA, 58 nt, Human
aacauuguuuugcacaacucuucauaaagaaagaguuuuaauggugccagacacuguu

SEQ ID NO: 4145408 - RNA, 88 nt, Human
aacauuuagaccgacauguuuauuauuuuauguaauguauuuauauagaguuggugugcuuaaaguaguggauuguuauugaaauguu

SEQ ID NO: 4145409 - RNA, 58 nt, Human
aacauuugugaaguacuuagauuaugccagaacgugcuauauacuuuucacagauguu

SEQ ID NO: 4145410 - RNA, 67 nt, Human
aacauuuuuuagagucccacauuuccuuauuuauacuguguuugaauguacggcuuuggauaguguu

SEQ ID NO: 4145411 - RNA, 82 nt, Human
aaccaauugaguguaagauagccuuggguuauuuuaaaugaguuaaggaagcccaagucucaucuucaguaccauauugguu

SEQ ID NO: 4145412 - RNA, 59 nt, Human
aaccacaaugugaagaaggaggugcuccugauugggcuucuuuucucagcuuugugguu

SEQ ID NO: 4145413 - RNA, 62 nt, Human
aaccacacuggcuagugaagaagcaggagcuucuuguuuuaauugcucaccaaugguugguu

SEQ ID NO: 4145414 - RNA, 63 nt, Human
aaccacaugaaauugcuuauauuugaccauuuuugacugaacaagugguaauuuuaugugguu

SEQ ID NO: 4145415 - RNA, 78 nt, Human
aaccaccgcauccccgccccuuuuugucgaccacuuacaggcccuuugaggucguggagagcaggggaugcgggcguu

SEQ ID NO: 4145416 - RNA, 64 nt, Human
aaccacuuuaauuagcucaugauucuguguauuaucaauuuguguugggcucauucaggugguu

SEQ ID NO: 4145417 - RNA, 63 nt, Human
aaccagaagcuuccuacauuguucuuuccuguacaauuggcuuaaagaagagguuuucugguu

SEQ ID NO: 4145418 - RNA, 62 nt, Human
aaccagccaagacuugcauguccaugcccauggaggcaggcccagcaacuuuggacugaguu

SEQ ID NO: 4145419 - RNA, 62 nt, Human
aaccaggagauuaaagaaaggugccauagaauaccuauuuaccuuucuugaucuuucugguu

SEQ ID NO: 4145420 - RNA, 86 nt, Human
aaccaugaaaugacauuaucugagaguguccuacaacuucagcuguuguaauuucacaccucaugguggccucugauuucaagguu

SEQ ID NO: 4145421 - RNA, 76 nt, Human
aaccaugccugaaaaucaagguaguuugguggucuaaggauagccaggaaauuaaugauauuucagguucagaguu

SEQ ID NO: 4145422 - RNA, 129 nt, Human
aaccauuucucgaugauuucagagccuucauucugagcaucaguuauaugcucuccaguguaaugacuuuauagccaagcacaguaauugauauuacugugaaggcccuuaacuuaucaagaaaugguu

SEQ ID NO: 4145423 - RNA, 75 nt, Human
aaccauuuuaaggcaaggggcauguacuuuguaaaccuuuuguuacauauugccaaauugcccuauaaaugaguu

SEQ ID NO: 4145424 - RNA, 63 nt, Human
aacccaacauuagcuuauuguaaggugaaaccugagcaaagguccuggggcuagugguggguu

SEQ ID NO: 4145425 - RNA, 74 nt, Human
aacccaccuaauauaugaugguggauuagauuaauaaauuagugcaauuucaaugcacucaugguugguggguu

SEQ ID NO: 4145426 - RNA, 130 nt, Human
aacccagauuuccucacucccagcccagugcuuuccccccgugcuacauucauucuuuaaucauccauugacaggauggauucuguaugugggauggaagguaaucacacacaguguggcuucagaggcu

SEQ ID NO: 4145427 - RNA, 62 nt, Human
aacccaggccuugaccucauuuucauaaauuccaaauuuagugagguccauguuaauggguu

SEQ ID NO: 4145428 - RNA, 67 nt, Human
aacccagggaaguguccagucccaaguuccagcuuugccuggagccacuuugcaucuaccuuggguu

SEQ ID NO: 4145429 - RNA, 63 nt, Human
aacccauaugugaccuucuuuauccagcaguguuuuuacugcagggucucugcaaaugagguu

SEQ ID NO: 4145430 - RNA, 119 nt, Human
aacccauugccuucaggugagacuucaugcagaagagagcuguuucuuuucuuucuccaaaccuucucagagacaugauuuauggacuuucuuuuucaaagcauuucaggcaggagguu

SEQ ID NO: 4145431 - RNA, 59 nt, Human
aaccccaggagcgcgugaacaggcugcuggcacggcgcaccguccgcugcuccgagguu

SEQ ID NO: 4145432 - RNA, 65 nt, Human
aaccccaguacugugacucagugagggcccaguuaggagauuacaagacacagugcugaaggguu

SEQ ID NO: 4145433 - RNA, 129 nt, Human
aaccccuagagaacuugguauguggccuugagagucuuugaacuucuccauucugaugcugaagcggcaucccagaacuugggaagcuuccaucccaacguccauacaaaugcuacuuuucuuucuuuu

SEQ ID NO: 4145434 - RNA, 77 nt, Human
aaccccuagcuucugggaguguuuacuacaaagauucacacuuguagaaggcuccucucagaaaugucuaggagguu

SEQ ID NO: 4145435 - RNA, 78 nt, Human
aaccccugccuuccacaaacacauccugagcacuguguuuggacagugcuuaggacgcauuuguggaaggcagggguu

SEQ ID NO: 4145436 - RNA, 70 nt, Human
aacccucaaucuggguaacaaggaagcuaagguaaucuuuggccuucucauuugcuuauuuguggggguu

SEQ ID NO: 4145437 - RNA, 86 nt, Human
aaccuacuagauugcagaugcauaggucaggccuaggggucuugcuugcuugccugugucugaccaugcacaugcacuuguauguu

SEQ ID NO: 4145438 - RNA, 78 nt, Human
aaccuauaaguaauaucagaugacaucuucuaugggguuauuuuagcagggauaucaucugacaucuucuauaagguu

SEQ ID NO: 4145439 - RNA, 112 nt, Human
aaccuauugaaucaggacaaggugaugguucugcuccuguggcaaucuaggucucagaaucugguaugcaggcaggguguaaagagcagauugcauuuucaagagaaagguu

SEQ ID NO: 4145440 - RNA, 96 nt, Human
aaccucugggccaagaggugaaguuaaaaaccagucucuggcuguuucagagaguuacuacuccaccugcuuguaaaauucugucucuuugagguu

SEQ ID NO: 4145441 - RNA, 67 nt, Human
aaauuggaagcugucauuuuuuaaaacaguaagucaaugaguuacaugugugacaguaucacuguuu

SEQ ID NO: 4145442 - RNA, 109 nt, Human
aaauugugggugucgauaaauguuuacuguuguuucaaaccacucaguuuuggaguaauuuauuaugcagcaauagauaaaacauuuaccaguuuaucacauacaguuu

SEQ ID NO: 4145443 - RNA, 130 nt, Human
aaauuucaggggagauauguguaauauuuauauuuaauacugcuaugagaauagauauacauuuauuaguuugucaguguaacucuuauagcagcuguggaagggaggaggcguauauauuuuccuugau

SEQ ID NO: 4145444 - RNA, 76 nt, Human
aaauuucccugaaggcauauauucuaaacaggacagcaagaaucugucuuuaaauaaaguguuuugagggcgguuu

SEQ ID NO: 4145445 - RNA, 57 nt, Human
aaauuucuugaggcucucuagcucuggucaaauuaucaucagaguuuuaagaaauuu

SEQ ID NO: 4145446 - RNA, 129 nt, Human
aaauuuuaauuaaggagaaguauuguaaaacagaacagaauagauuauacuugaagcauuugguauuuuugguguauaauuuauugaaugggcuguaauaauuuagaauauuucugcccgugguuuuuu

SEQ ID NO: 4145447 - RNA, 91 nt, Human
aaauuuuuuguuagcuacaguuauaugugauaaguaauuucuuugauguuaagagauggacugaucuuuauguguagaugauaagauauuu

SEQ ID NO: 4145448 - RNA, 87 nt, Human
aacaaacaaaaaccuucacuguuggcuuugcuugucuuggagauuucaagggccuacagaaggcagcagugagaaauuuuggcuguu

SEQ ID NO: 4145449 - RNA, 59 nt, Human
aacaaagaugccaaaaggaagacagauuuucaucugugauuucaaagggugucuuuguu

SEQ ID NO: 4145450 - RNA, 87 nt, Human
aacaagccaaccccauaccuuucucaagcacaugugcacauugacacaugucaauugcagacaggccuugugggguuuccauuuguu

SEQ ID NO: 4145451 - RNA, 106 nt, Human
aacaagcuucuaggagucaggacuuaagcucuuuguaguucuacuuuauauccuuugaaucuguggcagaaggcuaagguguccaccugaaguuugaagucuuguu

SEQ ID NO: 4145452 - RNA, 59 nt, Human
aacaaguucuaagugucuacuuugacagacaggauuaaaaguaggugcucauauuuguu

SEQ ID NO: 4145453 - RNA, 69 nt, Human
aacaauaacuagacaugccauggaaagaagcugccuaucaagaacaccauggauguucuuguuuuuguu

SEQ ID NO: 4145454 - RNA, 100 nt, Human
aacaauagaaauuacuguauuugauaagugaaguuuauuuuagggaguaucauuuuuuuaagaagguguaauuuauauacaguaaaauuuauccuuuguu

SEQ ID NO: 4145455 - RNA, 111 nt, Human
aacaauauuugcuauuguuugauugcuuuuagagcuguaucaaagagccuuaaccauuguguguuauuuuuugcuuuauagccucuaaccuaagcgucaauauauauuguu

SEQ ID NO: 4145456 - RNA, 78 nt, Human
aacacagaaaggcaccuucuggccagacacagugcaggaaauuugccuuucauggcucaggagggaucuuugcuuguu

SEQ ID NO: 4145457 - RNA, 57 nt, Human
aacacaggaaauugguaaauggagagaaacuguugucccuuugcuuucaucuguguu

SEQ ID NO: 4145458 - RNA, 60 nt, Human
aacacaggcauacuggcuccagaguauggguuuuagccacuguaugccuauaauuguguu

SEQ ID NO: 4145459 - RNA, 57 nt, Human
aacacauggcaagagcaggaaaugggaagacuaccuuuuuucuggcagcuauguguu

SEQ ID NO: 4145460 - RNA, 62 nt, Human
aacacccacuucugugagagacggucuguaaacaaugaacuguggcucagggaaugcauguu

SEQ ID NO: 4145461 - RNA, 58 nt, Human
aacacuaaugggagaacaacccuaauaaggucaacaaaaauguucuuguaauaguguu

SEQ ID NO: 4145462 - RNA, 56 nt, Human
aacacugucagccuuugauggacaaaagcuggacaaagucaaucucugaugguguu

SEQ ID NO: 4145463 - RNA, 62 nt, Human
aacacuugaacugaucuauacucaaugagaggaggucauugauuacaggaaguucaaguguu

SEQ ID NO: 4145464 - RNA, 61 nt, Human
aacacuuugggcauggccuucccucucagauaaacaggagggggaggcagcaccagagguu

SEQ ID NO: 4145465 - RNA, 62 nt, Human
aacagaaaagguagguggcuuuuuuagugcuuggguuuccuguuggugugacuuacccuguu

SEQ ID NO: 4145466 - RNA, 98 nt, Human
aacagaaaugagaguaaaaauugaggugcaaaaugucugauuuauggaugaaauuuguuaugcccagugauuuuuuuugcuacuuuaaauauucuguu

SEQ ID NO: 4145467 - RNA, 70 nt, Human
aacagacagugauucuucacauuucugggacuaaaugacccuuugauaaucugaugaauaacugaauguu

SEQ ID NO: 4145468 - RNA, 94 nt, Human
aacagacauauccuugggccugggguagugucggacaaagcaccuuguaacucucuuucucugaauuucccaaggcuaucugggguaugugguu

SEQ ID NO: 4145469 - RNA, 56 nt, Human
aacagacuauuugaguuugcagcaaucucuuccugcuuugaacuuuguacucuguu

SEQ ID NO: 4145470 - RNA, 72 nt, Human
aacagaguacacuuaauaagcuuaaucugaaacugauaguuugguagauacaguguuaaguguggaaguguu

SEQ ID NO: 4145471 - RNA, 116 nt, Human
aacagauagaaaauacauucucuagacuauguggcuuguuugggcuggccagggucuagccugaccauccagaccaguccaugggucugcucaguggguggaguuaucuuuuuguu

SEQ ID NO: 4145472 - RNA, 82 nt, Human
aacagauccaaacagauaagggacaauuucagcuaggacaugucauuugaauuuuguuguuuguuuucgucuuguuuuuguu

SEQ ID NO: 4145473 - RNA, 57 nt, Human
aacagcagcaaguaagcaggucugccugagcaguuaacugucaagacuccugcuguu

SEQ ID NO: 4145474 - RNA, 91 nt, Human
aacagcauccuagagggacagccuggaaccaggaguuacacgaguugggcaccagcucgugaccuuguucuaguuccaccuauacucuguu

SEQ ID NO: 4145475 - RNA, 58 nt, Human
aacagcucugcugcuggcugggcuggguuuaucggccagcgcucacucagagcauguu

SEQ ID NO: 4145476 - RNA, 82 nt, Human
aacaggaaagcuacucugcagugcccauggcucagccccagauccuagcagcacagccaguacacagcaguggcucacuguu

SEQ ID NO: 4145477 - RNA, 72 nt, Human
aacaggaagauagggguagaaaguuugccguccuauauaguagacuccuucucacugccuguaccuccuguu

SEQ ID NO: 4145478 - RNA, 107 nt, Human
aacagggaacagagggaggaauuucugacagcagaugaagccugcagauuuuuaccuacuuuguguaagccuuccuucucuauucucuuuucuccuccaucccuguu

SEQ ID NO: 4145479 - RNA, 67 nt, Human
aacaggguuugagguaaacuaaagaggggggagucucuaggcuguucaugcucagaccuaccauguu

SEQ ID NO: 4145480 - RNA, 56 nt, Human
aacaggugagggagcuuugugccugguagacuccuuggccuuggguuucgccuguu

SEQ ID NO: 4145481 - RNA, 57 nt, Human
aacaguguuuuucuucagcacuaagauaaauacaauguuucugugagaaacacuguu

SEQ ID NO: 4145482 - RNA, 58 nt, Human
aacaguucugugccugcaaccgugcagcugaacauggcuggaagaaaacagaauuguu

SEQ ID NO: 4145483 - RNA, 65 nt, Human
aacauaaacaaugucguaacuuaguuuucccucagugaagauauaggaccgacuuguuuauaguu

SEQ ID NO: 4145484 - RNA, 60 nt, Human
aacauaagggagcuucaaaacuuuagauuccuggaguauugaaaagcuacuuuacauguu

SEQ ID NO: 4145485 - RNA, 73 nt, Human
aacauagggaggugauuaggaccauguauuuuggaggcaaacugucuguauuugaguccugccuacccugguu

SEQ ID NO: 4145486 - RNA, 62 nt, Human
aacauaggguagcuguaugucaguacuucccuccuagaccagcaugccugcaucuuaguguu

SEQ ID NO: 4145487 - RNA, 61 nt, Human
aacauauggauguugaauuaacuuugucucauuauggcauuuaauuugauaucuauaaguu

SEQ ID NO: 4145488 - RNA, 101 nt, Human
aacaucauuucuucucaagcuccucagagacaucauaaugaaguuuccugguuggaguaguguaggaaaucucuuuugugguguuuagaaaagauaauguu

SEQ ID NO: 4145489 - RNA, 62 nt, Human
aacaugaauaggguauucuuuggcuggaucaaaauuauaaagguccaauuucuauucauguu

SEQ ID NO: 4145490 - RNA, 79 nt, Human
aacaugaguacagauggauguaagccagagucuugauggcaggaagauaaagacaugcuuauaggcaucaugcaauguu

SEQ ID NO: 4145491 - RNA, 78 nt, Human
aacaugcucugcuuuuuaaaaggaguccaacuuaagaacugccagauuaaaacgggcuugcuaagaagagcgcauguu

SEQ ID NO: 4145492 - RNA, 70 nt, Human
aacauuaaucagaguuauuugugcugcuucgcaggugucuagcugccuuaaauuacuuugugaaaauguu

SEQ ID NO: 4145493 - RNA, 67 nt, Human
aaccaaaggaaccugauuuucuuuagugggagagagaaaucuuguuugagagaaggauccuaugguu

SEQ ID NO: 4145494 - RNA, 80 nt, Human
aaccaagcauuuaccaagauagcaucugguuucauggcuaccuacccaaaugaaccagcuaucuuuguaaagaaaggguu

SEQ ID NO: 4145495 - RNA, 107 nt, Human
aaccacacccugacccugugccccacaaagcagaggccuagguggaaggcccagggugugggccgcucccuggaccacugcagugguggcuugggcagagugggguu

SEQ ID NO: 4145496 - RNA, 76 nt, Human
aaccacaccgagauuugcaagaguaagaauuucugccuauuggcuagaauuucaggacuccuguauucggguuguu

SEQ ID NO: 4145497 - RNA, 72 nt, Human
aaccaccaaaaccauugaaagaaaggauaaugggauuugaccuaaucaguucuuccaaggugcuuugugguu

SEQ ID NO: 4145498 - RNA, 79 nt, Human
aaccacuuuuaguuaucagugugguuucuggacugcuuggguccaaucccaguuccuccgcuugcuaauuaggugaguu

SEQ ID NO: 4145499 - RNA, 68 nt, Human
aaccaggaaaaguuaugaauagaagagcugggggcacuugucccucaaaauaguuaugauuccugguu

SEQ ID NO: 4145500 - RNA, 58 nt, Human
aaccaggacaauuugaauagaaaccauuauuauggacauucuugauuugauccugguu

SEQ ID NO: 4145501 - RNA, 63 nt, Human
aaccaggcucugcaaaaucaggcuccaagacugucacaaggagccuccuucagagucuagguu

SEQ ID NO: 4145502 - RNA, 68 nt, Human
aaccaguuaagcuaauuaguuccagcauggcuauguccaagcagagagcagaauuaaguuuuaugguu

SEQ ID NO: 4145503 - RNA, 72 nt, Human
aacggauaauuaggaaauucagccauuuugaaguuacuugacucugguuaugguuguuuucuaagcucuguu

SEQ ID NO: 4145504 - RNA, 65 nt, Human
aacguaccgacuuuucacaacaaucauuuauuuagcccaugauucugugaauuaguuggguaguu

SEQ ID NO: 4145505 - RNA, 81 nt, Human
aacguagauggcagugaaggaugccaaugaucaaugaaguacuuuucugucacaaguaauccuuuucuugcuuuuuguauu

SEQ ID NO: 4145506 - RNA, 70 nt, Human
aacguagggucauguuucuauacugagcaaaagggcuucuuuugcucaguauagaaaaugauaucauguu

SEQ ID NO: 4145507 - RNA, 83 nt, Human
aacuaacaaaaaagcaguauaaguaacggaagguuucucccacacucaaaccauuuauuauaaguauugcuauuuggucaguu

SEQ ID NO: 4145508 - RNA, 91 nt, Human
aacuaacugcauuauucauaugugccuuuuagguugaguguuuguuaugcuacauuuacuuaucaaaagucagugaaauguuugucuaguu

SEQ ID NO: 4145509 - RNA, 74 nt, Human
aacuacaaagucuuuuacaacagucauucuugguguauagcuaguggaggugaaaugggaagauuauuguaguu

SEQ ID NO: 4145510 - RNA, 76 nt, Human
aacuagaaaaagacuuucugagaaacugcuuggugaugagugacuuuaacucagagagcuaaaccuuuuuuugguu

SEQ ID NO: 4145511 - RNA, 94 nt, Human
aacuauguggcacauugggaagauuuagauccacugccuguuuuucauccuuuuccaccugcaguuuauucuucccaagugagcucauauuguu

SEQ ID NO: 4145512 - RNA, 58 nt, Human
aacuauugcccucuggcugacaggcuguuaacauacagucuucuagcuggguuugguu

SEQ ID NO: 4145513 - RNA, 127 nt, Human
aacucaaaccuuggauaugauauuacuaacugaaggcagggaugauuauuuuuccauauuuaaucaaaauaacagcacuguugaugguccaaaugguuuccugguuagaauuugaagcaauugaguu

SEQ ID NO: 4145514 - RNA, 77 nt, Human
aagcuacaugcaaguaacagaacguggaugggcaucaucucgccaguuucuacagcugcugcuucucaugucaguuu

SEQ ID NO: 4145515 - RNA, 57 nt, Human
aagcuagaaggagugcgugauuccuuggcucuaggcuuuaggcauuuggauuggcuu

SEQ ID NO: 4145516 - RNA, 55 nt, Human
aagcuaugaccugccagcuuucaggaugacauccaagaggcaguagucaaagcuu

SEQ ID NO: 4145517 - RNA, 67 nt, Human
aagcucacacuucaggacucuggggcaacagaaacccguugcagguuccccuuuugauguguaguuu

SEQ ID NO: 4145518 - RNA, 55 nt, Human
aagcucugaggugagcaaucggguuuuuuucuagccuuagcacaaagcagagcuu

SEQ ID NO: 4145519 - RNA, 74 nt, Human
aagcugaaggauguuucccaguccauuaggcaguuuaaaguccuugcuauggcucagaguucaucuuuuagcuu

SEQ ID NO: 4145520 - RNA, 76 nt, Human
aagcugaauaacuucagugugguauaaaacgugguuuuuaggcuauguuugugauugcugaaaagaauucuaguuu

SEQ ID NO: 4145521 - RNA, 73 nt, Human
aagcugacacugcuaacuccuggaguucuguguauaacccaaauucauagcccuugacauagccugucagcuu

SEQ ID NO: 4145522 - RNA, 77 nt, Human
aagauauuugggggagaggaugauuucuuggucuagggaguccuuuauaauuugaaucacuucccuccaaauggauu

SEQ ID NO: 4145523 - RNA, 77 nt, Human
aagaucacaguagcuaauauugcauuaugaugauacugccuucccagaaaugauugcagucuugcugcugcugucuu

SEQ ID NO: 4145524 - RNA, 67 nt, Human
aagaucaucaauggaugguaaaacuacugagcacauugucgcuagagaacaacauucauauggucuu

SEQ ID NO: 4145525 - RNA, 83 nt, Human
aagauccacccaggacuugacuuagugucuaggucagccugugaccuacauggcuuuaaguaaguuuccugaggguggauuuu

SEQ ID NO: 4145526 - RNA, 56 nt, Human
aagauccucagccagugaggcgccuucccugugcccagcacauugcugaggaccuu

SEQ ID NO: 4145527 - RNA, 55 nt, Human
aagauccuggguccacagaagcagaaggaagcuuccagugagacugagaggucuu

SEQ ID NO: 4145528 - RNA, 105 nt, Human
aagaucuauuugaaucuguaaacaaguagagauuacagugugcaaaaaguaauccuuuuuggcaccucuaguaagcucugcuucuugcagaucucggaggaucuu

SEQ ID NO: 4145529 - RNA, 72 nt, Human
aagaucuggaaugaaugagguucugugguccccuuauaaagccucuugcauuccaaauguguaaaugauuuu

SEQ ID NO: 4145530 - RNA, 79 nt, Human
aagaugaaacuggggugagguaccucugggucacuguuaagaaguaaaauguagaggcucuucauugcaguaguaucuu

SEQ ID NO: 4145531 - RNA, 67 nt, Human
aagaugaaugcugcucucauaauuauagcuucaaaccugugauucaaugggcugccauaaucaucuu

SEQ ID NO: 4145532 - RNA, 91 nt, Human
aagaugagguaugagguucuaugaucaugauggaacuuugaauaacauuuuugugacagucgugauuauaccuaucuuaaccaauagucuu

SEQ ID NO: 4145533 - RNA, 62 nt, Human
aagaugagugaccagaaaugauucuccagcucauaugugggccacugaauuuucugcaucuu

SEQ ID NO: 4145534 - RNA, 62 nt, Human
aagaugcuggcaggaauagcuagcggugaucccuuauacauagcuucucuuuucaacaucuu

SEQ ID NO: 4145535 - RNA, 61 nt, Human
aagaugcuugcaaauuucugaagccugggagagaaauccuagcagaccugacaaauaucuu

SEQ ID NO: 4145536 - RNA, 80 nt, Human
aagaugguagcagcagagcagguccucccacgcgugcucgcccagcauguggcuggaauccugccagcucugccccucuu

SEQ ID NO: 4145537 - RNA, 85 nt, Human
aagaugguugcagcuguagaggggagaaagagcaaaacuccauauauauuagucuuccuuuaucuuacagugcugcauuuauuuu

SEQ ID NO: 4145538 - RNA, 99 nt, Human
aagauuaauauuuccauagugagacaugugaauauuuguacuagguagaauguggaauaaguuaaauaaccucauguccguuggaaaauuguugguuuu

SEQ ID NO: 4145539 - RNA, 84 nt, Human
aagauuacacugaguuuuaccaggcacauucuucuuguugacaugcaaguaccuguggcuugguggacuuuuuguaggaaucuu

SEQ ID NO: 4145540 - RNA, 59 nt, Human
aagauucuagaggaacuucuuagaguaauuguuucugaguuugaaaucuuuagaguuuu

SEQ ID NO: 4145541 - RNA, 79 nt, Human
aagauucucagagugaaagaaucuauaauccuguuacauaagcauaauaggcaacuguucuuccacucuauggagucuu

SEQ ID NO: 4145542 - RNA, 113 nt, Human
aagauuguuaauuagauagaaaacuaguuaauguacuacggggaaauacaauugugguccuguuuuauugcccuguaguacaggacagaaaucauucgcaauuuaccagucuu

SEQ ID NO: 4145543 - RNA, 66 nt, Human
aagauuuaccacuuuauucaaguuuuaguuauccauaaauuugugaaaguaaagugguggcauuuu

SEQ ID NO: 4145544 - RNA, 91 nt, Human
aagauuuauauaauauacaagggacugugaauugaagaaagaacugagaguuuucuccaaggauacaguccuguguaacacuguaaauguu

SEQ ID NO: 4145545 - RNA, 79 nt, Human
aagauuuggaguuaaaggcaucucagcuaagauccaggcucugccuuucagcuggaugaauuuggaacacucuaaacuu

SEQ ID NO: 4145546 - RNA, 67 nt, Human
aagauuugucuuggucucaucugaguacuauaaugucauuguuagauggggucaggauggaaaucuu

SEQ ID NO: 4145547 - RNA, 106 nt, Human
aagcaaagguauugggaggaagugggauagaacugagcuuugaagaccgugcuaaaauauuuacagacuccccagguuaucucaaguucucuccaggaauuagcuu

SEQ ID NO: 4145548 - RNA, 63 nt, Human
aagcaagguuguuagguucuaagacugaagcugcucuuuaucucuucucccaacaccuggcuu

SEQ ID NO: 4145549 - RNA, 74 nt, Human
aagcaagugaaucuggcuauuugugugaguacguguguagcaaucugcucacaauuaucagaaguauugagcuu

SEQ ID NO: 4145550 - RNA, 61 nt, Human
aagcaaugcauuuggaaguauugaagcagggacccuuguaagagcuacacaaaugcugcuu

SEQ ID NO: 4145551 - RNA, 94 nt, Human
aagcaauggagguuugccuacaaacgaaucuaucugaaaauguccccgucuacuauuuagagauuccuuuggggaaagcacuacccaguggcuu

SEQ ID NO: 4145552 - RNA, 59 nt, Human
aagcaauguguuugaaaggccaagcacuaauaauuuguugcccauucaaacaauuguuu

SEQ ID NO: 4145553 - RNA, 66 nt, Human
aagcaauugguuuuaguaaaaugagacuucuucaggagucacuccuuuacuguggacccauugcuu

SEQ ID NO: 4145554 - RNA, 90 nt, Human
aagcacauacuguuuguaaguaagagagguucagcaaacauuucuuaaauaaaugaauuuugcugauauuuugcugauacagucuggcuu

SEQ ID NO: 4145555 - RNA, 74 nt, Human
aagcacgaugacuaaaugauccucuugguccuuuugggcaccagcccucccagaguggacaucaucaggugcuu

SEQ ID NO: 4145556 - RNA, 71 nt, Human
aagcacucuacuaucagaucaaucaaagauucugugagugaauuuauugguuugcauggugaagcaagcuu

SEQ ID NO: 4145557 - RNA, 79 nt, Human
aagcacuggcacagagacagaaggauuaaagagugguucaucucggaaaucuugcucugauuuuguuuguugguuucuu

SEQ ID NO: 4145558 - RNA, 57 nt, Human
aagcagaagagggcuagguagauuacagcagauaugcagccuuggcauucucugcuu

SEQ ID NO: 4145559 - RNA, 76 nt, Human
aagcagaauucuaauuccauuaaauugauguucaacagaacacacugaauuuuguggaaacuauggaggucugcuu

SEQ ID NO: 4145560 - RNA, 77 nt, Human
aagcagauuuuugguugauauuuugugaaucauuuugcuuucaguaauauguuuauaagauaucuuccuuucugguu

SEQ ID NO: 4145561 - RNA, 62 nt, Human
aagcagccuggcaugaugcuuucucuguggcccacucaccuucuguguauuugcugcugcuu

SEQ ID NO: 4145562 - RNA, 62 nt, Human
aagcagcuuccccaaagugccuuggcucccaagggcccuuuacuuacugggaaaaucugcuu

SEQ ID NO: 4145563 - RNA, 70 nt, Human
aagcaguaaaggcacacacuccuuguuauauuccugggagaugaaaggaauacugugccuccugacucuu

SEQ ID NO: 4145564 - RNA, 128 nt, Human
aagcagucacuugacagaagucuggaagcuaagcuuugcccuaggugagcacauuuucccacuucucuaauagaugugaaauucuucagguuaacuugucuuuugagagaugacuguaccaucugcuu

SEQ ID NO: 4145565 - RNA, 75 nt, Human
aagcauccagcacaugagaaagauguaggcugggaggcuagaccagucucucuuuuacauuuuuucugccuguuu

SEQ ID NO: 4145566 - RNA, 80 nt, Human
aagcaucguggcgaggcgggcaggggugcagggucccggcagggcagcccaggugcccucugccuuacugucggcugcuu

SEQ ID NO: 4145567 - RNA, 89 nt, Human
aagcaugaagucuuauauuuugaagucagaaagcauuaugcucugaaaggcauaaaguuuuguugccugacuuuaaaaugugaauguuu

SEQ ID NO: 4145568 - RNA, 62 nt, Human
aagcaugaauccaaaccuuucugaccuggauauaggucagcaguuucuuugaauuucugcuu

SEQ ID NO: 4145569 - RNA, 59 nt, Human
aagcaugaguuaccugcuucuaagcccaacuuggccagugggcaggugugcuuaugcuu

SEQ ID NO: 4145570 - RNA, 78 nt, Human
aagcaugauaaaaucuaguacuaguuaggaagaguauuucuauagucuaaucugacuagaauuaaaucaaccauguuu

SEQ ID NO: 4145571 - RNA, 66 nt, Human
aagcauguagugaagauuuauaugauaagggaaaagagaaccucuuugucacaucaucccaugcuu

SEQ ID NO: 4145572 - RNA, 93 nt, Human
aagcauucuuaugugcccagcucagugguggucacuugguggaagaauaugaucuaucaccaaggaguuacuacuuaguuugggaggaaucuu

SEQ ID NO: 4145573 - RNA, 76 nt, Human
aagcauuuaacaaauuggggaaaaacauuugcaacucaguugacagugucaguuuccuaauauauauuaagagcuu

SEQ ID NO: 4145574 - RNA, 91 nt, Human
aagcauuuuuaauuccuauuuccaugaaacacaaaaaguugauuugaaugcuucuuaguuuacucauggagauagguauuugggaauucuu

SEQ ID NO: 4145575 - RNA, 70 nt, Human
aagccaaaggcuccagugaccucugggaagagagagcccuucaaggucauuccagccauuccccuggcuu

SEQ ID NO: 4145576 - RNA, 62 nt, Human
aagccaacaugauuacuauaauguaaaacauauaaacaucaugaauaguaguauguaggcuu

SEQ ID NO: 4145577 - RNA, 95 nt, Human
aagccaaggaauguaggugguuucuggaagcuggaaaaggcaaggaaauggauucuuccccagagccuccagaaauacaucuugcaccuugacuu

SEQ ID NO: 4145578 - RNA, 55 nt, Human
aagccacugcagcaggagcugccauggggaaacaugguaccugcuuuaguagcuu

SEQ ID NO: 4145579 - RNA, 59 nt, Human
aagccaggaauggagucuucgccagagaccaaaucagccggcaccuuguucuuggacuu

SEQ ID NO: 4145580 - RNA, 55 nt, Human
aagccagguguugugguaagagaugccuccggcuauuuuuucccaggccuggcuu

SEQ ID NO: 4145581 - RNA, 115 nt, Human
aagccauguuauuacuaaauguggguuuuuaucuuguguauuguugugagccacugaagggcuuuaaucagguaacaugauaaaacuuacauuuuuagaaaaguuaguugggcuu

SEQ ID NO: 4145582 - RNA, 112 nt, Human
aagcccccuuucacauuuuagucauuuguuacaguggcacuccacuccaaguaccaaagucuguggucguuuucuauugcucuguaacaaauugacauguaauuaguggcuu

SEQ ID NO: 4145583 - RNA, 76 nt, Human
aagccccucagaaggaaguuagaguauggaaauauuaauaagaaugacccauauuugcuucuugcugauaaugcuu

SEQ ID NO: 4145584 - RNA, 110 nt, Human
aagcccugcccaagaagccacaacccagccccaguacaggcuccuuagauuuaucugcagcaaggauuuagggacaagggucugggguugaggcuucuagggcugagcuu

SEQ ID NO: 4145585 - RNA, 61 nt, Human
aagcccuggaaaagcaucauugagauugguucaccucccauccauuguuuucccaggguuu

SEQ ID NO: 4145586 - RNA, 56 nt, Human
aagcccuguccggggggaagaaagacaaccucccgagucccucaaggcaggugcuu

SEQ ID NO: 4145587 - RNA, 62 nt, Human
aagcccuguuaggcacuggggauaugacaauaaacaagaaaauucucagccucauugggcuu

SEQ ID NO: 4145588 - RNA, 56 nt, Human
aagcuguacuuagcauugacuccucugcuacagcaggagucugggggaugcagcuu

SEQ ID NO: 4145589 - RNA, 55 nt, Human
aagcuguuuuggccuuaguugaguugaugaaacuucagaacguuaagacaggcuu

SEQ ID NO: 4145590 - RNA, 114 nt, Human
aagcuuacccaaggucagaauucauucaagaugcauuggugucuuuuugagcauuaauuuccaccaguugugcacauucuaggacuaguagcgguuugaguuuccugguagcuu

SEQ ID NO: 4145591 - RNA, 71 nt, Human
aagcuuucccacauaucuugcauuuaugagguccaccuccagugugcauuaucaugugucuucgaaagcuu

SEQ ID NO: 4145592 - RNA, 80 nt, Human
aagcuuucuuagcagcccucuuggucacuaggcacacuaccuaggagucaagcugugacaagaggcugcuucuuaaacuu

SEQ ID NO: 4145593 - RNA, 67 nt, Human
aagcuuugccacacucuaguuuccauggaagccaauucuaagguggaaacuagagugugggaagcuu

SEQ ID NO: 4145594 - RNA, 81 nt, Human
aagcuuuguuggaaaagacagaauucuagaauguuaugacgauaaaucacauuguuggaaauugucuuucucuaaaaguuu

SEQ ID NO: 4145595 - RNA, 101 nt, Human
aagcuuuuuccuguguuuuucucagagauuuauggaaaacugucagaaucagugauuauguaaaaguuucucuagagucuuugaaaccauggaaaaggcuu

SEQ ID NO: 4145596 - RNA, 64 nt, Human
aaggaaaaaaagguuagcauggcuguaucuggguaagggaacuacaaauggcuuuuauuuccuu

SEQ ID NO: 4145597 - RNA, 109 nt, Human
aaggaaaaggagagggcggguugaggccaggacuccagguguccaggacuccagguguccaggacuccagguguccaggccuccagggccgcacccucaugacagccuu

SEQ ID NO: 4145598 - RNA, 75 nt, Human
aaggaaaaugagcugcaugcaacuguuuaaauauagaaaaugauguuuaggaagauguugcuggacuccuuccuu

SEQ ID NO: 4145599 - RNA, 57 nt, Human
aaggaaacagaggaugaccuugcuucauuauuuaagcagcucagccucuguuuuuuu

SEQ ID NO: 4145600 - RNA, 68 nt, Human
aaggaaauacaacauguauucauuagguggauauccacuaaaccacggauucaugcauuguaguccuu

SEQ ID NO: 4145601 - RNA, 114 nt, Human
aaggaaaugugcuuggugccuccauuucuguuauaccuuucucaggagcugauaauuggaaauguuuuaagagagguuauaauuagggcuugggggcuucauguauaguuuuuu

SEQ ID NO: 4145602 - RNA, 59 nt, Human
aaggaagaagacucuuuacuccucaauccacuagagagaguuaaaagcucuuuuucuuu

SEQ ID NO: 4145603 - RNA, 92 nt, Human
aaggaagaagcaggugugugccccagacagaagugauuuuuuuggcaagggaagacacuaaacuggggcuucagauccaucucgcugaccuu

SEQ ID NO: 4145604 - RNA, 94 nt, Human
aaggaagaagugauugaagggcucuuuguauuuuggaaucaauguaugcaacauaugacucaugauaacaaaagcuaccaguuuuuuuuuuuuu

SEQ ID NO: 4145605 - RNA, 106 nt, Human
aaggaagaugagaagguggaagcugaugggagacagggcagcuugugggugucucuuucuucuccuccuccuccucuuuuuccuacuucuacucccucucuuccuu

SEQ ID NO: 4145606 - RNA, 73 nt, Human
aaggaaggaauuugggauuccaggacuugggagcaucccucaaauucuauucuauacucagcuuucuucucuu

SEQ ID NO: 4145607 - RNA, 78 nt, Human
aaggaauucagcacagcuguggggucauucaugugguuggggcgggugaugugacuccacagcugugcugaauuccuu

SEQ ID NO: 4145608 - RNA, 130 nt, Human
aaggacaccggccaguuggcccccaggagcaggaggcuggucagcguuugucagagcagggcucaucacugauaacaaaagugcuggccacgccagugcuggaggcaggcuggggacugugcuuaucuuu

SEQ ID NO: 4145609 - RNA, 57 nt, Human
aaggacagagagccauuccagacucacccaguauugaaacagggcucucugcuccuu

SEQ ID NO: 4145610 - RNA, 130 nt, Human
aaggacaggacaggugaggcagggccagguggagcaugugaggacugaguugcuggcaggugcaccuguguccaccccucccauguccuucaugcccaugucuccaacccuacguguguccccagugcuu

SEQ ID NO: 4145611 - RNA, 78 nt, Human
aaggacaucuugcuugcugggcauuuucacuuggaaacccauucuuacagggagaugcuacaguucagcucuguccuu

SEQ ID NO: 4145612 - RNA, 65 nt, Human
aaggacugcuaaaccucucugagagcugccagauguuccugccuagccucagguuguugguucuu

SEQ ID NO: 4145613 - RNA, 86 nt, Human
aaggagaagauaaugaauuuauugaaugucuugguacugugccaaguuuuuuuacauaaaugguuucauuuaaucuuuacaaacuu

SEQ ID NO: 4145614 - RNA, 68 nt, Human
aaggagagaugggcucuuuuagacaggaacuccuggaggggaacagacagaagcuuaucuccuuccuu

SEQ ID NO: 4145615 - RNA, 64 nt, Human
aaggagcaagauaagaucauuuacacuauuguuuuaacauuaguaaugauuguaucuuguccuu

SEQ ID NO: 4145616 - RNA, 59 nt, Human
aaggagcgcuuagggggcagaaucuaacccagauuuugcugcccucaaagguccucuuu

SEQ ID NO: 4145617 - RNA, 82 nt, Human
aaggagcugaacccacaaauauuuacugaauccacugguuugccccaggggcagcauguaaaauuuccaaacuucacuccuu

SEQ ID NO: 4145618 - RNA, 81 nt, Human
aaggagcugugaagaggcuagagccaaguaaggggcuaccggagguggcucaggggucuggcucugucaucaggucuccuu

SEQ ID NO: 4145619 - RNA, 59 nt, Human
aaggaggaaaauauuguugcuguuaccucuuuauuaaagcaaagcagugcauccucuuu

SEQ ID NO: 4145620 - RNA, 58 nt, Human
aaggaggaaaugaaaggaggguuugaaauacuuguguagacaaucuucauuccuucuu

SEQ ID NO: 4145621 - RNA, 84 nt, Human
aaggaggaaggccagccuuggaacccugagucucuguggucaggagcgccucagggggcuggacuuuucacucaucuuguccuu

SEQ ID NO: 4145622 - RNA, 78 nt, Human
aaggauauugauuauuaguucacaauagcaccagguagacagggcuuaugugcaauaaggaguaauaguaaaaucuuu

SEQ ID NO: 4145623 - RNA, 64 nt, Human
aaggaucaggcgccaugggaaguguggugcggccguuuccccuacuucucuccgccucgugcuu

SEQ ID NO: 4145624 - RNA, 66 nt, Human
aaggaugccauuaaagaagcauuaugucacauuugucacuuugugucacauuuaguuggcauuguu

SEQ ID NO: 4145625 - RNA, 90 nt, Human
aaggauuauaagcauaaauugauacuguagccagagcagacuuaacacuucauguccugguucacaucuguuuaucuguuuucaguucuu

SEQ ID NO: 4145626 - RNA, 68 nt, Human
aaggauugcugucucuuuauuauuuguuuauuuucuaagcaagcuaacauaggagauugcuaucucuu

SEQ ID NO: 4145627 - RNA, 67 nt, Human
aaggcaaaugauuuuuaugucuccuuugucuguuccuaagacacuuggagucauuagucauuuccuu

SEQ ID NO: 4145628 - RNA, 59 nt, Human
aaggcaagcauugggaacagggcgguggagcaacuagccuaggugacccugcuuggcuu

SEQ ID NO: 4145629 - RNA, 58 nt, Human
aaggcacuacgcugcuggggcgguuguccuauuucugucuaugccagugugguuucuu

SEQ ID NO: 4145630 - RNA, 78 nt, Human
aaggcacuguuaugcacugguacuauucguguacacuauaaggaaugauguaucaguuuuacgucuaaucagugucuu

SEQ ID NO: 4145631 - RNA, 65 nt, Human
aaggcaggagaaaggugaauucacucugucuucaagagcuggcacagccaucuucuccugcucuu

SEQ ID NO: 4145632 - RNA, 115 nt, Human
aaggcagugcagggcuggagguccuggaggguggcggcgggucguccuaacuagcaggcugaaaggugcuggaggggaugccuucacucagaggaaguucacagccaccugccuu

SEQ ID NO: 4145633 - RNA, 61 nt, Human
aaggcauaccugaauguuuguggguggugcaacuuuuacuaacuuucaggauacugcucuu

SEQ ID NO: 4145634 - RNA, 79 nt, Human
aaggcauuagagcuaaaucaucauuuauguuugucacagggguugcaaauguauaaugagauuccagaguuaauguuuu

SEQ ID NO: 4145635 - RNA, 57 nt, Human
aaggcauucuuuagcuucuaaggcauuauaacaauaugcagaagcacaagaugucuu

SEQ ID NO: 4145636 - RNA, 65 nt, Human
aaggccaaaagcauaauccucacaaaugcaauaaugcacauugucagcuuaguuuuucuggucuu

SEQ ID NO: 4145637 - RNA, 61 nt, Human
aaggccucccucuuucaugggacccuaacuaaggucuuugagguguggagggaaggcucuu

SEQ ID NO: 4145638 - RNA, 87 nt, Human
aaggcugaauaauauuucguugcguggcuagaccacacuccguguacccauucaucuguucauggccacccggauuguuuucgccuu

SEQ ID NO: 4145639 - RNA, 61 nt, Human
aaggcugcuuuuaacaugcauacaacacguaugggaguguauguguguaucaagcugccuu

SEQ ID NO: 4145640 - RNA, 63 nt, Human
aaggcugugaacuuuucgggaacuggaacuguuuaacuugaacccaggauuguuuaaagcuuu

SEQ ID NO: 4145641 - RNA, 80 nt, Human
aaggcugugguggagacuguuguuuugcccacugguguccccuccuuugggcacacagcuagauuaccauucucagccuu

SEQ ID NO: 4145642 - RNA, 61 nt, Human
aaggcugugucagaagcucccuggggggguuguggguccccaguuccuggcacgcagccuu

SEQ ID NO: 4145643 - RNA, 64 nt, Human
aaggcuucuccccaguauggauucucugauguguaaucaagucugaccucugggugaaggccuu

SEQ ID NO: 4145644 - RNA, 55 nt, Human
aaggcuucuuaugcaauuguuuuugaccuuacaaggacaucugcuuuugagcuuu

SEQ ID NO: 4145645 - RNA, 70 nt, Human
aaggccaggaggacaguuagaggacugggaaauagauucccacuuaacugugacuucucucccaauccuu

SEQ ID NO: 4145646 - RNA, 62 nt, Human
aaggcccuagaaucuauauugcaaaaagaacagaggcaaaaaauggaaaaaauuagggcuuu

SEQ ID NO: 4145647 - RNA, 81 nt, Human
aaggccuaguucccagcugagauugagcaaggcaauacucugucuccuugauucaacucucauacuguaaacagcugucuu

SEQ ID NO: 4145648 - RNA, 56 nt, Human
aaggccuccaaggacgggcgccgugcgcggcaacugccugcaguuuugaagcccuu

SEQ ID NO: 4145649 - RNA, 74 nt, Human
aaggcuaacuuguacuuuccccagcaggcagcuggcacccugagcccucggcuggggcagagcaaaggagccuu

SEQ ID NO: 4145650 - RNA, 63 nt, Human
aaggcuaaguaaggcucuuucucugccugucuuugagcugagacaucagucuuauuuugccuu

SEQ ID NO: 4145651 - RNA, 82 nt, Human
aaggcuguaaguccaagaucaaggugccaguaggguugauuucuccugaggccuuucuccuuggcuugugggcugcagccuu

SEQ ID NO: 4145652 - RNA, 75 nt, Human
aaggcugugcuugccagcacuuggccagcugugccccaaagugcagcucagccacuguuuggcccuagcagccuu

SEQ ID NO: 4145653 - RNA, 78 nt, Human
aagggaacccaggagguccugacguuguucccuauuuuacuuuugccugaauuacuucaggacacccugugcuuccuu

SEQ ID NO: 4145654 - RNA, 128 nt, Human
aagggaacuguggauguaaaaaauccuuuguucuuuaaacacaccuuuggaacugugaccuugacauccauggaucaugugguaaagaggaguguuuaccaaaaagugaucaaaacagagcagcccuu

SEQ ID NO: 4145655 - RNA, 55 nt, Human
aagggaagcacuuuacgaugagaccuuuuacuauuucaucuuggaguacuccuuu

SEQ ID NO: 4145656 - RNA, 59 nt, Human
aagggagcucuaaguagagggaccagcaggcgcaaaggcccugugguaggagcuuccuu

SEQ ID NO: 4145657 - RNA, 56 nt, Human
aagggaggcucggccggcugcugcuuacgcggguaaccugucggaaagccuuguuu

SEQ ID NO: 4145658 - RNA, 78 nt, Human
aagggauacaccagagagugagauaauuucacauacaagugauguguuugagagagauuuccuuucuggugagccuuu

SEQ ID NO: 4145659 - RNA, 67 nt, Human
aagggauggcagcggagcuggaaaugauuacaaagucagagaaugaguccaucaauugccacaucuu

SEQ ID NO: 4145660 - RNA, 80 nt, Human
aagggcauauggagggaucuuuuugaaggaugaggcaccuuuuacauuacccucucaacugaaguccuguuauauccuuu

SEQ ID NO: 4145661 - RNA, 87 nt, Human
aaggggagacuugcucuaauuaugcauauacauuugacuauguaaagguaguuguagacuauauguauaaauaacaaguuaacacuu

SEQ ID NO: 4145662 - RNA, 66 nt, Human
aauucuaagcauccaucucuucuucaccuuucagugaggguggaaagaugaagauguuuaaggauu

SEQ ID NO: 4145663 - RNA, 55 nt, Human
aauucugaucaguucuuuuaagcuucauugaaagagaaaaggagagaucagaguu

SEQ ID NO: 4145664 - RNA, 56 nt, Human
aauucugaugaauaaaucauccugauaaauuccagggcugguuugucaugagaauu

SEQ ID NO: 4145665 - RNA, 62 nt, Human
aauucugcuucaucagcucuuugauuaacuggaaacaugguucauagaagagaggcaggauu

SEQ ID NO: 4145666 - RNA, 102 nt, Human
aauucuugagggggcaggcucuggcuuauucugggcaacugacuucaagugggaccccugagcuaccuauguaagcaaagagucagccaucucuggagaguu

SEQ ID NO: 4145667 - RNA, 82 nt, Human
aauucuuggcaagccaguguuaagugacugguuuuacacuuggugugacugaauggguacugaggcucagcuugccugaauu

SEQ ID NO: 4145668 - RNA, 121 nt, Human
aauucuuuaauugggacuguaccugcaagcauuacacuucuaaaugaagccucaaaggcucauacaauggaauagugagaaauguugcagaagaagucaucuaaauaugccaugaggaguu

SEQ ID NO: 4145669 - RNA, 124 nt, Human
aauucuuuagauuucacuuugagaacugaggagcaagagcagugcaggaacauagcuucuuuacccucucucaagaaguaugccagcacuggcucuacaguaaaacagugauaucuuuucuguu

SEQ ID NO: 4145670 - RNA, 92 nt, Human
aauugaagaguacauuuaggauucauugaaagccuaauaaugcaacacccugccuuucuuuccagugaaauuuugaauguugaauuucaguu

SEQ ID NO: 4145671 - RNA, 65 nt, Human
aauugcccuuauuugaguucacugaggaacacuguugggucaaguuaggucaaguuaggucaauu

SEQ ID NO: 4145672 - RNA, 59 nt, Human
aauugccucgugucugagucuguucaggcugcuagaacggaauaccauacuggguaauu

SEQ ID NO: 4145673 - RNA, 83 nt, Human
aauugcucgugaugguucccagugaggaagcaaugcagagugugugcaccugccuuccuccucagagcugccacuuggcaauu

SEQ ID NO: 4145674 - RNA, 119 nt, Human
aauuggauuaugaauauaaauagccaugugcuggccccaguggccagugugcacucccaggcuggugcuuggcagacuggguccuggggaaggcuugggcuguuuguuuauuuucaauu

SEQ ID NO: 4145675 - RNA, 77 nt, Human
aauugggaauaauaguacuuaucucugucauugugaucauacagugaauacuguaugugcuauuuccuagccuaauu

SEQ ID NO: 4145676 - RNA, 92 nt, Human
aauuggguuuugauucuuuaccaccuguaucacauuuuuccuuuccauuucaaggaaaacucgcaaagugguuaggaaaucaggaagcaauu

SEQ ID NO: 4145677 - RNA, 80 nt, Human
aauuguaggacguagauaacuuuuggguauucauggacuuuguauucuguguuaaagcucuaaaguuuucucuuucaguu

SEQ ID NO: 4145678 - RNA, 81 nt, Human
aauuguauaugguucaaccuaauacagcagaaagaaauucccacauucuuucugcuguauuagguugaacugcauaaaauu

SEQ ID NO: 4145679 - RNA, 74 nt, Human
aauugucaguuaugcuuauuuguuggaaauagugcuuucucuuucuuuucguuucuuaaguguaauugacaauu

SEQ ID NO: 4145680 - RNA, 98 nt, Human
aauuguuuuguuauaguuauuguuuuguuguguuuuguuuuagaacaauuugucugacaaagaccuucaacaagauuuugaagugauguacugcgauu

SEQ ID NO: 4145681 - RNA, 77 nt, Human
aauuuaaaucauauaguucaugugugcaccuguccugcaguuugaggcaggugugaaugugaauuaagauggcuauu

SEQ ID NO: 4145682 - RNA, 130 nt, Human
aauuuaauguuuccccuguggccuaaaagacuaaugaagcuucuuaaguuccugcagcagucccagacuguaacuuaggcacaagaagcugggucauuaagcuaaaggucucuggaugagcaucaucucu

SEQ ID NO: 4145683 - RNA, 126 nt, Human
aauuuagcuacuacugauuuaacuuggagcugauucagaugccuuucucugucuuucaagaguguaaaagguaaaauuuuagaaacuuuggaggauagauugauuuuguuccauuuagcucaaauu

SEQ ID NO: 4145684 - RNA, 64 nt, Human
aauuuaggucuaugauucauuuugagcuaauuuuuguguguagugaaggauaaggaucuaaauu

SEQ ID NO: 4145685 - RNA, 71 nt, Human
aauuuagucagugucauuauuagaguugugcuuucauaaaaagaaucucucaagugugacaaggcuaaauu

SEQ ID NO: 4145686 - RNA, 123 nt, Human
aauuuauauuccugugcauguuuuuuacaucuugucuauguccuggugucgaccaacguggacaauguaaaucaggauagcauuagaacaaagcaagaaagauguacagaggggaacggaauu

SEQ ID NO: 4145687 - RNA, 56 nt, Human
aauuuaucuuggagaaaucaguguguuucauacacuggcuuugauccagauagauu

SEQ ID NO: 4145688 - RNA, 84 nt, Human
aauuuaugagguuccuaaucuccauauguucaguuaugcagugaaauaugauuuguuugcauugcauagacauccucauagauu

SEQ ID NO: 4145689 - RNA, 63 nt, Human
aauuucacauaaggcucauuggccagagcugucaccuggccacucagagcuguaugggagguu

SEQ ID NO: 4145690 - RNA, 63 nt, Human
aauuucaccugcacuacaucgccaggccuucuucugguuaggugaaugugagcugguggaauu

SEQ ID NO: 4145691 - RNA, 55 nt, Human
aauuucccaguuucugugggagagugggagccucucccacagaaacugcgaaauu

SEQ ID NO: 4145692 - RNA, 63 nt, Human
aauuuccucuugucauauuuugggcuucacuaacgcauccccuugacaggacgaagggaaguu

SEQ ID NO: 4145693 - RNA, 130 nt, Human
aauuugcugagaaacaucaacaaaguaagguuuugcuuuaugaaggaacaaugcucccaaaaaguuggguguaaguuggauuuuuaugagacaauuuaguauuuuaagugcacaaugugaauugguuauu

SEQ ID NO: 4145694 - RNA, 77 nt, Human
aauuuggaagggaggguggugcaugccuguguguuugucagcugagcagagcuguauuuaucuuuccaauucaaauu

SEQ ID NO: 4145695 - RNA, 91 nt, Human
aauuuuagauuauuucacaauuuuaaggagcaaaauagguucacgauucauauccaaauuaugcuuugcaauuggaaaaggguuuaaaauu

SEQ ID NO: 4145696 - RNA, 61 nt, Human
aauuuuaugccuugcacguuggaguucaugggaguuagacauguaacuaaggcauggaauu

SEQ ID NO: 4145697 - RNA, 119 nt, Human
aauuuuaugugagguagucuagaaguuaaugagguaagguauucagggaauucucauuuaaguuccccagaaucauuuauucaaacuagcucaucucuaauugcaucucauuuaaaauu

SEQ ID NO: 4145698 - RNA, 77 nt, Human
aauuuuggcaggauuaaauuugaacugggcauagguuguauaugcagaaaacuaaacaugaugccuguacuaagauu

SEQ ID NO: 4145699 - RNA, 67 nt, Human
aauuuugggacagguuuauuauguagcauuauugaagcaauagcugauuaauguacuaccuaagauu

SEQ ID NO: 4145700 - RNA, 85 nt, Human
aauuuuucacuuuaaacaaguuacucuggcuguaaugaggaaaacaguuuugaaauggccaagagucgauuuggggagaaaaauu

SEQ ID NO: 4145701 - RNA, 79 nt, Human
acaaaaaaagaauaaucucuucccaguaaaaauggcucagguuaggucuagagcuaagggaaaggauuauucuuauugu

SEQ ID NO: 4145702 - RNA, 58 nt, Human
acaaaaggauuuuugcuaggaagacaaacuuuuuguauuuccugguuuagaucaaugu

SEQ ID NO: 4145703 - RNA, 64 nt, Human
acaaaaguguccugcuuucacauuuagauuauaacaugaacagguggaggccaggauacuuugu

SEQ ID NO: 4145704 - RNA, 100 nt, Human
acaaacacacuuagguuaauuaaaugguggucauucauuuuuugguagauaucuucccugagaagacugcaucauauuugguaaacugcaggauguuugu

SEQ ID NO: 4145705 - RNA, 77 nt, Human
acaaacacauucaaauagaacucacagacaagagcaguuauuuaacaguucucuuggguguguguuuauauguuugu

SEQ ID NO: 4145706 - RNA, 126 nt, Human
acaaacugccacacauuaggggacaaaaacaguagacauuaauuuucuuauaauucuggagacuggacguccaagaucaagaugucagcaggguugguuucuuuugugccucucuccuuggcuugu

SEQ ID NO: 4145707 - RNA, 62 nt, Human
acaaagaccauguggccugaaaagccuaaaauguugaggcuuuaaaauauuugggucuuugu

SEQ ID NO: 4145708 - RNA, 78 nt, Human
acaaagcaugauagggagcccaugggcagaugucugcaauuuauaaaugugugcccugaagcacccucacccuucugu

SEQ ID NO: 4145709 - RNA, 83 nt, Human
acaaagcuuucuguacauaaaggaggcucuuugccaagauugguauuugcaaagagaauccuguguguccugagagcuuaugu

SEQ ID NO: 4145710 - RNA, 79 nt, Human
acaaaggcauauguuccucugcuccaucuuuacuguuucaggaaaggguagggcccggagacagacagccuggcuuugu

SEQ ID NO: 4145711 - RNA, 58 nt, Human
acaaaggugcgucccuucagcucuucuccguggagcucggggcuuucuguauuuaugu

SEQ ID NO: 4145712 - RNA, 60 nt, Human
acaaagucugaaaccugaggcaauggacccacagaacuauuccuuggugucagaauuugu

SEQ ID NO: 4145713 - RNA, 76 nt, Human
acaaauagaauaaaaggaaaugugccugacacugcacuaaguauguggguguguuuguauauuuuucucugcaugu

SEQ ID NO: 4145714 - RNA, 55 nt, Human
acaaaugacucaaacaccacuuugcagaaguaaaggugcuaggcugagucuuugu

SEQ ID NO: 4145715 - RNA, 66 nt, Human
acaaaugucuacauugagaauaaugcaguaaagaaaaggaugcacuucuuaauaugagauaugugu

SEQ ID NO: 4145716 - RNA, 84 nt, Human
acaacacagagacccugcaauagaaaacucaauacuuaaggaaaaaagccuguauuuuauuucaguucacgguuaugcuguugu

SEQ ID NO: 4145717 - RNA, 58 nt, Human
acaacagagcuggacugagaggcccugcugaaggucacucagccuguccccugucugu

SEQ ID NO: 4145718 - RNA, 57 nt, Human
acaacaggcagguugagaaacauuuucuuggagaguuucuugauucuugccaguugu

SEQ ID NO: 4145719 - RNA, 59 nt, Human
acaacagugugguggaaggagcacuagauuaaguacuaauucugcugccacaucguugu

SEQ ID NO: 4145720 - RNA, 72 nt, Human
acaacauuuaagucucugacucacacaauguagcuguuaauuacauuucugucuuagggacuguuucguugu

SEQ ID NO: 4145721 - RNA, 68 nt, Human
acaacuagaaagaacauauuuccacaucggccugggacaggucugguuuaugccuuuugaucuggugu

SEQ ID NO: 4145722 - RNA, 106 nt, Human
acaacuugcuggugaaaaagugccacucggggaggcugcuaacaaggaaguuaaaugcuucugccacgagcaguuucuucgcuguauuuuucaugagcuguaaugu

SEQ ID NO: 4145723 - RNA, 61 nt, Human
acaagagacaagagguucuucuggccuccaggagaaguuuaagaccuuugauuucucaugu

SEQ ID NO: 4145724 - RNA, 89 nt, Human
acaagagacaucaacugggacuguguaaauauaagaaaguaucuccucaguuaagucaauaucaaucucagccacuggguguuuuuugu

SEQ ID NO: 4145725 - RNA, 84 nt, Human
acaagagcccaacaucuguaucauuaguacaucaauacgcuuguguguauguguggauagauguauauacuacauguucuaugu

SEQ ID NO: 4145726 - RNA, 78 nt, Human
acaagauacuaggucccaauccguggaaacuguuaauguuacuucacaggaaaaauggguccuuuaagaugucauugu

SEQ ID NO: 4145727 - RNA, 101 nt, Human
acaagaugaauucugguggaauuuaugauuucuauauaaaaaaugaaaccauaaaaaguauuagaagaaauuauagguagacguuuuuagaaucauuuugu

SEQ ID NO: 4145728 - RNA, 70 nt, Human
aauguaucaguugccuacuacauggcaggcagagggcugugugugugugugugugugcaaauauuauauu

SEQ ID NO: 4145729 - RNA, 70 nt, Human
aauguauuuuccauugggacugugugcuuuagauucucuuuauuauuugaguguuaauggaaauuauauu

SEQ ID NO: 4145730 - RNA, 57 nt, Human
aaugucagccugaaagcuauucuucacuucaaggggauuagagcuucagcugauauu

SEQ ID NO: 4145731 - RNA, 77 nt, Human
aaugucauaggugccacugaauugugaacaccuacaauuaaauaaguagguauuucccaaaguggcauggugguguu

SEQ ID NO: 4145732 - RNA, 62 nt, Human
aaugucaugagccugcucuuguuucucuccacugggaacagaggaaugggcuacaaggcauu

SEQ ID NO: 4145733 - RNA, 55 nt, Human
aaugcacaaaaauuguauguaaacauguguguguaugcaugcuuguguguguguu

SEQ ID NO: 4145734 - RNA, 74 nt, Human
aaugcacaugucuuggccucaccuccagccuacucaauuauaauuucugguuuuagagcccagaugucuguauu

SEQ ID NO: 4145735 - RNA, 63 nt, Human
aaugcagaacuucuguuaguacuauucauguuuuugcuaaaugugcacacagaaauuugcauu

SEQ ID NO: 4145736 - RNA, 74 nt, Human
aaugcagauuucuuggcuccucucacagacucagggaccaaaaauuuugugauguggaccuggcaaucugcauu

SEQ ID NO: 4145737 - RNA, 77 nt, Human
aaugcagcuggcaagugucugagguuuuguauuagcccacaaagggcauaauuaucucagacacuuguuuauucauu

SEQ ID NO: 4145738 - RNA, 74 nt, Human
aaugcagguauuccuggccucaccccaacuauuuuaauuucagguaauuugggugggguucaggaaucuucauu

SEQ ID NO: 4145739 - RNA, 112 nt, Human
aaugcaucaggcguuuuaagaaugaagugaaaguaagaaaguaggacugcccaauggaggacagucuuccaagaguuauauuucucucuuuuuucuaaaugccuauggcauu

SEQ ID NO: 4145740 - RNA, 80 nt, Human
aaugcaugguaucagaaguguuuuggauuucagauuuuuuuugggaaucuggaauauuugcauuguaccaguucagcauu

SEQ ID NO: 4145741 - RNA, 86 nt, Human
aaugcccucacaggcaugcuuuaucugugagaaccugagagcagaaaagcuuugguaauuaauuugauagguucuggauggguauu

SEQ ID NO: 4145742 - RNA, 57 nt, Human
aaugccuuuccacuggguaucaggaguacuugagcagcuauuaguggaagaggaauu

SEQ ID NO: 4145743 - RNA, 77 nt, Human
aaugccuuugcucaugucaccaaagcacaagcagaaacauuacugcuuagugucuuccaggacaugguaauaguauu

SEQ ID NO: 4145744 - RNA, 70 nt, Human
aaugcuaacauugguuuauaucccuugagcacacaccagcuggauaguaggaggaagccaguucagcauu

SEQ ID NO: 4145745 - RNA, 66 nt, Human
aaugcugaguccugugagucuuccuagcaaaucaaaucuggaaggggucuugaggacuccagcauu

SEQ ID NO: 4145746 - RNA, 58 nt, Human
aaugcugcugcaugaacagcggucacgaugcuagugggccagggagugcaggagcauu

SEQ ID NO: 4145747 - RNA, 58 nt, Human
aaugcuggaucuccuccuuggcaugcuuauuaucucccucgggagcagauccaccauu

SEQ ID NO: 4145748 - RNA, 65 nt, Human
aaugcuucugagaggucaaggcaaaaacuaaagaagcuguuggauuugacagcucagagggcauu

SEQ ID NO: 4145749 - RNA, 81 nt, Human
aaugcuucugauuuuccuacugauaaacaguuauuagaaaauaauuggauaaaaauaauuaguaggacaguugaagguguu

SEQ ID NO: 4145750 - RNA, 83 nt, Human
aaugcuugauacuauauuguuuacagacuuccuugugacucauggcucuucacaugucagucuuaaacagaugggaagguauu

SEQ ID NO: 4145751 - RNA, 57 nt, Human
aaugcuuugccaacagcuauugucuuugacaagugacugugcuggcaacauagcauu

SEQ ID NO: 4145752 - RNA, 57 nt, Human
aauggaaugaauaagcaagcugauaucaauuuaucagcuuaucuuguuaguuucauu

SEQ ID NO: 4145753 - RNA, 73 nt, Human
aauggagagaacugaccugaaaggauuuugauacaagguuguugacuguuccuaagguaagauucucuauauu

SEQ ID NO: 4145754 - RNA, 60 nt, Human
aauggauuccagggggaccauucaguaggauauugcaguggugcuagguggaauauaguu

SEQ ID NO: 4145755 - RNA, 91 nt, Human
aauggauuuaagcauaauuugauuuuauaguuggugaacguggcucaauuaacuucaccagguguacaguuaguugaucuugggcucuauu

SEQ ID NO: 4145756 - RNA, 62 nt, Human
aauggcagagcugggauaugaacccagguagucuggucaugaaguucccacucugagccauu

SEQ ID NO: 4145757 - RNA, 70 nt, Human
aauggcaguugagauggaguuuuggggauaugggcuucuuggaacauuuccuuuuacuccggcugcuauu

SEQ ID NO: 4145758 - RNA, 73 nt, Human
aauggccuguuagaguugucucagguuaggguuagaugauccugccuucauacugcuguaucaacuggccauu

SEQ ID NO: 4145759 - RNA, 77 nt, Human
aauggccuuacaggucugugucaucaucuguaacagagaaggcugagaagauggugucaguagauucuggggacauu

SEQ ID NO: 4145760 - RNA, 55 nt, Human
aauggcuggguuucauuuuguaaaggcauuuguuuagaaacuggucuuagccauu

SEQ ID NO: 4145761 - RNA, 70 nt, Human
aaugggagacugguuuauguaucaucuagaauugugauaugguucaaggggauaauaaaccuuacuuauu

SEQ ID NO: 4145762 - RNA, 57 nt, Human
aaugggaggauuuucucucuugcauaaauacacagagaccugaagagcuuccucauu

SEQ ID NO: 4145763 - RNA, 74 nt, Human
aaugggcugccaggggccucacaggccaugguaaugcagaagcccuggcuagauugagcccuugcaugcuuguu

SEQ ID NO: 4145764 - RNA, 129 nt, Human
aauggggcaaggugagaaugaacccugugggauuggauuugauuuguagauaguguagauacauuaauauauuauauuguguuauauaucacaucuuauccuaucuuaucuuauucuggcauguugauu

SEQ ID NO: 4145765 - RNA, 65 nt, Human
aaugguaaaugaaacagucuccagacuuggaugacaccaucagaagucuggacugcuucuccauu

SEQ ID NO: 4145766 - RNA, 79 nt, Human
aaugguuaguuuggaaggaggagcaucuggauguaaugaauuuacauguauugauuucucuucuuccaaauauauuguu

SEQ ID NO: 4145767 - RNA, 79 nt, Human
aaugguucugcaggugguuuggacacugcucaagaguccccuuggcuggcaggcaacggaccacuagucagaaauaauu

SEQ ID NO: 4145768 - RNA, 108 nt, Human
aauguauacuuuaaguucuaggguacaugugcacaacaugcagguuuguuacauaugcauacaugugccauguuggugugcugcacccguuaacuugucauuuacauu

SEQ ID NO: 4145769 - RNA, 79 nt, Human
aauguccaagucacagauuuucagcagacaggagaauaaaauccaugccaaugauggaaacuugggaacuuggcacauu

SEQ ID NO: 4145770 - RNA, 64 nt, Human
aaugugagggaaaucagucagaauuggcaauaucucacaauuucacugauuuuuccccagaguu

SEQ ID NO: 4145771 - RNA, 86 nt, Human
aaugugcucuguauucuauggcaguuggugauaauaauagcuugguuucuuuuggugcauuuccuucaaggaguugagaggacauu

SEQ ID NO: 4145772 - RNA, 78 nt, Human
aauguggaaauuugagaagaaauaguuugcaauuguguuuacuuuacaauuggccaauguuucucacuguuccucauu

SEQ ID NO: 4145773 - RNA, 56 nt, Human
aauguggguccuauggaguuucaguaucagacuuauaaaacucauagacucauauu

SEQ ID NO: 4145774 - RNA, 81 nt, Human
aauguguaauuggauuguaacauagaguaaaugcuugagggaguggauaccccauuuucuauguuguaauuguuacauauu

SEQ ID NO: 4145775 - RNA, 79 nt, Human
aaugugucagaaggcaauggggauaucugggcccuaguuucaacucagcuacaaauucacauuuagccucugacauguu

SEQ ID NO: 4145776 - RNA, 68 nt, Human
aauguguccuauaacuagaaauguguuuugagcaauuuguaggcucaguuuauggucuaguucauguu

SEQ ID NO: 4145777 - RNA, 94 nt, Human
aaugugugaaaaauacuugcuucaaauaaauguuuaauuauagacauuauaaugacaauauuaauuuggagggaguguauuuaacuaauacauu

SEQ ID NO: 4145778 - RNA, 56 nt, Human
aauguuaauggaucaaccuagacaucuuugugguguuaaacaugauccauuacguu

SEQ ID NO: 4145779 - RNA, 56 nt, Human
aauguugacguuggccagggccuuuccaaacaagccaggccaaaagguucaacauu

SEQ ID NO: 4145780 - RNA, 60 nt, Human
aauguuuaagaaaaauagcagcaguuucacuaugcugagugcaauuuagacuugaacauu

SEQ ID NO: 4145781 - RNA, 60 nt, Human
aauguuugaacuuugcauauuugacauaguuccugguaggaauagcacagcucaaacauu

SEQ ID NO: 4145782 - RNA, 76 nt, Human
aauguuuucaguagauuggcuaauuugauacuuugaaaaacaaguauacuauuauugucaguuuauaaauggcauu

SEQ ID NO: 4145783 - RNA, 77 nt, Human
aauuaacaugggacguuauuuuaaugacugauuuuaacuagaucaugugauuugaaguaaugggucugugucugauu

SEQ ID NO: 4145784 - RNA, 76 nt, Human
aauuaauucaauguuucuuaucaaguugaaaucaggaggguuuucaggucagcuggaugggagaccauguuugguu

SEQ ID NO: 4145785 - RNA, 67 nt, Human
aauuaauucaguuuuuaagggaaggaggagacccaaaucauaucccuaaauaaauucuggaugaauu

SEQ ID NO: 4145786 - RNA, 77 nt, Human
aauuaccuauuugaguccuguuuccaauuuguuggguuauauacccaugaauggaaucacuggagcauaugguaauu

SEQ ID NO: 4145787 - RNA, 68 nt, Human
aauuaccuuugaaguugugugggguuuuuucgucucccuuagaugacccacaguuaaccaaaggaauu

SEQ ID NO: 4145788 - RNA, 130 nt, Human
aauuacuuaauuaaaaaauggggagaaacauaauuugagcccuuuacaguaugguuguaucaaaacacauuuuauugagagaucaaacuuguaaaugauccaauuugugauuuuccaugccuuugagauu

SEQ ID NO: 4145789 - RNA, 62 nt, Human
aaucuacuucugcauauaccaggaaaggcuguuaaagacucugaaaugggcaaaaguagauu

SEQ ID NO: 4145790 - RNA, 58 nt, Human
aaucuaggacgccugccaugcuaggacccccuacaucucuucuuaaggcuccaggauu

SEQ ID NO: 4145791 - RNA, 71 nt, Human
aaucuauaugcuuuucacauacauaaauaaugacaagaaaacauuaggagcaggguggagagcaauagauu

SEQ ID NO: 4145792 - RNA, 130 nt, Human
aaucuccauacuugaacuuuuucuguuauuaaaucuugcuguaccucuacaagguaaauaugaccuuucuaggugagcaggauuucaugguguaauaguuuugugcuucugacuaguguaggugaccauu

SEQ ID NO: 4145793 - RNA, 66 nt, Human
aaucucuguugcuaugauaguuaagauacuaggaaaguccuuugugaacuaugaauagaagagauu

SEQ ID NO: 4145794 - RNA, 62 nt, Human
aaucugaggcuggcacgggaggugucaguagagacauaggcacacugucccauccucagguu

SEQ ID NO: 4145795 - RNA, 77 nt, Human
aaucugcccggaggagccuuccagacugcccacacuaggccaggugugggaggucuggaaggcuccccaggcagauu

SEQ ID NO: 4145796 - RNA, 57 nt, Human
aaucuggaguuaauguuuucgcucaaggaagcugaagacuaucaauacuccaugguu

SEQ ID NO: 4145797 - RNA, 94 nt, Human
aaucuuggugaaucguaauugcuuguuuucggucauaagaacauaaggaagaaucuguauugcagaaaauaggcaguguuuacucugcgagauu

SEQ ID NO: 4145798 - RNA, 118 nt, Human
aaucuuguuuguuguaacuaaugagugcccucuggaagugauggcaggucauuaccauuauucaaauuuauaugaucagccuauccuaucuagacucauuuucagugauagauagauu

SEQ ID NO: 4145799 - RNA, 59 nt, Human
aaucuuucaauacugcacuguguuuucuggucacagcguaaaugggguguugaaggguu

SEQ ID NO: 4145800 - RNA, 99 nt, Human
aaugaaauaaugcaauauguacacuuacagguauaucuucuuaguaaaauguauuuaagcuucauauaugugugagucaauaguuugugucucuucauu

SEQ ID NO: 4145801 - RNA, 129 nt, Human
aaugaaugaacaaugggcucucacaauuauuugcuggagauaaugaugcuaacccaguccaguuagcagaacuagacuggguuaacaucauuaucugcagcaaauaauuaugagaacccuguaauucuu

SEQ ID NO: 4145802 - RNA, 77 nt, Human
aaugaaugacaguugguuggacccaaguaaggaguuguuaguaaguuccuuucugguauuuaaccaaagcauuuguu

SEQ ID NO: 4145803 - RNA, 76 nt, Human
aaugacagcuacagggagagcauugccacuuggaaacaacuuugcagauguuguuccugccuguagacagguuauu

SEQ ID NO: 4145804 - RNA, 104 nt, Human
aaugagaaauguguagcauuggcauugggagcagcagggagaugcggagccugagauuccaguuccguccccucugaccuugcugauaugcaaauuguuucauu

SEQ ID NO: 4145805 - RNA, 124 nt, Human
aaugagauaacagguaucauugcuuuguaaauuguagagcuauucaugacauuuaaacauugaugucaauauuuauugagugcuaagaauaaucugcaaagugugcuacauggagcaucuuauu

SEQ ID NO: 4145806 - RNA, 84 nt, Human
acagcgugcuggaccuuccugagccugugccuugagagcagugaguuuucucacagcaggggccaggucugucuuguucgcugu

SEQ ID NO: 4145807 - RNA, 91 nt, Human
acagcugaaucauaauuuuuguugcucuguuuacuugaugaucaaggccaaaguccaguaaaaagcgacaggaaguguauauucagguugu

SEQ ID NO: 4145808 - RNA, 73 nt, Human
acagcugcuguguuucugcuagaaaauaaauaacaaauauauugacaugccuuuuccuuagaacagcagcugu

SEQ ID NO: 4145809 - RNA, 56 nt, Human
acagcugcuguuuuugaaggacgccagucucuuaugcuucauuggcagcagacugu

SEQ ID NO: 4145810 - RNA, 65 nt, Human
acagcugguuaucagagaggccuaggccagaacucaugccagcgccucucccauggcuauccugu

SEQ ID NO: 4145811 - RNA, 66 nt, Human
acagcuguaugugaggccacagugaaguuuguauacaggguuuuguuugccacacaaaacaguugu

SEQ ID NO: 4145812 - RNA, 58 nt, Human
acagcugugguuugccaauccuuuagacccaucuggucuagagacugccaccagcugu

SEQ ID NO: 4145813 - RNA, 55 nt, Human
acagcuucuauuucucuguacucuaugucuuugaguuuggagagaaagaaguagu

SEQ ID NO: 4145814 - RNA, 64 nt, Human
acagcuuuagagaagaaagguugcuguuggauucaagggcagcuuugagucuuagaguacuugu

SEQ ID NO: 4145815 - RNA, 84 nt, Human
acagcuuuuaacuugaccuguauaaaacacugaauuuaggagcuugcaugacguguuuacguaccaggcuaaggaaaaaauugu

SEQ ID NO: 4145816 - RNA, 67 nt, Human
acaggacuuugccauaugggucuuguuuccucaacuggugugaaaacucugugugaguagagccugu

SEQ ID NO: 4145817 - RNA, 93 nt, Human
acaggaucaaagggaaccuguuaggguugcuuuuggcugcaacuaacagaaaacugccccagugacccuaacagguagggcuuugguuccugu

SEQ ID NO: 4145818 - RNA, 63 nt, Human
acaggauuccaggauuccaggacaaauugauuacaaaugaccugcaaaugcuuggcacccugu

SEQ ID NO: 4145819 - RNA, 64 nt, Human
acaggcaagucacacaacuuguacaagaauucaucuugggccaggugcaguggcucaugccugu

SEQ ID NO: 4145820 - RNA, 58 nt, Human
acaggcaccaugacucuugugcagauugucuuguuuuaauaugggugaugaugucugu

SEQ ID NO: 4145821 - RNA, 60 nt, Human
acaggcacugucaagucaugaagaugugaguuucuuccuagcccugacagcaguggcugu

SEQ ID NO: 4145822 - RNA, 56 nt, Human
acaggcagcugcgacaagagagcccuuuugccgaaaauagcuuuccagcagccugu

SEQ ID NO: 4145823 - RNA, 55 nt, Human
acaggcagguccugucccagcugcagagcagaguggugggacacgaucugccugu

SEQ ID NO: 4145824 - RNA, 56 nt, Human
acaggccauaaaggcaggcccuucuuccucccucggguggcccccuuuauggaugu

SEQ ID NO: 4145825 - RNA, 87 nt, Human
acaggcccuugacucuuucuggugacucaggaggauaaagcugcauuucagucugauggcuccuucauuaugggucagauggccugu

SEQ ID NO: 4145826 - RNA, 85 nt, Human
acaggccuguaugcugauuauaagccagacguuucagacauuuugugaaaagauuuuagugucuggcuauauuuaaaugcucugu

SEQ ID NO: 4145827 - RNA, 65 nt, Human
acaggcgcuggggccaaggcuaaauaauuccucuguauucacaugccuucacucccagaguuugu

SEQ ID NO: 4145828 - RNA, 70 nt, Human
acaggcugaccggcugcacggccgggagggcgcggcuucuaggcccaggccugcggcuggggagcgcugu

SEQ ID NO: 4145829 - RNA, 85 nt, Human
acaggcuuucuggacaggucaaagcccaugaugacccauaaugagagaaguuggacacuauggcuugacuugcaccggcaccugu

SEQ ID NO: 4145830 - RNA, 77 nt, Human
acaggcuuuguaguucuggcucuccccugcuggguucagucgggcuuuccaaggguagggccaggccuuuugucugu

SEQ ID NO: 4145831 - RNA, 83 nt, Human
acagggacacacuugcauuugagaaaguucuccuggcagcagggugcacagcagaggaagcagauucggggaggugccccugu

SEQ ID NO: 4145832 - RNA, 65 nt, Human
acagggagcugacaaccaaggaguggcugauaaauacuccagcuuucuccccucgguuucccugu

SEQ ID NO: 4145833 - RNA, 60 nt, Human
acagggcuggggcacuuggcuggcacaggauggccaagccucugaagagucuuuuccugu

SEQ ID NO: 4145834 - RNA, 130 nt, Human
acaggguuucacuguguuagcgaggauggucucgaucuccugaccucgugaucugccggccuuggccucugaaagugcugggauuacagguuugagccaccgcgccuggcccucacacuucuugcucugu

SEQ ID NO: 4145835 - RNA, 98 nt, Human
acagguaaaguagcaugauuuauaacuuugggcccaccuguugagaguugggguuuauuacaagguuccagaauuaugcucuuuucuuccagcccugu

SEQ ID NO: 4145836 - RNA, 114 nt, Human
acagguaagcucucaaucauuguugacuacauaagaagaccaggguucaagucuuggcuccauucuuuaugaguugugugaucuaaauuuuuuggagccuuaaauuuuaccugu

SEQ ID NO: 4145837 - RNA, 72 nt, Human
acaggucucugcucuagagucugugauugucucccgagauggaccgugaacuucucaagggcagagacuugu

SEQ ID NO: 4145838 - RNA, 74 nt, Human
acaggucugaggcuauccacgcacaugggcuugaccuacauuaggucaagaauugaugugguuuuuaaaccugu

SEQ ID NO: 4145839 - RNA, 78 nt, Human
acaggucugguuggccucucccaaauggcuuugggugacccuaucccccuggcugcaggcagaggcugucuggccugu

SEQ ID NO: 4145840 - RNA, 61 nt, Human
acaggugagggguucuaggcuguauggagaaagaaaggaaagccaggaaguccccaacugu

SEQ ID NO: 4145841 - RNA, 83 nt, Human
acaggugucucugccucggccuuggcauguacagucgguuugaagcucugcugcucgccacggcccaggggagcuaugccugu

SEQ ID NO: 4145842 - RNA, 97 nt, Human
acagguguugaguaguuuccugggccuuuaaugcuuuaaauuuauuauuuaacaacuaaagccauacugaaagccacuuggaaacuucagcugaugu

SEQ ID NO: 4145843 - RNA, 55 nt, Human
acagguuuaagagguauuuccucuuucucauaggaaaugcuuuguauauaucugu

SEQ ID NO: 4145844 - RNA, 91 nt, Human
acaguaaagucuuggcgguauucucagagugaccaagucuuucuaucuuuggaaagaguuacacaguuucagaaacugcuaagauagcugu

SEQ ID NO: 4145845 - RNA, 55 nt, Human
acaguaacucuuuuacccuccuccagguauagauuuggguuggagaaguuucugu

SEQ ID NO: 4145846 - RNA, 55 nt, Human
acaguaauugugaacuuaacgucucagaauugggccaagaaagugcaguuacugu

SEQ ID NO: 4145847 - RNA, 62 nt, Human
acaguagauugguaugaugucagagaaggaauuccuggaugacucgggacuacauuuacugu

SEQ ID NO: 4145848 - RNA, 79 nt, Human
acaguaggugcucaauacauguguguggauggugcgcccagccaccuggagauuucuauacauguaagggcucugcugu

SEQ ID NO: 4145849 - RNA, 75 nt, Human
acagucaaacaaauuaacauauccaucaccuuccauaguuaccuuuuguguguguguguuuguuugugugugugu

SEQ ID NO: 4145850 - RNA, 70 nt, Human
acagucgcgguugcugauugagaacaggccugucccagcaguucucagaggagucgggagcugcggcugu

SEQ ID NO: 4145851 - RNA, 80 nt, Human
acagucuucuucucugucuucuguacuuuguuccuaugaccccagggaggccauaguuugggagucagggggaagagugu

SEQ ID NO: 4145852 - RNA, 58 nt, Human
acagugauucugcaaaccauaucgaacccauguuagauauuugcauucuagucacugu

SEQ ID NO: 4145853 - RNA, 57 nt, Human
acagugguauggacugaaauuguuucuauaauaagcccaccagcuuuaugcuacugu

SEQ ID NO: 4145854 - RNA, 86 nt, Human
acaguguaguaaaaguguagagacuuuggaaccagacagaucuucaucggaaucccgguucugucucuacacuugcucugugcugu

SEQ ID NO: 4145855 - RNA, 128 nt, Human
acaguguauaucaauuucaaggcacagggaggaaacauccauuuuguucaaaagcaucagacuuuguggauucuguuuggaugcagcagaaguguucuucucuuucaaaaguauuagaaacgcauugu

SEQ ID NO: 4145856 - RNA, 103 nt, Human
acagugucauuuguuuaggagaaucuacaaugaaaaaauguuuaaauuaaauguuuaggcauuuaaagauguaagacucgcuuaucuggcacauagacauugu

SEQ ID NO: 4145857 - RNA, 78 nt, Human
acagugugugccucugugggcagagcugccugucguagaagggccagggcagcaugcagcgggggugagggcuucugu

SEQ ID NO: 4145858 - RNA, 98 nt, Human
acaguguuggaggcugaaaauccaagaucaagguaucagcagauuugguuucuucaaagacuucucuccuugacuugcagauggcaccuucucacugu

SEQ ID NO: 4145859 - RNA, 70 nt, Human
acaguuaugcaagugcuuuccucacacuuggcaugcagccuaagugcuuuguggagaauuuguauuuugu

SEQ ID NO: 4145860 - RNA, 68 nt, Human
acaguuccccucaacagggcugggaccaucugcaggcacuuacuucagcugugugccaggggagaugu

SEQ ID NO: 4145861 - RNA, 73 nt, Human
acaguugcagaggccucaaaccagaccugaugauucagaaucucagaugcuagggcugagcuauuugcauagu

SEQ ID NO: 4145862 - RNA, 64 nt, Human
acaguugggcuuauguaauuuuaagauggaaaacauuuuccuuuaaaauuuuaaaagccacugu

SEQ ID NO: 4145863 - RNA, 55 nt, Human
acaguuuggcaaaugucccacagcccgcuuguccuggggugugugccugagcugu

SEQ ID NO: 4145864 - RNA, 63 nt, Human
acaguuuuggaaguauuacuaucccucuuuacaaaugaggagagacugaaacaccaagacugu

SEQ ID NO: 4145865 - RNA, 91 nt, Human
acaguuuuucaggagcacauuuguuucucuagaguagguccucuuuggaguccacuuugagaagcugaugaaagcuauggauucucauugu

SEQ ID NO: 4145866 - RNA, 55 nt, Human
acauaaaauagcaaauaaaacaggcuuuuccuguguccugguguuaauuuuaugu

SEQ ID NO: 4145867 - RNA, 62 nt, Human
acauaaacaugcuuacauucucaacacaaguggagagagaucaaccugugcauguucugugu

SEQ ID NO: 4145868 - RNA, 82 nt, Human
acauaacccagcggaagagcuggagcugcuacaggaaaaguuuuguaaucuugaaauauguucagcuuuuuuguagguaugu

SEQ ID NO: 4145869 - RNA, 83 nt, Human
acaaugaaugaugauuagaaguuauagaggugcagauucauauccacacagauaaguguuuucuaacaaaccauuaucauugu

SEQ ID NO: 4145870 - RNA, 80 nt, Human
acaaugaucagaauuaaagugcccuauguaaagcauuuuucaggaagaggguagaggcauugcuuaauuucagauuuugu

SEQ ID NO: 4145871 - RNA, 78 nt, Human
acaaugcauacuucgaaauuucaguggauguuuuucuuuaucauuguaugaauaagguuuugaaguacaauguuuugu

SEQ ID NO: 4145872 - RNA, 84 nt, Human
acaaugccuagcacauaguaggcucucaaugaauauuugcuuaaugccgaaugaauuaagagccuacuaugugccgggcgcugu

SEQ ID NO: 4145873 - RNA, 56 nt, Human
acaauggcggcgccaggcccuaauuggggacagaggcacccgcgcgcggccauugu

SEQ ID NO: 4145874 - RNA, 73 nt, Human
acaauggggcaacaugaagaaaacagaacccuugcacacuguuggugggacuguaaauucauauggccauugu

SEQ ID NO: 4145875 - RNA, 80 nt, Human
acaauguaccugguauguaauaaguguucuaaaaucacugacaggauuauuagacaauauguauuuuauauguguguugu

SEQ ID NO: 4145876 - RNA, 59 nt, Human
acaaugugauaauuuaaagauaugggaucucccaguuguuuuggagguuuuuucauugu

SEQ ID NO: 4145877 - RNA, 76 nt, Human
acaauuauccuuuuggcaucugucucugcuuguacuucucugcaaucaauuggcucauguaugaaagggugugugu

SEQ ID NO: 4145878 - RNA, 67 nt, Human
acaauucagaaagcaguugucaaugggcuggagcuuucagcugauaaggaggcauuucuggaauugu

SEQ ID NO: 4145879 - RNA, 65 nt, Human
acaauuggcaugaggucuaugaauauguaguucacagguauuuuucauauuucucuugcuauugu

SEQ ID NO: 4145880 - RNA, 62 nt, Human
acaauuugguuacuuccuuagaauucauuuuagugguguguuuucucuggauagccagaugu

SEQ ID NO: 4145881 - RNA, 100 nt, Human
accaaaggcuccugagggcugcuuccagagcuagccaaagccugugccuuuggggacuuggccuggaugcagccuuagaugucgcaggcgcacauguggu

SEQ ID NO: 4145882 - RNA, 70 nt, Human
accaaaugcugacggcugccugcuucaaacccugccacaucagcagggagggagcacagcggcauuuggu

SEQ ID NO: 4145883 - RNA, 67 nt, Human
accaaccaaaaacaaugacuuuggagaaaaauuagacucagaaagucuguccaggcauuggguuggu

SEQ ID NO: 4145884 - RNA, 79 nt, Human
accaagauagucugaaguuuagaguguuguaauuuacuauggggagagggcacaagacucugagccccaagcaauuggu

SEQ ID NO: 4145885 - RNA, 76 nt, Human
accaagcaacaugaugaccacguguauccauaagcacagcaccuggcuggcugagggcuggucacauuuguuuagu

SEQ ID NO: 4145886 - RNA, 56 nt, Human
accaagggcagagccuacauagaccugcaggcagccccugaggcucagcuccuggu

SEQ ID NO: 4145887 - RNA, 82 nt, Human
accaaguuagguuuuauccucuguuuacaugugugcuuuagagagggcacauguguaaaaguggauaaaagugacccauggu

SEQ ID NO: 4145888 - RNA, 86 nt, Human
accaauauuguuauaauauggagauugacaacuagaacaggagccucuuucuuagauguuagcucugugugggaugcagugagggu

SEQ ID NO: 4145889 - RNA, 55 nt, Human
accacagcaggcccuggaagcuggaacccccaccugcugccuuguccugcuuggu

SEQ ID NO: 4145890 - RNA, 79 nt, Human
accacaggcaccagagggaguuucugagguugcagaggugacugagcaauaucuuccaagcucccugguguauucuggu

SEQ ID NO: 4145891 - RNA, 56 nt, Human
accacagugaguuagauugaccauguuuuucaauugugguugguuaugccuguggu

SEQ ID NO: 4145892 - RNA, 69 nt, Human
accacauucaucaguguuguacugauugaucuuagaaauauauaaauagaauaauagugacgaaugggu

SEQ ID NO: 4145893 - RNA, 107 nt, Human
accacauuccuaggcacucuucuaggcacuggagauacagagaugaacaagacagagauggucacaguuuuucugucucuuacauugcagaaagagagggauguggu

SEQ ID NO: 4145894 - RNA, 90 nt, Human
accaccaacuuaaaaaggcugguguggggguuucauuaagacaauuucuuaaaauuguuuaaagauacaucccugaauuccuuugguggu

SEQ ID NO: 4145895 - RNA, 69 nt, Human
accacccccagcuaauuuuugaauuuuuaguagagacgggauuucaccauguugguuggcuaggauggu

SEQ ID NO: 4145896 - RNA, 56 nt, Human
accaccucagcucuggauggcacuuaagucagccucaauucauuggccaggguggu

SEQ ID NO: 4145897 - RNA, 82 nt, Human
accaccuucugauaauugagaacaggaguguucuuuuaggauuuuccuggauaccuaccaccuguucucacacgaggcuggu

SEQ ID NO: 4145898 - RNA, 56 nt, Human
accacgccuggcuaauuuuuguagagacaagguuucaccaucuuggccaggcuggu

SEQ ID NO: 4145899 - RNA, 78 nt, Human
accacuccaucuccaacucccuccccugucuagcuucauugaaaacugcaggauggguagaaguggaagagguguggu

SEQ ID NO: 4145900 - RNA, 130 nt, Human
accacuucagggaugauuucuggaccauugauaaaaagcuuagucaauagugaauauagaguaugauuucuuaguuuuuaucuuucuuuugaauugcuuuaagugggugguagcugaaucccucgagggu

SEQ ID NO: 4145901 - RNA, 65 nt, Human
accacuuugacaauuugauaggaacauaucuuuguguauuuucauguuucaauuguuaauguggu

SEQ ID NO: 4145902 - RNA, 80 nt, Human
accagaaccagcccagcacuaaguagauuuguguuggauaaaugaaaaugaccauuccgcuuuuugcugggcuguuuggu

SEQ ID NO: 4145903 - RNA, 72 nt, Human
accagaacccuaggccuguguugccguacuuuuaucaacucaaauacaggugugagggucucuuuacucggu

SEQ ID NO: 4145904 - RNA, 74 nt, Human
accagacauggucauugcucucaaguugcuggcauucuaauggcagcagaaauagaagucaaugauagcugugu

SEQ ID NO: 4145905 - RNA, 64 nt, Human
accagaggaagggaaucucaagucuuuaccucccacagucuggugugauucucucucuuuuggu

SEQ ID NO: 4145906 - RNA, 56 nt, Human
accagaggcagacuuacacuccagucugugauuggcuacauguuucuguuucuggu

SEQ ID NO: 4145907 - RNA, 57 nt, Human
accagaggccucuagggccccucaggaccuugucuugccccuggccaggccccuggu

SEQ ID NO: 4145908 - RNA, 64 nt, Human
accagauuugagcgucuuaaaccuacucaguaguagguuucuacuccaguuacaaccaucuggu

SEQ ID NO: 4145909 - RNA, 67 nt, Human
accagcagcacaauuuccaagucauguuauuuuuguuaaaaaugaacuagccagguugugcuguggu

SEQ ID NO: 4145910 - RNA, 95 nt, Human
accagccaucaugcucauguccgggaucucaguccucuggggaaggugagguggcuuuuccucagccaaggcugggauccucagugggugcuggu

SEQ ID NO: 4145911 - RNA, 70 nt, Human
accagcccuucaucaccuaacuugugauuuacagacacugagcacauugcagguugagaaggugcuuggu

SEQ ID NO: 4145912 - RNA, 82 nt, Human
accagccuacuagugcagcacauauaaacaaagagaaaacacauuuucucaaucaaacaugucugacugucuagauaguggu

SEQ ID NO: 4145913 - RNA, 65 nt, Human
accagccuggccaacauggcaaaaacccaucucuaccaaaaauacaaaaguuagccagguauggu

SEQ ID NO: 4145914 - RNA, 62 nt, Human
accagcuaccuuaacagugucaagccucugcuuuggggauagacacaaaggguaguaauggu

SEQ ID NO: 4145915 - RNA, 71 nt, Human
accagcuggucaccugggcacuauucucucccuucugucugugucccuuugaaagcaguugaccaccuggu

SEQ ID NO: 4145916 - RNA, 67 nt, Human
accagcuuuucucaccagaugguguugcuaucaagcauagccuuccucugccugagacuuugcuggu

SEQ ID NO: 4145917 - RNA, 85 nt, Human
accaggccucugugugucauuugucaauccuuuucuguagugggaagcagggagcaggaacauaauugauugcacagcucugagu

SEQ ID NO: 4145918 - RNA, 58 nt, Human
accaggcucccugccagggccggcgcagugcagcgccugagcuacuagggagucuggu

SEQ ID NO: 4145919 - RNA, 57 nt, Human
accagggcacauuccggccagauacccccacuguucugcugcuucuuugcccugugu

SEQ ID NO: 4145920 - RNA, 96 nt, Human
accagggccucagauucagugggaaugaaguggaggcccagaaagaaucauguccaggugaagcucuaccauucccagcaguauuugaggacuggu

SEQ ID NO: 4145921 - RNA, 55 nt, Human
accaggguacuucuagguggggcuugcagcugccccuguccugcuaggcccuggu

SEQ ID NO: 4145922 - RNA, 70 nt, Human
accaguagugccucauuuuuaaguguuauauaaauauucuguggccaaaauaaaaugaggucuaacaggu

SEQ ID NO: 4145923 - RNA, 60 nt, Human
accagucucugcaugccugcugugccuggaaaaggcaauccugcauguuagggauggggu

SEQ ID NO: 4145924 - RNA, 68 nt, Human
accaguuauuagcccuacaacuuugaacaaaucacauaaucguucauaauugcugguuaguaacuggu

SEQ ID NO: 4145925 - RNA, 74 nt, Human
accaguucuuuagaaguugaugguauugguuuuacauuauuucucauuuugcuucaaagguuauuuguacuggu

SEQ ID NO: 4145926 - RNA, 63 nt, Human
accauaugugucagguacacucauuagcucaacuuugcugaugaggauauagauacacaaggu

SEQ ID NO: 4145927 - RNA, 59 nt, Human
accauccaaacugcuuucuguggauccaaucuguaaucugcagagcgcgucuggauugu

SEQ ID NO: 4145928 - RNA, 60 nt, Human
accaucuagaagucccugagggcucaaaacugccccaccagugagaccuucuaagguggu

SEQ ID NO: 4145929 - RNA, 58 nt, Human
accaucuuuuacauuacugcccagaguucuuuuucugaagcaccgguaagaugguggu

SEQ ID NO: 4145930 - RNA, 72 nt, Human
acagaauugggcuggcugaacuucaaccugaucccaucaggcagggaagcuuccagucaagcugaaugcugu

SEQ ID NO: 4145931 - RNA, 111 nt, Human
acagaauuuguacuuuuuuauuagcacguuaguggaguuugaagcuguuaguugaucuuuucaggauauuuucaugagcuuuacuaguuuaggaaacagugcuuuuucugu

SEQ ID NO: 4145932 - RNA, 55 nt, Human
acagacaauuuuacugagccauuuguuuauuuaggauggccugcuagaagucugu

SEQ ID NO: 4145933 - RNA, 61 nt, Human
acagacauuuuaagacacuuuacucaaauccgucaucgaguaaaggaguugcauuguuugu

SEQ ID NO: 4145934 - RNA, 65 nt, Human
acagacccaguuccacaaacuggaacuucuacaacucuugcuuccaguuaaucacugaguccugu

SEQ ID NO: 4145935 - RNA, 77 nt, Human
acagacuuggaaucugcuuuuuauuguauaaaucaauuuuagcaguauuuguaaauaguaguaagaugccaagaugu

SEQ ID NO: 4145936 - RNA, 60 nt, Human
acagagaaagugggcugaagauuuccaaacauuuuucacucucaccuacuauuucuuugu

SEQ ID NO: 4145937 - RNA, 67 nt, Human
acagagaccuggccuugcuuugcauuaucccgggcgggggaagcaacgaggacucagauuucucugu

SEQ ID NO: 4145938 - RNA, 88 nt, Human
acagagcauaacagugagcaauguuaggucucuuuagaucacuaauaagggaaccaguggaaugauaugcucauucaaaugagacugu

SEQ ID NO: 4145939 - RNA, 58 nt, Human
acagagccccauugcuugcccaaguccuuuuccagaagaggccagcacagggcucugu

SEQ ID NO: 4145940 - RNA, 55 nt, Human
acagagcucccagccaucuccucccuguucuggaagacugaugggaagacucugu

SEQ ID NO: 4145941 - RNA, 55 nt, Human
acagagcuuaggaugacucccagugauucucacuuccugguguuuacagcuuugu

SEQ ID NO: 4145942 - RNA, 71 nt, Human
acagaggaccacagaugagccugcagagaaauacucuacuaguuugccggcucuaugugguuuuggauugu

SEQ ID NO: 4145943 - RNA, 57 nt, Human
acagaggcagugugagauacugaaugagaauugcgaucugguugaacauuccucugu

SEQ ID NO: 4145944 - RNA, 66 nt, Human
acagagguguuccagaccuagggagcuuucuaacaaagucauggaagcagguagggauaccauugu

SEQ ID NO: 4145945 - RNA, 63 nt, Human
acagagguuaggauggguuguaaacacuuuauuauuauacagagccuaauaucuaaucuuugu

SEQ ID NO: 4145946 - RNA, 64 nt, Human
acagagucauaagcauguuuuagggucuucaucgugaaccacucuuuaacagacuuugaucugu

SEQ ID NO: 4145947 - RNA, 63 nt, Human
acagagucuuacguggugauaacaaugacauuaugucucuuuuaucaccuguagguucuuugu

SEQ ID NO: 4145948 - RNA, 95 nt, Human
acagagugcauuacacaguaacuggcguguaguaaaugcucauuaaauguuauuuuauuaaacguuagguuuuauuuuaugauaauuuauuuugu

SEQ ID NO: 4145949 - RNA, 60 nt, Human
acagaguguaaugagaaugcaguugguuauguucauaccaauucucauuacaaucuuugu

SEQ ID NO: 4145950 - RNA, 56 nt, Human
acagauaaauuuauaggaguguucuaaggaagucacugcuucaggcauuuaucugu

SEQ ID NO: 4145951 - RNA, 120 nt, Human
acagauaucacccaucucagguuggcuggcucagggugcaguguccaugacaccagaacccuuuccugguccugugacggagcgccagagguaugcagagcuuggcuuucgggugacugu

SEQ ID NO: 4145952 - RNA, 80 nt, Human
acagaucaauccauacucagaaaguauugcagaaaccagaaaccaaaaauguuuguagacagcacugagauggguucugu

SEQ ID NO: 4145953 - RNA, 80 nt, Human
acagaugaauuuuggggggcacacaauucagcccauaacaaauacugaaggcuucucaguggcucccuugaauugucugu

SEQ ID NO: 4145954 - RNA, 67 nt, Human
acagaugacacauuugugcuguugaaggaaaacucagugacucagauagacacaaauuguuccaugu

SEQ ID NO: 4145955 - RNA, 63 nt, Human
acagaugaguuaaagcagagugagaucuagagcccaaaucuccugugugccauucuuaucugu

SEQ ID NO: 4145956 - RNA, 70 nt, Human
acagaugauaugggaaaagggcucggauucaccuggcuucaaauccuggugcugacacccauagcucugu

SEQ ID NO: 4145957 - RNA, 97 nt, Human
acagaugauuugucuucuccuguggagagauuuuguuuuagcagugauaauuuauucacuuuacagaugguuuccugacauuggaaagacauucugu

SEQ ID NO: 4145958 - RNA, 119 nt, Human
acaucuggacgugacugcaugaaguuacccaugggauaacaagaaggcugaggaaagaacaugaauucccugaccuucaucccaggagcucaguuugucuuuguuuuagcuccagaagu

SEQ ID NO: 4145959 - RNA, 58 nt, Human
acaucugggccuugcuguuccagcgcugcgagggugcugaggagggcacccggggggu

SEQ ID NO: 4145960 - RNA, 65 nt, Human
acaucugguuacagauuuagaaagagaacacuuucuucuuucacagugcucuguaaguauggugu

SEQ ID NO: 4145961 - RNA, 61 nt, Human
acaucuucccacacuugcaaaaucuucauagaacaugguggaaguggaugggcaaagaugu

SEQ ID NO: 4145962 - RNA, 75 nt, Human
acaucuugcuuccuuuacagaugggcaaaaugaggcuuagaaaaacgugaugcuucugcagaggaaguagggggu

SEQ ID NO: 4145963 - RNA, 73 nt, Human
acaucuugguuaaucacuuugcacucuuauuugaucuucaugacaauuaucuaaguaagugacagccaagugu

SEQ ID NO: 4145964 - RNA, 58 nt, Human
acaucuuuguuucuuaguguauagaucaggggguuaacacugggagugacaauugugu

SEQ ID NO: 4145965 - RNA, 69 nt, Human
acaugaaaccugagucuaacucuccuucccuguugaccuccagggacauccaagugccauguuuuaugu

SEQ ID NO: 4145966 - RNA, 73 nt, Human
acaugaaaugaaaggcucaccacuucauaggcuuuaaggaaauucuuggccagguguggugccucacucaugu

SEQ ID NO: 4145967 - RNA, 69 nt, Human
acaugacagcuaaggcuccuucuagguauaaaacguuauaaugucuagaauauaagcuuagccacaugu

SEQ ID NO: 4145968 - RNA, 65 nt, Human
acaugauauuaaugucuuauuuuucuuaaacacuuguuaugcggauuaagugagauauuacaugu

SEQ ID NO: 4145969 - RNA, 69 nt, Human
acaugauuauagugacuugugguuuaaccuguaagcuucaucugguaaugacaggcaauguaauugugu

SEQ ID NO: 4145970 - RNA, 58 nt, Human
acaugcaaagggaugcaauuauaagaccauaguauuauugauugaucucugugugugu

SEQ ID NO: 4145971 - RNA, 56 nt, Human
acaugcaagccccugaacacauguuuaggcuagauaugacccagggcuggcagugu

SEQ ID NO: 4145972 - RNA, 62 nt, Human
acaugccaaguaugauucacaugugugaaaaaacacacaaagaauauucucucugagcgugu

SEQ ID NO: 4145973 - RNA, 57 nt, Human
acaugccaauuugguuaguucaaguucauaacaauugacugagccacauuggugugu

SEQ ID NO: 4145974 - RNA, 80 nt, Human
acaugccuccguggagcuggaagggucugcuugugggguaacuucuuaccaugccaacaggaccuuccaauccaucaugu

SEQ ID NO: 4145975 - RNA, 129 nt, Human
acaugccuggcacucuagcacuugaggauagcugaaugaaguaaguuguugauguugcaguccugugaggaucacuucagaacuguuauaacagcuguuuuuugggagcugguguuggauggggugugu

SEQ ID NO: 4145976 - RNA, 80 nt, Human
acaugcugcuagagagugacaaucgcaaguguggcugcuuuuacagucagagcuauguuguuauauuauaguaggauugu

SEQ ID NO: 4145977 - RNA, 57 nt, Human
acauggcccugcacccagagcaguuccaugagcaguuucaugggagcaggagucugu

SEQ ID NO: 4145978 - RNA, 62 nt, Human
acauggcuuucucuaaugugguauugcaaauauuugucgugcccaguaaaugaaagcuuugu

SEQ ID NO: 4145979 - RNA, 73 nt, Human
acauggggaaaacagaggaaauuagaaaaggcccuguaguuugguuaaugauaccuauguuaauuucccaugu

SEQ ID NO: 4145980 - RNA, 64 nt, Human
acaugguugaaugcuuuauuugaaguaaagaugugugaucuuugaaugaaguuauuaaugaugu

SEQ ID NO: 4145981 - RNA, 80 nt, Human
acaugguuucugucucuuuucaagcuacccuuuguccagggugugucaaagaguagcucaagaagagacagaagucaugu

SEQ ID NO: 4145982 - RNA, 129 nt, Human
acauguauaaguugccaaccuggugccaauuaauggaacccugggcaaagucacauacaugauauucaacacaucauaguaaugcuucacccauucauuugggauccaggaaaagucucucauacaugu

SEQ ID NO: 4145983 - RNA, 99 nt, Human
acaugucggggauggcagagaggaccagggucugggcucuaccuuccuuccauggaggaagcagagccaccagcuuuggacugcccaucucugaauugu

SEQ ID NO: 4145984 - RNA, 63 nt, Human
acaugucuacacauucugcaauaguuaauacaugccauucuacaguggaauuuguagaugugu

SEQ ID NO: 4145985 - RNA, 69 nt, Human
acaugucuccuccugagaccccuuguccugacacacuacaggucucuggcugucucaggaguggcacgu

SEQ ID NO: 4145986 - RNA, 86 nt, Human
acaugucuuuguaguguguauucagcaagcgaaacagaaaauuaugaauuucuacuuaugugugaaauaugcucuguaaugcaugu

SEQ ID NO: 4145987 - RNA, 74 nt, Human
acaugugcuaagggccagagcugggauuuguacccaggccaccugacccagcucucugcucuuagccucuaugu

SEQ ID NO: 4145988 - RNA, 57 nt, Human
acaugugggugagcucagcuggggcuggaagaacugccaggcagccuacccacuugu

SEQ ID NO: 4145989 - RNA, 129 nt, Human
acaugugguuauuuguaaaagugcacugacuuuggagucagcuagaccuguguucaggacccucuaagucugacccugagcucaauguccugagucuauuguuuugcauuugaaucauaacuccacugu

SEQ ID NO: 4145990 - RNA, 73 nt, Human
acauguucucaagagcuggguggcaagcuagccaagaggugagguucagccagucagcuuucaggaggagugu

SEQ ID NO: 4145991 - RNA, 75 nt, Human
acauuuagguucuuacugucuucaaugucuagcucuguggaggcugacaauacagagagagcaaaaacuaagugu

SEQ ID NO: 4145992 - RNA, 58 nt, Human
acauuucuuugcuagacagcagaagaaucugcaagauguuuaucuggcacacugaugu

SEQ ID NO: 4145993 - RNA, 70 nt, Human
acauuugaagucugagauggucucuuuguuacucuguugauugacuggaauucgucuuugcuucuauugu

SEQ ID NO: 4145994 - RNA, 56 nt, Human
acauuugagcauauuucuugucacuuuuaauggugcuuuaaauauguagcaaaugu

SEQ ID NO: 4145995 - RNA, 61 nt, Human
acauuugauaauuauaaagacauaugauucugugaaaauagagugucuguaaaucacgugu

SEQ ID NO: 4145996 - RNA, 75 nt, Human
acauuuggagaugggcacucaggcugaggccgugaaagacuuaaggccuuucuagcuuugugcuccuccauuugu

SEQ ID NO: 4145997 - RNA, 74 nt, Human
acauuugggugugaaaaaguucugugucacaaauuuuuguggagggcaggaagagccuuuucacacuucaaugu

SEQ ID NO: 4145998 - RNA, 81 nt, Human
acauuuuucucuccccuuuggaagaagggucuagaacauucuuguguuuaagacugugaccgaagaaggaggaagaagugu

SEQ ID NO: 4145999 - RNA, 57 nt, Human
acauuuuuggaguacuuguguggaaccaggaagccacaagagagacacuaggaaugu

SEQ ID NO: 4146000 - RNA, 117 nt, Human
acauuuuuuuucacagagagacuguggaauggaaugacucuccagagcugcagauugaaggcauauuuucaucugacuuuggugauuauguuuccaaucucucugggaauaaggugu

SEQ ID NO: 4146001 - RNA, 83 nt, Human
accaaaagugaggaauggcuuaaugugggauacucaguggauuugccuaagguuuccaaauuggguuagguuuuaauuuuggu

SEQ ID NO: 4146002 - RNA, 56 nt, Human
accaaacauuuuaaauaagggauacucaaccgguaucuguucucugaguguuuggu

SEQ ID NO: 4146003 - RNA, 60 nt, Human
accaaaucccaguucuaggaucuagaucccaauucuagaaguuggggcuagggauauggu

SEQ ID NO: 4146004 - RNA, 108 nt, Human
accaacaauaacaagaagccaauuucguauaucaaauuugcaagggcuauaaaaauaauaguauuagaaagaguauaccagaaacaagcauucuuagacauuguuagu

SEQ ID NO: 4146005 - RNA, 72 nt, Human
accaagaauagaggcuucucggauggggcaguuugaauaaaugaccgcucugagagugucuccuuuuuuugu

SEQ ID NO: 4146006 - RNA, 58 nt, Human
accaagcccaccaucaauggagugagcaaguaaacuccucugauggaggagggcuggu

SEQ ID NO: 4146007 - RNA, 57 nt, Human
accaagcuagaacauuacaggcacugcugccuuugcuugugggauucucagcauggu

SEQ ID NO: 4146008 - RNA, 82 nt, Human
accaaggaagcuggauuccucuuuugagauaaugcugagccaguagcagcuguuagaaacaggaagccguguggacucuggu

SEQ ID NO: 4146009 - RNA, 76 nt, Human
accaaggacacugaccccaagcuguccugccuagcguccagcgucuucuaggaggguggggucugccuguccuggu

SEQ ID NO: 4146010 - RNA, 64 nt, Human
accaaguuuacagucugucuagcaauguguuuagggaaaauauccauauugacagcuauuuggu

SEQ ID NO: 4146011 - RNA, 71 nt, Human
accaauacucccuuuuauugccuuauaacucucucaagcuaugaaaugguaguaggaagggcuaucuuggu

SEQ ID NO: 4146012 - RNA, 56 nt, Human
accaaucuagagcauccacuagguguaacaaggugucugguugugcacggguuggu

SEQ ID NO: 4146013 - RNA, 66 nt, Human
accaauggacaggcugagcuuccucaagugucaggccugggaugugcguuuagcuugcuguuuggu

SEQ ID NO: 4146014 - RNA, 101 nt, Human
accacagaggcaucugcuaaaaucugcuguguccccugugcggguguuagcgaugcauucagccuagcagcacagccagaaaaagcagcaugaacuggagu

SEQ ID NO: 4146015 - RNA, 88 nt, Human
accacauguauaaaugcacauauauguguauacauauguauaaauugugugugugugugugugugcaugcacauagaauauuaguggu

SEQ ID NO: 4146016 - RNA, 60 nt, Human
accaccccauuguauccuauagcacaguugaacugguuuaaaagccaugcauggggaggu

SEQ ID NO: 4146017 - RNA, 60 nt, Human
accaccugcuucugauucucuaggaagacugcugagagucaacaucgagccacugguggu

SEQ ID NO: 4146018 - RNA, 93 nt, Human
accacgcccagccagauuuauuuugcuaagugcuugugagaauuugaaauaauauauauaagauacuuggcauagugccuggguggugguggu

SEQ ID NO: 4146019 - RNA, 72 nt, Human
accacuaaguuccuuuucacuucuaggaguauaauacccucauuugacagauguggaaagaaguuagaaggu

SEQ ID NO: 4146020 - RNA, 82 nt, Human
accacuggcaaaacaguuacgagcgcagaccuuggggucagacuuggguuugaauccuggcuguaugacuugccagcugugu

SEQ ID NO: 4146021 - RNA, 66 nt, Human
accacuuaggaaacauuugaagaggauuauguguccuaguagucuucugaaaaaucuuccuuuggu

SEQ ID NO: 4146022 - RNA, 69 nt, Human
accagaacuggggacugaggcacugaaggugcucuccugggcucccacguaccuggucccucuuuuggu

SEQ ID NO: 4146023 - RNA, 77 nt, Human
accagaagaguaaaauguagaaggcuauagacuaggagucagaaguccugguuacuuuuuucuaccuacagucuggu

SEQ ID NO: 4146024 - RNA, 80 nt, Human
accagaagccucauccucucuaguguuuaggcaacauauauaugcaaucuuauugcacuggggaaaacaggcuucuucgu

SEQ ID NO: 4146025 - RNA, 83 nt, Human
accagaaguggaaaagugaugcaauucagguucaucggaaugcaggaucuugggaauuugacauugacacaccuaugucaggu

SEQ ID NO: 4146026 - RNA, 111 nt, Human
accagaaguucuuaaucugagguucauggagucuuaggcaaucuauggauaggcuccacaggcagccacaugagcuccugaacuuuuuuuugcagcauugugaacuguggu

SEQ ID NO: 4146027 - RNA, 71 nt, Human
accagacagaagugacaccucuucccuuuccagucccugugggcuugguggugucauuuggcaugucuggu

SEQ ID NO: 4146028 - RNA, 72 nt, Human
accagaggcagagccaggucuaggagucucuucucaacagagguucucccuguccccugagcuuucuuuggu

SEQ ID NO: 4146029 - RNA, 65 nt, Human
accagcagaaaaugccuacuguggacucccuucagaaacauuccugcaaaauaggcucuguuggu

SEQ ID NO: 4146030 - RNA, 80 nt, Human
accagcaugucaguggaccuggagaggccaguucuugaaauaggaugaggacccucuuagguuucugacgaugucugugu

SEQ ID NO: 4146031 - RNA, 67 nt, Human
accagccuggcacacagcaggcucucaggaacacugcugaaagcacaaguggccuagguguccuggu

SEQ ID NO: 4146032 - RNA, 65 nt, Human
accagccuggccaacauggcaaaaccccaucucuacuaaaacuacaaaacuuggccgggcguggu

SEQ ID NO: 4146033 - RNA, 72 nt, Human
acguuuugauagcagugacauuuuaaugugaucaucuuaucuuggacacauaaagcagcugcuucaaaaugu

SEQ ID NO: 4146034 - RNA, 61 nt, Human
acguuuuuagucuccaaucuuucagagaauccugcuggacaggaucugagacugagagagu

SEQ ID NO: 4146035 - RNA, 75 nt, Human
acuaaaagcagaaauucagcugaguucuagagcacucgagagccucgcgucucacucaucugagccugcugaggu

SEQ ID NO: 4146036 - RNA, 92 nt, Human
acuaaacugguggguuauucaguagaguagcaggauauaagccacuuaucuauauuguuaaacuguauugcauaagggcccaccaaaauggu

SEQ ID NO: 4146037 - RNA, 79 nt, Human
acuaaagguuugcagaagggcacagugaucaauuccuuuggaaagauugguuguggcuuuucuguaaacagacaggagu

SEQ ID NO: 4146038 - RNA, 70 nt, Human
acuaaaugccugggacucuguuaucuugguaccuggaagacuaguucagugucccaaggcuuaguuuagu

SEQ ID NO: 4146039 - RNA, 64 nt, Human
acuaaauuuaagacccacagggaaguuguauguacuauaaaauucucuggguccugaacagggu

SEQ ID NO: 4146040 - RNA, 70 nt, Human
acuaagaauuuuggcuucugaccugcagaaaaugggaaacauggaaggcucaggaguggagagaauuggu

SEQ ID NO: 4146041 - RNA, 68 nt, Human
acuaagaugcaggaaaugcuagagaaauugcuacaaugguggcuuuagcuuuggauuuccagaucagu

SEQ ID NO: 4146042 - RNA, 79 nt, Human
acuaagcucuucucaaguguuaaguuuaaagacaguuaauuaucagcuauucuuuagagcacgggaaaaacaguuuagu

SEQ ID NO: 4146043 - RNA, 59 nt, Human
acuaaggaauuggagcauguguucauuuaaaggaagaacauagcauuccauucauuagu

SEQ ID NO: 4146044 - RNA, 67 nt, Human
acuacaaacucuggucaucuagcaguauaggauauuccacugcccccugaagaccagguuuuauggu

SEQ ID NO: 4146045 - RNA, 61 nt, Human
acuacaaaucccagaaggucaugcagugggggcggccgcggugacuucugggauuuguggu

SEQ ID NO: 4146046 - RNA, 56 nt, Human
acuacaguaagggaggcagcauuggaacccagcucuaacccuccauuugcuguagu

SEQ ID NO: 4146047 - RNA, 114 nt, Human
acuacauaaaauuuguuguaugucaaaguauuaggguccucccaggaauugaugucacaccaaaggacuuagcugaagggcauuuaauaaauagacugcuucgaaggugugagu

SEQ ID NO: 4146048 - RNA, 81 nt, Human
acuacccugggugucugugcuuguuacaauggaggccgaucccucagccacaccaggagcagauauggacauaagggaagu

SEQ ID NO: 4146049 - RNA, 68 nt, Human
acuagaagacauucaucuagucaguauuccauaguugucaaaaauacuggagauggaaugcuuuuggu

SEQ ID NO: 4146050 - RNA, 111 nt, Human
acuagacauucaaaaacacucccuggcagauuuaacauuggaacucguuuugaaagaacaauguggaaucuccuucacugggaguuuuugaauaaguaugaaauuucuagu

SEQ ID NO: 4146051 - RNA, 65 nt, Human
acuagacuccccuggagaggauuuaaaaaauauugaugccugggcuucaucccggagauucuggu

SEQ ID NO: 4146052 - RNA, 74 nt, Human
acuagagggcagcagagaacacaaugauggcaagauggccauuuuguccagucuuugucuucagcucuccuagu

SEQ ID NO: 4146053 - RNA, 78 nt, Human
acuagaugaggaagccagggcauuggccacccagugacacagauacugaagccuccuggccuuugcuccucauucagu

SEQ ID NO: 4146054 - RNA, 66 nt, Human
acuagcacagacagaaugagauaacccagauugauugauuuagcuggggcuuucauucuugcuggu

SEQ ID NO: 4146055 - RNA, 55 nt, Human
acuagcuuuccugccauguccugcggccaagcguugggggagcugggaagcuggu

SEQ ID NO: 4146056 - RNA, 75 nt, Human
acuaggaaggcauaugggcagacugggcauuccacuucugaaggccaaaaauugugauaugugcagauuccuagu

SEQ ID NO: 4146057 - RNA, 73 nt, Human
acuaggacacaugccauugcuuuaaaauuaaguagaaaaacugcuuggguguauaguggcagcaaauccaagu

SEQ ID NO: 4146058 - RNA, 55 nt, Human
acuaggcccugccugaaggagggggcuuucucccucuccagacacugggccuugu

SEQ ID NO: 4146059 - RNA, 56 nt, Human
acuagguuggggaaguucuccuggauaauauccugaagaguauuuuccaacuuggu

SEQ ID NO: 4146060 - RNA, 84 nt, Human
acuaguaucagcaggcacaccaaaaacuguguccaucaaaugcugggccauaaccucauuuuaugcugugcccuugguacuagu

SEQ ID NO: 4146061 - RNA, 66 nt, Human
acuaguguccuuauauaagaggccccagagaucugcuuugcccccuucaucaugugaggacacagu

SEQ ID NO: 4146062 - RNA, 98 nt, Human
acuauaacucuuuuaucucaguauuucuaguuucuuccacaguagcuccucaaaacgugguuguagauuuggaaauaaauguaauugaguggaccagu

SEQ ID NO: 4146063 - RNA, 55 nt, Human
acuaugcucugcugccagaggacucuuccaaaguuuuacaggucauagguauagu

SEQ ID NO: 4146064 - RNA, 73 nt, Human
acuauggcagaugguuccugggagccuuugguggagaaagccaguggcugugaccagggaccuuugcuggagu

SEQ ID NO: 4146065 - RNA, 75 nt, Human
acuauguagcacaugccgggagugaucugccagacauucuaauuugaaccagauaucucuggguagcuacaaagu

SEQ ID NO: 4146066 - RNA, 68 nt, Human
acuauuaauuaccacaguccccuuuccugaaaaaagauauuuugguuuuggaguggguaguuaguggu

SEQ ID NO: 4146067 - RNA, 85 nt, Human
acuauuuagcuguucaaguuccuggaaaagggauaucauguuuaccuuacucuauuuccaaagcugaguugagcaaguuaaaagu

SEQ ID NO: 4146068 - RNA, 63 nt, Human
acuauuuccagcaguaagaagacagacuggguccuuagcuugcuucuuuccucugccaauggu

SEQ ID NO: 4146069 - RNA, 62 nt, Human
acuauuugagaaacuggagguauaucagugaauaaaauugauauaacucuuguucuuauagu

SEQ ID NO: 4146070 - RNA, 83 nt, Human
acuauuuuagucugggcccugaagaugagacuucaguuaaguaugacucuuguuuguagagcccaccugacuaaggauauggu

SEQ ID NO: 4146071 - RNA, 60 nt, Human
acucaaaguuagagcaagagucuguuacaacugugacaguucugagcuauaauugcuggu

SEQ ID NO: 4146072 - RNA, 59 nt, Human
acucaaauagcaacggugagaagcucaggcugccauuaauuucacugugugucuugggu

SEQ ID NO: 4146073 - RNA, 61 nt, Human
acucaaauuugucaacugaagcuaagaagaucagcuaggcaaauagaagauaagugugggu

SEQ ID NO: 4146074 - RNA, 60 nt, Human
acucacucagcccaacccugcacaaggagaaaauuccugguaaaguucgggcuggggagu

SEQ ID NO: 4146075 - RNA, 61 nt, Human
acucagaaaaccagcgucaaaccccacccugcccaggauguggaccuugccuggugagagu

SEQ ID NO: 4146076 - RNA, 108 nt, Human
acucagaaacuaugggccuguuaucucauuugccugguuuuauuucauauguggaucuuaugcugagauagcugacuaggcauccaggcuuggccacaucuucuaagu

SEQ ID NO: 4146077 - RNA, 70 nt, Human
acccugcccucuccagcucagguuccaggauaaguucugggguccauuaguggguuggagggguaaaggu

SEQ ID NO: 4146078 - RNA, 67 nt, Human
acccuggcauagagaccugagucaugcaggcccuggacuguuguaacaggcacucugugccaggagu

SEQ ID NO: 4146079 - RNA, 72 nt, Human
acccuguuaugguguaacauuugauuauuacguuuuauugucaugucacuacaucauaaauauaugcagggu

SEQ ID NO: 4146080 - RNA, 70 nt, Human
acccuucugcagggcagguccccaagccccguaucucagguucugaccaggauguguccucagcaguggu

SEQ ID NO: 4146081 - RNA, 55 nt, Human
acccuuuggguuccccaagccugccugccugguccuugggccugcccagaguggu

SEQ ID NO: 4146082 - RNA, 96 nt, Human
accgaaauucaaauaaauaggcuguauaaccccaugcgacuguaauuuuccuuuuauagucagcuuguuuacuguuuauugaagagaaugucuggu

SEQ ID NO: 4146083 - RNA, 73 nt, Human
accgaccuggaggagcgcugaccagcuggcugaacccugccagcgacucuggaagggccgcuccucccucggu

SEQ ID NO: 4146084 - RNA, 78 nt, Human
accgcacgcauccccacacccggucccucccgcucagcccuggccggcacagagaggcuggguuggagaucgaguggu

SEQ ID NO: 4146085 - RNA, 86 nt, Human
accgcacucauguaggccacggaaagcagguugcacuccucauaggacagcucggugcccugcuuggucauggccuucaugcaggu

SEQ ID NO: 4146086 - RNA, 66 nt, Human
accggaacgaucgugcaggucauaaaugguugaucuuggaguuuggcaugaccugcgcuucacggu

SEQ ID NO: 4146087 - RNA, 60 nt, Human
accggagucuagaaugugcugacccagcucaaugugcagagguggcagguagacucaggu

SEQ ID NO: 4146088 - RNA, 56 nt, Human
accgggcaguguggcuccagagucugugcccuuagcucugagucacacugcccugu

SEQ ID NO: 4146089 - RNA, 61 nt, Human
accguccauaaaugucuguuuuuuugagaccuuggcaaagaggaggauugaugugggaggu

SEQ ID NO: 4146090 - RNA, 59 nt, Human
accgucucaucaugcccuguugaauaauaaacauugcucacaggggcagacgaguuggu

SEQ ID NO: 4146091 - RNA, 56 nt, Human
accgugggcaaugggaccuggaugcccguggccaaccaggguccagcugccauggu

SEQ ID NO: 4146092 - RNA, 102 nt, Human
accuaaaaacagcuuuuuaaagcuaguaguauuucaauguugacuuuaauuggaaggaaacuaugagaugaauaacuccugcuaagaaaccuguauauaggu

SEQ ID NO: 4146093 - RNA, 82 nt, Human
accuaaccagucugcggggcaggcucauucccauggccuuucucccacgggaaccaccccucugcccugaaguugcccaggu

SEQ ID NO: 4146094 - RNA, 65 nt, Human
accuacaacuuucuguuaaauguuagucauucugaugaguaaaaaguucagaaugguuguugggu

SEQ ID NO: 4146095 - RNA, 84 nt, Human
accuacagacccagaauccgcauuuuaacaagauguccagaugauucauaugcacauuaguguuugagaugcccuggucuaggu

SEQ ID NO: 4146096 - RNA, 73 nt, Human
accuacaggugagccucuccuccuggauuccagguaaggaugccuagaaacagagcagguggcccauguaggu

SEQ ID NO: 4146097 - RNA, 73 nt, Human
accuacaugggccaccugcucuguuucuaggcauccuuaccuggaauccaggaggagaggcucaccuguaggu

SEQ ID NO: 4146098 - RNA, 60 nt, Human
accuacauguuccacauaguuguagcuguaucuggguaucacugugcacauaugauaggu

SEQ ID NO: 4146099 - RNA, 76 nt, Human
accuacccccaagucucugucuuaggccaggccuuggggaacccaggcucaggccaggagcagcuaggugagaggu

SEQ ID NO: 4146100 - RNA, 83 nt, Human
accuacuauguggcaggcauugugacgaguguucuacaggggugaagaugugaaacagucacaguccugucuucauaguaugu

SEQ ID NO: 4146101 - RNA, 65 nt, Human
accuagaguagaaguuugcuuuuuaaaaaaaucauggauuggcaagagucagcuucuguaugggu

SEQ ID NO: 4146102 - RNA, 69 nt, Human
accuagaucuacaaguugugacuugauaccuacaaguaagguauaguuugcgauuugugguucuuuggu

SEQ ID NO: 4146103 - RNA, 129 nt, Human
accuagccuuggggacuucuuuagaaagaaggcauauuuucacugaaccaaaguaaaucuuaauuacauauuugcuuaccauggagagccuuuuugcuucugaaugggaaucuguaaccgauaaaaggu

SEQ ID NO: 4146104 - RNA, 57 nt, Human
accuagcuaaucauucugaucucauaggugaggaaauucagacccagauuagcaggu

SEQ ID NO: 4146105 - RNA, 58 nt, Human
accuaggcuggagugcauuggcgugaucucggcucacugcaaccucugccucccaggu

SEQ ID NO: 4146106 - RNA, 69 nt, Human
accuaggguaguucgauuauaugcagagcuguuuuauucauuguuaauccugcaaucagcuacccaggu

SEQ ID NO: 4146107 - RNA, 58 nt, Human
accuagguauuugccacuucacauuuacauuuguguaaauaugacuagaaugccaggu

SEQ ID NO: 4146108 - RNA, 85 nt, Human
accuaucugugcaccugaguccugaugcucuggcaggagaaaaccccauuuuaucugucuuuaucaggauuuagcagaggaaggu

SEQ ID NO: 4146109 - RNA, 88 nt, Human
accuaucuuuggaacacaauguuucuuucagcacaugucacaauguguauaaaguauuucugaggggauguguuucuaaguuaaaggu

SEQ ID NO: 4146110 - RNA, 58 nt, Human
acucugugaagucuuauuaugcacaucuuacaaaugaagcaacugaggcuuauagagu

SEQ ID NO: 4146111 - RNA, 95 nt, Human
acucugugaccccuaaugcagcugauuaacuucauuguaguucaucggaagaaauaaagacuaaugauuugaucuucuuuagggguuucaugagu

SEQ ID NO: 4146112 - RNA, 94 nt, Human
acucuguguuuaacauuuugaggaacugccagacuguuuuccaaaguggaugcaucacauuacauucccaucagcaauguauuaacacaagggu

SEQ ID NO: 4146113 - RNA, 62 nt, Human
acucuucauuuccauccaacugggaaccaucacaaacgaggaucugaugggaguuggggagu

SEQ ID NO: 4146114 - RNA, 79 nt, Human
acucuugaggaacugaguaccaugauucguagaagcagggcauuggccgcgaguaaauauugugcuuuuucucuagggu

SEQ ID NO: 4146115 - RNA, 117 nt, Human
acucuuggcugagucuuugugcuucuguucuguccugaaggacacgugaggagccagaaacaucuggcagccucugguccuuaguucagauacaacauccaugaagcugccaggugu

SEQ ID NO: 4146116 - RNA, 69 nt, Human
acugaaaaacuugcugcuugcuuacagaaugaauagaagugaauguacuagaagcuguaauuuuucagu

SEQ ID NO: 4146117 - RNA, 82 nt, Human
acugaaaguggagacugacugccuguauuugauuauguaauggauuaaauacagucaucaagucuuugccccuccuuucagu

SEQ ID NO: 4146118 - RNA, 55 nt, Human
acugaaaguugaugagucacugugccucucgggguagugaguuaucagcuacagu

SEQ ID NO: 4146119 - RNA, 58 nt, Human
acugaagaauaagcaugggguugcauuuagccacagaaaccauguguucuacaucagu

SEQ ID NO: 4146120 - RNA, 111 nt, Human
acugaagccaagcagcacuuuugguuugaaugagcauaagagggcuuaauuguugucucaucuuuuagagcauuucugauucaaaggugucaugcaaucauugguagcagu

SEQ ID NO: 4146121 - RNA, 130 nt, Human
acugaauaauauuccauuguguggaugcaacacaguuuaucgauucaccuaccgagggaaaucuuggucgauuucagguuuggguaauuaugaauaaaguugcuauaaacauacaugugaagguuuuugu

SEQ ID NO: 4146122 - RNA, 84 nt, Human
acugaaugcucccguuuuaacuagugggcuaccgugaguaguuuaggucacaggaguuaacauaauuaagagagaguauuuagu

SEQ ID NO: 4146123 - RNA, 63 nt, Human
acugaaugguuacuacccugggucuucuaccgaaagaaagaacaugggugugggcauucaagu

SEQ ID NO: 4146124 - RNA, 61 nt, Human
acugaauuguuucaaacucuagagucaccugugacauguggccuggagagaaaagaugagu

SEQ ID NO: 4146125 - RNA, 65 nt, Human
acugacaauuuuucaaagaagcuuaucucagccaagucugcaauagucacugaaaaauugugagu

SEQ ID NO: 4146126 - RNA, 76 nt, Human
acugacagagcuacauaguaacccacaaaucuaagcaacuguauggguguguguguguuugugugugugugugugu

SEQ ID NO: 4146127 - RNA, 78 nt, Human
acugacaucucuccaaaggaaggugcuauaguuaaacccacucuacagauguggcaacugaguucagagaggugcagu

SEQ ID NO: 4146128 - RNA, 56 nt, Human
acugaccuucucagcuaacucagcaaaacccagcaugucagugugacuuggucagu

SEQ ID NO: 4146129 - RNA, 130 nt, Human
acugagauuggaagaaguagaguuaaaaguuuuuacuaccuuugagaagccugcgggcauguucacagucgucccaugccagccagguucugaggcuaacugcuugugccccugcugcuucacauggcau

SEQ ID NO: 4146130 - RNA, 65 nt, Human
acugaggccuaacucuugacuuuuugacaguggugcucauaagaaaguuuggggcugggcacggu

SEQ ID NO: 4146131 - RNA, 93 nt, Human
acugaggcuuaaagaacuugggguuguggguggcuuauuaagacauucuaaugccauuuugaaaccaaguuauuuccuucaaaaacccucggu

SEQ ID NO: 4146132 - RNA, 55 nt, Human
acugaggcuuaaagagauuagguaacgucugggcuacucugggagccuaaccagu

SEQ ID NO: 4146133 - RNA, 67 nt, Human
acugagugaugugagaaaaugaacucuaacacuaaaguuaguuucauguagccauauuuaccucagu

SEQ ID NO: 4146134 - RNA, 56 nt, Human
acugagugguacauuguguaaugauggaacgccuuuaucuacaguguccauucagu

SEQ ID NO: 4146135 - RNA, 76 nt, Human
acugaguuagacuuuggugauccagaacucuuuuccuuucugagaugccugggccauggaagucucugcccccagu

SEQ ID NO: 4146136 - RNA, 77 nt, Human
acugaguaagcagaggcauuuuuaucuggaaggaggugagucccauaagauaaauugcacuuuuucuuacauugagu

SEQ ID NO: 4146137 - RNA, 84 nt, Human
acugaguagucugaaggauuagagagcacuuagcguccugcugggcacauggugaauguucucuaaauacuccuucuacuuagu

SEQ ID NO: 4146138 - RNA, 119 nt, Human
acugaucuacuccuucauuaauaucccaaauuuagguaacagucuguagagugugccaguuaguacagccuguuaccuauauuugggauaugaauauauuauccaaggaguagaacagu

SEQ ID NO: 4146139 - RNA, 70 nt, Human
acugauggagacuccacugugauucacucguuuacuuaaaaacauuucagggaugucuguaaauuucagu

SEQ ID NO: 4146140 - RNA, 111 nt, Human
acugauguguuccacugguuaggaaaugugaaccaagaagucaaagcgaucucuuugauccuauugauuuugugauuuuuagaaagugacuuagcauaccugggcaucagu

SEQ ID NO: 4146141 - RNA, 113 nt, Human
acugauuucuaucacuuuaucacuguuagcugaaguuaaagaagaauaguuccuuucucuaacaagaacauaacucucuuugauagcuguuugaaaggauagucugcaucagu

SEQ ID NO: 4146142 - RNA, 115 nt, Human
acugauuuuuaaaacaagaaaauacaucugaauuuugaugugcauugauaucuucaagcauuguauccaaauguuauuuuaaaauuugaauguaggcucuuuuuaaaaauucagu

SEQ ID NO: 4146143 - RNA, 72 nt, Human
acugcaaaaaugggugcauucaguaauuucagauuuucagugcuauuuuuauugcaacucauuuuguguagu

SEQ ID NO: 4146144 - RNA, 75 nt, Human
acugcaaucaccagggccuuagcuccccuuggaauaugaggguucccucuugcagcagccaagguucugugcagu

SEQ ID NO: 4146145 - RNA, 58 nt, Human
acugcacaccuccagggcacuauuuccacaugaauguuguccccuagaguugugcagu

SEQ ID NO: 4146146 - RNA, 59 nt, Human
acugcaggcucggaagugcuggcuuugccugacgcaagaguugagcaccggguagcagu

SEQ ID NO: 4146147 - RNA, 97 nt, Human
acugcaggucuuuagguugagugcaaauucaaugaacauguuuaagcgacuaaaaauguuccagcaaacauugauuuguuaguagcuuagauguagu

SEQ ID NO: 4146148 - RNA, 76 nt, Human
acugcaguugggacaaagacuccuugaauucagagcugugcuuugaaauucaaggagucuucgucccaauugcagu

SEQ ID NO: 4146149 - RNA, 95 nt, Human
acugcaucacugccacauccucugugcaauagaaaguggcauggaagaaugacuccaauaucugccacuugcacuuggguguggaguuuaccagu

SEQ ID NO: 4146150 - RNA, 81 nt, Human
acugcauguuuaauuaaagaacagcccuccucuaucuuccccagauagaggagggcuguucuucagucgaagauauggagu

SEQ ID NO: 4146151 - RNA, 74 nt, Human
acugccaccuccagccucuugaaaguuguuagcuuccuucagcacagcugaaaggguguuggaguguucucagu

SEQ ID NO: 4146152 - RNA, 57 nt, Human
acugccggcgccugcgguuccuccuggccccaaggcaccgcugcaggcgccugcggu

SEQ ID NO: 4146153 - RNA, 97 nt, Human
acugccuccugucucuugacccaguuuaaccuauccauuaugugauaucccuucuauuauaguaugggcuacuuaaaaacaagcaggcaugggcagu

SEQ ID NO: 4146154 - RNA, 73 nt, Human
acugcggccaggagaagcaucugaguguaauagcccagccaagcaaaguagauuccaaucuucucuccauagu

SEQ ID NO: 4146155 - RNA, 67 nt, Human
acugcuacauugaaauuugucauguaacuauauucauucauuaugcaugauucugcaaaugaguagu

SEQ ID NO: 4146156 - RNA, 55 nt, Human
acugcucucuuugcaggggcuagggcagugccuggcucaaagccaaggggguugu

SEQ ID NO: 4146157 - RNA, 55 nt, Human
acugcugauuuagcuuugugggcccacuaauggcauuauuguccacaucagcagu

SEQ ID NO: 4146158 - RNA, 81 nt, Human
acugcugccaaaauaauauuccuaaagcaugauucucauugccaucacugcuuucaaaaauuauugcuggcaggaagcagu

SEQ ID NO: 4146159 - RNA, 101 nt, Human
acugcugcuccuugcuuucucacacuuuccacugaggucacuuggggcacgacugagucaagacuuccagaggguguggaaauaucagggaagcaaacagu

SEQ ID NO: 4146160 - RNA, 60 nt, Human
acugcugcuguggcugaaagcaucuuccagaaauucugaggacacagcccagacagccgu

SEQ ID NO: 4146161 - RNA, 59 nt, Human
acugcuggcaucugaauuauguauuaauaaaaguuagauucaugcaguaugcuaguagu

SEQ ID NO: 4146162 - RNA, 81 nt, Human
acugcuucuccccugaauaucuacuguguccccacucuguuaaagaucacauaaauagauuauugggagggaacauguagu

SEQ ID NO: 4146163 - RNA, 66 nt, Human
acugcuugcuagaagcuuaaagguauuggguuggacuccauugcuuguucauggccuaguggcagu

SEQ ID NO: 4146164 - RNA, 129 nt, Human
acugcuuuuagggaauguguauauuagaauagcuugccuugugcucgauuugcuuuuguuggauuauuccuguuuaagcagagcaagcguauuuauucuacugugaaccauuuaauaauuacaugcagu

SEQ ID NO: 4146165 - RNA, 58 nt, Human
acuggaaaugagaugauaucaguuuggagauucagauaccuguccucccauauccagu

SEQ ID NO: 4146166 - RNA, 96 nt, Human
acuggaacauaguaauguaaguggcagaguuuguucuauaggccuauuaauguuguuuauagguccacugcaauuugccaaauauauuauaccagu

SEQ ID NO: 4146167 - RNA, 64 nt, Human
acuggaaugugauccaugugaagaacagaauuuauucuguuuaauucaccaucauguucccagu

SEQ ID NO: 4146168 - RNA, 90 nt, Human
acuggacacucuggggcaaauaauucucugcucugggggcuguaggauguuucauagcaccccuggacgguagggccaccagaugccagu

SEQ ID NO: 4146169 - RNA, 76 nt, Human
acuggacugaagcaagauuugacuucgugguuugacacauguccaauuacuccacaacauuuaugccucaguaggu

SEQ ID NO: 4146170 - RNA, 56 nt, Human
acuggagaggccccaagauauuuggucaacgaccaaauaucuuggccccuccuggu

SEQ ID NO: 4146171 - RNA, 108 nt, Human
acuggagcaggaugacaauggagcugugagacugauagggaagagguguuugcuucugcuuuggguccuauuuuuuucaugccgaccauguucagaaauggcucuugu

SEQ ID NO: 4146172 - RNA, 55 nt, Human
acuggcagaggauagcacuaauggaggaugucuaugugguauaaagccugucagu

SEQ ID NO: 4146173 - RNA, 65 nt, Human
acuggcaguuuuagaaauugauuugcaaguuugguuaaagcucccauuaucuucugaaacccagu

SEQ ID NO: 4146174 - RNA, 71 nt, Human
acuggcaucccacugguacaggaguauucaguguucuaacccugguagggucuuaccaauggauugucagu

SEQ ID NO: 4146175 - RNA, 70 nt, Human
acuggcauuuggaaauugcaagugauuugcauggugaaauacagugaacauggaaauuuccuauuucagu

SEQ ID NO: 4146176 - RNA, 58 nt, Human
acuggccaggagcuggaaauacauugaguaaaacagacauagcucuagcccuggaggu

SEQ ID NO: 4146177 - RNA, 78 nt, Human
acuggcgacuuccaguguuuauuccauuaguauucaauuauauuucccagauaaacagcuggaggccaucucuucagu

SEQ ID NO: 4146178 - RNA, 82 nt, Human
acuggcuccagguaaagcugcccucauucccagugcaucaacugacugacaucuggggcuugggcagcugcauuaagccagu

SEQ ID NO: 4146179 - RNA, 65 nt, Human
acuggcucucugccuuucucaaugacaccuuugagacuugggagucagggaggcagagaggcagu

SEQ ID NO: 4146180 - RNA, 56 nt, Human
acuggcuggaguugccaaggcuggagguaaggccaaaagcacuucacccagcuagu

SEQ ID NO: 4146181 - RNA, 68 nt, Human
acuggcuucccaaaacuuuaguuggggguacucuugcauuucugaagcucuggcguuggggagguagu

SEQ ID NO: 4146182 - RNA, 56 nt, Human
acugucacugacagaaucaacauauauugucugaaauuuccaaagucagaggcagu

SEQ ID NO: 4146183 - RNA, 69 nt, Human
acugucaucagaagaugaaaauuucauggguucuuaaccugggauacaugcaucuuuggauagaauagu

SEQ ID NO: 4146184 - RNA, 95 nt, Human
acugucauuuugucugggucuaaaaauucucagauggccuuauucacaugucuggacaaucuguuaggauuguuggaauguccagaaugacuagu

SEQ ID NO: 4146185 - RNA, 57 nt, Human
acugucugucuguuguugagaagcaguaaugcuuaggaugcuagcaggcaugagggu

SEQ ID NO: 4146186 - RNA, 76 nt, Human
acugucuucaaacugggccauguguuccccuggggagacuggagguccuucuaagggguucacaggcauagauagu

SEQ ID NO: 4146187 - RNA, 55 nt, Human
acugugaagaaugcacuggggaccugcuugcugcuccucaggccaguuuuaaagu

SEQ ID NO: 4146188 - RNA, 69 nt, Human
acugugacuuuguucuaauaguaucucucuggcugaauguugagaauaaacuagagcuaggucaagggu

SEQ ID NO: 4146189 - RNA, 70 nt, Human
acugugagcuugauuuuuguuuauccuuacaacuuuaguaaaagaggauaauaauaaucucguuuacagu

SEQ ID NO: 4146190 - RNA, 126 nt, Human
acugugcaaacuagaagaccuguguaaucauuuaaucacauagccaucucuuugagaagauaggauuuaguuaucaucaaagugaguggcuacaugaaggauugcauuauuuauguuagcuuaagu

SEQ ID NO: 4146191 - RNA, 63 nt, Human
acugugcauuccccaaccuguguuuaagcugagagcaagguuccuuauggggauggcuacagu

SEQ ID NO: 4146192 - RNA, 61 nt, Human
acugugcuugcuggccaguagcugugcccccauuuuacagcuaaggaagcugaggcacagu

SEQ ID NO: 4146193 - RNA, 61 nt, Human
acuguggcacagaaauguugacuguuaauaacuugcccaacgucaaugucuggccaauggu

SEQ ID NO: 4146194 - RNA, 130 nt, Human
acuguggguucuugggugagucacuuugccuccaaaggcaucaguuuccucaucuguuaggugagauuauacagacuggccuagcagggaagcagugaggauggcauuaaaucaagcacuaauccagggu

SEQ ID NO: 4146195 - RNA, 58 nt, Human
accugguuccuccucacugcuguguccccagcuuuuugcacagugcaugggaccuggu

SEQ ID NO: 4146196 - RNA, 66 nt, Human
accuguaggaacgccuucauuugcuuuauuucugacauuaaauuugcaaaaaggcacuuuccaggu

SEQ ID NO: 4146197 - RNA, 67 nt, Human
accuguauuaaacuuauuaaaagcuuggcaaagcggccaacaguacuuagaaaguuaauauaaaggu

SEQ ID NO: 4146198 - RNA, 56 nt, Human
accugugccggggucuccaggacaaaugccuggaaguuggaggccaggacacaggu

SEQ ID NO: 4146199 - RNA, 58 nt, Human
accuguggcaggugauguguggauguuuguuagcgcaccauacacaauuugcaacggu

SEQ ID NO: 4146200 - RNA, 79 nt, Human
accuguguucccgcaguuuccaccuaacagucucuucacugugcaguggcagcgugugggugugcauacaaacacaggu

SEQ ID NO: 4146201 - RNA, 56 nt, Human
accuuacucaagucucacugguaauuacuucauuuugcagaugagaaaagugaggu

SEQ ID NO: 4146202 - RNA, 70 nt, Human
accuuagcauuagagauagaaauagucuagauuuuuaagacuguugcugauucuuucugguggaauuggu

SEQ ID NO: 4146203 - RNA, 65 nt, Human
accuuaggaucucauccaugccacaggaaaacaaaaguggcucaagauugaugagucuuaguggu

SEQ ID NO: 4146204 - RNA, 56 nt, Human
accuuauucuugcccuuagaugacacaugauuccaucuaaauagguaaaaugaggu

SEQ ID NO: 4146205 - RNA, 72 nt, Human
accuucaagagcaucuaacacauaagccugaugaaaacaguugcugcaguuuaaguuugggugggugggggu

SEQ ID NO: 4146206 - RNA, 66 nt, Human
accuucacauucagaaaaagcccguuguaauguccagugguaacaauggagccuaagaguggaggu

SEQ ID NO: 4146207 - RNA, 76 nt, Human
accuucagaguauugcaggcuucaaacucuccuagcaauaccuuggguuugguauggagucugaguuucuagaggu

SEQ ID NO: 4146208 - RNA, 108 nt, Human
accuucccauggauuaagacauuuuagagauagggaaagucacugaggcccguuacaacugugaauuuucuuaugaugcugaaaugaauuuuaaucuggccaaaaggu

SEQ ID NO: 4146209 - RNA, 73 nt, Human
accuucuaauuguguuugcauaucuuaaaaaacauauuugauuaaguaagaauguaaguacaacuugggaugu

SEQ ID NO: 4146210 - RNA, 68 nt, Human
accuucugcagccacagcugaagguugcugagugcccaccauguccucggcucugugcugcugaaggu

SEQ ID NO: 4146211 - RNA, 112 nt, Human
accuucugucccaugcucugaaauucuuuuacggcucuacuuucccuucagugaucuuucuucaagaugacagugacagccaaaggcuuuuucauagcuuggaacagaccgu

SEQ ID NO: 4146212 - RNA, 103 nt, Human
accuugacugcauaucguuuauaauugagugguggugacaaauauaaaaugaaucauuauaggagucauuauaccauuauaauugugucaagugcuacaaggu

SEQ ID NO: 4146213 - RNA, 55 nt, Human
accuugagcaagaguaggaacugaauuuucuuucagauucuuuuguguucauggu

SEQ ID NO: 4146214 - RNA, 82 nt, Human
accuugcaauuuucuuguucuuuagaggcagcaguuguuauuuuuccuccauuguuccuguguggaaaagggccuguuuggu

SEQ ID NO: 4146215 - RNA, 95 nt, Human
accuuggaauauguagaaaugcagauucuuaggccccaccucacaaaacucugggauggagucuagcaaucuguguuuuaauaaguuuuucaggu

SEQ ID NO: 4146216 - RNA, 90 nt, Human
accuuggcaagaucacguucauugaggaagggaggaagcccagauugcaguguugacagggaaagacuucucuucccagggacacagggu

SEQ ID NO: 4146217 - RNA, 60 nt, Human
accuuggcagaggucugagguuuaucuuucauucccugaaccucaagcaacaaccaaggu

SEQ ID NO: 4146218 - RNA, 57 nt, Human
accuuggcuggggccugaauccugcagaaacuuggucagguagggcaucagccuggu

SEQ ID NO: 4146219 - RNA, 66 nt, Human
accuuggggauacacuggccaaguggaggagcugauggcagacuccucccagugugucccuguugu

SEQ ID NO: 4146220 - RNA, 62 nt, Human
accuuggggugaugcugaaagauugccauuuucaugcagacuaucaaauugcuccacuaggu

SEQ ID NO: 4146221 - RNA, 64 nt, Human
accuuuaagagcaggucugugggcuccagauaccagcuggcaaccgcauggccugcuucauggu

SEQ ID NO: 4146222 - RNA, 59 nt, Human
accuuuaugaaacagcugucguaacaggaauucugagaugacaguguggcauggaaggu

SEQ ID NO: 4146223 - RNA, 55 nt, Human
accuuuuacggugugacuagcaaaugccgugguuuuugcaaagucagugaagggu

SEQ ID NO: 4146224 - RNA, 69 nt, Human
accuuuugccgaagguaucugagaugaugugaaacuauuugaaucucuugagacuuugggguuaaaggu

SEQ ID NO: 4146225 - RNA, 97 nt, Human
accuuuugcucauuagcuuaaaugaacucaaugaucucccagcccaaccagacugcugggagucugugauucaaagcccucaccugagcucagaggu

SEQ ID NO: 4146226 - RNA, 97 nt, Human
acgaaggaggaaaaggaaggaggugucaguuggacugccccaaggcaacccuugagccaucaggacagcucaacaccuccucuguuuucuucuuugu

SEQ ID NO: 4146227 - RNA, 62 nt, Human
acgacagcuucuugggccgggccucuggggacagggguuccugcucucuaggagcugccugu

SEQ ID NO: 4146228 - RNA, 75 nt, Human
acgaggaaacguuugcaaauacugagcacgcaaucaauacucgauaaucgguggcugccaguauuaccuccuugu

SEQ ID NO: 4146229 - RNA, 61 nt, Human
acgagguaggcccaucuggauuagugaucuuugucuacuuccagaccugugcuugcucugu

SEQ ID NO: 4146230 - RNA, 66 nt, Human
acgagucacugggagucguaagacacggcccugccguucugccccucuguggcucccagcccucgu

SEQ ID NO: 4146231 - RNA, 75 nt, Human
acgagugucugguaguuaugguaaagaaucaacaauucaaaauguucaucauucaucuuauugccagucccuugu

SEQ ID NO: 4146232 - RNA, 58 nt, Human
acgauguguuggauuacaaggugaugcuucaguaucaccuugugagguuacauaaugu

SEQ ID NO: 4146233 - RNA, 78 nt, Human
acgcagauuuuagcuuucagaacuuuguuucaggaagauguauuugaagcaggugggcaugaaagcugaaagcugagu

SEQ ID NO: 4146234 - RNA, 76 nt, Human
acgcgauggccucuucccgcguucucggcggguacggcgcgccgccugccugcggcccgcggggagguggucgggu

SEQ ID NO: 4146235 - RNA, 76 nt, Human
acgcgcugagccccucacgcgcccuccugggcccuggcggacccagaggccccauuggcugugcgucucaaggugu

SEQ ID NO: 4146236 - RNA, 87 nt, Human
acgcucucaguaaaagaugaaugaaugaaaaaugggucagaugcaccugcaaugaugugugauucauucucaaaguugugugggugu

SEQ ID NO: 4146237 - RNA, 55 nt, Human
acggaauguccuauuguaggcgguuggagacaccuguguuuuaaugauauucugu

SEQ ID NO: 4146238 - RNA, 129 nt, Human
acggaggggcuuggcaaugccugcucucuugagaucucugcuaggguucagcagugccuuaaaucuaggggucaagccuggcccaguaguuuacccuuagggagcaagcuuuggcucuugcagcucugu

SEQ ID NO: 4146239 - RNA, 64 nt, Human
acggauaucugugcguauagcauuguacuuuaucagguauguacauauguguauauguaucugu

SEQ ID NO: 4146240 - RNA, 90 nt, Human
acggauugugccuuggaaagaauacugugcuggaaauuaguagaucucuaacuuucagcaaguaauucuggacccaaguaccucauucgu

SEQ ID NO: 4146241 - RNA, 81 nt, Human
acgggcacucagcugagcccucagcccucauggcuuucccgaugcucaccggugcagaggagccagcuggggagccucugu

SEQ ID NO: 4146242 - RNA, 61 nt, Human
acgggcugggacggggaagcucugugggaaacacucuaccuucucuucuucucuuaaccgu

SEQ ID NO: 4146243 - RNA, 87 nt, Human
acggggaagugaccacauacuuucuuuuucacgcauaggauuuguuuaucuauguugaguuuuagaaaguuaacaucauuuguuugu

SEQ ID NO: 4146244 - RNA, 125 nt, Human
acggugaggccaagaauauccugccuacucuggcgggcgggcgagccacgaagccugcuggaagggcaugaaucauggucccugccugccaagugcucacuugggauguguucgaggcuggcugu

SEQ ID NO: 4146245 - RNA, 77 nt, Human
acggugaggucauacaaggcacuggugauuuaugucuccuggccuuuuaucuccagcagugcuuuugagcccacugu

SEQ ID NO: 4146246 - RNA, 73 nt, Human
acggugcccagggacucugagagccugaggguggcacgucaccucgggggccauugggagcccuggaugcugu

SEQ ID NO: 4146247 - RNA, 120 nt, Human
acgguucagggaaccagaagccugaaagcaagcugucuggaggcucugagggagaagggguucccucccccucccuagcuuccgggggcugccggcacuuauuggcaucccuagacucgu

SEQ ID NO: 4146248 - RNA, 78 nt, Human
acgguuccaauaauuguucugaauuggauucuguugaaaaccuccuuaacagaauugaaaguauaaucugggcacugu

SEQ ID NO: 4146249 - RNA, 81 nt, Human
acguaucacguggaucagcuauggaacagauaccccaaaccgagggcugucugacuccaaguuggagcuccaguguccugu

SEQ ID NO: 4146250 - RNA, 78 nt, Human
acgucaucauacaaagagccgcugaugucagccccguagaucggggagacaaaggugagguucuuccaguauuugcgu

SEQ ID NO: 4146251 - RNA, 79 nt, Human
acguccuuggagcuguggagcccugguagggaccccagcucucgggaggggcccugcgggggcuccuaguacaggaugu

SEQ ID NO: 4146252 - RNA, 85 nt, Human
acgugauauauuuacuuccccaguugugguguaagcauccucuaaaaaugcuuacaccacaauuggggaaguaaauauaucaugu

SEQ ID NO: 4146253 - RNA, 58 nt, Human
acgugcuggagaagagcucgccuggccaccgggccacggccccgcagacccagcacgu

SEQ ID NO: 4146254 - RNA, 87 nt, Human
acguguccuuauuuuggaaauaaaugcuucugaaguuaaaauaaauguauuuaauuaguagaggcauuuaguucugagguggaaagu

SEQ ID NO: 4146255 - RNA, 89 nt, Human
acgugugagcccucagugacugguccuucacagccacacucugugggaugcagagucugugcuggggccagcucgggagagcugaccgu

SEQ ID NO: 4146256 - RNA, 72 nt, Human
acuguuauuuguaauccauuauuuggccaguaugggucugaauuuuguaaugggugugccuuaguauacagu

SEQ ID NO: 4146257 - RNA, 62 nt, Human
acuguucaaguuuuaugcuggaaaauaacuugauguucauagucuccagcuaaaugugcagu

SEQ ID NO: 4146258 - RNA, 61 nt, Human
acuguucuucccauuuauauugggcaccacuuuugguuguauuuaugaugggauggauggu

SEQ ID NO: 4146259 - RNA, 72 nt, Human
acuguugaaugagugaauucuaaaugcuaaagaguuuuccauucaaaguaagaauuuauuacaaaagacagu

SEQ ID NO: 4146260 - RNA, 100 nt, Human
acuguugccagugaaucuugacuacucuugugccugaugcgaccgugagucugcguaucucuguuuuaggagauagugaaugaaacugggaaccaacagu

SEQ ID NO: 4146261 - RNA, 69 nt, Human
acuguuguugaucagacagcacuucuuuaucucuuuaaguuuuaagugcuguuucugaugaaugccagu

SEQ ID NO: 4146262 - RNA, 76 nt, Human
acuguuucacguguuuaagcccaaagauuaugucaagaaguggcuuguaaguggcggcuugaaagcuggaaauugu

SEQ ID NO: 4146263 - RNA, 56 nt, Human
acuguuucacucuuuaagaauugccuauguaauucaauuuugcagaggaaugcagu

SEQ ID NO: 4146264 - RNA, 61 nt, Human
acuguuuucuagaaacaaugccuauuucaguuaugaacuagucuguuuugaagaaaauggu

SEQ ID NO: 4146265 - RNA, 82 nt, Human
acuuaaaaaccuauuuuauaauuuaaugugcaucauuaguggugaguguauuaaguuaugaaguuaguagggucaguaaagu

SEQ ID NO: 4146266 - RNA, 77 nt, Human
acuuaaaaguugcuucccuaacucuuaucccugggaaaugaucuagcauccaaguaugaggaaacaaccuuuugagu

SEQ ID NO: 4146267 - RNA, 75 nt, Human
acuuaacauucaaaaggaggcaugggcaauuccuuucaccaucuuucuuugcccccuuuucuuguuacacugggu

SEQ ID NO: 4146268 - RNA, 82 nt, Human
acuuaacugcuugcuuucacaccaugccuauaaaaccuuuuugguuuuagagguucuaugugucuggaaaguacagugaagu

SEQ ID NO: 4146269 - RNA, 64 nt, Human
acuuaaugugauagcuguuaaaaugucuuuaugugacuuaaugauagaugucauggucuugagu

SEQ ID NO: 4146270 - RNA, 77 nt, Human
acuuacagcaauuagaguggcgagugauuuacacucguuucuuuaagguguaaauugccacuuauugcucaguaagu

SEQ ID NO: 4146271 - RNA, 86 nt, Human
acuuaccuucucuuucugucacucuccuuggcugacuccuuccugccaggugggagacagacagcauuuucuuaagcagggucagu

SEQ ID NO: 4146272 - RNA, 76 nt, Human
acuuacuugauugcuucgauaugcuaauuugaauuccccuagaagcagacucugaggcaaggauucacauguaagu

SEQ ID NO: 4146273 - RNA, 86 nt, Human
acuuagacccccugagaggcaguaauugugggcaauagcuggacuuuuguauuguaauugcugcuauuagucuuaaaagucuaggu

SEQ ID NO: 4146274 - RNA, 61 nt, Human
acuuagacuaaccuguagaugaguuugguaugcaucaggauaccucacaguuggucucagu

SEQ ID NO: 4146275 - RNA, 82 nt, Human
acuuaguaguuggguaguugauuaugcagcugaaacuaauacguacagcuccaaaaaucacuguuuauaauacuaacugagu

SEQ ID NO: 4146276 - RNA, 55 nt, Human
agacuguagggauagaggucuuaaugugaauuagguuuuucuaauucuaaagucu

SEQ ID NO: 4146277 - RNA, 59 nt, Human
agacugugacuagaccuauaucuuuuugaggucuacaaauaagauguaagucaaggucu

SEQ ID NO: 4146278 - RNA, 55 nt, Human
agacugugccucauuuuuuaagugcccagcauugguaauggacaggcaauagucu

SEQ ID NO: 4146279 - RNA, 94 nt, Human
agacuuuaaauguaccgaacuguauugguuuucuauugcugcauaacaaauuauugcagccuuagagacuuaaaacaggacucauuuacugucu

SEQ ID NO: 4146280 - RNA, 64 nt, Human
agacuuucagcaacucuacuuugagggaacaaaccgacucccugaauacuggugcugaaaguuu

SEQ ID NO: 4146281 - RNA, 71 nt, Human
agagaaaaacauaacccuaggagauaagagagcaccaaggcuaauauuaacccugaggguuuguguucuuu

SEQ ID NO: 4146282 - RNA, 75 nt, Human
agagaaaagagauccauuuuccaugagaggucucaauacuucaaaagcccuacuagaaauguaucucuugauucu

SEQ ID NO: 4146283 - RNA, 63 nt, Human
agagaaaccagcauuuaaaccaggaaccgcugaaaagcaggauucaaaaugguguguuugucu

SEQ ID NO: 4146284 - RNA, 103 nt, Human
agagaaagaaaaauagcaaccaaugcacaucacucugaagaaaagcugggccugcaguuuucugaauaagcaggaugauuggugccucuaauuuucugucucu

SEQ ID NO: 4146285 - RNA, 68 nt, Human
agagaaaggcagcccuggcucagccuggcccuccgacccugagcaggcaugagccaggccccuccucu

SEQ ID NO: 4146286 - RNA, 74 nt, Human
agagaaaugaagucugcacaugcauguguuuuguaccauauauaccacagugaagcaugcagacaucuuucuuu

SEQ ID NO: 4146287 - RNA, 77 nt, Human
agagaaaugguaaaaagcaaacagaaccccaagcuuugcucacaagcuuggggccugcuaugcucuaccuugucucu

SEQ ID NO: 4146288 - RNA, 62 nt, Human
agagaacaaauuaaaggugguuauagacagaagcauuuucacuacuuuuuaauuuggucucu

SEQ ID NO: 4146289 - RNA, 64 nt, Human
agagaacguggaauguggcuccuuggucccauucagccuguaaggggauacuuccacuuucuuu

SEQ ID NO: 4146290 - RNA, 83 nt, Human
agagaacucucuuauuacuguauuaauccagagcagccaguuugcuaaggaaaggaaauacaguaaucuccuugagguuuucu

SEQ ID NO: 4146291 - RNA, 113 nt, Human
agagaacuuuuuaaaacuuccuuuucuaggugcaugcuucacuggauauugauaaucuuucuuuucucuguguucucuagagcuguacaaagaaaggugauucuaaaaucuuu

SEQ ID NO: 4146292 - RNA, 114 nt, Human
agagaagagaaugaagagaggcagccaaguacucacuuugacagagaaaugaauccuggaaagggcuuccgcuggaaggugaguucgcucuguuucucucaugcuuucuuuucu

SEQ ID NO: 4146293 - RNA, 55 nt, Human
agagaaggauggcggugggaggauagucaggguucugcccccagccaaauucucu

SEQ ID NO: 4146294 - RNA, 57 nt, Human
agagaagucucagcacacuugcuguucaucugcucuaugugcccugcagacuucuuu

SEQ ID NO: 4146295 - RNA, 67 nt, Human
agagaaucaaacugagcugaacaaauugcgaguggggcguccagcugugcuguuggcuugucucucu

SEQ ID NO: 4146296 - RNA, 81 nt, Human
agagaauggaguuuggggucaaauacucacggguuccuucgguuauuaguuugggauuugcuuuguagagguucauucucu

SEQ ID NO: 4146297 - RNA, 61 nt, Human
agagacaagaaggcagugaggcccgugcaggugcugcugggcccccagugaccuucucucu

SEQ ID NO: 4146298 - RNA, 68 nt, Human
agagacaagaugagcagcucagugucagcacuaggaucugauugcagagcgugugcuuucuucccucu

SEQ ID NO: 4146299 - RNA, 63 nt, Human
agagacaguuggggauuagugauuacugugacuuggauagucucacucugauuaggugucucu

SEQ ID NO: 4146300 - RNA, 106 nt, Human
agagacauuuugguuggagaaagauguuuagagugagacagcuggguuugaauaaaacuucaguacuuaguauuuuucagcuuugaaucucagaacaagaguuucu

SEQ ID NO: 4146301 - RNA, 63 nt, Human
agagaccauuauguauaaucacagagugucacaggcaugacaugaaugauuaugcaaaacucu

SEQ ID NO: 4146302 - RNA, 86 nt, Human
agagaccauucugguuaaauguuucagugaaaaguuaagacuggucuaucggucuuaacuaucauuugaacaccuggaaaaucucu

SEQ ID NO: 4146303 - RNA, 89 nt, Human
agagacccacaaagcucaaagcccauugugcuaggcuccugacccaucugaacacugagcgggcacugagcgggcucugagcgggcucu

SEQ ID NO: 4146304 - RNA, 79 nt, Human
agagacccuuugccuggagggacauggagaccugggagcagcugggccuucaggugucccugugggccugguagucucu

SEQ ID NO: 4146305 - RNA, 69 nt, Human
agagacgaagguaaacacaugaaugucuguauuuccgcacacaucaugccaaguuucaccugccuuucu

SEQ ID NO: 4146306 - RNA, 81 nt, Human
agagacgaugcuggauuaucucaagggaacagcagugaaccaucuugauuaaccuugaggaguccauaguaucacguuuuu

SEQ ID NO: 4146307 - RNA, 71 nt, Human
agagacuggagggcaagcuuugaacaucagcagcuguaucagaugcugccagggcucugcccacauucucu

SEQ ID NO: 4146308 - RNA, 109 nt, Human
agagacuuuagaaguuaucuggucaggaucucccaguacauaucucuccuguguauguaagguuacaggcauauguuuguggaagacuuguuagauaagaaggugcucu

SEQ ID NO: 4146309 - RNA, 106 nt, Human
agagagaaggaaagagaucuuuugggggcauagagcucauugguagcagagcaguuauuggucuucuguucccuauuucaggucucuuuucauuaugccacucuuu

SEQ ID NO: 4146310 - RNA, 106 nt, Human
agagagagagaguguguguauuugugugacuguguguuuguguguguugugcauuuacauagaguaucauacuggaugcaucacuuuauauaguuauuuuuucucu

SEQ ID NO: 4146311 - RNA, 76 nt, Human
agagagaggcagaaacugagacagaaggacagagagagaaaugcucuguuacucugaauguuucuacugauucuuu

SEQ ID NO: 4146312 - RNA, 80 nt, Human
agagagagguuaaugcagaauugcuaaguaucugaucaggauuugaaagcagggguuugcaauucuguagaccuugcacu

SEQ ID NO: 4146313 - RNA, 88 nt, Human
agagagcaaaggcaagaauguuagagauucuuagguuuuaguagaaagagcauaguuugaagccagaugaccuugcguuuaaaucucu

SEQ ID NO: 4146314 - RNA, 58 nt, Human
agagagcauugaggaaaucuucugucuggucucagaauccuuugcucauuugcucucu

SEQ ID NO: 4146315 - RNA, 77 nt, Human
agagagccacgcagggguugcaaugcugggugaguugggccguuugucucuucuguauuguuaacucaggguucucu

SEQ ID NO: 4146316 - RNA, 55 nt, Human
agagagcucccagucuccucuccauggcuccuugccugguugcuggggugccuuu

SEQ ID NO: 4146317 - RNA, 130 nt, Human
agagaggcaguaguuucuaauguaaccuaggauaugcuugggacugauacaguggaaaaguggaaucuaguguauuucucuuaggcauuaaaguuuggugcugacauaagaauguaauuucuguagcuuu

SEQ ID NO: 4146318 - RNA, 70 nt, Human
agagaggguuuucauuucugagcauucucugaaaagaaugagggcucauugacauggaaaagccacuucu

SEQ ID NO: 4146319 - RNA, 87 nt, Human
agagagguaaauuauacagauaucuaagauguaaacgguucuagaccuuuuggccauuuguugcauuuauuugguguuuaucucuuu

SEQ ID NO: 4146320 - RNA, 56 nt, Human
agagaguagguccacagucaucugaaucccagcucuggacaguggccuauggcuuu

SEQ ID NO: 4146321 - RNA, 65 nt, Human
agagaguguaacccaugguuuggcauuagguguucgaugaaaaggcagcuggguagcaucuuucu

SEQ ID NO: 4146322 - RNA, 61 nt, Human
agagagugucauugggucaguaaaaguugaaugcuuuguaaagagucaaaggcaugucucu

SEQ ID NO: 4146323 - RNA, 78 nt, Human
agagaguuccaugcccucuguacugccagucagauuuuaaccuuuauuuuugcccagugcugacagggaggaaccucu

SEQ ID NO: 4146324 - RNA, 65 nt, Human
agagaguugcuaguuuucaggauaccuccaacuaaaaaggcauccuggagaaaagaaacauuucu

SEQ ID NO: 4146325 - RNA, 59 nt, Human
agagauaauuagguuaaaugaggccaugaguggccucauccaauaugacuguuaucucu

SEQ ID NO: 4146326 - RNA, 130 nt, Human
agagauagaugcauuuucagauugcagaugccagggguguguugauuguuccaguaaugauacuacaacugggccagcaacugcaauggauuucaccaccugauuaaguuuacaguaaugcacugucauu

SEQ ID NO: 4146327 - RNA, 74 nt, Human
agagauagggaacuagacaaagagagaagaaaugugaagcaucuggcucacuuagucuaggacacucagucucu

SEQ ID NO: 4146328 - RNA, 57 nt, Human
agagaugacaugagggacuuaagggacuccauucccccugucccccauggucucucu

SEQ ID NO: 4146329 - RNA, 58 nt, Human
agagaugcaaugguauauggucaccuaaaguaggauaauggacaucuauugcuuuucu

SEQ ID NO: 4146330 - RNA, 130 nt, Human
acuuuccagccuccagaacugugagaaauacauguccguuguuuaagccacccaaucugugauauuuaaucuuguuauagaagccugagccaacuaagacagguguuuacaguguuuucugcuuuaaagu

SEQ ID NO: 4146331 - RNA, 62 nt, Human
acuuucccucuagccaaauuuuaaaacuguagcuguguuucaaaggaggcugagaggauggu

SEQ ID NO: 4146332 - RNA, 58 nt, Human
acuuuccuagacuucagugacagccugggucaggggcuggucacgaaacugggagagu

SEQ ID NO: 4146333 - RNA, 57 nt, Human
acuuucuauggcuuauuaugagguuuaauuuuaucuuguaauaagcaauauggaagu

SEQ ID NO: 4146334 - RNA, 76 nt, Human
acuuucucauuuagcuuucucucacuggugaugagaaaauccuuaguccacuacucugugaaaagcuguagaaagu

SEQ ID NO: 4146335 - RNA, 98 nt, Human
agaaguggacaaaugagauauugguaagaaucaagaaucaaguugguuucaguuguuuugcaggauccuuacaaaugaacauuuuaguccuugcuuuu

SEQ ID NO: 4146336 - RNA, 66 nt, Human
agaaguuaaagcauauggaaauaugauauugagaugcaaaaucaaaagacauguguuuuaacuuuu

SEQ ID NO: 4146337 - RNA, 78 nt, Human
agaauaaacauacucucauauuugaagugaccaaugauauauccuuauuggugcaauuaugaggguguguuccauucu

SEQ ID NO: 4146338 - RNA, 98 nt, Human
agaauacacuaaguauguuuuuaagagaaugcauuagcagagcuacaccauuaaaauauuagcaaaguguauuucccuugaauuacuuaauguguucu

SEQ ID NO: 4146339 - RNA, 77 nt, Human
agaauacucaauuuguuggaaagcauguagguuagcaaauuucaauuccuguguucuuuuaaucauauugaaauucu

SEQ ID NO: 4146340 - RNA, 65 nt, Human
agaauauaacagauucaaagauaagucucuaaagaggaaggcaaucuuugcaucaguuguuuucu

SEQ ID NO: 4146341 - RNA, 75 nt, Human
agaaucacaagcaacgacuuucaagcuguggguccccaaucuacuacuugucuccuuuuuuguuauguguauuuu

SEQ ID NO: 4146342 - RNA, 58 nt, Human
agaaucacagggaguuccugcuuuggauugggccauccaggaaagccugugugagucu

SEQ ID NO: 4146343 - RNA, 72 nt, Human
agaaucagccugaguuugcagcuuaaagccaaaggauuugauacaaucacuggcagcugccagggugguucu

SEQ ID NO: 4146344 - RNA, 86 nt, Human
agaaucauaugcugaagaaucacagggacugacaggggaaaaauguaaaugucauaguuuugcuaauuacuuuagcauguguuucu

SEQ ID NO: 4146345 - RNA, 58 nt, Human
agaaucccaauucuggcugauuuagcaccaaggaagcuuucuccagcuuugggcuuuu

SEQ ID NO: 4146346 - RNA, 69 nt, Human
agaauccugaugaaaaggagagaacgugggagaauaaaagacuaucauaagucuuuucaucaggaaucu

SEQ ID NO: 4146347 - RNA, 74 nt, Human
agaaucucucauuaauugccgaugagaaugcaaaagagugcagccacuuuggaagacaguugaugggaguuucu

SEQ ID NO: 4146348 - RNA, 114 nt, Human
agaaucuuuauguauuaggugugucuccugaagaaggcagauauuuguuuuguaauauauuuuauucuaccugucuguauuuuuuaaguagagcacuuagaccauuuacauucu

SEQ ID NO: 4146349 - RNA, 77 nt, Human
agaaugaaguuaagaggaugcugggccugccugccuuccucaugggacagugagagucuacacccucaaugcauuuu

SEQ ID NO: 4146350 - RNA, 65 nt, Human
agaaugauggagucuucugaguuauuggauaguauauacugcaauuuucagaaauuccaaauuuu

SEQ ID NO: 4146351 - RNA, 77 nt, Human
agaaugcuacagaagugaucuuggaugacuuucaaggcaagaugagaggaggucgagcaacuucugcuugguucucu

SEQ ID NO: 4146352 - RNA, 56 nt, Human
agaaugggaguuggggagggguuuauauuuuuuguccuucuucaguaguuuguucu

SEQ ID NO: 4146353 - RNA, 84 nt, Human
agaaugggcuccugucuguagagggagcgggauuccgaggggcagagguuaugguggagugcuccgucuuggacagggcauucu

SEQ ID NO: 4146354 - RNA, 88 nt, Human
agaaugguauaguauaauauucuuugaacaguuuuccugugcauaguaaaauaccuauggaagaauugucggggaugugcuccauucu

SEQ ID NO: 4146355 - RNA, 80 nt, Human
agaauguacauagacaaagaucagaagaguuugaaauaacacaguuuauauucaguuguaaucuuuguuaguuacauuuu

SEQ ID NO: 4146356 - RNA, 62 nt, Human
agaauguagucuuggagauuuaauacccuagauagugagugugaauuucccucuaucauucu

SEQ ID NO: 4146357 - RNA, 74 nt, Human
agaaugucuaaugaauugucuagaaauugaaauacgcaccuuuuaugaauagggacauuucauaagaccauucu

SEQ ID NO: 4146358 - RNA, 63 nt, Human
agaaugucuuucuguucuaugagauuuaggcuuugcucccuagucuuauacagaaaacauuuu

SEQ ID NO: 4146359 - RNA, 66 nt, Human
agaauguguguguguguuugugugugugugugugugugcauucgcacauuaacacucauaucuucu

SEQ ID NO: 4146360 - RNA, 130 nt, Human
agaauguugaggcucagcagaauuaagcaaauuuuccaagaucacacagguaacaaguggcagaaugucacuucaauacuagaugugugauuccaagguugauuuuguuccugcuguguaaagcaauucu

SEQ ID NO: 4146361 - RNA, 113 nt, Human
agaauuaauuuuauuuuaucuaauaugcuucgaauugggcuucuggaauucaacaugcaaauguaugcuccuagugcaaauuggagcaugcccagauuaauggagaaaauucu

SEQ ID NO: 4146362 - RNA, 77 nt, Human
agaauuagaacacuuggcuuuggauuuaaucauuaucccuagcaauguuuuagagauagccaaguguuucacauuuu

SEQ ID NO: 4146363 - RNA, 78 nt, Human
agaauuaggugguuugguuuugguggccagcucaggcacagacuugcugccuugcuucaaucaaaccguuuggccucu

SEQ ID NO: 4146364 - RNA, 59 nt, Human
agaauuccucuaggaucugccccuuucuuguucuccaggcaguaugccuuggacauucu

SEQ ID NO: 4146365 - RNA, 59 nt, Human
agaauugagcuuuggagggguccaggaguggaagguccaacauggggaagcucagauuu

SEQ ID NO: 4146366 - RNA, 68 nt, Human
agaauuguguuucaggguacuugaucugauuaagcauccagauccaagggcaugcugaaauaaguucu

SEQ ID NO: 4146367 - RNA, 65 nt, Human
agaauuuauccaggcuuaaugggagccaccucaacugggaggguguuccuuucccugggaagucu

SEQ ID NO: 4146368 - RNA, 67 nt, Human
agacaaacccaguggcuguuuuuguuuguuugcuucaauaaaauaagugaaagcccuggguauguuu

SEQ ID NO: 4146369 - RNA, 96 nt, Human
agacaaauuauguagcuuguucaaagucauaaaacuuguaaguggaucagagauucaaauuugaguccguaugacuuuuucaccccugcuaauucu

SEQ ID NO: 4146370 - RNA, 62 nt, Human
agacaacaucacuaaagcugagaaaacacaucuucucucgugucucaagugauagguugucu

SEQ ID NO: 4146371 - RNA, 67 nt, Human
agacaaccacgcccuucauuugggucagacuuuuagacaaaacccugggaaggcuuuugguauguuu

SEQ ID NO: 4146372 - RNA, 65 nt, Human
agacaaguauuuaagguuaguauauuuuauuuuaacaaaguauugcuacaucugaugcuuggucu

SEQ ID NO: 4146373 - RNA, 67 nt, Human
agacaaguuacaccugugcuugauuuuagguucauauuuuauaugucaaacagguguaauaaugucu

SEQ ID NO: 4146374 - RNA, 72 nt, Human
agacaauauguauauuaagaauugaugcucugugaggucaguaacuuuauuuuugauguagucauauugucu

SEQ ID NO: 4146375 - RNA, 92 nt, Human
agacaauguacagguagguauggugcagucuuccaguggucccuagugggauuaaguagcaagcugaucauucuugccuguuuuaucugucu

SEQ ID NO: 4146376 - RNA, 74 nt, Human
agacacagauucucugaggcaggggcagcuggagagacuuucuccaugccuccuauuccuuuuuucucuugucu

SEQ ID NO: 4146377 - RNA, 72 nt, Human
agacacagucaccuuaucaggaugucuuugggaugcgguuccuuucuggaaacauuacagggugaugugucu

SEQ ID NO: 4146378 - RNA, 57 nt, Human
agacacagucugucuggaggaguccccaaagacuguuccaauuggugaugugugucu

SEQ ID NO: 4146379 - RNA, 72 nt, Human
agacaccucacuuaaaaauucuaguuauggaauaauugugaugccauaggaagaaaauuaagcaagcugucu

SEQ ID NO: 4146380 - RNA, 82 nt, Human
agacacuuacuucccagagcucuggagguuggaagcccaacaucacgcuuccagcugagguggccucuguggaggucugucu

SEQ ID NO: 4146381 - RNA, 100 nt, Human
agacacuucuaaggugugaacucugugaauuuacaaagaggcaacagcucuaggauagagacuguggcucuuugaagggaaaaucuacuuugaagugucu

SEQ ID NO: 4146382 - RNA, 55 nt, Human
agacacuuucagaaguguuugcaaguucagauucuaaugacacuuuucagugucu

SEQ ID NO: 4146383 - RNA, 57 nt, Human
agacagacauucuagagccaccacauuucugucuucgugacuuuggaaaugcuguuu

SEQ ID NO: 4146384 - RNA, 77 nt, Human
agacagacggggaaggauugaguugacccaacaucaucuaucuggcuggacgcucauuuuucuucuccugccugucu

SEQ ID NO: 4146385 - RNA, 60 nt, Human
agacagcuccuacugaagccauguuuaaacagacacuuggaggagaggagggaguuggcu

SEQ ID NO: 4146386 - RNA, 61 nt, Human
agacaggagagggaacugccggacuggcaggacaggaaugcgcaggcccucucucuagucu

SEQ ID NO: 4146387 - RNA, 95 nt, Human
agacaggggcaggguucucagguggcccccaugagugggugacaucaggagaccccgcaucaggcaagguuaccugugugccugcugacuugucu

SEQ ID NO: 4146388 - RNA, 120 nt, Human
agacaguugaguugagcccuguaucuguaaaugcaaauguagcuuuuugggaaaaaauauaauuaacuuugaauuugcauuuacauagcauagauuucagauuaauuuaacuuaacugcu

SEQ ID NO: 4146389 - RNA, 76 nt, Human
agacaguuggcccauuuuuaguagauuuagugauuaaagacucaguaugucagagugaaaauggucccaaaagucu

SEQ ID NO: 4146390 - RNA, 129 nt, Human
agacauaaaaaaacaauguuuucaaaagauacugaaugucauggaaaaauuuauucuuauguuaagugaaaaauaggaagauaaacauuuguauguaaggaaucauuagaauauuguuaaaaugugugu

SEQ ID NO: 4146391 - RNA, 72 nt, Human
agacauacacauuauagagaguauaauaggguuguauacacaccuacauauaccuauauaaugugugugucu

SEQ ID NO: 4146392 - RNA, 59 nt, Human
agacauagauaggcacugauugcauccgucugcaaacauguccuuggauaucuauuucu

SEQ ID NO: 4146393 - RNA, 59 nt, Human
agacauauauugcaauucacugggcguuugagugagcuuggaagauugccauguugacu

SEQ ID NO: 4146394 - RNA, 77 nt, Human
agacauguggacuagaucuggaacagccugaaguuuagagccaaacucagcuaaacucagucuauguccaccuaucu

SEQ ID NO: 4146395 - RNA, 63 nt, Human
agaccaaacuacaugaguaugcccagaaacagaguggcuggcucagcuuacuuuugagggucu

SEQ ID NO: 4146396 - RNA, 71 nt, Human
agaccacauccagggagccccucgagcuguuuuucuaaacaagaauaguccucuccuuggaauuuguuucu

SEQ ID NO: 4146397 - RNA, 59 nt, Human
agaccaccagggaaagguggcauguguuauuuaugcucaaccugaggucccuauggucu

SEQ ID NO: 4146398 - RNA, 76 nt, Human
agacccaggacacugcuucucuggcagagccagcccuggcugggcucccucacaucggagccugugcccucagucu

SEQ ID NO: 4146399 - RNA, 105 nt, Human
agacccuuccuauuacagccgauaggccaguguuuuccaaacuacguucuuuggaauguuauugaacuacgagcucuuaguagauguaacugaaagaauggguuu

SEQ ID NO: 4146400 - RNA, 58 nt, Human
agacccuugcagucugguugucuguguaaaaggcauucacgaacauauugcaggguuu

SEQ ID NO: 4146401 - RNA, 65 nt, Human
agaccucaagaauugcccagggcaagagccaagcaccgcgcucuggguucugauuuaugagcgcu

SEQ ID NO: 4146402 - RNA, 77 nt, Human
agaccugaaaagcaaggccaggacaccaggggacuucaggcuucagccuuggcccauuccugucuuuucaaggugcu

SEQ ID NO: 4146403 - RNA, 57 nt, Human
agaccugagugcaggagccaggcuguggagcgugugugugggccugcaucugggucu

SEQ ID NO: 4146404 - RNA, 57 nt, Human
agacaugucaccaauucuuacugauucucauucucagugggccaaguguaugugucu

SEQ ID NO: 4146405 - RNA, 89 nt, Human
agacauuccucugcuuuacagucaccaaacuuugcugcaagaaauguaucagauuugucaagugacuuccugaagcaauaggaaagucu

SEQ ID NO: 4146406 - RNA, 89 nt, Human
agaccaaaauuccauuuguuugccuaugugaaggguuuauuauuaauuacccuauuaauuuauguccaaaccagaugugauuuccuucu

SEQ ID NO: 4146407 - RNA, 70 nt, Human
agaccaccgggagggacgaacaacucuggagugccagcuuuaugaacuguaacccucaccgcgaaggucu

SEQ ID NO: 4146408 - RNA, 59 nt, Human
agaccauagggaccucagguugagcauaaauaacacaugccaccuuucccugguggucu

SEQ ID NO: 4146409 - RNA, 58 nt, Human
agacccaggguuugagcucugcaggaauggccgacuccuugugguuugagccugggcu

SEQ ID NO: 4146410 - RNA, 75 nt, Human
agacccccaugcaagaaugguaauaaugugacuuuaacuuacauugaaauccaauuaucauauguuugugggucu

SEQ ID NO: 4146411 - RNA, 62 nt, Human
agaccccgaugacuccaguuuauaacccuggauucccaggggugcucagagccaugggggcu

SEQ ID NO: 4146412 - RNA, 68 nt, Human
agacccucacgcugucucugguguggagcccuguuaaacuccacacauuagagccaaugucagccucu

SEQ ID NO: 4146413 - RNA, 60 nt, Human
agaccgagaggaauccugacugaggcagggaucgccggucagccagaggcuucuugguuu

SEQ ID NO: 4146414 - RNA, 57 nt, Human
agaccuacuggcacauugguaucauccuuauuuuacagauggccaguuuagagguuu

SEQ ID NO: 4146415 - RNA, 57 nt, Human
agaccuggaaguucaagagaaagagaugaguucuugucucuaccccuccccaggucu

SEQ ID NO: 4146416 - RNA, 81 nt, Human
agaccuguccucccccaaaguuugcacggauaaucggaaggugugguagggugggcuugggggaagccaggagaagggucu

SEQ ID NO: 4146417 - RNA, 67 nt, Human
agacgcacagggccuuauauccagaaggacaucaccuuuggguuuuaaugcucugcacuugcugucu

SEQ ID NO: 4146418 - RNA, 60 nt, Human
agacgcugaaguucuuucauaucuuaauuagcaguuaauuaaguggaggugcuggugucu

SEQ ID NO: 4146419 - RNA, 91 nt, Human
agacggggcuucugugggagaugggaagguggaugccaggagaccugcaauugaguaaaaucuuuccuauuugccuaaagagacccucucu

SEQ ID NO: 4146420 - RNA, 71 nt, Human
agacuaagugauguagcucauuugugcaauaggucagggacuggguugcaggaagcacacacauguagucu

SEQ ID NO: 4146421 - RNA, 59 nt, Human
agacuagcuccaaaguuaguguuguuuuucuugauggcauuagcuucaaaagcuugucu

SEQ ID NO: 4146422 - RNA, 56 nt, Human
agacucagaguagaaaauagguuccaggcauggacuuucauuguuacucagaguuu

SEQ ID NO: 4146423 - RNA, 56 nt, Human
agacucaugguaaggguagaaaccggcaucuccacaugucuacccucucagagucu

SEQ ID NO: 4146424 - RNA, 72 nt, Human
agacucucaagagagugcugcuugggguucgacuguguucuuuagaacuccauuuuucaaacuuuagaguuu

SEQ ID NO: 4146425 - RNA, 85 nt, Human
agacugaauuguuucagaaaguccaggguuuaaucccagcuuuuacucaagagcagagagccuggacuuuucugagccucaguuu

SEQ ID NO: 4146426 - RNA, 55 nt, Human
agagggugaaugagauagaaaaacaagacaugauuuuucuggguacucucccucu

SEQ ID NO: 4146427 - RNA, 64 nt, Human
agagguaagaauagaggauuggggauggguugucuggcuuucaauuuccucaguucuuacuccu

SEQ ID NO: 4146428 - RNA, 73 nt, Human
agagguaagcaguggcaagugcugggcccagaaccaacacuugguugucagcugcuuaguccaaguauccucu

SEQ ID NO: 4146429 - RNA, 130 nt, Human
agagguaagucucgguugcagaggggacuggggcagaagugaggauuguccagccuauccgacugguugggcagcuguuuguccuccuguuacucuccccaacuccugcccugcacccugccacauuucu

SEQ ID NO: 4146430 - RNA, 74 nt, Human
agagguaccgcaaauucauucaguugaagaaaauccagugaguucuauaauuaaaaugaaggcauuguaucucu

SEQ ID NO: 4146431 - RNA, 61 nt, Human
agagguaccuagaaguauugcuaggcugugauuaggaaugcagaauuuggggguaaccuuu

SEQ ID NO: 4146432 - RNA, 73 nt, Human
agaggucaugcaaggcugaaacaugguggguuucuggcccaccaaaagugaaaagaccuuucuggguaccucu

SEQ ID NO: 4146433 - RNA, 84 nt, Human
agagguccagucaguaacacuauuuucauauguaucuaucuguauguauauauauaugaauauagguacuguauauguguaucu

SEQ ID NO: 4146434 - RNA, 94 nt, Human
agaggucuuaaaagcuuaguguacauuuaauuuugcaaaucaauacuauuauuccugguuugcagcugcaguaaauguucaccuguagaucucu

SEQ ID NO: 4146435 - RNA, 85 nt, Human
agaggugugaguucaucagcuucucaaaauggcuuagaucccaaaaagauuaagacccauugcuggaagucuaguucaugccucu

SEQ ID NO: 4146436 - RNA, 82 nt, Human
agagguuggcuguguuucauuuaggaacuuugaauuuuuccacuauuaguuuugauuccuugaaauauccuugcccauuucu

SEQ ID NO: 4146437 - RNA, 78 nt, Human
agagguuggggcaggcagugacuguucagacguccaaucucuuugggacgccucuucagcgcugucuucccugccucu

SEQ ID NO: 4146438 - RNA, 122 nt, Human
agaguaacuacagggacccuuuguuuaaauagcauguuugcucuuuuuaaaggagguaauuaauggcaaaggacuuuggaacuggaggaacaugcuagaaaagcaacccuugagugccaucu

SEQ ID NO: 4146439 - RNA, 63 nt, Human
agaguaaugugacucuguuucugaaaacaguuuuuguuacuaggaaaagaguuucacccaucu

SEQ ID NO: 4146440 - RNA, 71 nt, Human
agagucaaguagggcaugggcuuuccauggcucccuucagcccuucuggcuccaggcuccuauuucacuuu

SEQ ID NO: 4146441 - RNA, 56 nt, Human
agagucagugucuguugaaggccugcugccugccugguucacagacagcugucuuu

SEQ ID NO: 4146442 - RNA, 125 nt, Human
agagucccagugcagaagcugaacuuaauaccuuugacauuuaaggcagucacuuaaucagauuacucucucugguuauagccuaugggaauucacagguguuaaauuagcuucagaaggacucu

SEQ ID NO: 4146443 - RNA, 86 nt, Human
agagucccuugaacccaggaggcugaggcugcagugagccaagauugccucacugcacuccagccugggcaagagcaugagacucu

SEQ ID NO: 4146444 - RNA, 86 nt, Human
agagucucgcugugucucccaggcuggaguguaguggcgcgaucucggcucacugcaagcucagccucccggguucaugacauucu

SEQ ID NO: 4146445 - RNA, 83 nt, Human
agagucucuugucacccaggcuggauugcagugguacaaucuuggcucacugcaaccuccgccuuuuagguucaauugacucu

SEQ ID NO: 4146446 - RNA, 73 nt, Human
agagucugauauuuguaccagagugagucacugcuuuuaaucccuuauuuuggauuugccaacauuagacucu

SEQ ID NO: 4146447 - RNA, 58 nt, Human
agagucugaugucaacaguucuggaagagauuccacagaauuggucuuaccagacuuu

SEQ ID NO: 4146448 - RNA, 57 nt, Human
agagucugcuccagauguguccuuuauuccagaauccaggcugaaggagcagauuuu

SEQ ID NO: 4146449 - RNA, 55 nt, Human
agagugaguaaaauggaguauguaaaagucauauauacuacauuucucugacuuu

SEQ ID NO: 4146450 - RNA, 70 nt, Human
agagugcaguuggggugaggggaucuaagaggcugguucuccuccgccucucuuccaccucugcaccucu

SEQ ID NO: 4146451 - RNA, 83 nt, Human
agagugcaugcaguggccgauauuagagguaaaggguuggaaacagcuccagguagugccuuaucguuucaauguguaacuuu

SEQ ID NO: 4146452 - RNA, 67 nt, Human
agagugccaaggcugagaaauucugcccuagcuacagcuaaggacagaauucuuuuaguucaucuuu

SEQ ID NO: 4146453 - RNA, 83 nt, Human
agagugggagaggauuucugggcucccacauauuucauuaggauugcuuuggaaaugagggcgcuuagauucccugcugcucu

SEQ ID NO: 4146454 - RNA, 62 nt, Human
agagugggcaugaauacauauuugcugaauagaucagcaaauuaaccaaucaugcucgguuu

SEQ ID NO: 4146455 - RNA, 110 nt, Human
agaguggucuaguggggaaggcaccagcuuaggagccuggagagcugaacucuagcuuggguucugucagaagcuagcuccugggaaauguacuucaccccugagcaccu

SEQ ID NO: 4146456 - RNA, 67 nt, Human
agagugguuggacucagagugucuuuuucaaauagugaggauagcuuagauacaguuuaauuacucu

SEQ ID NO: 4146457 - RNA, 55 nt, Human
agaguguaaaaacuuagugagaugauaguguuaguuaucauacauguuacacucu

SEQ ID NO: 4146458 - RNA, 68 nt, Human
agagugucacuuucaacauuuaucaguuuaucagaggugcuauuuuucugguuuuaaauggacacuuu

SEQ ID NO: 4146459 - RNA, 75 nt, Human
agaguguuccugcugcacgggcgcccccagaugcacaacguucagcagauugaagccugggggugcucacgcucu

SEQ ID NO: 4146460 - RNA, 55 nt, Human
agaguguuuuggagugggaaggcaggcuucacuugcauuucacccagggcacucu

SEQ ID NO: 4146461 - RNA, 57 nt, Human
agaguuagguccagaauguugcuuaguuucuauucugaaagcaucucugccaacucu

SEQ ID NO: 4146462 - RNA, 93 nt, Human
agaguuccaaaagcuuauugauaauauagugcauaacauuuaaagguccucaugucucugagggcuuuuauaugccuuagcucauggaauucu

SEQ ID NO: 4146463 - RNA, 55 nt, Human
agaguuccaagcccauggcauuccugagagugaggaagcagggacauggaacuuu

SEQ ID NO: 4146464 - RNA, 57 nt, Human
agaguucugcgguaugugagaaacugaaccacagaccucuacauucccagcaacucu

SEQ ID NO: 4146465 - RNA, 56 nt, Human
agaguucuuuacuguguaaugcuaaauaucuuguugcgguuacacaggagagcucu

SEQ ID NO: 4146466 - RNA, 72 nt, Human
agaguugcagauggcugccuucuugcuguguccucacauggcagagaaagcgagccacacuuucuguuaucu

SEQ ID NO: 4146467 - RNA, 97 nt, Human
agaguuucauguauggcugaauucaucaagaaaaucuccuucucuauuccuugaaaugauuuucuugaggguuugcuuuguucucacagaaggcucu

SEQ ID NO: 4146468 - RNA, 68 nt, Human
agaguuucuugugagcacugacaguuuucuaagccagcaagcaaccucaauacucacaaagagauuuu

SEQ ID NO: 4146469 - RNA, 129 nt, Human
agaguuugacuuacaacucagccauucucugcuacuuauauaagagcaaagucaugucaaaaaagaagccaaaaugaaacggaauguucuuuaucgcaagaaugacugaaguuucgccaauuaaacuuu

SEQ ID NO: 4146470 - RNA, 89 nt, Human
agaguuuuuaauuaugaagugauguugaauuuugccagaugcuuuuucugcaucuuuugagauaaucaugugauuucauccuuuauucu

SEQ ID NO: 4146471 - RNA, 128 nt, Human
agauaaaaggaaaagaaagugcaaguagauuugggaucuauagauuggggaaagacauucauacagucaggaccagauguucacuggaaguuuuuuccuucuggauccuucuuuggcuauaggaaucu

SEQ ID NO: 4146472 - RNA, 62 nt, Human
agauaaaaugauuuucuggaucuucgaguuaauauugauaaugcagcuauaucauuuuguuu

SEQ ID NO: 4146473 - RNA, 129 nt, Human
agauaaagaaauuaaggccaaaagacaugcaguuaaaagacagcagagccaguggcucuagaguuuccucucuuuacaguuacacucugcugcuuuagcaaaugcuuuucaccacaauuauuaagaucu

SEQ ID NO: 4146474 - RNA, 68 nt, Human
agauaagaguuuugauguuucuauuucuuauuacuuccuguuagaagagaaucauggaaacucuuucu

SEQ ID NO: 4146475 - RNA, 76 nt, Human
agauaagcuaccuuugccagaacaguaguaacuccuuucuuugcuugaugguccacuggcaugaggagcuuuguuu

SEQ ID NO: 4146476 - RNA, 83 nt, Human
agauaaggaagauuuguguuaagcugauuguguugauguuuugaaggaacuuuaaaccauaguuuaacauaagagucuuauuu

SEQ ID NO: 4146477 - RNA, 129 nt, Human
agauaauauagaaagccacaauuuaaggccauugacugauauagugaaggcugugugaaaguucucucacucagagacauuuuuuagucuugacauauuugcauuggcuuuaaaaaguucauauuauuu

SEQ ID NO: 4146478 - RNA, 61 nt, Human
agagcagccucagcucccuguggggugacucauguguccccaggcacuggcuggguucuuu

SEQ ID NO: 4146479 - RNA, 58 nt, Human
agagcagcucgcuaccucucuaacauaauguguaacaagguggagagccagcugcucu

SEQ ID NO: 4146480 - RNA, 68 nt, Human
agagcagcuggggcagagaccagggcagagagcugaugcccagagagggugcuccuccaugcugcucu

SEQ ID NO: 4146481 - RNA, 57 nt, Human
agagcaggguguuacaggacugaacucagcuuuauuucagcugagcauccgugcucu

SEQ ID NO: 4146482 - RNA, 70 nt, Human
agagcauaguguuaaauugauucaccuuucuccaugugagaauuguaagcaauuugauuagcuuuucucu

SEQ ID NO: 4146483 - RNA, 55 nt, Human
agcaguugagugggaaucaggcauugguuuugcuuagaagccuaccagaauugcu

SEQ ID NO: 4146484 - RNA, 63 nt, Human
agcaguuuagcuauacugcuuguugucuuggggcaaaggaaaguagauagcuaaaguuuuguu

SEQ ID NO: 4146485 - RNA, 60 nt, Human
agcaguuuuagggagacacauuaggagcuggagugaacacuuaucaucucuauaacugcu

SEQ ID NO: 4146486 - RNA, 112 nt, Human
agcauaaauaaaacgcuugacagaagguuuuauccuaaguuuucagucauuaaauaucugaaauaauaggaaauuaagucucuuuugucaaacaaggacaucacaauaugcu

SEQ ID NO: 4146487 - RNA, 55 nt, Human
agcauaaguugguacagccacuuuagagaacuucuuaguggucucuacuuacgcu

SEQ ID NO: 4146488 - RNA, 73 nt, Human
agcauacacuuuagggcaaaguuucaacaguuccaugccgagcuuagagacuuucgccucugacauguuagcu

SEQ ID NO: 4146489 - RNA, 68 nt, Human
agcauacuugacacuucucuauuugcaaugauugccaugauaggccguggagagagaaguguguagcu

SEQ ID NO: 4146490 - RNA, 56 nt, Human
agcauagagaaguggccgcuugcugugcuucagcagcucaacagugucucuauucu

SEQ ID NO: 4146491 - RNA, 127 nt, Human
agcauauacucuuaacuaaaauugauuuucuccuguaguaaacauuuucauauuuucugguagcucaggauguuuugaauauauuugcuauguuuagggaauuuccaaucuuaauauaaguguugcu

SEQ ID NO: 4146492 - RNA, 56 nt, Human
agcauauggaggcagcuauucaguuaugcugagcuaugcugcaauaucauuuugcu

SEQ ID NO: 4146493 - RNA, 62 nt, Human
agcauccaggagcauuaagagaacauagggcucagccuuguggugcuggugguuuuugugcu

SEQ ID NO: 4146494 - RNA, 56 nt, Human
agcauccugccucuccucccaaugguucugugauguugggaaaaugaaaaggagcu

SEQ ID NO: 4146495 - RNA, 74 nt, Human
agcauccuucucugagauagacuaaguggcagaauaagaaaucuguuaaggucuauuaguggagaaggaggacu

SEQ ID NO: 4146496 - RNA, 59 nt, Human
agcaucuggucaugagugagaagaacaugacagcauugucucugguguggccagaagcu

SEQ ID NO: 4146497 - RNA, 61 nt, Human
agcaucuguaggaaguggaaagucucagaugauucaggaggcuaagguucugccagaagcu

SEQ ID NO: 4146498 - RNA, 92 nt, Human
agcaucuguuucagagaagaacagauccaugcauauggaugugggauuacuuucuuugcagcuggauuuaucuuuucccagugauagguguu

SEQ ID NO: 4146499 - RNA, 84 nt, Human
agcaucuuaugcauaaaaggaggucacuuuauuccugcucaacucuggggggagaucugagaucuuauuuuuuguaaaugugcu

SEQ ID NO: 4146500 - RNA, 120 nt, Human
agcaugaaauuuuguuuugagucaagguguuucauuagcugugaaacagcagaagagguuuuacuauuucuauuuuggacucauagaaggaaaugcaaaugaaucaaaaucuauuaugcu

SEQ ID NO: 4146501 - RNA, 58 nt, Human
agcaugcuuggcauuugucagagacgacuagaucugauuuaaauacaugagcacugcu

SEQ ID NO: 4146502 - RNA, 84 nt, Human
agcauggcacauuuuuaaaucugcucuuaaaugucacucuauuaucaagagcagcauuucauguagauugagaacaguugugcu

SEQ ID NO: 4146503 - RNA, 72 nt, Human
agcauggcuuacuuucagggaguauggcuucuauaucaauuauccaucucagaguuuagagcugagccaucu

SEQ ID NO: 4146504 - RNA, 93 nt, Human
agcauguccacaaggcuggaggcagcacgagggcaggaaccaagucugcuugaugauugcugucuccccagggccucccauguggaccaugcu

SEQ ID NO: 4146505 - RNA, 68 nt, Human
agcaugugaagauagcuguuacaucuugcauaucgucucagugagauucaggcaugucuucauuuguu

SEQ ID NO: 4146506 - RNA, 73 nt, Human
agcauuaauaucaacagguauggaugagauugcauugaaagcugugcauugcauuugucauuguugaggugcu

SEQ ID NO: 4146507 - RNA, 68 nt, Human
agcauuagaacauuccaucacuggguauuagacuuaugguuuacuugacuugaugaauguucuuuguu

SEQ ID NO: 4146508 - RNA, 91 nt, Human
agcauuauagaggcuuauuuacccagauucacaagccaagguugacuauauuaauuguggcugucuuuggcuaacuaggucuuguaaugcu

SEQ ID NO: 4146509 - RNA, 117 nt, Human
agcauuauuggaccacagcuguauucauucauuacauauugucuaugacugcuucuguguuacaagggcagaauuggauaguugugauaaagauuauacagcccauaaaaucuugcu

SEQ ID NO: 4146510 - RNA, 79 nt, Human
agcauucauucuaguugagggagacaaauaauauguaaguaaauaauguauguuuuauaucaggugauuaaggaauguu

SEQ ID NO: 4146511 - RNA, 84 nt, Human
agcauuccugcaguucauguaucauguauccaaacaaaaggcucgaacugcaggaauacaugauacaugaacugcaggaauguu

SEQ ID NO: 4146512 - RNA, 110 nt, Human
agcauugaaacagguggacucaagccauuccucugucucuuuucuggcacuguaguuauagauguaagcagaagaacagcuuguuugaaguaauggcauguuugaauguu

SEQ ID NO: 4146513 - RNA, 105 nt, Human
agcauugcugucuuuuuugucaucauuccguuuugcauuguuaucauucucuuuugcauuguuaauaucagaauguaaugguccuuaggaaagcacaguguggcu

SEQ ID NO: 4146514 - RNA, 56 nt, Human
agcauuucuuuuaaucacagugguguuacuagcaguacugugugaucuggaaagcu

SEQ ID NO: 4146515 - RNA, 64 nt, Human
agcauuugccaacagaagguguacuacugaaugcuaauaucggugagagccugucugugaugcu

SEQ ID NO: 4146516 - RNA, 85 nt, Human
agccaaagagaugucuguacgaguuacaauggggucgaccaggaggcagucaaaguaaaaguauagaguuuguauuuuuuuagcu

SEQ ID NO: 4146517 - RNA, 61 nt, Human
agccaaagcagcaacgugcauauaaccugcacuugucugguuagcacuuugcuuuuugucu

SEQ ID NO: 4146518 - RNA, 58 nt, Human
agccaacaacucugagcccaguuucuaucuaaaaacuggagcuaauacuuguuuugcu

SEQ ID NO: 4146519 - RNA, 82 nt, Human
agccaacaccagaggugggagugaucugguaggugguaacugcugugucccaagcuaauggcucacuguuucuuguguggcu

SEQ ID NO: 4146520 - RNA, 69 nt, Human
agccaacagaagaauuucucucaugauuugaaucugauuucagaaagggaccaguucuuuugaagggcu

SEQ ID NO: 4146521 - RNA, 60 nt, Human
agccaacccgcugcugcagagagcccucuacgaauagcccgcucugugcuggcggaggcu

SEQ ID NO: 4146522 - RNA, 82 nt, Human
agccaagagagugauuaugucuggcugguuaaugagcuaauccuuauuaggaaaaggucagaugugcacacugacucuggcu

SEQ ID NO: 4146523 - RNA, 74 nt, Human
agccaaggugaaccagcaguugccugaaaaagaccuuuccuugccuucuuaguuagucccugguaccuuuggcu

SEQ ID NO: 4146524 - RNA, 77 nt, Human
agccaaguaccacacuagacauuagguagguucaugggccuguggucuguuaucaaugucuuguguuaauccaggcu

SEQ ID NO: 4146525 - RNA, 83 nt, Human
agccaaguuuuaaacuuagaaggaacaguuuagugcaguagucuuguauugaaaaacuuucugagaaauuaaaaaauuaggcu

SEQ ID NO: 4146526 - RNA, 70 nt, Human
agccaauuagauguugaagucauauuugggcucauggcccauggcauaguguucaaccucucauuuugcu

SEQ ID NO: 4146527 - RNA, 57 nt, Human
agccacagaugggcaaucuuucugucaugccacugaauaaagauguccuuuugggcu

SEQ ID NO: 4146528 - RNA, 64 nt, Human
agccacaggcugucugaauggaggcccccagcacgggggcccccuguugagucagccuugggcu

SEQ ID NO: 4146529 - RNA, 67 nt, Human
agccacagugggcuaccagcucaauaaucuuccaauugucccaagcuccaaauggcccauugaggcu

SEQ ID NO: 4146530 - RNA, 79 nt, Human
agccacccuugugcagguucaugaugggugggucugcucagccagugggcugcucacaugagaucuguacauccgggcu

SEQ ID NO: 4146531 - RNA, 56 nt, Human
agccaccucuaucuugggcuccauguuccccaccuuagcuccugguauaggugccu

SEQ ID NO: 4146532 - RNA, 80 nt, Human
agccacuacuuaaaaccaagccacuuuugugguuuucagauuuuugaaaaacacaaguggcuuggucuuaauuagcagcu

SEQ ID NO: 4146533 - RNA, 59 nt, Human
agccacucauucauucguucaacaguguuuauugagcagcugagcuggaaugagaggcu

SEQ ID NO: 4146534 - RNA, 67 nt, Human
agccacuugggguggggagaggcaaguaggcaggugucugucccucucacaccucaccagaguggcu

SEQ ID NO: 4146535 - RNA, 81 nt, Human
agccagaauuacugcaguaaccacuguaggugugugugguguggcuuuagacacuuauuugugguaguguuuauuuugguu

SEQ ID NO: 4146536 - RNA, 72 nt, Human
agccagaguagcugcccugcaccuuggccaggaccaggguccaugugagaggagacagggaagugccuggcu

SEQ ID NO: 4146537 - RNA, 92 nt, Human
agccagcaggccaggggagagcaaggugauuuccuggcugggucacgcugaggaacaauacaggcuuuauuccucccggccuuguccugguu

SEQ ID NO: 4146538 - RNA, 56 nt, Human
agccaggaaaagagccuucacuagaaacuaacuaugcaggaccuugauccuggacu

SEQ ID NO: 4146539 - RNA, 62 nt, Human
agccaggccuuuucucaagguugugucuguaguaaguaaccuugagggaugagguaguggcu

SEQ ID NO: 4146540 - RNA, 84 nt, Human
agccaggcgcggcuggaccacgacguggcggccgccgugagcggugucuaccgccgugcaggccgcgacguggccgcccuggcu

SEQ ID NO: 4146541 - RNA, 61 nt, Human
agccaggucagcucacccugcuucaacaggauuccagccugugugugcuguggaccuggcu

SEQ ID NO: 4146542 - RNA, 96 nt, Human
agccagguucccacuugaguccaggaguuggggcagcagugaacccugaucaugucacugcacuccauccugggcaacagaguaaagauccugucu

SEQ ID NO: 4146543 - RNA, 56 nt, Human
agccaguaucacucuguguucuugauuuuuucuuaucgacauuccugacacuggcu

SEQ ID NO: 4146544 - RNA, 57 nt, Human
agccaguccaucacuaaugggucauuuaccuugauugacucaguguuaggacuugcu

SEQ ID NO: 4146545 - RNA, 66 nt, Human
agccagucucagaugugcgucagccacaggcuccaggggccacgugccuggccacaccugcugguu

SEQ ID NO: 4146546 - RNA, 61 nt, Human
agccagucugcauggcaggagagaggagaugcuucuccauuucuaccaaaugugacuggcu

SEQ ID NO: 4146547 - RNA, 130 nt, Human
agccaguuuugguugucauaacuggagugggacaugcuguguuacuuggcaucuaauggguauagauuagggaugcugggagacagcaggcaguucacacaucacccccacaacaaagcaguaucuggcu

SEQ ID NO: 4146548 - RNA, 62 nt, Human
agccauagaaacugagacaaggauuuaccaagcguaaaucuggacagucucguuucuaagcu

SEQ ID NO: 4146549 - RNA, 55 nt, Human
agccauccuacuaccucagcaugaaacauguugugagaggguaaaguaguaugcu

SEQ ID NO: 4146550 - RNA, 63 nt, Human
agccaucggccuauggcuggccuuaggaaucagucucuagccagacucaagggccaccaggcu

SEQ ID NO: 4146551 - RNA, 130 nt, Human
agccaugucuaagucagagucuccuaaaaagccugaacagcugcagaagcuuuucaucacaugguugaucuuugaaauaacugaugaggguuucuacagccauuuugagcagugagaacucuuauggacu

SEQ ID NO: 4146552 - RNA, 73 nt, Human
agaaggaaagaaaggugaggucuggucuucaauugaaaauugaagaguugauuauuaucuucgaacacauucu

SEQ ID NO: 4146553 - RNA, 72 nt, Human
agagccauccuugcccuaaaugucugugugaugagcuguaagacccuacacggcacuuuaggaaggggcacu

SEQ ID NO: 4146554 - RNA, 59 nt, Human
agagcccaggcaggcauccaggccuccucucucuaucccugggcuccuccugcugcucu

SEQ ID NO: 4146555 - RNA, 62 nt, Human
agagccccugggucacacagcccgucuccaguagggcuggggaaaagaacccagggcgcucu

SEQ ID NO: 4146556 - RNA, 55 nt, Human
agagcccguguccugcagaaagacagcuguuucucuguccacaagcacaggcucu

SEQ ID NO: 4146557 - RNA, 68 nt, Human
agagccgcccacgcugccgucuuucuugcgguucuuccgugggaaaauuggcgcguggggcuggcccu

SEQ ID NO: 4146558 - RNA, 73 nt, Human
agagccgguuugggccucggccaaggacgggguguccuggcccagccugggugugaggcccauccgcggcucu

SEQ ID NO: 4146559 - RNA, 69 nt, Human
agagccugcagcugugaagaaaagcucucagaauucucaaagacaagagcacauagucugagagguuuu

SEQ ID NO: 4146560 - RNA, 102 nt, Human
agagccuugugcacaagcaucucaguggguuguauauuuauuucucuaauauuuuuucauuagcagagguaaguguggcaauagggggguuuggcugguucu

SEQ ID NO: 4146561 - RNA, 63 nt, Human
agagcgggaguguugagcgcccugccagguuugugcacucuggcccagccccacuccuguucu

SEQ ID NO: 4146562 - RNA, 80 nt, Human
agagcuagagggauguaaggaauauagcaucuguugaaugaguaauaaagccuuauugauuuuaccuuccaucuagcucu

SEQ ID NO: 4146563 - RNA, 75 nt, Human
agagcuaggcauaagcccagguaaguggcucaugcuuauuuuagugaucagggccauaucuugugcaccagcucu

SEQ ID NO: 4146564 - RNA, 110 nt, Human
agagcucacugaaauugccaaugaugucaaaugcugcaaacucaucaaggaaaaugaagacugagaaugaguucauugcauuugacaguuggagaucuuuggugacaucu

SEQ ID NO: 4146565 - RNA, 79 nt, Human
agagcucaguguguuaugguuaauggaaauguugucauugucagauugccucuuaacuguaauauaaauaugagucucu

SEQ ID NO: 4146566 - RNA, 56 nt, Human
agagcucccuaaagcgagguggucauacuauagaugccaggacugcuggggacucu

SEQ ID NO: 4146567 - RNA, 82 nt, Human
agagcugaaaaguuacccagagucauguuuauucccuuuucuacuaagcagggaacuugaacucugggugcacaugaguucu

SEQ ID NO: 4146568 - RNA, 64 nt, Human
agagcugcaggguggacccaggcacuguucccauuggcauccugggucuccuccugcuggcucu

SEQ ID NO: 4146569 - RNA, 57 nt, Human
agagcuggcugcugcggugcuuucaagucaucuauuguuucauuguaggugggcucu

SEQ ID NO: 4146570 - RNA, 61 nt, Human
agagcugguucaaguccuggcucugucacuugcuguaacagaccagauacugaacuuuucu

SEQ ID NO: 4146571 - RNA, 64 nt, Human
agagcugucugcuuggcuuauaaccucaggcugacauaagccugaugaagaagagcccaguucu

SEQ ID NO: 4146572 - RNA, 63 nt, Human
agagcuguuaauuuugcacuggcuugccuuaugcacguaugacauuccaaaguugauggcucu

SEQ ID NO: 4146573 - RNA, 55 nt, Human
agagcuguuuauugaugucacagagaagaugggacgagccuuauagacagacucu

SEQ ID NO: 4146574 - RNA, 58 nt, Human
agagcuguuuuuccaaacuauugagcauggugacuuagugauuggaaaaacuaguuuu

SEQ ID NO: 4146575 - RNA, 61 nt, Human
agagcuuauaucuuggccauccuggacaugcacuaugauuggacaccuaagauaugagccu

SEQ ID NO: 4146576 - RNA, 106 nt, Human
agagcuuguggccaagaagauggaguugcaggugguuuggccauagagcugaugcuugcuaaauguguuauaucugugauggucauuuuagguuaauaaaagcucu

SEQ ID NO: 4146577 - RNA, 77 nt, Human
agaggaaagaggagagaagagaaauauucacauucuggguuuaaugagaaugaaucuuuugcuuucccagcaacucu

SEQ ID NO: 4146578 - RNA, 80 nt, Human
agaggaauagaccuuuggugccagccauuaacuuggaaacagaaaaggaaggucauugguaccagcuguguguucacuuu

SEQ ID NO: 4146579 - RNA, 72 nt, Human
agaggaaugaguauguuuaugaaaaagcauuagaaaaacagaugccuuuaucaguuucauggcuuugcuucu

SEQ ID NO: 4146580 - RNA, 75 nt, Human
agaggaccacuuggaaagguuuuacaaagcgcuggcugcccagcugcccgggccauuuaccaggcuuguccaucu

SEQ ID NO: 4146581 - RNA, 65 nt, Human
agaggagcugagccacguccuggcggccaugaagaaagcagcugccaggaaggacugagcucccu

SEQ ID NO: 4146582 - RNA, 64 nt, Human
agaggauagcaaaucuguuucagguauauuuggaauuuguuagaucuuguuacagauuuccuuu

SEQ ID NO: 4146583 - RNA, 72 nt, Human
agaggauaucuagacuggauuuucacugcuuuugcaaguaagcuuugcagugagaauucaguagguacuuuu

SEQ ID NO: 4146584 - RNA, 91 nt, Human
agaggaugagaacacagauucugguaucagucauaccuggguagaaaucucagcucugucacuuacuagcugugugaauuauucaaccucu

SEQ ID NO: 4146585 - RNA, 55 nt, Human
agaggaugccuccaaaugagggcagagcagcagcuuuccaacucagaggcccucu

SEQ ID NO: 4146586 - RNA, 68 nt, Human
agaggcaacaacaaucuacccuagcuucuuuuuacaaagaaaagacugggauagauuuuuuugucucu

SEQ ID NO: 4146587 - RNA, 106 nt, Human
agaggcaaccugguuagcucccacauuuggacucaaggaucucagaagagugaagcaccugaagguuucugggaguuucugugggagcugcagaaucuuugcuucu

SEQ ID NO: 4146588 - RNA, 70 nt, Human
agaggcaagggaccuuucugggaucucuuuuacaagcacacuaauuccauucaagaggacucuggccucu

SEQ ID NO: 4146589 - RNA, 59 nt, Human
agaggcacuaagggaagagcagaggaaucuacaccuguguuugguuccagagggccucu

SEQ ID NO: 4146590 - RNA, 61 nt, Human
agaggcacuguggcuuaccaaagcuaaagauguuuuagucagaaagaagccauaugccuuu

SEQ ID NO: 4146591 - RNA, 88 nt, Human
agaggcagacauauguuguaaacauuccaaucgugaggaaucucagaguuuucuuggaauguuaagacaaagcauucucucuuccucu

SEQ ID NO: 4146592 - RNA, 57 nt, Human
agaggcagauuggugcccucuguauagggaugguggagaggucauugggcugguucu

SEQ ID NO: 4146593 - RNA, 79 nt, Human
agaggcaggcugaaguuuaacuugaauucuuucucugcuuuucugagcacagaaaagauaaguuaauucuccuugaacu

SEQ ID NO: 4146594 - RNA, 66 nt, Human
agaggcagguuaucugggauuaaacagcucaggcccccauggcccaggcuggaauuccaggccucu

SEQ ID NO: 4146595 - RNA, 71 nt, Human
agaggcauucuucagcaggggacacuaucugccucauuccagauaguagcacuucugcuaagucuuccucu

SEQ ID NO: 4146596 - RNA, 72 nt, Human
agaggccagguggucaggggcugaggugccccacaaggucguggggguagguaguucugaccagcgccaucu

SEQ ID NO: 4146597 - RNA, 58 nt, Human
agaggccaguggcugugcugucauauccuaagaggcagccacgcagucuugggucucu

SEQ ID NO: 4146598 - RNA, 77 nt, Human
agaggcccagauuagaagcugaauguucauuuuccucuugugucuauuccuuuuguguuugguuugacugggucucu

SEQ ID NO: 4146599 - RNA, 101 nt, Human
agaggccccaagcuaaaggcaucaaucacauuugcccccauauuccaacuuuaguaguugagugugacagugugauucagccgcuuuuguucaaugucucu

SEQ ID NO: 4146600 - RNA, 55 nt, Human
agaggccgggugccugcucagaccuuuccggcaccgcgaggaggcccuggcguuu

SEQ ID NO: 4146601 - RNA, 67 nt, Human
agaggcugccugcauucuuuggcucauggcccccuccuccaucuuugaagccagcagcguagcaucu

SEQ ID NO: 4146602 - RNA, 80 nt, Human
agagggaagcguccuucugcuggucaucccaguggucacagaguacaccaugcuccagcaggacacaccucacgcccucu

SEQ ID NO: 4146603 - RNA, 72 nt, Human
agagggacuccaccugcugcuucuggaucugaagaagaggggacuaugagccaaggagugcagguggcuucu

SEQ ID NO: 4146604 - RNA, 55 nt, Human
agagggaggaaggccagcacucaaaaaacaagagaagcaaugcuuuuuuuccucu

SEQ ID NO: 4146605 - RNA, 66 nt, Human
agagggaggugauacugaacguaacacacuucgaguuuuguguuacauuuggggguaccaccuuuu

SEQ ID NO: 4146606 - RNA, 71 nt, Human
agagggcccaccucccuauccauggaagcugcuacgcccuggauccuggaucagcgggggcaggcaccucu

SEQ ID NO: 4146607 - RNA, 62 nt, Human
agagggcucauucaucugggcuuggcuuugccuuggcugagccagagggagucgggucaccu

SEQ ID NO: 4146608 - RNA, 88 nt, Human
agagggcuguuucuaaauucaguuuauuuugauacuuuaauggcagucaaagccuggaucaaaauggaagaauuuggcugcacuuucu

SEQ ID NO: 4146609 - RNA, 82 nt, Human
agaggggcaaacuggggaggggaggggagacuuguaaacaugagugcaauuuuccucugguuuccccagaaguugcccguuu

SEQ ID NO: 4146610 - RNA, 56 nt, Human
agaggggcucauauccugucauuguacuuaaugcuaauaaggauguuggccccucu

SEQ ID NO: 4146611 - RNA, 72 nt, Human
agagggggaccgagggcuguggcaucacagucgugggcaucuacuggcuggccacacccugguacacccucu

SEQ ID NO: 4146612 - RNA, 92 nt, Human
agagggugacaccgcuccagcugcgggcuguggggaggagauuugcacccugacacccacugccagccgcccggaggcaguucucacccccu

SEQ ID NO: 4146613 - RNA, 71 nt, Human
agacaggcuguuugcauagcauguuugcaucaguaaaauauugaaaaugacauuugugcccaaguccaucu

SEQ ID NO: 4146614 - RNA, 57 nt, Human
agacaggggaaaggugaauuugcucucugagcugaggcacccaucuucuccugcccu

SEQ ID NO: 4146615 - RNA, 65 nt, Human
agacagggucuugaucagagcucacugcaauaucaaacuccuggguucaagugauccuccugucu

SEQ ID NO: 4146616 - RNA, 65 nt, Human
agacagugaagugauaguuugccuaguuugagccuuggucuucuaggccuucuguuuuccuguuu

SEQ ID NO: 4146617 - RNA, 67 nt, Human
agacaguguucacuaagguuagcuuuacuuuugccuaguaaauaauggguuccuagugaaccuguuu

SEQ ID NO: 4146618 - RNA, 93 nt, Human
agacauagauguagauuagcuagaagguugaaagcagggggagaguuagacccccuauucaggccaucgagcuguauauacuuugcuguguuu

SEQ ID NO: 4146619 - RNA, 126 nt, Human
agacaucacuuucugaaucugauuugauucauaauucaacugaucuauuuugauuuugcauuuuagaaaaacagcagaguguagaaggagaaauggaucuuaaaucaaaggguuucagaugaaucu

SEQ ID NO: 4146620 - RNA, 63 nt, Human
agacauggccacaugauaaucaaguagaaugcuuguuaaagugcagauuacaugggcucugcu

SEQ ID NO: 4146621 - RNA, 72 nt, Human
agacaugguguugguguuugugagucgagccugaaaacacuucuccaguuccaaauaccugucaccuugucu

SEQ ID NO: 4146622 - RNA, 72 nt, Human
agacauuaugcuaagugaaagaaaccagacacaaaaggcuauguuuguaugaucccauuuagugaaaugucu

SEQ ID NO: 4146623 - RNA, 61 nt, Human
agacauuuccuagacaucaauggcuaguccaauuguguaagaugauguuugggaaaucucu

SEQ ID NO: 4146624 - RNA, 64 nt, Human
agacauuuccugugaaccuacuacauacaugaaggucaucagaguaggugauaggaaaguuucu

SEQ ID NO: 4146625 - RNA, 69 nt, Human
agacauuucugggccacaagccugugugaugcuuuucagaucaaaacccaggucgugccugcuauguuu

SEQ ID NO: 4146626 - RNA, 96 nt, Human
agaccagaggcuccaauagggccagcuucaugaguguacaaccuguguagacacacagcacacuauucuuagaaggggcccauguuugcuugguuu

SEQ ID NO: 4146627 - RNA, 73 nt, Human
agacccuccucagggauuaaggucaaaggugggaggaagaaggcuuccauuggccuuuuauccuagagguucu

SEQ ID NO: 4146628 - RNA, 61 nt, Human
agacccuuguuccuuguaccuggaugaacuugguuuccggggacaguucccacuggggucu

SEQ ID NO: 4146629 - RNA, 64 nt, Human
agaccgcagagcacuggggagggaugcgccgaucaggugggccaagcccaggcuuugugggucu

SEQ ID NO: 4146630 - RNA, 63 nt, Human
aggacacagcaggagguugggggaaaggaaugaggccacucccugggccuccugcuaugcacu

SEQ ID NO: 4146631 - RNA, 65 nt, Human
aggacacagccugugaacugggggagcccugcuacucaccagccacucucccagcacagcuuccu

SEQ ID NO: 4146632 - RNA, 81 nt, Human
aggacacgucagagcucaugagcagagccaacucaggccuggguuccaauucuggcucugucacugugagcuaugugaccu

SEQ ID NO: 4146633 - RNA, 55 nt, Human
aggacacuuggcuauuguuccaauuuaggacagugguuuuccuccaaguaauccu

SEQ ID NO: 4146634 - RNA, 71 nt, Human
aggacagaccuaggacuggagcucagguuccucugccuccaaagccccgcuccuaaccacugggcuguccu

SEQ ID NO: 4146635 - RNA, 63 nt, Human
aggacagaguggggucucaguaggaaguggccaucagaaggcucuaugcaagacccuaguccu

SEQ ID NO: 4146636 - RNA, 69 nt, Human
aggacagcccaauuucucaguuuaauuccaacucacggggaggauuugaauuguugaaaugauagucuu

SEQ ID NO: 4146637 - RNA, 75 nt, Human
aggacaugagauuugggaggggccauguguggaaugauaugguuaggccuuguguccccacccaaaucucauccu

SEQ ID NO: 4146638 - RNA, 99 nt, Human
aggacauggauuauggccuggauuuaauuaacuguugcucauggcaccaugcaggcugacauuuaauuauauucaguuuagcccuuuauuauauauccu

SEQ ID NO: 4146639 - RNA, 69 nt, Human
aggaccccagagauaccaguuuuaaugacuagguagagauagaaaauaagauuguguguccugugugcu

SEQ ID NO: 4146640 - RNA, 88 nt, Human
aggacuaaaaugaucaggguggggcuggcuaucaaaauuuaaaacuuacauguauuuugguccagcagucccacuuccaggaucuccu

SEQ ID NO: 4146641 - RNA, 95 nt, Human
aggacuaaugggaagagcggguggggagggaagaguuuugcuuuuugugcucugcugccuuuggcuucuccuaccaccucuuaacagcaggaacu

SEQ ID NO: 4146642 - RNA, 92 nt, Human
aggacucaauagguguuauucaacuugugucucuuaauuucuacaacuaaaaguaauggacuaguugaagacacacuaguucuuugggucuu

SEQ ID NO: 4146643 - RNA, 76 nt, Human
aggacucacaggugaaaaaugaccucuuugcaauccuuauugauccaccagcugaggucuuuuuuauguggaaccu

SEQ ID NO: 4146644 - RNA, 59 nt, Human
aggacucaccugaccuuuugcagcuugaauuuccucacuuguaaaacaaggugaauccu

SEQ ID NO: 4146645 - RNA, 65 nt, Human
aggacuccggaaguacucucuccuggauuucauuaaaucuaaugaguuagauaauuuuggagccu

SEQ ID NO: 4146646 - RNA, 70 nt, Human
aggacucgugaccucugugguaccaaggcaccaucugaagagcuggagucagacccaggcucaugguccu

SEQ ID NO: 4146647 - RNA, 74 nt, Human
aggacucuacaagaaaggaaagaaucagaugugugcauaaaauaaucuguuuguuuacaccuuuuugggguccu

SEQ ID NO: 4146648 - RNA, 95 nt, Human
aggacucugugacuucaggagcccugguggguggacagaagcucccugcucccccagccugucuacccagcagcgcuuuggccagucccauuccu

SEQ ID NO: 4146649 - RNA, 65 nt, Human
aggacucuuuacggaucauccccaaagcuacagauuuugagacggggaagacugucaggauuccu

SEQ ID NO: 4146650 - RNA, 70 nt, Human
aggacugacaagggcuguggguuuaagaaguuuacauagguaguggccuuccuggcacccuuguuagccu

SEQ ID NO: 4146651 - RNA, 55 nt, Human
aggacugauauggcccagccucuggcuuuaccugcucuggccccuuaucaguccu

SEQ ID NO: 4146652 - RNA, 103 nt, Human
aggacuuacucagugccuggcacagaguugacccccacuguggacuugcacagcaaccacagaaccucagcuuugagcucagagagcccugauguugaguucu

SEQ ID NO: 4146653 - RNA, 84 nt, Human
aggacuugagauugauuucaaggauguuagagguggugugcugggagaagucuuccuuugcauucuuaaacccuuucaagucuu

SEQ ID NO: 4146654 - RNA, 66 nt, Human
aggacuuuucuccaagccaguccuuccccuguccccccuuguaagggcugucuggauuagaagccu

SEQ ID NO: 4146655 - RNA, 62 nt, Human
aggagaaagacuggacagccaaccucaggaguucacuggguuugaaugaagucuuucugccu

SEQ ID NO: 4146656 - RNA, 60 nt, Human
aggagaagccacacauugggugucuggucaacaucaaauacccauccuugguucacuccu

SEQ ID NO: 4146657 - RNA, 66 nt, Human
aggagaauguggcuacauauggaagaagcuguguuuugaccagauagaugauggucccauucaccu

SEQ ID NO: 4146658 - RNA, 63 nt, Human
aggagacacugagacuucaccauuggccauuaucuggccuugcugguccgcucagaguuuccu

SEQ ID NO: 4146659 - RNA, 57 nt, Human
aggagacucagagaccuggccgaauccugccugcaggacaggccaacugagucaccu

SEQ ID NO: 4146660 - RNA, 121 nt, Human
aggagacugagaggaggaaguugaguagcuucucugaggucacaugaggagugagagagagccccagucauaaugaccccagaguccgcauucuuuacugccgccuugcuuucaguguccu

SEQ ID NO: 4146661 - RNA, 57 nt, Human
aggagacuggacaagaauaugguucugagaagggugcuaguucuuguccugucuguu

SEQ ID NO: 4146662 - RNA, 66 nt, Human
aggagacuugauucauuuugugucuggaacagucagugcaauguuacaaacugaaaugaguuuccu

SEQ ID NO: 4146663 - RNA, 55 nt, Human
aggagagugggggaaacagaugagugguuuagucacauguuugcuacauuuuucu

SEQ ID NO: 4146664 - RNA, 96 nt, Human
aggagaugggauuucaguggguaggaaaggcucuucccuaggaaaaaaaggaaggggagagccaaaucuuccugcucuaggaagccucaaacuccu

SEQ ID NO: 4146665 - RNA, 104 nt, Human
aggagcaaauugauaaagaugccugggucaguggcaagcugggugguuccuaauuuauaaaaacaccucgaguuccauuacucagccccuucuuuucugcuccu

SEQ ID NO: 4146666 - RNA, 62 nt, Human
aggagcaacccaggguuccuuugaauucuuugacaaaggucuuauggccuugggcugcucuu

SEQ ID NO: 4146667 - RNA, 62 nt, Human
aggagcaccaugacucaguccucagaagaagugaucugugaggugguuacuguggugcucuu

SEQ ID NO: 4146668 - RNA, 88 nt, Human
aggagcagaagauguuaagaaggaauugaaguuuaggccauacggggaggugcucaucuguuuuaacuguauuugucuucuggccccu

SEQ ID NO: 4146669 - RNA, 57 nt, Human
aggagcaguuguugagcaagccaccaccaccgaggugaaugagcucugacugcuucu

SEQ ID NO: 4146670 - RNA, 76 nt, Human
aggagccaaucaaaagcuuaccuuuucagucuuuguuauuguucaaggaugauugguaaugacacuaucuucuccu

SEQ ID NO: 4146671 - RNA, 73 nt, Human
aggagccccguccuggggaaucuugcaggggaaggcauggaaccuggccugcagcucucagggaaggguuccu

SEQ ID NO: 4146672 - RNA, 58 nt, Human
aggagccguacuuccugugacuuuaagcaacugagagcaccaggaacagugugguccu

SEQ ID NO: 4146673 - RNA, 59 nt, Human
aggagccuccuucucaugugcagcuacaaauagcaugucuagcagauugggggcugccu

SEQ ID NO: 4146674 - RNA, 88 nt, Human
aggagcucagaggugaggagcauucaggacaagccucccagagaggccuggcugucguuuugugaaauuuccucuauuucuuccuccu

SEQ ID NO: 4146675 - RNA, 60 nt, Human
aggagcucuucaguauuggaaaagggaacaacaccuuuccucuucauccuggaagcugcu

SEQ ID NO: 4146676 - RNA, 61 nt, Human
aggagcugaagaauagcaggugggcacacugauggguucuccuguuguuuuucuuucuccu

SEQ ID NO: 4146677 - RNA, 60 nt, Human
aggagcugauagucuauggagaaugagaguaaacaccuuccaaaggcugugauuaguccu

SEQ ID NO: 4146678 - RNA, 94 nt, Human
aggagcuucccaguccuuugagccaguucugaguauuccccaagccccaccuaccccgcccagggaucccagaaugggaaggacugcaguucuu

SEQ ID NO: 4146679 - RNA, 109 nt, Human
aggaggaagggaaaagaggcggggggaaguauuuguuuuugcauccaucaaagaaagcaauguuuuuggaugcugcauugaaugcuugcucccuuacuuccagccaccu

SEQ ID NO: 4146680 - RNA, 55 nt, Human
aggaggagcagcuuuuugucuccauagaggauggaauaaaaaguaucuuauuccu

SEQ ID NO: 4146681 - RNA, 68 nt, Human
aggaggcacugggugagggucacuggcuccaggugggugggguguccaggccucugccucgugccccu

SEQ ID NO: 4146682 - RNA, 87 nt, Human
aggaggcacugugggagcauuuuugucugcauuuuagcaaauaugcuugauugccagaggugcucacguugugguuuuucccuuccu

SEQ ID NO: 4146683 - RNA, 61 nt, Human
aggaggccaagggcaaagcggagagugccggagagcccucauuccuguucccucgccaccu

SEQ ID NO: 4146684 - RNA, 56 nt, Human
aggaggccuuugcacccggauuccgugguuggauucagggaggaaaggggccuccu

SEQ ID NO: 4146685 - RNA, 69 nt, Human
aggaggcugguucaggccauauuccaaauccucaucugugugugaguggcauucuuagccuagccuccu

SEQ ID NO: 4146686 - RNA, 74 nt, Human
aggagggcaggcuggcugccuaaaaauaggaggagacuggguuuuuggggagggcagcuuaagcuuguuuuucu

SEQ ID NO: 4146687 - RNA, 73 nt, Human
aggagggcuaggaaaaccaggaugggaaucagaaagaagcguccuccuggccaaggacguuuccugccuucuu

SEQ ID NO: 4146688 - RNA, 68 nt, Human
aggaggggaaggaugugacguggcugacauguuguacguguacucaguacuugcauccucuccuuccu

SEQ ID NO: 4146689 - RNA, 63 nt, Human
aggaggggcagccugagagcgacaacguggaguucccaugucucagguacaugcguccugccu

SEQ ID NO: 4146690 - RNA, 63 nt, Human
aggagggugcaguaggggagaauugaauacagaaugugggaggucacuuugcugaacucuucu

SEQ ID NO: 4146691 - RNA, 112 nt, Human
aggaggguggucuugguuggaaccgcccagcccacucuugcuuauaacuugggucagcaagaagcugugggcuuccagggguggaauccuagaggagaccuccuacaggccu

SEQ ID NO: 4146692 - RNA, 94 nt, Human
aggagguaguucuguuuuugcaaauuccaauccaauauuuaugacagucaaagaugagugagucaaaggguagguuguagaggaacugcuuccu

SEQ ID NO: 4146693 - RNA, 65 nt, Human
aggaggugaacucuggggccacccucccagcucugugcugagagcccacagcucguuccucuccu

SEQ ID NO: 4146694 - RNA, 105 nt, Human
aggaguaauuucuuuagcugaaauguaagcauagagguuggggucugugugcuaaccuguguuguguuugcaguuguaauuuagauucgagaagugguuuauccu

SEQ ID NO: 4146695 - RNA, 94 nt, Human
aggaguacgacgcugugguagcuaugaucaugccacugcacuccagccugggugacagagcaagaucuagauaauuacagucuguccugcuccu

SEQ ID NO: 4146696 - RNA, 58 nt, Human
aggagucuguugaaaugucuauuaucuugugguauaucagcacauuaaacauacuccu

SEQ ID NO: 4146697 - RNA, 60 nt, Human
aggagugaggaugucauggaccucacagaaggugacagugaggccucagccucagcuccu

SEQ ID NO: 4146698 - RNA, 61 nt, Human
agaggcagcugaagcccaggcagaacccaaagaugguuccccagaggcuccagcuuccccu

SEQ ID NO: 4146699 - RNA, 68 nt, Human
agaggcagcuuuguucugccaauggcccauaucucaagcagauacuccagaacagaauaaauuucucu

SEQ ID NO: 4146700 - RNA, 78 nt, Human
agaggcauccaacagacaacuccuguggcucacccaggucaggguggguacauuucaggcugucuuguagcugcuucu

SEQ ID NO: 4146701 - RNA, 63 nt, Human
agaggcaugggucugucccuucggauuaagaaucuuuaaccuggggccugaagaccaucuucu

SEQ ID NO: 4146702 - RNA, 88 nt, Human
agaggcauuuuauaggcauucuugaucccauuucugugaguaacaugcacucauaaaauagauucuaggaugucuuaucucugcuccu

SEQ ID NO: 4146703 - RNA, 94 nt, Human
agaggccagggcgggaaggggaggaggaggaaguggaacccagcucccaacccugccccgcuggcccucaccuuccucccucaccgcugccucu

SEQ ID NO: 4146704 - RNA, 64 nt, Human
agaggcccuuucugaaacugcgcauuugaaauauaagcucuggcuuccaaaggaaugggccuuu

SEQ ID NO: 4146705 - RNA, 84 nt, Human
agauccuugugagggugucuucaggagaauuggggcacaaaaaucgacagaaacccccuucucucugaagaccccaaacuaucu

SEQ ID NO: 4146706 - RNA, 78 nt, Human
agaucuagucucagcuuaucaaucgcagcccaggauccauaagauuuaaacaagcuggacugauaagucuugcugucu

SEQ ID NO: 4146707 - RNA, 92 nt, Human
agaucugagaggcugauaaguugcauguugagaaauucagaccccauguccucucucggguuucacacugcagcaucagagagcuugaaucu

SEQ ID NO: 4146708 - RNA, 81 nt, Human
agaucugcuccuaccagaggcaggacuucugcagcaggugacuguggcugcaggaguuccccucugccuggccaaagguuu

SEQ ID NO: 4146709 - RNA, 57 nt, Human
agaucugguuggaguccugacaugcuacuuacuugcuguuugaccuuggccaaaucu

SEQ ID NO: 4146710 - RNA, 87 nt, Human
agaucuuggccucucucgauacagugccaacucuccagcacauggcuccuuucuggguggcacugauaaugagacgugucaaauucu

SEQ ID NO: 4146711 - RNA, 90 nt, Human
agaucuuuuccacccuuugcugcucuuccucccccugugccagacuucagggaaccggaggucacaaggugaguaaaggagaaagugucu

SEQ ID NO: 4146712 - RNA, 64 nt, Human
agaugaaaauacgugacuuuaaauguuuguuuauaaaaauguuugaagggauuaauuuuuaucu

SEQ ID NO: 4146713 - RNA, 76 nt, Human
agaugaaaauuccugggacucuuuaucagagauuaugguauagcauuucuuuguuggaguccaaggauauuuauuu

SEQ ID NO: 4146714 - RNA, 78 nt, Human
agaugaaaucaaaugagguuaauacagugcuucuguaacucuauuugaggcauauguauuugcauucguuuguucacu

SEQ ID NO: 4146715 - RNA, 64 nt, Human
agaugaauguuacaggaccuaagaugaaaaaaauuugcuggauggaucugugacaguuuagucu

SEQ ID NO: 4146716 - RNA, 94 nt, Human
agaugacuggaaauugugcaaaggagggucuuguugauuguaucucuguuaugcuaucuaacugggcuauuuuauugggcaaugcuucauaucu

SEQ ID NO: 4146717 - RNA, 63 nt, Human
agaugagugagagcaucaacuucucugacaaccuaggccaguaaguagugcuugugcucaucu

SEQ ID NO: 4146718 - RNA, 58 nt, Human
agaugaguguguguguguguguguguguguguguauauguguguauauauagucauuu

SEQ ID NO: 4146719 - RNA, 83 nt, Human
agaugcagagagagccccaggggaggugcccugcagucccgaacucgacugacauccuacaccccugggucuccccagugucu

SEQ ID NO: 4146720 - RNA, 83 nt, Human
agaugcugauaugauauuuaagcugaucauuucugauugguagggccaacaauugaacagaugaguuaaauaccucagaaucu

SEQ ID NO: 4146721 - RNA, 95 nt, Human
agaugcugcuuuaaguuguuuugagaugugguucaaggguguuuguugaucaaacaccaagagcuagcuauuaccaagaauaauaacuagcauuu

SEQ ID NO: 4146722 - RNA, 57 nt, Human
agaugcuggggccccucggauggccuggcagcuccccccagcggugcccuagccucu

SEQ ID NO: 4146723 - RNA, 58 nt, Human
agaugcuuguuccaucuuaacccagagacuggagaaauaggcagaggagcagguaucu

SEQ ID NO: 4146724 - RNA, 85 nt, Human
agauggaaccaaagcauugugaacauuuuuauuaaaacagcaaaugaagcuaugaaagaagugucacauugccaaguauucaucu

SEQ ID NO: 4146725 - RNA, 92 nt, Human
agauggaagcuggcaucucucagaggucuucagccucuggaaacaggcccaggggacugaccgacccucagcauuugauguuggcaacaucu

SEQ ID NO: 4146726 - RNA, 82 nt, Human
agauggaauuuaaaaagcaugugguucgagucaucauugggaaaacaugacaaagauuauggaacacacaugaauuccaacu

SEQ ID NO: 4146727 - RNA, 57 nt, Human
agauggagauguuuugaaguugcuuauaaauaugcagguaaaggaacauuucuguuu

SEQ ID NO: 4146728 - RNA, 70 nt, Human
agauggcagugaauaaauuuugacuugacuuaaggacuugaauuucccuugcauuuauagacugccauuu

SEQ ID NO: 4146729 - RNA, 61 nt, Human
agauggccaaauaacagcuugcaugcugugucaggcaugccccuuuguaguguggccuucu

SEQ ID NO: 4146730 - RNA, 63 nt, Human
agauggccccagcuggugugcucuggaauccuuggcgccaaggccaugcugccaggggcuucu

SEQ ID NO: 4146731 - RNA, 56 nt, Human
agauggccccaggugcccagggccacgccuccucccucugcuccugcugcccaucu

SEQ ID NO: 4146732 - RNA, 56 nt, Human
agauggcugucuucucccuguguucucaccuggcacagaggaugaggcagcucucu

SEQ ID NO: 4146733 - RNA, 57 nt, Human
agauggggcugaaaguuccaauccucuaaucacaugaucggcaaccagcccccaucu

SEQ ID NO: 4146734 - RNA, 114 nt, Human
agaugguggucaaaaauauggccggaugagcagacugggagucaggaagaaguguuugcaaugacuucugacuucucucuuguuuacuucuccuuucacuuuuaaccccccuuu

SEQ ID NO: 4146735 - RNA, 78 nt, Human
agauguaaauucuccuggccaggaugaccuaacaggaugaccuguucucccugaugcccaggaagaaaugacuugucu

SEQ ID NO: 4146736 - RNA, 55 nt, Human
agauguaguagugggucuuuuaugaaaauauaaauaaugaucuacaacuauuucu

SEQ ID NO: 4146737 - RNA, 84 nt, Human
agauguauuccaccuggcccagguggucguugaggcuggugcugcgggccuuggcaggcacguccugcggcuuguaguacaucu

SEQ ID NO: 4146738 - RNA, 65 nt, Human
agauguccugugugccuccugugaucaggcccuggcauggcaggaaggacaugcacugaauaucu

SEQ ID NO: 4146739 - RNA, 61 nt, Human
agaugugaauucugacuucagguuuuaugaaguacauagcuugucuagugaauucauaucu

SEQ ID NO: 4146740 - RNA, 108 nt, Human
agaugugauuuuucucuauuuuucuuggcuaguguuuugggguuuauauuuggcauaaucuaaucugauauuagccaaaaagaguacugaagagagagacuuugcacu

SEQ ID NO: 4146741 - RNA, 118 nt, Human
agaugugcuugguuaccauuuuuuuauaagcucauauugcccucuuuauauuaaggagccaaggaaaacaguauuuguguuuacuuccugaaaaauggcaggaaaucaagguacaucu

SEQ ID NO: 4146742 - RNA, 107 nt, Human
agaugugggugcaugaacuuuggcugcauuuuggguucguuaacagagcaaagaauuugccagugaagccccgaugcguuuugccccaaguaccuugcccuucauuu

SEQ ID NO: 4146743 - RNA, 86 nt, Human
agaugugguuacagaauaaguaauuguaaaaugaaugagugaacaauuuuuuucccaaaggcaauugccuguucuuacuaccaucu

SEQ ID NO: 4146744 - RNA, 79 nt, Human
agauguuaucagggagcuggaguuggaguacuugcauuuuguguuugugccagcuguccauguuccucuucauauauuu

SEQ ID NO: 4146745 - RNA, 62 nt, Human
agauguugauucuuacucucaauagcuguccuaagaaguuaauggguugaacaucaaggucu

SEQ ID NO: 4146746 - RNA, 62 nt, Human
agauguuuuuccaggucuaauuauaagagucauaaggcuggaaagauuuggagaaaacaucu

SEQ ID NO: 4146747 - RNA, 85 nt, Human
agauuaacaaaaaucggcuucuguccuuauggaguucagacuuucacuguguguacuugaaagggcagguccuuugcauuagucu

SEQ ID NO: 4146748 - RNA, 61 nt, Human
agauuaaugagcuuugaguggguaaaacagcacaugcccauuauucagccauuaaauuucu

SEQ ID NO: 4146749 - RNA, 69 nt, Human
agauuagaaguaacuucuguuugugguuuugcucacuuaaagcugcagauaggauguuauuucaauucu

SEQ ID NO: 4146750 - RNA, 79 nt, Human
agauuagagugagagauaaggucagagacauaaagggcauuauaggccauugucagggcuuuggcuuuuacucuugucu

SEQ ID NO: 4146751 - RNA, 114 nt, Human
agauuagugaacauauauuugcccccucuacuacugcaggagcuucuuguuugccaggacagggcuauauuccucagagcugaggaggaguugaaucauguggucauuuauucu

SEQ ID NO: 4146752 - RNA, 58 nt, Human
agauuauuuuuaacaauuauugugaauuuggacucucaguauguguuagggauaauuu

SEQ ID NO: 4146753 - RNA, 71 nt, Human
agauucauuguggauauuuucugacccaggcuauugaauugcaggauuucaaaguaucacacaacgagucu

SEQ ID NO: 4146754 - RNA, 67 nt, Human
agauucuaaaugagauguacauaacucacugaaagcgccaguggguauguugauuucauuuaugucu

SEQ ID NO: 4146755 - RNA, 82 nt, Human
agauugaaguccaagucuaaacacauauuuaaaacguuuuguacugucuguucuaaauaugcugauuaggugacuuugaucu

SEQ ID NO: 4146756 - RNA, 72 nt, Human
agauugagaaaucggaugguugccgugucuguguagaaagaaguagacaugggagacuuuucauuuuguucu

SEQ ID NO: 4146757 - RNA, 61 nt, Human
agcaggacagggcagguaccgugcuaaaaacccaccucgguccugcugcuccugucguguu

SEQ ID NO: 4146758 - RNA, 76 nt, Human
agcaggcgggagauuuauuauuuuggggugauuaaaccgaagcuuccaacaccucagugaguguuuccuucuugcu

SEQ ID NO: 4146759 - RNA, 58 nt, Human
agcaggcugaugggcaugcuugcaucaacagaacaugggaggcaugauauuagcuguu

SEQ ID NO: 4146760 - RNA, 55 nt, Human
agcagggcagcugaugcgcacgucgagacccgugagaagcgugagaagcucugcu

SEQ ID NO: 4146761 - RNA, 71 nt, Human
agcagggcuggugcugagcagguaggaugggcccucacucccucuucagccucaucucagcccgugcugcu

SEQ ID NO: 4146762 - RNA, 95 nt, Human
agcaggggauggguagagguggcagcugcugcuacugcaggugcuuccccucacaccacagaugcaggucugcucaccugaccucucacccugcu

SEQ ID NO: 4146763 - RNA, 59 nt, Human
agcaggggcagggcuggggaugcaagaaagcaggcugggucccaggcugggcuccagcu

SEQ ID NO: 4146764 - RNA, 57 nt, Human
agcaggguugguuucuccucaggccccucuuccuggcuugcaaacuaccaccuugcu

SEQ ID NO: 4146765 - RNA, 77 nt, Human
agcagguguagagucggcaccuggccagaggagaggauagggguugcuuccucgaggccagcguggucugcacugcu

SEQ ID NO: 4146766 - RNA, 73 nt, Human
agcagguuagcuuuguuuaucaaggggcaauccuccugagcuuugucuccagaaagaaaaagcaaugccuacu

SEQ ID NO: 4146767 - RNA, 95 nt, Human
agcaguaaggagcaucggcugagucugaggggagagcugggugcuccuugcaccucccuggcccuggcaggucucuuugcugaucuugugcugcu

SEQ ID NO: 4146768 - RNA, 128 nt, Human
agcaguacucaaggaguuagaaauuggaucauuaagaauagcuacuaaacuauauucucaagguaaauuuuaaugugaucuaguagcugauuuuaaugagcccauucuuuguucuuugcuuaccuguu

SEQ ID NO: 4146769 - RNA, 72 nt, Human
agcaguccguccugucaagcagcugagggccagagcuggagggcugcaguggcugguuagggacaggacgcu

SEQ ID NO: 4146770 - RNA, 55 nt, Human
agcagugggauauugaaguauauggaacuauagucuauguaugaggucuucugcu

SEQ ID NO: 4146771 - RNA, 59 nt, Human
agcagugggugacagagcugagaauugaacccuauuuuuaucccuccagagccacugcu

SEQ ID NO: 4146772 - RNA, 55 nt, Human
agcaguguucuaaucuggcuaguggagaaggcugcaggacuacucgagcacugcu

SEQ ID NO: 4146773 - RNA, 59 nt, Human
agcauacaggucugaaacagcuacuguacaauagacagaaagcuccaggccuggaugcu

SEQ ID NO: 4146774 - RNA, 59 nt, Human
agcauagaaaagauucccagaguccugcucuguggaaaggaaagucuugauauuaugcu

SEQ ID NO: 4146775 - RNA, 90 nt, Human
agcauagggcagcaggaggaggagagugggccucugagucccagccccaggucugaucucagccccgcgccucagaagcugcucaguguu

SEQ ID NO: 4146776 - RNA, 88 nt, Human
agcauauacaaugcucuaaagauugcucaaaacugugaccugaauuuuaggauucuguuuuauaguggccaaucucaguuguauugcu

SEQ ID NO: 4146777 - RNA, 75 nt, Human
agcauaucacauuuggagauuuaugaauguuauaccauccuugcauuccugagauaaaucucaugugaccaugcu

SEQ ID NO: 4146778 - RNA, 58 nt, Human
agcauauuauggccuauugcuggaaauuacaaguaccagcauuagaguacuauaugcu

SEQ ID NO: 4146779 - RNA, 77 nt, Human
agcaucaccuacaggauuaauaaaaaauuguaucauaauauugaugauguuuuuagaaguccacaaaggagauugcu

SEQ ID NO: 4146780 - RNA, 58 nt, Human
aggaaucagaauucuuagaauugcucauagguaaauaacugggaguauugacuuuccu

SEQ ID NO: 4146781 - RNA, 69 nt, Human
aggaaugcagauuccuaggccacacccccagauauaaaucuggaacaaagcuuaggaauuugcaauuuu

SEQ ID NO: 4146782 - RNA, 74 nt, Human
aggaaugggagacuauguucagcaggcaugacagcauuuucuaaauguuauuacuguuggcaaagucuuaucuu

SEQ ID NO: 4146783 - RNA, 71 nt, Human
aggaaugggaggaggggagcugagagcuggggacaaggaacuucucagaguuccucuggagucccaauccu

SEQ ID NO: 4146784 - RNA, 56 nt, Human
aggaauuauuugucuuagucuuccuucuaaaccaaggaggaguagaaauagauccu

SEQ ID NO: 4146785 - RNA, 74 nt, Human
aggaauugucugccuuuaucaucuccuuagguuguuccaguuuuuaaaggauaguguaaacgcucuugauuccu

SEQ ID NO: 4146786 - RNA, 62 nt, Human
aggaauuuaagggcucagagagauggagugacuuugcuucagucuuuuaacuuuaaguuccu

SEQ ID NO: 4146787 - RNA, 80 nt, Human
aggacaacgggguacccagccccuggagaggccucggcuggcuaucucauucuccaggggcugcugugccaccuugcccu

SEQ ID NO: 4146788 - RNA, 58 nt, Human
aggacaagcuaaaggacuuccuuccccaaggcuaugaagguaguaaauguuugcuccu

SEQ ID NO: 4146789 - RNA, 89 nt, Human
aggacacacaguuggcagcaaaaccagaaucagaacccaggucuuuccaggccucucuguugcuguuuuguguuuguauguuugcuucu

SEQ ID NO: 4146790 - RNA, 57 nt, Human
aggacacaguuacuuauuuugccugcuugaagguaaccauucagagauugcugucuu

SEQ ID NO: 4146791 - RNA, 94 nt, Human
aggacagaacugucucuguuaacuuccagggcuaaggcaauguauagccuucaggauuuaggaagaugaacauaccagagauagcuugaaucuu

SEQ ID NO: 4146792 - RNA, 69 nt, Human
aggacagaaggcugugguucuauacagaagacaagaacacugcuuugguauugcacacugucuucuccu

SEQ ID NO: 4146793 - RNA, 76 nt, Human
aggacagauaaagcaaggaugacugaagacccuaaaacuccccaaaggaagcuuuaaucaaaauuuuugccugccu

SEQ ID NO: 4146794 - RNA, 55 nt, Human
aggacagcaguuggugagguucuuauaauuggucccugaccauucagcuugucuu

SEQ ID NO: 4146795 - RNA, 65 nt, Human
aggacaggaugaaauuauggagcguuauauuugaugagagccgaauggaugauuacaucuuuccu

SEQ ID NO: 4146796 - RNA, 83 nt, Human
aggacagugccuaacauauguaaaggucuuugaguucuucaggaauaaauggcacuuuauaaauguuaaacuacaaguuuccu

SEQ ID NO: 4146797 - RNA, 102 nt, Human
aggacaugaaagauggccaggcuggcuggagcucaggcccagcaaggcccccugggggccauggucaugggugagcuuggguuuggcuucuguuuucgucuu

SEQ ID NO: 4146798 - RNA, 92 nt, Human
aggacaugcuucgagaugugaaccauucugucuaagcuggcuacguuuuccuugaaugcacggggugauaugaauggucucagcagugucuu

SEQ ID NO: 4146799 - RNA, 55 nt, Human
aggaccagccuccaggucucuuuuccccagagaauaaagacugcagguuuguccu

SEQ ID NO: 4146800 - RNA, 104 nt, Human
aggacccguccgcggcgugaaggcugcugggaagugugguccaagcgcggauuagggccugcucggagucccaggagccccucuugcagcugccggaucggccu

SEQ ID NO: 4146801 - RNA, 129 nt, Human
aggacccucaaagcuauauaaggagauaagcuuucacaguguaauauauuuuucuuucauauaauuacauuugugagcugacagagagguaaguuaugaaggguuuguugcucuaugcuuagggggcuu

SEQ ID NO: 4146802 - RNA, 59 nt, Human
aggaccgcucucugagaaacaaggaccuagagguccaggucaucuuggagagcuguucu

SEQ ID NO: 4146803 - RNA, 56 nt, Human
aggaccucgcauuuacuaagcuccugguaugagcuaagaacugugccaggugaccu

SEQ ID NO: 4146804 - RNA, 80 nt, Human
aggaccuugcuagugaagaauugggcaggggcaggcaaggcuguugagaagcucugccaccaccuacacuaguauguccu

SEQ ID NO: 4146805 - RNA, 55 nt, Human
aggaccuuuggcaaggcugcucugacaaagagaaaucuaagaugcucaaggaccu

SEQ ID NO: 4146806 - RNA, 128 nt, Human
aggacggugaggacccuggagugcaacauuuaaggaggcacucgcucucaggguccuguaagugcaggguccgcaccugugagugagcgccuccuuaaaucuugcaccaacagccucacccuaguccu

SEQ ID NO: 4146807 - RNA, 61 nt, Human
aggacuaggggaugggccauauuugcaagaugagaaaugcagaggucuaagauucuagcuu

SEQ ID NO: 4146808 - RNA, 72 nt, Human
aggacucuguggucuguuuaauggguaagcauggggagcaccaguacaaaugaaaauagaccacuggguccu

SEQ ID NO: 4146809 - RNA, 95 nt, Human
aggacugccuagcuuuaugaggagaccuuaguauccaucagagaaaucuauguucacucugcuagguuucugccaugagguuguggaaaugucuu

SEQ ID NO: 4146810 - RNA, 61 nt, Human
aggacuggcuucuccagaaaucuugguggccacugaacaccgaacaggaggagccacuccu

SEQ ID NO: 4146811 - RNA, 76 nt, Human
aggacuuaaagauuaacucucagaaaagaggagcaaaagccagacgucucuuuuggugagguuaaaauuuuuuccu

SEQ ID NO: 4146812 - RNA, 57 nt, Human
aggacuucccuggcucccagcugacucuagugguccccggagaagcccaggaauccu

SEQ ID NO: 4146813 - RNA, 65 nt, Human
aggacuucuuaacuguauauacuaugagauggugaaacacauuucugggcaaguuauagaauccu

SEQ ID NO: 4146814 - RNA, 63 nt, Human
aggacuuuucugacauauccagucucagugaaaggccacugucacugugauguuagagauccu

SEQ ID NO: 4146815 - RNA, 65 nt, Human
aggagaaaauggaagacagauaaggcagaaaauaugcuuuacaacuuucuguucuguauucuguu

SEQ ID NO: 4146816 - RNA, 79 nt, Human
aggagaaacuguaaagcaggugaguagaacagacagcaucaauccaggucuacauuucuccuuuuuacauuuuuuaccu

SEQ ID NO: 4146817 - RNA, 80 nt, Human
aggagaaagaaaagagcaugcauuaaucaguuucucugcaacagacacuaauuaagcugcuuuacuuacaguuaucuccu

SEQ ID NO: 4146818 - RNA, 78 nt, Human
aggagaaagaguuucugauacuggaaucgaugccacugaucagugccaucugauaccaaaucaaugccacuguuuccu

SEQ ID NO: 4146819 - RNA, 72 nt, Human
aggagaacaauuucacaucuaucucagauuuguuuugcggauaaaaugagauacaguuugaaaguagcuccu

SEQ ID NO: 4146820 - RNA, 88 nt, Human
aggagaagcuguuuccuucuuuuagauuuccacucuuuuauucugcugagagagggcauagaaaaagggaaaaaaaggaauuucuccu

SEQ ID NO: 4146821 - RNA, 87 nt, Human
aggagaauuuguguuuuuauaaccaaguucugcuuguuacauuuuaagagugacaagcagguuuuguuguggauuagcaggacuccu

SEQ ID NO: 4146822 - RNA, 56 nt, Human
aggagacacaucacacuagcaucugagcaaaagcaggagcugggauguggacucuu

SEQ ID NO: 4146823 - RNA, 83 nt, Human
aggagaccauccauagauugagagaugguguuugcaagauauuuacagauaagacuauauccagacuauggaaggaucuuccu

SEQ ID NO: 4146824 - RNA, 79 nt, Human
aggagagcaauuuuuuccaugcucuuacagaugagacaagucccuuggaaacugagaaggcaugggaugauugacuucu

SEQ ID NO: 4146825 - RNA, 81 nt, Human
aggagagcagcugugacauggacagugauugauuaccugucauuuauugcaauuucugaucucugaguacagcagcuuccu

SEQ ID NO: 4146826 - RNA, 55 nt, Human
aggagagcgucagguagggaacaaugaacacuguccccaccuacacacugcuccu

SEQ ID NO: 4146827 - RNA, 76 nt, Human
aggagagggccuagaagcuccauaugcaggacccucccagauauugcccuguaugugucuuuaucuggcucuuccu

SEQ ID NO: 4146828 - RNA, 77 nt, Human
aggagaguggcagguuagggaguagaaucagcugcuauuuaaagagacaguauuuccucuucuuaacuuacuuuccu

SEQ ID NO: 4146829 - RNA, 62 nt, Human
aggagaguuggcugauaaggcauuuguaggauauaccaggccaaauucagucagcagcuccu

SEQ ID NO: 4146830 - RNA, 101 nt, Human
aggagaugagaggggggacauucauuuaggccaggcucccagccucgggccuccaggccaagccugccuggcaguguaauuccugucaaguuuuaucuuuu

SEQ ID NO: 4146831 - RNA, 96 nt, Human
aggagaugcaagagugagaauuuuacaaaauaccuccgauguuccuauuucauaagcauuuggguuuagauuugcugagauucgucuugcaaaccu

SEQ ID NO: 4146832 - RNA, 62 nt, Human
aggagauguauuuguuucuugagauaauuuugagauuauucagagaaugguaugcuuuuccu

SEQ ID NO: 4146833 - RNA, 65 nt, Human
aggagaugugugcuacaggugugggaagacugaaaagguuuuuuaaaauuagcacugcauuuacu

SEQ ID NO: 4146834 - RNA, 64 nt, Human
aggagauuugaguuguaguuccacuucugccacuaacuucugugggaucugaggcaagucuccu

SEQ ID NO: 4146835 - RNA, 78 nt, Human
aggagcaaugagguagaacaggaauugaauuauuucuaauugggaaggaauugcacauuucaguguucuguugcucuu

SEQ ID NO: 4146836 - RNA, 111 nt, Human
aggagcacaaaaguuagauuucacuucagagaagugcauucaguauucauaggccuucuggaggagcaaggcugugagaagaaugauauuaggugaaaaauauuggcuccu

SEQ ID NO: 4146837 - RNA, 59 nt, Human
aggagcagggcagugaauucuggcacuugucagugccagggcuaaauuauucugcuccu

SEQ ID NO: 4146838 - RNA, 56 nt, Human
aggagccguaggggauucacaugcuuacagacaggugaagguagacugggcuuccu

SEQ ID NO: 4146839 - RNA, 58 nt, Human
aggagccuauuauuagcauggcaucuucauuuguggcugcuucuagaauuaggcucuu

SEQ ID NO: 4146840 - RNA, 129 nt, Human
aggagccuccccagcccaccagagagccucgggucccaggcaggccacuggcaggccacugacagucccugggcuuugccugugaguuaagccgggaguugaguaauugcuggcuggguucuggcuccu

SEQ ID NO: 4146841 - RNA, 62 nt, Human
aggagcgaguggcgggggcucaccgggcgccaggugcuugcuccuaggacgccgcugcuccu

SEQ ID NO: 4146842 - RNA, 130 nt, Human
aggagcuaauauuuagagcuuugcaaauucgucacuguuaaacaccuauguuuaaaaauacaugaagcccuaaauguuuugacagugcugcuaaaaugcaaaguaaaauuccaugucucauauuguuucu

SEQ ID NO: 4146843 - RNA, 83 nt, Human
aggagcuccccugggcccuucagcuuccucugcagccucagguaugagaggaggaggaggaggcccccugggcagugacuccu

SEQ ID NO: 4146844 - RNA, 58 nt, Human
aggagcucucccaugcugcagauaccguucugaaucucugcaguuugucaagguuccu

SEQ ID NO: 4146845 - RNA, 82 nt, Human
agggcacagcuauuagauuggacuuccgcacaaugucuaguacagacuugcucaaugcuugaagccaauaauuaaugacccu

SEQ ID NO: 4146846 - RNA, 111 nt, Human
agggcacuuagcaccuugcagaaauaagaggcuuuauaacuauuuguuccauaauagaugguuggcugaauaaaugaauagagcuguuuucuccaaagcccaagaugcucu

SEQ ID NO: 4146847 - RNA, 56 nt, Human
agggcagcaaaucugagucugguaggguggacucuuaccagguuuuguagugcccu

SEQ ID NO: 4146848 - RNA, 73 nt, Human
agggcagcacuggggcugaugcguucgugugacucccaggucagcaugcgcuugaucagcuccaccaugcucu

SEQ ID NO: 4146849 - RNA, 56 nt, Human
agggcaguuaugaaugucuccaaaacuauuucagggguaauucaugaacauguccu

SEQ ID NO: 4146850 - RNA, 60 nt, Human
agggcauggggcccucugacuuauguauuccuuuacuuggagacucaguuucuaugcucu

SEQ ID NO: 4146851 - RNA, 61 nt, Human
agggccagaggcaccuugcagcaggcgaaacuugucagcccagcaggguccuucugguccu

SEQ ID NO: 4146852 - RNA, 64 nt, Human
agggccagaguauguuuagcuuugcgggccacagauggccucuguugcauaugcugcugggucu

SEQ ID NO: 4146853 - RNA, 65 nt, Human
agggccccuggagaaaagaaccaugaggaagcaugcucucagaauucuccacgcucagggucccu

SEQ ID NO: 4146854 - RNA, 57 nt, Human
aggaagagcuuacuuguuguuccaaggccuaauuggagaucuagguuggcauuuccu

SEQ ID NO: 4146855 - RNA, 59 nt, Human
aggaagaggguggcagauaaucacaagcaagugcuggcugaauauuuuagccucuuccu

SEQ ID NO: 4146856 - RNA, 129 nt, Human
aggaagcauuugucaugaguagcacuggugacucaaacuuauuuuuuagcccugccagccaagagcaacaggaaugaacucgagugaucugauuuauuagugaaaaaaaaccaacuacaaacuuuuccu

SEQ ID NO: 4146857 - RNA, 62 nt, Human
aggaagccacgaguggcacgggucugcuguuuuugaaggagacggugcaguccugguuuccu

SEQ ID NO: 4146858 - RNA, 61 nt, Human
aggaagccaggcugggggaucugauuagaaaacuucugcagucuccagucuuggacuuacu

SEQ ID NO: 4146859 - RNA, 80 nt, Human
aggaagcccuucagagggacauucaagggaaauuuugaccacaccguuuuucuccuuagguguucacuugagaccucccu

SEQ ID NO: 4146860 - RNA, 68 nt, Human
aggaagcuguucugaaucaguaaguaugauuuuuuaacacaaugauucacaagcagcacuuauuuccu

SEQ ID NO: 4146861 - RNA, 71 nt, Human
aggaagcuucauguuuuagcugcaaaaugaaaguauuuuucaacuguacuacuugaacauguauguuuccu

SEQ ID NO: 4146862 - RNA, 73 nt, Human
aggaagcuuuaaaguauagaggacaaaaacaaggcuuacuguuuuucccuacucugacuuuaccuggcuucuu

SEQ ID NO: 4146863 - RNA, 63 nt, Human
aggaaggaagagacaccauuuggauaauuuucuugccucaaguaauguaucucuguucuuccu

SEQ ID NO: 4146864 - RNA, 62 nt, Human
aggaaggacuccaugguccgucagcuuccagcgucguggcugaugcaucugguaucuuuccu

SEQ ID NO: 4146865 - RNA, 66 nt, Human
aggaaggcgaggaagaauauggauuuuacagcacauuaggaaaaucguuucguuccugguuuuucu

SEQ ID NO: 4146866 - RNA, 61 nt, Human
aggaaggcuucuuuggucuucucccccuuaaucacacaaggucagguaagaucaccuuccu

SEQ ID NO: 4146867 - RNA, 77 nt, Human
aggaagggacgcucggguccucugaugcccacgggccuucugcguguggaaggcagaggucugaugcgucccugccu

SEQ ID NO: 4146868 - RNA, 102 nt, Human
aggaagggagacaggugcuagaguagagagagucuuagggcuaauucaagugguagauuggccagguccauuucuccaucugggccucaguuuccucauccu

SEQ ID NO: 4146869 - RNA, 58 nt, Human
aggaagggagcaguuuguuguuugagugcucuuaaagcaaauaaucugcuugcuuuuu

SEQ ID NO: 4146870 - RNA, 57 nt, Human
aggaaggggagaaguuaaagcuucucucuuccaucugcguuggcuucuuuccuuccu

SEQ ID NO: 4146871 - RNA, 75 nt, Human
aggaaguaaggauuuaacauucaguugcuaacauguuuagaugauggcagcagaccccuaagucuaccgccuccu

SEQ ID NO: 4146872 - RNA, 68 nt, Human
aggaaguagauaacuaaagaaagggauuaaaguauuaaauuuaguuucuuuccuuagucauucauccu

SEQ ID NO: 4146873 - RNA, 74 nt, Human
aggaaguagggcugaggcgagggagaugcugagcaagggugccauuuaagcagucccagccucagccccauccu

SEQ ID NO: 4146874 - RNA, 79 nt, Human
aggaagucagugacagagacaaaaaucagauuuuaggccucauaaaacugugcauuucaugucuuuuccuggucuuucu

SEQ ID NO: 4146875 - RNA, 67 nt, Human
aggaagugacggagcauggaacccagcccuuaaaaacugugcuguuuucuucuguaccgugccaccu

SEQ ID NO: 4146876 - RNA, 79 nt, Human
aggaaguguagcauagauagagaugaacauaaaacaaggauuuugguucuuuuguaauguuuucuuaaucucauuuucu

SEQ ID NO: 4146877 - RNA, 65 nt, Human
aggaagugugcaauuaauuucuauuuaccaucccuucuucucuagaaaaauugauaucgcuuccu

SEQ ID NO: 4146878 - RNA, 66 nt, Human
aggaaguuuucuguacucgcucuuggcgaauccccagaggagccccaauugagcaguacguuuccu

SEQ ID NO: 4146879 - RNA, 62 nt, Human
aggaauagaccacuucacugagaggcagaacuugaguucuauccuuguaaagggcuguuucu

SEQ ID NO: 4146880 - RNA, 61 nt, Human
aggaauagauauggaacagagagauguaaauuguaucuuuguuauugcuuuaucuauuccu

SEQ ID NO: 4146881 - RNA, 68 nt, Human
aggaauagcaaacagacaugcacaagugcuuuucaagccucugcaugcaugauguuugguagcauccu

SEQ ID NO: 4146882 - RNA, 68 nt, Human
aggaaucuggaagacacagcuaccauaauaccaucuguugauggaaggccuguuguguccuaggcccu

SEQ ID NO: 4146883 - RNA, 56 nt, Human
aggaaugugaggcaaguugugaaauucaauuaauucuacagccagcccacguaccu

SEQ ID NO: 4146884 - RNA, 75 nt, Human
aggaauuggggcucagggagacagugcagaugucaauacuguggcuucugcuguugccaugaguaauaaaguccu

SEQ ID NO: 4146885 - RNA, 66 nt, Human
aggaauuguaaugagaaagagagugaauugggucauaauuucucuucguuuucauuaaauaugacu

SEQ ID NO: 4146886 - RNA, 61 nt, Human
aggaauuguguuguaguggagagcuuuuugauuuugcucucucuugaauucauaguuuccu

SEQ ID NO: 4146887 - RNA, 59 nt, Human
aggaauuuuucuagccggaguuacaggucaaauaccaugcuuuuuacuagaggauuccu

SEQ ID NO: 4146888 - RNA, 62 nt, Human
aggacaaaagccagaacuugcagggaguuguaaauucugcuaagaaguuuggauuuuguccu

SEQ ID NO: 4146889 - RNA, 76 nt, Human
aggacaaccuggagugcgcuuguuuccucgugugacaaauggauucucauacaggcucaagcuauacgguuuucuu

SEQ ID NO: 4146890 - RNA, 56 nt, Human
aggacaauuagacucuuuguuucuccuaugauccuaagagucagcuugacuguccu

SEQ ID NO: 4146891 - RNA, 77 nt, Human
aggacacacagcucuuuggcguuggcagagccaggugugagcucuggucugccuggaucacagccccuguguggccu

SEQ ID NO: 4146892 - RNA, 81 nt, Human
aggacacagaagcccaaaaggggcauggccacacacugaguuaacagcagaguuggagccagcccagggcucugauguccu

SEQ ID NO: 4146893 - RNA, 61 nt, Human
aggacaccuaggcacauccccgucucuggguccccagccuuaucaugugucugaguguccu

SEQ ID NO: 4146894 - RNA, 60 nt, Human
aggacaccuaucccaugaagcccguauuuucuaucaguggcuucuuggagaugguguuuu

SEQ ID NO: 4146895 - RNA, 63 nt, Human
aggacagacugugaugcuuuugaugacuuauucucagaaguuacauacugucacuucuguccu

SEQ ID NO: 4146896 - RNA, 61 nt, Human
aggacagcccccaacagcaacauuuaucuaaccaaaauguaaguagugccaagguugucuu

SEQ ID NO: 4146897 - RNA, 129 nt, Human
aggacagugggggacugugccccuuguccuugaagcaggaacguucugggguguguggccagcuccuucucacagcuuucagauuguucccaagggcauggagcauggagcaggucccucguggucucu

SEQ ID NO: 4146898 - RNA, 55 nt, Human
aggacaguguggaagagggugcccaugggagggacaaucucaggcaggcuguucu

SEQ ID NO: 4146899 - RNA, 66 nt, Human
aggacaucacucgccgccugucucgaaguggugagcgccaccacaucgggcggacacugggguccu

SEQ ID NO: 4146900 - RNA, 58 nt, Human
aggacaugaagaaagggcaagguuugauggaaaagcuuuguuuccucuaaucuguccu

SEQ ID NO: 4146901 - RNA, 73 nt, Human
aggacauucugagcuacuaauuaggcaucuggugugaggggagguggcugccaagcaggucagagaaguuccu

SEQ ID NO: 4146902 - RNA, 63 nt, Human
aggaccaccgguccauccacccaagcacuagacccgcucagacauguauugaccguguggccu

SEQ ID NO: 4146903 - RNA, 119 nt, Human
aggaccagaggugugugucugcaccgcgagcuccacagcagacccugcacucacugucagguaagcaaaaccagagagagacaggguuguggugccgugaugcugcacuacccuuaccu

SEQ ID NO: 4146904 - RNA, 60 nt, Human
aggaccagccuugacugccccagcacagaaauggcuacaguggcucagugcugguguccu

SEQ ID NO: 4146905 - RNA, 92 nt, Human
aggacggcgggugcggccuggccuccagaugugggcugugagugacccccacccaccccauguccauauggggggugaggccaccucugccu

SEQ ID NO: 4146906 - RNA, 58 nt, Human
aggacugaggcuccccuaggcucaguuguagauuuugaggcucuugaguuucaguucu

SEQ ID NO: 4146907 - RNA, 59 nt, Human
aggacuuagaacauuauguacugaaucagccccucugucuguaauaugugcugaguccu

SEQ ID NO: 4146908 - RNA, 80 nt, Human
aggagcugcccugggcagguauacaaaaaauguaauguguacuuaagcuuucauuugauauauuuguuuagugugauccu

SEQ ID NO: 4146909 - RNA, 58 nt, Human
aggagcugggccuuccagagaccuuugcauggaggcguccagggaaggcccagcugcu

SEQ ID NO: 4146910 - RNA, 70 nt, Human
aggagcugguggggaggaacugggagagccugggccaguaggcuucccugccucacuuauucucagcccu

SEQ ID NO: 4146911 - RNA, 66 nt, Human
aggaggagcaugggaaggcucugguggagagaacccuugaccaccagaucuccccugaugccuccu

SEQ ID NO: 4146912 - RNA, 62 nt, Human
aggaggauccuguguccugcuuuuccuuuaucaaaccaaaaagcuggcaauguuguccucuu

SEQ ID NO: 4146913 - RNA, 64 nt, Human
aggaggcacucgcucggggaugguuuggugguccccgaccccugccucagagcgcaggcccccu

SEQ ID NO: 4146914 - RNA, 58 nt, Human
aggaggccgcugaugggcucccugagacugcaggcgugauauccccaucaaggccccu

SEQ ID NO: 4146915 - RNA, 76 nt, Human
aggaggccggaagggaggaucuuucucuagcauguaguguaucaaguuugaggagaagacuuugcuuccccuuccu

SEQ ID NO: 4146916 - RNA, 71 nt, Human
aggaggccuggguuaccuacucguggggagggguccagacuguugcagaguaagggguagccaggcccccu

SEQ ID NO: 4146917 - RNA, 76 nt, Human
aggaggcggaagggaaaggagggaaacagagcggugaggaguuucacuuuuguucucucuuuucugugugcuuccu

SEQ ID NO: 4146918 - RNA, 76 nt, Human
aggagggccugcagggaagucccagcuccuggggagaccccuugccccggggcaggagucccuguagaguccuccu

SEQ ID NO: 4146919 - RNA, 56 nt, Human
aggaggggaugcuuccucuagcaugucaauucccuugcugagguagcuuuccuccu

SEQ ID NO: 4146920 - RNA, 59 nt, Human
aggagguacuggcuggugcauuguaggauauuuugcagcauucuuggccacuacucacu

SEQ ID NO: 4146921 - RNA, 76 nt, Human
aggagguagcucuuacucucuccggccugcacagagcugaggaaagcaggcuggggagaggggaagcacauguccu

SEQ ID NO: 4146922 - RNA, 63 nt, Human
aggaggucagagccccaugcugggaagcauagguugagcucacggaugggguucuguccuucu

SEQ ID NO: 4146923 - RNA, 76 nt, Human
aggaggucugcagaaaggcacccacugggucucauagugugaggccucuuguguuuguccuuguucccagccuccu

SEQ ID NO: 4146924 - RNA, 69 nt, Human
aggaggugaccaggugccugggggagcugcuggcugcggccugugccagcugggcccugcccacguccu

SEQ ID NO: 4146925 - RNA, 63 nt, Human
aggaggugaggcuaagugacacaggggcauggaaagcuccuuguggcuguggccucagcugcu

SEQ ID NO: 4146926 - RNA, 59 nt, Human
aggaggugcguggugauccccucugcuguugugcagaggaaugugcccacccaucuccu

SEQ ID NO: 4146927 - RNA, 80 nt, Human
aggagucagcaaauuuuuuuaguaaaagaccacauauuaaauauuuuagguuuugcaggcuauccuuugcugcaacuucu

SEQ ID NO: 4146928 - RNA, 66 nt, Human
aggaguccauguuaaaucuaguuauguuuaaauuguaauggaaaagagcuguuuacauggauuucu

SEQ ID NO: 4146929 - RNA, 58 nt, Human
aggaguggaauuacuggguucugggagauacacauacuuaguuucaguaacuacucuu

SEQ ID NO: 4146930 - RNA, 89 nt, Human
aggagugucacucugucaccaggcuagagugcaguggcgcgaccuugucucacugcaaccucugccucccagguucaagugauucuccu

SEQ ID NO: 4146931 - RNA, 68 nt, Human
aggaguucaaggcgagcucaauaaacuagaucacaaagucauuuuuacaacgcuugccuugucuuccu

SEQ ID NO: 4146932 - RNA, 79 nt, Human
aggaguucacugugcaggcucugagccccacccaguauuagaacgggaccugagaugcggaggccugccaggagcuucu

SEQ ID NO: 4146933 - RNA, 76 nt, Human
agucuuuagauaguaaauagcacuaagucuaaaagcaaggagauaagauuucauguuggauacuguuucaagaacu

SEQ ID NO: 4146934 - RNA, 56 nt, Human
agucuuuggcugccugaagcccaagucaacaucugacugcagccacgugagagacu

SEQ ID NO: 4146935 - RNA, 65 nt, Human
agucuuuuucucuauaucccgcuuucuucuuuuucuccagcugcaggagcuagagcugaaagacu

SEQ ID NO: 4146936 - RNA, 86 nt, Human
agugaaaauucagagacaguucuggggcaggagccagauuugacccauuccuaucccuaccauugucucuugagacucuguucacu

SEQ ID NO: 4146937 - RNA, 64 nt, Human
agugaaauacuuaauugaauauuagauugcuguggcaacugguagaaagcaguaagugguuacu

SEQ ID NO: 4146938 - RNA, 76 nt, Human
agugaacagaugcgcuugguugccagaccgcgcccuuugcgggucuaucaaaagggcaagcgcauauucuggagcu

SEQ ID NO: 4146939 - RNA, 112 nt, Human
agugaaggagaaaguggcuuuugugguaugaaaauuguaaaguucuuuuuaaaaaaggaaagaagaaacaaaaagauuuuuaaacaaacaaaaacuaagagaauucaucauu

SEQ ID NO: 4146940 - RNA, 112 nt, Human
agugaaggcuuggagaggggcacugcuuacccggccugacuucaguguccuuauacgugaaaaggcagagggucgaaguuaguguuucuaaaauauauuucagccuaacacu

SEQ ID NO: 4146941 - RNA, 65 nt, Human
agugaaggguccaaggcuuugcguuuagcacugcuacuuaguggcuaugugaccuuaaaaucacu

SEQ ID NO: 4146942 - RNA, 74 nt, Human
agugaauaaauugaauugauauuucaucugagauugcucaaucagauguaaaggcagacuuuaauuuuuguacu

SEQ ID NO: 4146943 - RNA, 60 nt, Human
agugaaugacaaaugagagguucagagggaucagaggaccugcuccaugucaccuucacu

SEQ ID NO: 4146944 - RNA, 67 nt, Human
agugaaugcuuccaaaauaccaagccuguuccuucugguuugggcaguauuauuggaguuaugggcu

SEQ ID NO: 4146945 - RNA, 87 nt, Human
agugacaaaucaugcuuaauccuucuuguguucauuagcgugacauuaauccugauagacucaauugggguauaaggugagagcacu

SEQ ID NO: 4146946 - RNA, 129 nt, Human
agugacaaguggacuaagugaaaucauauggguaaugaaacuuggauuucauuuaacccguuccuauaauuaagggaaaugugucaguuucauucucucaguuggcgaucaucuuagucugcuugggcu

SEQ ID NO: 4146947 - RNA, 61 nt, Human
agugacagccaaauccauccaugucagagcaauggccuaugguaugugguuucguguggcu

SEQ ID NO: 4146948 - RNA, 65 nt, Human
agugacauuuguaacacgugacagguugcuugauaaaggguaacauuucucuuacaaaugcuacu

SEQ ID NO: 4146949 - RNA, 65 nt, Human
agugaccgaggcacuuggcaacacuccuuccuccagcaucacugucacuagugccuucugucauu

SEQ ID NO: 4146950 - RNA, 66 nt, Human
agugacuggaggcugguguaagucccugcgacagcugggcuccaacuacaucagccuuaccacacu

SEQ ID NO: 4146951 - RNA, 81 nt, Human
agugacuugagagagguggccugcaagugcagauggccaagacgaguggccagcaagugcagauggccaagacgagucauu

SEQ ID NO: 4146952 - RNA, 109 nt, Human
agugacuuuucccacugaaggggacacagaggaaacuaugauuaggaguuuccagacaccuguguuccagccaugguuucccuauguccucgccuugggacccagcacu

SEQ ID NO: 4146953 - RNA, 73 nt, Human
agugacuuuugguccugagcaaaacuaugugugauaugcacuucauaagugacaguuuagggcaauggucauu

SEQ ID NO: 4146954 - RNA, 86 nt, Human
agugagacagacugacaggcaugggacgagggggugcuggacuuggaacccagagccugaggaugucccagcucagacuauucacu

SEQ ID NO: 4146955 - RNA, 56 nt, Human
agugagacaguggacucugcaucaucacaaacaugcugagaaaaucacugcuuacu

SEQ ID NO: 4146956 - RNA, 57 nt, Human
agugagauuuggguuguuuaacaugugguuuaaaaccauagucucccaguccuuauu

SEQ ID NO: 4146957 - RNA, 60 nt, Human
agugagcagagacgggggccuccagcauagcugcugguuuugaccuguuucuaguucucu

SEQ ID NO: 4146958 - RNA, 68 nt, Human
agugagcuucugacagaugcaccugugacaucacucugccaucccuggugacacuguggauguucacu

SEQ ID NO: 4146959 - RNA, 104 nt, Human
agugaggauuuucuuuaacugcauuaacacuggaccauuuaaacuugagguuuucaucuuuuucaguuuaagucaugguuacagaguuggcagggguaucuacu

SEQ ID NO: 4146960 - RNA, 62 nt, Human
agugaggcucaacccacagggguugcuugggaacuguugcccgugaggaguuggguguuauu

SEQ ID NO: 4146961 - RNA, 130 nt, Human
agugaggcugugccaaaacaacuuugcucuucacauuucccauugcagcaacauuuaaagaaggauuauuucugaaaaugugcaugagucagaaguggggaaugaguaauucugugcuuuggacuuuauu

SEQ ID NO: 4146962 - RNA, 66 nt, Human
agugaggugauuuccuuuugcaaagucagauauugugcucugagugcuuugagaaaucaccugauu

SEQ ID NO: 4146963 - RNA, 65 nt, Human
agugagugcgcagaucuugucuuggcuaugggcugcccgucaugccauccacaucuguuucuccu

SEQ ID NO: 4146964 - RNA, 71 nt, Human
agugagugcugagauggguccauugaaagaagaaagauuucugaaguggccaauaugucaugcucuucacu

SEQ ID NO: 4146965 - RNA, 70 nt, Human
agugauaugucucucagguuuaacuuuaagcaauagauguuucaagcaaacucugagaaauaaauuagcu

SEQ ID NO: 4146966 - RNA, 55 nt, Human
agugaucugccugccuuggccucccaaagugcugggauugcaggcaugagccacu

SEQ ID NO: 4146967 - RNA, 72 nt, Human
agugaucugcucagguuaccuagcuaguaaguggcacagcugaacagguccaagguuccugaauagaggauu

SEQ ID NO: 4146968 - RNA, 67 nt, Human
agugauuccugugcuuauuccagucugggaaucaccugccgagauggaguguggccaggcaguaacu

SEQ ID NO: 4146969 - RNA, 80 nt, Human
agugauucucuuguaagcuauguucagguggucaagauaaaaaugacauuccuagcaacaugguccuacauuaaauuauu

SEQ ID NO: 4146970 - RNA, 82 nt, Human
agugauugcuucugguagaauucaauagaguugucauaucaaauuaaguuuuaucgaguuucaccagauagggauauucacu

SEQ ID NO: 4146971 - RNA, 96 nt, Human
agugcaccucauagaagcuuuuaauagucuuuauauuuacuaaagaauaggacuaacuauggaacuaugaagaugagcuggaaaugacaggugacu

SEQ ID NO: 4146972 - RNA, 78 nt, Human
agugcagaaucaguacagaacgacaaagauaaaguugcugcuccuacuuugguucuugcuucugugcaauucaguacu

SEQ ID NO: 4146973 - RNA, 58 nt, Human
agugcagcccagccccagaaccuuucugggaaggacggacagagggcuugggcugccu

SEQ ID NO: 4146974 - RNA, 89 nt, Human
agugcagggagggggccuggagggaguggggauagacacgcccccugcuugccuggcaccacagccuuucagacuccuuacccuguccu

SEQ ID NO: 4146975 - RNA, 72 nt, Human
agugcaggggcucuaaugcaugaucacuuaaggaccaccacaaaugguauuugucauucgaguucugcuacu

SEQ ID NO: 4146976 - RNA, 107 nt, Human
agugcagguaggugugacaugcaugaggcaaagaugucauugguaagacaagugaucguuuccuugagugcauaucuuuggcucauaccauuccacaacccaguacu

SEQ ID NO: 4146977 - RNA, 91 nt, Human
agugcaugcaucauuaauccucaagccuguacaaccaggacagagcauguggaaaggugugcaggcuugaggauuaggugaugcaugcacu

SEQ ID NO: 4146978 - RNA, 74 nt, Human
agugcauuugguuuagagaugucuauauguuaucugaaaguugucuguauggcuugucuuuauaccaggaagcu

SEQ ID NO: 4146979 - RNA, 65 nt, Human
agugcauuuuagcucugauucugugauuucuaaaugagugauuacaguaacagcuacaaugcauu

SEQ ID NO: 4146980 - RNA, 55 nt, Human
agugccaagguauuaauuuauauguaaaccuaucuuauaauaaugccugggcucu

SEQ ID NO: 4146981 - RNA, 115 nt, Human
agugccaggagaggaccggagcauaguuagugcuuauuaaauaguaucaugauaacaugacacauguaaaacacuuagcaauguucaauaaacucuggucccuuuccuccccacu

SEQ ID NO: 4146982 - RNA, 82 nt, Human
agugccauggcacuuuacacccauuuggcuggugaacauuacaaagcuggguaaugccaaguguugguggggcugugggacu

SEQ ID NO: 4146983 - RNA, 81 nt, Human
agugccccaggucaggaggccucugccauuucccaauucugacgggaagugauggagaaaagccucuuccuugugggugcu

SEQ ID NO: 4146984 - RNA, 129 nt, Human
agugccccauggccaaauauucuugcacugucuuccuuggaucuuuccuaugauuugugcacauacugcagugaaaauggcaaagagagauccugcagggauugguaauuuuucaccguggguggcacu

SEQ ID NO: 4146985 - RNA, 70 nt, Human
agugccuggugcccuuaagaugagaacagcaauaauaaucacaccuuucauguaccguguaccaggcauu

SEQ ID NO: 4146986 - RNA, 126 nt, Human
agugcggcagguuuucuucaguggcauguaaugguacuuucugauuuuaagcucuaauuuaucucgcagauuaaagcaaugaaaggggucagaaucuauugguguuaagaagucagccucagcacu

SEQ ID NO: 4146987 - RNA, 62 nt, Human
agugcgggugcucaugccugaguaaaaaugauagcaguuuuaggaacaaagagccucacauu

SEQ ID NO: 4146988 - RNA, 104 nt, Human
aggaaccaggaagcucucugagcugaacaauggucucuguuuggggcuggcaaggguucaucuuuucugauucugcagagacccugugaguuuucuuuguucuu

SEQ ID NO: 4146989 - RNA, 65 nt, Human
aggaagaacagauaauggacgcuggaagcccuuucuugccuggcaccgguuaaucuguuuuuucu

SEQ ID NO: 4146990 - RNA, 65 nt, Human
aggaagaccacccccuacagcacacuugcauaaaaacauguccugagggugguuggucacagccu

SEQ ID NO: 4146991 - RNA, 87 nt, Human
aggaagagaaggaagaugugggugucuucagcugguaaacucaacauuguuagcucugacaaaggccacuuacacuaggcuuuuccu

SEQ ID NO: 4146992 - RNA, 76 nt, Human
aggaagaggagcacacacauuucucuuuuuguaaguuagaaacguuaaauaagugacauguuuuacucuucauccu

SEQ ID NO: 4146993 - RNA, 63 nt, Human
aggaagaggugugcaauggugucuuuggaguccaaaaaaugcugauaucuucauuccuuuccu

SEQ ID NO: 4146994 - RNA, 61 nt, Human
aggaagaguguuaccuauggguaccuuguaguucaggaaggaccugggaaaaccuuuuccu

SEQ ID NO: 4146995 - RNA, 65 nt, Human
aggaagauaauuucagaaaagugauacgaacgugauaucaaaguuucccagaaguugucuauccu

SEQ ID NO: 4146996 - RNA, 86 nt, Human
aggaagcaccuguguucuuuucucuaaacugauaaacuaaugucuauuuuuaccuggaggaaaagaaaaucaacagaugcugaccu

SEQ ID NO: 4146997 - RNA, 62 nt, Human
aggaagccacgaguggcacgggucugcuguuuuugaaggagauggugcaguccugguuuccu

SEQ ID NO: 4146998 - RNA, 57 nt, Human
aggaagccuggggcugcccucgugucacccagucauuggaaagucucagugccuccu

SEQ ID NO: 4146999 - RNA, 75 nt, Human
aggaaggacauaaggaauucccuuucugacagaacucguugguuacuuguuaggaauuucuacuauugccuuccu

SEQ ID NO: 4147000 - RNA, 73 nt, Human
aggaagggaaguauuucguucugaaaaaguauuuuacccaaacuggagugcucagugagaugcuccccucucu

SEQ ID NO: 4147001 - RNA, 69 nt, Human
aggaaggggguuaacugggugccaggccugggcuuccacggaacaggcuucaucucguugacaccuccu

SEQ ID NO: 4147002 - RNA, 61 nt, Human
aggaaguaaaguggagucccuacaaccagcugggugacuuuagccaagggacuugcuucuu

SEQ ID NO: 4147003 - RNA, 79 nt, Human
aggaauacuagaccaagugucaggagacuuggauucuacuccuggcucugccacuaacuugguauuuccugguuuuucu

SEQ ID NO: 4147004 - RNA, 58 nt, Human
aggaauauauuuggaauaugugacgcuaaucuagcuuauugcauccaaaugcauuccu

SEQ ID NO: 4147005 - RNA, 80 nt, Human
aggaaugaaagaugcucccgugccuccgccuuggcgccgucuucccuccacacgccagggcaggggagcaucugccuccu

SEQ ID NO: 4147006 - RNA, 59 nt, Human
aggcugcgagcucuuguucugagagcccucuggccucucagaaccucaguuugcucucu

SEQ ID NO: 4147007 - RNA, 75 nt, Human
aggcugcugccugguuuuuguaguccaucgaugucuucuuccugggcucacagccaaggcuccauaucccagccu

SEQ ID NO: 4147008 - RNA, 56 nt, Human
aggcugcuggaggauuuaugccuucaguguggcuucuguaaguucuuaggcagcuu

SEQ ID NO: 4147009 - RNA, 73 nt, Human
aggcuggagugcaauggcaugaucuuggcucacugcagccucugccucccagguucaagcgauucuccugccu

SEQ ID NO: 4147010 - RNA, 77 nt, Human
aggcuggagugcaauggcgugaucuuggcucacagcaaccucugcuucccggccggguucaagccauucuccugccu

SEQ ID NO: 4147011 - RNA, 73 nt, Human
aggcuggagugcaguggcgugaucucggcucacugcaaccuccgccuccuggguucacgccauucuccugccu

SEQ ID NO: 4147012 - RNA, 79 nt, Human
aggcuggagugcaguggcgugaucucugcucacugcaaacucugccucccggaaucacgccauuguccugccucagccu

SEQ ID NO: 4147013 - RNA, 73 nt, Human
aggcuggagugcaguggugggaucucagcucacugcaaccucugccuccuggauucacaccauucuccugccu

SEQ ID NO: 4147014 - RNA, 63 nt, Human
aggcuggagugcaguugcacagucuuguugcgaguacaggcguugagcuacugcacccagccu

SEQ ID NO: 4147015 - RNA, 83 nt, Human
aggcuggauaggcagaggucagagugagugagcgacaacccugagucucauucucagacucuuggccucagcuucuccaucuu

SEQ ID NO: 4147016 - RNA, 57 nt, Human
aggcuggcauacauuuguucuuucuuuugccagaacaacccaucgguguggcagcuu

SEQ ID NO: 4147017 - RNA, 76 nt, Human
aggcugggaaggcgguuggggcagcuugggggcagcuccagaguugccaggcucagccccuaucuucuucccuccu

SEQ ID NO: 4147018 - RNA, 58 nt, Human
aggcugggcggugcagcagagugaguggaguuccacggacccugaggcuccccagccu

SEQ ID NO: 4147019 - RNA, 101 nt, Human
aggcuggggacuagcagaauagaggaguuugcuggugugugcaguggcccccacgccuaccaguaggagcucuugggguuuaucauaguccaguccagucu

SEQ ID NO: 4147020 - RNA, 58 nt, Human
aggcuggugccugcagugaaucauauaauuaauuugguauuacaugacacuccagccu

SEQ ID NO: 4147021 - RNA, 87 nt, Human
aggcuggugcugacauuuggguucccugacagcgaugcugccaaaaucagugaugcagauuagggaaucugccaggcccucaagccu

SEQ ID NO: 4147022 - RNA, 64 nt, Human
aggcugucaccuggcaaccucuguguuucuuuucccaaggccacagcuccagucaggugacccu

SEQ ID NO: 4147023 - RNA, 64 nt, Human
aggcugugaaauguggcaaggagauucaaggaccucauucaaaggcucacguuugcauaugcuu

SEQ ID NO: 4147024 - RNA, 72 nt, Human
aggcugugaguaguucuuguugaaucauuuuacuggcaguaaaccagaugaagauacaagaacuccacacuu

SEQ ID NO: 4147025 - RNA, 87 nt, Human
aggcugugaguuucuuuggaaggcaggcuucugauuagguguugccaaaggcucugccuaaacguuuguuuucuguugauggagucu

SEQ ID NO: 4147026 - RNA, 100 nt, Human
aggcugugguccaggugcaucuugugcuucuucuuuagcuacucacaagaggugagcugagguugaagagugaacgaagguagguguugaucaacagucu

SEQ ID NO: 4147027 - RNA, 56 nt, Human
aggcuuagaaaggguaagugacuuucucaaacagaguguuaccuagagcugggccu

SEQ ID NO: 4147028 - RNA, 92 nt, Human
aggcuuagagcuaauuagucuguuaucugguagagcacuaauguacauggcugauuuaauauacagauuaacagauuuaaagcuuuuacccu

SEQ ID NO: 4147029 - RNA, 61 nt, Human
aggcuucagacaaauguuauggauggauuguauaucucccagauucacauguugaaguccu

SEQ ID NO: 4147030 - RNA, 55 nt, Human
aggcuucugagcauggaguuuugcaaagacagaaacaccaaugugccuggagccu

SEQ ID NO: 4147031 - RNA, 69 nt, Human
aggcuuguucuggggagauuuguuuuggaacuucaacucuguucugaagaauuccuaggaacuaagcuu

SEQ ID NO: 4147032 - RNA, 64 nt, Human
aggcuuuccaggacuucauggcucugaaucagaauuucagaggugcaagaaguucugaaagccu

SEQ ID NO: 4147033 - RNA, 64 nt, Human
aggcuuucucuguggugaggagggugcaauagaaaggcaucuggucgccccgugggagcagccu

SEQ ID NO: 4147034 - RNA, 70 nt, Human
aggcuuucuuaggucagguaucagcagguauuguucaauguccacugccucucaggaugcuugacagcuu

SEQ ID NO: 4147035 - RNA, 65 nt, Human
aggcuuuuuucuccgaguggucugucuuaggaaaauguuugauuaucuuggcuugaaagaugcuu

SEQ ID NO: 4147036 - RNA, 129 nt, Human
agggaaaauuuaggcaagaaucuuuauugagguuuccuuggucaaacgugaggcagggcagggugagcagguuuagaauuggcuagugggaauacuuucaaugggcuuugggguguagggguugucccu

SEQ ID NO: 4147037 - RNA, 82 nt, Human
agggaaacccaguugcuuggguggauccagacaaaauggauuuucauccuuggauuuugugcccacgccucugggucaccuu

SEQ ID NO: 4147038 - RNA, 80 nt, Human
agggaaagcuaagagcuugaagcaucuguaauuggcauucaaagccauucauaguacaguucuagcuuuuacauuuuccu

SEQ ID NO: 4147039 - RNA, 76 nt, Human
agggaaaguaagcauuucauuaacucugugaaauuuguauguugagucagaaaauaaaugaaugguacuuuacccu

SEQ ID NO: 4147040 - RNA, 86 nt, Human
agggaaaucaaggaaggcuucauggaggaggugaguccugaacugauucagauugcacuaauauucauaaguagcuugauggcccu

SEQ ID NO: 4147041 - RNA, 65 nt, Human
agggaaaugaggcuggcuuuuuacuuguaguacucuacaacaguaggaaaacaugucuagucuuu

SEQ ID NO: 4147042 - RNA, 86 nt, Human
agggaacauggagucuaauggacugacucagugcugccaguuauaaaaugagaagccuugagcaguucacuuggucugugugaccu

SEQ ID NO: 4147043 - RNA, 55 nt, Human
agggaacauuugcacuguuggugggaauguaaacuagacaguguggagauuccuu

SEQ ID NO: 4147044 - RNA, 61 nt, Human
agggaaccugcuucaggaagugauaggucugauauuucccaaagauuuccugcaagccccu

SEQ ID NO: 4147045 - RNA, 74 nt, Human
agggaacuugaaggauuauucuagaccuaaucuccauaguccccugugguaggcagaauaauuccuccuucccu

SEQ ID NO: 4147046 - RNA, 72 nt, Human
agggaagaaguuaaauaaauggaccaggagugguuuuucaugguaccauguugcuuugauuugcacuucucu

SEQ ID NO: 4147047 - RNA, 129 nt, Human
agggaagaaucacuugggagcuuuuaaaaauaccuuuccaggaccccauauucacugaaccagaaucucuggggauuggagccugggguucgagauuuuugacaaguuccuaaggcgauucugauuucu

SEQ ID NO: 4147048 - RNA, 74 nt, Human
agugcgguuuugggguuuacaagagcugauggauguaaagugcuuagaagaaugccuaggacagaguacgcacu

SEQ ID NO: 4147049 - RNA, 88 nt, Human
agugcguguuaaaacaacaaaccacugcaccagcucauaugugcaggcugagugagcugcauggagcugucugcaugguuuacguacu

SEQ ID NO: 4147050 - RNA, 55 nt, Human
agugcuaaaggaucacagggucaaguagaacacaggaccauguugccuuuggccu

SEQ ID NO: 4147051 - RNA, 72 nt, Human
agugcucaugaggcuuaauuaucagugaaaugucuugcuuuagauuucacagcuuaauaaggcucagagacu

SEQ ID NO: 4147052 - RNA, 82 nt, Human
agugcucauuauauuguagagagggccuuuggagcucucauuagauuugacaggaauucucucuagggggaaacugggcauu

SEQ ID NO: 4147053 - RNA, 77 nt, Human
agugcuccggaccuggcugacucauggggcucccucgaaccccuuacuuguggccagccccauggacaguucccacu

SEQ ID NO: 4147054 - RNA, 61 nt, Human
agugcucucugagugagggacaagcuggauucagggccagcugguucucaccaggggugcu

SEQ ID NO: 4147055 - RNA, 68 nt, Human
agugcucuugggagagaauaaucaauagguugguauugauuugcuaaucauuauucuguccuggcauu

SEQ ID NO: 4147056 - RNA, 61 nt, Human
agugcugagccuuuucuggggggcacugguuuagacauugugccccuuagggguuaagccu

SEQ ID NO: 4147057 - RNA, 68 nt, Human
agugcugaggccauacuccauaccaauuaaaauagaaucuguuggguaggaucagugguaucaguauu

SEQ ID NO: 4147058 - RNA, 87 nt, Human
agugcugagggauggaguuuauauagagaguagaguagagaguguggucacuauugaauuaacuauuaaaguuuaucuuuuguuacu

SEQ ID NO: 4147059 - RNA, 59 nt, Human
agugcuguggcuuucauggaggaaacaggacucacuucuagccuccaaguccccagccu

SEQ ID NO: 4147060 - RNA, 65 nt, Human
agugcuuaguaaauugucgauguuaauauuauuaaugaaauuuaauccugacaaugacaagcacu

SEQ ID NO: 4147061 - RNA, 57 nt, Human
aguggacauucugcacuuggagugagcaagauaaacuccaggcugaugaugucaacu

SEQ ID NO: 4147062 - RNA, 65 nt, Human
aguggaggcucagaaagaggagauguuuggcaagccucccaaauucauuucauugugucuucacu

SEQ ID NO: 4147063 - RNA, 71 nt, Human
aguggauuaccaagaaauuucuuaagaacuaauuuucuauacuggauuagugaaguuucuugugguuuauu

SEQ ID NO: 4147064 - RNA, 66 nt, Human
aguggcaccagcggcaugcaagcccagggcugccugauucuggacuccaugcugccuggagcuucu

SEQ ID NO: 4147065 - RNA, 62 nt, Human
aguggcagagcugguacuugagccugggucugcuugguucuaaagcucaagcucuugccauu

SEQ ID NO: 4147066 - RNA, 60 nt, Human
aguggcagggcuuugcuguucuucacucucagcccccugaaagcaguucuuccugccucu

SEQ ID NO: 4147067 - RNA, 119 nt, Human
aguggcccagguaugugaugcuccggacucugcaguggcccagcuugcaggcuucaaacagaggugcuccccaggaccagccuuugagcaagggcugcguagagacaggccugggcucu

SEQ ID NO: 4147068 - RNA, 55 nt, Human
aguggcucacgccuguaaucccagcacuuugggaggccgaggcaggcggaucacu

SEQ ID NO: 4147069 - RNA, 55 nt, Human
aguggcuccugccugcaaucccagcacuuuagaaggcugaggcagguggaucauu

SEQ ID NO: 4147070 - RNA, 62 nt, Human
aguggcugcuaugaucaggacaacuaacgugguugaacuagaauggaucuuaggaagucacu

SEQ ID NO: 4147071 - RNA, 58 nt, Human
aguggcugcuggaguggagaugggaauggguaggacuuuagccgcuccaguagccauu

SEQ ID NO: 4147072 - RNA, 67 nt, Human
aguggcugucuuccaaaaucugcaacguauuuuauaaacguuauuacugacuugguaagcggccauu

SEQ ID NO: 4147073 - RNA, 55 nt, Human
aguggcuugugaaaagcuggugacucucagagcgccugccuuuuggaggcacauu

SEQ ID NO: 4147074 - RNA, 115 nt, Human
agugggaaaugaggagugagguagggagaggaaggaaugugccucaacaugaaaacacugaggaucauuuugaugcccuuuuaguuccuuaccuacuaacaucucuaguccuauu

SEQ ID NO: 4147075 - RNA, 98 nt, Human
agugggaggaucccuugagcucaggaguuggaggcuacagugagucaugauugcaccacuguacuccagccugggggacagagugagauccugccucu

SEQ ID NO: 4147076 - RNA, 63 nt, Human
agugggagguggagacacagcugaaggcugccaacaaaccuuagcugccagaccauucuuacu

SEQ ID NO: 4147077 - RNA, 56 nt, Human
agugggauagcugggugucagaauucuguuuccguucuuguccuugcucucccacu

SEQ ID NO: 4147078 - RNA, 75 nt, Human
agugggcucccucacauaccuguuuucccuuuauuuguguuauaaggggauggauauguagagaaaggagcuccu

SEQ ID NO: 4147079 - RNA, 71 nt, Human
agugggcuguaaauaacugguaauugggguuuuugguggacaaaauuaccuaguuauuuucucugcccgcu

SEQ ID NO: 4147080 - RNA, 66 nt, Human
agugggcuugacugaaauaguucauuuaggaugagaacuuuguguauaguugagucaaguuucacu

SEQ ID NO: 4147081 - RNA, 64 nt, Human
aguggggaggaaaggcucccucccucugcaccagucuuugcagaggguccuuaccuuccucacu

SEQ ID NO: 4147082 - RNA, 63 nt, Human
agggcauuggcacagaucugcuuucacccugagucucucuaggugucucuguguccaugccuu

SEQ ID NO: 4147083 - RNA, 81 nt, Human
agggccagacuugaauaucuguuguccaugcagaaagugacccaagucauuuccucaacacucagaaacauuuaaagcucu

SEQ ID NO: 4147084 - RNA, 79 nt, Human
agggccauauggcugagaugggcuccaggcuaggguugggugaggguugaugcuugguccacucaguccagaugccccu

SEQ ID NO: 4147085 - RNA, 63 nt, Human
agggcccuucucagagcauggcccuuugccgcugcauaggucauguguccaggagguagcccu

SEQ ID NO: 4147086 - RNA, 66 nt, Human
agggccgugucuggcuggcuggcuggcuggcuggcuggcuggcuggcuggcuggcugaccggccuu

SEQ ID NO: 4147087 - RNA, 130 nt, Human
agggccuccaucugucugccuggaacauguggucucaucaguguggcaguucacuguggcuagagcucauuagagaaugugcugacauugacuaccggccccuacguucaauucuuuucuugaggcuccu

SEQ ID NO: 4147088 - RNA, 57 nt, Human
agggccugagcucuccuccagugcgggcgucuuauucuggaugaugccucaggcucu

SEQ ID NO: 4147089 - RNA, 94 nt, Human
agggccuggugcaggaagggcgggugacggggguguccuggagcuggagaacagcagccagcccuguuuaugugucacuuguaaaggugucccu

SEQ ID NO: 4147090 - RNA, 68 nt, Human
agggcucacuccaaauaucaccuguucaguaggcuuuccaauagcacugaagaugucuuaguggcccu

SEQ ID NO: 4147091 - RNA, 69 nt, Human
agggcucuuccuuugccucucagcugcucuucccuggaggguugugggggaggcaaggaaaggggcccu

SEQ ID NO: 4147092 - RNA, 83 nt, Human
agggcugaagucauccacuaugggggagagcagcuggccauucccaggauccuucccauugcauagauggcuguguuaguccu

SEQ ID NO: 4147093 - RNA, 87 nt, Human
agggcugaagugggggagggcaaggacaggggaaaaggucacaacaugacccuuaauuucccuuugcacucuacaauuucagacucu

SEQ ID NO: 4147094 - RNA, 96 nt, Human
agggcugaguaggaagggucugaggaacuccuauaauuguaauuccaguuaccucaauuggugagcucuuuagacugggacguuuauucuggcucu

SEQ ID NO: 4147095 - RNA, 64 nt, Human
agggcugcaaugguagugacucccccagggcugccucagcccgcaucucgcuaaagauagcccu

SEQ ID NO: 4147096 - RNA, 66 nt, Human
agggcugcuccuuugucagcuggaggugcggagagucuugucugggcuggcacugaggagagcucu

SEQ ID NO: 4147097 - RNA, 57 nt, Human
agggcugcuuugcuaaauauggaagcccaugugacacuugacuuagcaaaaggcuuu

SEQ ID NO: 4147098 - RNA, 75 nt, Human
agggcuggcccugggugggacucugcauuaggcaguuuucccugccaguuuuuccccucaggcagccagugcccu

SEQ ID NO: 4147099 - RNA, 61 nt, Human
agggcugggcacugugcaagguauuuuaaaucuuauauagcauuguacagcaaccaacccu

SEQ ID NO: 4147100 - RNA, 105 nt, Human
agggcugggccuggaauccauggcuugggaagggcccuguguacaaccacugaccguuggaagugaauauuguccuucuccaccacccgugccaggccugccacu

SEQ ID NO: 4147101 - RNA, 56 nt, Human
agggcuggggagacacaggugggaagugaaaucccagcucccuguuuccucacucu

SEQ ID NO: 4147102 - RNA, 56 nt, Human
agggcugguauguccaugaaagucccaugguggaaggacucucaggggcuagcccu

SEQ ID NO: 4147103 - RNA, 67 nt, Human
agggcuuacaguucuuccccuuucucuuuccaguuggcuggaaggcagauauaaagacuagagcucu

SEQ ID NO: 4147104 - RNA, 73 nt, Human
agggcuucuucacccuucucuucauuuccagagagccaaucccagaggauggagagaagggauuccaggcccu

SEQ ID NO: 4147105 - RNA, 60 nt, Human
agggcuugccauugccuguuagagauccuuuggguccguucagaagcaaggcagguaccu

SEQ ID NO: 4147106 - RNA, 72 nt, Human
agggcuugguuuucucagcuggaccaugauccuauuuuuauguuugagcucagagaacaugauuaaugcccu

SEQ ID NO: 4147107 - RNA, 130 nt, Human
agggcuugugagacgaggacgcugggcugagaagauagggcuucacuaggcggagggccccaggguaccccauacacaagccugccuuggcuucucguccaauuuggugcaucucacacuacacagcccu

SEQ ID NO: 4147108 - RNA, 74 nt, Human
aguguuauuuauuguuucauaaaacuuccaauuagugaaucaacugggaaccuugauagauaguuauuagcacu

SEQ ID NO: 4147109 - RNA, 56 nt, Human
aguguucaauuugagcucaaaggcaucugcaaguaauugaggagauauugaauacu

SEQ ID NO: 4147110 - RNA, 105 nt, Human
aguguucccugggccucauugcacuuuggguccaggacaggcagcugcugcucuuuggccuucguccuggaauccuagaacagugucagaccaggguuggacacu

SEQ ID NO: 4147111 - RNA, 130 nt, Human
aguguuccguggagaaauggagguuguucacaggaaagccuuucccuugaagaggggcaaagguugcuucuucucaaggggcagguggaauuuagguuuuaacuuucuuugcaagauccaccccaacauu

SEQ ID NO: 4147112 - RNA, 83 nt, Human
aguguugcaugaaaauaucuuguauagcccuggcacauacaaagugcucaguaaaugguacguauauuuuuaucauuaacauu

SEQ ID NO: 4147113 - RNA, 69 nt, Human
aguguugcuauauuuauugucuuuuaaauguuguaucauacccaggagagagacagagaaaguaacauu

SEQ ID NO: 4147114 - RNA, 69 nt, Human
aguguuggcuggccaccucacagccagaucuuccuccucucugcuaauagagguggccauguccagccu

SEQ ID NO: 4147115 - RNA, 64 nt, Human
aguguuggggcaaucuugggggggauucuucucuaaucuuucagaaacuuugucugcgaacacu

SEQ ID NO: 4147116 - RNA, 101 nt, Human
aguguuuccuuucaaccuaauuuuaacugguaauugcuucuccaugguuccucuggagaaucugucagugugguagugggaacaggggagaaggaaaaacu

SEQ ID NO: 4147117 - RNA, 90 nt, Human
aguguuucuuggacuuucuaggguagaggaaaaaugggacaaugaaauaacucuuuuauucuuuuaugucuguuggagucuugaaacucu

SEQ ID NO: 4147118 - RNA, 72 nt, Human
aguguuugggggccuuguaacagauagugaaaaggugguaugaucaauagcuugcagguguguccaagcacu

SEQ ID NO: 4147119 - RNA, 83 nt, Human
aguguuuggggguguccgcugccgcucagcgcccucugguccccacccaagaggggaagggccgcagccacccucugggcacu

SEQ ID NO: 4147120 - RNA, 55 nt, Human
aguguuuggggugauuguaaccucauuauuuuugacacuagcugccccgaaugcu

SEQ ID NO: 4147121 - RNA, 85 nt, Human
aguguuuucuccaguacagcugcagcagccuguucaaccgugugacauucagcaggcgguagcugccacuuccccgaaggcugcu

SEQ ID NO: 4147122 - RNA, 56 nt, Human
aguguuuuucaggagcagaacagggauuaauugaucuuuugucucugaauaauauu

SEQ ID NO: 4147123 - RNA, 63 nt, Human
aguuaaccuggaggacugcaauccaugugcuagcccacauggccauucaucgacuccagcacu

SEQ ID NO: 4147124 - RNA, 78 nt, Human
aguuaacuccugucuguauuauucaccacucugcccccaacuccuauaagaguggcuaugcaugacuggaauauaacu

SEQ ID NO: 4147125 - RNA, 80 nt, Human
aguuaagaaaguguggagauugaacuaaaacuuaggccuucuggcuucuaauuuaguucuaucuuuauaguuacauuacu

SEQ ID NO: 4147126 - RNA, 76 nt, Human
aguuaauaagcugaggcucuggcugcagaaccugaacucuuaaccccucugcagaauugucucaagcuagauagcu

SEQ ID NO: 4147127 - RNA, 130 nt, Human
aguuacagaucacccacucauuuccuaggaaucuuugcccagagacucagccuccagucagaggaggcaccacucaucucuggggcgggugggauuuuaccaaggaagagucaggucguucuguuuuccu

SEQ ID NO: 4147128 - RNA, 94 nt, Human
aguuacaggugggcccugcgccugcugcauccucacccuugugauggggcgacacuugggagggugugggcagcuguaaagggcacuggagacu

SEQ ID NO: 4147129 - RNA, 77 nt, Human
aguuacaucaucuacagaauggagggucagagauaccugaauacguauuuaagaucuaucccauuuuguauguuacu

SEQ ID NO: 4147130 - RNA, 59 nt, Human
aguuacauucugagcugaguaguuuaaaaccacuauuaagcucuccaggaaauguaucu

SEQ ID NO: 4147131 - RNA, 84 nt, Human
aguuacauuuuccuucugaauucaccauguucuccagaagguaggcuugugaacuuccagaugauaaacaaggagacuguaacu

SEQ ID NO: 4147132 - RNA, 62 nt, Human
aguuacccugucuguauugguuugcuaugguugccauaaaauauaucacagacugggugguu

SEQ ID NO: 4147133 - RNA, 78 nt, Human
aguuaccugagugcuacccagucucugucaauuucguacaucagagucucccagcaccugguguagcacucaggugcu

SEQ ID NO: 4147134 - RNA, 73 nt, Human
aguuacucacugaggguuuauuuugauauuaacuacuuauuuuccagugucuaccaaccgucuaguaguaauu

SEQ ID NO: 4147135 - RNA, 77 nt, Human
aguuacugagucccccccagguuugccacacugaaccagaaacaccagugagggccuugggaggagggucagaaacu

SEQ ID NO: 4147136 - RNA, 62 nt, Human
aguuagaaggaauucuagaagguuuuguuuaagauaacaaaaguguaggaauuccuuaugcu

SEQ ID NO: 4147137 - RNA, 89 nt, Human
aguuagauaaagccccugauaguugcuacccugcaaacuuaauguuucucuagcagcuugcacacauauuagacgguaaauauuucacu

SEQ ID NO: 4147138 - RNA, 72 nt, Human
aguuaggagaagguaucucugaucuccgagauacaaugcauggaucgcgaucuugaaauaucuuuuccuacu

SEQ ID NO: 4147139 - RNA, 77 nt, Human
aguuagguaaaaauauguuuuccaguugucaucuuaaaauagagacacagaacacaaaagcauagguaagccuaauu

SEQ ID NO: 4147140 - RNA, 55 nt, Human
aguuaguaugcaguuggccagaauaacucuuuuuccccgcugccugcaacugacu

SEQ ID NO: 4147141 - RNA, 65 nt, Human
aguuagugcauguaaugugcuuagagcgugccuggcaugccagaagugcuuuauaaguguuaacu

SEQ ID NO: 4147142 - RNA, 68 nt, Human
aguuagugugcucugguugccaugcugugaacgguuaagugcagugagguauuaccagggccaggacu

SEQ ID NO: 4147143 - RNA, 76 nt, Human
aguuauaaggcuugauauuuacagucuuuauagaaguaaaggaccccauguaauuaucaaauaguccuagguagcu

SEQ ID NO: 4147144 - RNA, 108 nt, Human
aguuauaauugaauuaaugauaugggcaagugugagacacacaaaauuaacauuugaagaggccugguuuaauuuugucuuuuacauauuugugucuccaauuauacu

SEQ ID NO: 4147145 - RNA, 82 nt, Human
aguuauaggguacauguacacaaugugcagguuuguuacauauguauacaugugccauguugguguacugcacccauuaacu

SEQ ID NO: 4147146 - RNA, 68 nt, Human
aguuauaggugguuuugagaauacuucuuuccaguuugggucaagagugaucagagcuuuauauagcu

SEQ ID NO: 4147147 - RNA, 71 nt, Human
aguuaugaagauuuucggguacuugauaaacaucuucaucuguguauuuaugaccgaagauuuucccagcu

SEQ ID NO: 4147148 - RNA, 110 nt, Human
aguuaugccuccuuuaaagcaagacagaccacgugacagggccccaggaucgauuuuuaugcacuaagggcucugcgcacgguucuuuuugcaaaugaacuggugugucu

SEQ ID NO: 4147149 - RNA, 129 nt, Human
aguuauggcuuuuguguucauucuucaaguauucugugauuuguguuuaauacaaggaccucccagaccugacauugcaaggguagguuuaaauauaaauucuagauguugagaggugauauaugaccu

SEQ ID NO: 4147150 - RNA, 56 nt, Human
aguuauucagggacauuuacucuaagaagcaagagauuugguggccugcaguggcu

SEQ ID NO: 4147151 - RNA, 66 nt, Human
aguuauucagugaauuucaggucaagagucagucaugauuuuugcccugcaguacauaaauuggcu

SEQ ID NO: 4147152 - RNA, 62 nt, Human
aguuauugaguaucuauaaugugcuacauaguaugaaaagugcaagggauacuacauugacu

SEQ ID NO: 4147153 - RNA, 127 nt, Human
aguuauuuacagugugaagagugcucugagauugaauuucucagcauaucaaaaccaagucagccuguuauugauggcugugauuuacucagugagcaaaaauuucucuacuaacaauguuauaucu

SEQ ID NO: 4147154 - RNA, 57 nt, Human
agguggccaagacuguuugacaugugacccaggucccagacccucuagaggccaccu

SEQ ID NO: 4147155 - RNA, 107 nt, Human
agguggcgaaggcuguggccacaccauggucucagaugcugaggcaggccuaugugacugccaguggguaggccauggugaguggagaaaacaggcaguuguccccu

SEQ ID NO: 4147156 - RNA, 83 nt, Human
agguggcuaauguuuccaucaaauuugaugacccucuaaauucaggcuagaguuauuacagagugaugugacuugguccaccu

SEQ ID NO: 4147157 - RNA, 126 nt, Human
agguggcugacauuuuuagcccccggggugggaugucacagacggcuguuuuuacguugucggggaaccagucagcaaaguagcugcuguucuuaucuugaauguugaacauuuguucauccaccu

SEQ ID NO: 4147158 - RNA, 92 nt, Human
aggugggaaguaggagugagacacaaacacauuuagaggagaugacaaggauccuuugcauuuauguguccauuuuuaaacuguucugcacu

SEQ ID NO: 4147159 - RNA, 56 nt, Human
aggugggccucgagcauccccugggcugugucagcacagggcucugggccuggccu

SEQ ID NO: 4147160 - RNA, 61 nt, Human
aggugggugcagggggcuucuuagggcucuccaaauacuccuuagccaccccugaccuccu

SEQ ID NO: 4147161 - RNA, 84 nt, Human
agguguagcucauauuccagaguuuccuguaugagcaggcuaaaauuacugaccacaggacucucugaaaauguaccuauacuu

SEQ ID NO: 4147162 - RNA, 71 nt, Human
agguguauuuccucagggcugcuucuugcuuguucucagagaaguuggccaaucacugacaaaaugcauuu

SEQ ID NO: 4147163 - RNA, 79 nt, Human
aggugucaguggugucuaaaguauagugauaaaugguucaggaugaauguuugucaucccuuuugaaacugagacacuu

SEQ ID NO: 4147164 - RNA, 63 nt, Human
agguguccaggaagaugcuggccuggccaagccauuugucugggcccuucuugcuggaggccu

SEQ ID NO: 4147165 - RNA, 60 nt, Human
aggugucuggauggguguccuugugaacuguggcucugaggacacccugagacagaacuu

SEQ ID NO: 4147166 - RNA, 79 nt, Human
aggugugugugagugugugugcgugugugcauguguguguguguguaugcaagugccaugugcacagugccaaccaucu

SEQ ID NO: 4147167 - RNA, 63 nt, Human
agguuaaacuuccugcagggcuuucucugaagucacagccauuaguucugcagaggcaaaccu

SEQ ID NO: 4147168 - RNA, 83 nt, Human
agguuaaggaaauuguucccuaaauguagcauugcucggauugacagcugcugaagugagagaauugcagguuucuuaaaccu

SEQ ID NO: 4147169 - RNA, 65 nt, Human
agguuacaugaucugugugacuuugcuagggcugccguaacaaaguaccauagauuggguggcuu

SEQ ID NO: 4147170 - RNA, 102 nt, Human
agguuagcaggugauggagcuggugauuguguuugugcauaucugagggugugauaagccccagcugguuuuagcacaguuagcucucagugcuugaguccu

SEQ ID NO: 4147171 - RNA, 60 nt, Human
agguuagugcugaaaugacaugggaacuagaccauuucuaaacuggauucagccuggcuu

SEQ ID NO: 4147172 - RNA, 55 nt, Human
agguuaugaagugguagagcugagaucuggaccagcucugaugacuuuacaacuu

SEQ ID NO: 4147173 - RNA, 66 nt, Human
agguuauguuuuauuuucugcuuauaacaagcaagcuuaugagcagucagacaagcaucacugccu

SEQ ID NO: 4147174 - RNA, 77 nt, Human
agguuauuggaagaaaacuucauggccgaagaaugauaaagaucguuuucuucacuuugcaaguugcucagaaaccu

SEQ ID NO: 4147175 - RNA, 120 nt, Human
agguucacuuggggaguuuguuaaacagugcagauucccgggccucucccuagaaauucugauuuaguaaauuuggguugggcccagagaauccacagguuuaagcuucccggggauccu

SEQ ID NO: 4147176 - RNA, 78 nt, Human
agguucacuuuauacucaguuuccugcuaaaaguccuggcuuggagucagcagggccugagugaccuaacuguggccu

SEQ ID NO: 4147177 - RNA, 55 nt, Human
agguuccaucaccugcaguggagagcaagugcuguccucugcagugagguggccu

SEQ ID NO: 4147178 - RNA, 113 nt, Human
agguuccucaaaaaaaccucugucuguuuauucaucaguuaauguaaguauguagcaucauugcuucuuuaaaugauagucaacaaggagagagaauaaugaggacaggaccu

SEQ ID NO: 4147179 - RNA, 71 nt, Human
agguuccucuuccucuggccugaugccaccucaccccaauuuccaaggcacaggcucugcuagaggagccu

SEQ ID NO: 4147180 - RNA, 96 nt, Human
agguuccuugaugugccuuucaggaacaaggccuaugggacucugugacucaggaacacaguacuuuuccugauggcaaggcagcaucaagauccu

SEQ ID NO: 4147181 - RNA, 93 nt, Human
agguucugugauuagcuaugugauuuaaacaagguuggauaaguuucuuacuguuguaauacuuagaucacugaauagucuuguugagaaucu

SEQ ID NO: 4147182 - RNA, 73 nt, Human
agguucuguuuuaggaacauucgucuuguagagguaagaagacugcuucaagaaucuuccugaccacuaaccu

SEQ ID NO: 4147183 - RNA, 56 nt, Human
agguugaccgagcaaguggccaccuuauuggcucucaagcacuugcuggucuaccu

SEQ ID NO: 4147184 - RNA, 77 nt, Human
agguugagguggagaaggaggagggggcugcuguggcgggggcagaggcggcauccccacuuccuccugcccggccu

SEQ ID NO: 4147185 - RNA, 106 nt, Human
agguugcauuaauuuauacucccaccugcagaguacuucagggucucauccauucuuugaagccauuacuguguuagggggcacugucuuuauucaugaacagccu

SEQ ID NO: 4147186 - RNA, 79 nt, Human
agguuggagugcaauggugaguucucagcuuauugcaaccuuccccucccagguucaagcaauucuccugccucagccu

SEQ ID NO: 4147187 - RNA, 76 nt, Human
agguuggcgcuaaaguauuugugauuuuuaccauugaaaguaauggcaaaaacugcaauuacuuuugcaccaaccu

SEQ ID NO: 4147188 - RNA, 72 nt, Human
agguuggcuaugagagcuuuagugggugcauaaagaauaucacuaauccgccaggcuugguagcucaugccu

SEQ ID NO: 4147189 - RNA, 76 nt, Human
agguugguacaaaaguaauuacgguuuuugcuuuuaaagguaauggcaaagauugcagucacuuuugcaccaaguu

SEQ ID NO: 4147190 - RNA, 92 nt, Human
agguuggugcaaaaguaauugcgguuuuuaccauuauuuaacuuuugccauuacacuaauggcgaaaaccacaauuacuuuugcaccaaucu

SEQ ID NO: 4147191 - RNA, 80 nt, Human
agguuggugcaaaaguaauugcuguuuuugcauuacuuuuuaaaaaauggcaaaaacugcaauuacuuuugcacuaaccu

SEQ ID NO: 4147192 - RNA, 76 nt, Human
agguuggugcuaaagucauugcgguuuuugucguuaccuucaguggcaaaaaccauaauuacuuuugcaccaaccu

SEQ ID NO: 4147193 - RNA, 95 nt, Human
agguugguuuguggagcuuguauaaacaagacuggccaacuuugcacaguugugagaauuagccggauucuuguuuugccuuuaagagcaauccu

SEQ ID NO: 4147194 - RNA, 112 nt, Human
agguuguuguuguucuugcuguuuuuaagaacacaugagauuuauauuuuuggaggccuguguccuucugagauguuguuuuacagauucuuuaagcgagaccuaacaauuu

SEQ ID NO: 4147195 - RNA, 79 nt, Human
auaguuuccuaagaauucuaggaagagacuggguuauuacccucccauuuccauguagcaauuuucucaagggugcugu

SEQ ID NO: 4147196 - RNA, 77 nt, Human
auauaaagacaauguucugucugacuugucagugcuuauaugaucauagacaggcucacauugacuguucuuuauau

SEQ ID NO: 4147197 - RNA, 83 nt, Human
auauaaucuccuucccaugagugugggcaggauccaugaaugugauggaguuaugcuacauuauauggcaaaggagauuuuau

SEQ ID NO: 4147198 - RNA, 70 nt, Human
auauaauguaaaaugugcuuagacaaggcuaaggucaccuagccugucugcgucacgcuuauuuuuaugu

SEQ ID NO: 4147199 - RNA, 130 nt, Human
auauaaugugacugaauuauuaaaaggcaagugucaccagcgugagcauaggaccaagggcagucauguugcacuaacacagcuggugcacuagcucugauucuaaugauauauucagcauucaaaauau

SEQ ID NO: 4147200 - RNA, 64 nt, Human
auauacaagugagaagaagaguucugaagucuagguuugaaugagcucugcauucucaguaugu

SEQ ID NO: 4147201 - RNA, 112 nt, Human
auauaccauguggcauuacuugcuuuuagcuugcgguguuuugcaguucaggauuuagugacauugaaaguaauaacuuuguucaagugcaagugaugcaaugugugugugu

SEQ ID NO: 4147202 - RNA, 74 nt, Human
auauacccacaaacauauauguaauuuuucacaaauauguaacugugauaacaugcaugcuuuggugggugugu

SEQ ID NO: 4147203 - RNA, 114 nt, Human
auauacugcagauaaaauuguggacugagcaguuauauaacuaucuagaugcauuuuauuuacuaagagcagugggccuuguuaacuucaguucuaagaucgauuuaaguauau

SEQ ID NO: 4147204 - RNA, 80 nt, Human
auauacuguauaggacaagucauaauugcaauguauaaucauguuauguacauucauggugacuuguauguauggucuau

SEQ ID NO: 4147205 - RNA, 81 nt, Human
auauacuuacuuccucacuuacuuuugugguuugguagcuuuuucuuuacacauuuaggagguggggaagcacagagauau

SEQ ID NO: 4147206 - RNA, 81 nt, Human
auauagcacuaucuuuagcauuacuuuauucaguaaaugagaacugcaaaaguucugcuggagaggacuggaugcauauau

SEQ ID NO: 4147207 - RNA, 59 nt, Human
auauagccagcuccuggcagaguuuuaaugacaacauucugggagggcugguucaguau

SEQ ID NO: 4147208 - RNA, 90 nt, Human
auauagcuuguuuuguucaaguagaaagugaccaaauucuccuagacugagaaaagauuggcauguuugcuugugcauaucagauugugu

SEQ ID NO: 4147209 - RNA, 94 nt, Human
auauauucugacugguaucaaacaauuaauuagauuuuuacaaagaauauaaaauagauuuuaauuaguguauugguauguuggucaaauaugu

SEQ ID NO: 4147210 - RNA, 108 nt, Human
auauauuuaaaaaauauaccucuucugccagugaaaauaaugauuaucccuggaaggguaaauuauuauaaaauuccugugaaggaugaggcuaugaauuaaauuuau

SEQ ID NO: 4147211 - RNA, 57 nt, Human
auaucaaaauaaacagcaugcaggcuauugggccuacuugugcuuauguuuagauau

SEQ ID NO: 4147212 - RNA, 58 nt, Human
auaucacaggaaaggaagauacacagauaaauuuuggauuuaucuuuuccagugguau

SEQ ID NO: 4147213 - RNA, 65 nt, Human
auaucagaaauaguaagcagagcucacggaauuugugauuuaaugcaaugcuguagucuugauau

SEQ ID NO: 4147214 - RNA, 70 nt, Human
auauccaauguguuccauugcaugugccuuuugcuccagaggccaaaaaugcaaggacauguaaugaugu

SEQ ID NO: 4147215 - RNA, 63 nt, Human
auaucucauuaccuugcuguucugcuucauuaucugaccagccucgggcagggugcuggguau

SEQ ID NO: 4147216 - RNA, 62 nt, Human
auaucucucugucuuccugagaguuuuauuaaauguuaaaguuuucugugauagagaggugu

SEQ ID NO: 4147217 - RNA, 80 nt, Human
auaucucuggcauugaugggugugguugcucuacuaauuccuagggcagggcagcgcugauuaggguuugccagacuugu

SEQ ID NO: 4147218 - RNA, 56 nt, Human
auaucuguaucuauauuucaauagauguguaguuauagagauauagaaguagaugu

SEQ ID NO: 4147219 - RNA, 84 nt, Human
auaucuuaaagggaagcaaauucaaauuagaauguuuugccugugacaagccucgcuuuggauuucgcuuuccaacucagcugu

SEQ ID NO: 4147220 - RNA, 63 nt, Human
auaugaaaauguuuuagcuguaggauguacucuuaagguucccaaagcaagcaguuuucaugu

SEQ ID NO: 4147221 - RNA, 60 nt, Human
auaugaagcuguugcuucucaagauguacaguaaguacacugaaagaagccagcuugugu

SEQ ID NO: 4147222 - RNA, 79 nt, Human
auaugaccagcuuugcauuuugauaagaucacuuuggcuacuguguugaaagauguuaggaaaguuaggguggacauau

SEQ ID NO: 4147223 - RNA, 123 nt, Human
auaugacuaacaguuuggauuuucaaguucaagaauguuugugcagagucaucugaguccucccuacaggugguuuuuuucagcacauuuuacuuagucaaaucaucaaacuauugaucaugu

SEQ ID NO: 4147224 - RNA, 58 nt, Human
auaugacugagguugaauaaugaagcagggaugcacauguuuuucuaucucagcgugu

SEQ ID NO: 4147225 - RNA, 130 nt, Human
aguaucaguauccuuccucacuaguucacuugcuuuugucauugugauuuucucugaauuuugagaagguauauguacaauagacauuuaaguuggauacuaaaaggguauaaaggacuucugauuuacu

SEQ ID NO: 4147226 - RNA, 75 nt, Human
aguaucagucuuagcagauaguagaacauguauaugugauuuaugacacauucuuuugacuguuuaauugauauu

SEQ ID NO: 4147227 - RNA, 68 nt, Human
aguaucaucuuccauguucuugacacaguggcacuaaaucaugugccaguggagcacauggugaagcu

SEQ ID NO: 4147228 - RNA, 60 nt, Human
aguaucaugacggauggaaucuccauuaaaaggagaucuuaguggccaaugucagaugcu

SEQ ID NO: 4147229 - RNA, 73 nt, Human
aguaucgucucuuagucaauauuuucuggugacaagaaauccacucaaaauaccaccacuaggggaggauauu

SEQ ID NO: 4147230 - RNA, 67 nt, Human
aguaucuguuucagucccuguguucaauaauuuugguuauacaccuuggaguggaauugucgguauu

SEQ ID NO: 4147231 - RNA, 56 nt, Human
aguaucuuuacuuaaauagucaguaugccaggauggcauauuuugagugauguauu

SEQ ID NO: 4147232 - RNA, 74 nt, Human
aguaugaauuauauucuauuuuaucuuauaugcacacaguguaaaaaaaucuagaggaggaugugaugcauauu

SEQ ID NO: 4147233 - RNA, 76 nt, Human
aguaugaccacauggagauuuggaaagcagcuggaucacauaacugugcugcugaauuaaacucuauguggcagcu

SEQ ID NO: 4147234 - RNA, 73 nt, Human
aguaugaccuaagguccaguggaaacuagagugaacauuacucuagguuugacauggacugagcagguucccu

SEQ ID NO: 4147235 - RNA, 68 nt, Human
aguauuagcagacaagcugcuggaaaaguuaaaucuuuaaaaaguuugcaauuugugcugcaaaugcu

SEQ ID NO: 4147236 - RNA, 69 nt, Human
aguauuagggauuuuuauagguauuuauagguauuuuuuauaaagucauuaugaagaucuaauuaagcu

SEQ ID NO: 4147237 - RNA, 75 nt, Human
aguauuauagauauaggacaguacuguaucauaccucugugaauguaaaauaucuuguacuugcuuuaugauacu

SEQ ID NO: 4147238 - RNA, 64 nt, Human
aguauucuggaauucuaugugagggacaaacacucagaagccagcagcaguguucuagaauacu

SEQ ID NO: 4147239 - RNA, 60 nt, Human
aguauuuagcugacucgcuacacucuacggaagcaauaugaagugaucugcugcaguacu

SEQ ID NO: 4147240 - RNA, 70 nt, Human
aguauuucugauucuaugcuggaaguaauaaugacugaguacuuuauuucaaaguggagaauuagacacu

SEQ ID NO: 4147241 - RNA, 62 nt, Human
aguauuuguggacauugccaaacgucccuugaggggcaaaauuggccuuugucucagacacu

SEQ ID NO: 4147242 - RNA, 75 nt, Human
aguauuuucugagacacaguggcugaaaaguuguaauuuuaugauuuaucagaggcuauguuucauauugaugcu

SEQ ID NO: 4147243 - RNA, 71 nt, Human
aguauuuuuguagcauuuuuccaguguuggcugagcugcuuucauuagaagaacaguuauauuaacuaucu

SEQ ID NO: 4147244 - RNA, 129 nt, Human
aguauuuuuuaaauuaugacuuuauuacuuuaagugggguagaggcaaauauuuguuuuaaaaaaggcaagauucagagucuucuaaccucauaucuucaauguuugaaagaauaaugaugaauuuauu

SEQ ID NO: 4147245 - RNA, 110 nt, Human
agucaagcccuaggggagcuuagaaguguguggugggggaaaggguuugugaccuaagagaacccauguuucucccuuuauaagacuguaauucuucccucucuuugacu

SEQ ID NO: 4147246 - RNA, 84 nt, Human
agucacaagcaaaauggcuuuugcacuuaaaucggacacaaaauccauuuuggcucacuguaagggcuaaugcuuucagugacu

SEQ ID NO: 4147247 - RNA, 58 nt, Human
agucacaggcaagagggcuccagauuuaggucuuugguucucagcccugccguguacu

SEQ ID NO: 4147248 - RNA, 97 nt, Human
agucacagugucuucaggauauguagagauaaaauccaaauaugauuauuucaaauuccagggucagcucauacaugaucaacugagguacuggacu

SEQ ID NO: 4147249 - RNA, 60 nt, Human
agucacauggacucaggaugacaaaagaagaauccuugacaucuguuuugucccugugcu

SEQ ID NO: 4147250 - RNA, 76 nt, Human
agucacguucccuuuggaggaucuaagggagaaucucuuuccuuuccuuuccaugcuucuagaggcugcguagauu

SEQ ID NO: 4147251 - RNA, 84 nt, Human
agucacucgaggccgggagggagcgcgugcagaggauggucccuggugacugucugcaauguuuucccauccuggccaggugcu

SEQ ID NO: 4147252 - RNA, 56 nt, Human
agucagagacccuagaucuaauuuauugugagguaaauuagggagggauucugacu

SEQ ID NO: 4147253 - RNA, 67 nt, Human
agguuuaggcuccugaguccacagcacaccaacagucuguagugcaguaucucugggagugggaccu

SEQ ID NO: 4147254 - RNA, 75 nt, Human
agguuucucugaggcaccaaauggagggguccagcuagcagcuggcuccuggucuggagcuucaaggagaggucu

SEQ ID NO: 4147255 - RNA, 126 nt, Human
agguuucuguugauguauuauuguugcuaucaugucuauuuuacgguaucuauuuauugcaggccacucaauucuuuguaauaauguaggaugauaaaugaguguguuaauaaccaacuagaaccu

SEQ ID NO: 4147256 - RNA, 80 nt, Human
agguuugaagagcuguaugccauaugauugcauaugaugccacagggaugccaaucauauggcauagagcucugcauccu

SEQ ID NO: 4147257 - RNA, 80 nt, Human
agguuuggguuuuaauuauaucugggcaguuagaaaaugcaauucuuuccuauggcucacaaauaauaaauuucaaaucu

SEQ ID NO: 4147258 - RNA, 119 nt, Human
agguuuguuuauuaaacauaaauagagaaugucaacuguaccuaaagaaagugcauugcuaauccaaagggcacucauuuuuacugcaauugagcauuaaauuuuacuauaaacuuccu

SEQ ID NO: 4147259 - RNA, 84 nt, Human
aguaaaacauuguuuaauuuuauuugacuuuaugacguugcuuuucaacaagcaaauguuaaauguguuaagacuuguuguacu

SEQ ID NO: 4147260 - RNA, 77 nt, Human
aguaaacaguuauuuucagcuaggaaagccacucucaaucagguagugguuucuuaagcugaaaaaggcuuuccacu

SEQ ID NO: 4147261 - RNA, 68 nt, Human
aguaaacauucuucaaauaucacucuuuguggaaaugcauuagagggaggcaagaauggaaguuugcu

SEQ ID NO: 4147262 - RNA, 58 nt, Human
aguaaacuguagcuacuuaacuaaaugauuucguguggcugagauccuacuguuugcu

SEQ ID NO: 4147263 - RNA, 78 nt, Human
aguaaagagcagauuugcuuucagccuuaaggauagagauacugccuaucacuggagugaaaggcaaacaugcuuacu

SEQ ID NO: 4147264 - RNA, 78 nt, Human
aguaaagcacuccagaauguuaccaguuagucugucaccauaguagcagcaucuggggaacauucaagauguauuauu

SEQ ID NO: 4147265 - RNA, 70 nt, Human
aguaaaguauccaguuauucuucuagggcugcuuagucaaguuaacuggaagauaugacaauaguuugcu

SEQ ID NO: 4147266 - RNA, 59 nt, Human
aguaaagugaagauauacuguuguccucauaaggggaaaucaaagaucuuuacuguauu

SEQ ID NO: 4147267 - RNA, 76 nt, Human
aguaaauggcugagcucccuguguguuggguaauuuauguuccuuuguccauugauucguucaacugccauuuacu

SEQ ID NO: 4147268 - RNA, 126 nt, Human
aguaaauuauucugcaaauauucugcuuauauuucauuggcccaaacuuagucgcaucaugccaccuugaggucaucugaaguacuaggcugagaagaaaauaauuugcaugacuuaauauuugcu

SEQ ID NO: 4147269 - RNA, 103 nt, Human
aguaacaagacaaccucaaggaguaaauauuuuauguaaugaauuaaccaugcaagguucauucauucaugaauguuaauuagaauccugagguuaaauugcu

SEQ ID NO: 4147270 - RNA, 66 nt, Human
aguaacugguccucggauguuguggaguugguaaauagcucuaauacaaggcaggaagcaguaacu

SEQ ID NO: 4147271 - RNA, 77 nt, Human
aguaagagcgaaaaauguguaaauauguuugaggacuacaaaaagcuguggcauaaguacauauuuuuauagaugcu

SEQ ID NO: 4147272 - RNA, 86 nt, Human
aguaaguugacucauguaaucuuuggauacagcuuaagcuuuugaugcuucugucaucucacugauauagaugagcugugcuuacu

SEQ ID NO: 4147273 - RNA, 110 nt, Human
aguaaguuggccaaagucacacagcuaggaggcagcagagccaggauuucaaucuccaggcucuaggcugcucuccauggagcuguugaaucacacauuuuguccuugcu

SEQ ID NO: 4147274 - RNA, 59 nt, Human
aguaauguccuaaggcuggcaggaagaugggaaguucccuggccuggaaggauaucacu

SEQ ID NO: 4147275 - RNA, 129 nt, Human
aguaauuaaugaaaugaaauaacuuauuaugauaaaugcccacugacuucagggauaaaaaguaauucauguuuuggauauaccucugggucauguuuguuuauaugaagaguuuucagcaguugaacu

SEQ ID NO: 4147276 - RNA, 77 nt, Human
aguaauuggaugcuacuucugugaugaaacuacacaagaugugaguuuugucuugcuagaaguuucugucccuugcu

SEQ ID NO: 4147277 - RNA, 91 nt, Human
aguaauugugcaagguuaauaugaacagcagaaggaauguaaaaauguaaaguggucuucuaauucuuauguaagcuuugucauaguuauu

SEQ ID NO: 4147278 - RNA, 76 nt, Human
aguaauuucucauuccgcuaaucauuugugaacuauuauuuaacugucagagucccauaguggagugacaaguucu

SEQ ID NO: 4147279 - RNA, 66 nt, Human
aguacaaagugcuccugguucucagggaagcagugauuuauuaaaagaacaccagggcauuuuacu

SEQ ID NO: 4147280 - RNA, 76 nt, Human
aguacaagucuggggauggugcugcacuugaguuaccuuuaaaugagaggcacaguuucauccccgggcuuauacu

SEQ ID NO: 4147281 - RNA, 61 nt, Human
aguacacaguagacuuucucauccuaggcauguggcuggagaggaggaaauaucuggugcu

SEQ ID NO: 4147282 - RNA, 73 nt, Human
aguacagacagcagcaauagcagugacauuuuccaaggacucuacggaugugucaggcccugcauuaugugcu

SEQ ID NO: 4147283 - RNA, 57 nt, Human
aguacagauuuagacacgauagguuguuggaaccuggcguugggauaagucagugcu

SEQ ID NO: 4147284 - RNA, 109 nt, Human
aguacagggccucguaguacucaucaauuaaggccaugacaucugaaucauugccucagaauuacacagggccuugauagaauuuaagaguggaguggggucugguauu

SEQ ID NO: 4147285 - RNA, 64 nt, Human
aguacaugcagaacuaacagauguuuuauacagauacaaaaauauuuguuauaagcaaugugcu

SEQ ID NO: 4147286 - RNA, 58 nt, Human
aguacauuaauuuugcucaauggccuuucuauaaaaugagcaucaaauugaugggacu

SEQ ID NO: 4147287 - RNA, 129 nt, Human
aguacauuacucaaugcuggaugcauagucagugcuuuauguuuaguauccauuuucaguaaauuauuauauuuuuugaaaacucaaaauguggagcacugaucagucuuguauauguguacaugaauu

SEQ ID NO: 4147288 - RNA, 73 nt, Human
aguaccaccaaacaauuugcauuuccuuagggaguaauuuuccuacaggacaaauagcaguugucaaaggacu

SEQ ID NO: 4147289 - RNA, 65 nt, Human
aguaccaguguuuguugagaaaggcaacuaagcuuuugguuggcuuuagcccaaaugacuggacu

SEQ ID NO: 4147290 - RNA, 72 nt, Human
aguaccaugcuuccugacuggucucuuggggccccuuuagucucccagucuuugccauggaagcauggugcu

SEQ ID NO: 4147291 - RNA, 68 nt, Human
aguaccauuaaaauggaauguagugaucauucagauucaacuaauguuuauuuuaugaaguggcuacu

SEQ ID NO: 4147292 - RNA, 88 nt, Human
aguacuacuucagugcuucuggugggcgugagggagaaaauuaaacauaagccacacuccuucauucagcaaguauuuauuaagugcu

SEQ ID NO: 4147293 - RNA, 69 nt, Human
aguacugcaggugguggcccagguuggucuuguaggaagcccgccguccuacgccaucauagcgguacu

SEQ ID NO: 4147294 - RNA, 60 nt, Human
aguacugggaauggagccugggccucggcaccaugccuagggccgccacuuuccagugcu

SEQ ID NO: 4147295 - RNA, 69 nt, Human
aguacugugcaguguuguaacccgaauacuuugcugguaugugaaguuuuugaaauauugaacagugcu

SEQ ID NO: 4147296 - RNA, 67 nt, Human
aguacuuacaauagugccuggcauagaguaugccuucaauacauguuagcuacuauuguuauaaucu

SEQ ID NO: 4147297 - RNA, 111 nt, Human
aucauggggagcuuuaaaaauuucugauacccggucacccuccagaaccaauaacaucagaauuucuaaggguaaaacccagggaucaguauuuuuuaaaccucuccaggu

SEQ ID NO: 4147298 - RNA, 68 nt, Human
aucauguuugccucuuauuugccagaagaaacauauauguaaauucugaaauaggagauagcugugau

SEQ ID NO: 4147299 - RNA, 63 nt, Human
aucauuaaagacaucacagauuacacaguauucuguguccugggucucugauucuuuuuagau

SEQ ID NO: 4147300 - RNA, 73 nt, Human
aucauucauauacuuuucuauagcuuucucaaauguccaaaacaccaugagggcuuggaagagaguagauggu

SEQ ID NO: 4147301 - RNA, 87 nt, Human
aucauucugcaagucucuagccaaaaggucacaugcuaacuugguacguauguauauauguuggguagaauacuugcuccagaugau

SEQ ID NO: 4147302 - RNA, 60 nt, Human
aucauuuaguuggcuugcuguaguggacucagacaauauauacaaguaaugcugaaugau

SEQ ID NO: 4147303 - RNA, 119 nt, Human
aucauuugguuuugugugacuuauccaugaaagccaucuguauuaagugaagcagcaacuuugcuuuacuuuccguggagaugaaagcuugaauuauguguacacaauuuuagaaugau

SEQ ID NO: 4147304 - RNA, 61 nt, Human
auccaaauuuagcaaguauuuacugacuaacuauugguuaaaagacacugcuagaugggau

SEQ ID NO: 4147305 - RNA, 70 nt, Human
auccaagauuggagauuccuggucuguguagaguauaugguuuugcacgaaaucuuucuagucuugugau

SEQ ID NO: 4147306 - RNA, 75 nt, Human
auccaaguauccucagaggcagaugguaagaaugaaaguucccacuaccaucuguucugacccaaauccuuggau

SEQ ID NO: 4147307 - RNA, 82 nt, Human
auccaauucagucauuaagacaacuggaguaaccagacuguaaaaugguuggucugguuauuucuuaaugauguaauuggau

SEQ ID NO: 4147308 - RNA, 68 nt, Human
auccacacucuccaagggcucccagacgucucucaccagaacaggagcucucuguccuugggagggau

SEQ ID NO: 4147309 - RNA, 84 nt, Human
auccacagcccacagccaggcguggcuucagcagccccuggacccugagggcauggggcccaugccgggcuuugugggcaggau

SEQ ID NO: 4147310 - RNA, 72 nt, Human
agucagagccugaaauugucugugcccaagucucuccucagaaauuuagcacagcauuuucccuuucugucu

SEQ ID NO: 4147311 - RNA, 112 nt, Human
agucagaggagagguguggagucuauaggacagaguucccugauggcccacaggacucugcaguccgaggccuccgggaaguggccuguugaaccaggacaaucuugugacu

SEQ ID NO: 4147312 - RNA, 90 nt, Human
agucagaguuaacaugugguucucuaguagcaguuucuuucuaauaaacuuuacuugaaagaacaugugugauagauuuugcucaugauu

SEQ ID NO: 4147313 - RNA, 80 nt, Human
agucagauaaugcuacaaauucguaaucaauuauuucacggugaaauuaaucaguuuaaggguuuggggauugacugacu

SEQ ID NO: 4147314 - RNA, 71 nt, Human
agucagauuuccuccuacgcuuaucacuuuauauguggaaaauggaguaaaagaguaggaggaauaaggcu

SEQ ID NO: 4147315 - RNA, 96 nt, Human
agucagcugguauagaagaaucaacugaaaauuggugagagugaagacuaucuuccuuuucuguugcuuuugauuucuauauaauccagguguacu

SEQ ID NO: 4147316 - RNA, 81 nt, Human
agucaggcagggcccuccccgcucagggcagggcucaaauuccagaccugcccgcaacagggcggggaggccagccuggcu

SEQ ID NO: 4147317 - RNA, 64 nt, Human
agucaguguucuggguuguaaucuguaaacuauugucuucacauaacucucacagaagcugacu

SEQ ID NO: 4147318 - RNA, 59 nt, Human
agucaguugcaguuuauggaugauucgguuaugguuuacucuguaugcuugcacugauu

SEQ ID NO: 4147319 - RNA, 58 nt, Human
agucaguuucccuggaaagcagccuguuagauggagcuuugagugcaggaagcuuacu

SEQ ID NO: 4147320 - RNA, 86 nt, Human
agucaguuugccaacauguacuauuaagaggccuaaaugcacacauuacugacacaaugggcuauaauugugcuuuugaaacugcu

SEQ ID NO: 4147321 - RNA, 72 nt, Human
agucauacaguguggcauguagucuuuugugaaauaggcuugaauucuauuuuuaccacuuauugugugacu

SEQ ID NO: 4147322 - RNA, 72 nt, Human
agucauauacugccuuguagauuauuagcauucgauguauaugugucuagucuacaugguuaguauuaagcu

SEQ ID NO: 4147323 - RNA, 82 nt, Human
agucaucagguuuugugaggaccucagcagagucuguccucaggcaggagucauugagagggguccuuggaguucuggagcu

SEQ ID NO: 4147324 - RNA, 76 nt, Human
agucaucauuuuuagcauaugggaauacauauuacgauaaagaaagaaguguucucuggucugaccaaugauggcu

SEQ ID NO: 4147325 - RNA, 70 nt, Human
agucaucccgcacugcucagcucucugugagaauaauuaucgucaccuugaaugcagcagcguggagacu

SEQ ID NO: 4147326 - RNA, 62 nt, Human
agucaugacuccauuggucaagcuaaaagaaguauuagcaaaggccaaguggauucaugauu

SEQ ID NO: 4147327 - RNA, 88 nt, Human
agucaugagagucaaauaagaagaugcaugugaaguacuuagcacagggccuaaagacuuuauaugcaucacauuggcuguuauuauu

SEQ ID NO: 4147328 - RNA, 92 nt, Human
agucaugaggagacaggagagagcucugugccugggauaguuguguugugacauucuaaaucagagagcucuguuuuagucaacuugagauu

SEQ ID NO: 4147329 - RNA, 58 nt, Human
agucaugggaucugcaaaagagguaguuuuacuacuuucuuucugauccuuaugcacu

SEQ ID NO: 4147330 - RNA, 67 nt, Human
agucauuuucugccuguaaucuauucagcuucucgagugcugaccaagugcuuggcagagaauggcu

SEQ ID NO: 4147331 - RNA, 56 nt, Human
aguccaaagcagaugagggccagggaauggaugcuggccuugucuggugaaggacu

SEQ ID NO: 4147332 - RNA, 63 nt, Human
aguccaaaugguuuuugcauauucagguuaucuuugaccugaagcagagaaaaccagaagacu

SEQ ID NO: 4147333 - RNA, 74 nt, Human
aguccaagaguacaaaguugcaguuaugugauuauagucaguaauacuguauacugcaaauuugugaagagacu

SEQ ID NO: 4147334 - RNA, 57 nt, Human
aguccaagaucaaggugucaacagguuugguuucuccugacaccucucuccuuggcu

SEQ ID NO: 4147335 - RNA, 99 nt, Human
aguccacaucuuggggauccugucccaugcuuccaccuagugcaauaggacagacuguugugaggaugugagcgugaaccagggcccaggacaagggcu

SEQ ID NO: 4147336 - RNA, 70 nt, Human
aguccagagggcagcagcuccuccuagcuggaccagaauccagcuuccuggcuuccugcccuuccuggcu

SEQ ID NO: 4147337 - RNA, 56 nt, Human
aguccaggucucugagucacaacagaagaaaacugcugaacaagagcaccuggauu

SEQ ID NO: 4147338 - RNA, 88 nt, Human
aguccagugcccagccagcucuuauuuucucuccuaaaucugcaguggcagauugagcuggggaugagugaggcuuguggucuggauu

SEQ ID NO: 4147339 - RNA, 62 nt, Human
aguccaugaugaaaccagauccaaggucuugaucuugaucuuuuuacuacaucauggugacu

SEQ ID NO: 4147340 - RNA, 79 nt, Human
aguccccacagagccgucugcaaagcaugagaacuggagcauucauuuacuuagcaugcaguguucugcccaggguucu

SEQ ID NO: 4147341 - RNA, 60 nt, Human
agucccuggauugucucugucaagcaccaucugugcacaccagagacauauccaaaggcu

SEQ ID NO: 4147342 - RNA, 87 nt, Human
agucccuucugccuagcugccaggcagggagauggcugggcaugcagcuuguccuccauuccuacaagucugguaggcagugugacu

SEQ ID NO: 4147343 - RNA, 64 nt, Human
aguccuaaacucagcacauucuggguggucaagcacucuggccaugcugcaguuucaugggacu

SEQ ID NO: 4147344 - RNA, 69 nt, Human
aguccucauuucugcaacccugaaaggcggcuauuccauccccauuuuacacuugaggaaacugaggcu

SEQ ID NO: 4147345 - RNA, 57 nt, Human
aguccugcccccuggaacauccaaacccccugguccagguuuucugaaggcaggacu

SEQ ID NO: 4147346 - RNA, 80 nt, Human
aguccuggaggaguaauuaguguccagcuucugcuuaucaaagcuuugccaggaggcuugguccacaugauuccaggauu

SEQ ID NO: 4147347 - RNA, 81 nt, Human
aguccuggaggcuagagguccaagaucaaggugccagcaggguugguuccuucugaggucccuguacauugcuuguagacu

SEQ ID NO: 4147348 - RNA, 65 nt, Human
aguccuuacaccuggaaccuauaauccaaccuuauuuggaaaaaugggucuuugcaggugggauu

SEQ ID NO: 4147349 - RNA, 59 nt, Human
aguccuuccucugaucuaggguaugaaucugugugugcacugggaaagaaggagggauu

SEQ ID NO: 4147350 - RNA, 70 nt, Human
aguccuuggcuuccacugugugcccccuggauggugagggcuagaaggggguagcaugaggagugggacu

SEQ ID NO: 4147351 - RNA, 78 nt, Human
aguccuugguuggaccugacagcacgcuccagucuuaccuuucacugguagcacagcagcgucuaaccgauagggacu

SEQ ID NO: 4147352 - RNA, 59 nt, Human
agucgcuguuggucguggcacugaggcccagaucaugccaccuccucuaacaaguggcu

SEQ ID NO: 4147353 - RNA, 58 nt, Human
agucuagaggauggguccagaugggggaugggcuuccaucuuggaagcaucucugacu

SEQ ID NO: 4147354 - RNA, 57 nt, Human
agucuaggggagaggccucaggagaaaccaacccugcuggcaccuuggucuuggacu

SEQ ID NO: 4147355 - RNA, 66 nt, Human
agucuauccaauguucagaucugagauucagcaagaaauugccaaauaaagcugaccagauggacu

SEQ ID NO: 4147356 - RNA, 87 nt, Human
agucuaucccaauaugucucugcaguugggugacccaauaugucucugcaguugggugacccaauaugucucugcaguugggugacu

SEQ ID NO: 4147357 - RNA, 79 nt, Human
agucuaugaaauuuuuucucuuguuaauguacugaaaguuguaucucauucaguuucacuugaagaaaagacauggacu

SEQ ID NO: 4147358 - RNA, 64 nt, Human
agucuaugcuuaaaauaugaaacugagcaaaagucauuggucaauauuuuuaugagcauagauu

SEQ ID NO: 4147359 - RNA, 63 nt, Human
agucuauuuuagcugcauauguuuucuguauuaauugggugauguuagcugcuauaguagauu

SEQ ID NO: 4147360 - RNA, 56 nt, Human
agucuccacuugacaucagcagggucacgaaggacucagaugaccaagagggggcu

SEQ ID NO: 4147361 - RNA, 65 nt, Human
agucucccuccccgcccgacuucaccaccagagccaccagaagaguuugcaagggaugggagauu

SEQ ID NO: 4147362 - RNA, 97 nt, Human
agucuccuggcagcggagcuccugcugcccgccaugggugucugugaugcugccgugcccacugggggcugcaggcacuccagcaucaggauggacu

SEQ ID NO: 4147363 - RNA, 99 nt, Human
agucucugacauccccucaccaggucuguacagccuggcucugagaggcucugucuggguccgggacuguggauguguguggggagucaggcccaggcu

SEQ ID NO: 4147364 - RNA, 75 nt, Human
agucucuggcaucuccugguacaauagauguucacuagacugugagcucugagacaguagagauggcaccugacu

SEQ ID NO: 4147365 - RNA, 60 nt, Human
agucucuuccucaugcauauguacuuuccuccacauuguacgcugcaugaggaggggccu

SEQ ID NO: 4147366 - RNA, 58 nt, Human
agucugaaggauggaagguaccguagagaucaucgacccauuccuucaucuuucagcu

SEQ ID NO: 4147367 - RNA, 67 nt, Human
agucugaagguacaauagaaauaauuaagcacacaaugugguuugauuaguuuuguugaagaaggcu

SEQ ID NO: 4147368 - RNA, 77 nt, Human
agucugaauguuacagagcccuuuggaaaauggcuuaccuggcuucugucaugcucauguaauuguacauucagacu

SEQ ID NO: 4147369 - RNA, 56 nt, Human
agucugaguuaguggaaauguagugaaugcccuaaguauuucacagauucaugacu

SEQ ID NO: 4147370 - RNA, 56 nt, Human
agucugauggcaguguagugcuuccugaaucauggaagcaaggcuaaaucaugauu

SEQ ID NO: 4147371 - RNA, 95 nt, Human
agucuggaaauaucuuuguguuugcuuacuuguaugcugccucuauuccuagaagucugcaaacucagugagauaaaaguggaccuuuccaggcu

SEQ ID NO: 4147372 - RNA, 66 nt, Human
agucuggagugauuaugugggaaguaugaaacaugccucaacccacaauggucuuacuacccgauu

SEQ ID NO: 4147373 - RNA, 76 nt, Human
agugggggguugggcugaggagggcguggccugugauugacagccgucgcucccucccucggccaccucccccacu

SEQ ID NO: 4147374 - RNA, 78 nt, Human
agugggggugccccagacacgcauguggggucuagugugaccaccagcagcggugugagggugcauacagcccccacu

SEQ ID NO: 4147375 - RNA, 96 nt, Human
aguggggguugcaggagagaacuggcuccuucuagacaggggaauaucgugguuaggguucuggagucagauucaaucugggcucugucaccuacu

SEQ ID NO: 4147376 - RNA, 68 nt, Human
aguggucagaauauuccauaagggucuuagcaagaaggccaguucucuggggaugcacucugaccacu

SEQ ID NO: 4147377 - RNA, 56 nt, Human
aguggugagaccuggugcuuuccuaaugucuaaggaccagucccuagucuuauccu

SEQ ID NO: 4147378 - RNA, 61 nt, Human
aguggugauaaccacuaucauagcuaccauuaaauuauucguugugacugguugucucgcu

SEQ ID NO: 4147379 - RNA, 57 nt, Human
aguggugaugaggauaacauuuauccaauaaauaaauguguaaaccuccauuacccu

SEQ ID NO: 4147380 - RNA, 84 nt, Human
aguggugugauuccucugggaauucugagcaagcaaauauuuuuguuagacaugacagaauuuuccaggcauguuauuaucacu

SEQ ID NO: 4147381 - RNA, 66 nt, Human
agugguguggggauaagcacucugccucugguuugcauagauuuagguucuaaucccagcacugcu

SEQ ID NO: 4147382 - RNA, 102 nt, Human
agugguuauuugaagcaucgugugcucaguggagccugagacuagccucugaugugaauauucugaggaaucuugacacauuugacagucagguagcucacu

SEQ ID NO: 4147383 - RNA, 55 nt, Human
agugguucaugccuguaaucccugcaauuugggaggcugaggcgggaggaucacu

SEQ ID NO: 4147384 - RNA, 70 nt, Human
agugguucuuauuuauuucgguuccuuagaacauuuuuaaauugccuuaggagcuaauucauaagccacu

SEQ ID NO: 4147385 - RNA, 76 nt, Human
agugguugagugcauaugcaugagauuugguucugcauuuauuucggauggucucauguccuaugugcuuaucacu

SEQ ID NO: 4147386 - RNA, 130 nt, Human
aguguaaaaugcagaguguugucaacuuaucacaccaagaauauuuuuuugcaccuuuuuaguuuggaagggucaaauugagaugacagaggaauaguggauaagagcuauagugcuauuaaauuacauu

SEQ ID NO: 4147387 - RNA, 62 nt, Human
aguguaacuugcuggaaaaacuaggacccaagagaccagcuccuaguugccaaguuaccacu

SEQ ID NO: 4147388 - RNA, 56 nt, Human
aguguaauaccugcauauacacagaaggauggaaguguauggcaggccgaggcacu

SEQ ID NO: 4147389 - RNA, 68 nt, Human
aguguaaucagcagacuaggcagauuacuugaaauuucaauuucuuuccccucugcugagaguacacu

SEQ ID NO: 4147390 - RNA, 74 nt, Human
aguguacaguguucucuuccuguauagcacuuguauuuucaagagcuagggucauugagagaacacuucucacu

SEQ ID NO: 4147391 - RNA, 75 nt, Human
aguguacuuaagcacuaauauuuuggcaccuuugaaaagaacagggcugcaagacguuauuagcgucaguacauu

SEQ ID NO: 4147392 - RNA, 65 nt, Human
aguguagguguuuaguaaauguuucucuuccccuggaagaugacagaugcuuagaguccucuacu

SEQ ID NO: 4147393 - RNA, 109 nt, Human
aguguauagcaaggccacuccucugagcucaaagacaucagaaccagcugagcaagaccccuccucagaggucugaguuucagcuccucaaggugugucuucuagaacu

SEQ ID NO: 4147394 - RNA, 86 nt, Human
aguguaucuuagcagacuuggcuacuguuccacugugauugaguuaugaagcauguacagcuagcaagguuucuguagguaaaacu

SEQ ID NO: 4147395 - RNA, 63 nt, Human
aguguaugguugaguuguguuaagaacauucaccuuguugugcaaccaucaccaccauccacu

SEQ ID NO: 4147396 - RNA, 63 nt, Human
agugucagugugagauaaucuuggagaacaggcauuuuaccaggaauuauuuuacauuuugcu

SEQ ID NO: 4147397 - RNA, 71 nt, Human
agugucaucuggaaggacgugugcucaacccugaaccuguuuucauguggguccucgucuuccaaggcacu

SEQ ID NO: 4147398 - RNA, 65 nt, Human
aguguccauaaauaaaguuuuaaugcaacauaaucauguucauucauguauugucuauggaugcu

SEQ ID NO: 4147399 - RNA, 59 nt, Human
aguguccuggcaaggguuucaggguuucaaaaacagauuccacuaaccccuaggacauu

SEQ ID NO: 4147400 - RNA, 63 nt, Human
aguugucagucaaagacauuuguguuaaaugaguuucagguguuucuauuuuggcugcuagcu

SEQ ID NO: 4147401 - RNA, 78 nt, Human
aguugucuaagacuuuggcacacaggucauaacccuucuauguacuccaugcccugcuguguaucauuuuagaugacu

SEQ ID NO: 4147402 - RNA, 70 nt, Human
aguugugcugcagggaacugaggcccagaggcugagcccuugccugcugggcccugcccugcugcccacu

SEQ ID NO: 4147403 - RNA, 99 nt, Human
aguuguggagcccccugggcagugagaaaggucagguuuuugauuggcaaaguaagccucaagacauuuuuaauugcucuuuccuccuacuagacaacu

SEQ ID NO: 4147404 - RNA, 61 nt, Human
aguuguuaggggaguaaacaugugcugcuuugcacacauugguuuuacuccuuugacuucu

SEQ ID NO: 4147405 - RNA, 84 nt, Human
aguuuaagaucuuaacaugcucuguuucuuggauguuuggaaaauguuuauuugagagacagagacaggaaugcguuuuagacu

SEQ ID NO: 4147406 - RNA, 94 nt, Human
aguuuaaugaaaauggguuguauguaaaguuuguaauagaaaacaggaaaguggucuuguacauaauuauuguaaacuacuauuuuuauaagcu

SEQ ID NO: 4147407 - RNA, 60 nt, Human
aguuuaauuggaggcguggcucggacguaaauucaaggagcugcggcuagaaagugaauu

SEQ ID NO: 4147408 - RNA, 56 nt, Human
aguuuaauuugcauucugaauauuaccauguguucauggagaaugcaaagcaggcu

SEQ ID NO: 4147409 - RNA, 64 nt, Human
aguuuacagacagacuucccacccucagggucaucugagguauuggccauugucuguucagacu

SEQ ID NO: 4147410 - RNA, 71 nt, Human
aguuuaccucuagcuccuacaaguacagcaaagaagaaauuuuuuuauggcaugaaggagagaauaaaacu

SEQ ID NO: 4147411 - RNA, 79 nt, Human
aguuuagccggcuaaaacaauacccauguacuggcucaugguccuguagaucagaacagcaggguguggcugguucucu

SEQ ID NO: 4147412 - RNA, 61 nt, Human
aguuuauaaaacauugcguggcguagccaagguccuaggucauagaaugaguuaaugaacu

SEQ ID NO: 4147413 - RNA, 59 nt, Human
aguuuauagcaucauaaauaagaugcauucguugccuuuacauuugagagcuauaagcu

SEQ ID NO: 4147414 - RNA, 69 nt, Human
aguuuaugaacacugauggaaaguauguuucuuucuguggaaauucauuuuucuuagugugcauuaucu

SEQ ID NO: 4147415 - RNA, 63 nt, Human
aguuuauucucuggucuuaguaguugcuuaauaauucauugauuaagaacuacagaauaaacu

SEQ ID NO: 4147416 - RNA, 73 nt, Human
aguuucagacauagaucugugauucauucugaguuaauuuuugcaaaggauguaaggucuaugucuagauucu

SEQ ID NO: 4147417 - RNA, 69 nt, Human
aguuucaucagaggcaucuggcaaggcucucaugguuugacugucaccagaucucucuguaaugggauu

SEQ ID NO: 4147418 - RNA, 85 nt, Human
aguuucauuaguagaacaguuaggguaaugauuggaaauuuaaauaugaugccucauuaacuguccuuaauuacuauugacaacu

SEQ ID NO: 4147419 - RNA, 91 nt, Human
aguuuccuuucauuaaugaggucaucuguuuugguuacugagggaaacucaaaacucucgggaccuagauaccugauaaugcugaacagcu

SEQ ID NO: 4147420 - RNA, 80 nt, Human
aguuucuaaaccuuuaccagacuagcaagagauguuccauucaaauaaguucucugauguaugggugacaggcaagagcu

SEQ ID NO: 4147421 - RNA, 72 nt, Human
aguuucuuccaagcuguauguuccuagagguuaucacaaagacuccucuaguggcaacuggcuugcagaacu

SEQ ID NO: 4147422 - RNA, 58 nt, Human
aguuucuugccgugcuuuccauuggcauacccuaacugaaagccacuggcaagagacu

SEQ ID NO: 4147423 - RNA, 65 nt, Human
aguuucuuucuggucuguggacuauaauggguacaguucaccucuccacaaguuagaaggaaauu

SEQ ID NO: 4147424 - RNA, 59 nt, Human
aguuugaagaaggugagaugcagaccucgguucgagcccugcauugccuuuuacaagcu

SEQ ID NO: 4147425 - RNA, 86 nt, Human
aguuugaagaggacagaguuucgguaagcauagaauggcuuucucuauuuuaagcaagauuuuauggaaaugacuuucuuuaaacu

SEQ ID NO: 4147426 - RNA, 80 nt, Human
aguuugaaguaggauggaaugcaaaugugucaggcacacacacacagucucacacacuguugcucauccaggcacaaacu

SEQ ID NO: 4147427 - RNA, 56 nt, Human
aguuugauaaacaccagcuaguccgguaccugggcuaucuggcaaaaugucaaacu

SEQ ID NO: 4147428 - RNA, 71 nt, Human
aguuugauugggcugaaguagagggcagaaucuuaccagccucugcuuauuucuguuuagcuuuucauauu

SEQ ID NO: 4147429 - RNA, 90 nt, Human
aguuugcacaaucaccauuaguuaacuucuuucuguaaucagaaaugacacaggaagagagauaauaauagacugggaauuuuguagacu

SEQ ID NO: 4147430 - RNA, 65 nt, Human
aguuugcugaaaugucuuuagcaguguuuguucaauaaaugcuuucuaaaucaucucagcuuauu

SEQ ID NO: 4147431 - RNA, 89 nt, Human
aguuugcugcucauguagaagggauuuuaaaggugcuaaaagacaucaaucugaaauguuuccuagcuauaaagcucuuccagcagacu

SEQ ID NO: 4147432 - RNA, 61 nt, Human
aguuuggcugcugggaacucaaacaauaccaaguacugugugaauucugagcaguuuagcu

SEQ ID NO: 4147433 - RNA, 104 nt, Human
aguuuggguucucauuaucuagcauauuccuuggcaaaaaauauaugucuaucacauguuucuuugaugaguaaggggaugagaagguaauaggauuauaggcu

SEQ ID NO: 4147434 - RNA, 86 nt, Human
aguuugucucaggacaaccucagguugcugcagugucucucuaucucccuguagugucuacugggcguuguaccuuuggacaggcu

SEQ ID NO: 4147435 - RNA, 101 nt, Human
aguuuuaaaaucauguauuucacaguaaauccagaagaaauuaugcacuuaauuuuucugggugaauuguguuauagagguaauagaggauuauuaaaauu

SEQ ID NO: 4147436 - RNA, 58 nt, Human
aguuuuacagacaauuucagaggcuucaugaagucccugaaacaucucuguggauccu

SEQ ID NO: 4147437 - RNA, 82 nt, Human
aguuuuaggguacaugugcacaacgugcagguuuguuacauauguauacaugugccauauugaugugcuguacccauuaacu

SEQ ID NO: 4147438 - RNA, 82 nt, Human
aguuuuaggguacaugugcacaacgugcagguuuguuacauauguauacgugugccauguuggugugcugcacccguuaacu

SEQ ID NO: 4147439 - RNA, 79 nt, Human
aguuuuagguggugauucuggaauuuucuauauaugcugugauugggcaaaagcuuagaaagcagaaaccaucagagcu

SEQ ID NO: 4147440 - RNA, 82 nt, Human
aguuuuauaugucaugcugagaggguuuguacuauauuaugaaggaaguaaagacuuaauagaagcaugacauagccaaauu

SEQ ID NO: 4147441 - RNA, 94 nt, Human
aguuuuauuacuucuuugacguguauauguguauuuuaugacaaacauuuuaaguugcauggagcacacaguaugcuuuuaaugacauauaacu

SEQ ID NO: 4147442 - RNA, 82 nt, Human
aguuuuauuagaagguccaugacucggcauaguaagacuaauacccugcuccagaauuaugaccauacgucuuugugaaacu

SEQ ID NO: 4147443 - RNA, 79 nt, Human
aguuuucuaaauacuagccuucagauuuuagaauugcuguuguaagagaagauucugaaggacuaguuuuuacaaaacu

SEQ ID NO: 4147444 - RNA, 64 nt, Human
aguuuucuaguauauaacuagaucuuccuacaacuaggaagauuuuacggaguauuaggguauu

SEQ ID NO: 4147445 - RNA, 82 nt, Human
aguuuuuaaaaugucaaugucuggaauugauucccagagauuguucuuggauccaucucaggcauaggaauuuuuuaaagcu

SEQ ID NO: 4147446 - RNA, 66 nt, Human
aguuuuuaacgccauguuugaacaugaaauggaagaaagcaaaaagguaaacauggcuuaaaggcu

SEQ ID NO: 4147447 - RNA, 130 nt, Human
aguuuuuaccugccucacaggagugucuuaagaauugauucacauuuacaaagcacucagaaauccuuggauuugagaugcuguagaagugagugcauuauuauuauuaucaaccugaggcagauaaauu

SEQ ID NO: 4147448 - RNA, 112 nt, Human
aguacuagggaaaggauagggcagguaacuauagacauagccguaauuuauuuuguaaaagacagauguaaacaagguuauuguccauauaauuugcuauucaccaaguacu

SEQ ID NO: 4147449 - RNA, 83 nt, Human
aguacucugugugcgaguucucugugugugcgaguacugugugugagugcucagugugcacgaguacucugugugugaguacu

SEQ ID NO: 4147450 - RNA, 87 nt, Human
aguacugcuggagagaaaugacaaagcuaaacuuuuggaugacacacaauuucaugguuuguuaucucagcuccaccaagcaguccu

SEQ ID NO: 4147451 - RNA, 80 nt, Human
aguacugggauuacaggugggagucacugugcccagcuaagggauaguuuagaagauucacuaucuuguagcucaauauu

SEQ ID NO: 4147452 - RNA, 58 nt, Human
aguacuuagcgcguuguguagaauguaauaggcacucaaccaauguuagcuuaguacu

SEQ ID NO: 4147453 - RNA, 56 nt, Human
aguacuuugcacuuugcucagacuuacaugacuaggaagagcagaaccaugguacu

SEQ ID NO: 4147454 - RNA, 57 nt, Human
aguacuuuucuuuugagaaacugcaacaguuauuuaaaucucagaggaaaaauugcu

SEQ ID NO: 4147455 - RNA, 56 nt, Human
aguagaaaguugcaggaggaaugaaaaauaauaccuaaugaccugcggcauucucu

SEQ ID NO: 4147456 - RNA, 67 nt, Human
aguagaacugucagauguuauaugcuuccugagaugaggaagcagcaaaucugcaguaucaucuacu

SEQ ID NO: 4147457 - RNA, 65 nt, Human
aguagaauggaacagauauuuguggcagguuugcuggagguucuauguauaucuuuccauucacu

SEQ ID NO: 4147458 - RNA, 130 nt, Human
aguagaauuuugaagacaaauauuggcugguucuuuuucugagggcugacugcuuagcuguggucacugugugaugugauagaaagguaguggacuuugaggaagacagauuugggcucuaguuucuauu

SEQ ID NO: 4147459 - RNA, 55 nt, Human
auaacaugagccagauugaaagggagugauuuucauucaucuuaggucauguuau

SEQ ID NO: 4147460 - RNA, 75 nt, Human
auaacuaguucugccauucagugucacaugucugugucugauuuuaugaccuccuaagugacagaauucgguuau

SEQ ID NO: 4147461 - RNA, 55 nt, Human
auaacugccugaugacucucaagcucaggugugaccuucauagacaggcuguugu

SEQ ID NO: 4147462 - RNA, 74 nt, Human
auaacugucaugugaaauuacuuuaauggggaaaaucaaacccaauuacagcaaugcuacaagaugacaggggu

SEQ ID NO: 4147463 - RNA, 79 nt, Human
auaacuuaacuucucugagccucauuccuguguaaaauggguguaggaagugaggaauuagguuuauaagaaggguugu

SEQ ID NO: 4147464 - RNA, 82 nt, Human
auaagagcagcgauucauuagguggggaucucuaaauauuugcuaucaguauuacguaacuacuuaaauugcuucuacuuau

SEQ ID NO: 4147465 - RNA, 72 nt, Human
auaagaugagcagacuguaucaaugucaguauugugguugugauacuguacugcaguucugcaaaauguuau

SEQ ID NO: 4147466 - RNA, 63 nt, Human
auaagcuuuguccuugaggagcucauaguccacuaggagaaaugggccuugggacacaauuau

SEQ ID NO: 4147467 - RNA, 57 nt, Human
auaaggcuuaaaccuuguugccacagcuggcuuucaaauuuggcuuuaagccauuau

SEQ ID NO: 4147468 - RNA, 68 nt, Human
auaagguuaacaucaucagugauaauucauguugauagcauguacucccugauaugaugugauguuau

SEQ ID NO: 4147469 - RNA, 69 nt, Human
auaaguaaauucagaaacucugggcagaacuccaaaauuugagguuuugcuuaaguucucuuuauuugu

SEQ ID NO: 4147470 - RNA, 94 nt, Human
auaaguaccuauuuaucuuuucuauuugcugcaacuauaugaaaauauauauggauauaaucagacuggaaaggacuuugaaaaugguauuugu

SEQ ID NO: 4147471 - RNA, 72 nt, Human
auaaguaggaaaauuugaauauggacugguuauuggaggguacagggaaauauucucaauuuucuugggugu

SEQ ID NO: 4147472 - RNA, 81 nt, Human
auaaguauuacagaaguguugaaguuuucauggguuauuccauaaaacauuuuaugacuucaugcuucacuguccauuuau

SEQ ID NO: 4147473 - RNA, 69 nt, Human
auaagucucaugagagcugaugacuuuacaaggggcuuccccuuucacucagcucucauugucucuugu

SEQ ID NO: 4147474 - RNA, 83 nt, Human
auaauaauguuaccucccugugccucaguuuccucauuugaaaaauggggacaguagcugcgcauagcugauaggauuauugu

SEQ ID NO: 4147475 - RNA, 99 nt, Human
auaauacuaacuucacagggcugcugugaguuaauauuuguaaugccuuuaggauggcguuuggcacacaguaagcccuaagugaauguuggcuguuau

SEQ ID NO: 4147476 - RNA, 57 nt, Human
auaauagcagaccucugagugauaacugauacuauuccuccugggacugcugguuau

SEQ ID NO: 4147477 - RNA, 72 nt, Human
auaauauuuggauaggacaguagggaguaacuaguuaauuuucccaaaguuguagcuauccaggaauauugu

SEQ ID NO: 4147478 - RNA, 101 nt, Human
auaaucccuuuucugugucugggggaucccuggacaugucugcacaaagccccgagucacuggguccuuggcagcaguccaccccacacagaacugauugu

SEQ ID NO: 4147479 - RNA, 58 nt, Human
auaaugaagccacguuaaauuggcuguacaaacauccaaacaaaugaggccucacugu

SEQ ID NO: 4147480 - RNA, 87 nt, Human
auaaugaagucuccgaguguaugaaaguagccggcuucaaaauaaaaucuuugagugcauacuuuauuuuaauacuuauuuuguuau

SEQ ID NO: 4147481 - RNA, 78 nt, Human
auaaugacaagacauagucucugagugucuccuuuccuuccacuagacuugaaucaauacuaugauuuuguacauugu

SEQ ID NO: 4147482 - RNA, 99 nt, Human
auaaugcauuauacgagaaagcugucuauagaaucaugcaguuuguguucaaccccuaaauagaaugcagcugugggcagggcuucuaauaaacguugu

SEQ ID NO: 4147483 - RNA, 60 nt, Human
auaaugggaagcuagagagcaugguuccagccaucacucagcuuucaagcuugucauugu

SEQ ID NO: 4147484 - RNA, 85 nt, Human
auaaugguuucauccucugaauguacuucauaaucuuuuuucuugcuuaaaaggaaugugacauuuuggggugaauagccauugu

SEQ ID NO: 4147485 - RNA, 121 nt, Human
auaauucgaaaauuaaaucugcucaaaugcuuuuguggauugauaagagacaagugauuauggaucaagucauuaauauucaucaauguaaagaauaaguuggggaauuauauagaauugu

SEQ ID NO: 4147486 - RNA, 82 nt, Human
auaauugagacaacaccaaaugcuaguguggaugaggagaaacuggauuacacauacaaugcuuuucggguuguaaaauugu

SEQ ID NO: 4147487 - RNA, 72 nt, Human
auaauugugggcuugccuggcucuuggcagccucuccccuccaagacccuuaauagccuugcagacgauugu

SEQ ID NO: 4147488 - RNA, 93 nt, Human
auaauuuaaaagaccaguaguauggauuaugaaaacacgagcccaccacagggaaaguuaaagucuauguacuacacuuguuuuuuaagcuau

SEQ ID NO: 4147489 - RNA, 80 nt, Human
auacaaauugugucucaggcagugguucuagaguuuucagugucucucaagaugauggcaggaugagacaacaauuggau

SEQ ID NO: 4147490 - RNA, 95 nt, Human
auacagagagacugaaaguuaugugccacuuuuugaagaugacuacuccaaauugguuaaauuuucaaaauugguauguuaaaaagaguugguau

SEQ ID NO: 4147491 - RNA, 57 nt, Human
auacaggccuuggcaggcaugugacagagaagguuuguuauaugcuuaaggaugugu

SEQ ID NO: 4147492 - RNA, 86 nt, Human
auacagugcucaaauaacaugcuuauccaaggaaaagguaaagcaagucauuuuugcuauuuggaaaagcauuuggggaugugugu

SEQ ID NO: 4147493 - RNA, 83 nt, Human
auacauaaaugagauuauuuaaaaugcgguaauguugugaaaaacaaacacaggcacaacugaguagacucauuugauaguau

SEQ ID NO: 4147494 - RNA, 62 nt, Human
auacauaggagaauaacuucagagauauggaagauauccacuggguugaguuucugauguau

SEQ ID NO: 4147495 - RNA, 130 nt, Human
auacauauauauauauauauauauauauauauauauauauaugugugugugugugaguauauauauauaugcacagacauacacauauaugaauuuauguguuuguauacauauauauauauauauauau

SEQ ID NO: 4147496 - RNA, 68 nt, Human
auacaugagaagguuuuggcauauacugugguacauaauaaauguuacuuuccuuucacaucaugugu

SEQ ID NO: 4147497 - RNA, 83 nt, Human
auaccaaggcuuugacagugucuaucuuauugguuaugguauccauggcuccuaggauggugccuggcacugaguguuggugu

SEQ ID NO: 4147498 - RNA, 56 nt, Human
auacccagcucuuucguuuuggguccucacaaaugguaaaagugugagcugggugu

SEQ ID NO: 4147499 - RNA, 80 nt, Human
auaccccaaaacuaguaguaccauuguagguauguaggagagaaauuaauucacuacauacaguggaugcuuuagggugu

SEQ ID NO: 4147500 - RNA, 81 nt, Human
auacuaucaauaugacagcacuguugaagguggccuugaccaccuggcugagguagugcuugucauguuuuucuaugguau

SEQ ID NO: 4147501 - RNA, 75 nt, Human
auacucaaguuuauauaguaaguuauucucauuaucacuuucugugaaugaguuuggcugcuguucuugaaguau

SEQ ID NO: 4147502 - RNA, 69 nt, Human
auacucaguuugccuugguaccaaugagcuacagguaaacacuguaagaucaaaggcaaaggugggugu

SEQ ID NO: 4147503 - RNA, 67 nt, Human
auacugaguacauaaauugugaagucagaagaccugacuccauccaaucuguguucuacaacagugu

SEQ ID NO: 4147504 - RNA, 67 nt, Human
auacuguggagaguauccugaaauccuacguaagcaguagagucccaggccuuuuuuccugcagugu

SEQ ID NO: 4147505 - RNA, 121 nt, Human
auacuuagccggaaaucacuugaacccaggaggcagauguugcagugagccaagaucaugccacugcacuccagccuggguaacaaagcgagacuccgucucaaaaaaaaaaaaaaaguau

SEQ ID NO: 4147506 - RNA, 85 nt, Human
auacuuaguuucuaagacucugcaaaucagcuuauaagcucuaugucaaggugaaaagaacagaguuugccaaacuccagaguau

SEQ ID NO: 4147507 - RNA, 77 nt, Human
auacuucagugaguuuuuagucuugucugcuuuucaaacuuaagagggacaucucacaaacaacuuuauugagguau

SEQ ID NO: 4147508 - RNA, 71 nt, Human
auacuuccucauuuuagcagucuugcugacuguacuuuauacagugucucacugcugaaaucaauuagugu

SEQ ID NO: 4147509 - RNA, 78 nt, Human
auacuuguugagagaaaaaauuuauugguaaaacuaucucaaagcuuaucaaugaaauuauucuuucauuuugggugu

SEQ ID NO: 4147510 - RNA, 94 nt, Human
auagaaaaauacuuauuuuaggaacuuagguuuauggauuuuaucaugagauucauaguguucccuuaguuccuauuaauagauuuuuaucuau

SEQ ID NO: 4147511 - RNA, 89 nt, Human
auagaaaucauuauugucuaggcuuuuggagaagcauaugcugugaaaaugaucacggcugugcuccuaaaagccagucauguuucugu

SEQ ID NO: 4147512 - RNA, 61 nt, Human
auagaaauggcagcuggugcuauuucacuuuaaauaaauguuugguacuagcgcugucuau

SEQ ID NO: 4147513 - RNA, 103 nt, Human
auagaaauugugccaggaaaauggaaucaccuguauugucaccaauauuauagguccuauaucauuuuucaaauuuuugguaauauaauaauauaacuucuau

SEQ ID NO: 4147514 - RNA, 126 nt, Human
auagaauagagcucagaaauaaauccauauauuuauagugaacugaucuuugauaaagaugccaagaaaugcauaaucgaggaaaggacaguuccuucaauaaaugguauugggaaaucuagauau

SEQ ID NO: 4147515 - RNA, 102 nt, Human
auagacccagcaggacagaaaacuagguuuaacuuucacagaaacugaugaaauaaaaugguuucuuucaaguuaaaacuguuucuuucaaguugaaacugu

SEQ ID NO: 4147516 - RNA, 86 nt, Human
auagagagugauaaaauagaaacagugguccagaauuaucuacucuaaaugcccuugaauuucugucucccauuuauugccucuau

SEQ ID NO: 4147517 - RNA, 96 nt, Human
auagagcgugggaugcuaggaaaagagcccagucuggcuggcugucucucucucaacucaugguccugaggcuuguuuccacuccuucaugccuau

SEQ ID NO: 4147518 - RNA, 62 nt, Human
auagaggugaaauaaaacauuagagguaaaugauuuuacccacugaugcauuuucucucugu

SEQ ID NO: 4147519 - RNA, 64 nt, Human
agucuuugaaaucugguguguguuuuauaccuacagcacacagacuaaccauauuucaggcacu

SEQ ID NO: 4147520 - RNA, 83 nt, Human
agucuuugcuuuuacuuguaucacuccguaucauuuaaucuagugcuauaacugagaagauacauaguagcugucaacuggcu

SEQ ID NO: 4147521 - RNA, 86 nt, Human
agugaaagcugaaguucauacaauggccauuaaggcucuacuugauuuggucccuuguugugucccugauaucacuuccuuccacu

SEQ ID NO: 4147522 - RNA, 69 nt, Human
agugaaagucuugguguguuuuuauccuucagguaaagucugguaaaugaugagaagcaccccuuuccu

SEQ ID NO: 4147523 - RNA, 55 nt, Human
agugaaaugauucugagcaagauaaguaaucucuuggaaccucaguuucaucacu

SEQ ID NO: 4147524 - RNA, 96 nt, Human
agugaaauuuucugcuucuuaucaaguggcaaaucuuuugaaauugauauuucauucucauggacgcuauuuaguugaagauguauuuauuuuauu

SEQ ID NO: 4147525 - RNA, 75 nt, Human
agugaagcauuagaaaagcagcugggaccuuaccuggcauguaguuggugcccagcaagcuuucaaugacccacu

SEQ ID NO: 4147526 - RNA, 68 nt, Human
agugaagccaggagagcaaaggucacucugguuuccaagugguuugcccagcuuuucggcuuuucacu

SEQ ID NO: 4147527 - RNA, 127 nt, Human
agugaaggcacuugaaggcaucugugcaggaggaugacaacugcaaacauuaaucaccccaaaguguccuagccuccuuugcaguugucacccuccugcauggauggccuguacagaugucuucgcu

SEQ ID NO: 4147528 - RNA, 65 nt, Human
agugaauauggcuugaguuucagacuauguuagagcuccugauauucagucucaucaaauucacu

SEQ ID NO: 4147529 - RNA, 70 nt, Human
agugaauggcagauggccuggaaccaaagccuccuggcucccaauccauugcuucugccaugaaaucauu

SEQ ID NO: 4147530 - RNA, 85 nt, Human
agugaauuaggcagaaagauuuucaacaggaggugaaaaaguuucuaccucuuguuugaaaauguuucuaaaaucuaaguucauu

SEQ ID NO: 4147531 - RNA, 65 nt, Human
agugacaaccaggcacuccugaggucugacccuaaccuuuuggucgagccuccagccuugucacu

SEQ ID NO: 4147532 - RNA, 56 nt, Human
agugacauuauuuuguguacuaggauguccucuuguuuagacagauuuguguuacu

SEQ ID NO: 4147533 - RNA, 76 nt, Human
agugaccuaugugggcaaucccugcuucagcacccccuucagcuccaguaauuugauugcccagaauauucucauu

SEQ ID NO: 4147534 - RNA, 64 nt, Human
agugacuggaugcuaagcguuggagacuuguccacauucuccacgugauggaguccaggccacu

SEQ ID NO: 4147535 - RNA, 70 nt, Human
agugacuuaauggugguuguggacucugagggcguuggagauguucaguuaacacagacaccaggccacu

SEQ ID NO: 4147536 - RNA, 130 nt, Human
agugacuugaucaugucccaggucaggguguuuucacuccagacagggagccugaguugguggugagugugauacaaagcuuucugucugguauagucuaaagaucuuguggcuugauauaucaauuccu

SEQ ID NO: 4147537 - RNA, 62 nt, Human
agugagaacaguuaaaaguugaaaguugaaguuagaagcuuuggacuugugacucuucuccu

SEQ ID NO: 4147538 - RNA, 69 nt, Human
agugagcauguauucauguggaacucagauaacuaaaaaaguaaaguuguaucugaaugcauguaggcu

SEQ ID NO: 4147539 - RNA, 102 nt, Human
agugaggccaccaucaauggcccaagugcccugaccugaagcguagggagccuccuguccuuuuggcagggagggucgcugggccuuguuggauucccuccu

SEQ ID NO: 4147540 - RNA, 66 nt, Human
agugagguggggucacagggacagccagauaauggggagccaugagucccuggggcccuacuuccu

SEQ ID NO: 4147541 - RNA, 84 nt, Human
agugagguugaauaucuuuauguugguaaaaucuucuuucucuugaugcgccaucaucaagaauguacagccaauaaagucacu

SEQ ID NO: 4147542 - RNA, 75 nt, Human
agugaguagacaaaaggguugccaccuugaaaguauaucuauacuguagauguugcauccugacgucuauuuucu

SEQ ID NO: 4147543 - RNA, 93 nt, Human
agugaguaggugagaggguggguuuuacuggcgaaggguccccagagaagaggacucuuccagcaaugugaaaucacccugcuuccgugcacu

SEQ ID NO: 4147544 - RNA, 111 nt, Human
agugagugaguugacaaugcuucagcuguagaugaccccaggguuugugucagaauaagaagcuaagacccugaaguuuucuaugauugauucuuuguucauucauuuauu

SEQ ID NO: 4147545 - RNA, 73 nt, Human
agugaguggauguaggaauugggguaaaugagcaauagcugccuugucauuucaaguucugugucuuacuccu

SEQ ID NO: 4147546 - RNA, 57 nt, Human
agugauagaaaaugccuggcaagcgugacaucaacucuugaccugcaagucaucauu

SEQ ID NO: 4147547 - RNA, 70 nt, Human
aucaguggugcugaauuauggugaguacauuggcacucacuccaauuuuacccauucagacucacuugau

SEQ ID NO: 4147548 - RNA, 126 nt, Human
aucaguuaaaaauucuuaacauguuauuucaagcugccuagaguugaaugucuacaaaauaugauguuuggggauaccacguagcuuuggcaguagagaguuauggcagaaauacauuguacuggu

SEQ ID NO: 4147549 - RNA, 91 nt, Human
aucaguuuacugugaaggauuaguagguacaguucauaugaaugaaaugaacuauuuggacaguaucucuuauuccucaaaacaaauugau

SEQ ID NO: 4147550 - RNA, 65 nt, Human
aucaguuucacuugcuugcaaagaucugaauugauacagauauugguacaaaaaugagaacugau

SEQ ID NO: 4147551 - RNA, 74 nt, Human
aucauacaaauuuagauuuggauagagguuuagaaauuuaucuaugacauuuucccagauuuauuccuguagau

SEQ ID NO: 4147552 - RNA, 87 nt, Human
aucauacacucagugcggaaggcuagaaacgaugcuuauaauaacuccauagucaaauauuucugcuuucucuugcacagugugggu

SEQ ID NO: 4147553 - RNA, 63 nt, Human
aucauaguccaguagcaccagguuaccccagcuuaauugcuggccuggcuuugcaucugugau

SEQ ID NO: 4147554 - RNA, 71 nt, Human
aucauaucuuuucucuucccuauuaaaacuccuccucuguucagggaacuuggggaagaaaaggaugugau

SEQ ID NO: 4147555 - RNA, 71 nt, Human
aucaucacuguguucaguucaugaugccuauggaguucuacuggugucagugaccuagcacggugcuagau

SEQ ID NO: 4147556 - RNA, 59 nt, Human
aucauccuguuaauguccacucuagaaauuuacuagaaguaaacagaaagcaagaugau

SEQ ID NO: 4147557 - RNA, 57 nt, Human
aucauccuuugcuuuugugggucccuucuguguaggccugcagauauauaggauggu

SEQ ID NO: 4147558 - RNA, 129 nt, Human
aucaucuaggugcuggguccagcaguguggcacaauccuauuuguaggcugggccaguucugaagaucacaauacucagcugcuagacagaagugugucaaaacugcaccugaaggaaagaccaaggau

SEQ ID NO: 4147559 - RNA, 93 nt, Human
aucaucuggacauaguguuaaaauggagauucuuauuuaaauagagucuggcugaggccugagagucuacauuuuuagcaagguccaggugau

SEQ ID NO: 4147560 - RNA, 102 nt, Human
aucaucuggggagcuuucaaaaguacagaugccagggaaaucagguaauuggucuggaguggguccugcacauuaguauuuuuuaaaagcucuucagaugau

SEQ ID NO: 4147561 - RNA, 106 nt, Human
aucaugcuuugggucacaaugcguuaaaucuguggccuuugcaucgaagccaugcuuucaagauguaaaaccuauggagcugacaccaggggcccaacagcaaggu

SEQ ID NO: 4147562 - RNA, 83 nt, Human
aucauggaaagguucagcaagcuuaauacuccacucaacauuagacacauaugguaggacgaauuucugaacagccccaugau

SEQ ID NO: 4147563 - RNA, 91 nt, Human
aucauggucagaagaacuguaagaagcaggucacagacagggcuuguggggcaagccucucucuuucugcucucuggguuccuguccaggu

SEQ ID NO: 4147564 - RNA, 66 nt, Human
aucauggucugagggagugagugggggcugaaaucacgccaauaacucugcucccuaagccaugau

SEQ ID NO: 4147565 - RNA, 129 nt, Human
aucauguauuuuauaagauauuuuucuuagucauuucuguuucuucagugcuuaguacaguacuuaacauguagaaugcacuugauaaauguuaacugacuugagaaauuaggaucuuauaacauugau

SEQ ID NO: 4147566 - RNA, 67 nt, Human
aucauuaacacuaaggcgcugauucucugaaagacguucaacugaagagagccuugaggaagaugau

SEQ ID NO: 4147567 - RNA, 74 nt, Human
aucauuacagguuuuagaguggauucuagaaagaaagaacguucauucagaaucuuucuagagucuagaaugau

SEQ ID NO: 4147568 - RNA, 84 nt, Human
aucauucugaacauuuuuaaggauacuuuaaggcauuuuagcuucuguaugucaaagaugucuuugaaaauaguuuuuuauggu

SEQ ID NO: 4147569 - RNA, 67 nt, Human
aucauucuggaguccagauccauuuggcugcaaagguuuggguaauggaugauggaccugaacugau

SEQ ID NO: 4147570 - RNA, 68 nt, Human
aucauugagauuuuuuacaacugcugcacugggugacaguaacaccuguggugaaaauuuuucaagau

SEQ ID NO: 4147571 - RNA, 123 nt, Human
aucauuguuuuaaucugaucaaggcagauuaccaaacgggauaauauagauaccaaaguagguuauaaaaauugaaauauccuguuugguugucugccuugauuucauuaaccagacaauggu

SEQ ID NO: 4147572 - RNA, 77 nt, Human
aucauuuaugugugcuuuuuccaugcauuucaauuuaauaauuugauauguaaguuuaagcacaacaagaaagugau

SEQ ID NO: 4147573 - RNA, 95 nt, Human
aucauuuccaagguguucagguuuucccauuuuagcauccugcaaaagacauccacuuugcaguugauggggucuuagaauccuuuaaacauggu

SEQ ID NO: 4147574 - RNA, 80 nt, Human
aucauuucuuuggagauaugugaaaaaaacagcaucaauagucgacucucuucuuuaugcauaucuucaauggcagugau

SEQ ID NO: 4147575 - RNA, 61 nt, Human
aucauuuguaagcauggcguuggaagaaaaguuuguccaaauuagccgugguuauagaggu

SEQ ID NO: 4147576 - RNA, 94 nt, Human
aucauuuguugaauuuuaaaaguccacugaaguugacugaagaugaacuugaaaucauuuguugaacuuuagugcgcuuuagaugacugaugau

SEQ ID NO: 4147577 - RNA, 62 nt, Human
aucauuuuaauaaaguguaaagauucugaauaucgguugucugggcaccuuguugacaugau

SEQ ID NO: 4147578 - RNA, 63 nt, Human
auccaaacucugaguuccauuccccuccugaaaugagagaggauuggccccaggaguaugggu

SEQ ID NO: 4147579 - RNA, 58 nt, Human
auccaaagaaugcuuagaccugcagccaauggcucuuggugggucugguucucuggau

SEQ ID NO: 4147580 - RNA, 63 nt, Human
auccaagaaaucuauacucagcuaaccuucuaauugugaggguagaauacagguauuuuggau

SEQ ID NO: 4147581 - RNA, 77 nt, Human
auccaagagcacuugacauuuuguggacaugauguuuaucuuugagguuaaccacaagaugcaaacucuaacaagau

SEQ ID NO: 4147582 - RNA, 70 nt, Human
auccaaguguugacaaccacagagcaacuacagaaggaacuuuguucucugaagguuguggaacuaugau

SEQ ID NO: 4147583 - RNA, 72 nt, Human
auccaauggauauuuuaugugagaaaacuguuaguauacagcauuccuuuccaguaaauuauugaguugggu

SEQ ID NO: 4147584 - RNA, 67 nt, Human
auccacgcuccuaauaaaugugguuuagcugcugcucuuaaaacuacacuuugggaccagcauggau

SEQ ID NO: 4147585 - RNA, 59 nt, Human
auccagaaggccacccggggauggaguucuguguggaagcuguccguggccuucuggau

SEQ ID NO: 4147586 - RNA, 64 nt, Human
auccagaucuucugugcaccuagcaucggcagcauguauguucaguuagcacugaagucuggau

SEQ ID NO: 4147587 - RNA, 60 nt, Human
auccagcaguguggucaccuuucacacagugugcaaggucuuaggagcauggugcuggau

SEQ ID NO: 4147588 - RNA, 88 nt, Human
auccagcucagcccccuauaaugacacauggugaguccuuccuauauacucacugaaagaaugacauuauggaaagauugaguuggau

SEQ ID NO: 4147589 - RNA, 78 nt, Human
auccagcuguuuucauuugauguaacaaagaacaagcagaaacuuuguuuuauccaaauggauaauaguguccuggau

SEQ ID NO: 4147590 - RNA, 56 nt, Human
auccaggccugagucugguccuggguuugggccugggccugggacuuaggcugggu

SEQ ID NO: 4147591 - RNA, 71 nt, Human
aucacaguuuccauaggucagcaguccagacauggcugaguccucugcucaaugucuuaugagacugugau

SEQ ID NO: 4147592 - RNA, 81 nt, Human
aucacaguuuuagcuguuaaauagaaugcuuuggggaaugauguuaauaucugcagauagcuuaacagcaaaacuguugau

SEQ ID NO: 4147593 - RNA, 62 nt, Human
aucacauagucauauaccuuugcauuccaggcacuuaaaaagaaugcaaauggcuguuugau

SEQ ID NO: 4147594 - RNA, 62 nt, Human
aucacauucuuucaaagcagucacggcccaccuaaaaucaagggcaggagagggaauguggu

SEQ ID NO: 4147595 - RNA, 66 nt, Human
aucaccaaccaguagcugaguucaaaaacuacauauuucuugggcaguccucuacugguaugugau

SEQ ID NO: 4147596 - RNA, 105 nt, Human
aucaccaugagauuuccaguauacugauuagauaguaagugacuaaaggacuacuuucaacugggcggaucugagaaggcuauucugagagguaacauuuaagau

SEQ ID NO: 4147597 - RNA, 85 nt, Human
aucaccgcaccaauccuagaacuuaguuauuaucacccuccuuuuguauguguggaaacuaagacuagagagacuuuguauugau

SEQ ID NO: 4147598 - RNA, 114 nt, Human
aucaccuagaaggcuuguugaaauagaucucugggucucaccaccagguuuucugauuugggagggccacaguggggccugagaaucugcauuucuagcaaguguccaggugau

SEQ ID NO: 4147599 - RNA, 111 nt, Human
aucaccugaagagcuuguuaagacacagauuuauuggccccuucucagagaugccuauugaaguuaguuggggcccaagaauuugcauuuuuaaccaagcucgcagaugau

SEQ ID NO: 4147600 - RNA, 64 nt, Human
aucaccugagccugacccagagccaccuagauaugaguacuuguuucaaggcucccugagggau

SEQ ID NO: 4147601 - RNA, 92 nt, Human
aucaccuggggaucucauuaaaaauguagacucugauucaguagggcugggcugaggucaagauucuacauuuguaacaggcuccaggugau

SEQ ID NO: 4147602 - RNA, 59 nt, Human
aucacucugagaggucacuggaaaagaacgagaacagcuuuccccauuucuuaggugau

SEQ ID NO: 4147603 - RNA, 118 nt, Human
aucacuguuauuauggugaauaccgaaugacuucacaauaaugugacacuuaaaaugcuagugcaauuuauuguuaagaaggacauuuuuuaguuuguucacuaaugccuacgguggu

SEQ ID NO: 4147604 - RNA, 62 nt, Human
auccuuaauuuacuugcaucuuaccuagccugaaguaaaaacggugcuuguagcuuaagggu

SEQ ID NO: 4147605 - RNA, 67 nt, Human
auccuuaucuucccauugugugcagccccagaauggguccugggacucccaagcuuggaggaaggau

SEQ ID NO: 4147606 - RNA, 84 nt, Human
auccuuauucuuuuucaaggaaaugacaugcugcccucauuucuaaaucuagaugucaucuuuuuaaagaagagacccugggau

SEQ ID NO: 4147607 - RNA, 83 nt, Human
auccuucuccuuauauuguaagguaagcauggguguacuggaaacaccacacucagaaccauuuacucugaggaaaaaaggau

SEQ ID NO: 4147608 - RNA, 79 nt, Human
auccuucuuugaagccagagaggaagguuuaggucaguaauggcagccucagguuuucuuugaaaucauagaaauggau

SEQ ID NO: 4147609 - RNA, 112 nt, Human
auccuugagaugaaaguuuuugcuaccauguaccagcaacuggaagucagauccauuggacugauuggggucccugcugugucauggcauaaaaugguuucauaucauugau

SEQ ID NO: 4147610 - RNA, 58 nt, Human
auccuugguaagagaguuggauuugagugacaucuggaggcuuucuauaccuagagau

SEQ ID NO: 4147611 - RNA, 99 nt, Human
auccuuuagguguguuggaguuuagaaaugauugagcuguaauacuuuuccagaguauugcuccuacagucaauuucgaguuccuuaagcccuauugau

SEQ ID NO: 4147612 - RNA, 92 nt, Human
aucgacccagcaguguccccaacgccugaggaccagcacccaucugugacaaggcacagggguccgcgauguuggccacugcuuugggugau

SEQ ID NO: 4147613 - RNA, 70 nt, Human
aucgcuuaagccugggaggcagagguuguagugagccaagaucgugccacuacacuccagcuugggcgau

SEQ ID NO: 4147614 - RNA, 59 nt, Human
aucggcaagccccacaccgucccuugcaaggugacaggccacugcggcucugugcuggu

SEQ ID NO: 4147615 - RNA, 80 nt, Human
aucggccuggcgcaguggcucacgccugcaaucccagcacuuugggaggccaaggagggcggaucacagggucaggagau

SEQ ID NO: 4147616 - RNA, 82 nt, Human
aucuaaaaacuuaucaguagauuucaggggagaggaaaagaccauuuuaauucuuuugcaagacuauugauuaguaacagau

SEQ ID NO: 4147617 - RNA, 92 nt, Human
aucuaaaauacuauauguagauuguaccaaugucaauuuccuaguuuugauauuguacuaggguuacauguuacuuauggaguaaacuggau

SEQ ID NO: 4147618 - RNA, 61 nt, Human
aucuaacaccuguuagcucuaauuuucuuuccugagaagcacaccaguagacaggguagau

SEQ ID NO: 4147619 - RNA, 65 nt, Human
aucuacguuagcugccuggccuuaguggggcucacacuccgccaagaguuuccagcugcaaggau

SEQ ID NO: 4147620 - RNA, 62 nt, Human
aucuagaaaaggugacuaaaaucugucaaaguacaaauuuuaggaugugccuuuuguuaggu

SEQ ID NO: 4147621 - RNA, 57 nt, Human
aucuagaaaguguugaagaucaugugagggaaacgugaacugucacacacuucugau

SEQ ID NO: 4147622 - RNA, 70 nt, Human
aucuagacuuucugggucaguauuuuggcuucuccagaauccgcuugacuuugaaguaucaaaccuagau

SEQ ID NO: 4147623 - RNA, 58 nt, Human
aucuagauuuaacagaguauaaguuacuauaggucaucuuguauuccuugaaucaggu

SEQ ID NO: 4147624 - RNA, 60 nt, Human
aucuagccaagggucagcugcacagagagacacauuuaggugaagacacuuuggcuugau

SEQ ID NO: 4147625 - RNA, 108 nt, Human
aucuaguuugaaagucagccagcuccuggucugagcucuaaaacuaacuccagaugaauugcccuuacaguaaucagauccagcgucucuggcugaucucuauuagau

SEQ ID NO: 4147626 - RNA, 69 nt, Human
aucuauaaaauuagucaaaacacugaguguuacaaaaauaguucaguguuuuaacugucuuuuaggggu

SEQ ID NO: 4147627 - RNA, 99 nt, Human
aucuauagaucagcuuuucaaugugaauuuuguccggccagcuuuuaacuaucaucugaagcagguggaaaauucuuaucaggauauagguagauagau

SEQ ID NO: 4147628 - RNA, 99 nt, Human
aucuaugaggugcuuuuauauuguuuucuuugcaguuucugagacuguuaaagcucaaaaguaagaggcugcaggcuggaaaucagagggacucuagau

SEQ ID NO: 4147629 - RNA, 73 nt, Human
aucuaugguaaaugagcauauguuccuuccuauacauaccuaccaugguggugagcauuugcuuauuuuaggu

SEQ ID NO: 4147630 - RNA, 97 nt, Human
aucuauguacuuuucucuauguguguuguaguuugaugaaaaguuaauacacacaagcacaaacacacacacauuuagggacuucuggguuauaggu

SEQ ID NO: 4147631 - RNA, 113 nt, Human
aucuauuaaauaauacagugguugagcuuggcucugaguucaccaacaagugugcuuaaauaaggugaauuacacugugagcugaagggcugcucgguguauuuuguaaagau

SEQ ID NO: 4147632 - RNA, 126 nt, Human
aucuauugagauaaucaugugguuuuugucuuugguuccguuuauaugcuggauuacguuuauugauuuguauaugucaaaccagccuugcaucccagggaugaagcccacuugaucauaguggau

SEQ ID NO: 4147633 - RNA, 71 nt, Human
aucucacaucuugguugauuuucuuuaugccgauugagggauaagcugaauagucaacacaaaauauagau

SEQ ID NO: 4147634 - RNA, 70 nt, Human
aucucagggauuccauucuugcuuuugaucuggaugaaaacaaauggaagaaagaugagugcccucggau

SEQ ID NO: 4147635 - RNA, 57 nt, Human
aucucagggcagagguaggugaggaaagagcuuauaugacugccccuucucugagau

SEQ ID NO: 4147636 - RNA, 88 nt, Human
aucuccacauugcuguucugcaccagacuucagcaccugcuaguuacaaugaaguuuuugcugcugggcaaaaccaaaguuuggagau

SEQ ID NO: 4147637 - RNA, 96 nt, Human
aucuccaccuccugaggcugggcguccuugugccagcuacuacucagcucuugcacaggccugagugugggcacgggggccuuggccgggugggau

SEQ ID NO: 4147638 - RNA, 85 nt, Human
aucuccccauguccagaagaacaguaauuccaagugcuuauacauaaauuauguuaggcauuaaaauuauauauggucgguagau

SEQ ID NO: 4147639 - RNA, 56 nt, Human
aucuccuacaugggaggagagaaaguuuuccuacucgccagucccauacaggagau

SEQ ID NO: 4147640 - RNA, 60 nt, Human
aucucucccuagguuagcggucaggcagaccuugcucugaacgaaccuccugggagagau

SEQ ID NO: 4147641 - RNA, 81 nt, Human
aucucugaaagaagaaauagucuaucugaacguaacucaaauuagguauaagaagauuauuuauaauagcucucaagagau

SEQ ID NO: 4147642 - RNA, 66 nt, Human
aucucugaugaugacuuugugaaaaugcuccuaccaccuggaaggauaaacagagcacaucaagau

SEQ ID NO: 4147643 - RNA, 95 nt, Human
aucucuuaccccugcuuucaaagaauguaucagauaaagcauguggaaaagaaaucuuuccaagccagugugauaugaaguagaaggugauggau

SEQ ID NO: 4147644 - RNA, 75 nt, Human
aucucuugguuacauuggcaguuuugaucugguuuuaaucaagauuuccuggauguaauucccauaagaagagau

SEQ ID NO: 4147645 - RNA, 86 nt, Human
aucucuuguuuuuaagugaugaaagcagaugucuaauauuguccuuaaggcaagaauuuuuacacuuauuuauuaauugaagagau

SEQ ID NO: 4147646 - RNA, 76 nt, Human
aucucuuucucuuggcagcugccugaacagcaguuuguggaaaggacugcugucaguuggcaggaugagggugggu

SEQ ID NO: 4147647 - RNA, 129 nt, Human
aucugaaaaaucacuuuugucuuugcuucuaaauguuuugcucccaugugguuauuuaauucugcaaauggcacagggacagaauuuuuaugacuaguaaugugcaaguaaauguguguuccaucugau

SEQ ID NO: 4147648 - RNA, 55 nt, Human
aucugaaaagccucuuacuccuuuuguuaagaggguauauaguguuuuugcagau

SEQ ID NO: 4147649 - RNA, 62 nt, Human
aucugaaaagcuuuaaugagcuaauacuagauaugccauaguuuuugaagcuucauuuagau

SEQ ID NO: 4147650 - RNA, 59 nt, Human
aucugaagaggucauggcugacauuuuuccaauauaaaugaaaaugugacuucucagau

SEQ ID NO: 4147651 - RNA, 93 nt, Human
aucugagacuaccuuauugcaaccagguggugaugucugagaggaacuuaggauuuauuacaagccaugguuuaaagguaaaagauuucagau

SEQ ID NO: 4147652 - RNA, 85 nt, Human
aucugauguccugcaggcugauagaggauuccauugcagaccugaucucuauguggaauuggaaaucagcauuguaguuucaggu

SEQ ID NO: 4147653 - RNA, 57 nt, Human
aucugcagaaacugugacuauguuguuauauggcaaauaggaauuaaguuugcagau

SEQ ID NO: 4147654 - RNA, 74 nt, Human
aucugcaggucuguccuggagaaccucaucaaggugagccacacagcccagcuccaggagaggccugaccaggu

SEQ ID NO: 4147655 - RNA, 78 nt, Human
aucugccuugagcuuacacaggaagcagccuggagccagacugcccagguucaaauagcugugugaccuuggacagau

SEQ ID NO: 4147656 - RNA, 100 nt, Human
aucuggacuagaacauauuacucaugugacuauauucucugguuuccaggcuauagaaaauuguaucacacgacuaugcuuuguucucugaaaaacagau

SEQ ID NO: 4147657 - RNA, 57 nt, Human
aucugggcagggcagcaaggcgagccacacuucaccuaaacuaauuccugcugagau

SEQ ID NO: 4147658 - RNA, 82 nt, Human
aucugggguuacgauuauucacagauguauuggaacuccuacacaaugggagcuacuuugugaaaagugaaauacuccagau

SEQ ID NO: 4147659 - RNA, 62 nt, Human
aucuggguuccuacucuguuagcuuucugccuggaaaauuugauucuuucagggaccuagau

SEQ ID NO: 4147660 - RNA, 73 nt, Human
aucugucugguuggagaaucacugcaagccaaggcguggcauuggccaauggugauucccggccuccucaggu

SEQ ID NO: 4147661 - RNA, 76 nt, Human
aucugucuucuacuuuuuaagugguuggaaaaaaaucuaaguggucucuuccaacuuugaaaauguuaugaaagau

SEQ ID NO: 4147662 - RNA, 83 nt, Human
aucugugucagaccccggcaguaaaacuuuauggguucuuccccgugaaauauuuuguuuaugucacgugggucucaucggau

SEQ ID NO: 4147663 - RNA, 72 nt, Human
aucuagaguucuugcuuauucuuuccacaauucauggaaacaugagagauugaauuaggagauuucuaaggu

SEQ ID NO: 4147664 - RNA, 61 nt, Human
aucuaggagcaugaagggaaggcaugaaaacccaaagcuuuuccugugaugcuuccugggu

SEQ ID NO: 4147665 - RNA, 72 nt, Human
aucuaggcauuuauuuuccaagccaauguccugucuuauuaagguaccacuuuggaagauaaugcuuaugau

SEQ ID NO: 4147666 - RNA, 129 nt, Human
aucuaguucuguuucuauuaacguuuuucucuuaguguuuagucauuuggauuugaucuuuugcauggcucauaauuauuuuguauuggaucccagauauuguauaagacaaaauuguagacucuggau

SEQ ID NO: 4147667 - RNA, 130 nt, Human
aucuauguuuaacuuuuucaggaaucaucaaaguguuuuucacaguggcugugccauuugacauucccaccaucaguguacaaggguaugguagcuuauuuuuaugacuuacguagguaucagacaggau

SEQ ID NO: 4147668 - RNA, 61 nt, Human
aucuauuagccuguugcauuuucacugcuaagcauuugagacguguacagagcuucaggau

SEQ ID NO: 4147669 - RNA, 114 nt, Human
aucuauuauugcuggcauuucuuuccccacugggcuguuuuuugaguggaugucauacucaucucauacagaaggcauguccaucaugcuagagcagugcugucaauauuagau

SEQ ID NO: 4147670 - RNA, 62 nt, Human
aucuauucuacucacaggaaggguuucccaauuuguuaaagaaacccucucuguagaaagau

SEQ ID NO: 4147671 - RNA, 78 nt, Human
aucucaaccucugaggacagaagggggcucucaaauccgcccaugcauugagaucuucgcucuucacagaggugggau

SEQ ID NO: 4147672 - RNA, 56 nt, Human
aucucauguucugaaccccaagguauucuaugacagaaugcaaaggacacugagau

SEQ ID NO: 4147673 - RNA, 88 nt, Human
aucuccaagauguauuaagugcaaaaaugaaaguauagaaccacguuccugauaagcuaccauuuguauauaaagcaugugugggggu

SEQ ID NO: 4147674 - RNA, 55 nt, Human
aucuccaggaagugucauuuaccuacccugcggugugaauagugccccuggaggu

SEQ ID NO: 4147675 - RNA, 115 nt, Human
aucuccaugauagccacuugucagcaaguagagcaugcacccuguacaggaaccagguguguacaaggccaucuacaugcuguagagucccuuaaagccaguggcuuaugguaau

SEQ ID NO: 4147676 - RNA, 62 nt, Human
aucuccauuugcaguuucaauagugucgucuaugaaacuuuugagcaaugcugcaaagagau

SEQ ID NO: 4147677 - RNA, 122 nt, Human
aucucccaucuucuaagcuaucguuagucuucuuucauuuacucaguuuccagaacugaauuuguguagauggucuggaagcaguagcucagguggcucauagaauuugaugcaaaggagau

SEQ ID NO: 4147678 - RNA, 71 nt, Human
aucuccucuacuuuuccugugaagcuguuucuucuccuucuggaagauaacagcaggaugauagaggaggu

SEQ ID NO: 4147679 - RNA, 91 nt, Human
aucuccuggagagcuguugaaaugcagacugugaaucaguaggucugggguacugcugagaaucugcuuuucuaacaagcucccaggugau

SEQ ID NO: 4147680 - RNA, 55 nt, Human
aucuccuguuuugagggggauuuaggagccucaggcuucccuuagagcaaaagau

SEQ ID NO: 4147681 - RNA, 79 nt, Human
aucucuccuggaaugcagaaguguggcccaacaggaucuucuaagccuuugcaacacaaaguuugauucccagcaagau

SEQ ID NO: 4147682 - RNA, 84 nt, Human
aucucucuggagucuagaccuggggcaaacguuuucuggaaagagcuagauaauaaauguuuuagguuuugugggccaagaggu

SEQ ID NO: 4147683 - RNA, 58 nt, Human
aucucugguccaaauguuaccuuuaccucaaauguggagaauagcaugcuuuagagau

SEQ ID NO: 4147684 - RNA, 129 nt, Human
aucucuuuuccacagugacaauccugagugucuccugcaguucugcaugugacacuguuuugagucaucauuuaagaccuugucuaaacauguagauauugucaaugcuacuaugucuuuauuaauauu

SEQ ID NO: 4147685 - RNA, 63 nt, Human
aucugaaaguauauuuccugcuguuuaucugcuuccagaacuggcugaaguuuacuuuuuggu

SEQ ID NO: 4147686 - RNA, 77 nt, Human
aucugaaaguuguauugacaagaaagcgucuucuuuuucagccaguuuggcugaauuuuuugucuuuguaacuagau

SEQ ID NO: 4147687 - RNA, 87 nt, Human
aucugaaguucccauggagagaggcaagucaaagugcaaauguugaagcugccguuuuucuccaucagcuuucuugggaauugaggu

SEQ ID NO: 4147688 - RNA, 130 nt, Human
aucugaauccauuuagaguagaaaugguaucccugugauuggcuuccuucuuauugucagucucugcuaaaagagugagaagagaugaggaagaaaaugggaagcagaaucuccucuuuuggguucuggu

SEQ ID NO: 4147689 - RNA, 55 nt, Human
aucugaccuucuguuugagaacaauguuccccaaauguguaaggaaguguuagau

SEQ ID NO: 4147690 - RNA, 103 nt, Human
aucugaucuagugacuuaguucugcauguauaauuaauuggcagcauguucacagcuccuacuaagcugccugauuuacauagugaagcuagcagaugcagau

SEQ ID NO: 4147691 - RNA, 97 nt, Human
aucugaucugcuacuuaucuuuguaaguuauauguaguauauugauaauaacagguuacacauacauugcuuacaaggugauagagauagauuagau

SEQ ID NO: 4147692 - RNA, 83 nt, Human
aucugaugcgauuuuuuaagcugcugguuuguuccaaacugauaucucaaaggaguacaaauuauagcgcuuggaauuuagau

SEQ ID NO: 4147693 - RNA, 76 nt, Human
aucugccucuucuucauugcgaucuuagccuuuuggauuucaauuucuucauuuguaaagaggggggaugguagau

SEQ ID NO: 4147694 - RNA, 75 nt, Human
aucugcuggcuuuaguaauaaguuucucccuuaaaaggugaacgggcuuugacuaaaguguaaauaaacagugau

SEQ ID NO: 4147695 - RNA, 59 nt, Human
aucugcugucacauguuugaagcaugaauauauccuuccaagaaacaagugaugcagau

SEQ ID NO: 4147696 - RNA, 67 nt, Human
aucuggaauaggauaauaucuauuugauuugaaauugaacagaugguagcauuauguugguccagau

SEQ ID NO: 4147697 - RNA, 57 nt, Human
aucuggaaucaguggcuuacccuccuugagcaggaguagcuauacaggauuucggau

SEQ ID NO: 4147698 - RNA, 61 nt, Human
aucuggagcucugcacaccuggcccaaaauacacuugagcaggugauguugacuuuaagau

SEQ ID NO: 4147699 - RNA, 83 nt, Human
aucuggauaauucagauuuacaacacuacuuauccuugaaaugguuucaagggaaaaaugguuuuguggggacuuguuuagau

SEQ ID NO: 4147700 - RNA, 86 nt, Human
aucugggaagccccagcucugccaagcgucagcuccgagcccucgccagucucugaagcugccagcgcagggcuggggacccagau

SEQ ID NO: 4147701 - RNA, 70 nt, Human
aucugggcauggaggaaagagaaaugagucugcuuuauuuugcuaauuauaucuuucuuuccgccuagau

SEQ ID NO: 4147702 - RNA, 58 nt, Human
aucugggccuguucccucaccuaguuagaacacagcaaaugaggccaaggucacagau

SEQ ID NO: 4147703 - RNA, 58 nt, Human
aucugggucuaugaucucacuucaaaguuuuggaguaagaaauucuguagauccugau

SEQ ID NO: 4147704 - RNA, 87 nt, Human
aucugguacauguuaaugaauuuuugcaguuccuuuggauauaaucucuuuccuccacugucagguucagcauguuucuagccaggu

SEQ ID NO: 4147705 - RNA, 63 nt, Human
aucugguauuauuucacaugugaaguacagacuugauguuauucucacaauaugaugccagau

SEQ ID NO: 4147706 - RNA, 104 nt, Human
aucugguauuggcaaggagguggaguaacacugcagaugaaagcauaaguugguacagccacuuuagagaacuucuuaguggucucuacuuacgcugaacagau

SEQ ID NO: 4147707 - RNA, 63 nt, Human
aucuggucucaaucaagcuacuggguaagagacuuuuguguaauugaaauugagaaccaugau

SEQ ID NO: 4147708 - RNA, 78 nt, Human
aucuggugcccuuccagcauucuuagaccucuauacucuuaaaguccguugcauaugacugggagcaagggacuagau

SEQ ID NO: 4147709 - RNA, 76 nt, Human
aucuguaaauuguauuuguacaagacaugugauugccaagagcuuucuccacagucuuugcagaagcaauauaaau

SEQ ID NO: 4147710 - RNA, 63 nt, Human
aucuguaagagacuauugagcaucuuggccgcuuccaaaaugaccucagaguuuuugucagau

SEQ ID NO: 4147711 - RNA, 60 nt, Human
aucuguaguauuauacuaaggacuaaaugagauaaagucacuaaaguguuuagugcagau

SEQ ID NO: 4147712 - RNA, 90 nt, Human
aucuguauguggaccauugcaaauaaacaaguauacauuguauguugagaaaguacuguguaucaacauguuuuuuguguucaugcaggu

SEQ ID NO: 4147713 - RNA, 62 nt, Human
aucugucacuauuggccagaacaagcaacauuacuucucucuguuugaugguggagccaggu

SEQ ID NO: 4147714 - RNA, 63 nt, Human
aucuguccuggagcuaggcuucccaccaggcgaaaaugaaggccaggaggagcuccaguaggu

SEQ ID NO: 4147715 - RNA, 89 nt, Human
aucugugaaccaggucagcuggcaucuauaccagaguccuuccggccuacauguggucacuuguuuggagccagcuguaauucacaggu

SEQ ID NO: 4147716 - RNA, 88 nt, Human
aucuguggcuguugacagaaugagucaugaagauuagcaauguguuuauugguuacagaaaaugauuuauaauguggaagauacaggu

SEQ ID NO: 4147717 - RNA, 81 nt, Human
aucuguguaugauaagccaugucguggucaugguguacugcgguagacuacaaauucuaugguuuuuauuauaagcaagau

SEQ ID NO: 4147718 - RNA, 62 nt, Human
aucugugugcagggaugagugcagguacgugugaguguguaaguguauguguguacaggggu

SEQ ID NO: 4147719 - RNA, 72 nt, Human
aucuguugucugggucggugccacugugggggaaaacaaaggccuucccuaccuuccugcccagagacagau

SEQ ID NO: 4147720 - RNA, 83 nt, Human
aucuguuuggggauaggugcaauaaauaaauagauuguuguaauuaauaauaaucaauguguuauuguaauuaacauuuagau

SEQ ID NO: 4147721 - RNA, 102 nt, Human
aucuuaaccuccgagcuaauuggcaagcagauuuccacuaaauuuauccaucucucaacaauuuauggagguaguuuuguaugcuaaggccuggauuaagau

SEQ ID NO: 4147722 - RNA, 62 nt, Human
aucuuaagguaagaggcuuagcgugaugcagcuuucucaucaagugccuuucaccucuaggu

SEQ ID NO: 4147723 - RNA, 56 nt, Human
aucuuagagaguuuuuauauccuaaaaagaucuuugaaggagaaagcuuucuuggu

SEQ ID NO: 4147724 - RNA, 74 nt, Human
aucuucuaccucccuguggcaacaauauuuucuaauuaaaggaguccuuuugugccacagggaggauuucugau

SEQ ID NO: 4147725 - RNA, 76 nt, Human
aucuuggaauccuucucuucucuuauguauucugaccuugaagggucacuguauuuggaagggaugggaccaugau

SEQ ID NO: 4147726 - RNA, 65 nt, Human
aucuuggcaucaccacuuacuuacuagucccuaaugguggcuucucugugggguguugugaggau

SEQ ID NO: 4147727 - RNA, 89 nt, Human
aucuugucucaaauggccuuugggcacugugggcagagaugaucgacugcugucccuucugugcccucggugcugggccugagcaggau

SEQ ID NO: 4147728 - RNA, 60 nt, Human
aucuugucuguuaguuggugugggggagaaaacaaauguuucuaaucuuacagacaggau

SEQ ID NO: 4147729 - RNA, 78 nt, Human
aucuuguugagaccagacacgaugccuugcucuucuuccauuaccagugucaggcacagugccuggaaucaaacagau

SEQ ID NO: 4147730 - RNA, 60 nt, Human
aucuuuagagucaucugagugucaacacacucuauuuaugacacucguaauuuuagaggu

SEQ ID NO: 4147731 - RNA, 62 nt, Human
aucuuucuaugguacuuucuccauaucauaaaaacuuuggagaccuguauuauugggaagau

SEQ ID NO: 4147732 - RNA, 55 nt, Human
aucuuucuccauauacaucuuucaucauauaaagggagaaguaaaggggaaaggu

SEQ ID NO: 4147733 - RNA, 76 nt, Human
aucuuucuggacagauuuguucuuuugggcuaaugaaaaauugaugguuauggguggagaacaggaccagaugggu

SEQ ID NO: 4147734 - RNA, 62 nt, Human
aucuuuguaguuauaaacgacuuuuguuuuaauaacaaaguuguugauuuucuacuaagggu

SEQ ID NO: 4147735 - RNA, 83 nt, Human
aucuuugucaaugcucauccccccauuugcaaaaugagggucaaauggugaccucaaaguagagggagaugaggaccagagau

SEQ ID NO: 4147736 - RNA, 66 nt, Human
caaauagcucuuuaguccuggccauuccagaccagaagcucggagucagagcagaagggcugcuug

SEQ ID NO: 4147737 - RNA, 58 nt, Human
caaauaguaugagcaaugauucuggguuucagccucauugccugguuuauacuguaug

SEQ ID NO: 4147738 - RNA, 99 nt, Human
caaauauauaugcuagcagggauacaguuaaaaaguucaaugguuauuuaggaauuaccuuuggaguuagcuguguucaaaaauuagcauauuaguuug

SEQ ID NO: 4147739 - RNA, 70 nt, Human
caaaucaccacuuaauggguuaaagcagaaaccauauuauuugcucacaacucuaugggucugugauuug

SEQ ID NO: 4147740 - RNA, 67 nt, Human
caaaucauaauuguauacauucauggggcaccauguuauguuuuauguaucuauacaauaugaagug

SEQ ID NO: 4147741 - RNA, 74 nt, Human
caaauccacauuuaggucucuaaaauuauucugucuccugaggauguuucagggucagccuguauguguauuug

SEQ ID NO: 4147742 - RNA, 60 nt, Human
augccuggguuccauccucagagauuuggauucaauuuaagugagugggagcccagguau

SEQ ID NO: 4147743 - RNA, 64 nt, Human
augccugugucaucuuucuuguucacauuuauaucaaugcugagcacagcaaagagacaaguau

SEQ ID NO: 4147744 - RNA, 128 nt, Human
augccuuaggcccaccccuggccucccuggaggggagcaacauagucacucucuaguuacagaguacuugguguagauaaugaugcucuccacccugggccaaaguggccaugcaugggccaagacau

SEQ ID NO: 4147745 - RNA, 68 nt, Human
augccuuauggacuuugggcucuuuguagauagauguuucaagcagagucaaaaguaccacaaguuau

SEQ ID NO: 4147746 - RNA, 69 nt, Human
augccuuauugcauuuugugaauuccuuuucauguauaacauuaagauucacagagugaaugaaaguau

SEQ ID NO: 4147747 - RNA, 89 nt, Human
augccuugaaaaaugauuuuguagcugaugcagaagccgucugcguauggcuguucuuugcaucaguccucaauaaaauccaagggcau

SEQ ID NO: 4147748 - RNA, 72 nt, Human
augccuuugccaccaggagaaccagugcaacugaaguuuccacugccugcugcucuccuguggcauccacau

SEQ ID NO: 4147749 - RNA, 59 nt, Human
augcguuaguuacugaaagcauauauuuguccacauguuuucuaaguaacuggcagcau

SEQ ID NO: 4147750 - RNA, 56 nt, Human
augcuacuuaaaguauaggggaauuuaaauuauugccuuuaugcaaggacuggcau

SEQ ID NO: 4147751 - RNA, 71 nt, Human
augcucaccgucuugggaucuacauagcuauguacacugggccuugugugcagaaucucaggagugauuau

SEQ ID NO: 4147752 - RNA, 60 nt, Human
augcucagggcacacucuggaccaauuaaauccaaaucucaaggagagugacccaagcau

SEQ ID NO: 4147753 - RNA, 79 nt, Human
augcucaggugccuuggcuaauuguuaucugguuauuaucuaucaaggaacaauuacuaccaaggccuguaggaggcau

SEQ ID NO: 4147754 - RNA, 77 nt, Human
augcugaaggccuucccacagugaucgcauucguacgguuucucccccguguggcuucgcaugugcgucuucagcgu

SEQ ID NO: 4147755 - RNA, 62 nt, Human
augcugaaucccagaguccccaagaaaccauacuuugcaugguggcuucagggaguuagcau

SEQ ID NO: 4147756 - RNA, 130 nt, Human
augcugagaugaaucagaaauuugcgccccaccccaccccggcuucuauuaggucggugcaaaaguaauugcaucaaccuaauaucagcucauggguuagugguguucacaaccaucugauuucuauugu

SEQ ID NO: 4147757 - RNA, 66 nt, Human
augcugaggaacaucuaucacauaaacgagauuccuuaauuguuuagcauaaagauuuuccagcau

SEQ ID NO: 4147758 - RNA, 82 nt, Human
augcugauuccuaggaguugaggagugugaggucucccaggagcaacucagaggcuuccuuccucggagcuggaacuggcau

SEQ ID NO: 4147759 - RNA, 75 nt, Human
augcugcguaucaacaggguggccaguguauuuuuacauguaaguacacaaaggcacucuguuguuaccacgcau

SEQ ID NO: 4147760 - RNA, 112 nt, Human
augcugcuucaguaagugucaugguauggggagauaggaauuaacccacaucaaccaaacuagagcuuuggucugauucuugcuccccaagauggggcccgcaaagcagcau

SEQ ID NO: 4147761 - RNA, 78 nt, Human
augcuggacauauggagagguucaauacauguuggugaccaaaugaagugauguugauuuuaccacuuacuccaguau

SEQ ID NO: 4147762 - RNA, 62 nt, Human
augcuggagcccugaaugggcaggaagcauugcgguuuccauuucauucagagcucuuucau

SEQ ID NO: 4147763 - RNA, 64 nt, Human
augcugggaaguccuaaccacaucaagaaugccucagaucagugacccaaggaccuuccagaau

SEQ ID NO: 4147764 - RNA, 87 nt, Human
augcugggcuguggcacggcauguuugcgguaagcuacucagauuuaaggcccuuaguguaaauugugcuugagauaaggccagcau

SEQ ID NO: 4147765 - RNA, 59 nt, Human
augcuggggccucagaccagaacaguaauuuagaaccucugguaguggggcccagguau

SEQ ID NO: 4147766 - RNA, 56 nt, Human
augcuuaaccuugguguacaauaagcacaauauugauguacaacaaugcugagcau

SEQ ID NO: 4147767 - RNA, 58 nt, Human
augcuuccaugaacguucuugucaauguugacaaaugcaagagcuuuccaugggguau

SEQ ID NO: 4147768 - RNA, 129 nt, Human
augcuuccuucccuguucuggagguuggguccucuuccauaagguguuguccuuugguacagcuuuguuguaccauauagaugguaccuucugggccuggacaaucacuugaccaaagggaugggagcu

SEQ ID NO: 4147769 - RNA, 61 nt, Human
augcuuggccccuuuauagccuuaaauauaaaaagaaugcugucuuugaagggguuaguau

SEQ ID NO: 4147770 - RNA, 60 nt, Human
augcuuggcguuucacuuccuguccacugagacaguccuaagucaugcaugccauagcau

SEQ ID NO: 4147771 - RNA, 81 nt, Human
augcuugugucuccauugaacauccucucagaaccuuuagcaugcuaauguguuugugaauguccaagggagucauaacau

SEQ ID NO: 4147772 - RNA, 58 nt, Human
augcuuuauuggagacagucauuguaucaacaguacacuugaucuccaguacagacau

SEQ ID NO: 4147773 - RNA, 76 nt, Human
augcuuuuuguaauccuaaaauuaauuccaguuagcuuggcaaaaguuuuagguuauuuuauuuggaaggaagcau

SEQ ID NO: 4147774 - RNA, 56 nt, Human
auggaaagcuuuagaauuguacucagucaagcugacaguucagacaaguguuccau

SEQ ID NO: 4147775 - RNA, 62 nt, Human
auggaaauacagccagagcagaaauaacagucuauuucccucugccugugcuguguuuucau

SEQ ID NO: 4147776 - RNA, 79 nt, Human
auggaacagaugccugauucauaggagguuccccaggacucuccucucauggggucugagggucaggaaucugugcugu

SEQ ID NO: 4147777 - RNA, 63 nt, Human
auggaagaaagagacaauuugauuugggaauccagggauauuuguacacucuuuuuauuccgu

SEQ ID NO: 4147778 - RNA, 71 nt, Human
auggaaggaauguggcaugcagcugaccucugguacaggacagcaagaggaagcugagaugccucuuucau

SEQ ID NO: 4147779 - RNA, 67 nt, Human
auggaaguuggaaccauucauaaaucuagggcugcuuggacagaaucgugguuccacaacuucucau

SEQ ID NO: 4147780 - RNA, 66 nt, Human
auggaaucagagaaaacaagauaugaggauucuuuaaaaaucugcccugucuuuuucugaugacgu

SEQ ID NO: 4147781 - RNA, 129 nt, Human
auggaauuaggaccagaagcuugucugaugcuuuccuuuuuacuguaugagugugguagucuuugaacaagugaauggcaucauagugcaguagaggagagcccaggauuggaaucuagcuuuuaccau

SEQ ID NO: 4147782 - RNA, 57 nt, Human
auggaauugaagacagcauaggggccagaaccuugugucaggaaguuucaguucuau

SEQ ID NO: 4147783 - RNA, 121 nt, Human
auggacaccagauggcggaagaggcugcagaggugcugccagagacaaggcuaggguccaccccucuggcugcuaccuuugaaaaggcuauggcuucuuccuuagaaaaggggcaucacau

SEQ ID NO: 4147784 - RNA, 72 nt, Human
auggacauacguuuucauuucucuuggauagauaccuaggaguggaauugcugauugaaauaguauguuuau

SEQ ID NO: 4147785 - RNA, 64 nt, Human
auggaccagaguugacuacaaaccacagauuucaccugugacauuuguuaauuuugaaguucau

SEQ ID NO: 4147786 - RNA, 66 nt, Human
auggagaaaguacagcaggcaacaaaaauagucuucucauuacuguuuucuguguauuuuuuccau

SEQ ID NO: 4147787 - RNA, 105 nt, Human
auggagaacggcuucuguccugcauaaguuccuuuuuuaaucaacacaggguaaauuucuuaucucugugggaggaggaguaggcuucagaaguuauugcuucau

SEQ ID NO: 4147788 - RNA, 86 nt, Human
auggagaagcuaaaagagaugugguuuaaugaggacuaaaaucaagacuuaagagaauuuacacauuuuaauuggcauuucucuau

SEQ ID NO: 4147789 - RNA, 85 nt, Human
auggagauuccaguuaguggcagcuuauccgguuacuuuagagacugauuaaugaguugucacuguuuuauuggauaucggucau

SEQ ID NO: 4147790 - RNA, 73 nt, Human
auggaggaguaaaacuggaaugaaauuuacgaugcuuaaaggccauuguuaguacauuugagaacucuaacgu

SEQ ID NO: 4147791 - RNA, 77 nt, Human
auggagguuuggggaguuccuuuaggcccccaauaaaccuguuuguggaggccuggggaguuucuucagacccccau

SEQ ID NO: 4147792 - RNA, 129 nt, Human
auggagugacgagggagaauugaccuauggaaaccucuggcucagugccuucagaagucagggugucaguuuucaggcucugccagacacuguggccaaggccaagggugcuccgucaaaucuauccau

SEQ ID NO: 4147793 - RNA, 64 nt, Human
auggaguugacggccgacacccagaucucguacuccgaguuggggcucaggccgccgaugcugu

SEQ ID NO: 4147794 - RNA, 106 nt, Human
auggaugaaacucaaggauauuaugcuaagggaaauaagccagacacaaaaagauaaauacugcaugauuccacuuauaugauucaucuugaguagucaaauccau

SEQ ID NO: 4147795 - RNA, 58 nt, Human
auggaugacuuggaagccugucauuuaacuguucugauucaguuucuuccucaucuau

SEQ ID NO: 4147796 - RNA, 60 nt, Human
auggaugaguccuugagacacagcuuaaauggaaaagcauuaugucuugcauucauccau

SEQ ID NO: 4147797 - RNA, 63 nt, Human
auggaugcuuuucuuuucagcaagacuucaauugucuaccuguuuauauaggagaagcucugu

SEQ ID NO: 4147798 - RNA, 66 nt, Human
auggauggauggaagaagaauccuaugagguugugcuugccuccugguugcuucuccaacaaccau

SEQ ID NO: 4147799 - RNA, 74 nt, Human
auggauguauuuuagaucugcuuugcccuauaugauugcuacaugugucuacugagcauuugaaauaugacuau

SEQ ID NO: 4147800 - RNA, 85 nt, Human
auggauucuacagguuaggaauuuggacagagaacaauaguuugucucugcuucccaauuucugggaccucuauuuggaagacau

SEQ ID NO: 4147801 - RNA, 78 nt, Human
auggauugugaguagaaguggcauaugucacucuuggaccaaagcauuuaagagcuaguaugucauuucacagucugu

SEQ ID NO: 4147802 - RNA, 102 nt, Human
auggauuugccuauucuggacauuucauguaaauggaaugauacaauauguuaccuuuugugucuguauucuuuuagcaugauguuuucaagguuuauccau

SEQ ID NO: 4147803 - RNA, 76 nt, Human
auggcaaguggcuguucucauuggccuggcuuccccuugagacuggggaugaggaaaaugaaacagcaacugucau

SEQ ID NO: 4147804 - RNA, 113 nt, Human
auggcaaucccaggagagcucaaugguuauuuuuggaugcuaguuaguuacaggguggagcauauaacuaacuaguguucaaaauaccuacugagcucucuugggacugccau

SEQ ID NO: 4147805 - RNA, 56 nt, Human
auggcacaggagaggagggcuguuugugcacgggcagcuccugcagcugcugccgu

SEQ ID NO: 4147806 - RNA, 57 nt, Human
auggcacugggagucuguggggguucuuaucugauuacuucaauuucucagugaagu

SEQ ID NO: 4147807 - RNA, 72 nt, Human
auggcagaagaguagaagagcaagcuagcugaaugcugcaugaagucuuuuuuauaggcgucuuaauaccau

SEQ ID NO: 4147808 - RNA, 56 nt, Human
auggcagccuguggacagucaaggguaccggggccagggcuuauaggaccugccau

SEQ ID NO: 4147809 - RNA, 61 nt, Human
auggcagggcccuuggcucccaugccagcgcaugggacuggacaguggagggccauguggu

SEQ ID NO: 4147810 - RNA, 63 nt, Human
augcuacacuauuugcugagcaagguauaacuugcuuugagucagagguaagagaugaagcau

SEQ ID NO: 4147811 - RNA, 61 nt, Human
augcuacacuccgcgaaaauguaaaauuuuagaagaaguucucuauuugugggugaaguau

SEQ ID NO: 4147812 - RNA, 63 nt, Human
augcuauguuaugacaagcaugacagacuugauggggaucuguucugacucaugacauugcau

SEQ ID NO: 4147813 - RNA, 84 nt, Human
augcuauuggcuccuucuaacaugucuuuacauucucagauauuugauggcagacaguuugaaggcccaacaaaaaugugguau

SEQ ID NO: 4147814 - RNA, 129 nt, Human
augcuauuuuaaaaauaguucauuuauuuaagaauacuuuuugaauaauucucaguaccaucugguagcuggaaaucaaagaaguggaucuuaacauucauagaggaacuguuuuuuaaacaguuuuau

SEQ ID NO: 4147815 - RNA, 77 nt, Human
augcucacaggcaaguuguuugcuaucucagaaauuaauuaacccugggaggggcaggucccaaguugucaaagcau

SEQ ID NO: 4147816 - RNA, 68 nt, Human
augcucaguugcuuucugauuuauaccauacacgugaaucaaagaaugugacugaaauauuuaugcau

SEQ ID NO: 4147817 - RNA, 68 nt, Human
augcuccucgagugucucacagacaagaaaacuaauuccuuggguauaggucaggcacgugagagcau

SEQ ID NO: 4147818 - RNA, 66 nt, Human
augcucuauacugauaauuuugacuggugcuaauuuaccagucaguucugauuauguggauugcau

SEQ ID NO: 4147819 - RNA, 68 nt, Human
augcucugccugcucaccagggcucugcugcucuuuuaccaccagauugcccuuggcaaggcuuguau

SEQ ID NO: 4147820 - RNA, 82 nt, Human
augcucuugguaccaauucuuaaguauuccugauaggccacugccuucagccuagaacuugagaggacccaguucuuagcau

SEQ ID NO: 4147821 - RNA, 88 nt, Human
augcugagaauggcaguggauccaaugguaucuucucuguaaaguugaggaaugcgagaauugcuuuuuuaccugccauucuucucau

SEQ ID NO: 4147822 - RNA, 80 nt, Human
augcugagguccagagcuggcacacugucacugccacacuuugccaaugcaagugacaaggccagccuggauuccagugu

SEQ ID NO: 4147823 - RNA, 109 nt, Human
augcugagugguguuuacugcucauuagcucagauaccucugagagauucugccuaaacuacuauaaaucucuuauuugagcagcaaguagauagccaugaauaugcau

SEQ ID NO: 4147824 - RNA, 77 nt, Human
augcugcaggagggcccaccuugggaguggcaucuggggucccacagaggccaccagagguggugccugggcagugu

SEQ ID NO: 4147825 - RNA, 62 nt, Human
augcugcagguugagucuuagagccaguacugucugggaaagaagauucugauuuguagcgu

SEQ ID NO: 4147826 - RNA, 61 nt, Human
augcuggcuagaauauuuuaaaacuguuuuuauugaaaaguacaaauguucuagccaucau

SEQ ID NO: 4147827 - RNA, 59 nt, Human
augcuggcuuuuugugucaaagaucaugucuguaucucagagaggcagaggcacagcau

SEQ ID NO: 4147828 - RNA, 57 nt, Human
augcugggugagcauuaauagagguucccuuuuccccuugcacuaucacccuggcau

SEQ ID NO: 4147829 - RNA, 61 nt, Human
augcuguggccagaguucaacuuuacaaaguuuuugaaguugguucucuucagccuagcau

SEQ ID NO: 4147830 - RNA, 64 nt, Human
augcuguguuuggagguuugccaggagauauuucuaacugagcagcaccuucaagaaacaggau

SEQ ID NO: 4147831 - RNA, 57 nt, Human
augcuuacuguaaaggucacaugguguuaaauuagcacuuugauauacagaaaguau

SEQ ID NO: 4147832 - RNA, 71 nt, Human
augcuuacuguacauuccguuuguugcacaguagacaguuggcaauaaaagugugaagugcagagaggcau

SEQ ID NO: 4147833 - RNA, 71 nt, Human
augcuucccuaacugcaaagccaaucucaggaguugaguagcuccugaaagaagcuuugaguuagaaguau

SEQ ID NO: 4147834 - RNA, 84 nt, Human
augcuugcaagaaacauauuccacaagcguuuggguaagucauauauuauuugacacuuuggaaauaaauuucuuguuaagugu

SEQ ID NO: 4147835 - RNA, 59 nt, Human
augcuuucuucuuuccuguaagcaaagaucaauucuucccuaggugcugaagauagcau

SEQ ID NO: 4147836 - RNA, 93 nt, Human
augcuuuuugaugcuuagaguagauuucucuuuaagaugauguaauauuagucuucuaugaaguucagagaucuauaccauagcucaaagcau

SEQ ID NO: 4147837 - RNA, 82 nt, Human
auggaaagggauuaaccuaaagaaggauguguguuuucuggaaggauaauaaaucucugcuccucuuggguuuuuccuccau

SEQ ID NO: 4147838 - RNA, 93 nt, Human
auggaaaguacugguuaaguaguagaugcagauuguuuggguuugaauccuggcucccucauuuacuacucaugugaccuauuuacuucccau

SEQ ID NO: 4147839 - RNA, 74 nt, Human
auggaagacuugggaugcucaggguccugcuagccuucaaacugcaggacucugagcaucccaagucuuaccau

SEQ ID NO: 4147840 - RNA, 93 nt, Human
auggaaguguuuuagacauggaugcugaguggagaaugguuaagucaaucagucaucccagcuuucaucucuaguguccugauagcacuccau

SEQ ID NO: 4147841 - RNA, 73 nt, Human
auggaauacuaagcccaagaacacauggucugaccuugaacccugguucugaucugcuucugaguuauucuau

SEQ ID NO: 4147842 - RNA, 60 nt, Human
auggaaugcucccuggggacauggggccgacccucucccuuucgaggggcagcaguccau

SEQ ID NO: 4147843 - RNA, 82 nt, Human
auggacaauuaguugauuccauguuugggcuguucugaauaaugcugcuaugaacaugagaaugcaaauaucucauugacau

SEQ ID NO: 4147844 - RNA, 59 nt, Human
auggacagguacugcaguggguggcagauggccacauaaugaucauaguccuugaccau

SEQ ID NO: 4147845 - RNA, 65 nt, Human
auggacgagccacagaaauucuacuuugaaucaggggaauuaauugugugguuugaauaauccau

SEQ ID NO: 4147846 - RNA, 65 nt, Human
auggacugaauuucuugaaggcaggauacuucuuuuuaguuuuguacucucagaauucagaacau

SEQ ID NO: 4147847 - RNA, 62 nt, Human
auggacugggcucuagaaaggaaagaagcaggcgacagcuuuaacccuagugcucagugcau

SEQ ID NO: 4147848 - RNA, 89 nt, Human
auggacuucucgcacgggcuggcgcucucccagcgcugccccaacgccguggagccgcuguggguggagggcgccgggcacaaagacau

SEQ ID NO: 4147849 - RNA, 80 nt, Human
auggacuuugcuaucguguauucuagccaugucuucuucacaaacauguaguaguuuggagacacugguuuagcauucau

SEQ ID NO: 4147850 - RNA, 62 nt, Human
auggagacauuacacuaagugauagaagccagacacaaaggccauuuauuguaugauuccau

SEQ ID NO: 4147851 - RNA, 69 nt, Human
auggagacucugcuaagaauauaauucaaucuuaaggacagaguuaauccuuuuuugacagaguugcau

SEQ ID NO: 4147852 - RNA, 56 nt, Human
auggagcccagauucuuuguuugcuuuaaagaaaguaaucuggaauuugguuuugu

SEQ ID NO: 4147853 - RNA, 69 nt, Human
auggagggaaaaguggagagccacagaguuggcaaauaaugcuaucauccucuccucucuucauucuau

SEQ ID NO: 4147854 - RNA, 84 nt, Human
auggaggggaggagagaaagugauggauauggauacauuuaggagaauguguacaaccaagcacuaaacucuccuuuucugcau

SEQ ID NO: 4147855 - RNA, 65 nt, Human
auggagggguggggacaaugcacugauguuuaaaaagacaucuguuguuuuucaccacccaccau

SEQ ID NO: 4147856 - RNA, 70 nt, Human
auggaucucuuccagguucugguugggaagcagaggaaugaacuuaacggccucuggaaguaaugucuau

SEQ ID NO: 4147857 - RNA, 59 nt, Human
auggaugaugguguguccugugucgccuugccaggggcuucucagcacacuguccacau

SEQ ID NO: 4147858 - RNA, 73 nt, Human
auggaugggauauugcuugccacuucuccccaaggaccagagagaggauuaaugaggcaguauucacauuuau

SEQ ID NO: 4147859 - RNA, 61 nt, Human
auggauguuaugagcauugauauaagauguuaauuuacauuguucacucauagacaucuau

SEQ ID NO: 4147860 - RNA, 61 nt, Human
auggauuagcaugguaaugcagucacccccugcuaaucggggcgaguaccagcugauccgu

SEQ ID NO: 4147861 - RNA, 63 nt, Human
auggauucaagaaccaagggagaguaaaauugguccaucucacccuaacucuaaaggauccau

SEQ ID NO: 4147862 - RNA, 114 nt, Human
auggcaagucacuuucugaaacugggcuguagcucuagacaaaugauuguaugaaguuuuaaauaaacauacaacauuuacguuaggcuguuucuugaaaugauuuauugucau

SEQ ID NO: 4147863 - RNA, 75 nt, Human
auggcacagcucacccaucacgucugcuucccacuaacaagcaagagugccaugggaugaggucuccuaggccau

SEQ ID NO: 4147864 - RNA, 79 nt, Human
auggcacuucaauguaauaaaauacucuauagcauuaaaaugagauagaauauuuaaugacagaagaaaagguggccau

SEQ ID NO: 4147865 - RNA, 59 nt, Human
auggcagaaaggcaugugggcccagcugucuaacucuaguccacugcucuuucugcugu

SEQ ID NO: 4147866 - RNA, 105 nt, Human
auggcagcugguaaugucuugcagcugguugaccaguuuaaugaugccaaaaucuggcuacaucccucuccuguucugaccagugcagggaucagcuuucgucau

SEQ ID NO: 4147867 - RNA, 89 nt, Human
auggcaggcagccagcuguucuuuaauuuaacccuuugucuuugcagggacaaaacacauuaguuuaaaaagaagcugcugcuagcuau

SEQ ID NO: 4147868 - RNA, 59 nt, Human
auggcaggcauugcaacauguacauacugagugcugaguaugugcccugugccuguggu

SEQ ID NO: 4147869 - RNA, 71 nt, Human
auggcagggcugagcccaggcauguaguaagcccuccaagcuuguuacccaccuuucucaugccaagucau

SEQ ID NO: 4147870 - RNA, 82 nt, Human
auggcagugucccuggccacaguguccagcagcagcauggcagccgcagcagggcucuguggucagacaggggugcugcugu

SEQ ID NO: 4147871 - RNA, 55 nt, Human
aucagagcugugauucccacucuugcugcacggcgggcugaauugcgccucugau

SEQ ID NO: 4147872 - RNA, 68 nt, Human
aucagaggauggccuccaaagaauucccuggacauuaugggaauuacauuguuagccuuccuacugau

SEQ ID NO: 4147873 - RNA, 81 nt, Human
aucagauguauuuuuuaaauguagcauuuguuauuuuacuuuuuaaaauaaagcaugcuuguuuggagagcacuacaggau

SEQ ID NO: 4147874 - RNA, 62 nt, Human
aucagcaaguccuguuaauucuaccuucaaaacaucucuugaaucucacaggcuuuguugau

SEQ ID NO: 4147875 - RNA, 119 nt, Human
aucagcaccaccugggaacauguuagaaaugcaaauuaucaggcuucucuagaaccacuaagaagcucuggcgaggccuagcaaucuguguuuuaacaagccuuccaggcaaugcugau

SEQ ID NO: 4147876 - RNA, 128 nt, Human
aucagcacugacucagaacuuguuggaaaugcaaauucucagaccccacccuagaccuucuggauccgaaacucuacagguggggccuggcaaucuguguuuuaacaaguugucuagguaacgcugau

SEQ ID NO: 4147877 - RNA, 57 nt, Human
aucagcagaguuucaucuugggaugauggaaauauucuaaaauuagauuuuggugau

SEQ ID NO: 4147878 - RNA, 127 nt, Human
aucagcagcaucuggauacuugcuagaaauggaaauucucuggcccuauuccaggccuuccaaguuggaaacuuugugauggggcccagcacucuguguuuuaacaagcccucuagguaauucugau

SEQ ID NO: 4147879 - RNA, 91 nt, Human
aucagcugaagaucauguuaaaauauacauucugauucuguaggauuaggguggauauuuugcauuccaaaagcuccuagaugaugcugau

SEQ ID NO: 4147880 - RNA, 64 nt, Human
aucagcuuggaccaauaagaugaggaaaagaaaauaaaauucauucuagcaguuacaggcugau

SEQ ID NO: 4147881 - RNA, 89 nt, Human
aucagcuuuugaccacucaggaguugguaauauuguggauuucguaguuucuauucuauaaccauacccugaaauucuugagagcuggu

SEQ ID NO: 4147882 - RNA, 57 nt, Human
aucaggcagugacaugaucagauuuaugcuuuggaaaggucacuguggcugcaggau

SEQ ID NO: 4147883 - RNA, 60 nt, Human
aucagggcaggaugcugugauuauucuuauugcaaggaaauaugagcagcuugucuugau

SEQ ID NO: 4147884 - RNA, 63 nt, Human
aucaggugucggucaggcgguuuuuaaagguuucucuaaaauggucucagcuggcaccaggau

SEQ ID NO: 4147885 - RNA, 79 nt, Human
auuagcuuuggaacuuugacaacacguuauuugccuccugugggggugccuuggugugcuguaggguucugugguugau

SEQ ID NO: 4147886 - RNA, 59 nt, Human
auuagcuuugguggaaaggaguguaaaaugauuccuuuucuaaagacaccaaugccaau

SEQ ID NO: 4147887 - RNA, 63 nt, Human
auuaggauguagcuaugucaucaucccaucccugaugggauggaucaauuaagcugcccuagu

SEQ ID NO: 4147888 - RNA, 65 nt, Human
auuaggcaaggacuggcauuaucuuauguuucuuggaauuuccuuggaacaaugcagucucuagu

SEQ ID NO: 4147889 - RNA, 56 nt, Human
auuauguguagagaugaguagguccuguuuggauaacucauuugucugcaucuaau

SEQ ID NO: 4147890 - RNA, 84 nt, Human
auuauuagguuggugugaaaguaauugcgaguuucaacauuacuuuaauggcauaaacugcaauuacuuuugcacccuaauaau

SEQ ID NO: 4147891 - RNA, 88 nt, Human
auuauucauucuaaaauauuaauuuugugugggaucaaaggaaguggaugugcuuuuuguggaacaagguugaccaagaauggaugau

SEQ ID NO: 4147892 - RNA, 59 nt, Human
auuauuccuauggccacugcuacuacuaucaagguauggucgcagauacauggaauaau

SEQ ID NO: 4147893 - RNA, 130 nt, Human
auuauugcagccauauagguauggccuguguugauuuaugugacacuccuuaauguucugaagaauccugaauacaugaggcucauuuaugucaugucacaggauuguaccaugaugaaauagaaaucau

SEQ ID NO: 4147894 - RNA, 70 nt, Human
auuauuuauuuuugaauaccuagccucuaucacacuauaggcacuuggcaggugcucaaaaauauuuggu

SEQ ID NO: 4147895 - RNA, 90 nt, Human
auuauuucaugguauugcagaggcaauuaguuauacaaauuagguaaucauguaucaacaaaggccuuguguuugugccguauagguaau

SEQ ID NO: 4147896 - RNA, 71 nt, Human
auucaacugcugauuaugaaagugacacauucuaggaugaugcaccuuuaaauucagcaguaaacaugaau

SEQ ID NO: 4147897 - RNA, 91 nt, Human
auucaaguuaaucuggacccuuagaaugugaucuuauguuagaaauagaguccuugcagaggucacuaguuaaggugagguuauacugaau

SEQ ID NO: 4147898 - RNA, 55 nt, Human
auucaauaucuguguauuggaaaucagaacuaauuccaauauauagugaguggau

SEQ ID NO: 4147899 - RNA, 59 nt, Human
auucacagggacaaugggagagcaaaauaaaguugcuuuuaggaucucacucugugagu

SEQ ID NO: 4147900 - RNA, 69 nt, Human
auucacagucauucagcaaacauuuauugugucggccaugugccacgcacuaugcuggagagugggaau

SEQ ID NO: 4147901 - RNA, 67 nt, Human
auucaccuuuccccaaaaugagaaacagcagaagcauuauaaagcugcccaugggugacagguggau

SEQ ID NO: 4147902 - RNA, 55 nt, Human
auucagcugacuuugauucauuuauaaauaaaauguaaaguagagucagcuaaau

SEQ ID NO: 4147903 - RNA, 66 nt, Human
auucagugucuugaucugggaaugauaauauuaacuaccuccauagauugcuacaagucauugaau

SEQ ID NO: 4147904 - RNA, 74 nt, Human
auucaguuucuuagugacacaaaucucaggguaaauuuaugccuucaugguuuguuuccuuaaaaaauaugagu

SEQ ID NO: 4147905 - RNA, 65 nt, Human
auucauuaaggcucaguuuuaggcauuagggaugcaaauguauacuacagggucuugcuaugaau

SEQ ID NO: 4147906 - RNA, 60 nt, Human
auucauuagccacuaacuagcacagucguaugagucugauguuguuuuauggcuaugaau

SEQ ID NO: 4147907 - RNA, 75 nt, Human
auucauuuaaaaauauuuacuggauaucuacuaaaaggccucuuagaaggugcuugguaaauauuuuaggggaau

SEQ ID NO: 4147908 - RNA, 67 nt, Human
auuccaccagcuuuggcggugacagguaaguugaugaugcauagcugucuccugggcuagguggaau

SEQ ID NO: 4147909 - RNA, 63 nt, Human
auuccagauggcuucaaguaagcugucaguucacaucuggccucuugaauugccaccuggaau

SEQ ID NO: 4147910 - RNA, 71 nt, Human
auuccaggggaguggcagagggacagccagcacgagacauuuucaagguuguuuuucccacccuuuagaau

SEQ ID NO: 4147911 - RNA, 85 nt, Human
auuccauuugagcuuaaguaucugcauuugaacuucaacuacagccucaauauagcaguguacuugagaaccgccaauguggaau

SEQ ID NO: 4147912 - RNA, 89 nt, Human
auucccaccuuaguuugggguguuuugaagagguucagagacuaaaucuuaaaccuuauuugaauaccaacgauagcuauuuugggaau

SEQ ID NO: 4147913 - RNA, 85 nt, Human
auuccccuuauugucccaauaggauugucaacagcucccagggccugcauguuuucuuaauugugauuaguaaguaagagggagu

SEQ ID NO: 4147914 - RNA, 84 nt, Human
auucccugaucuucaguuucguuaucuaugagaugggaauuaauuauaaccguaccuuacugacaacgagauuguuugaggagu

SEQ ID NO: 4147915 - RNA, 56 nt, Human
auuccuagguuugagggaaccaaaaggaaaauuuaugggcaccaaaaccuaggagu

SEQ ID NO: 4147916 - RNA, 91 nt, Human
auuccuauuuuauucagcuuagaaugugagcccuucugcacaggccaugccggucugagcacaucacacagcucagaauaacguaaggaau

SEQ ID NO: 4147917 - RNA, 79 nt, Human
auuccugaagccccauuuccaauuuucaaauuucuucuuggagaagagguagaaaauaauggagagaagcugaaggaau

SEQ ID NO: 4147918 - RNA, 79 nt, Human
auuccugaaguugcuggaaaguuaaauuuuggaaaggugacacugcuucuccagugacucaucugagcgccucaggaau

SEQ ID NO: 4147919 - RNA, 71 nt, Human
auuccuuggcucauggcucacucccaucuucuaaaccagccaugauagguugagucuuuugcacaaggaau

SEQ ID NO: 4147920 - RNA, 55 nt, Human
auucggucacacccauuaauggucaagaccaccuucauuauggcugugaaagagu

SEQ ID NO: 4147921 - RNA, 59 nt, Human
auucuaaccaaaacugaaugcuaguagcaggaacugguaugaagauugcggucuggaau

SEQ ID NO: 4147922 - RNA, 61 nt, Human
auucuacacaaagcaagaagacugguguugccaguggguuucuaacaugccuugugagaau

SEQ ID NO: 4147923 - RNA, 98 nt, Human
auucuagccagcauuuaaggguggauacaggagaucaaaguauuugaauacuugcuucacuuucuauuugugucuggucccucaaugcugagugggau

SEQ ID NO: 4147924 - RNA, 77 nt, Human
auucucauguaugaugggaggaauggaauuuuauuacuuuugaaauggcuagucaaugucccauuuauuaaaagagu

SEQ ID NO: 4147925 - RNA, 88 nt, Human
auucuccuuccagcuuguucucaugccuuucucaucaccugcugaggccuugaucacggacagagcagacgagcagcggggggacaau

SEQ ID NO: 4147926 - RNA, 66 nt, Human
auucucugaucugaaggaggaauggugcucaauuaagacauuugucuucuuucagauuagcagggu

SEQ ID NO: 4147927 - RNA, 76 nt, Human
auucucuuuuuauucaguauguuggacguuaugugacuguaguacacaugcuuugauuauuguuuuagaggaggau

SEQ ID NO: 4147928 - RNA, 59 nt, Human
auucugaaauuuuccacauaucaaaguggccucaauggcucuuggaaaaaguucagaau

SEQ ID NO: 4147929 - RNA, 57 nt, Human
auucugaagcagaaaaggcagagaaugaggacagaacagcucugccaguuuuagaau

SEQ ID NO: 4147930 - RNA, 89 nt, Human
auucugaguaguaauguccuuuaaguaaucagcaugguuaucaaccuaccaaccacagcucuaacuauuaagaggucauggcuuagaau

SEQ ID NO: 4147931 - RNA, 55 nt, Human
auucugauaucuuauucuagcucugucacuuaugagcugggaaaguuuauagaau

SEQ ID NO: 4147932 - RNA, 61 nt, Human
auucugauaugaacacacauauauauauaauuguguacuugugaaagugcaugucuagaau

SEQ ID NO: 4147933 - RNA, 101 nt, Human
auucugcaauaggagggguucaggcuauauuuaaagaagaacuuccugcccaggaaagauguucuauguugagauagcuaauccucccaaaauagcagagu

SEQ ID NO: 4147934 - RNA, 61 nt, Human
auucugcucagcauuugugauugaauuugacucucaaauuauucaaaaagcuguguugagu

SEQ ID NO: 4147935 - RNA, 59 nt, Human
auucugcuuuugcugaccuaccauucuacagccauggugauaggucaggaaagcagagu

SEQ ID NO: 4147936 - RNA, 55 nt, Human
auucugguucuugcucauugugucucuaggcauuuuguagggcaggaaucagggu

SEQ ID NO: 4147937 - RNA, 91 nt, Human
auucuguaguuaagacugcuuuggacauuuuuaaaaacuaauuggguuaaaauuaguguuuaaagguuucagaguucacuuaaauaggaau

SEQ ID NO: 4147938 - RNA, 87 nt, Human
auucuuacucaaugauuagucuucaacauucucacauacucucagccacuuugaguaaacgaagauacaucauucaggagugagaau

SEQ ID NO: 4147939 - RNA, 58 nt, Human
auucuucacauaagugcuguacuccaauuggaacggaagccaguacuaugagaaggau

SEQ ID NO: 4147940 - RNA, 70 nt, Human
auucuugcauaaagauuuuauugcauagguuauaggauaaaaugcaagagaaauguuuuguggaaagagu

SEQ ID NO: 4147941 - RNA, 60 nt, Human
auucuuggggugaugggcauggggguggaggagaucacuucuagagucagcuccaaguuu

SEQ ID NO: 4147942 - RNA, 66 nt, Human
auugaaacuagaaccacuuguauuuccuuccaugaugccgauaggaaccgagaggucuggaucaau

SEQ ID NO: 4147943 - RNA, 80 nt, Human
auugaaggcaaagcgauaccagagcuaaaacguuaaugaaaaaccuaauuaacuuggcuagguagcuuucugcugucaau

SEQ ID NO: 4147944 - RNA, 91 nt, Human
auugacggauauguuuugauugaaggauuaguuuacucauucauucauuuguucagauaauucaauucaauucuaaauauauugacucaau

SEQ ID NO: 4147945 - RNA, 99 nt, Human
auugagcaggggcuguggauagaaauuuccuguaggggcuugcgaaggcaucuucacugguccuuuauaggaacccucuaugcauuucccuuugccagu

SEQ ID NO: 4147946 - RNA, 67 nt, Human
auugaggugggaggugaggcaugauguuugguaauuauauaggaucauguacaugccuacuaucaau

SEQ ID NO: 4147947 - RNA, 113 nt, Human
auugaguuaagaaggccaggacuuuaaauccuccuccccaggaugaucaguccauuggaugcgaguuaucccuggaaggaggcaugacuuuggcugaagaaguuuuccucagu

SEQ ID NO: 4147948 - RNA, 60 nt, Human
auugaguugcauuuuccauaauucagcaaagauuugaagacauggaaaauuguacucaau

SEQ ID NO: 4147949 - RNA, 93 nt, Human
auugaucacuuuuucuuaugaaauguauucagauauguauugaagacuuauuugaaugcagucuguacauuuuaagaauuucagcuguuuaau

SEQ ID NO: 4147950 - RNA, 65 nt, Human
auugauucucauaggaccaucuuuucuuuagcaagauacagauauuuggcccuuuggggaucagu

SEQ ID NO: 4147951 - RNA, 63 nt, Human
auugauucugaugaaaguccauuugagagccaagaaugagugugcugguccaucugaaucaau

SEQ ID NO: 4147952 - RNA, 55 nt, Human
auugcaagucagagugcaggugucuaauuccaggcaucaggcuuucuguugcgau

SEQ ID NO: 4147953 - RNA, 127 nt, Human
auugcacauacuugauauacauguauauacauauaaguagacauguguauguuugggcauaugcauguauaauauaugcauguguacuuaugugucuguuaauaugcacguauauauuuguuauaau

SEQ ID NO: 4147954 - RNA, 55 nt, Human
auugcaggauacccagguagagaacacugaucucucugcauuucuggguggcaau

SEQ ID NO: 4147955 - RNA, 61 nt, Human
auugcaggccaguguccugggcgauuccguguggaauagaccacagcaaagguuaugcaau

SEQ ID NO: 4147956 - RNA, 59 nt, Human
auugcagggcaucuaugucuggucucaggauuuucuuguaucagcaacugccacucagu

SEQ ID NO: 4147957 - RNA, 69 nt, Human
auugcagguaccuuggguugaguucauucuggcaccagugagcuuucaccccaaggaggcagaagcagu

SEQ ID NO: 4147958 - RNA, 71 nt, Human
auugcaucaauuucaugugcacugauuuaggcgaagaugcguaggaaaagagcaaggaaaugaggugugau

SEQ ID NO: 4147959 - RNA, 67 nt, Human
augagacagaauugaagcugaguaaauauacauuaguguguuuucuuuauguaauucugaaucuuau

SEQ ID NO: 4147960 - RNA, 129 nt, Human
augagaguugcagccucagcaccagcuuugcaggagguggcugaacuugagggaguacccagaaggggguccucagagaugggcaucuaagauacuucagaguuguugacgccauggggcaacuuucau

SEQ ID NO: 4147961 - RNA, 57 nt, Human
augccgucagcuuauuaaagaacuaguuugggacuuguuucaguugguuaauggcau

SEQ ID NO: 4147962 - RNA, 61 nt, Human
augccuaugccauuuugagauguuaaugauucauuucacuacaauucacaagugguggugu

SEQ ID NO: 4147963 - RNA, 66 nt, Human
augccuccgcugcucgcagcgggccuggccucggccccgggcuccacgcacgcgagaggugggcgu

SEQ ID NO: 4147964 - RNA, 73 nt, Human
augccuucugucccagaugucuggaacucccuggacacguagggauuucugugugucuggccacagaagucau

SEQ ID NO: 4147965 - RNA, 66 nt, Human
augccuuggcuagaucuuucagaagaaacuaacaaaggauguuucgggagagaaagaccaaagcau

SEQ ID NO: 4147966 - RNA, 72 nt, Human
augccuuucacaggugacuggggauaacucacuaccuggagguccaugucauucucaucgcugugauugcau

SEQ ID NO: 4147967 - RNA, 66 nt, Human
augcgauaacuagagggaaagaguacuugccucauacggcagauucuucauucauucuacaagcau

SEQ ID NO: 4147968 - RNA, 66 nt, Human
augcgcuuugugugaagcagugacagugcaaucugcuaagauagcugcugcuguggacaaagccau

SEQ ID NO: 4147969 - RNA, 68 nt, Human
augcggggucccugauugagccuuucuguccccugcaggacagagguggaccucagcaggcucugcau

SEQ ID NO: 4147970 - RNA, 116 nt, Human
augcgugugugaagcagucuguuuuauagagugagcauauauguaaucguuuucauauaauugaaaaugugcuguguguugcauuuuauucucaugucgacuuuucuacuauguau

SEQ ID NO: 4147971 - RNA, 74 nt, Human
augcuaaaguauugacagagggucagaagaggggaaggagcugguccuucauccccaccugucuaugcuagcau

SEQ ID NO: 4147972 - RNA, 58 nt, Human
augcuaaauggccaguaccaaaggagggaaaagaacuccuggggauguucuuuagcau

SEQ ID NO: 4147973 - RNA, 72 nt, Human
augcuaagacaagacauugguaaagauaugggaaaaucuguauuaacagcaauaaugucuuuguuguagugu

SEQ ID NO: 4147974 - RNA, 60 nt, Human
augcuacagcccucuuugcauauucaucucugauaugcaccaaaaggagcugucugucau

SEQ ID NO: 4147975 - RNA, 76 nt, Human
augcuagaacuguucuaagcaauaucuaaacacuauguccauguauauggcauguuacuuagaauaauucuggcau

SEQ ID NO: 4147976 - RNA, 61 nt, Human
augcuagcaauuuaguaucuguuagguguaauauccuggcacuaugcuuacaugcuuauau

SEQ ID NO: 4147977 - RNA, 74 nt, Human
augcuaucuagaacaauuauugucacagauaagauuuguuugugcccugucuguucucaguaaauuaggagcau

SEQ ID NO: 4147978 - RNA, 75 nt, Human
augcuaucuauuucauuauggucaauguuuacuuacaauaauauguagcaaugcucuaugaugaaaagccagcau

SEQ ID NO: 4147979 - RNA, 59 nt, Human
augcuaucuucagcaccuagggaagaauugaucuuugcuuacaggaaagaagaaagcau

SEQ ID NO: 4147980 - RNA, 75 nt, Human
augcucagagaaccacugaccucggggcauguaguuaacaccugcagugcuugaagagguggccaguuugaaugu

SEQ ID NO: 4147981 - RNA, 111 nt, Human
augcucaugugacaaugaagacuucuaguuuugccuuaucaacaucaugcuacuaaaauucaucuauguuguugaguauagcugcaguucauuuauuuuucacuacuguau

SEQ ID NO: 4147982 - RNA, 61 nt, Human
augcuccaccuuuugcaggaacugucaucaaguuaaaagcugcugugaaauguggcaguau

SEQ ID NO: 4147983 - RNA, 56 nt, Human
augcuccaguacuuagccuugcaaaccucaacauggcuucuccagguacugagcau

SEQ ID NO: 4147984 - RNA, 61 nt, Human
augcucugggaaagcauugccuugaucaaaugccaaggcuguugcaugccacagauagcau

SEQ ID NO: 4147985 - RNA, 87 nt, Human
augcugaagaccaauuugggccauggcgaggcugcagcauagcuggccuuggaagccugguuuguagguugguuggaaucauagcau

SEQ ID NO: 4147986 - RNA, 60 nt, Human
augcugaggacaaagagaucaagcaggguauagagcugcugauccuaaagucugcagugu

SEQ ID NO: 4147987 - RNA, 80 nt, Human
augcugauagggugccuuuuauugcugugaaauauuggcugcaguguagacaugauagcuggagggcaccuuguaaccau

SEQ ID NO: 4147988 - RNA, 128 nt, Human
augcuggcucuccaagcugggacagaagauagggucaguucccacuugcucuccacgggcgcgggcccagcagagaggagguggcccugucuugagagcccagcugccuuuugucgagggccaguauu

SEQ ID NO: 4147989 - RNA, 98 nt, Human
augcugggagggacugaguguugaauagacgcuuugaggcucuggagagggcagacguuucccaggcccucagggcugccacucagccaccucggcau

SEQ ID NO: 4147990 - RNA, 61 nt, Human
augcugucaguauuaugugcaguccauuaccaaggcaaauuauauaacaugcugucaguau

SEQ ID NO: 4147991 - RNA, 75 nt, Human
augcugucccuguguccccaagguucagcccacaguuuccgcagcucugauuucaaggggaagcaaagacgauau

SEQ ID NO: 4147992 - RNA, 130 nt, Human
augcuuagaaacaaacuacccauuuuuuugacauuuaugaggcaauuggaaauuuuaacacugacuggauaguuguugauauuacggaauuguuaaccuuuuuaaugugugauaaugguauuguuaggau

SEQ ID NO: 4147993 - RNA, 63 nt, Human
augcuugcuucagggaaguuagaggcaccaggcccugcaucucacuucccugcagcaucccgu

SEQ ID NO: 4147994 - RNA, 57 nt, Human
augcuuuaaacuauaaauccacaguauuuggugacuguggaggugcagagaaggcau

SEQ ID NO: 4147995 - RNA, 64 nt, Human
augcuuugaaguuuuuccucauaaagaacauaaugcaguaacuuaggagagaccauuaaagcau

SEQ ID NO: 4147996 - RNA, 76 nt, Human
augcuuugccacagaacucuuccaaaugcagcuaaagcuuccugaggcuaagaugcaugaggaucuggggaagugu

SEQ ID NO: 4147997 - RNA, 77 nt, Human
augcuuuuaacuccuuuaucccauaaaucuguugcaguacaguuaauaauuugcaggguagaaauggacagaggcau

SEQ ID NO: 4147998 - RNA, 64 nt, Human
auggaaaaagucaugugcacagagaacagucuaugaauggugacugauuuaaacguggcucuau

SEQ ID NO: 4147999 - RNA, 76 nt, Human
auggaaagauuuucauucuuauuugugaucuggacaguggguggacuaguucagauccauagagaaaaaucuccau

SEQ ID NO: 4148000 - RNA, 59 nt, Human
auggaaaugugaagcuggcacuuagauaugaaagucugagcuuccagagcacauuccau

SEQ ID NO: 4148001 - RNA, 129 nt, Human
auggaaauuucuguuccaaaggugaagucucucauggcugacagcacuggaucgcauuaacaaggaaaccagcccugcucucuggcugugggaucagacacaaaaucuaaggaacaguuugacuucaau

SEQ ID NO: 4148002 - RNA, 79 nt, Human
auggaagcaaugucaaggagaccaaaacgcgggugucagaacuucccuuuguuuuuauuucugugccguuuguuuucau

SEQ ID NO: 4148003 - RNA, 70 nt, Human
auggaagcagcucagauugacugaauugacucugcaaacccuucaggaacauuaauggaguugcuacuau

SEQ ID NO: 4148004 - RNA, 59 nt, Human
auggaagggguccacguauacucgagcuuuugcuugggauaaaucucagcuucuuccau

SEQ ID NO: 4148005 - RNA, 81 nt, Human
auggaagucacucaugugggaaacagaaaauccaucuuucaauugucccagaagguucuuucucaacaugaauguuucuau

SEQ ID NO: 4148006 - RNA, 60 nt, Human
auggacagauuaacacaguagauguauucagcaauagaacgacaguguuauucuggccau

SEQ ID NO: 4148007 - RNA, 65 nt, Human
auggaccagagccucauucugugaugcuaucauuucugcauccacagauucacugcacuggccau

SEQ ID NO: 4148008 - RNA, 74 nt, Human
auggagaaaggccagcucacagaugagacuaaaaugaaacccagguuuccucuggcuucuggcuuuaucuccau

SEQ ID NO: 4148009 - RNA, 66 nt, Human
auggagaugauaauggcuuuuugaagggucguuauaaggauuaaacggaaacauuuuuauuuccau

SEQ ID NO: 4148010 - RNA, 76 nt, Human
auggaggacucucuugggggagagcagagggauaagccccucaucucucaaggaucccagagcaaaauccuuccau

SEQ ID NO: 4148011 - RNA, 70 nt, Human
auggaggagggcuuuugaggcugggagaaauauaugguauuuacacugguucucagagcucauuuucugu

SEQ ID NO: 4148012 - RNA, 55 nt, Human
auggaggaugugcagcaugggcaggaaaagagccuucagugguguacauuuccau

SEQ ID NO: 4148013 - RNA, 66 nt, Human
auggagguaaauaagaguaugucuggaauauaggagaucccugaaggcaucucuuaguaucaccau

SEQ ID NO: 4148014 - RNA, 63 nt, Human
auggagguguuugauaauuugguugcuaugcaaccacuuuacaauuauguaagcuccuaccau

SEQ ID NO: 4148015 - RNA, 69 nt, Human
auggaguaauuuucuuaaaacaucaugauggccgaaauaauggugaugccauaguaaaauuugcuucau

SEQ ID NO: 4148016 - RNA, 61 nt, Human
auggaucuucccucauuucugagguuaaaauacuuuuuaauaaaugaugggaauaaucuau

SEQ ID NO: 4148017 - RNA, 80 nt, Human
auggaugggcugccugaguacaagucccagagcuuucccuuaauagcugugagacuuggggcagguuacuucucuuccau

SEQ ID NO: 4148018 - RNA, 74 nt, Human
auugccaagaaaauuuagaauaggaagggauauuauuaucugcuugaaacuucuuauacuacauuugagguaau

SEQ ID NO: 4148019 - RNA, 64 nt, Human
auugccauuucucaaauaugacuagauauuaaauuuuuuuuaguugcuaaacagaaguggcaau

SEQ ID NO: 4148020 - RNA, 87 nt, Human
auugccuagccaugucucuccaagccugggagagccaucuguggccaaaacuguccucuggccuuucccaggacacgggcaggcagu

SEQ ID NO: 4148021 - RNA, 59 nt, Human
auugccuaguucagaguaauuucuaggucagugaacccuaauguuucugaacagguagu

SEQ ID NO: 4148022 - RNA, 88 nt, Human
auugcgauauauccuuauguugcuuuaacuggaggaacuaaaauaacuguggcucugauaguuacagcaggcaggauauauaggcaau

SEQ ID NO: 4148023 - RNA, 63 nt, Human
auugcuaccccaacaagggcaguguggccgguggggccaucuggcuuggguguggguagcagu

SEQ ID NO: 4148024 - RNA, 75 nt, Human
auugcucuuugaauuuaccauugugggguaauugaaaagaccccauauuaacaagaguaauuucaacagaguggu

SEQ ID NO: 4148025 - RNA, 59 nt, Human
auugcucuuuuaaaucaaucacugugacugaaaugugcaggacaguuuggaagagaggu

SEQ ID NO: 4148026 - RNA, 56 nt, Human
auugcugacucaauaauugaaggaaucucuugguugcuucauuguguggucacagu

SEQ ID NO: 4148027 - RNA, 124 nt, Human
auugcuuugguuccucaggaucuuuuguguuuccacaugaauuuuaagacuguuuuuucuauuucuaugaagaaugucguugguauuuuaauuggaaaugcauugaaucuguagcuugaguaau

SEQ ID NO: 4148028 - RNA, 70 nt, Human
auugcuuuuucuagugguugcaugauuaucaugccucugaugauaaaucugcacccacugaaaaugcagu

SEQ ID NO: 4148029 - RNA, 85 nt, Human
auuggaaacagaagguggugucuuuagaaagaagcagacaacagcaugugccucaaaccuggagauauaccuucucucugcuagu

SEQ ID NO: 4148030 - RNA, 58 nt, Human
auuggacacauuuucuucuuaaggauuuguguuuccuccaggauaaaauguguugagu

SEQ ID NO: 4148031 - RNA, 56 nt, Human
auuggacaggcuauauaauuuaauaauugggauuaggcuguguagcagugugcagu

SEQ ID NO: 4148032 - RNA, 129 nt, Human
auuggacugggcuccugggagucuuuguggugcuucaugugccagagcugaaaauaaugcuguaagagcugauuggucaagucuugcaggugacagcccaaggaaucccaguccucuaucccauccacu

SEQ ID NO: 4148033 - RNA, 62 nt, Human
auuggagggucugagcugaggggaaaucacggacgugcaucaccccuaaucagacugcuaau

SEQ ID NO: 4148034 - RNA, 68 nt, Human
auuggcaucuugggcuuagggcacuuaccacuuuuugacaguaggauaagagccuguccaaugugaau

SEQ ID NO: 4148035 - RNA, 64 nt, Human
auuggccuaugaucuugagagccaccuaucaauuauacuuucaacaggaugauaauaggcuaau

SEQ ID NO: 4148036 - RNA, 75 nt, Human
auuggcucauuuguagaaucauuauuucuaguaauguauuacggagacaaagaugcuacauucucaucagucagu

SEQ ID NO: 4148037 - RNA, 59 nt, Human
auucuuucuucucaggcuggguaaauccacgauuuccugcuuuuccugggggaaagaau

SEQ ID NO: 4148038 - RNA, 128 nt, Human
auugaaaauucaaauuagaaaacgaacucuuggagauacuaguaagauauuugacaggcgccgaaugcuccaucaagcuggcuguugcuauuucaaggguuaugaucauucugaugaagauauuuaau

SEQ ID NO: 4148039 - RNA, 64 nt, Human
auugaaauugaugaaauucuugcauuccagugcuucaaagaccuggacuuucaucaguuuuaau

SEQ ID NO: 4148040 - RNA, 65 nt, Human
auugaacucugcaggagcugccuuuguuucucugccuuaacauguauuuguuccugcagauuagu

SEQ ID NO: 4148041 - RNA, 61 nt, Human
auugaaugccacgcuucccccaucugcuguaauaacagugcugggucugcuuggcuucagu

SEQ ID NO: 4148042 - RNA, 81 nt, Human
auugagaauuguuuaacuaguuuucacacuucuucaacaggucuaggaguugaaagcaaaaguugauauuauguucuggau

SEQ ID NO: 4148043 - RNA, 57 nt, Human
auugagauuugggccugaggagaggguuuccaacuccagggcuggccagaccucggu

SEQ ID NO: 4148044 - RNA, 56 nt, Human
auugagcuauuucuuguauacaguaaagcacacaaacuguacauauagagcucagu

SEQ ID NO: 4148045 - RNA, 59 nt, Human
auugaggcagcauaguucaggggcucuaagaaaaguuucuggaacaaggcugcuugggu

SEQ ID NO: 4148046 - RNA, 78 nt, Human
auugaggugaacccuaaacuaucaguagcuauaagucuucuuuuggcuucuuguuugguuuaagaggauuccugcaau

SEQ ID NO: 4148047 - RNA, 61 nt, Human
auugagucuuuucauuucacauaugaggaaaucaaggcccagagaagugaagugacucaau

SEQ ID NO: 4148048 - RNA, 94 nt, Human
auugauagcaacagagagaggccacugcuauuaauucacugcugauuacugaugcuuauuaaggaugauaguaguggguuuuuuuccugucagu

SEQ ID NO: 4148049 - RNA, 73 nt, Human
auugaugcugcucugaguauuaacggaggccacaaacuauguggccucauuuauaucacuuagaguugucagu

SEQ ID NO: 4148050 - RNA, 76 nt, Human
auugauucaacuuucuugaaugcaauuuuuuaaaacauuuaaguugcguaauauugaucgagucauuugauucagu

SEQ ID NO: 4148051 - RNA, 107 nt, Human
auugauuuuccccagaggggcauuagaauucagaaugcauuucuaaucaguuugcuguaccuaacuuauuagaauugcuguuugauuagugcccacugcaaaucaau

SEQ ID NO: 4148052 - RNA, 65 nt, Human
auugauuuuuacauguggugugaagaagaggucaaacuucauucuuuuacaugugaauauucagu

SEQ ID NO: 4148053 - RNA, 66 nt, Human
auugcacaggacugugauccaguaaccaagauaaaggccucuuguguucaucccagucugugcaau

SEQ ID NO: 4148054 - RNA, 93 nt, Human
auugcaggccuugugucccaagucuuuucagccccuucaucauagagugacccugugcuaaguucugcaaaagauaaucaugcaggccgugau

SEQ ID NO: 4148055 - RNA, 59 nt, Human
auugcagggaggcagguagauggcuuucgguaggggcccauguauagcuucacugggau

SEQ ID NO: 4148056 - RNA, 121 nt, Human
auugccaaaacugcuugucuaaguaucuuguuuaugaauguuacuauagagugguggcccuuuacacuguaguaugaauuaguggccagcaugcuugacagagagcgcagaacagggcagu

SEQ ID NO: 4148057 - RNA, 84 nt, Human
auugcccuuugaacuccagacuacuaauuuagugaauucuucacuauuucuagaugcucugauaacagagguuaaggggacagu

SEQ ID NO: 4148058 - RNA, 84 nt, Human
auugccucagguucauggccagcucagagcacucaguuacugacaggcauguguguggacgagcguggcccaucugggugcgau

SEQ ID NO: 4148059 - RNA, 75 nt, Human
auugccucuguuccauguuuuguuccauauaaacauccagacacaggucucaugggagaaacaucaugaggcagu

SEQ ID NO: 4148060 - RNA, 77 nt, Human
auugcucucugugugccuguacaucugcucucauugcagucgguacaacugcgagauguuuagccagcagccguaau

SEQ ID NO: 4148061 - RNA, 82 nt, Human
auugcuggaagaagcaggucuugcucucaacaggcauaugaauuaucuuccuguaccaagcaccugcauagcuucaggggau

SEQ ID NO: 4148062 - RNA, 65 nt, Human
auugcuggcccagaugcuuuagcgagaaaacugucuacaacagcuaagcaucuggauguagcaau

SEQ ID NO: 4148063 - RNA, 84 nt, Human
auugcugugguguguagacugccaguaauaucucaaggaugagcugggccuagauauuaccagcagucuaugcaccauaguaau

SEQ ID NO: 4148064 - RNA, 62 nt, Human
auugcuuauaacacuugcauuuguaugagacuugagucuuguacaacagguuuuauuucgau

SEQ ID NO: 4148065 - RNA, 69 nt, Human
auugcuugaacccaggaggcagagguugcagugagcugagaucaugccacugcacuccagccuggcaau

SEQ ID NO: 4148066 - RNA, 81 nt, Human
auuggaagggaacaccauuugaccuuguaagcauggcuauacuuauuauuggaagugcauggcaaaguguguccuuccagu

SEQ ID NO: 4148067 - RNA, 69 nt, Human
auuggagugguuuaaauagcuguuguuuauuuacuaucacagagccggcaacuguuuugagcacccagu

SEQ ID NO: 4148068 - RNA, 86 nt, Human
auuggauauuccucugguccuaaagcccuacuccaaaucuuaguccauauggauaaggcuggaccuagaucucugaaccuuccagu

SEQ ID NO: 4148069 - RNA, 129 nt, Human
auuggaugauuggguauuuguuucuaaaugcaguuggcagucauuguagaacugauuugaauuacauuguuuuaaaagguacucaggcugcuguacugugaauggcauuugguagagccucauccauau

SEQ ID NO: 4148070 - RNA, 110 nt, Human
auuggcagauaaggauuggaaucagugaguucucagcuuaguaugcugugggucauacaggcauaguguugagaagcauacugguacuuaguugacacuuauuuaauaau

SEQ ID NO: 4148071 - RNA, 60 nt, Human
auugggaaacugaagcuugggccaaguggaggaacauggcucccuccuagcuuucccaau

SEQ ID NO: 4148072 - RNA, 60 nt, Human
auugggguuuauuuuuauccagauuauuuuuauuaauuguacaaaaaaguagaccuuggu

SEQ ID NO: 4148073 - RNA, 116 nt, Human
auuggguggggagaagauccccuugcuucuugagaucauuuauuuaccuuucuugcuuagaaagacaaauaaauggucugaaagugcuuauuugggggguaguuuuuuuuuuuaau

SEQ ID NO: 4148074 - RNA, 57 nt, Human
auugguaguccuggaugccucuagguggcaguucaaguggcauccagaacuaccagu

SEQ ID NO: 4148075 - RNA, 62 nt, Human
auuggucuaggcuuuaaaaagaccagcagccucuacuucugcugggagaagccagauacaau

SEQ ID NO: 4148076 - RNA, 58 nt, Human
auuguaaaguacuguguacaauucaguagcuuuuacugcgcucacaaugcuuugcaau

SEQ ID NO: 4148077 - RNA, 64 nt, Human
auuguaaauagugccacaauaaacauacuugugcaugugucuuuauagugguaugauuuauaau

SEQ ID NO: 4148078 - RNA, 56 nt, Human
cacaugggaagaauaauguuuggcauaauuauaaaaagcaauuaccuucccaugug

SEQ ID NO: 4148079 - RNA, 59 nt, Human
cacaugggugugccuggaggaagaaaaauguucauucugccuuccuugcuccccaugug

SEQ ID NO: 4148080 - RNA, 99 nt, Human
cacauguauuuguuaauguuuuggaguuaccugacauauagguauagguauaggaaaaccuauuccagguauucuucaagaggugauaguuguugugug

SEQ ID NO: 4148081 - RNA, 60 nt, Human
cacaugugcaaauacugaggcucacaaaucauuccugugaacucagcuguagcucaugug

SEQ ID NO: 4148082 - RNA, 58 nt, Human
cacauucauggaguuugccugucagcaaugugaugucaacagguaaauaugaauagug

SEQ ID NO: 4148083 - RNA, 82 nt, Human
cacauuccuauuugaucauuuuucugguaaaauuguucucaagguccaagcguagccaggggaauuccaggaaagauuugug

SEQ ID NO: 4148084 - RNA, 70 nt, Human
cacauugggaguugaguuauuaggauaggcugggggcagagauaauguuaaaaauucagcucuagaugug

SEQ ID NO: 4148085 - RNA, 69 nt, Human
cacauuguaguaaaagcugcugugaauguuauaauggugguugcuaugggcaacagcagucacaaugug

SEQ ID NO: 4148086 - RNA, 62 nt, Human
cacauuuagguuccuauagccaugaacccaugaaucuaaugcaaaguaggaaacugcaugug

SEQ ID NO: 4148087 - RNA, 56 nt, Human
cacauuucauuggcuuacguaauauuuaauucuauuauguaaguuacaaagaugug

SEQ ID NO: 4148088 - RNA, 71 nt, Human
cacauuucuaacuagaacgucuaguugcuggaggcucaaguugaaaucccuggacuuucuaguauaaugug

SEQ ID NO: 4148089 - RNA, 62 nt, Human
caccaauuuccugcaggggcuggugggcgcgauugcucuggacagcccuccaggaaggggug

SEQ ID NO: 4148090 - RNA, 62 nt, Human
caccacagcauccacuagaaggaauauuuaggguuuuguuucuuuuugaguauguuuuggug

SEQ ID NO: 4148091 - RNA, 62 nt, Human
caccacaugugcucuucuuucaguuuaggcauaccagcgcagcugcagaagacacaguggug

SEQ ID NO: 4148092 - RNA, 72 nt, Human
caccaccacacccagccauguucaguucucuagaguauauaccuagaaauggaauugcugggucauauggug

SEQ ID NO: 4148093 - RNA, 55 nt, Human
caccaccaccauuuaauguuuguuaaagcagugcauaaucuaaauggggguugug

SEQ ID NO: 4148094 - RNA, 106 nt, Human
caccacguuggccgggauggucuugaucuccucaccuugugaucucccugccuuggccucccaaagugcugggauuacaggcgugagccaccgugcccggccagug

SEQ ID NO: 4148095 - RNA, 109 nt, Human
caccacucacauggaacuuacuuucuaguggaauucugguauguuuuaauggaagauaagguuguaucugaauuacuauugguaaaggugagcaaaauuuagagugaug

SEQ ID NO: 4148096 - RNA, 71 nt, Human
caccagaugcccgggcuccaucggacuuggguuugaucucagacucuagagauggggucuguuuguuagug

SEQ ID NO: 4148097 - RNA, 69 nt, Human
caccagauucugguaauuucaagggcaggucaauuacuggcugccuauagaauuauuaguacaaaggug

SEQ ID NO: 4148098 - RNA, 78 nt, Human
caccagccccaggccuggcaggggggcagugguggcucugcaagcugucacucaccaggccugcaucgggcacaggug

SEQ ID NO: 4148099 - RNA, 106 nt, Human
caccagccugguuugcuuuugucucuacuucuugaucugucgaccucagauauuaccucucagccuugaugaucaaaggugaggaucuggcucacucgugcuggug

SEQ ID NO: 4148100 - RNA, 56 nt, Human
caccagcgacugugaccagcaauagcccccuggcuccagcuguccuguagcuggug

SEQ ID NO: 4148101 - RNA, 86 nt, Human
caccagcuguuguccagucagugauggagagagugcagcaucguaggauucuccagucacugacuucgagauucuauuagucggug

SEQ ID NO: 4148102 - RNA, 56 nt, Human
caccagcuuugcccacugcccaggggaugcuuugacggcaguagaggcagcucgug

SEQ ID NO: 4148103 - RNA, 82 nt, Human
caccaggagcugagagucaccagcuuuagguugccugccagagagcucugccgggcccuggauuuggcauuagccuugagug

SEQ ID NO: 4148104 - RNA, 64 nt, Human
caccaggcuggagugcaguggcaagaucucgguucaagccauucuccugccucagccucuugug

SEQ ID NO: 4148105 - RNA, 108 nt, Human
caccaugaccuguguuaaugaaguuaauugaauuuaagaucaauaaugguuaauuauugcaauuugacauucagagauaaauggcuuuaagacagagaaguaugugug

SEQ ID NO: 4148106 - RNA, 63 nt, Human
caccaugugaaugacauauuuuguacugcucuacccagguagaacauaagucauucauuugug

SEQ ID NO: 4148107 - RNA, 103 nt, Human
caccauucuucugagaauccuuaacagaagcuucugcuccuuuggguccuccuuggaugucaguaaaugagcaaaaauuuccacauuuucaggagagaggcug

SEQ ID NO: 4148108 - RNA, 67 nt, Human
caccauuuaguagcaagagcucagagauugcaucuuguucuccagugcuucuagaaaauaccuggug

SEQ ID NO: 4148109 - RNA, 70 nt, Human
cacccaacacuagcgcaaauacgcccaugagcugcucuauuuauaguguguaaagugcagugauuggaug

SEQ ID NO: 4148110 - RNA, 129 nt, Human
cacccacccccucagauccuggaggaagcuaccacugcaacugguugacuucuaggcccuacaacugacugaggccuccagcaguccugggagacuuacccagccauggugcuuccaauaggaugaugg

SEQ ID NO: 4148111 - RNA, 57 nt, Human
caaaugcacaaaacuuacgccaagccaaggggucuugcagagacuugugugcauuug

SEQ ID NO: 4148112 - RNA, 59 nt, Human
caaauggggugaaacaccaagacaguuaaaaguauuugucuuuaugacuugcccauuug

SEQ ID NO: 4148113 - RNA, 78 nt, Human
caaaugguuaggcugagagaacuagaugcuuuaguagcuacuguauuuggcauuuauuugucucauucuuacuaucug

SEQ ID NO: 4148114 - RNA, 106 nt, Human
caaauguauacaccacaugcuaaccucacaaaauuggaauaagcuuuugaaaagaaauugguccuugaagcuuguaucuaauauuggcacuggauuauagaauuug

SEQ ID NO: 4148115 - RNA, 91 nt, Human
caaauguccuuuggccuuuugucaaauccacacugaccucuuuucaaaugcguguggucaguguuauuuuucaaaggcccuuugaaguuug

SEQ ID NO: 4148116 - RNA, 56 nt, Human
caaauguugacuaagaggguuuaagaacuaagaggagacccucuaguuuuuguuug

SEQ ID NO: 4148117 - RNA, 78 nt, Human
caaauguuuaaguuuacagugucuuguugacuguacacgcaacauuguacagcagaucuguggagcuuauucaucuug

SEQ ID NO: 4148118 - RNA, 55 nt, Human
caaauguuugcaucacagggcauuuccuuuguccagugguacauggagacacuug

SEQ ID NO: 4148119 - RNA, 74 nt, Human
caaauuagcagcaugugccuuaaaucauucuauuguuugauuauagauuguagaaguucacugcugcuguuuug

SEQ ID NO: 4148120 - RNA, 79 nt, Human
caaauuauauugaauauguccuguauugguguuacucccugauaucacaagacaagacaaauugcaauccagggauuug

SEQ ID NO: 4148121 - RNA, 59 nt, Human
caaauuccaaaaauaacaaaagcguuagaugauaacaacgcucuuuguaagggaauuug

SEQ ID NO: 4148122 - RNA, 72 nt, Human
caaauuuaaacaugugauauaugauccugcuggaaacuguuuuagcaacaugguuaucacauuagaaauaug

SEQ ID NO: 4148123 - RNA, 129 nt, Human
caaauuugccuuuuguaagaaucacuccaggugcuuauuaaacaugcauauucccacaccccaucccagaaguauugaaucggaauguuuaauggaugccugugugauucauacgaugaggcaaguuug

SEQ ID NO: 4148124 - RNA, 94 nt, Human
caaauuugguuugugacaguuuagaacuacuguggcuaggauugaauaaagauugccagucagugguuuaaaaguuaugguggcucagaucuug

SEQ ID NO: 4148125 - RNA, 64 nt, Human
caacacaggacagucuaguaacaguacaguucaaagggaacguuacuuauagacguguuguuug

SEQ ID NO: 4148126 - RNA, 75 nt, Human
caacacagugucugugcuucaguguuccucuuaucaggaaggauaauaugugugaugcauggacuaacucuaaug

SEQ ID NO: 4148127 - RNA, 64 nt, Human
caacacaguucagcacagaacugaaccaagcccucugcagaauucccuucucugagcuguauug

SEQ ID NO: 4148128 - RNA, 113 nt, Human
caacacaugucugaacagggaaagaaaauacaaagauggaagguuauguuaaguucaaaaacaaacaaacaaacaaacauuuugucaucuuucuggccugguaguuuguguug

SEQ ID NO: 4148129 - RNA, 57 nt, Human
caacacugugcuugcauccuguggaaagucacauuuggggucaagugaaugguguug

SEQ ID NO: 4148130 - RNA, 55 nt, Human
caacagaggaguggccugauccgaguggcauuuaacaagguucacuuuccuguug

SEQ ID NO: 4148131 - RNA, 72 nt, Human
caacagaugauuuauauuuuucuaaacucuuuucauuaaaugguuuaagggagaauauugauggucauggug

SEQ ID NO: 4148132 - RNA, 57 nt, Human
caacaggguagcaaaaauguggaaauaaucuggguucuugaugcuaccuuuaaguug

SEQ ID NO: 4148133 - RNA, 69 nt, Human
caacagggugagaccccaucucuacuuaaaacacaaaaauuagcagggcaugguggugcacaccuguug

SEQ ID NO: 4148134 - RNA, 95 nt, Human
caacaguagugggugagagaagagcuuuauaucuggauucaguuucucauaaaugaaauaaaugugucuuuuuaaggccuuccgcaugccuguug

SEQ ID NO: 4148135 - RNA, 101 nt, Human
caacaguuuggaugaagguugaggugagucaugcauuggaggaacuaaaagaaaguccuaagccagguaggacucaauuccucuuccucauccagauggug

SEQ ID NO: 4148136 - RNA, 66 nt, Human
caacauaccugagaguuagguuuuuauguuccccuaauaugacaauauugagucuuagguuaauug

SEQ ID NO: 4148137 - RNA, 75 nt, Human
caacauucaacauggcuggucuaguaacuauuuuauuauuuuagagaugggaucucacuauguugcccaugcuug

SEQ ID NO: 4148138 - RNA, 57 nt, Human
caacauuuucauggccagggagagauuccauuucauggccagggagagagaauguug

SEQ ID NO: 4148139 - RNA, 75 nt, Human
caaccacacaauuucaguugcaugcaaccauaaguauuuguuucuggcucauguaccuguagguuggcagggcug

SEQ ID NO: 4148140 - RNA, 67 nt, Human
caaccacacauucauuugcuauuguguauggcugcuuuugagcuacuacaguagaggugaguaguug

SEQ ID NO: 4148141 - RNA, 86 nt, Human
caaccauuuuguuuggauucaaccuuuucuccaguggcugagucucaagcccuggagaaaagguugaauccaucuaagaauuauug

SEQ ID NO: 4148142 - RNA, 77 nt, Human
caaccgucugaugauaagcagaaauuauuugcagaucaagacaauuguucugcagucuggauguccucagaugacug

SEQ ID NO: 4148143 - RNA, 60 nt, Human
caaccugacaagguuaaugaauacccaaauagcuggaaaaaaauuaugccugugagguug

SEQ ID NO: 4148144 - RNA, 74 nt, Human
caaccugcucagcuucagcacacugggcaucacaaauagugucacucagugcagcuaggcaugagaagagguug

SEQ ID NO: 4148145 - RNA, 75 nt, Human
caaccuggcugcaagacaagguugguuuccaagccuuccuggaccuccagauuugauuugcacuauuuaugguug

SEQ ID NO: 4148146 - RNA, 61 nt, Human
caaccuggcuuuuguggcaucuugcuuacccuauuuugcagaacacagauaccaaagguug

SEQ ID NO: 4148147 - RNA, 75 nt, Human
caacgcuacaggcagagccaaucgugggguaagaagugucaaaucuaccacccccggccuucugucugaugcuug

SEQ ID NO: 4148148 - RNA, 129 nt, Human
caacggcguuggggcaagccucucugcaccugcguguccagccucuccugcaugccagaaguccccaggcaggaguguggugggacauccggcugggguaaggacaggcacccucccacagugucaggg

SEQ ID NO: 4148149 - RNA, 55 nt, Human
caacuacuguuuuugccucuuuagaaggcucuccuuuuugaggaagaauaaguug

SEQ ID NO: 4148150 - RNA, 106 nt, Human
caacuagauggugagcuucaugaaggugggcccaugcccucgacuacaguagcccuccaguguuggccucaggguugggcccauuaaggaugcuuauuuuagguug

SEQ ID NO: 4148151 - RNA, 103 nt, Human
caacuauaacagcugguggcauuuagauucuaaauacugcuuguucuccuauguaugcaucauuagaaucagguguuauaaucauccauggcugcaauagaug

SEQ ID NO: 4148152 - RNA, 64 nt, Human
caacuauccugugagacuuguccauuaucuucacuuugcagauaguaacaauuuauaggacuug

SEQ ID NO: 4148153 - RNA, 57 nt, Human
caacucacugagccuugccagcuuggugccuuaccguccugauaacucagugcuuug

SEQ ID NO: 4148154 - RNA, 130 nt, Human
caacucccaguuauguguugggugaggcucuagauguauugauguucuugggaugcuuuuucauggauuccagggaagagcaaggcaguuuauagacagcuuauuccaacacuggguuugaacuaaguug

SEQ ID NO: 4148155 - RNA, 55 nt, Human
caacucuacucuacuuuuccugaaauccuucagguauaaaguucagggagaguug

SEQ ID NO: 4148156 - RNA, 57 nt, Human
caacugaggucucagccaauuauggagagcucuggcugugggauggccccucaguug

SEQ ID NO: 4148157 - RNA, 96 nt, Human
caacuguaugucugauccauuuucuauguucacauuuaaauaaaguucuugcugugauguuuaaauguuuauagagaguacaggcuuaauaaguug

SEQ ID NO: 4148158 - RNA, 76 nt, Human
caacuugagaacucauuguuuucuccauuugcauuuacaacuucauagagccugagaggauaaugggguuaagaug

SEQ ID NO: 4148159 - RNA, 73 nt, Human
caacuugagagucggcuucacuuauguuaugggagauucugccaacucccuuaacaagcccaacuuucauuug

SEQ ID NO: 4148160 - RNA, 81 nt, Human
caacuuguaggacaaaauacuuacuggagaacauuuuuguaauguuguuuuucaugugaauauauuugucuuagaacauug

SEQ ID NO: 4148161 - RNA, 100 nt, Human
caacuuuauuuuauuuucccuuuaugagaauuugucagcaggaauugugaaaagugauuauaauauuccuuguuguagguggaaaauggaaaaggaguug

SEQ ID NO: 4148162 - RNA, 65 nt, Human
caagaaaaguacucuugcagaaacaucaggaaguucaccaugaacugcaagacaugcuguucuug

SEQ ID NO: 4148163 - RNA, 85 nt, Human
caagaaaauaguaaaaaggcagaaagaauacuuccuauugcuacaaaaggaauguuaguucuguauacaaaguauuauuuuguug

SEQ ID NO: 4148164 - RNA, 63 nt, Human
caagaaacauacagcugaugaacccagcucacaguugcacugaaaucaccugguguuuccuug

SEQ ID NO: 4148165 - RNA, 75 nt, Human
caagaaaguauuuacauuaacaucuccauggucucuuugacccucuugcaggugugagugaagugcuuggcucug

SEQ ID NO: 4148166 - RNA, 57 nt, Human
cagaaauuuauuggacucacaguucugaaggcugagaagucccagaucaaauuucug

SEQ ID NO: 4148167 - RNA, 95 nt, Human
cagaacaauaaacacaguggaacacagucauuagaggcagccauaauccauggccugcuguguacugaugucaacccugcugcguuugacaucug

SEQ ID NO: 4148168 - RNA, 76 nt, Human
cagaacacuuagccuucaguaaauccacugugaugggcaaaugccugccacauuuauuugaggcuaauugcuucug

SEQ ID NO: 4148169 - RNA, 69 nt, Human
cagaacagaggaggaagcacacggcuuguauuaaaagggaguuaauggaauguuuccucuuuuauucug

SEQ ID NO: 4148170 - RNA, 83 nt, Human
cagaacaggucauaaauuuaucuuugaguguuuuaaauuaucugauuuuagugucuuugacacauucaaaggaaugacuuuug

SEQ ID NO: 4148171 - RNA, 104 nt, Human
cagaaccccuucgggagccuguuaagguguauauucugugguuccuccggucuaggauaaagcccaggaaucugcaucuugaccacauucccugagggauucug

SEQ ID NO: 4148172 - RNA, 69 nt, Human
cagaaccugaggugggcaucagcauucucagacuggcaccggcuggcugcaugcccccuccuucuucug

SEQ ID NO: 4148173 - RNA, 78 nt, Human
cagaacuaccaaaucucaaucugaguauuaacaacuccgcaggugguuccuacgcacauugaauuuuggaaagugcug

SEQ ID NO: 4148174 - RNA, 61 nt, Human
cagaacucaguaguauggcuuuguugaucaguaaugacuagcagggauguuauuacuucug

SEQ ID NO: 4148175 - RNA, 71 nt, Human
cagaacucuagguaaaugagauauuucacugcucaugcugugugaccuucaugucccaucugccuagacug

SEQ ID NO: 4148176 - RNA, 61 nt, Human
cagaacuugaucagagcugaagacauauuugguagucuucugcaucugaauuuaaguacug

SEQ ID NO: 4148177 - RNA, 104 nt, Human
cagaagaaauggaugugacugcuuuacauuaauuucuacugaucccauccaaacagauaauaucagaagaaauggaugugacugcuuuacauuaauuucuacug

SEQ ID NO: 4148178 - RNA, 61 nt, Human
cagaagacuuuucuuuguccugucucaucuggccugucugugacaauagaaaagucuuuug

SEQ ID NO: 4148179 - RNA, 62 nt, Human
cagaagagaagagaggacaugauagauaccuggcuauuucagcaucucaaccuucucuacug

SEQ ID NO: 4148180 - RNA, 130 nt, Human
cagaagagaagcuaagcccuguggacggcaaauggacccaaggacacgggcagggacagagcugcuuccacugagccagcuguuaggugcuuguguucuuggcccccuggccgggguugucuuugauaug

SEQ ID NO: 4148181 - RNA, 69 nt, Human
cagaagagaggggaacugggugugcauggcaguuaugcuaugagcacagcucaguacucccucuggaug

SEQ ID NO: 4148182 - RNA, 57 nt, Human
cagaagaucagagcuuucugugaaccaauccuuuucacacagagcucucugcuucug

SEQ ID NO: 4148183 - RNA, 77 nt, Human
cagaagcaacuuaccaagggguauuuaaagacaugaaaauuuccagaaauaccauuuggugcaucccuuuguuucug

SEQ ID NO: 4148184 - RNA, 60 nt, Human
caaguaacaucugaacaugauguggaccauucauauccuaaagacauagguguuaccuug

SEQ ID NO: 4148185 - RNA, 57 nt, Human
caaguaacuaaagauauccauuuacaugaaaauaagaaugguuucauuggguacuug

SEQ ID NO: 4148186 - RNA, 130 nt, Human
caaguaacuaugcaugaagauacaccaggaacagcugccagcgacucauccucugggggacccauccagcucagccagucagucaguugcuggcauuuguucacagguugcaaacaacagaaagugcuug

SEQ ID NO: 4148187 - RNA, 68 nt, Human
caaguacaaguugucagggcaacugauguuaagugauuaaacaguacuugauaauuugcacguacuug

SEQ ID NO: 4148188 - RNA, 70 nt, Human
caaguacugauggcuccagguguuuucuauguuagauucccuuugaaaguacugaugccaucagcacuug

SEQ ID NO: 4148189 - RNA, 81 nt, Human
caaguagagccacaagagucaauuuguuuuugcuauuuugauuuaagauacaucaaagcaaauuggaaugugguuauaaug

SEQ ID NO: 4148190 - RNA, 120 nt, Human
caaguauugccauuuauaaaugccugagcuggagugagggaccauauuugugaaacugcaagauguguccucaaaucaguucucccuuucuucagcugugcaucuacgaugcauuucuug

SEQ ID NO: 4148191 - RNA, 58 nt, Human
caagucacccuccucagcccagugugaauuguguuucuguccugaggcagguggccug

SEQ ID NO: 4148192 - RNA, 61 nt, Human
caaguccaggacucagaguucaggaaaaucaggagucuccugaaguauggguauggaguug

SEQ ID NO: 4148193 - RNA, 60 nt, Human
caagugaaugaugugaaguguaaacaaccaucuauguuucauguuacugucauacacuug

SEQ ID NO: 4148194 - RNA, 55 nt, Human
caagugaauguagcaaacuugaaccuggaauaggugucugccuuuacuucacuug

SEQ ID NO: 4148195 - RNA, 85 nt, Human
caagugagaggugacauugagaacacagcuaaauugacacagugccagguauuguucuaaguguuuuguucaugucacuuaauug

SEQ ID NO: 4148196 - RNA, 59 nt, Human
caagugcaugguggcaaagaaugcaaugauaauuaauugcccuugcugccauugccuug

SEQ ID NO: 4148197 - RNA, 72 nt, Human
caaguggcagucggaagucaggagaaucgggugguaauucuggcucucuuaccaccuggcugucuuuacuug

SEQ ID NO: 4148198 - RNA, 59 nt, Human
caagugguagccggccucaggccucagccggugagggaugaugagacagcuaccacuug

SEQ ID NO: 4148199 - RNA, 56 nt, Human
caaguguaaccuuuccugcuaaaacucuucuugggucuggcagcauugguaccuug

SEQ ID NO: 4148200 - RNA, 82 nt, Human
caaguuaaaacugcucugucuucuguagcuaauaauucuuggcacugggauuauguuucaggauggcagaacagucugcaug

SEQ ID NO: 4148201 - RNA, 56 nt, Human
caaguuaucagaaggcacuuuuaauuucugguuugaaucugcuucccugugacuug

SEQ ID NO: 4148202 - RNA, 65 nt, Human
caaguucaucucuagacaggaggcuggugagguggacaucagccaggcccuaagagauugaccug

SEQ ID NO: 4148203 - RNA, 82 nt, Human
caaguuccaguuggcuuuugcuauacacauguguauccaacguuugcucaucuggcuucaguaacagucucacuuuaauuug

SEQ ID NO: 4148204 - RNA, 64 nt, Human
caaguuccuguuacuccccagaauuuauuauugguguauuauuuugguaagaaggaggagauug

SEQ ID NO: 4148205 - RNA, 61 nt, Human
caaguucuaggcagugggaacagcuggugcaagcucugagguggccacagccuggcacuug

SEQ ID NO: 4148206 - RNA, 56 nt, Human
caaguuugcugauccuuguuuuaaacaauaaacaaagccaggaaccaguaaaccug

SEQ ID NO: 4148207 - RNA, 107 nt, Human
caauaaacaaaaaauauggaucauaucacagcucuuucauugcuuucauuucuugagauauaugaauguaugugauauauuugauguccuguauuuuaucuuuauug

SEQ ID NO: 4148208 - RNA, 62 nt, Human
caauaaagaagauuuuugcaauacauguauaaaagcaaaagcaacacagaucuucuuuguug

SEQ ID NO: 4148209 - RNA, 67 nt, Human
caauaagaguugugugguuauucaguguguaaguuggcacauuucagaaucacacagcuuggguuug

SEQ ID NO: 4148210 - RNA, 129 nt, Human
caauaccccucauuccuuuacgugguugcuacaggcgaguggguacgcuuuuggucucugcagguucugccgugaguccagcaggaugcaagugccaucuuguagaauucaugggaauggaggaggaug

SEQ ID NO: 4148211 - RNA, 68 nt, Human
caauacuucaaucucguucuuauguaaugagccuuaauuaaccaagugcuccuagaaugaggguguug

SEQ ID NO: 4148212 - RNA, 64 nt, Human
caauagcuaggcugguaaaggacugaacaucuacaaggauacccuccuuugcuaguugcuguug

SEQ ID NO: 4148213 - RNA, 81 nt, Human
caauaguuuuagcaacaauugaugauucuuaugugaaacauuauuucuguguugcuuaucaaaugagugcugagacucuug

SEQ ID NO: 4148214 - RNA, 110 nt, Human
caauauauaaauuuuaaugccaagacaggaaauucaaucuaagaaaugaucacuugccaaauuaaugauccguuuacaucugagguuagagcugaggcauaauuauauug

SEQ ID NO: 4148215 - RNA, 73 nt, Human
caauaucacauuuguucuugaaucuaagcccuugggaugccauccaauuggaauugugaacuaagugauuuug

SEQ ID NO: 4148216 - RNA, 81 nt, Human
caauaugaauguauguguuuauuuucagauuuucuuaucaaauguguaagaucuagaaggcaaauauagugcuguauguug

SEQ ID NO: 4148217 - RNA, 76 nt, Human
caauaugcuguuuugaauucucuagaacuuuguugcuccaaaaucaaauaucuucagauaaagggagaguauguug

SEQ ID NO: 4148218 - RNA, 83 nt, Human
caaucagaucaggcccugugcaggugugcagcagcugagcuuuguagcgcugcagaagcguguucaggacacuggauucguug

SEQ ID NO: 4148219 - RNA, 104 nt, Human
caaucaucauuaaggcuaaacugaagcucaacucaaauugguagugauaagagaaugccaaaugauugauaaaugaguuuuaaguccuuggucuuaagauuuug

SEQ ID NO: 4148220 - RNA, 79 nt, Human
caagaaaguggugauuauauccccauuuccagguuaaugaaggagaaccuggagguaauguuauuuuuguugauucuug

SEQ ID NO: 4148221 - RNA, 77 nt, Human
caagaaauggcugugugcuucuccccauuucucagacgagaaaauugaggcaugagaaaaacaacaaaaccaucuug

SEQ ID NO: 4148222 - RNA, 82 nt, Human
caagaaccguguaccuacucuuuaaacaaauagguuuaauacuguuuaaaaauauaaaggguacuguauagauguguucuug

SEQ ID NO: 4148223 - RNA, 57 nt, Human
caagaagccgagcuacaggcucuggcuuuggccaugugccuguucacaggcuucuug

SEQ ID NO: 4148224 - RNA, 68 nt, Human
caagaagucuuacauaaacaggaaauggaguugugugcgcuugguugcuguaaauguagacuucauug

SEQ ID NO: 4148225 - RNA, 75 nt, Human
caagaaugguuuuauuauugccuuucuaaacaaguggaauauuuggaugaacagguaaucaguaaaauguccuug

SEQ ID NO: 4148226 - RNA, 82 nt, Human
caagacaacuauauuaacuugugauccuggauuggaaccuuguccaggaacagaauguuagugcaacaguuggugacgcuug

SEQ ID NO: 4148227 - RNA, 76 nt, Human
caagaccccuggcuucucugcauuguucuagcuucugauccauucagggaacaugaggagagcccuugggguaaug

SEQ ID NO: 4148228 - RNA, 75 nt, Human
caagagacauuuaucucucaguucuggaggaugggaaauccaagaucaaggcacugacagauucugugucuguug

SEQ ID NO: 4148229 - RNA, 79 nt, Human
caagagccagauguaagcuggacacugacccacugucccuuggaauggcuaugucuauguccagccugcucugcuguug

SEQ ID NO: 4148230 - RNA, 83 nt, Human
caagagcggaucacucuucuggaucucagaaauuuuagaaagcaaauacugugggaugcaguaggaacaauuauccguuuaug

SEQ ID NO: 4148231 - RNA, 117 nt, Human
caagagggaaagugugagauuuuggaaaauauaugcucugggauccugaaagccaaaccuucucuuuucacaaacucagggugugugacaucuucagaaucaaaugaguucuuuuug

SEQ ID NO: 4148232 - RNA, 129 nt, Human
caagaggguggcuggugggagggggugugccugugacagcgaccugggcagggcaucccucucaugccuggaagaacuguccggucaaugucgcaggcccagcacaccuucccaacgagcugaaagcug

SEQ ID NO: 4148233 - RNA, 61 nt, Human
caagaguuucugggucaaggauuugguggcuuggcauggaguucuggcccaggguuucuug

SEQ ID NO: 4148234 - RNA, 60 nt, Human
caagaugaaacuacagggaggaaagauuagucaccuugguucccuagagugcucaucuug

SEQ ID NO: 4148235 - RNA, 68 nt, Human
caagaugccaugccccaauacaggacaccuugcgugggccuuggugggucuugcggggcagcuucuug

SEQ ID NO: 4148236 - RNA, 96 nt, Human
caagcacguuacaccaaucaguugcagcugugacauugcgccgaggcucugaaguggguaauugcagaccacagcuaggcuggaaugcuguguuug

SEQ ID NO: 4148237 - RNA, 57 nt, Human
caagcagauauuuuagucaagaauuccagagaaggcugcuccuaaaaugucuacuug

SEQ ID NO: 4148238 - RNA, 56 nt, Human
caagcagguccugaaucugguccaucaugcagauagccaacgcagaaccauguuug

SEQ ID NO: 4148239 - RNA, 84 nt, Human
caagccagcagcucuuccauuuccuucagccugagaucaaaugauuaagcuuuagaaauguaggagauacuguugagaagcuug

SEQ ID NO: 4148240 - RNA, 64 nt, Human
caagccagggggcccuugcaggugagcgagccaagccuuucuuuucucagggccucucugcuug

SEQ ID NO: 4148241 - RNA, 76 nt, Human
caagcccauucauucacauuuugucuauggcuacuuugacccuacagcuauaguuagugagugagugaaugaauug

SEQ ID NO: 4148242 - RNA, 60 nt, Human
caagcccuuccgggaacaguuguagauuuuugcugccuucagcacguccucaaggguuug

SEQ ID NO: 4148243 - RNA, 81 nt, Human
caagcuagccuucccgagauggcccaagacgccuccuccuggggucuggggugaaggccguccuuggggacugggagccug

SEQ ID NO: 4148244 - RNA, 69 nt, Human
caagcuuuucuuuugauauuuguuacauuugugaaauaauauaacaaugcaguuaaugggaagagcaug

SEQ ID NO: 4148245 - RNA, 62 nt, Human
caaggacagguggagugguuagcaggccauugcgugguugccguuuguucuaccagaccuug

SEQ ID NO: 4148246 - RNA, 70 nt, Human
caaggacccguggauggaaggccacugcagagugugagcuggcagaugcguuuucauuuucgguucuuug

SEQ ID NO: 4148247 - RNA, 80 nt, Human
caaggagaguccagguguggcuggggcagaggccuuuguaaggcagguucuaugccaacaccugucuauggacauccuug

SEQ ID NO: 4148248 - RNA, 55 nt, Human
caaggagagucuucucaugguauccccaaggaucucugaguuguacuuucccuug

SEQ ID NO: 4148249 - RNA, 81 nt, Human
caaggaugguuucuucagucuuugugaaaaauaguauuucagucuucucuauauucagaaaacugagcgaugacauccuug

SEQ ID NO: 4148250 - RNA, 78 nt, Human
caaggauguugacacaaacagugauguaguaaaaauaauuucuacuuacugagcacucacuuuuguuauagguccuug

SEQ ID NO: 4148251 - RNA, 60 nt, Human
caaggcaguagguguuucaaacugagucuggauugaccuagcuggaaccucuacuccuug

SEQ ID NO: 4148252 - RNA, 76 nt, Human
caaggcauuucagcucuaguaagcagacaccagcccacugcauuguguuugagaucugaagcugaauauggcuuug

SEQ ID NO: 4148253 - RNA, 95 nt, Human
caaggccuccucggugucuggguccccuacugucaaccucauagccccugaggucauaaaagccaggggagucagcugcuggagaucugguuuug

SEQ ID NO: 4148254 - RNA, 66 nt, Human
caaggcuugggguguuuauugacaggccuagcccaugcagaacgcuauucagaacacugggccuug

SEQ ID NO: 4148255 - RNA, 77 nt, Human
caagggaagcuggccgcgccuccgcgacgguguucuuggcacggaggacugaggcgcaguccggcugucuccccuug

SEQ ID NO: 4148256 - RNA, 77 nt, Human
caagggaagugaagguuugagucugaacagguuccaaaauggauugugcaaaaccucaggccucccuccuuccucug

SEQ ID NO: 4148257 - RNA, 58 nt, Human
caagggauggacuuugaaauuccacagaacuggguucaaauuuuaucuccauccuuug

SEQ ID NO: 4148258 - RNA, 85 nt, Human
cacauuuuuaggaaauaagcauguacucaagcaaauguuuauuuauaaauaugcugauuguaguauugcuuauaaccagaaugug

SEQ ID NO: 4148259 - RNA, 81 nt, Human
caccaacagacuaaaugacagguaccauaguggggacauuuuucuggcuccugguacagugccugucauuuagaaguggug

SEQ ID NO: 4148260 - RNA, 62 nt, Human
caccaauuggcuuuucaugacaacucagcgauagauugcaauugcuauggagagcgugugug

SEQ ID NO: 4148261 - RNA, 65 nt, Human
caccaccacgccuggcuaauuuuugguagagacagguuuucaccauguuggccaagcuggucuug

SEQ ID NO: 4148262 - RNA, 81 nt, Human
caccaccagaggaucuuauuaaaaugcagauccacauucaacgucuguaauuuugcauuucuaaugagcuccgggguggug

SEQ ID NO: 4148263 - RNA, 100 nt, Human
caccaccugcuugguggcuucggggaugugcacggugucaaacggggcugccacagcacacgucccgcccuuguacuugccgagccgacagcccacggug

SEQ ID NO: 4148264 - RNA, 87 nt, Human
caccacgaugacaugagaggcugaaguguacaugggugaagagcacuccaucaucucucuaccucagucuccagaacuugucuggug

SEQ ID NO: 4148265 - RNA, 74 nt, Human
caccacugccagaucauuggauucacacaugcugaggcuucaguggcucaauguggguugaagaugcaguggug

SEQ ID NO: 4148266 - RNA, 85 nt, Human
caccagaaagugucucaagcaaucucugugucccugccugaucccggccacagggaacacggggaugcuggucagacucagggug

SEQ ID NO: 4148267 - RNA, 65 nt, Human
caccagcacauuaguaucuaagaacaugaaaguucagcauaugucuuuuaccuaaugagcuggug

SEQ ID NO: 4148268 - RNA, 56 nt, Human
caccagcgacugugaccagcaauagcccccuggcuccagcuguccgguagcuggug

SEQ ID NO: 4148269 - RNA, 64 nt, Human
caccagcugagcccucagggcagagaagggggcaucuaugcagagaucugggcgucggcuggug

SEQ ID NO: 4148270 - RNA, 73 nt, Human
caccagcuuaaccaagggaucaaugucaacaccaccaauaauuggaugaauugaaaucauugggcaccuggug

SEQ ID NO: 4148271 - RNA, 60 nt, Human
caccagcuugggcuguggaaaugcuauuuuauaguuggcaauuccaccaugagcuaggug

SEQ ID NO: 4148272 - RNA, 73 nt, Human
caccagguaucuaaaggauuuaauuuagugguaauagacaccacuaagagagcaucccuuugcugcauuggug

SEQ ID NO: 4148273 - RNA, 90 nt, Human
caccagguuggucagaagagacacagcuuugagcagccaguggcaaagcauugucauguggcaauuaaagcaggugacuaaugcuggaug

SEQ ID NO: 4148274 - RNA, 70 nt, Human
caccaucagccaguuugauucuauuuguuucucaagucccccaagaacagaaccuggcacagagauggug

SEQ ID NO: 4148275 - RNA, 58 nt, Human
caccaucauccauccaucuucuccaauuaacuugggggagaauaugaggaugauggug

SEQ ID NO: 4148276 - RNA, 112 nt, Human
caccaugcaugugaaucaccuggggggcugcuuaaaaugcagauucugucucaggaggucugggguaggaacaagagucugcauuucuaacaggcucuguguagugcuggug

SEQ ID NO: 4148277 - RNA, 60 nt, Human
caccauggggagagucugggucagugauugcucuggccaacugugggguccccgauggug

SEQ ID NO: 4148278 - RNA, 65 nt, Human
caccauuguggaauauauccugcuaaucuggcuaaagaugacugcaggacaaaauuuccagggug

SEQ ID NO: 4148279 - RNA, 63 nt, Human
caccauuuuuagaugggccaaauagaugcucuagaccucugugguggcaucuguaaaauggug

SEQ ID NO: 4148280 - RNA, 59 nt, Human
cacccacggacuguguaauugcugcuaucggggcugaugggcaggcacagcccugggug

SEQ ID NO: 4148281 - RNA, 58 nt, Human
cacccacugagcucaugucccagggcuaggcucugccugaggacaggagacaugggug

SEQ ID NO: 4148282 - RNA, 65 nt, Human
cacccagagccugagagggauaguaaaacaaucacuacuuuauguaaaccuguaaguucugggug

SEQ ID NO: 4148283 - RNA, 59 nt, Human
cacccagcauggugggucaggcccuggcuuugaauacuggccucaccacuagcugggug

SEQ ID NO: 4148284 - RNA, 62 nt, Human
cacccaggagguugggaagggccccaaaacacaagcggcguuucauucagcacccugaggug

SEQ ID NO: 4148285 - RNA, 85 nt, Human
cacccauaugucccuccagugucccaguggggaguuagaggaaugguucucaucuccaggaaagacacuggacugauaccaggug

SEQ ID NO: 4148286 - RNA, 130 nt, Human
cacccccaccccagcucccugaccacgggcugcggaagagugggacguuauggaaccuucucagcuuauucagagaggcuucuucuuccuauuuagucucccucuggcuuucccugcugggaucugggug

SEQ ID NO: 4148287 - RNA, 73 nt, Human
caccccccaacccgaaggcugccaguggcccucuugggguccuccaggagcgcagcccaaggguuggggacug

SEQ ID NO: 4148288 - RNA, 86 nt, Human
caccccggguccuguccucugggugccccaucccagggccucacaucuuccaagauggacacucagagggaggccaaccuggagug

SEQ ID NO: 4148289 - RNA, 64 nt, Human
caccccucaggucuggcaguccccuacccacuggccuaaucauacugugcagccugaggaugug

SEQ ID NO: 4148290 - RNA, 61 nt, Human
cacccgaaagcugguccuaauugagccauuuucugaaugcuagccuuggaccggcugggug

SEQ ID NO: 4148291 - RNA, 89 nt, Human
cacccgacuccuggauuuggugagagugcuuuacaagcaaccauguguguuguggcugaucaaagcgcucagaauccaggggaaggcug

SEQ ID NO: 4148292 - RNA, 76 nt, Human
cacccuagucaaggagcaagcuugccggcugcccaccggggaugcccagcccuuggcuggcuccuugccugaugug

SEQ ID NO: 4148293 - RNA, 96 nt, Human
cacccucaugggcucuuggugcaacucuggaucuucugguaaaagagaaguuuuucccuucugagccaagcuugcaacaggguuaauuugggggug

SEQ ID NO: 4148294 - RNA, 55 nt, Human
cacccugacuucugacgauguuucuggaauacaguuaauugucagaagucaugug

SEQ ID NO: 4148295 - RNA, 83 nt, Human
cacccugcagacagcuccagaggcagugaugaaguuucugcuauagguuagccuuuuauucucuucuggagucuucaugggug

SEQ ID NO: 4148296 - RNA, 126 nt, Human
cacccugccccacaaccucaggagccagggcccuucccccaagccccuccucaaaccucagccagacuccaccccuggcugaaggagggaagaaggcucuguguccugggaacccaggggccugug

SEQ ID NO: 4148297 - RNA, 61 nt, Human
cacccugcugucccacagcgcugaccacagggagagagguuugcuggggacauacagggug

SEQ ID NO: 4148298 - RNA, 78 nt, Human
cacccuucccaaagcuacucuucugacuggccacaggggccugcaagucagaguucuuggggagacacugccauggug

SEQ ID NO: 4148299 - RNA, 69 nt, Human
cacccuucccccacaccccucgguuuaagcugaaacucgauccgucuacccugugggugugcaagggug

SEQ ID NO: 4148300 - RNA, 64 nt, Human
cacccuuuccuggccaagcagaguggaaagcccaagcuuuccaggaugccguggcacagaggug

SEQ ID NO: 4148301 - RNA, 77 nt, Human
caccgaaaaugaaaggcccuucuccagagaggcccaaagcaauguuuugagcacaacucuuggagagcuggguggug

SEQ ID NO: 4148302 - RNA, 77 nt, Human
caccuagaauuccuucacagauuauacuguaaauccaaacuacaggacuuucugaaaugcaggcaauuugcuaggug

SEQ ID NO: 4148303 - RNA, 89 nt, Human
caccuagcaucucacugauuuacugugccuaagacaggaaauauuggcaaacauguuuaguuagaaucaauggaguauguuccaaggug

SEQ ID NO: 4148304 - RNA, 77 nt, Human
caccucaggccugcaggaaaggcuccccugccugccugacaaaccuggcuggggccucaccagcaggcccgagugug

SEQ ID NO: 4148305 - RNA, 62 nt, Human
caccucaucugucauccuagggaaugccuuaauuuauucuuguaauuuggagaaaugaggug

SEQ ID NO: 4148306 - RNA, 58 nt, Human
caccucccaggccaccaggaggcagcucaugaucacaacuugguggcucugggaagug

SEQ ID NO: 4148307 - RNA, 57 nt, Human
caccucucagcuaggaguaaguagaaccaccaaccuaugccuggugcagaagaggug

SEQ ID NO: 4148308 - RNA, 89 nt, Human
caccucugcugccaagagcuggagaggcagucuaucauucaagaagaaugacucuaugcuuccuuauuagcccuaggcuggcagaggug

SEQ ID NO: 4148309 - RNA, 97 nt, Human
cagcacuuugugaauuuuucuguuucacaguauucagaauucauuagaacauguuugauuagaaugcacaugaggcaagcaaaauuagcacagucug

SEQ ID NO: 4148310 - RNA, 57 nt, Human
cagcagagaugagauuccuauaguuauuuauugaacuuggauuuucaaucauugcug

SEQ ID NO: 4148311 - RNA, 63 nt, Human
cagcagagcauuugguaggaggucaggagcucacaggagaugggauucugccgaugccugcug

SEQ ID NO: 4148312 - RNA, 79 nt, Human
cagcagaguggccaaggcugaggcccugggcuuggccugauguggccguggccggucccuggccuuggucucucuccug

SEQ ID NO: 4148313 - RNA, 61 nt, Human
cagcagauggacugguuuuuagcacuccugagggggagaggauggagccagucugucucug

SEQ ID NO: 4148314 - RNA, 59 nt, Human
cagcagcaacaacggaagccuucaguguucacuucuggagccucacgucuugacugcug

SEQ ID NO: 4148315 - RNA, 104 nt, Human
cagcagcauacguggagaugaggcgagaggcuugggcuaguaaggaugccaccuauacuucugcccggacccugcuggcuauccugcgccuuuccacugcucug

SEQ ID NO: 4148316 - RNA, 82 nt, Human
cagcagccaguuaacauuuagagugaaggccaagcguaaaacaagaaaugacccuuggcccacucucagaauguggcgaaug

SEQ ID NO: 4148317 - RNA, 70 nt, Human
cagcagccucaaguuuauuuuccacaggcaacucaucagcccagggacaguagaggcuugaucgcagcug

SEQ ID NO: 4148318 - RNA, 61 nt, Human
cagcagccugucuaaaguauguuugguaauuuccgccaagaccugcaucugauaggcccug

SEQ ID NO: 4148319 - RNA, 107 nt, Human
cagcagcgguggcugcagaacagcgguggcuguagaacagcgguggcuguagaacagcaguggcuguagaacaguggauauuggugaucugcaaaugcugcugccug

SEQ ID NO: 4148320 - RNA, 81 nt, Human
cagcagcugaucuuagacauuucuagcccauaaaacugugagaaauauuuggaggcugggaaguccgagaucacaaugcug

SEQ ID NO: 4148321 - RNA, 55 nt, Human
cagcagcugguugaauccuucucaugcuugaaaacucugacuucaacuucugcug

SEQ ID NO: 4148322 - RNA, 63 nt, Human
cagcagcuucuguugaucagaaacacaaccccacuguuaacucugcauucgagggaggcucug

SEQ ID NO: 4148323 - RNA, 62 nt, Human
cagcagcuuuggagugugagugcugucucuuuggagagauugugggcuccuugagggcucug

SEQ ID NO: 4148324 - RNA, 60 nt, Human
cagcaggaaguacuagcuuugaauccaggauuccugccucccagacuggugcugcugcug

SEQ ID NO: 4148325 - RNA, 71 nt, Human
cagcaggauguaugucuuauucuucuaccagaugagaagagaaugcacagagacaaauaccauccauacug

SEQ ID NO: 4148326 - RNA, 56 nt, Human
cagcaggcugauuaggccucguccauuauagagagugacuuccuaaucgccagcug

SEQ ID NO: 4148327 - RNA, 83 nt, Human
cagcaggguccugucuuccuucugcucugugggacagugccagggcacugccaggcagcagagggagaagcggggagccguug

SEQ ID NO: 4148328 - RNA, 66 nt, Human
cagcaggucucagacuggcaggcagugagcuagauuaugccugaaaaccuguuuuguuggccuaug

SEQ ID NO: 4148329 - RNA, 55 nt, Human
cagcagucaggccugugggagacagaggguggguucacagggcaccuggcuccug

SEQ ID NO: 4148330 - RNA, 65 nt, Human
cagcaguccacauagucauuaauuucugcugcugacaucaggaaagaggauuaugugugugucug

SEQ ID NO: 4148331 - RNA, 61 nt, Human
cagcagugaugugugaggguucguuaauuauugcucuuacugauguuugcacaggcuguug

SEQ ID NO: 4148332 - RNA, 61 nt, Human
cagcaguggccaucuguguggucccaguucccaacucagcuguuuucacaccggccuguug

SEQ ID NO: 4148333 - RNA, 55 nt, Human
cagcaguggcugcaggcagcuggguacacgcuguaauuugcauggcugaaugcug

SEQ ID NO: 4148334 - RNA, 84 nt, Human
caaagggcccuggcuggcaccaggcaugcugggagaggggagaguuauccuuggagcuauuuuccuggaugucaccguguuuug

SEQ ID NO: 4148335 - RNA, 69 nt, Human
caaaggucagaugaccauacugaucuugucuugacuucucaguguuuccugugguacagcugaccucug

SEQ ID NO: 4148336 - RNA, 65 nt, Human
caaaguauaguguaggauggcaaaauagucauguacauuuauuuaaauauuuugcauuuacuuug

SEQ ID NO: 4148337 - RNA, 56 nt, Human
caaagucuuggugaucaacuuuuucacaacaaaacauugcuguugccaagauuuug

SEQ ID NO: 4148338 - RNA, 58 nt, Human
caaagugcuggaauuacaggugugagccaccgcacccugccccuauuccugccuuuug

SEQ ID NO: 4148339 - RNA, 55 nt, Human
caaagugcugggauuauaggcaugagccaccuugccuggccaauuccagcuuuug

SEQ ID NO: 4148340 - RNA, 67 nt, Human
caaaguuggggcuguugaaccaaacugacauuucuuaacaguugaucuucuuaaagaccucacuuug

SEQ ID NO: 4148341 - RNA, 56 nt, Human
caaauacuggguaaguuaauuucaaauggcuuuggaguccaacaaaccuguguuug

SEQ ID NO: 4148342 - RNA, 80 nt, Human
caaauacuucugacaauucaguaacagcaugccuuuuuuggugauuguuguaaaauuugagaugucagcuuuguauauug

SEQ ID NO: 4148343 - RNA, 56 nt, Human
caaauagacuucaaucucuugaauuagauauguacaagauauugagugucaguuug

SEQ ID NO: 4148344 - RNA, 61 nt, Human
caaauagcaggugguucugaguauuuauuuuauaguaaauacagcagacuccuguugucug

SEQ ID NO: 4148345 - RNA, 118 nt, Human
caaauauuucacgaugguuuuaaaugucauaagugugaguuaugucccugcucaccuccccuucugauuugagcagaugucuaacuuuuacaugagaucagaauaaucugauuguuug

SEQ ID NO: 4148346 - RNA, 116 nt, Human
caaaucacuugcagaacaaauuaguucacauaaauuguauuuuucauuccaagugagaugcuggucucauuacuugaauggauaggauuugaacuguggcugcgagaacagaagug

SEQ ID NO: 4148347 - RNA, 101 nt, Human
caaaucauaaagcuaucguuacaccauuuaagaaagccaaauuucaguuaugcucugaauuuggcagugucuugaaguaauuaucuggaguuauguauuug

SEQ ID NO: 4148348 - RNA, 63 nt, Human
caaauccugcagggcuuagauggcaguggccuggugcaaaggaaaauuuaagcccccagguug

SEQ ID NO: 4148349 - RNA, 93 nt, Human
caaaucuauuuacauagcaaagccucuaugcuccucccagaguuuaggaggccuggccaagcacuggggucaaaauguguaaaaugggcauug

SEQ ID NO: 4148350 - RNA, 92 nt, Human
caaaugaaugagucagacuugacuuuguaaguuuuuacaugcuuauauaaugugaaaauuaucuccuuaaggacuagacuuauaaauauuug

SEQ ID NO: 4148351 - RNA, 104 nt, Human
caaaugagagacagagcuaguaucugaacccaagcagucagccugaagacugauccuuaaucagcaggccaugcugcuuuucaagauuugcugccucucaucug

SEQ ID NO: 4148352 - RNA, 94 nt, Human
caaaugcaaugaauguggccagucauguaguaaccagauagagagucaggaaguugcaucaacugagucauuaaucagcucauucauuuauuug

SEQ ID NO: 4148353 - RNA, 82 nt, Human
caaaugcccccagagccagcaaguccccuuccugccccgcuaaaagaggaauaagaacuugucucuggcagccucuuauuug

SEQ ID NO: 4148354 - RNA, 64 nt, Human
caaaugcucagcauucaagugugugcauguacacacacacacacacaugcaugcuugccauuug

SEQ ID NO: 4148355 - RNA, 65 nt, Human
caaauucuuugaauacaaacuaucugagcacuaaucucagaugcagacuugguucaggcaguuug

SEQ ID NO: 4148356 - RNA, 68 nt, Human
caaauugaucugucuuuaugaacagggcacaguaaagcacccaugcugaaauaaagauggucacuuug

SEQ ID NO: 4148357 - RNA, 66 nt, Human
caaauuuuagcaucugaacuguugaaaaggaaggauucaucagcacagcagaugcuucaauguuug

SEQ ID NO: 4148358 - RNA, 58 nt, Human
caacaaacugacuuauguucucagcaguguagacacugaagggccugagcagauguug

SEQ ID NO: 4148359 - RNA, 66 nt, Human
caacaacaucuccaaccuacauccacuugggggacagccagcgugcugugggagggagcuggcuug

SEQ ID NO: 4148360 - RNA, 110 nt, Human
caacaaggaugcugccacaggcuugggagcagagccacugaaaacaggcagccuagugcccacugguggcuccgcuuccaugggcuggaaaaugagcggcagacugauug

SEQ ID NO: 4148361 - RNA, 63 nt, Human
caacaagggacaguguucuaaacagagaguuuaguucuggcuuaggaauuuauuccauuguug

SEQ ID NO: 4148362 - RNA, 74 nt, Human
caacacaggcuugaaagaguauucaugaggaccuaaaagcccuaaguucuagguagugcucuuucccugaguug

SEQ ID NO: 4148363 - RNA, 68 nt, Human
caacacugacaauggacugauuuucauggcuuugaaaauuuuuaaguuaguucauucaauuaggguug

SEQ ID NO: 4148364 - RNA, 64 nt, Human
caacacuucuuauacuuacugaagagacagacauacugcaaauucaguguauuuaagaauguug

SEQ ID NO: 4148365 - RNA, 124 nt, Human
caacacuuuaucauuccacagacuugcuccgggcugaacguggacugggccugggucucaguacuggggacagggguccaggcguggcccagaugaacucaggaugugugguuuggguguguug

SEQ ID NO: 4148366 - RNA, 73 nt, Human
caacagaaaucaauuuucccauggcuucagaaguugcgaaguccgagaucaaagugaaguugguuuccuguug

SEQ ID NO: 4148367 - RNA, 61 nt, Human
caacagaccuggauucaaaaacuaccuuucuauauugggauucuuguuuccaggucuggug

SEQ ID NO: 4148368 - RNA, 124 nt, Human
caacagcucugcaagcuugggguugugguucacaauuuuuacugauugggcgacugagaugcagaaaggccacaguuacucaguuuguaugugagcaguccaagguucaaacccaugucuguug

SEQ ID NO: 4148369 - RNA, 130 nt, Human
caacaucucacuggccagaacuaugucacauggccaucccuagcugccagggaggcugggaaguuaaguacuucagcuuucuagacucuguggucaugauggcaagggcaaggggcugaaguggguguug

SEQ ID NO: 4148370 - RNA, 70 nt, Human
caacauguguggauaaugcacuauccauauggguguguguuuauauauguguauguguccacaucuguug

SEQ ID NO: 4148371 - RNA, 83 nt, Human
caacauguguugccaaauuggccuugaucucucuaacugcuguggaauagcucugagauucgugggucucuugagacauguug

SEQ ID NO: 4148372 - RNA, 80 nt, Human
caacauuauguuucugaggacuuuccauguuaaugugaccccaauuuauucauuuuaacagucagaguuuuccauuguug

SEQ ID NO: 4148373 - RNA, 64 nt, Human
caccucuguccuggcuggucucgugcacgcaagccaugcaggugccagcucucaggcaggagug

SEQ ID NO: 4148374 - RNA, 89 nt, Human
caccugagucugcaucucugacuuuuucucaguguaccccacaggcuguuacacagauuuaaaagcagggaaagagaggcucaagggug

SEQ ID NO: 4148375 - RNA, 74 nt, Human
caccugaugcgguggugcgugugauuugucaaaagaaagccuucuggaugcuguuaagauguacccuucaggug

SEQ ID NO: 4148376 - RNA, 62 nt, Human
caccugauuacuuucucuaguauaauuggcuucauuuagaugcagccagagggaagcaggug

SEQ ID NO: 4148377 - RNA, 124 nt, Human
caccugcacuuuguuuggauuugccucuauacccacugcauuucucugauguuuuuuucuaccauucuguuuggacagagcaucagaugaaaucaacugcugagagagggaagugagugcugug

SEQ ID NO: 4148378 - RNA, 66 nt, Human
caccugcagggcuuagaaaugguggcuauaaucagaaagcauguagcaauagaagccuugcagcug

SEQ ID NO: 4148379 - RNA, 130 nt, Human
caccugcauucuguuacccggcuucucagcagggcaggaaacauucccauaacacauggagugcuuugguuuugggggguuucugcauuucccugcugaggauccagaaaucaggugauagaauauuuug

SEQ ID NO: 4148380 - RNA, 73 nt, Human
caccugccucauuugucccugcuggaacuugcugccuuugucccacacccugcagggcagcugaagcuaggug

SEQ ID NO: 4148381 - RNA, 70 nt, Human
caccugccuccugggacaggcuggcacaggcacauucuuaugcuggaaucugugucccaggggucaagug

SEQ ID NO: 4148382 - RNA, 74 nt, Human
caccugcuccccaggggccuugugaauuuggaggguucucugcuaagcucacauggcucuaggaggugcuggug

SEQ ID NO: 4148383 - RNA, 65 nt, Human
caccuggucaagggaggagacacagcccuaccagcggucagguuuggucaacuccuuauuaggug

SEQ ID NO: 4148384 - RNA, 90 nt, Human
caccuggucccaugaacuuauuucugaacuuuucaucacggaggacuguagggagaagccaacagagcuguuuucacaagggaccaugug

SEQ ID NO: 4148385 - RNA, 86 nt, Human
caccugguuguguuauaugcauuguugcagagaaauuuaaucuaauuuuuuuuagcuuccugugcaaugccuaaucacaaaaggug

SEQ ID NO: 4148386 - RNA, 62 nt, Human
caccuugcauucuuuuaauuuacuugaauucaaguggaaaaacugaggagagagcugaggug

SEQ ID NO: 4148387 - RNA, 58 nt, Human
caccuugcuagguauuugggaugcaaagacagaugucuaucccuggccuuaaggagug

SEQ ID NO: 4148388 - RNA, 83 nt, Human
caccuuguauguggcuuucugcguuuucuccagagcgcacaagggcuggugagaagaugcuggaaguguggcaacucagggug

SEQ ID NO: 4148389 - RNA, 87 nt, Human
caccuuucuuuugauugagcaguuucaaaauacuauuuuuguuuaauuugcaaagggauauuugagaucucaaugaggacuacggug

SEQ ID NO: 4148390 - RNA, 89 nt, Human
caccuuuggcggccauguggucaucuggguuuguggcaucaggugagcagaccuggguugccacugacccaggggccacccagauggug

SEQ ID NO: 4148391 - RNA, 91 nt, Human
cacgagcauguguuucuuuuagaggagagcuucaauuuuacuauaauugucuaaagacggagcugcuuugaucugaagaauuauuauugug

SEQ ID NO: 4148392 - RNA, 84 nt, Human
cacgagccuccuguaaaugaggugcuacuguuuucccauguccauuuccaagacaaggacauagaggcccugcauggcucagug

SEQ ID NO: 4148393 - RNA, 63 nt, Human
cacgcagccagagggggugugaucagauguguguucugguuggauggcucuuguggcugugug

SEQ ID NO: 4148394 - RNA, 58 nt, Human
cacgcgugcuccucaguguccucugucuccaggcaugggcugcugggagagcugcgug

SEQ ID NO: 4148395 - RNA, 68 nt, Human
cacggcccaguggggagcuucugccuuggacugcaggcagcucaggggaguuugcuacuaggugggug

SEQ ID NO: 4148396 - RNA, 127 nt, Human
cacggcuggaaacggggaagcuggauuuggaguuugccugacugcagagaggcaccucuguucccguggugucucugcuuuccuugcagggcagugcacauuucuugguuuuccuuuuaaagccgug

SEQ ID NO: 4148397 - RNA, 70 nt, Human
cacgggaaggguacauggggugaaguccaggggaaaccagaugccaguuucccauuguuccccuccagug

SEQ ID NO: 4148398 - RNA, 65 nt, Human
cacgggauucuuuugccuagggcugaaaagaugugucugcuagccaaguagggggaaagcccgug

SEQ ID NO: 4148399 - RNA, 112 nt, Human
cacguauaugaagaaguacugguuuagaccaaggcaauuggcuuguauaagaggccuacccucauaccaaaagccaguuuccuuggucuaggccaguguuuacugguaugug

SEQ ID NO: 4148400 - RNA, 59 nt, Human
cacgugcaggucuuaggagacaaaggaagggaagugacuguuuccuggccuggugugug

SEQ ID NO: 4148401 - RNA, 114 nt, Human
cacguuuuccuccuuaucugcuucccugguguuuauugaaugauacuguacccaaaacccugugauagacacuguaugagcuggguggggaggauacaaggaauauuagacgug

SEQ ID NO: 4148402 - RNA, 58 nt, Human
cacuaaaacuacauuggaaacacauucccuaccacuugugcuaagagugguuuuagug

SEQ ID NO: 4148403 - RNA, 81 nt, Human
cacuaacaauuuucuggucagauguuaagucaaaaauggagauucccuucauuuucagcacccaucugaaagauguuauug

SEQ ID NO: 4148404 - RNA, 63 nt, Human
cacuaaccauauucacacuaugcccagugugugugcugugcugugugugugugugugugugug

SEQ ID NO: 4148405 - RNA, 79 nt, Human
cacuauggaaaaucaguuugagaaauggcagggagagcaauaggagguuguuagauauuucuuagaagaagccauggug

SEQ ID NO: 4148406 - RNA, 114 nt, Human
cacucacccaggagugcguuuuuauaaagcagguccccagacacucaccagagcauucuguagauuuagugugccugggaaucugcguuuuaauaggcaccucugauugaagug

SEQ ID NO: 4148407 - RNA, 62 nt, Human
cacucaccgccuugcccggccgggcccaggugcagaugaggcccuccuggcaggcagugaug

SEQ ID NO: 4148408 - RNA, 89 nt, Human
cacucaccuuuuuugagaaaugcuguucacuggcaugcuucccaaagaagcagccauuuaaaaugaauugguauuucuuuccgggagug

SEQ ID NO: 4148409 - RNA, 125 nt, Human
cacucacgcuguaaaaucccccaucuccgggugcagacugggggcucuaacagcuuucaugaauaucgaaaauucucuuaaagcuuccaguuucaaucuggauauuuggauauaugugugaugug

SEQ ID NO: 4148410 - RNA, 59 nt, Human
cacucagcccacccauguuuguguaaacugaguuuugccggaacauagcagggcuggug

SEQ ID NO: 4148411 - RNA, 122 nt, Human
cacucauuguauuucuucagagucagguacuugaagucuugaugaagcaguaauaaguauugauuuuauugaaacuucacuuuuugaguaaauuccuucuuagaauuuuauguagugaagug

SEQ ID NO: 4148412 - RNA, 76 nt, Human
cacuccccucaaaguuauaacaucucccaucaacaucagcucagaauggcagugaugcuuaugguuugugggggug

SEQ ID NO: 4148413 - RNA, 69 nt, Human
cacuccccucccacacagcccgcucaccggaccccaccccguccgggccagauggcucuggggagagug

SEQ ID NO: 4148414 - RNA, 56 nt, Human
cacuccuacuccagagugcuaggcuauguaaacuccagcuccuggacuagagagug

SEQ ID NO: 4148415 - RNA, 84 nt, Human
cacuccucagggccaucucugucccuaacaguacaccgugcugugugcagcucaggggauacgagggugggccugguccuagug

SEQ ID NO: 4148416 - RNA, 69 nt, Human
cacuccucccucucugucuauucccccaccuccguuaccacacauagguaagcagugaggugaggagug

SEQ ID NO: 4148417 - RNA, 129 nt, Human
cacuccugcagaugagguacaggggaagccaccagagagaagcugugcagguccccacugccugccagggcacuggagagggcaggggccagcagagcccuccugauccccgucaaugggcagauggug

SEQ ID NO: 4148418 - RNA, 117 nt, Human
cacucggugcugagggguaugcucugccucugucuccucugaggugccagcagagccuguccuggccucacucuggccuggggagugggggugcuguauccucuacagggcugacug

SEQ ID NO: 4148419 - RNA, 55 nt, Human
cacucucacugagcucaugccaaacuuaaagaacuugguguuagaccagagagug

SEQ ID NO: 4148420 - RNA, 85 nt, Human
cacucucucaggcaucagaagauggcucuggaaauaaagguucauuuauuuccaugcaccugucauuugguuccuaagugaugug

SEQ ID NO: 4148421 - RNA, 59 nt, Human
cacucugauuccacaaggcuccccgaccccgcuagucaucugccuuguugucaguggug

SEQ ID NO: 4148422 - RNA, 62 nt, Human
cacucuggggaugcaaggagaggugagaauuacagccauuuuugcaauaaucucccacagug

SEQ ID NO: 4148423 - RNA, 95 nt, Human
cacucuguccacaguacacaggguuguggccuuaaaggcucagcaaggucaucauuucugagccuacaguaacagcccuguggucucacagaaug

SEQ ID NO: 4148424 - RNA, 78 nt, Human
cacugaagacagcaugauacaugaugcucuuggccgcuuguacaggaaguggcguguggacaugaugcaaguucagug

SEQ ID NO: 4148425 - RNA, 123 nt, Human
cacugaagacucaggcuucucugaaggcaaaauuacaaaguuauuaggaauucucuuaaugguuuacucugauuuauggauguguuuagucagcccaucaucauccaugaguauucaaaagug

SEQ ID NO: 4148426 - RNA, 77 nt, Human
cacugaagcuuuuaguucacaccaggguagcagaagucagcuugcuucuugcuuccuuuaagugauuggcuuuggug

SEQ ID NO: 4148427 - RNA, 65 nt, Human
cacugaaggaaggacuacugcaucccuaauaaugagcggaccuguaauaggauuucacugcagug

SEQ ID NO: 4148428 - RNA, 73 nt, Human
cacugaagugcaugcaugucagggauccuggaacuauuuugcuucuuuucuuggagaugcaugcccguuagug

SEQ ID NO: 4148429 - RNA, 70 nt, Human
caagucaauuauuacgguucugagacauugaacccagaaaaucauuucagagucaggaaugcuugauuug

SEQ ID NO: 4148430 - RNA, 94 nt, Human
caagucuaaagagccaaagucauuguaauauaugcuaagggcaaagggaaauagucaauagcuuuguuagaaugucuucaggucuuugaguuug

SEQ ID NO: 4148431 - RNA, 93 nt, Human
caagucuuaaaucaucauugccuguuucccuuggaaaccaaggagaaccugguugaacaccaguuggggaaauagggauguugccugagcuug

SEQ ID NO: 4148432 - RNA, 86 nt, Human
caagugacagagcugggauuugaagccaccuuuacccaaccuuuccauccuaggagcuuacaaucauuucaguuuaguugaccuug

SEQ ID NO: 4148433 - RNA, 81 nt, Human
caagugaccuacucaggaucacgcagugagugcagcccagccggggcucagcuccaggugugcaucuugauauggcauuug

SEQ ID NO: 4148434 - RNA, 98 nt, Human
caaguguccccaauacauuuucuucuuucaucuuuggcaucagggccagcuacauaaucuguggggcccagugcaaaaggaaaauauggggcuucuug

SEQ ID NO: 4148435 - RNA, 78 nt, Human
caagugugauuuucauuuucuaagcuuuuaaugcuguguuuuuagguguuuuagaguuucuaaauggaauuauaacug

SEQ ID NO: 4148436 - RNA, 60 nt, Human
caaguguggcugucuguucuccuaggucagacaagacuggaagggggacagccacacaug

SEQ ID NO: 4148437 - RNA, 66 nt, Human
caaguguuuugacccuguggaaacuaaguuuuguuaccuauggcucucuacaggucaagaccauug

SEQ ID NO: 4148438 - RNA, 108 nt, Human
caaguucaagaacugggaggcaagaaagagcacagcuuguuuaaggauuagccauguuuaguugcauggcuggaaugcaacuguguguuguugggguuuuugagguug

SEQ ID NO: 4148439 - RNA, 105 nt, Human
caaguucugucaaugggauuuuuaaaaaguauuuucaaaccaccagagaggcagccugguguugcggaaaacacuuugaucugaaaguguugauucaaggacuug

SEQ ID NO: 4148440 - RNA, 106 nt, Human
caaguuucagagcauggcuuggcucuagucugccuggcugggcugcucauggggacaaggcuggugucagaggagucaggugagcugggucaugccucgaaucaug

SEQ ID NO: 4148441 - RNA, 72 nt, Human
caaguuuccagagagagggaaaauacugaugugagcuacauauuugucucugcacuuuacucagggaauuug

SEQ ID NO: 4148442 - RNA, 80 nt, Human
caaguuugacauuuaaauugcaggcagcccuggguccauuccaggagcuggcugugguugagugcaguucugaucacuug

SEQ ID NO: 4148443 - RNA, 96 nt, Human
caaguuuggucaaggggugaguguguccgacuccaaggagcaucuccguuucugagugggaacucucaugacacugugucccuugccucaggcuug

SEQ ID NO: 4148444 - RNA, 77 nt, Human
caauaaaauguaguaagaagagcaggagcuuuggaaucuacuuggguucaaacucuugcucugcuaguugcuuguug

SEQ ID NO: 4148445 - RNA, 64 nt, Human
caauaacuaguaauuauuccgguccccaaacagaagaggacuggaaaaucuugacuagcuguug

SEQ ID NO: 4148446 - RNA, 88 nt, Human
caauacugagccagcauuccuacaugauaagaauuaguagaaauagaaaaauuacuccugcuuagauaggauauguucucucauauug

SEQ ID NO: 4148447 - RNA, 68 nt, Human
caauagcacaucacuccagugaguuucuaguucccugagggacuaaccguggggagaugugcucauug

SEQ ID NO: 4148448 - RNA, 86 nt, Human
caauauaauaauguuuugcuguaguguucugaugucaaauaagaaugcauuagagaauuaaaggcacgugacauuauuaguacuug

SEQ ID NO: 4148449 - RNA, 78 nt, Human
caauaugaugaccuuaaaauuuuaauucuaggguggagagaauugucuuaguucucaugaauuuuaagucaugauuug

SEQ ID NO: 4148450 - RNA, 72 nt, Human
caauauuccuguggcuuccacaucaugaucucaagucaugggaugagggugagccacaugagccauauguug

SEQ ID NO: 4148451 - RNA, 76 nt, Human
caaucacaucacuucuuuugaaaucugcuggugauuggucaccaugcaucaguuaaaaggaguaagcaugugguug

SEQ ID NO: 4148452 - RNA, 58 nt, Human
caaucacuccacaauaugguucuuaccccuucagugagugcuauggucugaguguuug

SEQ ID NO: 4148453 - RNA, 78 nt, Human
caaucaggcuugcauagaaaccauaaaggagcucgucaggcugcuggagugagugguuucuuaugaacagccucauug

SEQ ID NO: 4148454 - RNA, 59 nt, Human
caaucaguaaccggaucaugguuccagaggcuuaacugacaagugauuuuugcugauug

SEQ ID NO: 4148455 - RNA, 84 nt, Human
caauccuuuuccuugguaagauuaucauauguaagagcuuuacaagcuuucaugaaaauaaucuacuuacgggggcagggauug

SEQ ID NO: 4148456 - RNA, 63 nt, Human
caaucuggcaaauuaauugaagcuaacuuuagaugaugucaguuagauugccuccuuagauug

SEQ ID NO: 4148457 - RNA, 56 nt, Human
caaucuuaguggcuuacaaagaguuacugcucucucauguguguccauugugauug

SEQ ID NO: 4148458 - RNA, 124 nt, Human
caaucuuucaacuagacagcagcugucucuuuacguacgggcauggcugacauagaggacugaauugucuccugucagaagcauccugaggaagggucagcucucaggucaagaggagggauug

SEQ ID NO: 4148459 - RNA, 89 nt, Human
caaugacucgcucagcauugauugugaggccucugcaggagcagucagcucugacuggcagaauucucagauguagaaguggguuguug

SEQ ID NO: 4148460 - RNA, 55 nt, Human
caaugacuggaagggaagcagagcugcugugcuucaucacuucucaguuaacuug

SEQ ID NO: 4148461 - RNA, 71 nt, Human
caaugacuuaaauugggggugacacaucugaacaucagcaugugcucuacaugcuccauguuugggucuug

SEQ ID NO: 4148462 - RNA, 72 nt, Human
caaugacuuguuuuguaacugaaggcaagagaccuucccuguccaugucucaguauacgaaacacuucuuug

SEQ ID NO: 4148463 - RNA, 71 nt, Human
caaugauaauguagaagcccggaggaaggagagccuuacccagagcacuugagcuuuugcauuccuuguug

SEQ ID NO: 4148464 - RNA, 76 nt, Human
caaugcacgcucagauuugaccuaagaaacaccuuaaaacauuaaaaauucaucagucagagcugguguuguauug

SEQ ID NO: 4148465 - RNA, 81 nt, Human
caaugcccagugccuguggccacugcgucugcaaucugucuuguggaaugacauaugcugggccucaggugaaucacauug

SEQ ID NO: 4148466 - RNA, 80 nt, Human
caauggugaaauuacgggauuuuuuaaguuaauggcaucuauggcauuguuuguaaaauuccaguagcccuucauaacug

SEQ ID NO: 4148467 - RNA, 114 nt, Human
caaugguucggauccuuuacauagugcuuucccacuacaagcugcaaacuauaauuucaguggaaaugguaagugggaggcauuagcuguguuuuauuucacaaaaguucauug

SEQ ID NO: 4148468 - RNA, 73 nt, Human
caauguaauguaugcaguguagaugcaugagaauuuuuaagacgcucuuggugucauuacuguaauuauugug

SEQ ID NO: 4148469 - RNA, 78 nt, Human
caauguauggugugggugaugaauuuguucuugucacagcagaggacugaguauucuuuacccaaaugcuauagauug

SEQ ID NO: 4148470 - RNA, 101 nt, Human
caaugucucuuuuuuaaccuuuugacuuugcugugaaaccaugggaaguuauugacuuuacaggcacuucaaguauacaaucaggcagaaaaagggcauug

SEQ ID NO: 4148471 - RNA, 60 nt, Human
caaugugagaauaacucaaaacaaugaguucucauugugaggaauuuuguucucuuguug

SEQ ID NO: 4148472 - RNA, 73 nt, Human
caauguguaucaccaaagguuuucaucacagcaagaaguacuucugaagcuggaggaagcuuugggcacauug

SEQ ID NO: 4148473 - RNA, 64 nt, Human
caaugugucuggcauggcucuauuccauuuauuuuagaucauggaauacgcaccagaugcacug

SEQ ID NO: 4148474 - RNA, 71 nt, Human
caauguuguucaggcuuugcucuguugauuucuauuuauuggaaaaacaacuagaaccugaagcaauauug

SEQ ID NO: 4148475 - RNA, 55 nt, Human
caggccuggcccccggcacacccagaggaaggagaggcuggguggcucaggugug

SEQ ID NO: 4148476 - RNA, 64 nt, Human
caggccuggguucaaaucccuuaagauacauggccuagaguagggguugucaaacuaaggccug

SEQ ID NO: 4148477 - RNA, 129 nt, Human
caggcgcagccccuuaccuggcugggcuccugggcagcugggcgguggcgugaagguggcugggugcucagaucugcucuccaucggcugcccugcccuggcccagcccagccucugggagugaccugg

SEQ ID NO: 4148478 - RNA, 56 nt, Human
caggcgccucgcauggcacacucagaccgcugggaggguggccgcaugggugcgug

SEQ ID NO: 4148479 - RNA, 55 nt, Human
caggcggcaagcagcaggggcuccggcaucagccccccagcaccuugccagccug

SEQ ID NO: 4148480 - RNA, 61 nt, Human
caggcgggcaggugcggccccuccccgccgccgcagagggccgggucccacugcccgucug

SEQ ID NO: 4148481 - RNA, 72 nt, Human
caggcgugaaggaggacacccaggacugggcgccuuggccccccgcuccuuaccuguccaaccucaucucug

SEQ ID NO: 4148482 - RNA, 105 nt, Human
caggcucagagaagauacguggacuuccuucgagucauauaguuguaacccagguuaggacaugugccuccagggcagaguccaccugccuuggucucuagucug

SEQ ID NO: 4148483 - RNA, 55 nt, Human
caggcucagaugcccugcgcugcucuccauugaggaguugggcucuggaggccug

SEQ ID NO: 4148484 - RNA, 79 nt, Human
caggcucaguuugggcucuucuugucucugguuagaauguauuauucuuuauagcuauuggaugaguacuugcagucug

SEQ ID NO: 4148485 - RNA, 56 nt, Human
caggcuccccaccugggagaggagugcccagcucugauccugccuggggccgccug

SEQ ID NO: 4148486 - RNA, 65 nt, Human
caggcucuaacucucgccuuggacuucaauuguuggaaaaaaggcaaugagggagauagagugug

SEQ ID NO: 4148487 - RNA, 64 nt, Human
caggcucuggaaaaccacuagcaggaaauuacguuuucccguuagguucauccaugauuaucug

SEQ ID NO: 4148488 - RNA, 59 nt, Human
caggcugacugugugaccuugggcaagcaucaucucuugaaaugcacacagacagcuug

SEQ ID NO: 4148489 - RNA, 61 nt, Human
caggcugcguuugugaaagguaauuaaauugugauaauguuuccauucagaccccagcuug

SEQ ID NO: 4148490 - RNA, 66 nt, Human
caggcugugauggauguaaaggaccgauucccaacgauuguccuuuaugaaaaccucauaagccug

SEQ ID NO: 4148491 - RNA, 73 nt, Human
caggcuguuggaaggccagcaccuugaguccuuuauggaggaccccacgggcuucuuucaacuucaaccccug

SEQ ID NO: 4148492 - RNA, 56 nt, Human
caggcuuaagaugcuagagagcuuuguagcucuguguauacauucucuuggguuug

SEQ ID NO: 4148493 - RNA, 104 nt, Human
caggcuuccugcugccuagggauuucuggagauacugcucuccauauuccccauggaguuauggucucuguauuuucaggucucuccuggaagauggaaaccug

SEQ ID NO: 4148494 - RNA, 82 nt, Human
caggcuucucugcuucugggacaucuggacaguuucauuuggaggcuucuacguggucccagggucuucugcaguaaguuug

SEQ ID NO: 4148495 - RNA, 75 nt, Human
caggcuuggccagacagagaggcuuuguuaggggaaagagaagcuaguugagcuuuagugucagguagggaccug

SEQ ID NO: 4148496 - RNA, 65 nt, Human
caggcuugggucagaaggcuuguuccuuagucacauguugcuacaaguaaaugacaccaggccug

SEQ ID NO: 4148497 - RNA, 56 nt, Human
caggcuugugucucagcugcaggcaguuaucacaaaugcacgcuagcacagguuug

SEQ ID NO: 4148498 - RNA, 115 nt, Human
cagggaaauggugggcugccgggcagggacgaggcugggggacaggcuggcugucuccacggcugcgcuccuggccacguucuugcugggcuuagagucugcuuccguuucguug

SEQ ID NO: 4148499 - RNA, 87 nt, Human
cagggaaccccaggagucaccagcccaaagucaccccgggaugacuggcgaugcugggggguuggggcugggggacccagguccuug

SEQ ID NO: 4148500 - RNA, 56 nt, Human
cagggaauucagcuucugguauggacaagcaagcuucuaccauguugacuuuccug

SEQ ID NO: 4148501 - RNA, 66 nt, Human
cagggacaauggcagagccugaaauucuuccuagucguccaauucagguucacuccccuguuccug

SEQ ID NO: 4148502 - RNA, 77 nt, Human
cagggacacauggcugggaugggguagagaaaggagucuccuuuuucucauacuacccuuuaguuauuguguauuug

SEQ ID NO: 4148503 - RNA, 111 nt, Human
cagggacgagggccugggcgcagggcugaccuugugcuccgaggcgggcagcagcgaggggcugggggcccggcggagcagagggggccgcaucucgaacuccacgcccug

SEQ ID NO: 4148504 - RNA, 77 nt, Human
cagggagccccagcauggagcuuugggccuugguuucgggaaacugggacuggcccuggcugcuaggcugcucccug

SEQ ID NO: 4148505 - RNA, 72 nt, Human
cagggagcuggauccugggaucuggaugaccaaggagagauguggugcagagagggaucuagggcuucccug

SEQ ID NO: 4148506 - RNA, 58 nt, Human
cagggaggagcagccugcucuagcccacuuugcucucaggauugaaugcuucucccug

SEQ ID NO: 4148507 - RNA, 55 nt, Human
cagggauuaacuuggcaccuucuaaacugaagaaggagccaaauuuuagacucug

SEQ ID NO: 4148508 - RNA, 75 nt, Human
cagggcaauugaacagugggcaugugaagacugaaggcucauguaguauauuaucccacucauuugaugacucug

SEQ ID NO: 4148509 - RNA, 61 nt, Human
cagggcacgcggugggcuggugguuucauagccgacacacagcgccuaccaugugcagcug

SEQ ID NO: 4148510 - RNA, 85 nt, Human
cagggcagagaugaacagccuggccucuugcuaggcagcccuguguugucugaguggugcaaggcugacauuucuucuugcccug

SEQ ID NO: 4148511 - RNA, 68 nt, Human
caccgugugcuugucguggagccaggcucggugccuaccaggccugagucaagauguggcaccuggug

SEQ ID NO: 4148512 - RNA, 61 nt, Human
caccguucagcccuguggcaggcaacugugccuguguauacaacuuauaggagccacggug

SEQ ID NO: 4148513 - RNA, 76 nt, Human
caccuaauccacccugugguggcuuucuggagagggaggcaucuaagcugagcuguggcuggguggagugugggug

SEQ ID NO: 4148514 - RNA, 98 nt, Human
caccuaauuuagaugacugagaugaugagauuuggaacuuuugagcuaaugagacugugagcuuuuaaucuuauguuaauguuaugauggauagagug

SEQ ID NO: 4148515 - RNA, 56 nt, Human
caccuagcaugaaauucagcagaaggcaaagacuccuacugaacucugauuaggug

SEQ ID NO: 4148516 - RNA, 84 nt, Human
caccuaguauagggccugaugcguaggagaccuuccagaugugggucagucuuauucagugggcucugccauuuucaguaggug

SEQ ID NO: 4148517 - RNA, 61 nt, Human
caccucacagaguucaggacuaaaugugaucacauguaaagugucuagaacauuguaggug

SEQ ID NO: 4148518 - RNA, 60 nt, Human
caccucacagguccaagagauccuccuacuucagccccuugagugguuggaccagaggug

SEQ ID NO: 4148519 - RNA, 66 nt, Human
caccucaggcuccccgggggugagcacugugaaucacagaaguguccuccucugggagccagggug

SEQ ID NO: 4148520 - RNA, 122 nt, Human
caccucuuaugauuaauuaaccuuuuguggaguaacuaggacaucugugugggaugagauguacuuuggucagacuucaguuuuuaguuguucagcaagaggauaauuaauuauaagagcug

SEQ ID NO: 4148521 - RNA, 86 nt, Human
caccucuucugcccauuucagcagcccauguuuggauuuuuaggcccuacuggauuccaaacagucaccaugggaagaguggggug

SEQ ID NO: 4148522 - RNA, 88 nt, Human
caccugaccucgagucuuucaaauggccauuggcuuagguuaccccaauuagccagacucauuuggaaguauccagaggagucaggug

SEQ ID NO: 4148523 - RNA, 112 nt, Human
caccugaggauguguuaggaaugcaguuuccugggccccaacccagaccuacugaaucaggaacucugggaaugaggcccagcgauuuucauuuuagcaaaacuugcaggug

SEQ ID NO: 4148524 - RNA, 66 nt, Human
caccugagucccggagguugaggcugcagugagccacgauugugccacugcgcuccagccugggug

SEQ ID NO: 4148525 - RNA, 60 nt, Human
caccugccugguccuuagggcuucccucuucccauuugcccggaaaaccacuaucaggug

SEQ ID NO: 4148526 - RNA, 95 nt, Human
caccuggcugucugggagggguggcccuggcguguaccguuugcugauuucugugccguagguacuuacaccagggcuuuaaaggcaccagugug

SEQ ID NO: 4148527 - RNA, 73 nt, Human
caccugggacuuuguuaauaucucacauuccugguucacaggaaucugugguuuuaacaggcaccuccaggug

SEQ ID NO: 4148528 - RNA, 59 nt, Human
caccugggucauugcugguguuaaggcagaaggaaaagacaacacggcagacccaggug

SEQ ID NO: 4148529 - RNA, 64 nt, Human
caccugggucugucuuauaggaauggagggccggccugucauaacuuuaaagacagugugggug

SEQ ID NO: 4148530 - RNA, 92 nt, Human
caccuggucauuuccuugggaaauuacucugcuaggagaagaguuagaugcuuuuccuugagauuuuuuucuagguaggaaauugccaugug

SEQ ID NO: 4148531 - RNA, 60 nt, Human
caccugguggggcccacaaaccucuguuugcuucauuuugggacucuagagacucaggug

SEQ ID NO: 4148532 - RNA, 73 nt, Human
caccuguaaucccagcuacucgggaggcugaggcaggagaauugcuugauccugggaggcggagguugcagug

SEQ ID NO: 4148533 - RNA, 73 nt, Human
caccuguaaucccugcuacucagguggcugaggcaugugaauugcgugaaccugggaggcagagguugcagug

SEQ ID NO: 4148534 - RNA, 60 nt, Human
caccugugacucucugccucucguuccacaaguagggcaggccagaaaugucagggagug

SEQ ID NO: 4148535 - RNA, 61 nt, Human
caccuguuguuuauucaucucucaaguguggcugacuucagggaugagaauaaacaaugug

SEQ ID NO: 4148536 - RNA, 79 nt, Human
caccuuggcuugccaaagugcugagauuacaggugugaaccaccacagccagcuauucuagagccuuuuagccaaggug

SEQ ID NO: 4148537 - RNA, 70 nt, Human
caccuugggaggcugaggcagguggaucaccugaggucaggaguucgagaccagccuggccaacaaggug

SEQ ID NO: 4148538 - RNA, 91 nt, Human
caccuuuaaucuggcuuggaucaggcaauaauaucucagauuucaaggguagagugcuuuagguguuuggcugaacucuagacuuaaggug

SEQ ID NO: 4148539 - RNA, 67 nt, Human
caccuuuaggccuggcuggaucugccaccgcccuccugggggucaccuuuccagcaggucugaggug

SEQ ID NO: 4148540 - RNA, 86 nt, Human
caccuuugcaauugagugaggaggaaguuuucauuuauucuucaagauagaguaaaucacucuucucucaccaccuugucuuugug

SEQ ID NO: 4148541 - RNA, 81 nt, Human
cacgagaaaauggcagaagugauauaaugugacuucagaggcugagucacaaaaggccauguggcuuccgccauguuugug

SEQ ID NO: 4148542 - RNA, 75 nt, Human
cacgagauaggauggcgagaaagugagagagagaguucuucacucuuuagagguacaucucuucuccugcuugug

SEQ ID NO: 4148543 - RNA, 90 nt, Human
cacgauaccucucuuugcuggaacucugaagucccugggacauuuuuaugaagucucagugguguuuugaguccagcauaguuacaagug

SEQ ID NO: 4148544 - RNA, 87 nt, Human
cacgaugcaaaccaaggcaggguggcccuccagugagcaagaugacuuucuucugccacuucacauugccugggucucuugcaucug

SEQ ID NO: 4148545 - RNA, 68 nt, Human
cacgaugccauucacuuaggcacuugcuuguucuagaaauauuuauuaagcacuagguguggcaggug

SEQ ID NO: 4148546 - RNA, 60 nt, Human
cacgcagcuggugggccuccagggucuccacggugauguuggggucccacaggcugccug

SEQ ID NO: 4148547 - RNA, 130 nt, Human
cacgccuggcuaauuuuuguauuuuuaguagagaugggguuuugccaggcuggucucgaucucccgaccucaggugauccacuugccucggcuucccaacgugcuggaguuacaggugucagccaccgug

SEQ ID NO: 4148548 - RNA, 57 nt, Human
cacgggugggaaagaacauuuuucacccaaaucaagaguggucuuuuucacccagug

SEQ ID NO: 4148549 - RNA, 82 nt, Human
cacggugagcaugggaagggccgauggagccucaugggaggaaccaugaguucugagaagcccuugauaccuaaacacugug

SEQ ID NO: 4148550 - RNA, 63 nt, Human
cagcagagcauuugguaggaggucaggagcucauaggagaugggauucugccgaugccugcug

SEQ ID NO: 4148551 - RNA, 90 nt, Human
cagcagauggguuuggcugccuucuauuuagcuuauccacuagcacauucauggaugcugaauuccagggccccacuacccagccuucug

SEQ ID NO: 4148552 - RNA, 59 nt, Human
cagcagcaagcagugguggcagccacauccuggcaaccacgucugcacuguagcuguug

SEQ ID NO: 4148553 - RNA, 57 nt, Human
cagcagcagcuaaaggaaagagcucugagguucccaguuucuugucggcuguugcug

SEQ ID NO: 4148554 - RNA, 59 nt, Human
cagcagcucacucagguggcucuacagcaucauaggcccacuuuccuggugagcagcug

SEQ ID NO: 4148555 - RNA, 75 nt, Human
cagcagcucagccuccuucccauugguucucacaaagcaugcuucucuggguggagcaggcuggugcuucaguug

SEQ ID NO: 4148556 - RNA, 85 nt, Human
cagcaggaggagccgguuuagauacaaauggauuccauggcaacuccugacuccacaugacuucuaauaacuggcauuucaguug

SEQ ID NO: 4148557 - RNA, 114 nt, Human
cagcaggauagaguuacagaauuuauuaggaguugagugucaaacuuccguguaauaacuuacagcaagacagaccgcucaauuugccugggaguuagcaaaaucuacaagcug

SEQ ID NO: 4148558 - RNA, 61 nt, Human
cagcaggcagccauuucacuguggggcucccugcaucaaugcacugaauggcacccuguug

SEQ ID NO: 4148559 - RNA, 64 nt, Human
cagcagggagcacugcgagcggcagugaggggcccucucugacggugcagaugcuuuuuggcug

SEQ ID NO: 4148560 - RNA, 128 nt, Human
cagcagggcagccccuugauuucuuccgcagacugcaccuccagcggcuggugagcaaugagagccagaggcgccagcugguggggaagcugcagguccuuguggaggaggccuuugguugccagcug

SEQ ID NO: 4148561 - RNA, 56 nt, Human
cagcagggccucuggcacugguccuuagcugugggcuucagugagagucccugcug

SEQ ID NO: 4148562 - RNA, 61 nt, Human
cagcaggucugcauuugaggucugaaaauguacauuucuaacaaguguccagaugcugcug

SEQ ID NO: 4148563 - RNA, 68 nt, Human
cagcaguaauuagugcugcaugaugccucauucagcaagaaaggcagguugcuacccauuaacugcug

SEQ ID NO: 4148564 - RNA, 67 nt, Human
cagcaguacucccagaacaaacccugcaugacucaagguuguuuucugggcagugggcauucuguug

SEQ ID NO: 4148565 - RNA, 56 nt, Human
cagcagucacacaaacucuggaaucauggcauuugauuucuaaguuuugcuugcug

SEQ ID NO: 4148566 - RNA, 84 nt, Human
cagcagucccauuccucuggccagggauuaacuuuccgcacagcaacgugaugaaguuuggccaaggagacauggagaaggcug

SEQ ID NO: 4148567 - RNA, 62 nt, Human
cagcaguggaugcuaauuauuggcaugggaaagugcucuuaggauacacagcuucacuguug

SEQ ID NO: 4148568 - RNA, 69 nt, Human
cagcaguggggaagcuacaggguuucuuguucucuagcuggccagagccccugagcuucccuguggcug

SEQ ID NO: 4148569 - RNA, 57 nt, Human
cagcaguguacaaggugucagaguaugcacggcgcuuugguguuccggucauugcug

SEQ ID NO: 4148570 - RNA, 108 nt, Human
cagcagugugaaagccaggggacauaugggcagggaggaaguucagugggagggcauuuaugcaaacauucgcuugucucugcuccugggcgucuuaaauauugucug

SEQ ID NO: 4148571 - RNA, 81 nt, Human
cagggcaggacugggugggcaagcguggacugcaucuguccugcaugggguccugcgucuggcucgcccggugccgugcug

SEQ ID NO: 4148572 - RNA, 74 nt, Human
cagggcaggaggaggcaggugggcagaggaauagcagccguuuguucuggaggccccuuccuucucccgucuug

SEQ ID NO: 4148573 - RNA, 55 nt, Human
cagggccaccguguuugcugcucgaugagagaggaggcauggaaauggcacacug

SEQ ID NO: 4148574 - RNA, 84 nt, Human
cagggcccuagggcucagccuccuccucagcccacgaagccaugugacugcugggcuggggaucgaaggcagagccugguucug

SEQ ID NO: 4148575 - RNA, 79 nt, Human
cagggcccuguggcauucucggcaccaucugccccgugccugugcgcugcugcugccaagggugccacaggcagcacug

SEQ ID NO: 4148576 - RNA, 66 nt, Human
cagggccgggggaggcaagagacaugccaagaacauauuugcaugaccuagccuccuucaguuuug

SEQ ID NO: 4148577 - RNA, 56 nt, Human
cagggccucucaucccacgggcuucuccaggacaccgcguggggcagaggcaccug

SEQ ID NO: 4148578 - RNA, 58 nt, Human
cagggccuucguaaguguccggccccaagcauccugggguggacgucugaggucacug

SEQ ID NO: 4148579 - RNA, 66 nt, Human
cagggccuuuguuccacaaguguaaacagcgaugcacaaagcugguuacauucaaaacaaacucug

SEQ ID NO: 4148580 - RNA, 130 nt, Human
cagggcgcgucgcgcuggccguuccagccggggucaccgcgcugcucgccccacaugcccucauggcuguuguuccagggggggcaguggggugggccgcccugguggugcggguaggguggcugcucug

SEQ ID NO: 4148581 - RNA, 60 nt, Human
cagggcucagaagacagaccucagcugccuucuagaccagcuggucugcucuuggcccug

SEQ ID NO: 4148582 - RNA, 55 nt, Human
cagggcucaucugugugaccaguagaauacuguggaagaaacaaugugagaccug

SEQ ID NO: 4148583 - RNA, 75 nt, Human
cagggcuccuaaacggaagauuuuuuaaauaaacugugcuccucagaauaugacaagauuuuccuaggaaaucug

SEQ ID NO: 4148584 - RNA, 109 nt, Human
cagggcucugucucagcugucuuggcaacaccuggaagacaugggccucugcaaggucucauacuuucaggagguguugaugaaggauauggacagaucugaagcucug

SEQ ID NO: 4148585 - RNA, 56 nt, Human
cagggcugaagaaauucaaaagauaugagaaaaucuuugaugaauuucagacucug

SEQ ID NO: 4148586 - RNA, 68 nt, Human
cagggcugauguggaauuugaaugagauuauucauguaaggcacccauguucauacagacaugccuug

SEQ ID NO: 4148587 - RNA, 80 nt, Human
cagggcugcugcugccagcgacaccucagaaagcauagccucggcuuccugccccaugugucccuggaagcuguacccug

SEQ ID NO: 4148588 - RNA, 77 nt, Human
cagggcuggcucaggcuccuucccagggauggucaccacagggucugccaucccugugugaggggcagccaguugug

SEQ ID NO: 4148589 - RNA, 62 nt, Human
cagggcuguggaaaacuggugcuuccucaaaaaguuaaauacagcauuuccacguggcccug

SEQ ID NO: 4148590 - RNA, 80 nt, Human
cagggcuguuuucugcaacucuguucauuuaauucuuccaaaucuuucauggcccagcccaaguacagaaaagagcccug

SEQ ID NO: 4148591 - RNA, 81 nt, Human
cagggcuuuauuaagaugcgaaugcugaucuucucuuaucuucuaugggccuucagcgucuggauuuuuaugggcuugcug

SEQ ID NO: 4148592 - RNA, 123 nt, Human
caggggacagauuaggagaauacagacaucauucggaguauugacaugugaagcuaagaguaauggaaucacuuucuucauacaauuuuuugacauauguacaaagcuacuauagguucccug

SEQ ID NO: 4148593 - RNA, 57 nt, Human
caggggagaaacuuaauaaauauugguugaguauuauuaaaauguguuucucuucug

SEQ ID NO: 4148594 - RNA, 130 nt, Human
caggggagagacccgccccucugccaccuggcccucggaguccagcugccacucaccaucccacugcaaagcacaggugggcagcagcgggccugccggggcgccagcaggaugguggccucuccagcug

SEQ ID NO: 4148595 - RNA, 77 nt, Human
caggggaucccuucagaaggaaggaagcauucuguucaagacacgggcagggguggccuuccuuugggggcuuaaug

SEQ ID NO: 4148596 - RNA, 66 nt, Human
caggggauggggguggaggagaggggcucucuuuugaugucccugagggucucucugaugucccug

SEQ ID NO: 4148597 - RNA, 76 nt, Human
caggggcaagagcaguguuuuacucagcugaugcuauuagcuggggcuuugaugaacugauuugcuuuugcuguug

SEQ ID NO: 4148598 - RNA, 71 nt, Human
caggggcacuaaugacauuguauccacagagcaaaauuugaauguucuguaaugaugucauuaaacuccug

SEQ ID NO: 4148599 - RNA, 57 nt, Human
caggggccuggcugucuaggaaggguucagaaggcacacccaagacucaggccccug

SEQ ID NO: 4148600 - RNA, 77 nt, Human
caggggcuaggcugcucugcgaagucagcugccuguguauuccugaaacaagcaccuccccgggagcagccuccuug

SEQ ID NO: 4148601 - RNA, 56 nt, Human
caggggcuccccacagagggaccugaaggcggcucugugcucgggggagcucucug

SEQ ID NO: 4148602 - RNA, 121 nt, Human
caggggcucuuggcuccuuguaaauucaguucuuccagaugguucuuuagcuccuguuuuggccccguggcuaaugaguucgagaucugcugaugagaaugggaguauuggagagccucug

SEQ ID NO: 4148603 - RNA, 65 nt, Human
caggggcugauggaacucaggccuccccgacucugagggagguccugcucuuucauuaacccaug

SEQ ID NO: 4148604 - RNA, 76 nt, Human
caggggcuuucucccucacaaagcauucucuucauggaaggaugaugaaguaaaucuuaugucagggagccaccug

SEQ ID NO: 4148605 - RNA, 76 nt, Human
cagggggugguccaggcugcgcuagaccugggguggaguugguguaucaggugcgguccuagguggccacugcuug

SEQ ID NO: 4148606 - RNA, 85 nt, Human
caggggugaagugcugcugaaaacuggaacucuugauaauuuuaugaccucaguucaauucaguuagauaaaguaaauacuucug

SEQ ID NO: 4148607 - RNA, 95 nt, Human
caggggugagcgcucagagcaggaaggggaugaugggcaugcgcaggggcggguagucccggaacuccuucagguagcugcggugcuugcccuug

SEQ ID NO: 4148608 - RNA, 90 nt, Human
caggguaaaaaguuggaagacaagaaaucaauuguuggcgaauaaugucaauguuaauuuacugucuucauuuuuuaaaucacuacuuug

SEQ ID NO: 4148609 - RNA, 77 nt, Human
caggguagaaggagucuccccuguuggccagguuuucaccagaaauacuguccaccauggagcaaggccuugcccug

SEQ ID NO: 4148610 - RNA, 83 nt, Human
caggguagagaugaacagacacccgcauggcuggcuggcugccucugaauccacccaccugcugguuuugcucuccugcugug

SEQ ID NO: 4148611 - RNA, 70 nt, Human
cagggucaaaaccuuggggccagucacacaaucuacucaggguaggaugacuggaacccaagugagcuug

SEQ ID NO: 4148612 - RNA, 58 nt, Human
cagggucaggaggaucuggcuucccauuggccgacacgacagaauccuucucgcuuug

SEQ ID NO: 4148613 - RNA, 81 nt, Human
caggguccgggcaggcgccucuuccaggcccgggauuaaugagucucuggacugggagauggcagaggcauguagacuuug

SEQ ID NO: 4148614 - RNA, 69 nt, Human
cagggucugggaggucacguccuacaggcaaggcuguuucaagggcugcuaccuuaaucaguuauucug

SEQ ID NO: 4148615 - RNA, 61 nt, Human
cagggucuggggggcaugggcaaccauaggaagggauguaaaugcacccucagggucccug

SEQ ID NO: 4148616 - RNA, 89 nt, Human
cagggucuugcucuguugcccaggcuggaaugcaguggcgccaucuuggcucacugcaaccucugccucccggguucaagcaagucuug

SEQ ID NO: 4148617 - RNA, 68 nt, Human
cagggugacugcccuggccacugccaggcgagggcucgggggaggguggcagaggugcaucagcccug

SEQ ID NO: 4148618 - RNA, 85 nt, Human
cagggugcugucucccucuccugaguacugugugaaucaguccucaugucccacucacacacucucagaggguggcagcaauuug

SEQ ID NO: 4148619 - RNA, 64 nt, Human
caggguggaguuuucagcccucugacauuaaaaggugaagcagaggacaugaaaacucgcucug

SEQ ID NO: 4148620 - RNA, 60 nt, Human
caggguuucaucaaugauuucuuauugugcaaagaaaaagagaugaaucuugagacucug

SEQ ID NO: 4148621 - RNA, 58 nt, Human
cagguaaaaauaaauuugugagagucacaguucuggcuagggaauuuucuuuugccug

SEQ ID NO: 4148622 - RNA, 66 nt, Human
cagguaacuuguaauuaauggcagcaauuaguuccucuggcuauuuguugcgggaauugcuauuug

SEQ ID NO: 4148623 - RNA, 60 nt, Human
cagguaacuuuagugaaagagcucugaucccucaguuuaucuauucauuacaguuauuug

SEQ ID NO: 4148624 - RNA, 83 nt, Human
cagguaaggggaauuggggcagagagauuauaauuaaccuagccauaguuuugggaaugucugugccuuaaaacuucuuaaug

SEQ ID NO: 4148625 - RNA, 69 nt, Human
cagccucugccauguuggaauuucaaacccaaaacagcugcuuggaaggagccagcaugccagaggcug

SEQ ID NO: 4148626 - RNA, 111 nt, Human
cagccucuggguaaauaggauaucuucauagacucaagaacagugaucuugaucaucuggcaagaauguucuuguagucaugaauauggcacuuccuucgcuguagggcug

SEQ ID NO: 4148627 - RNA, 60 nt, Human
cagccugacaccagcuuugggcuuuaaaucucauuuucccaacagagcugguagcagcug

SEQ ID NO: 4148628 - RNA, 76 nt, Human
cagccugcuucagggcuuucccuuguagaaauuuaguguaaaccuugaguuggggagaacagcucuggccaggcug

SEQ ID NO: 4148629 - RNA, 67 nt, Human
cagccuggccugggacugcugaagaugaaguauaggagaauuucugcugcauucucaguacaggcug

SEQ ID NO: 4148630 - RNA, 73 nt, Human
cagucaauuuuuugggucuuucaggcuaaggcagauugucuuguggucugauuccaccuaacugaauugacug

SEQ ID NO: 4148631 - RNA, 64 nt, Human
cagucacacucagaaugacuagagucugauaccaugaaagacauccaggagcugagucugacug

SEQ ID NO: 4148632 - RNA, 58 nt, Human
cagucacauggaugauggauagcguugggagcuguuuucucuaucuuccagguggcug

SEQ ID NO: 4148633 - RNA, 64 nt, Human
cagucagauguaaguuggaagcuggggcaaaaauauagggcaguuguugaugaagaucugacug

SEQ ID NO: 4148634 - RNA, 56 nt, Human
cagucagauuuaaagcuguuugaugcgcgugcauuaagaaagcucagagcugggug

SEQ ID NO: 4148635 - RNA, 60 nt, Human
cagucagugccaccagccacugccuuuugcuaaccucagaggcuggaaggggcacugcug

SEQ ID NO: 4148636 - RNA, 59 nt, Human
cagucauauuccucacuaggcuauuuuguugggggcaaaaugcucuggggauaagacug

SEQ ID NO: 4148637 - RNA, 83 nt, Human
cagucauggguucuuaguuucuguuucugauuaagccaguaaagcuccuuccucagagagacagaaacuaaacaccauggcug

SEQ ID NO: 4148638 - RNA, 57 nt, Human
cagucauuggcaagucuuucccugagguauuucaagaauugcuaauccaagugacug

SEQ ID NO: 4148639 - RNA, 80 nt, Human
cagucauuucguuuccuugccucgggguaccuugccuuucaagguugaagaguguccuuguaaaaauaauguuguggcug

SEQ ID NO: 4148640 - RNA, 61 nt, Human
cagucauuuuauuugaaaauuaggcgucuccucggcacccucauuuauugagaaaugacug

SEQ ID NO: 4148641 - RNA, 129 nt, Human
caguccaaaaagagguccugcaauuggccuguuuucuaucuccgucauaucauucauuccuugcagucacacaugaagacaauggagagcagaguacucugggcaugguggguccucaaaagauauuug

SEQ ID NO: 4148642 - RNA, 84 nt, Human
caguccacaccagauggcagcgugggagagggacaucagcucuagaccuucccucacuucuaguuauaagccuuugggggacug

SEQ ID NO: 4148643 - RNA, 67 nt, Human
caguccacagaguuguaaacauuuaccagugcaccacugcauguuuucuacuuuguacaaugggcug

SEQ ID NO: 4148644 - RNA, 130 nt, Human
caguccacugcuguccugcacgacccaugcuuggaucugcccugcugugccuggagccacuucuugaaguagcacagggcauaugcgguggccaggaucugagugugugagaagugauagcacaggacug

SEQ ID NO: 4148645 - RNA, 74 nt, Human
caguccucagcaccagaacuagggcacacugggccagguauuaggccuuaaguuguggguugaggagaauucug

SEQ ID NO: 4148646 - RNA, 57 nt, Human
caguccucucugaaaaacgacuaaggugguagcuuucuaacguagacagggagguug

SEQ ID NO: 4148647 - RNA, 63 nt, Human
caguccucucugugucugcacccuaugaccagugugggccaugccagcucagaguuaggacug

SEQ ID NO: 4148648 - RNA, 89 nt, Human
cagucuccauggcaacaaguaaagggggaagaaacauuuucuuaugaaugggaagccuuucccuuuugccuugcguggagugguggcug

SEQ ID NO: 4148649 - RNA, 68 nt, Human
cagucucuguuguggcccaaugcaaagcuuuaccuaacagaugcuuugaauaggguggcaacaaacug

SEQ ID NO: 4148650 - RNA, 81 nt, Human
cagucugacucuucuaggggcucauugucaacacuuaauaagugaaacagaagcuccuggaauauuugaaagagucaggug

SEQ ID NO: 4148651 - RNA, 129 nt, Human
cagucuggaauauucaugaccaguugcaacaagagcauuuuuccaguuggacaguagaaaagggacguaguacugucuuauuuugaaguguucacaaguuggauguuaacugugagucuguccuugaug

SEQ ID NO: 4148652 - RNA, 75 nt, Human
cagucuuaauugggagaaaguuguuuguuauuuuaguaaaaaucugccaugcugcaacuuucucccauuggacug

SEQ ID NO: 4148653 - RNA, 60 nt, Human
cagucuugcuuuacugagauggcuaauuuguuuagcaguuauuuugagaaugcaugacug

SEQ ID NO: 4148654 - RNA, 57 nt, Human
cagucuuguuacagagugucuuuucuggcaauuucaagaaggcaccagcaaggacug

SEQ ID NO: 4148655 - RNA, 99 nt, Human
cagugaaguaacuuaaauugugugugugugugcaugauucuagggccauaccuaauuuaugucuuaaguaugcuaauucuaaaguuauauuuucaacug

SEQ ID NO: 4148656 - RNA, 71 nt, Human
cagugaaucacugggcugcaucucauguuaaaugucucaggaggacagaggugcccagggcagguuuacug

SEQ ID NO: 4148657 - RNA, 93 nt, Human
cagugaauuuuucuucauuugucuguauaaggaaauuugguauuucaaguaugucacugaaugcagauacgugacaaagagaucuaacaacug

SEQ ID NO: 4148658 - RNA, 55 nt, Human
cagugacucacacaaacaugugugcucauguuucaugagagcugugagucugcug

SEQ ID NO: 4148659 - RNA, 58 nt, Human
cagugacucaugccuguaaucccagcacucugagaggcugaggcggguagaucaccug

SEQ ID NO: 4148660 - RNA, 57 nt, Human
cagugacugcuucaccaccagagccgccacccagugccuggacugggagcagcacug

SEQ ID NO: 4148661 - RNA, 69 nt, Human
cagugagccaguguuucugugccccaguguuccugagaguuagaacacagaaaacagagcaggcucuug

SEQ ID NO: 4148662 - RNA, 68 nt, Human
cagugaggagcccgaggcccugagagagaaccaggcugguccucuucagagggaccucgggaccacug

SEQ ID NO: 4148663 - RNA, 61 nt, Human
cagugaguccgcagcucucagcugagucgucaguggcucagaaaaugaaauggacucucug

SEQ ID NO: 4148664 - RNA, 91 nt, Human
cagugaguguaggucacaagggcuuuguaggcuuugcuggaggauccacuucagacagagguaggggcaagggguccugugaagacaccug

SEQ ID NO: 4148665 - RNA, 79 nt, Human
cagugaguucugcuacuuuugaaagucaucaaagccaacuucuccaggaugaaauauuucagagcagagugccuuccug

SEQ ID NO: 4148666 - RNA, 71 nt, Human
cagugauaauuauggccacuaaccauauugagcaauugagcaauugcaauguguuagaugguuuuacauug

SEQ ID NO: 4148667 - RNA, 81 nt, Human
cagugaucuacacaccaaaucacucugguuacucuggggagguagauuggaguaacaggguauuuguguggggggugucug

SEQ ID NO: 4148668 - RNA, 59 nt, Human
cagugauggauauggagaagucagcaggacuuccaaacuguuucguauuuaugcuacug

SEQ ID NO: 4148669 - RNA, 61 nt, Human
cagugauugugugaugaugaagauucauucauucauucauucauucagcacauauuuauug

SEQ ID NO: 4148670 - RNA, 98 nt, Human
cagugcacuuggcauuuucugucuuuguuggaauaauucacaaagugagcaacugagaggaauuccugggaaggcacagccagugugagggggcacug

SEQ ID NO: 4148671 - RNA, 124 nt, Human
cagugcaugcaaacugaauggcaggcucucuucugaagggguaauuagagcugcucccucacauggcacuggaggcacccuuagagaggccugcugccccucacgucaguagugcaugcagcug

SEQ ID NO: 4148672 - RNA, 68 nt, Human
cagugcauuugucaggaauugaaaaguuuuggagccaguucgaggacuuucuccugcacaaaguguug

SEQ ID NO: 4148673 - RNA, 117 nt, Human
cagugccaggugacucuggcuaagaugcucuagggcugaauuuuuuaaugccagcuuucccaggggaucaguaaagguuuugcccuggguauuccaaccaggagagccuguguccug

SEQ ID NO: 4148674 - RNA, 56 nt, Human
cagugcccaagaugugccaugcccaauuucaggagcuggagauagaauggccacug

SEQ ID NO: 4148675 - RNA, 58 nt, Human
cagugccugucuuauucuuacaagcugaccuaacaugcaacuggagaaucagguauug

SEQ ID NO: 4148676 - RNA, 81 nt, Human
cagugcgucgaagucacauggaguagggcagcugugcacuagaaaggcaaacugcugugcuccauugucuucacugcacug

SEQ ID NO: 4148677 - RNA, 67 nt, Human
cagugcugagugcuuuaccuagauaauguuauuucaaucucaugauaacuugguuaaguaggcacug

SEQ ID NO: 4148678 - RNA, 100 nt, Human
cagugcugcauggguugucacucauauucagucacugaugcagguugcacacagcccugagcccugugucuaauauggcugauacccauguauggcauug

SEQ ID NO: 4148679 - RNA, 63 nt, Human
cagugcugcauucucuggacagcuuucauaggcuguacgaacucagagagucacagugaacug

SEQ ID NO: 4148680 - RNA, 64 nt, Human
cagugcugguguaggcugaccaacuuguuuugguuuucccaggccguacccauuuuuagcacug

SEQ ID NO: 4148681 - RNA, 78 nt, Human
cagugcugguuucacccaaccgaugugcagaagccaaaauuuugauuuauauccuuugggugagauuuuugaguguug

SEQ ID NO: 4148682 - RNA, 86 nt, Human
cagugcuguaucugugauguuggcaaguuauucagccucucaaagccccugguuuggaauaaaaacaacucacagagacagggcug

SEQ ID NO: 4148683 - RNA, 61 nt, Human
caguggaaacuuuaagacaguccucaagagcuagcagcagucuuggggguagagaucacug

SEQ ID NO: 4148684 - RNA, 70 nt, Human
caguggaagagucuccagcaacuuauugacaauuucaagcccuguuaggggucucuaucuccuuucacug

SEQ ID NO: 4148685 - RNA, 80 nt, Human
caguggacucuggguugagauguaaugaccagagccaguguucaacgugggaaaguaccucucuaaacccagggacauug

SEQ ID NO: 4148686 - RNA, 58 nt, Human
caguggagaggugaggaaugcuugggcuuuuguccaucucuguuccugccuuucucug

SEQ ID NO: 4148687 - RNA, 84 nt, Human
caguggaucagagccaacuaggagauuaagguagaucuuaacaaagucgcuguuccugaaugccuggcuggcuuugcugcacug

SEQ ID NO: 4148688 - RNA, 67 nt, Human
caguggcauagcuaguauuucuuccauggcuagcugauuaauggcagacaaagcagcaugccuauug

SEQ ID NO: 4148689 - RNA, 58 nt, Human
caguggcucacaccuguaaucccagcacuuugggaggccgaggcagguggaucaccug

SEQ ID NO: 4148690 - RNA, 63 nt, Human
caguggcuucucaugucauucagaggaaaagccaaaggucuuaacagugacugagaggcccug

SEQ ID NO: 4148691 - RNA, 61 nt, Human
cagugggacuccagcucuucuccuugcccacggaggcaucucuggaaguuuggguccccug

SEQ ID NO: 4148692 - RNA, 55 nt, Human
cagugggcacagaucucugcaagacauuuccaggucagacuucugugccccucug

SEQ ID NO: 4148693 - RNA, 77 nt, Human
cagugggcaccaaagcagaggcuaagaugaguggguguuauugcauuuaacacucgcuaagagccugcuggccccug

SEQ ID NO: 4148694 - RNA, 56 nt, Human
cagugggcagagaucuggaucaaacugccaccccguagagucccuugggcccgcug

SEQ ID NO: 4148695 - RNA, 91 nt, Human
cagugggcauauaguauuaucucauugcaguuguuugaauguguaauucccaggcuaccagugaggucaaucuccuuuuauauguuuacug

SEQ ID NO: 4148696 - RNA, 56 nt, Human
cagugggcugugauggauucaccuuguugugucugucuccaaggcauggcccagug

SEQ ID NO: 4148697 - RNA, 79 nt, Human
caguggggauaacgaaggcugaugcgggauuaaaagcauaauguugaugguguugaguuaguucugguuauuccuucug

SEQ ID NO: 4148698 - RNA, 73 nt, Human
caguggguuagauggacuuccuggacuaaagcacagcuggaaaguaccagaugguccagagucuagccccaug

SEQ ID NO: 4148699 - RNA, 63 nt, Human
caguggguuaucugugggaacuuuggaaagggcuugagaauucuuacaaggcuggcccacuug

SEQ ID NO: 4148700 - RNA, 106 nt, Human
caucuaacauugcuuggaguguuuauuuuuaagugcauauuuuuguuguagagggaaagauuaugaucucuaccaauuuaaacuguacuuuccgagcauauggaug

SEQ ID NO: 4148701 - RNA, 79 nt, Human
caucuauauauggaagccuguauuuuggaacagacauaugaaaguguuucuuccaaaggcacguucuccugaaaagaug

SEQ ID NO: 4148702 - RNA, 70 nt, Human
caucuaucccuuaacaaaaguuuacuuagugccuucucuaugcuaggcacuguguuacauguugaagaug

SEQ ID NO: 4148703 - RNA, 70 nt, Human
caucucucuguucauugagucaaaacggaauauuuagugggcuccuuuuugguucugggauacagagaug

SEQ ID NO: 4148704 - RNA, 84 nt, Human
caucucugcuauacucagguguugucuaaagcuucagacuaauuuauugaauggacauggacaacugccucagcuucagacaug

SEQ ID NO: 4148705 - RNA, 66 nt, Human
caucucugcugcagaucauuuuacaccugcuuuuccucacuuuguuuuuggcucugcagccagaug

SEQ ID NO: 4148706 - RNA, 109 nt, Human
caucucuuuacuccauccauucauuugcccaguaagucacagguuuucuucuugaaucacugacucucacugguuaguugaguuuuaggaugauugaggaggagagaug

SEQ ID NO: 4148707 - RNA, 87 nt, Human
caucucuuugcaaaacuaggaaaaguugaagccuuguggaaagacugcuacauaacccauggcuuucagauuucuauguuggaggug

SEQ ID NO: 4148708 - RNA, 69 nt, Human
caucugaaauucuuccuccagcugucucgauagcgaugcuugacagacuggaggagaauaguuugaaug

SEQ ID NO: 4148709 - RNA, 80 nt, Human
caucugauuucuacugcagcugcucaacucugcugucguaaugggaaagcagccauagauagcaugcaaaagaaugggug

SEQ ID NO: 4148710 - RNA, 58 nt, Human
caucugcaaaggaugaauccuguuaacuuuuuggaaaacugguucucuuuugcuugug

SEQ ID NO: 4148711 - RNA, 56 nt, Human
caucugcagggccccacagccaugggcaucaggaccagggcucugccuugcugaug

SEQ ID NO: 4148712 - RNA, 93 nt, Human
caucugccacuuguuuggggagcuccuacucuaugccagacacugaaagugcucagggacaauggagaggggcauucuaagcugaggcaggug

SEQ ID NO: 4148713 - RNA, 56 nt, Human
caucugcccacucgggucucuggcaauacuaaccaggcuucacgaugggugaggug

SEQ ID NO: 4148714 - RNA, 71 nt, Human
caucuggucagcagaggggaaggcaucugucucuccaauggcuccugcagagccccccuucugaucacaug

SEQ ID NO: 4148715 - RNA, 78 nt, Human
caucuguauuucaccaggaaauucaguuuuaauaaucacuguguuacuacauaugcaguuugaauugaaaugcagaug

SEQ ID NO: 4148716 - RNA, 79 nt, Human
caucuguauuucuagaaugguagcacuauugcugaugaacuagaugguaccagugcugcacuucuggggaucacacuug

SEQ ID NO: 4148717 - RNA, 59 nt, Human
caucugucucauuucuguauuuccggugcccacguagggauuuacccaauggauagaug

SEQ ID NO: 4148718 - RNA, 81 nt, Human
caucugugauacuccuuauacuacuuugugguauguggauacuucuuauacaucauuuauggaauaaggugaucauacaug

SEQ ID NO: 4148719 - RNA, 56 nt, Human
caggggugggcugagguggggagggagccuccucucuggcagaggcccuaucccug

SEQ ID NO: 4148720 - RNA, 90 nt, Human
cagggguggggugggucgugggcccugcuccauucaguggugccucugccugccucggaacucggggucccugcccacccauacccucug

SEQ ID NO: 4148721 - RNA, 78 nt, Human
cagggucaaucagcuaaauaaacuagucauucagucaacuagcauugauuagauuuuagcaagauggaauugacuuug

SEQ ID NO: 4148722 - RNA, 58 nt, Human
cagggucacucugucugcuguguggagaacaguccgcaggaagacaaggguggaaaug

SEQ ID NO: 4148723 - RNA, 89 nt, Human
caggguccuggcuauaauucuccuguucaauaaauagaaaaaucuuuuuuacagacaacuuaauaggggauuuaguagugagggcuuug

SEQ ID NO: 4148724 - RNA, 55 nt, Human
caggguccuuugccaacacuuggauggcucacaguccaggcuggaaggggcguug

SEQ ID NO: 4148725 - RNA, 56 nt, Human
cagggucugugcaagaacacgccuuggugaucauggugucauuucuacaggccgug

SEQ ID NO: 4148726 - RNA, 62 nt, Human
cagggugcgccacucagauguaccucucccuugccaugggcuccacugagugugugcuccug

SEQ ID NO: 4148727 - RNA, 55 nt, Human
cagggugggcuuccagucacccgcacauaugcggggcacuggccgcccaucccug

SEQ ID NO: 4148728 - RNA, 99 nt, Human
caggguguugaugagaaggcauuucauggcagacuuuaacccuggacuggauucuggggaagguuacaagucuccaucuccuguucuuaucaaaacuug

SEQ ID NO: 4148729 - RNA, 84 nt, Human
caggguuaagccacaagcauccuggacaguuuccccuauuaccccacaaugauauugggccuccgggaugcuggccacaucuug

SEQ ID NO: 4148730 - RNA, 67 nt, Human
caggguuagcccagaaagcaaaugucucugaucagcagggcaaagggagccucuggagcugaguuug

SEQ ID NO: 4148731 - RNA, 74 nt, Human
caggguucucagguacaggagccauccucuccccagaguggcccaggacaggagccuguuaguugagugcucug

SEQ ID NO: 4148732 - RNA, 63 nt, Human
caggguucugcaucgccucgaacccgcaggccguggcggguucuccugaggaagcagggacug

SEQ ID NO: 4148733 - RNA, 76 nt, Human
caggguugauuccuucuggaggcucugagggugagucugcuccggaccccucuugcccagccuccaguggguccug

SEQ ID NO: 4148734 - RNA, 60 nt, Human
caggguugggcuccaaggauggaauggcaagcuggcaucccaccgauggucccaacacug

SEQ ID NO: 4148735 - RNA, 101 nt, Human
caggguuucaccguggugucaaucuccugaccuugugauccgcccgccuuggccucccaaagugcugggauuacaagcgugagccaccgcgccugaccuug

SEQ ID NO: 4148736 - RNA, 85 nt, Human
cagguaacuaaagcauuacuagacuggauuuuggaguuugaguagaaagauaacagaauuuagcuuguaugaaugcuuuuaugug

SEQ ID NO: 4148737 - RNA, 72 nt, Human
cagguaacuuauuguccacucugccauuccuaucauuccacacugaugggcuggugagggaucauuuauuug

SEQ ID NO: 4148738 - RNA, 64 nt, Human
cagguacauuuuuuuuccuccuuauuuugaggcagaagcuauuggaggaaaaaggaaugacuug

SEQ ID NO: 4148739 - RNA, 69 nt, Human
cagguagcgacagccagcuuugcugugguugaggagacucaugcaacggcucgcugagccgcaggccug

SEQ ID NO: 4148740 - RNA, 72 nt, Human
cagguaggagcaggcuggugggugucugauuuuauuguagcuaggcuaauucauuggcuugaacuccaccug

SEQ ID NO: 4148741 - RNA, 61 nt, Human
cagguagguuuuaggcuaaacagagaguuauacucuuccuuauuguuugggacucugccug

SEQ ID NO: 4148742 - RNA, 68 nt, Human
cagguaguuauuuccuacuauaaacaaaccuuugaaaucagacuuuuuugguggagagaagcuauuug

SEQ ID NO: 4148743 - RNA, 76 nt, Human
cagguaucucccacagaccaugaguggaagcgaugagugucccuucuuuuacaggucuuggguuaagaagcaacug

SEQ ID NO: 4148744 - RNA, 73 nt, Human
cagguauucaaugggcauuuguugaaccaacuaaugagaaaguauuuauucaacaaguauuuauugagcacug

SEQ ID NO: 4148745 - RNA, 90 nt, Human
cagguauuccaugguucauccauucuacaagguagcagggaagaauucugaaguuccuuuguuaucuguaaaugguuagugugagaccug

SEQ ID NO: 4148746 - RNA, 78 nt, Human
caggucacacaagaaguuaaugggcaaagucaagaaccuacauauuauggccauuucuuaaacucuucccugggccug

SEQ ID NO: 4148747 - RNA, 105 nt, Human
caggucacucaggggugacugaacuggagaugcucagggcuucagagggcaccccuccugcaagcuaccccuagcaucagcucagggccacccugagcuggccug

SEQ ID NO: 4148748 - RNA, 58 nt, Human
caggucagcuuggagcaucucugcagaacagggcagugccgagcuucaggcuaaccug

SEQ ID NO: 4148749 - RNA, 74 nt, Human
caggucauaagugcacaaaugcuguugcuagauacuuaucucuggcugacaaauaggugcaguucaaugaaaug

SEQ ID NO: 4148750 - RNA, 58 nt, Human
caggucaugaucugaaaguugucauggagcacuuuaagcaggaacaggucaugaucug

SEQ ID NO: 4148751 - RNA, 79 nt, Human
cagguccaguaagacguacuauugguuuauaccuuuuuacauaaauuguacuacaccauaguacugaguacaccaccug

SEQ ID NO: 4148752 - RNA, 117 nt, Human
caggucucuggcuucaucaggugcacucugagcugcagcagguggacacacucaccucccagagggugcaggugaggagguggcaccuggcuuagguuauucuggcucaagggccug

SEQ ID NO: 4148753 - RNA, 57 nt, Human
caggucugcagacagggccaugggguuuggucucugcccugcccuggggccggccug

SEQ ID NO: 4148754 - RNA, 67 nt, Human
caggucuuugauggugauccaguggcaggaggagcucagcuggaaugggaaucaggaaagagaccug

SEQ ID NO: 4148755 - RNA, 61 nt, Human
caggugaccugggauccgcugccaguacaaucccauccugagcagcugcccccagucccug

SEQ ID NO: 4148756 - RNA, 56 nt, Human
caggugauucuaauauguauccacggcugagaacucaugcacguuggaaucaccug

SEQ ID NO: 4148757 - RNA, 123 nt, Human
caggugauucucucuguuuccauguuauuuaucuuccucccuuccuauugaaggcgucauauggaguguugaaggcuggugguaaggaggaaaaaggaaugaacacugaaucaguaauaucug

SEQ ID NO: 4148758 - RNA, 116 nt, Human
caggugccugugagugcagcugggacccugcccuguggccuuuggauccugaagaaugugcuggaucaugaaccaggugcaggggagggugaaguccugcagcagaaaggcaugug

SEQ ID NO: 4148759 - RNA, 108 nt, Human
caggugccuucuccguguccuccugcacagagaugcagacuggcucaggcauggccugcccccaggagcucacugucuaaugggaagagacaugcaugaaagcagcug

SEQ ID NO: 4148760 - RNA, 73 nt, Human
cagguggccaugggcccugcuggaguccuggcaggaggcgccaucagugccaggcccagcagggcggccccug

SEQ ID NO: 4148761 - RNA, 86 nt, Human
cagguggcccagugugaaaggucauuuaucugaaaggaaacauuccugaagugacugaugagugugccuuucagcuggcauauuug

SEQ ID NO: 4148762 - RNA, 62 nt, Human
cagguggcccguacccagccucuuaacacccaugaacuagaggccagcuagcgggccaucug

SEQ ID NO: 4148763 - RNA, 71 nt, Human
caggugguaaauggcagauccacaguuugaagcccaauggcuuggcugggaacugugauucaaacuguuug

SEQ ID NO: 4148764 - RNA, 82 nt, Human
cagguggucaauuggagucacaggagaagaaugggcacgagguacaggccuguuuuccucaauggcuugcugggcucagcug

SEQ ID NO: 4148765 - RNA, 79 nt, Human
cagguguaagcagucuaggguguauaaggaagccucacacuuuuggggcucuucuggcaugcugcucugcuguucccug

SEQ ID NO: 4148766 - RNA, 60 nt, Human
cagguguacacauuguguuuauauuuguauguaaaucuauacgcauaauguuuauuccug

SEQ ID NO: 4148767 - RNA, 77 nt, Human
cagguguauuacuggccugcggaagacuuggaugucccagcaugguagaaggccaggucccugcagugcaacgcuug

SEQ ID NO: 4148768 - RNA, 60 nt, Human
caggugucaaaauacuaaguggcuauaagcacacgcaggagaguauuuuguaaaacccug

SEQ ID NO: 4148769 - RNA, 66 nt, Human
caggugucugaccuagccugcugucugcugggcucacuucaaagcaauagguuaggucaagaucug

SEQ ID NO: 4148770 - RNA, 87 nt, Human
cagguuauugcaauauuguaucagaauagcagcuucuagauggguuagagcuuguuguuacugaugcauuucucuguuaugggccug

SEQ ID NO: 4148771 - RNA, 58 nt, Human
cagguucaacagcuagcuguggacagagccagacuuugaaugcaggcuguugaaacug

SEQ ID NO: 4148772 - RNA, 55 nt, Human
cagguucagagagggacagaaagagagggaguuugaggucggcucucugagccug

SEQ ID NO: 4148773 - RNA, 64 nt, Human
cagguucucaggcucugagacccuaugggaaauugccuauagggccccacagccugggaaacug

SEQ ID NO: 4148774 - RNA, 60 nt, Human
cagguucuugaagccuucuggcaccugaagaauguuggaaugacuucuucaagaagccug

SEQ ID NO: 4148775 - RNA, 55 nt, Human
caggcagagucagauuagacuugauagauauucaagucucucuaauaaaugcuug

SEQ ID NO: 4148776 - RNA, 56 nt, Human
caggcagagugagguggucuaauuugaagguguuuacuuccaacugacucagcuug

SEQ ID NO: 4148777 - RNA, 66 nt, Human
caggcagcagcucagccgggcacugcagagagagagucugggcagcauccagcagagcugcaacug

SEQ ID NO: 4148778 - RNA, 56 nt, Human
caggcagcaggagcccugcucgcaucucccauuguagcuguggccuugcuggucug

SEQ ID NO: 4148779 - RNA, 58 nt, Human
caggcagcucugcuuuuccuaaauaucagaggacacuaggaauaugcagggucaccug

SEQ ID NO: 4148780 - RNA, 67 nt, Human
caucuuaauaugggauguuuggaaaaguuacuuaagcuuucuaaacuucaauucuaaauugcagaug

SEQ ID NO: 4148781 - RNA, 69 nt, Human
caucuuacccaucugguuuuugagucuggacaagcuccucuccagcuccucuacccgaugcguaucaug

SEQ ID NO: 4148782 - RNA, 57 nt, Human
caucuuaccccugcuaaugaccaaguauucucuggcaauuggggacuggguaaggug

SEQ ID NO: 4148783 - RNA, 106 nt, Human
caucuucacagaccugcccaaccuccuggguuggcaacugggauuuucuugguccuuccagggauggccuagacuagcuuggagauguaggggguccaggaagaug

SEQ ID NO: 4148784 - RNA, 84 nt, Human
caucuuccagugucacauggggcucccguacacaacuucccagcaaaccugggaugcaggagcccuugggcucuggugccaaug

SEQ ID NO: 4148785 - RNA, 69 nt, Human
caucuucuaguuccuucuuccaaacccaucaucucauaggugaggcagggaaggggagccaugagggug

SEQ ID NO: 4148786 - RNA, 130 nt, Human
caucuugaacuguguuauacaaaguaccuggagaaaaaggaagugggaguauuauuuuacuucaucuugguagacaauacauuuauucccuuuucauucagcagacauguuagguauaaacacuguugug

SEQ ID NO: 4148787 - RNA, 63 nt, Human
caucuugaagguuucuuuagcuuuucacaaagucuuagaaaacugagagacuaaaucaggaug

SEQ ID NO: 4148788 - RNA, 65 nt, Human
caucuuggagauguugaugugugguguccaaaacugaugcuccaaacagcaauucuuuaaagaug

SEQ ID NO: 4148789 - RNA, 60 nt, Human
caucuuuaacagaauggauuuggccaccuucagacaugcccuguuuauuuugauaagaug

SEQ ID NO: 4148790 - RNA, 72 nt, Human
caucuuuagaauuuaaugguacagaaaucauaguuagcuuagugauucugaaauauuagaaaaauggagaug

SEQ ID NO: 4148791 - RNA, 64 nt, Human
caucuuucucuugauccugcuuuccgaucuugauuggacugaagacagcgaggacagaggggug

SEQ ID NO: 4148792 - RNA, 85 nt, Human
caucuuugcccauuuuagcaauuggaaucuaguucaugaaguaaguguugaacagucuucaugcuagaauggcacuaaguagaug

SEQ ID NO: 4148793 - RNA, 85 nt, Human
caucuuuuugugugugugcaugcuuccguuucuggcugggguuuucccaguguugcaugaggcaguaccacagugcacagaggug

SEQ ID NO: 4148794 - RNA, 67 nt, Human
caucuuuuuucccacccuucuaggacaaacucaugcaaagugaggggagcuguggugaaaagaggug

SEQ ID NO: 4148795 - RNA, 59 nt, Human
caugaaaaggcuuuucuagugaaguuccggugauguuucagcuggagauccuuguugug

SEQ ID NO: 4148796 - RNA, 85 nt, Human
caugaaaaugggcuuuuccuguuucauagaaaacugaacaauuuauuucagucauugauggaguaggucaguguuuaucuucaug

SEQ ID NO: 4148797 - RNA, 129 nt, Human
caugaaacaagccccagggcaggaaggcuggcaucuuuccaccugaaugacuguuuaaguaaaagcagcacacgggagaaagacaggcuagucuguuuuccuuguaauugguguuggcuugaauauaug

SEQ ID NO: 4148798 - RNA, 90 nt, Human
caugaagcaaauaucuaugcaauaccuucugaaaauaauggaucaguaccuuauuuaauggaggucauuguuagaauuuugcauuuuaug

SEQ ID NO: 4148799 - RNA, 64 nt, Human
caugaagcacacuguguagagggcaugagagaugccgaauagcugcucacagaugugcucagug

SEQ ID NO: 4148800 - RNA, 56 nt, Human
caugaagcauguuuugucaugaggcaacucaguugacaaccucaugcuuugucaug

SEQ ID NO: 4148801 - RNA, 87 nt, Human
caugaauagaaugcuggcugccuuucaccucaucucauccauuaacugugaaaggugagagccagccuuauuuuucuaaauaucaug

SEQ ID NO: 4148802 - RNA, 129 nt, Human
caugaauagugaauaggaaaaugaugaaauuguugcugcuuuuuauagaggcuuagaaucauggaaaucauuugcuuuaagguauaaaagggaauaauuucauuuucuacuuuuuacuuuaaauuucug

SEQ ID NO: 4148803 - RNA, 55 nt, Human
caugaaugaguaauuuacaaagcccauuaaggcggcacagaauuacuuauuuaug

SEQ ID NO: 4148804 - RNA, 57 nt, Human
caugaauuauuuuucacaagaugaacaugguuuuaaucugugagaguauaauuuaug

SEQ ID NO: 4148805 - RNA, 63 nt, Human
caugacaagcaugugguaaaaagacccggguuccagucccaggucugccacguguuuguugug

SEQ ID NO: 4148806 - RNA, 55 nt, Human
caugacaucugcuuaguaugaauuugacguaagaccuuacuaggugagggucaug

SEQ ID NO: 4148807 - RNA, 76 nt, Human
caugaccacaugugcacugcuguauggccccagggcacugccaugccuuccaccccauugagcuagugcacacaug

SEQ ID NO: 4148808 - RNA, 66 nt, Human
caugacuacuuaguuugagagcauggaaacguucauauuuuaguucugugcuuuuuaagugugaug

SEQ ID NO: 4148809 - RNA, 80 nt, Human
caugacucauuagugaguugauuauauuuuaccauuguuguucauauuuugucgauguucuuauaccauugugggucaug

SEQ ID NO: 4148810 - RNA, 62 nt, Human
caugacugagaaguugugcguaauauguauacucacaucccauuggccaaaucuuagucaug

SEQ ID NO: 4148811 - RNA, 84 nt, Human
caugacuucuagauucuucuuuugagucucugagugagugguggugucaugaaaggagacgguuaagagggagugaggagcaug

SEQ ID NO: 4148812 - RNA, 62 nt, Human
caugacuuuuccuuuugaaugaaaaagauuuuauuuucuucuucucaugggauaaguacaug

SEQ ID NO: 4148813 - RNA, 60 nt, Human
caugagaagggguggaguuagaacacagguaaauauacucccagcccuuaggaacucaug

SEQ ID NO: 4148814 - RNA, 68 nt, Human
caugagauaauuuuucuccagucuucaucaugagaaucuugugugucuccuggaggaaaaaucucaug

SEQ ID NO: 4148815 - RNA, 67 nt, Human
caugagcauaauuagaauccaagugaccugugaguucauuccaguccugguucugauucugacagug

SEQ ID NO: 4148816 - RNA, 77 nt, Human
caugagcuaaagcuuuacuugcuuuguuacaaaacuuuauuaaaguuuuaaguuaauauaauugaggcugugucaug

SEQ ID NO: 4148817 - RNA, 57 nt, Human
caugagcucuucucuuggauccaggauucaaacauccaucuugggacagggcacaug

SEQ ID NO: 4148818 - RNA, 88 nt, Human
caugaggcauuuuuggaaaguguacaaauuugaauaaggacuggauauuacguauuauaaaauuguucauuuuccuaaggugacaaug

SEQ ID NO: 4148819 - RNA, 69 nt, Human
caugaggugugggaggagcuacauaaguuggaucuaacuuuccaaauaaguaaugucuuccuuuucaug

SEQ ID NO: 4148820 - RNA, 88 nt, Human
caugagucaagguaaauaaaaguucccugguuagaaaagggcaccaaaaaagccuuugaaaaguaguucaacuugacuuugacuuaug

SEQ ID NO: 4148821 - RNA, 67 nt, Human
caugagugccuucuaggugcuguggauauaguacugacuaaagucagacacaguacuugcccucaug

SEQ ID NO: 4148822 - RNA, 62 nt, Human
caugagugugccagucugauauggugagauaagccugggacagaugugcugccgcauucgug

SEQ ID NO: 4148823 - RNA, 94 nt, Human
caugaucucagcccucaaaaaccuugagccucugccuggcagucccagacaaaggcaucggcaauuagggagcauugaugagggcaagagcaug

SEQ ID NO: 4148824 - RNA, 55 nt, Human
caugaucugguccuacugugggcagcgcugcugcccagagccugagaggauuaug

SEQ ID NO: 4148825 - RNA, 82 nt, Human
caugaugcuguguuacugagauccggccccuggaggaguuuucuuuuacaauuuccccuaugccauuucacacagacauuug

SEQ ID NO: 4148826 - RNA, 60 nt, Human
caugauggcucaugcuuguaaucccagcaauuugggaggccgaggcaggcagaucacaug

SEQ ID NO: 4148827 - RNA, 57 nt, Human
caugauguaguuguugguagauagagguuuguucucugaccauuugacaacauccug

SEQ ID NO: 4148828 - RNA, 55 nt, Human
caugauuauguguuagaguuuggucagaguuuaccuaauucacagcauaauuaug

SEQ ID NO: 4148829 - RNA, 72 nt, Human
caugauugagcuuggaagcagauccucacccagugaagcuuggagaugacugcauucccggcagauucccug

SEQ ID NO: 4148830 - RNA, 82 nt, Human
caugauuuuauuuuucagugcacuuuuucuggaaaacaauuuugcaaggugcaagguauucagaugaagugcugaaaucuug

SEQ ID NO: 4148831 - RNA, 82 nt, Human
caugcacagugauaucugaagaauuauugcuuccuuuccaauaucauuccacaagcauuauugagaugauccugcaugcaug

SEQ ID NO: 4148832 - RNA, 62 nt, Human
caugcagaugucaugaggcaugucuggcaggucacugcuuuugugucuaaucugauugcaug

SEQ ID NO: 4148833 - RNA, 80 nt, Human
caugcagcuacgcuccacuugaguaggccugaucucuuauccugccucuucagcucagcuggaccaucguguuuugcaug

SEQ ID NO: 4148834 - RNA, 55 nt, Human
caugcaguugaagcacagagaggggauccuagccuuucuguuauaaaauuccaug

SEQ ID NO: 4148835 - RNA, 57 nt, Human
caugcauauaaggcacauguauuuccauaagugugagugugugugugugugugugug

SEQ ID NO: 4148836 - RNA, 60 nt, Human
caugcaucgaugaaugcguggguggauucauagguggccacauggguggauggaugcaug

SEQ ID NO: 4148837 - RNA, 61 nt, Human
caugcauguuuacuacagugacguagaaugauuuuucuaggagcuguauuaaagauacaug

SEQ ID NO: 4148838 - RNA, 61 nt, Human
caugcauuaugcauuugugaucugggcucaaacugcagcugccaguguggcaugaugcaug

SEQ ID NO: 4148839 - RNA, 116 nt, Human
caugccacauuucuuuugaugaugucauauuuuugcaggguuggauuuuuacuaguugugauacagaucaagcacugugcaaaaaucaguguggaacaggaaaggaggguggcaug

SEQ ID NO: 4148840 - RNA, 105 nt, Human
caugccagcugcuguggguguguggggccuucggguccugugggauggcgagugugugugcugagcaggaccuguagggccugcaucccaggugagugggccaug

SEQ ID NO: 4148841 - RNA, 57 nt, Human
caugccauucccugauccuaaccuuccuuaaggaaguucaaguaggagaguggcaug

SEQ ID NO: 4148842 - RNA, 73 nt, Human
caugccguaucaggaaaucuccagucaggccgcguuguuuauuuagccugcugaggccucuugguauggugug

SEQ ID NO: 4148843 - RNA, 62 nt, Human
caugccucuguuuuaguuguugacugggguugaacaggaaggcagcuuucaauaggguuaug

SEQ ID NO: 4148844 - RNA, 94 nt, Human
caugccugguuuagaagauuuuggggacuugcccucagcuuuauugcucuuggggcuccuguagaucucuaaagcaccucaagcccaggcuaug

SEQ ID NO: 4148845 - RNA, 78 nt, Human
caugcuagcgcucaucugccgccugccggacgguccccuucgcucgucuggaaggaggagauggagccgaugcucgug

SEQ ID NO: 4148846 - RNA, 121 nt, Human
caugcucaguuucuuuccauggauaaacaaaauguagaugagauauuuuuuguuagcuugaauagaggaauuuauuucauauacauacugccugucuguacaguugauugaaaauagcaug

SEQ ID NO: 4148847 - RNA, 57 nt, Human
caugcucuagauucucucuaauccuacucagucagaguuuggggaaguuugggcaug

SEQ ID NO: 4148848 - RNA, 129 nt, Human
caugcucuuuucuuauccuuuuacuucuuuggcuugacaaaaauaacacagcauaaaaugcaccuagcauuaugauguuuguucuuguuccucuucugauaaggacuaaauguauaauuaaggaaaaug

SEQ ID NO: 4148849 - RNA, 60 nt, Human
caguaaugugcucugcauccagucugugucugucugccggugcagagcugacauuaccug

SEQ ID NO: 4148850 - RNA, 56 nt, Human
caggcuuaaaagcagauuuugagucauaaauauuaaacucugccauuuuuggccug

SEQ ID NO: 4148851 - RNA, 112 nt, Human
caggcuugguuccuucugaggacuaugagggaaggaucuguuucaggccccuuuccuuggccuguacauggccaucuuuaccuucauggucuugucccuaugugcaugccug

SEQ ID NO: 4148852 - RNA, 87 nt, Human
caggcuuguuaaauagguaaauuguguguugcuaggggaugguguacggauuauuuugucacccagguaauagcaguuuggagccug

SEQ ID NO: 4148853 - RNA, 76 nt, Human
caggcuuuacuauuuggucuuggauuauuucuggaaauauugagagguucagaauuuuaaaccaaggaaaagccug

SEQ ID NO: 4148854 - RNA, 80 nt, Human
caggcuuuccacagcuguccuguaacaggugugucaacuggggauuuuccuguugccccaggacugcugccaagacccug

SEQ ID NO: 4148855 - RNA, 71 nt, Human
caggcuuuguaccuggggucuuaacuagacuuuaugagaauuaagcaauaagaucuuagaugcaaaaacug

SEQ ID NO: 4148856 - RNA, 88 nt, Human
caggcuuuuuuaugaccacagaggaauuugaagaggcaggaacacaacugaaaaaaaaucucuucccuuuaugguaugugaaggugug

SEQ ID NO: 4148857 - RNA, 65 nt, Human
cagggaaagucacuuccuucugucagccuccuccaugaaaucgaggugaccuaguugacccccug

SEQ ID NO: 4148858 - RNA, 87 nt, Human
cagggaagaaguagcaugauuauuauacuguggaucuuugucaacucccuguuuucaaggcuaauccacaguauauguguuucccug

SEQ ID NO: 4148859 - RNA, 129 nt, Human
cagggaagaauaaguggcugucauagaagaggacuucugagcugcuuuaaaacuuuucaauauauuaccguuugaugcagcacauaguagucuaccacuuguaugcuauauuuacuugagauuuaccug

SEQ ID NO: 4148860 - RNA, 94 nt, Human
cagggaaggaucguuggagacagagcuuugggggucuuguacaagaugauauuuaaguuccuuuucaacaacuuuaugauccuauaauucucug

SEQ ID NO: 4148861 - RNA, 56 nt, Human
cagggaauacuaugacacacaggugauucacuggagcaucucuugguauuccucug

SEQ ID NO: 4148862 - RNA, 72 nt, Human
cagggaaugcuaaauccagaagcagucaauaaauuuauuuuauuucugauuuuguuugugaauugguaccug

SEQ ID NO: 4148863 - RNA, 59 nt, Human
cagggacagauccagggacacaacugggauaaccgguauuccugguaagccugucacug

SEQ ID NO: 4148864 - RNA, 62 nt, Human
cagggacagcacuaaacucuuguugugauauagguguuagaugauaagggaggccgucucug

SEQ ID NO: 4148865 - RNA, 84 nt, Human
caucaagccuacaggugaguggcagugggaugcuaucaggccauugugugucuuucgcaccuacugcccuugugggaguugaug

SEQ ID NO: 4148866 - RNA, 58 nt, Human
caucaagcugugcuacuggguaagcagaagguggaaggccccaggagcaguauugaug

SEQ ID NO: 4148867 - RNA, 77 nt, Human
caucaaggucaagcuggaggcugagaucaccaccuaccaccgccugcuggaagauggugaggacuucaaucuuggug

SEQ ID NO: 4148868 - RNA, 111 nt, Human
caucaauaccguuuuaauaugaaccuguaaaucacauuuaguggcuauagaaaaaccuuuuggcacagcaacaugugguaguguagguaaacauuagcugaagguaauaug

SEQ ID NO: 4148869 - RNA, 78 nt, Human
caucacagaccugaacugcugaaugcuauuccucauggaaacugaggcauggacauuucggcagcucccccuuggaug

SEQ ID NO: 4148870 - RNA, 97 nt, Human
caucaccacauucuaggugcuuaucuucaacuugaucauuugaauauuaguauauccguaaaugguugguuaaggcauguguguguauguggugaug

SEQ ID NO: 4148871 - RNA, 62 nt, Human
caucacugcuucuaaaaugguguuauaucuuaggauuuucauuuguuuuuaggaguagggug

SEQ ID NO: 4148872 - RNA, 76 nt, Human
caucacuuggcucauaucccggccaucauuaggaggaauuccccgaaaugaugcugacguuuuaguugacauggug

SEQ ID NO: 4148873 - RNA, 130 nt, Human
caucagaaucaccuggagaacuuguuaaaaccauggauggcugggccucauccucagaguuucugacucuagaagucugggguggggcccaagaaaugugaauuuuuaacaagcccccaggggaugccag

SEQ ID NO: 4148874 - RNA, 83 nt, Human
caucagagcugaaaauauacuaggauuuuauuuuccaugagaaaauaguucuuuaugagaaaaagauuguaacagcuuuaaug

SEQ ID NO: 4148875 - RNA, 55 nt, Human
caucagcagucacaugaugcugucuguccagauagucaugauguuaacucugaug

SEQ ID NO: 4148876 - RNA, 75 nt, Human
caucaggcagagagggcugagcuagaacaaaaugcaauucucuucguuccuguccagagcucuuucugcuugcug

SEQ ID NO: 4148877 - RNA, 78 nt, Human
caucaggcccugaucccaauguauuuuaaucaccuuaaggaaaagaacugcaugggauuaaucucugggucaauggug

SEQ ID NO: 4148878 - RNA, 62 nt, Human
caucaggcugggaacacagaucaggauuucaaaugcccccuucucuguggccuucccugaug

SEQ ID NO: 4148879 - RNA, 88 nt, Human
caucaggguuguuuccaucugagagcugugaagaagcuguuccaugccucucuccuaauuucaggugcuuugcugaaaauccuuggug

SEQ ID NO: 4148880 - RNA, 58 nt, Human
caucagucugaaagccagggaguuggucugagugacaaggaauugguuucagaugaug

SEQ ID NO: 4148881 - RNA, 69 nt, Human
caucagugcggcaucugucauccugcuaggcccaaauuguuuucuaugauggaugucacagucuguaug

SEQ ID NO: 4148882 - RNA, 78 nt, Human
caucaguguggucagugugacauuuuuuaaguuauuugcauuuaaucuuagaacauuucauaauguuaccacuugaug

SEQ ID NO: 4148883 - RNA, 69 nt, Human
caucaguguugucauguuguugcacauugcaggguuuccuuuuguaaggcuaaauaauauuccacugug

SEQ ID NO: 4148884 - RNA, 77 nt, Human
caucauaccucccacccccuccgggaagggaaauuacauuuccccauuuuagcaagggguggcgagagggaagaaug

SEQ ID NO: 4148885 - RNA, 79 nt, Human
caucauagugugacccauggcaagggcaguaauaaccaccaaaaucuccugcauuugcaauggguacacaaccaagaug

SEQ ID NO: 4148886 - RNA, 89 nt, Human
caucauauucuucugacaauagccaugccauuuuguguucccagggccaaggagaagacagaaaccuguuuggcuugaggaauguuaug

SEQ ID NO: 4148887 - RNA, 61 nt, Human
caucaucucucccccaggccugggccacacugcccuguccuguggugacagguacaagaug

SEQ ID NO: 4148888 - RNA, 56 nt, Human
caucauuccacauguaccacuagcaguugcccccuuugcuagugugugguguggug

SEQ ID NO: 4148889 - RNA, 62 nt, Human
cauccacagcccuugaugauaauuuauccauguuaggcagggugacgaggccccugugauug

SEQ ID NO: 4148890 - RNA, 70 nt, Human
cauccaugugugaaucccagaaccugugacuguuaccuuacauggcaaaagggacuuuacagcagaggug

SEQ ID NO: 4148891 - RNA, 68 nt, Human
cauccauuuccuccacuauaaaggggaauuuuaauuccuacccgacucgguaguaggggaauugggug

SEQ ID NO: 4148892 - RNA, 74 nt, Human
caucccauagaaagaggcagggguugcaauugaaaacacacugacagauuaaaccccaguucucuuacuggaug

SEQ ID NO: 4148893 - RNA, 93 nt, Human
caucccccuggcucaccgugcuccaggcagaugggccggcuucagagcuuuugugcugaaggccccuuugccuggaacgucuuugccuggaug

SEQ ID NO: 4148894 - RNA, 72 nt, Human
cauccgcagagcucacacaagauagcugugccugcgugugcccauaugcaucugugugcgugucugcgugug

SEQ ID NO: 4148895 - RNA, 58 nt, Human
cauccgguucguggucaccuuguggaacucauuggccacgagguucacgcgcuggaug

SEQ ID NO: 4148896 - RNA, 127 nt, Human
cauccgucaccauaaccagccuacagagagcagcuggcacagaccucuucaggaugcgggggucuccucacuucuccaugccucgggaagagucugugggagcucucugugaauguagugaugugug

SEQ ID NO: 4148897 - RNA, 77 nt, Human
cauccuacagccacacgccauuuaagcgaacucauuugagaauguuucaggcuugcaugauuggaguggguggggug

SEQ ID NO: 4148898 - RNA, 65 nt, Human
cauccuucccaaggacagggcaucuaaccagagaacagaaggagauggcccaguggggcagggug

SEQ ID NO: 4148899 - RNA, 57 nt, Human
cauccuucuugccuucacccuucccugaccacacagccaggguggcaaaggagggug

SEQ ID NO: 4148900 - RNA, 83 nt, Human
cauccuugcuucuucuuguuccaugaaagacagaccugaagcuagauuucacaucaugggauggaagcugcuuauugaggaug

SEQ ID NO: 4148901 - RNA, 76 nt, Human
cauccuuguuugucauaacucugcugcaaguuauuuuggucucugugacuuguggcggcaccaugauuaggguuug

SEQ ID NO: 4148902 - RNA, 79 nt, Human
cauccuuuauuacucuauggcauacuugaaaauuucuuaauuuauugugguguccugucagcuagagugaaggaggaug

SEQ ID NO: 4148903 - RNA, 66 nt, Human
caucgagaagugacuuucuuauggccacacaacuugacgguggucagagcugcacauucuaugaug

SEQ ID NO: 4148904 - RNA, 65 nt, Human
caucggcagggauuuguuuaagacgagaaggcuguuggccuacgugcaaggucccugccccugug

SEQ ID NO: 4148905 - RNA, 99 nt, Human
caucgggagaagcugugugaaugcaggguaaguguuaacagaagugggacagaauuucugaagauucgccuuuguuuauccaguccccucugccugaug

SEQ ID NO: 4148906 - RNA, 62 nt, Human
caucuauauucuggaauguccauuuacuuuaauguaguguaguggaauuuagaguauaauug

SEQ ID NO: 4148907 - RNA, 130 nt, Human
caucuaugaaguacauugugaaaacuucauuauugaaccuuguuuuuugggagaaggaagcugagauucagagaaacugagguuuagagaaaccaagugauuugccccugaacuacauggcuauuaaaug

SEQ ID NO: 4148908 - RNA, 62 nt, Human
caucuauugagcuguuuuucugguaguaugcuaggcugcuaugcuaggaggauacugagaug

SEQ ID NO: 4148909 - RNA, 118 nt, Human
caucucaauagcuaccauuguuuccucugcccacuaggagcucauuguggauggaugggccuuccuccaggguccauaaugaacucugggcagguggagguaaaauaagcccuggaug

SEQ ID NO: 4148910 - RNA, 71 nt, Human
caucucacuuucaauugcaauauuccagcagcucaauggccacauagggcuucuggcuacuguaugagaug

SEQ ID NO: 4148911 - RNA, 58 nt, Human
caucucggcuaggcuauggugcccucuuguuugguuaaacacuagucuagaugggaug

SEQ ID NO: 4148912 - RNA, 83 nt, Human
caucucuagugcaugcugccaccugugguagucuguaguuacugucagucaccaccagguggcaguauuguugaauagaaaug

SEQ ID NO: 4148913 - RNA, 128 nt, Human
caucucuauaauaaaaaggaaaaagaggaauccccuuuguagguuucauaguuuauacugauauuucugaugucgucucagagaauuagucacaauuauaggaacucagaaggcauuccguggagaug

SEQ ID NO: 4148914 - RNA, 68 nt, Human
caucucugguucagucucuguggaaugauaccuggauauuaggaauugcaggaugauuggacacgaug

SEQ ID NO: 4148915 - RNA, 78 nt, Human
caucucugugcuuuuuauuauuuuugguaggcugugggaaacuguucuacaauaugaauaaugaagagcugugaaaug

SEQ ID NO: 4148916 - RNA, 55 nt, Human
caucucuguguccccacacccagccugacacauggagccugggauacaauagaug

SEQ ID NO: 4148917 - RNA, 92 nt, Human
caucucuuccccagcgcccaggggcagggcucucuggccuggcuugugcugguucccagagucccugcugucaggugcugggaguggaggug

SEQ ID NO: 4148918 - RNA, 86 nt, Human
caucugacauauugcuuauuucuucuuuuguuuguuuccucccacuagaauacaaggaccaugaggcagacccuuugugucauuug

SEQ ID NO: 4148919 - RNA, 58 nt, Human
caucugaugcuuugauuugguuucucuagaagcacauucugagacagggauucaggug

SEQ ID NO: 4148920 - RNA, 70 nt, Human
caucugcaagagccccauuuccauauaaggucagauucugagguacaggagguuggggcuacagcauaug

SEQ ID NO: 4148921 - RNA, 63 nt, Human
caucugcucuuucaggagccagaguucaaccucuaaagcucugagugauuaaggagcuucaug

SEQ ID NO: 4148922 - RNA, 55 nt, Human
caguuauuuugaggauuaaaugagauaucauuuauauuguccugaaguguaauug

SEQ ID NO: 4148923 - RNA, 66 nt, Human
caguucaaaguuaagcagcaguugcacaacuuccagcaacuuucucagccggcuacuaaugagcug

SEQ ID NO: 4148924 - RNA, 87 nt, Human
cagggacaggcuuuacuuucucucugaaugagaauguagccuugcugauauuacauugguuucagagaaaggaaagccggauauuug

SEQ ID NO: 4148925 - RNA, 55 nt, Human
cagggacauugguggccagguuguuguccacggaaccucucccuuugugucccug

SEQ ID NO: 4148926 - RNA, 97 nt, Human
cagggaccaauaauagaaucauuucuacucauccuuuggagaagagccauuucuccuuucugcaaacuaagagugggucuuuuguuuguuggccuug

SEQ ID NO: 4148927 - RNA, 99 nt, Human
cagggaccugagcuuggggcuggaugugagaugagugcugcguaucuuggauauaauccauaaccuggugucauuuuagccucaggcaagugcucccug

SEQ ID NO: 4148928 - RNA, 62 nt, Human
cagggagaggcugguggaguaagguccagcgguauucggggguccucugucaccucgcccug

SEQ ID NO: 4148929 - RNA, 60 nt, Human
cagggagcagugugcuaacuaugugacaugugacuuuagccugcagguacauugcuacug

SEQ ID NO: 4148930 - RNA, 55 nt, Human
cagggaggucugagugcggaaagccuggaccacaggaaugugccuagccucccug

SEQ ID NO: 4148931 - RNA, 59 nt, Human
cagggaguggggaauaguguggugucucuugaaugccgccugguuucuccgccccccug

SEQ ID NO: 4148932 - RNA, 62 nt, Human
cagggauggccuggcgggccacagugagccuucugcucaagagccacuagugucugucccug

SEQ ID NO: 4148933 - RNA, 55 nt, Human
cagggauugugcuugcaaucgcagagugguugcaaaugggcaaagcagaucccug

SEQ ID NO: 4148934 - RNA, 79 nt, Human
cagggcaagugcuucugaugguggaaugcuucagcccaggaggccaagcagaaccauucaggcacauuucuagucucug

SEQ ID NO: 4148935 - RNA, 76 nt, Human
cagggcaccgucucccucagagcuccagucccgagagcugacagcagccugggcucuaagggagcaccgucuccug

SEQ ID NO: 4148936 - RNA, 71 nt, Human
cagggcagagcugccucucacugggucugggucagccaagagccaccauuuguggaaugcacucugugcug

SEQ ID NO: 4148937 - RNA, 75 nt, Human
cagggcaggaauuugacauugcgaaagggaaaaauaaagaaaugagcuuugggcauguacaguuuuucuguccug

SEQ ID NO: 4148938 - RNA, 56 nt, Human
cagggccggugucccuccugcagaaagcucacccugucuccugggcccuggcccug

SEQ ID NO: 4148939 - RNA, 59 nt, Human
cagggccucuccuccaggaacugcgucugaacauaccagagccugcaguggagaccuug

SEQ ID NO: 4148940 - RNA, 97 nt, Human
cagggccuggugcucucugaagcaccuggacggugccuggggacuuacggagcccagggcuggaccagugcuugggaggccagagcaugggguccug

SEQ ID NO: 4148941 - RNA, 64 nt, Human
cagggcuccaugcagggacuccccgaccccagaagcugggaaggaaacaccucauggaguccug

SEQ ID NO: 4148942 - RNA, 61 nt, Human
cagggcucugaccagaaucuggacucugauuguggugcaauuuucugaaucuggugcccug

SEQ ID NO: 4148943 - RNA, 62 nt, Human
cagggcuggauuucauuucuagcuuaauuaaauccuagaagcacaccugaccucuagcuuug

SEQ ID NO: 4148944 - RNA, 55 nt, Human
cagggcuggcuguggcaaucucucaucuccagguuaccacuuguugccagcucug

SEQ ID NO: 4148945 - RNA, 63 nt, Human
cagggcuggcuuccaaguuguucugaaaaugguuuaagagagcagggaaaggagucagcugug

SEQ ID NO: 4148946 - RNA, 64 nt, Human
cagggcuuaaugucauauuaguuugugccuccaggaaggagguggaaagauggcugggacccug

SEQ ID NO: 4148947 - RNA, 74 nt, Human
cagggcuuaggaaagccuugcccgucacugggaccagcaacaccgcuuucccacucugcagggcuuuggcuuug

SEQ ID NO: 4148948 - RNA, 62 nt, Human
cagggcuugccuugccccggcgcucgucgcuucccugggcgccgggcgguuugcaagcccug

SEQ ID NO: 4148949 - RNA, 63 nt, Human
caggggaaugagugcccagaaagcccuggcugguccuggggcugagcugccacucaccuccug

SEQ ID NO: 4148950 - RNA, 62 nt, Human
caggggacauuaaagcuccauacccaauauucucugaguagggaaaguaguaauggccuuug

SEQ ID NO: 4148951 - RNA, 66 nt, Human
caggggaucugccugcuuucuuacauguuuguuucuauggacagauagaaaucagcauguccucug

SEQ ID NO: 4148952 - RNA, 61 nt, Human
cagggggcagggcugggccucggggucagccaacuggagucuggcuuggcgcugcccucug

SEQ ID NO: 4148953 - RNA, 76 nt, Human
cagggggcugaugcaguggcuucagugucagugacuaaccaguggcccuggagugacucguaaggcagguacccug

SEQ ID NO: 4148954 - RNA, 74 nt, Human
cagggguacugucaguaguuuuaagucuguuaaaugagauuucccagaacagauccuggcucccaguaccugug

SEQ ID NO: 4148955 - RNA, 59 nt, Human
caggggucuccauuccagcaggcacugaugaaaagccuccaggagugauaaggccacug

SEQ ID NO: 4148956 - RNA, 81 nt, Human
caggggugcagcaccacaccuggcuaauuuuuugcagagcugagguuucacuauguuggcuaggcuggucucgaacuccug

SEQ ID NO: 4148957 - RNA, 64 nt, Human
cagggguggcaggaccagggaaaagcaaagucguuucauccaaggagaccuugcagagccucug

SEQ ID NO: 4148958 - RNA, 55 nt, Human
cagggguguugggccagggccagggaaguccaucuggcagcacccacacccucug

SEQ ID NO: 4148959 - RNA, 58 nt, Human
caggguagacaguaggugucuguguccagggcucacccuauaccucugugaaccccug

SEQ ID NO: 4148960 - RNA, 57 nt, Human
cagggucaggcugcuagaagcugagcuuuugcagcuugguuuuuaguuucugaacug

SEQ ID NO: 4148961 - RNA, 62 nt, Human
cagggucugcuacacuuggcaaggguuaagauuagaauuagagucaggauuaguaaacucug

SEQ ID NO: 4148962 - RNA, 79 nt, Human
cagggucugcugguguaucuguaccacugcugggacuuugguaguucaguguugugcacauacaaaauguaugccucug

SEQ ID NO: 4148963 - RNA, 76 nt, Human
cagggucugguugagggcugggguggugacggcgugauugugccuggcuaccggguucucagccaggcagcaccug

SEQ ID NO: 4148964 - RNA, 73 nt, Human
cagggugcagcccagguggaguaaucuaugggaagcgugggugaggauucugccugggccucgcuuagcccug

SEQ ID NO: 4148965 - RNA, 55 nt, Human
caggguggcaggcaccauggccuauaccaggggcuacagcaugccugccacccug

SEQ ID NO: 4148966 - RNA, 57 nt, Human
caggguggccagguagauaauaguuccaucccuguuauugcuuucccugccuuccug

SEQ ID NO: 4148967 - RNA, 92 nt, Human
cagggugguagaauguaaagaauagagguuuuagaauuagauacauuuuagcuggaauccuacuucuaacacuugcuagguuugcuacccug

SEQ ID NO: 4148968 - RNA, 59 nt, Human
caggguggugguaguuguuuuaauaugugaaaauguagcuuuuaaacaucacuauuuug

SEQ ID NO: 4148969 - RNA, 78 nt, Human
cagggugguuccaccuggcgagggguaugccuccugacuguccaggacaaugccccuggccuggggaacauagcccug

SEQ ID NO: 4148970 - RNA, 75 nt, Human
caggguucugguccagaguccuugcuagagacuggucuucuauccuguuuccucauggcacugggcuggccccug

SEQ ID NO: 4148971 - RNA, 79 nt, Human
caggguugggauuggaacuggggcuuuugcacgugggaggcaugcccugucccccacccaugcccugucccccacccug

SEQ ID NO: 4148972 - RNA, 98 nt, Human
caggguuugcuugguaggcacuguguuuguaggaguacagucuuaacugcuguaacaaaggggcuccaaaguacagugacuuaccaagagagaaguug

SEQ ID NO: 4148973 - RNA, 85 nt, Human
cagguaaaauauuggguagguccuuuggaguucuagacucaguuugagauuacagaagauaugcucaacauccuccuuugaccug

SEQ ID NO: 4148974 - RNA, 87 nt, Human
cagguagaggcugggcugugacaacaaugucagaagcuaucuauugagggcuucuugugugucaggcucugagccaaacacugccug

SEQ ID NO: 4148975 - RNA, 67 nt, Human
cagguagggauaugauggugauccaauaucuauuggucuucuuguccauccauuuugucccuuccug

SEQ ID NO: 4148976 - RNA, 74 nt, Human
cagguaguagaugauagggccagaauuugaaauuuaaauuuauuucugauuuguaaugucauccuauacuucug

SEQ ID NO: 4148977 - RNA, 55 nt, Human
cagguaguguguagcacagcaguucucaucucagacugcccacuagaacuaccug

SEQ ID NO: 4148978 - RNA, 61 nt, Human
cagguauauuuugaucacccucuaugaguaagguuuuauaauggugaacaaaaugacucug

SEQ ID NO: 4148979 - RNA, 59 nt, Human
caggucagauuugacuuuaucaacuaggcacuggguuuuaugaagacaaauccgacuug

SEQ ID NO: 4148980 - RNA, 59 nt, Human
caggucauaacuaugcaugaacauuuuuuaucaggaauggccgauguguaugugauuug

SEQ ID NO: 4148981 - RNA, 56 nt, Human
cagguccaaauguugagacugaugucuuugucacaguugaagucuauuuggaccug

SEQ ID NO: 4148982 - RNA, 58 nt, Human
caggucccaguguuagggugacaacugcaaaaauuugguuaucauucucuugggccug

SEQ ID NO: 4148983 - RNA, 82 nt, Human
cagguccugugacucuccgcaccaugccgggugggggaaccacauguucccuggcucuggugaggagaaguuaggagacuug

SEQ ID NO: 4148984 - RNA, 105 nt, Human
caggucuaugguggcagggccagcuggcaggagagucagggcuuggcagcuucuucugcaagaugcaucugugcuuccugccacuaccaagccaccuggcuccug

SEQ ID NO: 4148985 - RNA, 57 nt, Human
caggucucccaagggccagggagcaggaaaaucucucagcugcuuuugggaggccug

SEQ ID NO: 4148986 - RNA, 123 nt, Human
caggucugcuauugaaaaccuuauuagagccaaucuuugggcucuugguugagagcuuguauuacccgggaacuagagacuuggcagggaugggacagggaaaaauucaaugccauagacuug

SEQ ID NO: 4148987 - RNA, 65 nt, Human
caggucugugugccauuuccaaccuucaaguugaugaggggagggaaacggucacacgcaaccug

SEQ ID NO: 4148988 - RNA, 120 nt, Human
caggucuuacccagucaggaggaaugagauaagggaucugccccuagaagcugucuggcugcuuuuugguagagcaggcaugcugcauugaggggcucucuuccucaucuggacuaccug

SEQ ID NO: 4148989 - RNA, 61 nt, Human
caggucuuauuuauuucuguauccccagcagaaggcccgggacacaguagaugagugacug

SEQ ID NO: 4148990 - RNA, 88 nt, Human
caggucuugagucuguaaggauguucagggccagaucccagaacagggaauucuccagguaaauggcauccugcccacucacugccug

SEQ ID NO: 4148991 - RNA, 69 nt, Human
caggucuugaguugccugucugcccauagaccucccuggcagccgcuagcaggcacucuagaggagcug

SEQ ID NO: 4148992 - RNA, 71 nt, Human
caggugaagugggacuggguugcaagaccuggugcggcuuuucuccacggugcagccugucccuucuccug

SEQ ID NO: 4148993 - RNA, 68 nt, Human
caggugaauuugugacuggccuuuugcuuucuugggaggagagacacaggcauuauaaauuucaccug

SEQ ID NO: 4148994 - RNA, 60 nt, Human
caggugagagcugugggacccugacacagcugucuagggaauugugguuuucuuagacug

SEQ ID NO: 4148995 - RNA, 82 nt, Human
caggugagggugugguacuuaccgcuauguuccuuccagaauuuaaguaggaaaaauugguaaagugcucuaacuucauuug

SEQ ID NO: 4148996 - RNA, 63 nt, Human
caggugcaagaaagguaauugcugguacaaaauaugccauuaccuguuuuacaugcacaacug

SEQ ID NO: 4148997 - RNA, 123 nt, Human
cauuuuuaucuuuguaacuuccucauacagcucacuuguuucaucuucucuuuucccauaguggagagaagcuaaacccugaagcuaagauuguucugugugcuugaagucaaagagagaaug

SEQ ID NO: 4148998 - RNA, 56 nt, Human
cauuuuucuccugacaucugggguugguuucauugaggauuuacaggggaaaagug

SEQ ID NO: 4148999 - RNA, 65 nt, Human
cauuuuugguugccacagcugggcagggguuguuccugguaucuagcagguggcggccagcgaug

SEQ ID NO: 4149000 - RNA, 77 nt, Human
caguuuaugaauagcauuaugaugcugcagaccuaccccgucuccauccacccugcauuauauuugcuguaaaacug

SEQ ID NO: 4149001 - RNA, 94 nt, Human
caguuucaauggcugcagagcauguccucaggacagugugugugcccccagcagcccugcuccucgggaggaccugcuuaagcagucauagcug

SEQ ID NO: 4149002 - RNA, 125 nt, Human
caguuuccuggccaagacauucugggaugucucuuauacccuucucugguugcagucuucauagggcaagauuguuuugggggaagugguucuguaaggaccuuccaggucuugcuaggaaauug

SEQ ID NO: 4149003 - RNA, 57 nt, Human
caguuugaugaugagauggggauuuaaccucugcuugccaucauuaucaguucacug

SEQ ID NO: 4149004 - RNA, 76 nt, Human
caguuuguaauuggaugauguagacaaaaauaugcuuuacccuagggguauauacauugucugcuucuacaaucug

SEQ ID NO: 4149005 - RNA, 56 nt, Human
caguuuuagggcaaugugaagagugcauuucucucucaccuguugcgaugaagcug

SEQ ID NO: 4149006 - RNA, 76 nt, Human
caguuuucauuacugcugugauuuucauaucagaucaugggggagggagguagagaucacaugcugauggaaaaug

SEQ ID NO: 4149007 - RNA, 75 nt, Human
caguuuucuugccauauuucagcccuuauuccuucugugaauaagcuuuugacuugguagggaagauaacuacug

SEQ ID NO: 4149008 - RNA, 80 nt, Human
caguuuugaaaguuauugaaccuuauuuagagucaggugguuuuuauuguaguauaugugguucaguaauuuggaaguug

SEQ ID NO: 4149009 - RNA, 77 nt, Human
caguuuugaauaggggaaaaguguugucucuagauaaauuagaauuuaaagcaugcugcuuuuccauuuuagaacug

SEQ ID NO: 4149010 - RNA, 97 nt, Human
cauaaaagcuaaugcauaaucgaggaauguaaaaaauucggcaucauagauuuaaaugauauuggauugagacauuuuagaaauguaagauuuuaug

SEQ ID NO: 4149011 - RNA, 71 nt, Human
cauaaagaggugcaguuugcuuguauuuugaacucucgugucuagugcagcaacaaacugcccuccuugug

SEQ ID NO: 4149012 - RNA, 85 nt, Human
cauaaagccaacagggcuggaggagauccagaggcuguggucucauagcuuccuaccacccuccccaagcuaguuggcucagaug

SEQ ID NO: 4149013 - RNA, 91 nt, Human
cauaaagcucuuccaaaugcaaguucauauuuuguucucacuucuugugugugagaacaaaauaugaacuuacauuuggaagagcuuuaug

SEQ ID NO: 4149014 - RNA, 57 nt, Human
cauaaagggacauuaugggacauaguaaaaucauaaugucacaaaagucccauuaug

SEQ ID NO: 4149015 - RNA, 102 nt, Human
cauaaauaaucaaggucugacuauuuuauuuucgguggcuguguuuguucuaaauuaagaaugccauugagauugaaguaagcaugcugacuguaauuuaug

SEQ ID NO: 4149016 - RNA, 83 nt, Human
cauaacagcuucuauugugaagggaaaaauagugcauucaaaauauaauggaauauacuccauucacgauaguaagaaaaaug

SEQ ID NO: 4149017 - RNA, 92 nt, Human
cauaacuugaaucacaguaacuucaugcauuucaaaugggauaaagucagccaagaaguguuuagguuugcagucgauugcucaagauuaug

SEQ ID NO: 4149018 - RNA, 56 nt, Human
cauaagaauauuuaguggcagcugcaggcugaugauuuuccacuagauagguugug

SEQ ID NO: 4149019 - RNA, 64 nt, Human
cauaaggagcacacaaucuagaacccucgcaugggugguucacaguaagguuugugcuucuaug

SEQ ID NO: 4149020 - RNA, 63 nt, Human
cauaaggugucucucugcuucuuggagcuggacgguuuccaagggcugagauacaucuagaug

SEQ ID NO: 4149021 - RNA, 58 nt, Human
cauaaguggagauuagaacuuggcuguuuggccccagggcuuuucucacuagacuaug

SEQ ID NO: 4149022 - RNA, 55 nt, Human
cauaauauacuacauugaugaauauuacaugauaugguggauguaauauauuaug

SEQ ID NO: 4149023 - RNA, 78 nt, Human
cauaauauauagacuugucuaccaugaauauuuaggaaccuagauacaugaaauggcagauaguguuauuucauuaug

SEQ ID NO: 4149024 - RNA, 107 nt, Human
cauaaucccaaggucuggcauacuguaguaaagcggaaagggugauagggaagaugucuugcuguacugacuugcuuagcugguacuagcuuaggcacugggauaug

SEQ ID NO: 4149025 - RNA, 64 nt, Human
cauaaucuguuguuaauauugacuugaagaaaaaucgaguuaauaggucuucaagagcauuaug

SEQ ID NO: 4149026 - RNA, 72 nt, Human
cauaauggggcauucuguggagcucagacaaugcauguccagagcucuguacacagaggguguccaauaaug

SEQ ID NO: 4149027 - RNA, 57 nt, Human
cauaauguuccagaaaaauccacuuuggcugccaaaguagcccuucuggaauuuaug

SEQ ID NO: 4149028 - RNA, 77 nt, Human
cauaauucuagggcugggcaaacaagacucuucuuguuucuucagggagacucucauugucaagcuugaaaauaaug

SEQ ID NO: 4149029 - RNA, 61 nt, Human
cauaauuucacugucguauggccgcugaguuaauguacuuacaaaugacagagaaagugug

SEQ ID NO: 4149030 - RNA, 66 nt, Human
cauacagucacugugguaccacugucgacauuacaguucaucccgguaucaaagugacuggauaug

SEQ ID NO: 4149031 - RNA, 71 nt, Human
cauacauuuugcauauuuaccauagcauaagagaaucuugaagaacaauuuuauagaugugcaauugugug

SEQ ID NO: 4149032 - RNA, 79 nt, Human
cauaccuaauaguuugaguguggaagaguagaacauaauguugacuagaaguucagcaacucaaaccuauuagcaguug

SEQ ID NO: 4149033 - RNA, 67 nt, Human
cauaccuggauaucauucauucuccucaaaagaaggagaauccacucaaaaugaacaucaggaugug

SEQ ID NO: 4149034 - RNA, 55 nt, Human
cauacgccauaggcuccucacuucaacagugaagaaggugauuucuaugguuaug

SEQ ID NO: 4149035 - RNA, 58 nt, Human
cauacucucuuaggugggacucgccuccugggcaguuuuccaugacucagagagaaug

SEQ ID NO: 4149036 - RNA, 100 nt, Human
cauacugauucuaucucuaugaaaucuagaguaggcagaacagaucuguggugauugaaaucagaucagugcuugccucuggaggagauugacaagaaug

SEQ ID NO: 4149037 - RNA, 64 nt, Human
cauacugugaagcuuacuauuucauuaucucuuccuucgcuagaauguaagcuuugcaagugug

SEQ ID NO: 4149038 - RNA, 92 nt, Human
cauacuuaucacuaacacccuaauaaucacagacuagugcacagaucaagauguuaacaguuaauuguuguuggguguugggaauaugugug

SEQ ID NO: 4149039 - RNA, 70 nt, Human
cauacuucuaagcucaaauugguauauuuuuaacaugguauauggaugagauaaugagccauggaagaug

SEQ ID NO: 4149040 - RNA, 120 nt, Human
cauagaaaauuucagcguauaaaauaaaauuaauaauaguagaugcuuauaaagagcauauuguguuccagguaguaugcacuauagguauuaacuaauuaauagccugaaaagucuaug

SEQ ID NO: 4149041 - RNA, 56 nt, Human
cauagacauugauagguuauauuuguuuuauaacaauuguguaccuaauguuugug

SEQ ID NO: 4149042 - RNA, 60 nt, Human
cauagagcugguuuacucaggaauuuggguuuccuuucaacucuucguccagcucuugug

SEQ ID NO: 4149043 - RNA, 80 nt, Human
cauagcacaggagauucagagggcugggaugacuucugagcugcucucuauacccaaggcccuuucaauuucuagcugug

SEQ ID NO: 4149044 - RNA, 65 nt, Human
cauagcagcauggagaaaccguucagauacuaaguaauugaguguguguuucuucuuggugcaug

SEQ ID NO: 4149045 - RNA, 64 nt, Human
cauagcauuuaauguauugucaaugacuaauuucauggucuaauggcagaguugaguaguuaug

SEQ ID NO: 4149046 - RNA, 79 nt, Human
cauagcucagauguucuguugggagaaugguucucucaugucuuguugagcaugaggcucuccaagcagaugaguagug

SEQ ID NO: 4149047 - RNA, 74 nt, Human
cauagcuuccaccgccccauccuucuucuaaaucuuuaauuuugcaaagccauagggaguggugguagccugug

SEQ ID NO: 4149048 - RNA, 61 nt, Human
cauaggauguugccucuaauugcugugcauuaauuauuagcaucugggcaucaauuuugug

SEQ ID NO: 4149049 - RNA, 86 nt, Human
cauaguacagcaaaaugggauaauagaaguagaaugcaacuuauagauauucuccuuguguuauuuuauauguguguauauauaug

SEQ ID NO: 4149050 - RNA, 87 nt, Human
cauagugccuguuuuauuucuggcauuguugcacguacuuguauugcucuuuuaauugucauaacaaccuguaggacagguacuaug

SEQ ID NO: 4149051 - RNA, 63 nt, Human
cauaguguccugcuaaugggugaaauaaauuuuauuuaggguuuuauuuauauaggacacaug

SEQ ID NO: 4149052 - RNA, 91 nt, Human
cauauacucauaucacauuggaccuuccugacaauccuaugagcuaagcacauuaguugcagcuagaagauucacugugcugugguauaug

SEQ ID NO: 4149053 - RNA, 57 nt, Human
cauauacugaggagacuuuauauguagccaugcauguuuaaagaucuucuguaugug

SEQ ID NO: 4149054 - RNA, 68 nt, Human
cauauagucacacacauaaucuaagauuauaugccaaauauauuauggggugugugugugagugugug

SEQ ID NO: 4149055 - RNA, 72 nt, Human
cauauauaugccauuuaaaaaugaccaaaugacgugcuaaccaugguugucuuugggugguagaauuauaug

SEQ ID NO: 4149056 - RNA, 117 nt, Human
cauggggaaacugaggcugagagcagugcugcagucacacggcuaucucagagcagaugcagaggugggcccagugggcuccagugccgcucacuccuucagucugagggcuucaug

SEQ ID NO: 4149057 - RNA, 57 nt, Human
cauggggaugaggcugagacuucuuccaaggagcaaucagcuugcuucauuauuaug

SEQ ID NO: 4149058 - RNA, 67 nt, Human
caugggguaccuugguaugcuugguagagcuaugacagguucugcugaagccagggagcaagccaug

SEQ ID NO: 4149059 - RNA, 96 nt, Human
caugguaugugaaaugacucugcucaguucaaggaagguggaaucugagcugauuuucucauuuucugaacugaaaaagucaggcacaguaaccug

SEQ ID NO: 4149060 - RNA, 71 nt, Human
caugguauuagguugcuagagcugccauagcaaaguaccacagacuuggugguuuaagcaauaguaucuug

SEQ ID NO: 4149061 - RNA, 84 nt, Human
caugguauuaugaugaggauuaaauggcaugaaacauguaaagugcuugccacagugccuuuuagugcucaauaaagugaggug

SEQ ID NO: 4149062 - RNA, 60 nt, Human
cauggugguacacgccuguagucccagcuacucaggaggcugaggcaggaguaccacuug

SEQ ID NO: 4149063 - RNA, 61 nt, Human
caugguguauguaaagucugagggccauuuagauauaugccacaggcuucuauacacaaug

SEQ ID NO: 4149064 - RNA, 100 nt, Human
caugguucuaaugaggguauucuuuauugucauuugaaguaaaaaugcauuuuucaugaggcuguauuaauuugaccauaaauaucuucuuauuuccaug

SEQ ID NO: 4149065 - RNA, 59 nt, Human
caugguuuggaguuaguuccauguucuggguucaaauucuagcuaacucacuaacuaug

SEQ ID NO: 4149066 - RNA, 59 nt, Human
cauguaacuccuuaaagcagcuggaaaaagacaggucuguuagguugcuuuaagacaug

SEQ ID NO: 4149067 - RNA, 71 nt, Human
cauguaggcauucuccuguauaugugcauacacacacuccuaaguuguguaaauguguaccugccugcuug

SEQ ID NO: 4149068 - RNA, 67 nt, Human
cauguaguuggguagcuuguaguaaaaugcucuauaaugcauuuguuuauaaguuccccagucacug

SEQ ID NO: 4149069 - RNA, 83 nt, Human
cauguauauuaggaaaggaagaugaggugcugcuuaguguaccuugugacuaaguauaucucuucuccuaauucuaacacaug

SEQ ID NO: 4149070 - RNA, 63 nt, Human
cauguaucuguuuaucuugucaucuggcuucccucagcacagugcaugaugggcagaagagug

SEQ ID NO: 4149071 - RNA, 60 nt, Human
caugucaaagcagacugagagcgguaccaauuaugagaccccagcugauuuuuugacgug

SEQ ID NO: 4149072 - RNA, 59 nt, Human
caugucagcaaagcaucacuccaaucugaacuuucugauuuccagcuuugccuggcaug

SEQ ID NO: 4149073 - RNA, 129 nt, Human
caugucccuuuagaggcauuaaugugacaagcauauugcauuuagagugaaacauuaugcaucaacuaaaacacugguacaugaccaagcauguuaaauguauguucauauuuuuguuacaaaggagug

SEQ ID NO: 4149074 - RNA, 77 nt, Human
cauugcccaguguguggccuguggaaguuacucauuaaauacuggguaccuaacuuaccuagguccacaugguaaug

SEQ ID NO: 4149075 - RNA, 58 nt, Human
cauugccuccuccuguuagaauuugcagcagaauccuguggccugggaggaggaaaug

SEQ ID NO: 4149076 - RNA, 79 nt, Human
cauugcuggguguggugguuuuucucauuucuguauaaauuuucaauuugaaaacagaguggagccaaacuuugcaaug

SEQ ID NO: 4149077 - RNA, 81 nt, Human
cauugcuguuccauguguguacagugccuugcucuccacuuuuaccugcaagcaucuccucaucauuugggucucaguuug

SEQ ID NO: 4149078 - RNA, 63 nt, Human
cauugcuuccucacagcuuccuauguacaaauacugggcauuugggagucuggaugaaagaug

SEQ ID NO: 4149079 - RNA, 76 nt, Human
cauugcuuuuaauauaaaugcuuuauaguguauuaugcaagugaaauaugagaaagacuuuagguuagaggcauug

SEQ ID NO: 4149080 - RNA, 130 nt, Human
cauuggaaucaccaggagagcuuguaaaaauguagacugcugggcugcacccccagaguuucugauucaguaggucugggguggggccugagaacuugcauuucuaacaaguucccaggugaggcugaug

SEQ ID NO: 4149081 - RNA, 98 nt, Human
cauuggaguuacauaguccuagugaagaggaaguggggcacaugcaagauguaaugugcugcuuugccucaucuuuauuucuauuuuaagcuucaaug

SEQ ID NO: 4149082 - RNA, 62 nt, Human
cauuggaucuagccaggaaaaccugaggccuggcucugccucuuccuggcucuaggaccuug

SEQ ID NO: 4149083 - RNA, 87 nt, Human
cauuggcccucuaagcccuugcuagagaauauuuguuaagacauuuuguagucuaauacucauuucuguaacucggcuucgggaaug

SEQ ID NO: 4149084 - RNA, 96 nt, Human
cauuggguaggaguaaguguauguagccuauacuagugggaacaacuaccccaccaacacuguucugggcaaaugucacuuucuuuuuuccccuug

SEQ ID NO: 4149085 - RNA, 58 nt, Human
cauugucuacuguggaggcaaauccuuugauugauaggucaaugcucuauagucagug

SEQ ID NO: 4149086 - RNA, 78 nt, Human
cauugucuguuuuguguuuuuggaaguauuugagagugguauuuuugcaaguauugugggaaagcagaaaggagaaug

SEQ ID NO: 4149087 - RNA, 84 nt, Human
cauugucuuugccaaauguuuuuauucuacaacaguugaucacauauguuauacuuuuaaugggaacaggcaagucagauaaug

SEQ ID NO: 4149088 - RNA, 128 nt, Human
cauuguggcccucucuuaaaaucauugacugccgagaucugggcccaggcggcucucggacugaaccggucugugcuaggcagccuggcccacucggccuucaaaacacaagggaugggagacauaug

SEQ ID NO: 4149089 - RNA, 57 nt, Human
cauuguggccuauuugacuuugguuuccuaauacugagcaaaguaccuggcacagug

SEQ ID NO: 4149090 - RNA, 56 nt, Human
cauugugggccugucguggguggggccagcagcacaugcaugccgggcugacagag

SEQ ID NO: 4149091 - RNA, 97 nt, Human
cauuguguauguuuauguauuuguguguagguguguaugugugugugugauacauacauacaucaaguaucacaagacauugaccuuauauauuaug

SEQ ID NO: 4149092 - RNA, 66 nt, Human
cauuguuaccaucuuuuaccuacaccauugaguaaggugggauagguuuaaguugguggcauaaug

SEQ ID NO: 4149093 - RNA, 73 nt, Human
cauuguucuaccuggaauagagucucuccaguccucugcuugacuggauuuaggaugcucaggcugaagaaug

SEQ ID NO: 4149094 - RNA, 56 nt, Human
cauuuaauaagcuuuauggacucaggauauaaaaucagaguaaagcuuauuacaug

SEQ ID NO: 4149095 - RNA, 57 nt, Human
cauuuaccagcugugcacugauaaugauuuacuuuguaggcaguacaguuguaaaug

SEQ ID NO: 4149096 - RNA, 81 nt, Human
cauuuacugcaaaggaagagccaagcagucaucaauagugcagcuguggauaacuauuggcuuuaagcuuugcuuuaaaug

SEQ ID NO: 4149097 - RNA, 86 nt, Human
cauuuagggcccugcuuuauggauagccuuuccccacacugugggaagguaggcaggggagcugucuggguugagggcccugguug

SEQ ID NO: 4149098 - RNA, 69 nt, Human
cauuuagguagacuuuaucccuggcuuucucugaagagcuucacuaaaugauaaauugucucuuaagug

SEQ ID NO: 4149099 - RNA, 120 nt, Human
cauuuauaccuaguaaaauuccucuucuugcuuuugcuauugaaacuuguaauggcaaauugaagcuacuuuaaaacuauggcagaagucaagaugaguuuuuacuccacaugguaaaug

SEQ ID NO: 4149100 - RNA, 83 nt, Human
cauuuaugacuugagccuggguucauuuaugaauuuagucuggauuaacuucuuugguguuacccagcucauuccuuuaagug

SEQ ID NO: 4149101 - RNA, 67 nt, Human
cauuuaugagucuuacugcagugaagcuuccuguguauggaaguguaaauucacagacuucaaagug

SEQ ID NO: 4149102 - RNA, 87 nt, Human
cauuucaauguauaacaggaaguauucaaacagauuucaccuaaacuggagaacuguuguuaauguaacugcuguuauaucaaaaug

SEQ ID NO: 4149103 - RNA, 99 nt, Human
cauuucacuuuaguuaauuucuguaaauucaacuauguauagucuucuuuacgaaaaggagagaacauacuugagaaauauaauuuaagagugcaagug

SEQ ID NO: 4149104 - RNA, 80 nt, Human
cauuucagauuucuuuucaagagggugcuucuaaaguaacuauugcgcaaaaguccucugaaaaaauaggucaagaagug

SEQ ID NO: 4149105 - RNA, 74 nt, Human
cauuucaucucauuuggaaauuacucauuguccugauguuuuuuaggcuagagaauuuuaaguagaguaaaaug

SEQ ID NO: 4149106 - RNA, 71 nt, Human
cauuucauguaaucauuuagguggcuaaucucauccaaauaauuuauggccucuuggugcuugaugaaaug

SEQ ID NO: 4149107 - RNA, 62 nt, Human
cauuuccacuucugaaaacuggaauaauagcaccugcuucacacaguuuuuaggaagaaaug

SEQ ID NO: 4149108 - RNA, 86 nt, Human
cauuuccaugaggagcuccuugaaaugagcaugagacccuuaaagagcaugcuaaagacacaauaaguagcuucuaaaugguuuug

SEQ ID NO: 4149109 - RNA, 69 nt, Human
cauuucccacuggguucuguuuggccacugccuggcuucgcagcugugcugauugcucaguagggaaug

SEQ ID NO: 4149110 - RNA, 67 nt, Human
cauuucccccagcccacaagcauauuaaaaugacuguuuuuaagcuuuuacggguugaggugauuug

SEQ ID NO: 4149111 - RNA, 78 nt, Human
cauuucccuaauaauuggcaauguugagcauauuuucauguucuuauuggccaauuguauaacuucuuuggagaaaug

SEQ ID NO: 4149112 - RNA, 121 nt, Human
cauuuccuguuacuuggugguagccugcuacaggcuucaguuucucuugagagcgggagcugugucuuguuucuccuggugccugauauauaguagguauuccauaaauaaguugugaaug

SEQ ID NO: 4149113 - RNA, 62 nt, Human
cauuucuacagcuucuucagaagaaugcuaacaacaacuucuuagggaggucucuggaaaug

SEQ ID NO: 4149114 - RNA, 117 nt, Human
cauuucuauuuuaugugccaaaguuacuacgaaugugagcaauacuacugaucucgguuuuauuuuaaagugauuaguauuugcagauuugugucaauuuacauauuuauggggaug

SEQ ID NO: 4149115 - RNA, 66 nt, Human
cauuucugcugauuucagguuuucuuucaguggugaaugacaaagacaugcaauuagcaaggaaug

SEQ ID NO: 4149116 - RNA, 84 nt, Human
cauuucuucccugcuggaagccuuucuaacuccuauuagcucacuggaugcugcuuucaaaggcuuucuagaugggguggaaug

SEQ ID NO: 4149117 - RNA, 67 nt, Human
cauuugaacauuccugaaugaagcaugggcauucuuugcaaaauacuuaagggaauguuuuccagug

SEQ ID NO: 4149118 - RNA, 79 nt, Human
cccagcuggccagagacagagacaggaguuggccggggcugccuggcuucaaaaccuaucuuugaucaucugugcuggg

SEQ ID NO: 4149119 - RNA, 55 nt, Human
cccagcuguugucucucacauauuaauuaggggugacaggaacaacagcccaggg

SEQ ID NO: 4149120 - RNA, 67 nt, Human
cccagcuuagcucucccuccccagauuccuguguggcauggacugagggauagaggugcuuccuggg

SEQ ID NO: 4149121 - RNA, 56 nt, Human
cccagcuucuggcguggagccugaccauagugagcucuuuaucagccgaggcaggg

SEQ ID NO: 4149122 - RNA, 59 nt, Human
cccaggaacagcacagaacagcagggccuggccucugggucuucuguguccuuuguggg

SEQ ID NO: 4149123 - RNA, 65 nt, Human
cccaggaagaggggucagguguuggggccucacacugcccccuucuggaucucccucauccuggg

SEQ ID NO: 4149124 - RNA, 60 nt, Human
cccaggaagagugaguggcauuugaaauccauaucgucuugcuagucugcuguccuaggg

SEQ ID NO: 4149125 - RNA, 78 nt, Human
cccaggaagucugguggccuggggauuuggugggucugcuccuuagcaguggccuggggcucuguguguguaucuggg

SEQ ID NO: 4149126 - RNA, 56 nt, Human
cccaggagaccugugaaaggaccguuuacuccuuucuugaaacagcaucuuuuggg

SEQ ID NO: 4149127 - RNA, 60 nt, Human
cccaggagagggaaccaaauguccauguccugacagcacagccaguucaccucuccuugg

SEQ ID NO: 4149128 - RNA, 56 nt, Human
cccaggagcaggcccaaggacacaugggcccuaugagcugaggaaccugcccuggg

SEQ ID NO: 4149129 - RNA, 58 nt, Human
cccaggagccaucugucuuggcaugccccagacagugccacagauggaggaaucuggg

SEQ ID NO: 4149130 - RNA, 56 nt, Human
cccaggagcugagcagggagccucagaggaggcugcugcaagagccagcucuuggg

SEQ ID NO: 4149131 - RNA, 56 nt, Human
cccaggaggcggagguuguggugagccgagauugcaccacugcacuccagccuggg

SEQ ID NO: 4149132 - RNA, 56 nt, Human
cccaggagguggagcuugcagugaaccgagaucgcgccacugcacuccagccuggg

SEQ ID NO: 4149133 - RNA, 59 nt, Human
cccaggauguguacaaguagcuccaugauuacaguggggccacagugggaaauccuggg

SEQ ID NO: 4149134 - RNA, 55 nt, Human
cccaggcaggagugcaguggcaugaucucgggucacugcaagcuccgccucuggg

SEQ ID NO: 4149135 - RNA, 56 nt, Human
cccaggcaggccuacacaaugggagcugcucccugcagcccccgggccggccuggg

SEQ ID NO: 4149136 - RNA, 56 nt, Human
cccaggcagucuggcucuaaagccuauucccuuuccacuaagccaggcugccucgg

SEQ ID NO: 4149137 - RNA, 57 nt, Human
cccaggcagugugugcaugcgugcaugugugcgugugcguguguguguguguugggg

SEQ ID NO: 4149138 - RNA, 97 nt, Human
cccaggccucuggcucuggggugugauuuggcuagagauggauccaggacucuuuccccuuuaggucccugcccaaagcccuuggggcagagguggg

SEQ ID NO: 4149139 - RNA, 57 nt, Human
cccaggccuggccaggggaugccugcaaccaugcggauaccccacaccagggcuggg

SEQ ID NO: 4149140 - RNA, 67 nt, Human
cccaggccuggcugcagcucgccuuucacacccagauguaggagcgggcgcgggagcccugccuggg

SEQ ID NO: 4149141 - RNA, 57 nt, Human
cccaggcuagaaaggccaacaacccauguauguggucuggggucuaguuggccuggg

SEQ ID NO: 4149142 - RNA, 56 nt, Human
cccaggcuggagugcaaugacgccaucguggcucacugcaagcuccaccucccggg

SEQ ID NO: 4149143 - RNA, 85 nt, Human
cccaggcugggauggagccacugucugcacccgaggaggccuccagagcaggaggcgggagcagcagcucugagcccggcuuggg

SEQ ID NO: 4149144 - RNA, 55 nt, Human
cccaggcuuuuaaguuagacagacuuggguugcagucuugcuuguaggaccuggg

SEQ ID NO: 4149145 - RNA, 66 nt, Human
cccagggaaugacucuggccuuuuuccugggccccauuggccugggaccagcagagcagcccuggg

SEQ ID NO: 4149146 - RNA, 108 nt, Human
cccagggacacucuguuaaggcuguaagcaaugagauaaucaugggagcagugaagcuuuuaugucacuuauuucaugugccagcgugugguguaguaaacccauggg

SEQ ID NO: 4149147 - RNA, 65 nt, Human
cccagggauuauaaaggugaaaauaugcacaaacuuugccaauaucauguuuguagucucaaggg

SEQ ID NO: 4149148 - RNA, 63 nt, Human
cccagggcccaggacagcaucagggaccaccacucggguaaccccugggacuugggcucuggg

SEQ ID NO: 4149149 - RNA, 73 nt, Human
cccagggcuggacuagaagcagggcucaugaaaagcgcauggccucugaggcucugcuucuguggcucuuggg

SEQ ID NO: 4149150 - RNA, 79 nt, Human
cccucccuucucaagcaggccugccuggucaucugugaaccauuucauggcuggcacuggccuggguuccaggggaggg

SEQ ID NO: 4149151 - RNA, 130 nt, Human
cccuccucacugguagggcccgcacaaaguccacagggcugaggcuggcuucuugaacugagcucuuugugaggagccuuccuuucuggggcucugcugccaucuaguggaagacaugcacaagguuggg

SEQ ID NO: 4149152 - RNA, 67 nt, Human
cccucggcacaucuuaauuguuacugcuccuaauuggcccggcacugucgauuaugaugagucaggg

SEQ ID NO: 4149153 - RNA, 69 nt, Human
cccucgggaaguuuguuuggacugggaugacugaacuaggucuuuuuucugaguccuaaacccccaggg

SEQ ID NO: 4149154 - RNA, 69 nt, Human
cccucuaaagcagaauuucccacacugggacugggaggccucagggaugguggaggaauuucaagaggg

SEQ ID NO: 4149155 - RNA, 71 nt, Human
cccucuagggaggcaggacugagggaggcugggcgccccgucccuccugcacuugcuuuccuucaguaggg

SEQ ID NO: 4149156 - RNA, 83 nt, Human
cccucucaagaggcuaauauggcacaugaacacagacauuuccucugguguguauguggaccaugugaagaugagggagaggg

SEQ ID NO: 4149157 - RNA, 65 nt, Human
cccucugacugggccaguucugggcuuugcaaagauggccuggaccuggucaggcggacgcaggg

SEQ ID NO: 4149158 - RNA, 57 nt, Human
cccucugagacagguagcucacccccgaccuugugggcagcaccagcucucagaggg

SEQ ID NO: 4149159 - RNA, 73 nt, Human
cccucugauucuaucuuuccuguggccuuacaucuguggcuugucugcccacacagggggaugaguuauuggg

SEQ ID NO: 4149160 - RNA, 70 nt, Human
cccucuguccccaccaacauaugccugacucccugagcaggcccuuagccuuggugggauuucagcaggg

SEQ ID NO: 4149161 - RNA, 121 nt, Human
cccucuucucccuagugacacacauggucacaucagagugguggccugguguuccagcuguguacacaccaagcugugcuacucauccccugauggacugaguuauuuguauuagagaggg

SEQ ID NO: 4149162 - RNA, 64 nt, Human
cccucuuugacaccauuccucauuguccuaggcacaggcaacugaggucuccagugcagaaggg

SEQ ID NO: 4149163 - RNA, 75 nt, Human
cccucuuugccugucugcagggcugucauugugugauucauaacucaauauuaaccacagaugagggaggagugg

SEQ ID NO: 4149164 - RNA, 77 nt, Human
cccugaaccuuguuccugcccuccucccaccccuguccuccuggaggaaggcugcuucaggagcugcaggcucaggg

SEQ ID NO: 4149165 - RNA, 86 nt, Human
cccugaagacagacacccagccugcuguccccggcacacugcacagugccuggcacauagugggcaugcaggacuguauuuguggg

SEQ ID NO: 4149166 - RNA, 114 nt, Human
cccugaagcugggauuuagguaaggggaggaccuuuccaaggcuuguuuacagcucagauuugcagaggaccagguauuugggaacuccucuucugaagaaccagauugcaggg

SEQ ID NO: 4149167 - RNA, 93 nt, Human
cccugacaggccuaauugcugcucauuccucaugcugccccucacgccgcugguuagggagccagggaugcagcacagugaaggaaguuuggg

SEQ ID NO: 4149168 - RNA, 94 nt, Human
cccugaccggcuagagagccugcuaccucauuccagaguuaucacugccacaccucggggucggggguggaggcucgauagggcugguuagagg

SEQ ID NO: 4149169 - RNA, 104 nt, Human
cccugaccuucucccuggugccccuuuagccccugcagagacuucugccuuucccuaggauacaugguugcuggggguggcagagcuagaaccagggugguggg

SEQ ID NO: 4149170 - RNA, 57 nt, Human
cccugacuuaguugcaaauggaaaccgggcauuguuuccaggaguggcugggcaggg

SEQ ID NO: 4149171 - RNA, 71 nt, Human
cccugagaaagaggaggagacggggcggggcccaggacgggauccuugcccgcugccucugaguuuguggg

SEQ ID NO: 4149172 - RNA, 81 nt, Human
cccugagaggccagcuccagcccaucugcucgugugcagcacauacagcguauagacugggcucagaagagcagucuaggg

SEQ ID NO: 4149173 - RNA, 69 nt, Human
cccugagcagcagggagacuggugcagccccaagcagcugcccggcugagcucaccugcuuguucuugg

SEQ ID NO: 4149174 - RNA, 90 nt, Human
cccugaggagcuucucagaauuguguccacugggcugacugagcaggugcccagguucccagguugcacaauucuaaggucacucagagg

SEQ ID NO: 4149175 - RNA, 61 nt, Human
cccugaggcccuccuggggucugugccgcaccaauuauacacagacugggcugccuuaggg

SEQ ID NO: 4149176 - RNA, 58 nt, Human
cccugaggcuggagugcaguggugcgauuucagcucacugcaaccuccgccuccuggg

SEQ ID NO: 4149177 - RNA, 100 nt, Human
cccugaguugcaaugacaggcccugggaaggggaagagaauuccucugugggaacucucugucuucuagggauaaaccgagucugcugcuggacacaggg

SEQ ID NO: 4149178 - RNA, 56 nt, Human
cccugaucgagguuggcaaagguggcccugagcugcagucagcaccauggacaggg

SEQ ID NO: 4149179 - RNA, 60 nt, Human
cccugaugacaccauauuagccuagagacugccuuucucuggucuucuauugcaugaggg

SEQ ID NO: 4149180 - RNA, 78 nt, Human
cccugcaaucuaagccugcuuggcuucugaagagguaaucacaaugcccacuagaaucaagcaguagagcagacuggg

SEQ ID NO: 4149181 - RNA, 57 nt, Human
cccugcagcauucucuaacugggacuucagaaacccauuaggaaaaggagugcaggg

SEQ ID NO: 4149182 - RNA, 117 nt, Human
cccugcagugucuucacaucaguguucaggcaggcagagggcaaaugcaggacagcaaagcugcauuucagaagguucgucugcugccuccaguggacagaaagcacaugagcaggg

SEQ ID NO: 4149183 - RNA, 62 nt, Human
cccugcagugugaccucaccuaaaaguccagccggggauggagagggugcagcugacagagg

SEQ ID NO: 4149184 - RNA, 66 nt, Human
cccugccccuucgggcagccuccucuuguauguaugguccuggaaggaaggccuggaguggcaggg

SEQ ID NO: 4149185 - RNA, 73 nt, Human
cccugcccugccacccuggcggcagccugcuccccuggggggccucucugggcugccgaggcugugggcaggg

SEQ ID NO: 4149186 - RNA, 56 nt, Human
cccugcccuuccuccucucacugggcauccacagguucaggagaaagggaccaggg

SEQ ID NO: 4149187 - RNA, 58 nt, Human
cccugccucccugaaggcacagcuuuuccuaacccugagccgccaggaaggccauggg

SEQ ID NO: 4149188 - RNA, 93 nt, Human
cccugcucccaagugacuuugucuucagauaggcauucuuccuggacuucccuauacaggaagaugagagacagaauaaauggugguucaggg

SEQ ID NO: 4149189 - RNA, 83 nt, Human
cccugcucccuagguggccccaggccucugccagcccuguggggcucauguggcaggguuggccaccuuaccaugagaugggg

SEQ ID NO: 4149190 - RNA, 60 nt, Human
cccugcucuuagugccugugugaaugagugaaauugaugcugguguuuuugggaccaggg

SEQ ID NO: 4149191 - RNA, 82 nt, Human
cccugcugccaaggaaguuuuaggagaggaauccagucuuaucagguuccuagcuuaaaacauuuugauaaucccagcaugg

SEQ ID NO: 4149192 - RNA, 56 nt, Human
cccugcugccccgggaggcccauggaaguggccaggcuggguccccagcugcaggg

SEQ ID NO: 4149193 - RNA, 97 nt, Human
cccugcuggcagcugggggcgcagcagcccagggcucucagaguggccuuccaacacucggggcucagaagcugcuccgcggagccugccagcaggg

SEQ ID NO: 4149194 - RNA, 67 nt, Human
cccugcuuuauauuacauaguguuugagauaaacauugugaauccauucuaugugaaauguccgggg

SEQ ID NO: 4149195 - RNA, 56 nt, Human
cccuggacaggaggccguuuccagcuucccuggagcauggcaguccguguucaggg

SEQ ID NO: 4149196 - RNA, 130 nt, Human
cccuggagauuucagagauaaacccgaccuggaucugcauuuacauugcuuguaauugucaaauggaagacagcugcaaacaguuaagaugcaggcgugggaaacaaauauugggaguagaaaggaaggg

SEQ ID NO: 4149197 - RNA, 72 nt, Human
cccuggaggucgggcccuuuucagucacauuuaccaucuccuaaauucacugccuggccuggccucacuggg

SEQ ID NO: 4149198 - RNA, 78 nt, Human
cccuggauccuucugaagaaauucuacuaagcugugcuggauggcagcuggcugaaucuucugcaauacacuucaggg

SEQ ID NO: 4149199 - RNA, 60 nt, Human
cccuggcauaaaacuucuccagagauaaaauagcuuucugacaggaggguuguggcaggg

SEQ ID NO: 4149200 - RNA, 96 nt, Human
cccuggccaaguucugcagccucucggggccugguccugugucugugaggcaggacacacccagcucacgggggugcugugggugugggggcgggg

SEQ ID NO: 4149201 - RNA, 61 nt, Human
cccuggcccagcccuaccuacgugcucugauccugggagcccacagcugagcuggccaggg

SEQ ID NO: 4149202 - RNA, 58 nt, Human
cccuggccugaggcucggcaugggucagcuguggccguggagccucuuggccguaggg

SEQ ID NO: 4149203 - RNA, 78 nt, Human
cccuggccugggcggcugccuccacgaugccacugcucaucgaggggcagcgagugcggcugccacaguccgccgggg

SEQ ID NO: 4149204 - RNA, 68 nt, Human
ccacucuggacuaacagcagccucaggguguuaaagcucacucugaggcugcuguaagucuagagugg

SEQ ID NO: 4149205 - RNA, 94 nt, Human
ccacucuucaaaaguagagucuauuuuucuuaaauguggguuggccugugacuugcuuuggccaagagaaugugagagaaaugauauugggugg

SEQ ID NO: 4149206 - RNA, 99 nt, Human
ccacugaggucauggacgcacacugagcugcucuaaucucgccuuuuaggcucaucuacagggccagcuagagcccucgccgccaugucaucuccuugg

SEQ ID NO: 4149207 - RNA, 64 nt, Human
ccacugauccagagccaaccaaggcaccucaggaaauggaaggccacauugccucuggauuugg

SEQ ID NO: 4149208 - RNA, 58 nt, Human
ccacugauucugccaggucucugcaauugcacugcauggaacugggacuggucagagg

SEQ ID NO: 4149209 - RNA, 129 nt, Human
ccacugcaggugaaauggacaccuggcucucccugguguccccuccaggagcugucacugggcaguccgccuuccaggaugggacauaguggagcaggcacggggggccaugucagccugucagucggg

SEQ ID NO: 4149210 - RNA, 63 nt, Human
ccacugcuuuuuucccccgagccuguaagggcauguccccagcagccagggagagaaccaggg

SEQ ID NO: 4149211 - RNA, 130 nt, Human
ccacuggccaggcacuggggauaggcagggguggugugagaaguaggggcucaggugcuucuuagggacacaucagccucagcuuugggccaccuuccugagacuggcugccugguuuuggggcaagugg

SEQ ID NO: 4149212 - RNA, 57 nt, Human
ccacugggggcugcucccagguguggguagauggugccuggggaauggccccagugg

SEQ ID NO: 4149213 - RNA, 55 nt, Human
ccacugguuuuauuguagcuuaaaauugagcucuccacacauaggacuagcuugg

SEQ ID NO: 4149214 - RNA, 68 nt, Human
ccacugugcuuguguucauuguuaauugaagucacacugugugcacaagagagcgauaagcacucugg

SEQ ID NO: 4149215 - RNA, 76 nt, Human
ccacuguggucuccugucuuggccuucccaaacgggacagguugugucugaaggcaagaagagaaccaucgguugg

SEQ ID NO: 4149216 - RNA, 107 nt, Human
ccacuucugauucauugcuguuugcccugcccuugcuauuucuaacaagaugccaugugugaaugggaguagaugaggagugggcagagaggaauacuuuggaaggg

SEQ ID NO: 4149217 - RNA, 80 nt, Human
ccacuuuuuaaaauccuucaauuagaaccaauugaccagagcccauguguaauugcuaaaugaaggagaagggaacuugg

SEQ ID NO: 4149218 - RNA, 92 nt, Human
ccagaaaacagcaguggcaggagaaggcggcugcgggaacauuuucuccuuccaaaagagcuuucaucacucuacuuagcuuucauuucugg

SEQ ID NO: 4149219 - RNA, 75 nt, Human
ccagaaaggcaaugaauacuguuuuuguuaauaacuagcuggugacagaaagcucuuucaaucuugccuuccugg

SEQ ID NO: 4149220 - RNA, 78 nt, Human
ccagaaaguaucuucuagagccagccgcaagagcugugagcugcuuccaaguuaggcgagcugguggugguacccugg

SEQ ID NO: 4149221 - RNA, 98 nt, Human
ccagaaccuaguccuguaauuauauggugaauuucucggaaugcuucggcaacgucuugacauucaaucauguauacuucauuuugggacugagcugg

SEQ ID NO: 4149222 - RNA, 82 nt, Human
cccugcgcggccccgcaagcugacuguccuccacgccugcucuccugcaagccaggaaggauccagcacgcggccggcaggg

SEQ ID NO: 4149223 - RNA, 55 nt, Human
cccugcuacucaggaggcugagucaugagaaucacuugaaccugggaggcagagg

SEQ ID NO: 4149224 - RNA, 112 nt, Human
cccugcuauuuauuaauuuucauuggacuuuguaggaaaaagucacaagcaacaucagaauguuuugaacucuuagcagaggaccgaguggaaugugaaguaaacugaaggg

SEQ ID NO: 4149225 - RNA, 63 nt, Human
cccugcugagagccagggcuggcauuagugacaagaccgugccucccggggcucuuccuuggg

SEQ ID NO: 4149226 - RNA, 56 nt, Human
cccugcugccuucacccaggacagcagacagacuagccaggaugaugcaagcaggg

SEQ ID NO: 4149227 - RNA, 82 nt, Human
cccugcugcuaaaauuaacuaauuguuaaaguaauaaccauggacccucauggccuauuuuaauagucaguggcaaucuggg

SEQ ID NO: 4149228 - RNA, 69 nt, Human
cccugcuuccuauccacacaaugccucugaaaucggaaagggcaccacagguggugugggaaggcaggg

SEQ ID NO: 4149229 - RNA, 67 nt, Human
cccugcuucuaucccuccacugcacugccuuuuauuuauaaaaugaggcacugggggaugagcaagg

SEQ ID NO: 4149230 - RNA, 74 nt, Human
cccuggagaauuuugucaccagacauuguaauuauguuuuuagaugaugucacauguguggcauuuuuccaggg

SEQ ID NO: 4149231 - RNA, 81 nt, Human
cccuggccagguggugccucuguucgcacaggucuggagaagugcagcagcaccaggcccccugcugagauugagccaggg

SEQ ID NO: 4149232 - RNA, 86 nt, Human
cccuggccuuggugagguagcagagacagugaauguucaacuucugaguaauuuauagguaacucugcagcaacacuaacacaugg

SEQ ID NO: 4149233 - RNA, 79 nt, Human
cccuggcucugugccccgaugguccccucccugccccauuaaggccaggagcccaggcugggguucagaguguccaggg

SEQ ID NO: 4149234 - RNA, 94 nt, Human
cccuggcuugacugggcagggcuuccagagaacgaugaaagcugggggaacugagcucaaagugucucuugacuuucccgggaagaagcugugg

SEQ ID NO: 4149235 - RNA, 60 nt, Human
cccugggagccuggcaguugcugagcccauacgccucagggacuggugagcuuccagugg

SEQ ID NO: 4149236 - RNA, 61 nt, Human
cccugggagcgcagcaggcacaacccuugcaucugguguuugccuccugcagcuccuccgg

SEQ ID NO: 4149237 - RNA, 64 nt, Human
cccugggcagugagcuguggugggguagaggacccuucccucccugccaggcccaacccauggg

SEQ ID NO: 4149238 - RNA, 94 nt, Human
cccugggccaggcuguuucugucuguguggacacggcugcccugcacuugguuggccuccaagacagacgaaaagcuagcaagcagccucaggg

SEQ ID NO: 4149239 - RNA, 62 nt, Human
cccugggcuguucugccccuggguuugcugucccaaacagugggccuagccggaaaccaggg

SEQ ID NO: 4149240 - RNA, 61 nt, Human
cccugggcuguuugcugucccaagccccuucuggaaguuagaagcagcaaagggcccgggg

SEQ ID NO: 4149241 - RNA, 87 nt, Human
cccuggggaaaggcucaacagcuguacuuugucuaggaacuuuuacguaggauaaagucuuucucauuggccaugcugucccuaggg

SEQ ID NO: 4149242 - RNA, 83 nt, Human
cccuggggccggggugcagcugagggccucuucuagggacccaacuccugauccagccccugccggccgcaccuuccgcaggg

SEQ ID NO: 4149243 - RNA, 76 nt, Human
cccugggugaguguccaaggucagcgagagucacuuguggaggggacggaagaugaccuggcugaucuggccaggg

SEQ ID NO: 4149244 - RNA, 55 nt, Human
cccugguucauauaggcaaguuuaagcagugauuuaaaacugccccugaccuggg

SEQ ID NO: 4149245 - RNA, 58 nt, Human
cccuguauagauacaggucauagggaaauagucucgugaggccugugagugucuaggg

SEQ ID NO: 4149246 - RNA, 89 nt, Human
cccuguccugucuucgaguauuuguuuuuaaugcugggugucgaucgagacaacaagcgcucagagcaaagcaaggaugcauuacgggg

SEQ ID NO: 4149247 - RNA, 91 nt, Human
cccugucuuguggaaucagaauuacugaauggagcccaggcauuuuuuaaaaaaguucccuugguaauucuguuccuuagcaagucuuggg

SEQ ID NO: 4149248 - RNA, 56 nt, Human
cccugugaaccucucaaugacucaggagggacuccagagcaguggaguuuccaggg

SEQ ID NO: 4149249 - RNA, 68 nt, Human
cccugugcacacacuucacucugcugccaaaagcaaccaaucgccugucagaguggaugugcaugggg

SEQ ID NO: 4149250 - RNA, 70 nt, Human
cccugugccuuggcgcugugccacggagggccgaaggaaggcgggcacuuacugccaaggcgagccaggg

SEQ ID NO: 4149251 - RNA, 77 nt, Human
cccugugcucugugagcaucccuuaccggaaguuccaccaggagcugggcaaggcugaagcuaccagguguggaggg

SEQ ID NO: 4149252 - RNA, 59 nt, Human
cccugugcugggcccugagaccaggggccucugccaccuucagaaugcuccaggcaggg

SEQ ID NO: 4149253 - RNA, 64 nt, Human
cccuguggugacaggccugucugcacaugaggcugugagggcacaggccugugugcacacgagg

SEQ ID NO: 4149254 - RNA, 66 nt, Human
cccuguguaguauuuguacacauauaucagcuccucagcuuuauuuguugcauauguuuuaugggg

SEQ ID NO: 4149255 - RNA, 66 nt, Human
cccuuaaauccaucucuccgagaaguuucuagcugacguuuuucagggggucauggagggugaggg

SEQ ID NO: 4149256 - RNA, 128 nt, Human
cccuuagaacagcugccuaauacucaagagccucaagccuucugauuuauauaugcagauacuacauauggaauuuguuaaaaauuagaucgccucuacuuuuuggguggugugggugggaggagagg

SEQ ID NO: 4149257 - RNA, 56 nt, Human
cccuuagcucugggcagccgguggcuuuggcggccacuggccaccacuggcagggg

SEQ ID NO: 4149258 - RNA, 60 nt, Human
cccuuagcuggugagcccagcgccuccuguguggggcggucugggcugcccagcuauggg

SEQ ID NO: 4149259 - RNA, 99 nt, Human
cccuuaucuacauagaauagucagcaagaucauggacucuggacccagaacaccugaguccuagacuuuucugccacuuaagagcuaugugaugcuggg

SEQ ID NO: 4149260 - RNA, 70 nt, Human
cccuucaauugacuagagguaaugagaaagaacccacccuccuuucuuuauaucugcuaguggguugggg

SEQ ID NO: 4149261 - RNA, 102 nt, Human
cccuucagugccacgaccuuccugugccaaucauggguaugaugucaguucaucuaauccuugagcugcaguuagccccagaugaggaaacagacuggaggg

SEQ ID NO: 4149262 - RNA, 61 nt, Human
cccuggcucugguaacauuggguagcucccuaguuguuggccuucccuaccugggccaggg

SEQ ID NO: 4149263 - RNA, 61 nt, Human
cccuggcuggcucugcccggacaguccuuagggacaucuugguccugcccaccagccaggg

SEQ ID NO: 4149264 - RNA, 95 nt, Human
cccugggacaucucucuuagcaugcugauauuuggcugcuucucugauaaugggagcagcauucucugguauggggugcuguggaagaccuaggg

SEQ ID NO: 4149265 - RNA, 59 nt, Human
cccugggcaagcccuauuuuccucccugcuaacuugaugacaacaggggaaguucaggg

SEQ ID NO: 4149266 - RNA, 73 nt, Human
cccugggcaguuucucccucucuccagcuguccagucaaauuucaggcuggagaagccaaacuagucacuggg

SEQ ID NO: 4149267 - RNA, 55 nt, Human
cccugggccuuuuggggacaagcagcucucugaggaccccacaggaggcccuggg

SEQ ID NO: 4149268 - RNA, 81 nt, Human
cccuggggugggguggucagggugagcaggugggcucugugagccuguuuccccaugcccugacucaccccaaucccuggg

SEQ ID NO: 4149269 - RNA, 109 nt, Human
cccuggguguggcaucggggcauggcugugagcaggcagcuucagagcaagguggguugugugaaggagguggcuggcucagagccaggccuucagcugaggccugggg

SEQ ID NO: 4149270 - RNA, 78 nt, Human
cccuggguucugaguccuccuuugaaggccacccugccagaaaggaagagccugauggagguuucuggggacuuuggg

SEQ ID NO: 4149271 - RNA, 58 nt, Human
cccuggucagggaaggcgccuggcuuccagcugugagacaggcuccgcaggacuaggg

SEQ ID NO: 4149272 - RNA, 85 nt, Human
cccuggugccccuuuagccccugcagagacuucugccuuucccuaggauacaugguugcuggggguggcagagcuagaaccaggg

SEQ ID NO: 4149273 - RNA, 58 nt, Human
cccuggugggaaugauugcaggaaggagugggaaagacugcaggugcugccaucaggg

SEQ ID NO: 4149274 - RNA, 71 nt, Human
cccuguaacugugguuaccucuugucuuagucaguucaggcugguauaagagaauaccauaggcucagugg

SEQ ID NO: 4149275 - RNA, 130 nt, Human
cccuguagauuugccuggugcauguaaugaaaccugcagcuuuauggggugauggcagugcucugcugccuuacuuucaaguggcuggggguuuuuuuaguuuggcagguacagauuuuuuuuaauuggg

SEQ ID NO: 4149276 - RNA, 79 nt, Human
cccuguagccugaguggugaaaccccaucccccuaggggcacauggacaauggaggugcagcauccucagcagcauggg

SEQ ID NO: 4149277 - RNA, 78 nt, Human
cccuguauuuacuccagagguucucaucugggacugauucuuccccacucccuccaugagaugucuggcaauguuggg

SEQ ID NO: 4149278 - RNA, 125 nt, Human
cccugucccaaauauucuaauuuaauggcuguacgguggggcuaggaccucaggaugauucacuccaccgagguauccggucguccugaaguauagccaagguugagaagcaccgauagacacgg

SEQ ID NO: 4149279 - RNA, 80 nt, Human
cccugucccccucucagagggaagcugccucugaagaggcaggaagcugaggcucugagagggaaguggguugcccaggg

SEQ ID NO: 4149280 - RNA, 80 nt, Human
cccugucccgccacucugcugucugauggcaggaauggagugccucuccuacacagauaacagagacgcgggggcagagg

SEQ ID NO: 4149281 - RNA, 130 nt, Human
cccuguccuugcucccgucccuggcccggaccuuggcugucuccucuuugugccgagauugucagucugugcggcuacagcgggguggagacggccggcucugucacggcuucaugagagcggggacggg

SEQ ID NO: 4149282 - RNA, 121 nt, Human
cccugucggcauggcaacuucaaggcuguaccucuuguuagugacugccuggauggaagaaaagccaccuuucaccagggcuccagccagccuacagccgagguuagacccagccacaggg

SEQ ID NO: 4149283 - RNA, 70 nt, Human
cccugucuccaaaacaaucucagaugagauucucaugagaacacaauuuguuuggagaaauuagcauggg

SEQ ID NO: 4149284 - RNA, 63 nt, Human
cccugucuguggugcuccuaugcuguccauugaggacucagcuggaacgucacaggagcaggg

SEQ ID NO: 4149285 - RNA, 76 nt, Human
cccugugcacuaucugcauuuuuaaugauuugguuacuuuuguaguuauauuuaagaaguccaguguguaucaggg

SEQ ID NO: 4149286 - RNA, 129 nt, Human
cccugugcauuguucagggcaagccuagagguccuugagccuuugcucuggcggccagcagauggaacugcuggagcuccgggcuguaggaggccaggugcucugcgcucucacuugcagcgggcugag

SEQ ID NO: 4149287 - RNA, 69 nt, Human
cccugugugcccaucugggauggggcuguggguguuccuugauguccucacagaugggugcauagcagg

SEQ ID NO: 4149288 - RNA, 69 nt, Human
cccuguucucagcaucuucaacuuuggggcugccugagaaggcaagcgcagaagcggaggaaggaaggg

SEQ ID NO: 4149289 - RNA, 63 nt, Human
cccuguuuaagaaaccuguaaaggagcucaaaucaaguaaaaucugaugguuucugagcaggg

SEQ ID NO: 4149290 - RNA, 56 nt, Human
cccuguuuauuuuuggagagaacacauuuuugcugcuuuucaggagcuaugcaggg

SEQ ID NO: 4149291 - RNA, 130 nt, Human
cccuguuuucucauugcugaaaaaugguaugcugccuuuugcaaagucuuuauuuuguaucuuuaucuuaaaguggaagauaaagacuuugaaaaagacagcauaucuuuaaagagaauggaaacaaggg

SEQ ID NO: 4149292 - RNA, 63 nt, Human
cccuguuuugugaggcacccacagguagagucuucgacaccuagggggcuucccagagaaggg

SEQ ID NO: 4149293 - RNA, 86 nt, Human
cccuuaaaaaugcuucugaguucuuuggggcagaagugcaagaagaaugcuuucuguaauuaaaagggcaggggcauuugugaggg

SEQ ID NO: 4149294 - RNA, 81 nt, Human
ccgcuccucaugccacuugaagccuuaucagucacuuauacuuuggugugaaugaaggaagggggcuagggagugaagugg

SEQ ID NO: 4149295 - RNA, 71 nt, Human
ccgcugaagccggugacauuucaccaaagcuacucccuuuggaagcagcuggugcaaaugucacucagcgg

SEQ ID NO: 4149296 - RNA, 81 nt, Human
ccgcugacaaagauuccuguguccacgcacuggcaugaucccuccugaucgugccuuucguugacagauccuggaagacgg

SEQ ID NO: 4149297 - RNA, 71 nt, Human
ccgcuggcccuggggcaggaggguacagggaguuggcccugagccccucugaccucagagccgaggcgcgg

SEQ ID NO: 4149298 - RNA, 70 nt, Human
ccgcugucaccagcugcugacaugggcaggucccuuguggggcugccugugcgggucgcuagggcggugg

SEQ ID NO: 4149299 - RNA, 98 nt, Human
ccggaaagcuggcugaaaugcagaucccucacucugacauccugcgucaguacggcugagaauucugcauuuaagcgaccccuugaugcucauucugg

SEQ ID NO: 4149300 - RNA, 65 nt, Human
ccggaagagcuggcccaaucugagcauccccaagaaggugcugggaguagccagguucauguugg

SEQ ID NO: 4149301 - RNA, 56 nt, Human
ccggagagaccccaucugcugggacagaagguccgaagucauuggguguccuucgg

SEQ ID NO: 4149302 - RNA, 84 nt, Human
ccggaguucuggaggcaggcugccaggauacuguguauccauacucgaauauucauccugcaaagucuguuucuaacgcugugg

SEQ ID NO: 4149303 - RNA, 56 nt, Human
ccggcccugcccugcccugcggaacgccggcucugcagcugccucuggcgggccgg

SEQ ID NO: 4149304 - RNA, 129 nt, Human
ccggccgcggggccccggguacuucgccggagcgcgcgcggccgccgagagaguugugggcgaaguaaacuuggcuccucuccucggagucggggagcugcccgcgaagggcgccgaggccgcggccgg

SEQ ID NO: 4149305 - RNA, 104 nt, Human
ccggcgcaugcgugucccgcuccggcgcgguuuagugggugcggccuggagagcccacgccagccggacacugggccacgucggagccgccggggcggcgccgg

SEQ ID NO: 4149306 - RNA, 101 nt, Human
ccggcgucccuagagaagaagcacccagagggccuuuggaguuauccaucgaccuggaucucuccuuggcuuuguuggaucucucauuccuggaccuccgg

SEQ ID NO: 4149307 - RNA, 129 nt, Human
ccggcuaccccuccagcccguugagcccaggcauuuuguaacauaaguggcacuuugcccagauuaaacgucuauggcagagacacuuaucaccuuagaucuuggggucagagcugcuuugaaagccag

SEQ ID NO: 4149308 - RNA, 64 nt, Human
ccggcucggcgaccaggcugaaacucauguuugaauuuagugagccguuuguucguuaguccgg

SEQ ID NO: 4149309 - RNA, 80 nt, Human
ccggcugagacucugcuacaggccgagguugguugauugucuuggcagcuaacaaaagccgaaguaggugucucaguggg

SEQ ID NO: 4149310 - RNA, 56 nt, Human
ccggcugugggcaggaaaccucuguuccucucacaggggccucuccacacagccgg

SEQ ID NO: 4149311 - RNA, 77 nt, Human
ccgggggacccguggcaggcugccugcucuugcucccagggaagcugcugggcagggcagccuugccgggucccagg

SEQ ID NO: 4149312 - RNA, 79 nt, Human
cccuuuuuucauuugggucaguuuuccauaggcuucccaaaucaucuaagucuguguugauaauuccagagacaaaggg

SEQ ID NO: 4149313 - RNA, 126 nt, Human
ccgacgcccuucacuccccccccuuuuuccuccaaaaacuacaucagcgaaacgugaagguccuuagugucugauccguaguuacaucuuggaaaagaaaagggaaagauaaauaaaaaauguugg

SEQ ID NO: 4149314 - RNA, 62 nt, Human
ccgacuguaucuugcauuucagaguucagagaaguuucuuuaacgaaaugcaagaaagaugg

SEQ ID NO: 4149315 - RNA, 71 nt, Human
ccgagaccugaagauacaaaugugggcuuucuugaacuguuuugagaagagcacugcuguauuuuccuugg

SEQ ID NO: 4149316 - RNA, 125 nt, Human
ccgagagccacgcagagccuggccuuggccuuggccuccuggugcuggggcugccgccgcugcggggguugccgcugcgccgggugcugcuggggccgagguugaacagagacgccagcuuucgg

SEQ ID NO: 4149317 - RNA, 77 nt, Human
ccgagcacauucccaggagcugcugguacagcuugccucaauaucuuaucagcaggugaauuccuggaugugcuugg

SEQ ID NO: 4149318 - RNA, 63 nt, Human
ccgagcgggacacauuagucaugcacaaacaagagcagcccuugccugacuuuauuugcuugg

SEQ ID NO: 4149319 - RNA, 56 nt, Human
ccgaggcuggagugcaguggcgcgaucucagcucacugcaagcuccaccucccagg

SEQ ID NO: 4149320 - RNA, 55 nt, Human
ccgaggcuggagugcaguggcgggaucuuggcucacugcaagcuccgccuccugg

SEQ ID NO: 4149321 - RNA, 55 nt, Human
ccgaggcuggagugcaguggcgugaucucgacucacugcaaccuccgccuaccgg

SEQ ID NO: 4149322 - RNA, 83 nt, Human
ccgaggcugggaggacugcagaugggugcaucccugugaagucucagggcugggcucagaccuagugaacuccacggccuggg

SEQ ID NO: 4149323 - RNA, 64 nt, Human
ccgcaaggacuggucacccgcgcugagacaccgccagcugccuaugaccuagccuccaaagcgg

SEQ ID NO: 4149324 - RNA, 55 nt, Human
ccgcagagcaguaucaugaguuggaaugacugccuugcuccuggaugaccugugg

SEQ ID NO: 4149325 - RNA, 61 nt, Human
ccgcagaggcagacccuccagggcggugcagcaccuccacggcgucgucuaccaucugugg

SEQ ID NO: 4149326 - RNA, 93 nt, Human
ccgcagcagaucauuucauauugcuuccguggaguguagcgagucagcuaaauacuuugacgccggugggaauagcgaugauuaugguagcgg

SEQ ID NO: 4149327 - RNA, 80 nt, Human
ccgcaggcuccggggugcccuggcucagcgcagaaaggacgccgcgcacagguacagcccaggccgcccgggagccgcgg

SEQ ID NO: 4149328 - RNA, 57 nt, Human
ccgcagggcaaacccagguguucagggcaaggccuggacacugucugugaccugugg

SEQ ID NO: 4149329 - RNA, 81 nt, Human
ccgcauagugcaggcacagguggacuucacagucagcuggauuugauuaugagucgacugugccacuuaccggcugugugg

SEQ ID NO: 4149330 - RNA, 57 nt, Human
ccgccauuccuacugccugauguccucucaggagggcucugaggauggagcuggugg

SEQ ID NO: 4149331 - RNA, 67 nt, Human
ccgccuugauuccucucuaccugguuguuagacugcugggaaaauauggagagugauuucagugugg

SEQ ID NO: 4149332 - RNA, 121 nt, Human
ccgcgcugccauucuucuccaucugccugggaugcaggggcuguguuuuggguuucauuaugguauccagcaccuaguguagcccugggcacacagcagauguuuuagagggacguguagg

SEQ ID NO: 4149333 - RNA, 130 nt, Human
ccgcuccugcuugaucuccuccaggaucuucucaugcagggaccuuugcuuugguggcaacgggcgcagccgccucucagagaccugcgguggggaagcgagaccugcgguggggaagcaggaccugcgg

SEQ ID NO: 4149334 - RNA, 60 nt, Human
ccgcugcaggcagaaucucccaaugggcuuccaggguuuaccaguuugcauugcagaugg

SEQ ID NO: 4149335 - RNA, 114 nt, Human
ccgcugccccucucaggcccgggagcccgcguaccuggcagucagucuuuccgcagcgccgaggugggugccggagagagacgccgggaccgggacuggcgggccggcuggcgg

SEQ ID NO: 4149336 - RNA, 70 nt, Human
ccgcuggcaccaggugcuggaggacaucaacguucagcuugaaaagccggccagcaucgguaucccucgg

SEQ ID NO: 4149337 - RNA, 82 nt, Human
ccgcugggaaguggagucagaaugcgacaggccucauaauucuccagugggccuccaucuuaucuuacucuguauucccugg

SEQ ID NO: 4149338 - RNA, 92 nt, Human
ccgcugucucuacaacuccagcuccacuuccuucugcccucagcccacccucagagcugaguggaggugagacaggagguguagagcugugg

SEQ ID NO: 4149339 - RNA, 85 nt, Human
ccgcuuggugagguuucggggcugggcggcaucacccaggccuacgugguacacccugccguccaccucgauggccacugagcgg

SEQ ID NO: 4149340 - RNA, 76 nt, Human
ccggaaauggcuccagcuuggcuucaccucccagcgaccaauagggagggaguggaguggggaugcacauugaugg

SEQ ID NO: 4149341 - RNA, 130 nt, Human
ccggagagacgucgcgcuguggccugaaguggcgcaagcuugcuuuguaaauaucuguggucccgauguagugcccagaacguuugugcgaggcagcucugcgcccggguuccagcccgagccucgccgg

SEQ ID NO: 4149342 - RNA, 74 nt, Human
ccggagaugcugcagcucgagggucccgccugcaccauccauggcucucgagauccuucagagcgcggacccgg

SEQ ID NO: 4149343 - RNA, 74 nt, Human
ccggagccaaagcugccuugcugaggagaaauccaaguggguuuccuccucccccaaggcauccagccucccgg

SEQ ID NO: 4149344 - RNA, 73 nt, Human
ccggcguccugguccugccuccccaugcacuggagggcagccgcauaggacagcagguccggggucaagccgg

SEQ ID NO: 4149345 - RNA, 60 nt, Human
ccggcgucucacuuccgccugcgagccuucgggggccgcgcggcucucgcgagauguggg

SEQ ID NO: 4149346 - RNA, 67 nt, Human
ccggcuggccugcuggcguccaggcuguucuuggucagugcgaggggcugcuccaggccaaggcugg

SEQ ID NO: 4149347 - RNA, 67 nt, Human
ccggcuggggcgaggaaugcaggcgccuagagccuuggagcuccugaaacguuccugccgccuccgg

SEQ ID NO: 4149348 - RNA, 96 nt, Human
ccgggagaugccugugagccaaggcuguggugggcuuugagccagacacuuugacucugccucccuugccaggccagguucauuugucucuucugg

SEQ ID NO: 4149349 - RNA, 72 nt, Human
ccgggagcuguaacgagccauugcugcgauuauuauuaucucucguagucaugcauuucauuacagcucagg

SEQ ID NO: 4149350 - RNA, 64 nt, Human
ccgggaggaagaauggaguggagugggcccagcaggaaugucuguuccaccuuucuucauuugg

SEQ ID NO: 4149351 - RNA, 60 nt, Human
ccgggccccucuccgccccacacagcgcaccgacugccacgagggcuggaggggacccgg

SEQ ID NO: 4149352 - RNA, 71 nt, Human
ccgggcggagugggcggugaggauaccacagcuacugcuucccugcacaguucgccuucuccaaggcccgg

SEQ ID NO: 4149353 - RNA, 87 nt, Human
ccgggcgggguucuugggugccccgccuaagccggccugggcgucuccagcugcuuuuagggccgggcucccaggacuuucgcccgg

SEQ ID NO: 4149354 - RNA, 72 nt, Human
ccgggcgugguggcacucaccuguaguuucagcuacucuggaagcugaggcuggagagucacuugaacccgg

SEQ ID NO: 4149355 - RNA, 122 nt, Human
ccgggcguggugucagacgccuguaaucccagcuacucaggaggcugaggcaggagaauugcuugaaccugggaggcggagguugcagugagcugagaucacaccacugcacuccagccugg

SEQ ID NO: 4149356 - RNA, 77 nt, Human
ccggggccugcuccaggcuggggugcagguuggcuggcuggcuguacugacgaggaagccuggagggagagcucugg

SEQ ID NO: 4149357 - RNA, 130 nt, Human
ccggggcuccacaucacacaacuccagcaguuuccaccauucaugcuaauauucuuaguaaaaagcaccccuggaguagaaagcauugugaauggugcccccuggaguuguacgaggcaagaggcccugg

SEQ ID NO: 4149358 - RNA, 94 nt, Human
ccgggggcgucuauccuccuccuggccccaucccucaccugugggggaggcuaagugggugucagggcccugucagagggugagccacccccgg

SEQ ID NO: 4149359 - RNA, 77 nt, Human
ccgggucggcggcgggcuuggcuccagggcccaggaggaacugcugcugcucuucaccauggccucgcugcacccgg

SEQ ID NO: 4149360 - RNA, 72 nt, Human
ccgggugcagugguucacgccuguaaucccagcuacucgggaggcugagacaggagaaucacuugaacccgg

SEQ ID NO: 4149361 - RNA, 94 nt, Human
ccggucugcggccccgcccuccucgcaaguuuuaggcgcucccaaguccccgccccagacuagcccaaaccugcgagcagagcgguagagccgg

SEQ ID NO: 4149362 - RNA, 68 nt, Human
ccggugccugguuuggggaauguucgugggauauguuccaaaggacugacggaccaaucagguacugg

SEQ ID NO: 4149363 - RNA, 65 nt, Human
ccgucauggcacuucuacucuguguuuuccaggaagauagcacagagguggaaguguauaugugg

SEQ ID NO: 4149364 - RNA, 58 nt, Human
ccguccacugugugauacuuaguuauggcagcccuagcaaacucauacaugugggugg

SEQ ID NO: 4149365 - RNA, 64 nt, Human
ccugacuaucuagaaucugaauauucuuauuugggaagaauccccaaacaggugagauagcagg

SEQ ID NO: 4149366 - RNA, 68 nt, Human
ccugacuuaagucuccuguugggcaacaggugcagaaauuucaguuagacaggaggcauaaauucagg

SEQ ID NO: 4149367 - RNA, 119 nt, Human
ccugacuucgcacaccagcugcagagggaauuccaggguuucuguccaggcagucacuggugccuccaggccugggcaagaaggggcguccuccuggguuggugggcugugagcucggg

SEQ ID NO: 4149368 - RNA, 76 nt, Human
ccugagacaucagugcucuugguucuugggccuuuggacuccgaaacuuacacuacugaugacccuuguucucagg

SEQ ID NO: 4149369 - RNA, 74 nt, Human
ccugagagagaagcgaccugguauaagccacuggcugcuauacacaucugguuaauuccuucaauccuuuuagg

SEQ ID NO: 4149370 - RNA, 58 nt, Human
ccugagagccagugccugcccauccuacaacaggaaacagugcaucaaagcucucagg

SEQ ID NO: 4149371 - RNA, 56 nt, Human
ccugagagugguguacaggagauaucaaaucucuauagcauaaacccauuuuuagg

SEQ ID NO: 4149372 - RNA, 56 nt, Human
ccugagaucagugcauuuggugaacuguauguuguguuccagauuggugucucagg

SEQ ID NO: 4149373 - RNA, 101 nt, Human
ccugagauucaagcaauaagugcuuaugguugaaugcuacugaaguguugcaaauuuuguuacacaguauugugacuauaacuugagaauuuaauuugggg

SEQ ID NO: 4149374 - RNA, 57 nt, Human
ccugagauuucauugucuggccucucuaaagggaugauaauggucucaucucauagg

SEQ ID NO: 4149375 - RNA, 92 nt, Human
ccugagcaaggagauggguuaggaggauauuugaguaucuugugaaagucgaugggauucuggauugucugcuugaauauugaauuggcagg

SEQ ID NO: 4149376 - RNA, 58 nt, Human
ccugagcagcucugaggggcgagucucugacgguggggcucccccucguccugccagg

SEQ ID NO: 4149377 - RNA, 58 nt, Human
ccugagcaguuugcacaaaaaaugcauaugaugacauuuugccucuuggcugcuuagg

SEQ ID NO: 4149378 - RNA, 61 nt, Human
ccugagcaugcuuucugaccuguguuuagaaaaaauggacacuaaauggaagugucugagg

SEQ ID NO: 4149379 - RNA, 55 nt, Human
ccugagccugcagccgagcagagcgcgcucacucucgccgguccuggaggccagg

SEQ ID NO: 4149380 - RNA, 62 nt, Human
ccugagccuggcucaugcacucuggccuuccaggucaagcgugggguaugaccagagccagg

SEQ ID NO: 4149381 - RNA, 59 nt, Human
ccugagcugacucuccuuucagacagcuaaagaccuugaaagcaagaagccagcacagg

SEQ ID NO: 4149382 - RNA, 79 nt, Human
ccugagcuucagcacugcugcuguacacacaugaucuguuuuuuacuguuuuuuggcucucagcagugacuggugcugg

SEQ ID NO: 4149383 - RNA, 58 nt, Human
ccugagcuuugcuuuccucaucugugaaaaugacaagagugaggcaagauggcucugg

SEQ ID NO: 4149384 - RNA, 89 nt, Human
ccugagcuuuuccacaaaaucaaugguucccaaguaauucauucuaaaacuaaugcuugagacacauaugaauuuggaggaaccuuagg

SEQ ID NO: 4149385 - RNA, 59 nt, Human
ccugaggaaugagugaggagccaauuguuaagauuauuccuuugccuacauuuuucagg

SEQ ID NO: 4149386 - RNA, 60 nt, Human
ccugaggacacacgcugcaggagagcagccucgagucuuuucugccuucgaggucucagg

SEQ ID NO: 4149387 - RNA, 62 nt, Human
ccugaggaguuauuuuuugauauucuuucacaagagaauuucaguugcuaauaaguucuggg

SEQ ID NO: 4149388 - RNA, 93 nt, Human
ccugagucagggagagguuggggaggugggcuaaggacucucucgagcuaugacugagagcucuccuguccccucccugagcccugaggcagg

SEQ ID NO: 4149389 - RNA, 61 nt, Human
ccugaguccaggccccagggauucuuguuuaauaggccuugggugcagccuggguauuggg

SEQ ID NO: 4149390 - RNA, 79 nt, Human
ccugagucccuagggccccccaaaagcccagaggucaccgggcagguggagggcagugucggggcccagggaugagagg

SEQ ID NO: 4149391 - RNA, 57 nt, Human
ccugagucccugucucucuggcagcacccagugcuuggcaugcagcaggcacucagg

SEQ ID NO: 4149392 - RNA, 67 nt, Human
ccugagucugaggagaagcuaagaaacacaguuuacaucaagaagcugggucucucuugaggcaagg

SEQ ID NO: 4149393 - RNA, 68 nt, Human
ccugagugacuuggccuuccagucuggucccccuucucgccaguccugggcaggucaggccagcuagg

SEQ ID NO: 4149394 - RNA, 56 nt, Human
ccugaguugucaguugcuguagcuucucugagucaaaguaacuuagcaacucuagg

SEQ ID NO: 4149395 - RNA, 62 nt, Human
ccugaguuucuggcuccuuuuuuacaaugugggugcagagcaaggagccuaggaggcucagg

SEQ ID NO: 4149396 - RNA, 80 nt, Human
ccugauaaaagcugaggcaaaagagguucauucagcaaaccuuaugugaauaauuccuuuuugucaagugcuaugucagg

SEQ ID NO: 4149397 - RNA, 118 nt, Human
ccugauagccacagguuggaggcagccagugcauugccgugucuaggucuucagugggaagcucugcccuuguucuccuaagccugguaagucuggcuuuucuaaacaggcagucagg

SEQ ID NO: 4149398 - RNA, 67 nt, Human
ccugaucuuugacugaccucugacccuggccguggacuggcuuugauucagacagucgcaguucugg

SEQ ID NO: 4149399 - RNA, 56 nt, Human
ccugaugagggaaguuuuuuugagcacgugcuauguaucucagacccugugucagg

SEQ ID NO: 4149400 - RNA, 77 nt, Human
ccugaugcgguuuaugggugaccaguccaagccccggggcaaggaugagauggaucugcucuaugaacugcugaagg

SEQ ID NO: 4149401 - RNA, 56 nt, Human
cccaggcuggagugcaguggcgcaaucucugcucacugcaagcucagccucccggg

SEQ ID NO: 4149402 - RNA, 56 nt, Human
cccaggcuggagugcaguggcgcgaucucggcuuauugcaagcucugccucccggg

SEQ ID NO: 4149403 - RNA, 56 nt, Human
cccaggcuggagugcaguggcgcuaucucggcucacugcaagcucagccucccggg

SEQ ID NO: 4149404 - RNA, 56 nt, Human
cccaggcuggagugcaguggugugaucucggcucacugcaaccuccaccucccggg

SEQ ID NO: 4149405 - RNA, 70 nt, Human
cccagggaagaccacuuccuggagggggcuugccacacuuauguucauuccacaguugucuuucacuggg

SEQ ID NO: 4149406 - RNA, 77 nt, Human
cccagggacacccaguuauuaggccaucuucaguagccaauggccaguaauagcuucugguguccccucuucuuggg

SEQ ID NO: 4149407 - RNA, 72 nt, Human
cccagggcagaggcugggaggcuuucaggccacagauuuccaccauuugccaagcuucccugcucuccaggg

SEQ ID NO: 4149408 - RNA, 61 nt, Human
cccagggcaucacauccaguguugggcuuucaauuccaucugccugcuuaugaugccuggg

SEQ ID NO: 4149409 - RNA, 61 nt, Human
cccagggccccauuugcccauggcagcagcacagagcaggcagacagaugagggugcuggg

SEQ ID NO: 4149410 - RNA, 75 nt, Human
cccagggccggccuuugcgagcauucugagcagcgagcagagaaugcucgcuggggcacagguagaggcucuggg

SEQ ID NO: 4149411 - RNA, 66 nt, Human
cccaggggacugccaggaacacagccccaucccggccacgugaucauucucuagccuuccccuggg

SEQ ID NO: 4149412 - RNA, 113 nt, Human
cccaggggcacauggcauggagaguaaauggcagaaucagaauguggacacaaauuuguuugggucugaauccuguguucuuuucauuauaucgagugucuggccuccuuggg

SEQ ID NO: 4149413 - RNA, 57 nt, Human
cccagggugcagggcccucggcuucugguuggugccgcugcagggcugcgccugggg

SEQ ID NO: 4149414 - RNA, 80 nt, Human
cccagggugggcuucuuucugggguccuucggcugcaguacaaguggggcaugcacagaugagacuccaucuacccuggg

SEQ ID NO: 4149415 - RNA, 98 nt, Human
cccaguaaucauuguuuccuuucugguuuggucauagcugggaagagccaaccaaccaaauaugaauaaaccaaggacagauacaaccauuuaagggg

SEQ ID NO: 4149416 - RNA, 63 nt, Human
cccaguaaucggagaguacuuaaauaaggccaaaauaggcccaugguuucuuugauagcuggg

SEQ ID NO: 4149417 - RNA, 55 nt, Human
cccaguaccucuguucccugcuacauucccuacguaaggaauauuuguaucuggg

SEQ ID NO: 4149418 - RNA, 75 nt, Human
cccaguccucccaucuuuugagguccagcuggucccaaauaagacuuucuuuuaccucaaggaugaggcucuggg

SEQ ID NO: 4149419 - RNA, 85 nt, Human
cccagucuuugcuauugugaauaaugccgcaauaaacauacgugugcaugugucuuuauaguagcaugauuuauaguccuuuggg

SEQ ID NO: 4149420 - RNA, 64 nt, Human
cccagugcuauuuggacacagggaacaagggcuccucucuccuccuuuguugagauaaauuggg

SEQ ID NO: 4149421 - RNA, 57 nt, Human
cccaguggaaggaguagaagaccaaugaacuaaggggcguaugccuccuuccacggg

SEQ ID NO: 4149422 - RNA, 61 nt, Human
cccagugggugcugggcucugccgauacuuggucuugaggcagcugggcagcacucauggg

SEQ ID NO: 4149423 - RNA, 78 nt, Human
cccaguuucuuuauuaggguaaggcuuuucuuaggaccaaaguuuuugggcaggcuuuucccuagagggagugcuggg

SEQ ID NO: 4149424 - RNA, 121 nt, Human
cccauacaaaauauaauguccaugcaauauuuauuuaaaaguuuauuuuagcuccggaaagguguugaagauuauucuauuaaaaguugaauuguguuugggauauuuucuauuguauggg

SEQ ID NO: 4149425 - RNA, 72 nt, Human
cccauccagcguuuggccucuuaguuguggagugccacaugguucuguacuucaggggcucuguugggcggg

SEQ ID NO: 4149426 - RNA, 84 nt, Human
cccauccucaucagauuucagaugcucggcaguugacacagcuacagcaaaggacucugagucaucaucucauugugggauggg

SEQ ID NO: 4149427 - RNA, 79 nt, Human
cccaucucuaaaaugggaauauaauuuuagcaaccacacaguggguguucugaagguguaucuguuaauuggagauggg

SEQ ID NO: 4149428 - RNA, 94 nt, Human
cccaucuguuugggcaaacagggugugaacaguguaaaacaugauuaaugcugcaaguuaguauacauucuguguucaaguaugaacagguggg

SEQ ID NO: 4149429 - RNA, 64 nt, Human
cccaucuuaaugaguuucacuuccucaucuaggaaguggcucuccaagaagucacagagauggg

SEQ ID NO: 4149430 - RNA, 71 nt, Human
cccaugcacccccacggaaggccguacgccccaacacucacccccagggcggccgccuccuggggccaggg

SEQ ID NO: 4149431 - RNA, 71 nt, Human
cccaugcccuaaaggacuggcaguauaugacauaaacacaauaaucuugcacacuuccuuuaggccauagg

SEQ ID NO: 4149432 - RNA, 72 nt, Human
cccaugccuaaucuggugugcucuggacuugcaggaucccuggaguugcagcuaccagacauggugcguggg

SEQ ID NO: 4149433 - RNA, 58 nt, Human
cccauggacacugccuguuuugggacccucuggucccucagacagauguguuccuggg

SEQ ID NO: 4149434 - RNA, 82 nt, Human
cccauggugccuucccacccugcgaggcugcacucucaacugggaggcaccagcccccuggcaggguuucagagcucauggg

SEQ ID NO: 4149435 - RNA, 62 nt, Human
cccauuacuucugauguauucuacuggucaaugagccacagaguccgcauuugaggcgaggg

SEQ ID NO: 4149436 - RNA, 71 nt, Human
cccauuagaaagcuguugaaguaauucagccaugagacgacaguggccugaaauaaaguagcagaaguggg

SEQ ID NO: 4149437 - RNA, 88 nt, Human
cccauuauaccacacagcaagagcuaaaugaccaucuuucuagaaugcaguuggggaguucuuugcacagugugugcaugugagaggg

SEQ ID NO: 4149438 - RNA, 58 nt, Human
cccauucccuuuacuguugcauuauaagcugcauacagacagauaccagggacauggg

SEQ ID NO: 4149439 - RNA, 73 nt, Human
cccauugugaagguccagagagaugaucaggacagcucauggcucaguccuggcaccucacuggcuacaaggg

SEQ ID NO: 4149440 - RNA, 56 nt, Human
cccauuuagaccuauucugcccaaaaugcagugguacagaaaccugucaaaguggg

SEQ ID NO: 4149441 - RNA, 59 nt, Human
cccauuucccugggggcaggaggaucacuugcggugcucuaagaacucuaggaauuggg

SEQ ID NO: 4149442 - RNA, 77 nt, Human
cccauuucuugauuccaccagugaagagcacaaauaaagacuaagcccucuuccggauuuauggagagagaagaggg

SEQ ID NO: 4149443 - RNA, 57 nt, Human
ccuggaaaaugccacuuucacaaguguaaacgcuuaacuggaaacuggguuucuagg

SEQ ID NO: 4149444 - RNA, 65 nt, Human
ccuggaagaaucucuacucaaguacuuguuggaaguucuuuggguggaguagggguuuuaacagg

SEQ ID NO: 4149445 - RNA, 68 nt, Human
ccuggaagagucugcauauuuaucaugagucuaaacaaggauuagacuucuaaauagcagcuucuggg

SEQ ID NO: 4149446 - RNA, 95 nt, Human
ccuggaagcacauggcacgaggacagagacagcagcugguaguccaguucuaaaaccaauucugcuucuacugccaaacacugcccaguuccagg

SEQ ID NO: 4149447 - RNA, 118 nt, Human
ccuggaaggccaccauaacuucuggauccugcauggcugcaagaaccucuggaucacuaagaauuucauugaauccaggcauuccagccauuccagacaugcccccucccauuccagg

SEQ ID NO: 4149448 - RNA, 101 nt, Human
ccuggaauuaagcucugaguuucucagcuccacuugcagcuaggcuugguuaaggcuaagccaaugaagugugaguagaaaugcuguauggagcuucuagg

SEQ ID NO: 4149449 - RNA, 65 nt, Human
ccuggaauuguagguuuggccaggaguuugccaggauugcucgaaggucaucuuccaaucccagg

SEQ ID NO: 4149450 - RNA, 101 nt, Human
ccuggacgggaggcucgccgucucccaugcaggugcccgaugccugugugugcccaggcacagggcagaggguccguggcgagcggcagcaccuugucagg

SEQ ID NO: 4149451 - RNA, 69 nt, Human
ccuggagccuggaguggggaacgguagcagacugcugaugcccucagccaccuccaaguucuucucagg

SEQ ID NO: 4149452 - RNA, 56 nt, Human
ccuggagcuucuggugcuagagcaguuucuuuccauccugcccaaggagcuccagg

SEQ ID NO: 4149453 - RNA, 80 nt, Human
ccuggaggaggagguuggagggcugcccugcagggucacugcaccucugcccagagccucuuaccuccagauccuucagg

SEQ ID NO: 4149454 - RNA, 85 nt, Human
ccuggauccgcucccggccccaagcuccacacagccgggaaggaagcucgcguuuguuuugcuggcgccagggauacgguccagg

SEQ ID NO: 4149455 - RNA, 56 nt, Human
ccuggaucuuuguuguaaauaucaaccucaauggcaauuuggagcagugguucagg

SEQ ID NO: 4149456 - RNA, 71 nt, Human
cccccaaaccaucagugagccccuugaugagcagggcucuugccacuucaucaggguggucagucgggggg

SEQ ID NO: 4149457 - RNA, 81 nt, Human
cccccaccaucccaaguugcucugucccaaggcccacaaggaacccugaggggagaagcagcagccugggauuggugcugg

SEQ ID NO: 4149458 - RNA, 59 nt, Human
cccccagagcuccugcacuguccuucccaacccuugggcucccagaggagcuuuggggg

SEQ ID NO: 4149459 - RNA, 79 nt, Human
cccccagaggaaucugguaaagaagacaaacagggccaggcgcgguggcucacuucuuuaaucccagcacuuugggagg

SEQ ID NO: 4149460 - RNA, 76 nt, Human
cccccaggaggcccccaggcucuggagaaccugcggggaaccaaggcuuccugaggcuugggggucagccuggggg

SEQ ID NO: 4149461 - RNA, 94 nt, Human
cccccaggccucagccgggccgaguggguaccggagcaggugcccgugggaccggccggcuggugaccgcugggcuuccggcugguggaggggg

SEQ ID NO: 4149462 - RNA, 66 nt, Human
cccccaguggcaggggaagcagguguggaguggguucaggcuggcuggguccugcagacugggugg

SEQ ID NO: 4149463 - RNA, 61 nt, Human
cccccaugacugcuucaucuugcaucuguggugccuagcauggcagccaguacaugguggg

SEQ ID NO: 4149464 - RNA, 75 nt, Human
cccccaugguaauauagugugugagagagugaaacaccuguuuagcuuuuuuguguauuaagaagcuacaggggg

SEQ ID NO: 4149465 - RNA, 70 nt, Human
cccccauuuucucaccucucagaugggugucauaaaccaucgguuugucuugaggcuggggaaguggggg

SEQ ID NO: 4149466 - RNA, 70 nt, Human
cccccccaggcaccccaggugagcacugucagcugccaagagcccagagcucccaagggguugggguggg

SEQ ID NO: 4149467 - RNA, 82 nt, Human
ccccccugcuuccuccuuauuugggaccaccugguggccagcagaagaccaggggaucugauuuaggaugggagccggaggg

SEQ ID NO: 4149468 - RNA, 63 nt, Human
cccccuacagggacagcacagaggccacuuccuggcuuuacacagcugguucuuguguccggg

SEQ ID NO: 4149469 - RNA, 67 nt, Human
cccccucuacuacugcaggagcuucuuguuugccaggacagggcuauauuccucagagcugaggagg

SEQ ID NO: 4149470 - RNA, 67 nt, Human
cccccucugccgggguccuucaccuugaugggccacaggccccucugaggguccccagcguuggggg

SEQ ID NO: 4149471 - RNA, 64 nt, Human
cccccugggaacugaaugucucgguauaaaacacgauuguacauuuguucaauucugagguggg

SEQ ID NO: 4149472 - RNA, 61 nt, Human
cccccugguguggcugucacagagggaaguggacguccugugguuugaccccaccagaugg

SEQ ID NO: 4149473 - RNA, 60 nt, Human
cccccuuugacugaugaagcaacuccaggagggucagcauguucuuaggucacagggugg

SEQ ID NO: 4149474 - RNA, 82 nt, Human
ccccgaggugcacaggcucuggggcaggauggcugaagcacaaaucucagcucugucaacagcuagcugugugaucuugggg

SEQ ID NO: 4149475 - RNA, 92 nt, Human
ccccgaucaaugaauacaucugaaggcuaugaauacuauaacaaaaagcaggagaugacauaugaccuaagaugugugccaaauguuugggg

SEQ ID NO: 4149476 - RNA, 56 nt, Human
ccccggaagcugaaggaugacugcgggaguuucaguccccuacauaguuccugggg

SEQ ID NO: 4149477 - RNA, 83 nt, Human
ccccggcucuccucuggaugguguauugcaaggagggagcuguucuccccauuaugcagucauuauguggagaucugcugggg

SEQ ID NO: 4149478 - RNA, 75 nt, Human
ccccgucucccuggugacucccaaagcugggccuucaaccuacagcugcguagcggggaaccagggagcugaggg

SEQ ID NO: 4149479 - RNA, 56 nt, Human
ccccuaacuaaagggaagcuaaagaaguuacuucuacacuuuucauuagcuagggg

SEQ ID NO: 4149480 - RNA, 81 nt, Human
ccccuaauugaucuuccugcaagacugagcugcccguccaaauggcagaacagccaacuguguaggaggagagcuuaaggg

SEQ ID NO: 4149481 - RNA, 57 nt, Human
ccccuagaacacgcagacacugagucuucucaggcucaccugugaguccuggcuggg

SEQ ID NO: 4149482 - RNA, 80 nt, Human
ccccuagcgaaucucagcuggugcugcgcagagacagcagucagcgucugccgguggcgcggcccaggaggagcagaggg

SEQ ID NO: 4149483 - RNA, 56 nt, Human
ccccuagcuaaugaaaaguguagaaguaacuucuuuagcuucccuuuaguuagggg

SEQ ID NO: 4149484 - RNA, 55 nt, Human
ccccucaaaaaugccuggucccucugcauaaaggagaacauggcagguggagggg

SEQ ID NO: 4149485 - RNA, 61 nt, Human
ccccucccugggccuggcuugguggggugagcccaacaggugagcucuaucuagggagggg

SEQ ID NO: 4149486 - RNA, 75 nt, Human
ccccuccuggagcauggcuuuggaggauagcaaccccgaacuugcaauccugacugcuaugugaccuuggggggg

SEQ ID NO: 4149487 - RNA, 65 nt, Human
ccccucggcuucagcucaggccccucggggagcaucccuugccgugagacugacagccuuugggg

SEQ ID NO: 4149488 - RNA, 62 nt, Human
ccccucugccaagcuagaacguucccaggcccaaugccuuggggaggggcuggcagaguggg

SEQ ID NO: 4149489 - RNA, 59 nt, Human
ccccucuuccgggcaagccccaggcgugagucacuggagagcgcgacgggaggaagggg

SEQ ID NO: 4149490 - RNA, 55 nt, Human
ccccucuuggcauugagugccaguccucugccaggcucuguguuacaaguugggg

SEQ ID NO: 4149491 - RNA, 59 nt, Human
ccccugagauucuggcuugggacuggacuuggauuuguccagccagaguggcccagggg

SEQ ID NO: 4149492 - RNA, 94 nt, Human
ccccugaggagagcagguuaaggugugguaguuuaguucugcaggaaaaucauaggcagagcucgaggccaacacuucucugccucuguugggg

SEQ ID NO: 4149493 - RNA, 59 nt, Human
ccccugaucuaauuccuuagggucagguagaaguuagccaggcagguguggagaagggg

SEQ ID NO: 4149494 - RNA, 129 nt, Human
ccccugaucucaggugauccaccugccucggccucccaaagugcugggauuacaggcaugagccaccucgcccagcccaauccuagcacuuugagaguccaaggcaggcagaucacuugagcacgggag

SEQ ID NO: 4149495 - RNA, 72 nt, Human
ccccugcagcugggccagggccaccggcaccucccaguacccgcuggugccucugggucccaggugcugggg

SEQ ID NO: 4149496 - RNA, 84 nt, Human
ccccugcagugacagguggcucugacagcucugguuugucagcaggcagacacaugaggaugaggggaucaugaggaugagggg

SEQ ID NO: 4149497 - RNA, 85 nt, Human
ccccugcugacuucaggcucccugcugggcucuggagaugcauagaucaacaaggucccccaggagcuugggauucuaagagggg

SEQ ID NO: 4149498 - RNA, 129 nt, Human
ccccuggcagugagggcucaggcaugucuucuccuuggucauuuguauguuccuccuuaggacuuugaaucuugaaugaggcaugcaaaggggaagggacagcuuagaauccuccugugacagacgugg

SEQ ID NO: 4149499 - RNA, 68 nt, Human
ccccuggcuuggaggguagggugugguguguagauacugaacagcaccuuccuauccaggagaugggg

SEQ ID NO: 4149500 - RNA, 96 nt, Human
ccccuguccucggugacccugggccuugcaucccagagccagcacgcacgccgggcuccccccaugcaggugccccugggacacuggguaucuggg

SEQ ID NO: 4149501 - RNA, 63 nt, Human
ccccuguugggucagauccuggucuaucaugcgacgguggcaccagagggggcucugcagggg

SEQ ID NO: 4149502 - RNA, 61 nt, Human
ccccuuccaggaagcagaaucgggccuggucaaaaaccauuuauuuuccccaaggaagggg

SEQ ID NO: 4149503 - RNA, 56 nt, Human
ccccuuccuguacacuucuugccagagcagaacugggaggugagugugggaaaggg

SEQ ID NO: 4149504 - RNA, 65 nt, Human
ccccuucugaaaccuucaguaugaagccauuauguuuuacccuuuccagguuuuaacauaagggg

SEQ ID NO: 4149505 - RNA, 57 nt, Human
ccccuuggcugcucucaagucccuuuacgaugaggcuggcuuguagcagcgaagggg

SEQ ID NO: 4149506 - RNA, 76 nt, Human
ccccuuugagaaauuacuucagugauggcacagguuuugccuucauccuucugugacuucucagguuggcuggggg

SEQ ID NO: 4149507 - RNA, 103 nt, Human
ccccuuuuuaagaaucagcacccuggguaugaggcaaguuuggaaacugaaugguuuggaaacaucucugccuuuauucauggaguuggggagugaggagggg

SEQ ID NO: 4149508 - RNA, 88 nt, Human
cccgagcugcuccucauaucuguguuucccuuuugcucaggugcuagugcaggagcucgaggagcaucagguacggagccccuucggg

SEQ ID NO: 4149509 - RNA, 101 nt, Human
cccgaggccucacagcugggaaaggagaggagggauuugguuuuggaucacaaguccaggccucccucuccugcacaguccuugggcuggaggagucaggg

SEQ ID NO: 4149510 - RNA, 65 nt, Human
cccgcagggccuuagcagcggcugccgcagcucaaucgcggagcaacuagccgggcgucugcggg

SEQ ID NO: 4149511 - RNA, 104 nt, Human
cccgccacgccucgcgcgcugcggcucuuagaccccuggagccccuuuuuugccagagcuaccgguccacgguuuaaaugaucgcagcgaagauacauaaaggg

SEQ ID NO: 4149512 - RNA, 67 nt, Human
cccgccuccagcccacgcaggccugcccuggccuccugggagcgggcggcgauggcugggguguggg

SEQ ID NO: 4149513 - RNA, 115 nt, Human
cccgcgaggggcucugcacccgcccuugaggcacccucaagcaguggcacgugcugauagguaggcgacagcuugauggugcgcacgcgggcgucggcggagguggccucgcggg

SEQ ID NO: 4149514 - RNA, 71 nt, Human
cccgcggccucugcgccucagccgaccuccaccgcgggugcgugcgggggugcgggggugaggggugcggg

SEQ ID NO: 4149515 - RNA, 56 nt, Human
cccggagccugggacugggggucaugcugcugcguccccuuccacacagcucuagg

SEQ ID NO: 4149516 - RNA, 73 nt, Human
cccgggaaaaagauucaagcggcaaaguccggaggaaacgaggagcaggcuuucaagagucuucuuccagagg

SEQ ID NO: 4149517 - RNA, 101 nt, Human
cccgggaacuguuagaaaugcacauucucagcugggccuuuaccuacggaguugucaacccuggaugggcccugcagugugaguucuagcaagcccacggg

SEQ ID NO: 4149518 - RNA, 80 nt, Human
ccuugcuaaccugcugcuuugauguguaaaucauaaaucaaucaccauuauucacucauuaaagcaggaccuuaacaagg

SEQ ID NO: 4149519 - RNA, 89 nt, Human
ccuugcugagccucaguguccuccucuauacauaugggauaauaucacccaugucauggcguuguggggacuaacugaaaucacuuagg

SEQ ID NO: 4149520 - RNA, 83 nt, Human
ccuugcuuccuucccguucuucuccuugcccuacuccaggaggaacaugaccuugcuuuggagagggacaggaagggaggagg

SEQ ID NO: 4149521 - RNA, 86 nt, Human
ccuuggaagcaaaugauugaagcuauauaaaaaagcucagcaaugcugaagcuuuaggauggguucaucauugaaugucccugagg

SEQ ID NO: 4149522 - RNA, 96 nt, Human
ccuuggagcuuauuggagaucagaugcagaggcuggggguacccaggcugcggagacucccccagcuucugcccguguuugcucuccugccccugg

SEQ ID NO: 4149523 - RNA, 84 nt, Human
ccuuggauguacuggcagaugggcagaaggccuugcaugcuggcuuccugccaugcugucuucuguucugugaggcuuccuagg

SEQ ID NO: 4149524 - RNA, 56 nt, Human
ccuuggcaggggagaaauauauggaggaaaaucaguaccuuuguuuccucccaagg

SEQ ID NO: 4149525 - RNA, 123 nt, Human
ccuuggcucccacucgccugaagggcaggaccuugggccuucccuggcaucuuguugccacagagaccaggagccacaggaggagccggauccccuccuccagggaaggggagcuucacgagg

SEQ ID NO: 4149526 - RNA, 87 nt, Human
ccuugggagaggaugaguguauuuugcacgugagaagaaugauucacauucuucucacgugcaaaauacacucauccucucccaagg

SEQ ID NO: 4149527 - RNA, 59 nt, Human
ccuugggaguggugaccacagcucagggccuggguuggauccugguggcugcccuaggg

SEQ ID NO: 4149528 - RNA, 56 nt, Human
ccuugggggagauugugcaucucuaagaaaccaaaucuuugagugcucucccuggg

SEQ ID NO: 4149529 - RNA, 65 nt, Human
ccuugguagcuauauuuucguuuuauuauaauauauuugauuagcuuugaaugugcugccaaagg

SEQ ID NO: 4149530 - RNA, 71 nt, Human
ccuuggucuagccuuccaaccuaccuuccaaccuggaaauuugggaggugugggaaacgggugaccucagg

SEQ ID NO: 4149531 - RNA, 57 nt, Human
ccuuggucugauaggccagggguaaucucauuucucugggcugcuuaaggaucaagg

SEQ ID NO: 4149532 - RNA, 73 nt, Human
ccuuggugccauaagguuuggggccaugcacaauggcugaugccuguagucccaacacuuugggaggcggagg

SEQ ID NO: 4149533 - RNA, 76 nt, Human
ccuuguaguuguuucccccauugucugucaaaguggagaguaaucccagaugguuugcaugggagggcuacaaagg

SEQ ID NO: 4149534 - RNA, 64 nt, Human
ccuugugugaggucgguuaccugagacaagcaaguguuucucauaaggucagauuucacaaugg

SEQ ID NO: 4149535 - RNA, 63 nt, Human
ccuuguguuuuuacuuacuguccccagugugcuagcuacugcagggacacgaagacaaauagg

SEQ ID NO: 4149536 - RNA, 76 nt, Human
ccuuguuauugugaauaaugccgcaauaaauauacuugugugugucuuuguagcagcaugauuuauaauccuuugg

SEQ ID NO: 4149537 - RNA, 58 nt, Human
ccuuguuucucucccagauaagcuaagguuggcaggggcugaggggagugaggcaggg

SEQ ID NO: 4149538 - RNA, 60 nt, Human
ccuuuaaccucuuugaaccucagugugagugugcuggcaaagaggagagagaggaagagg

SEQ ID NO: 4149539 - RNA, 75 nt, Human
ccuuuaacuuggaucagguuucucucuuuagauuuuuacugagacuccagagugacuauuugucccauucagagg

SEQ ID NO: 4149540 - RNA, 98 nt, Human
ccuuuaauccaucuccuuguuucguuaaaugcuaaaacugacauuacuuaacauaauuaaaguuuucagauuugaugcugaggaagcugcuuuagagg

SEQ ID NO: 4149541 - RNA, 63 nt, Human
ccuuuacaguagcccuuuugaaaccucuaggcagcaggaaacagagaagggcugcucuguugg

SEQ ID NO: 4149542 - RNA, 76 nt, Human
ccuuuacggcaaucaggaugacuauaaggcugcauuuggagugggcucuuuuuaguacacuugacugcuuacaggg

SEQ ID NO: 4149543 - RNA, 55 nt, Human
ccuuuaggccaucuguuccaccuggcuaugaagguuggccugaauggucaagagg

SEQ ID NO: 4149544 - RNA, 129 nt, Human
ccucaaagaccgagcucaaaccuguucucuuccauguugaucucuucagugugagcuguggaacaaucucaugcacagccaucuaagaaauacaaaauuggaaucacagcagguugaggaauugggggg

SEQ ID NO: 4149545 - RNA, 83 nt, Human
ccucaaccugucuuaauauaucaaugauucuuuuuacuguaguuauagauaggguuaauugguguccugaggcaucauggagg

SEQ ID NO: 4149546 - RNA, 70 nt, Human
ccucaacucuuucaagggcccuaguuuggcuuugggaaagucagaaucagggccucuucaaaggaagagg

SEQ ID NO: 4149547 - RNA, 69 nt, Human
ccucaagauuaaaugcuuuguuuguguuucuaggucuccaagcagcuuugaaguauuuggucuccgggg

SEQ ID NO: 4149548 - RNA, 119 nt, Human
ccucaauuguaagucacauuccaauuccagagaugauaaaaugugguaaacaugugucugaagaguaauucaauauaguguuagcucauuugauccucccauugacuccacaaagcagg

SEQ ID NO: 4149549 - RNA, 80 nt, Human
ccucacaacccugaggcaaguacuuucccuuuuuacagaaagaugaaauaauuugccuaaaaggucacauaguuguuagg

SEQ ID NO: 4149550 - RNA, 104 nt, Human
ccucacaagauuuuuuaguacgaacauuuuacaaaaguugcuuuauaguuccacaaaggcauauaaaugcacuuuugaaauauaucagacagaugguuaggagg

SEQ ID NO: 4149551 - RNA, 59 nt, Human
ccucacacagggagucugaggggauaguguuuaagugagcacucaggcuuccucugagg

SEQ ID NO: 4149552 - RNA, 64 nt, Human
ccucacagccaguaaucuaccccugucccccuuaucccaggccugcauaguuauuggcuggagg

SEQ ID NO: 4149553 - RNA, 56 nt, Human
ccucacagcccuccucuagcacugaucuggcugaacucugcagagcagcugugggg

SEQ ID NO: 4149554 - RNA, 68 nt, Human
ccucacaugccugagguggucugcaaauguuuguaaauggaaugaauggggauucucaggcagguagg

SEQ ID NO: 4149555 - RNA, 83 nt, Human
ccucaccauggacuggaccuggagaauccucuucuugguggcagcagccacagguaaggggcucccaagucccagugaugagg

SEQ ID NO: 4149556 - RNA, 73 nt, Human
ccucaccuggggaucuaggcugauggagcagccacugucuggcagugcuggcucuaggcugagacaggugagg

SEQ ID NO: 4149557 - RNA, 72 nt, Human
ccucaccuugcugagugacauugguaaaucccagucccggaauucaggccguguccuucagggagagugugg

SEQ ID NO: 4149558 - RNA, 111 nt, Human
ccucacgcgucuuauucauuacugcuagucccgauucuuccuauacaggaaguaaacgcauuguccugaugggaggaaugggucauggaaguuuaauuccuuugccucagg

SEQ ID NO: 4149559 - RNA, 58 nt, Human
ccucacuuuccccaguaaggggacccaugggucuuucugcugagugggcaggugcagg

SEQ ID NO: 4149560 - RNA, 62 nt, Human
ccucacuuuguuuucauugaaugccauauguaccaagcacugcagugaacacaaagagaagg

SEQ ID NO: 4149561 - RNA, 84 nt, Human
ccucagaaaggacagagugagggugguauuucucuaucuauucgaaucaguacuuuccuacuccuuacuuuucuuuugcuuagg

SEQ ID NO: 4149562 - RNA, 88 nt, Human
ccucagaauuaccccaccagaggggugggagcugggauauuuauacaccagcugccaucagccuuuggaugagguuguuccuuugagg

SEQ ID NO: 4149563 - RNA, 64 nt, Human
ccucagacuucucuuuaguacuaaaugucauaaugaaaugacauuaaaauggagaauuuugagg

SEQ ID NO: 4149564 - RNA, 74 nt, Human
ccucagaguauauagugcagcacagaaugauaauagccucauugcucucacucugcuugggccauaucuggagg

SEQ ID NO: 4149565 - RNA, 61 nt, Human
ccucagaugcgcgggugccuaucuguauauucauuauacagaacugcacgugcacgcgagg

SEQ ID NO: 4149566 - RNA, 100 nt, Human
ccucagaugggccacgugcccucgugggacccucauugucaccgugagcucuuuccaaggggacgccaccagugggggccugggcaggaggcagcugagg

SEQ ID NO: 4149567 - RNA, 68 nt, Human
ccucagauuccaucuuucagcuuuguuggaucuguuuggauuuagggaaauaagagguggaaaggagg

SEQ ID NO: 4149568 - RNA, 69 nt, Human
ccucagauugcuggaguagaaaacuuaacuuuccaaaacacugaguuguuuucagcccagcauuagagg

SEQ ID NO: 4149569 - RNA, 59 nt, Human
ccucagcauccuggugaaguagacaucacaaucacacaccacagauuuggaagcugagg

SEQ ID NO: 4149570 - RNA, 70 nt, Human
ccucagccagccacuucccaggagccauggagguggagacuugggggguccugggccaagggcugugagg

SEQ ID NO: 4149571 - RNA, 64 nt, Human
ccucaggaacccuggucuccugcucuaccaagucagcacggaguugaggggugcagaccugggg

SEQ ID NO: 4149572 - RNA, 63 nt, Human
ccucaggacagcugggccaccaccaggacucuaguaugguggacaaggugcugucccaugagg

SEQ ID NO: 4149573 - RNA, 89 nt, Human
ccucaggagcugaugauugucucuccucucuccaaguucaaaacugcagccacagggggugagggacaaagccauaucucuuguucagg

SEQ ID NO: 4149574 - RNA, 55 nt, Human
ccucaggauccgcaggugcaguggccgcgcucccacugaacuuguguucuagagg

SEQ ID NO: 4149575 - RNA, 72 nt, Human
ccucagggcuuugcugaccccauucugagucaggccccagccaggucuugggagaugggacagaaagugagg

SEQ ID NO: 4149576 - RNA, 57 nt, Human
ccucaggggugcccacagcugccccacgcaguagcugcuugugggaauccuuggagg

SEQ ID NO: 4149577 - RNA, 57 nt, Human
ccucagucuugaauuagccagaugugccuuucaguccuuggcugagcuggacugagg

SEQ ID NO: 4149578 - RNA, 63 nt, Human
ccucagugcaggaauuuccuuagaaacauuacaaauggcucuaaauucuuuccuggguugagg

SEQ ID NO: 4149579 - RNA, 56 nt, Human
ccucagugcguacugaacagugaccaugugcuggaugcugugugaggcacuagagg

SEQ ID NO: 4149580 - RNA, 109 nt, Human
ccucagugcugguggcuggagguuggaccauguuggggguuucaccaggauuuacuauagucuugcagacagcuuccagccugcucuuagucagcccucccgguucagg

SEQ ID NO: 4149581 - RNA, 70 nt, Human
ccucaguguuagguucucagcuucugagagugcugucaucuguggucuccaaagcuuaggacuacugagg

SEQ ID NO: 4149582 - RNA, 64 nt, Human
ccucaguuuccucauguuaauauggaauauucccuguuucauaguaugaugaggauugacuagg

SEQ ID NO: 4149583 - RNA, 125 nt, Human
ccucauaauuuuauaauucaaugcagcuaaauguugcuuaaaauuuggcuccauaugugucaucuguuaaauaauuaauguagcauuuagcugauuuagaaagaauugaaauauuuuuaugcugg

SEQ ID NO: 4149584 - RNA, 72 nt, Human
ccucauaugguggaagggggaagacagcucuguggagacucuuuuauaagggcacuaaucccuuccaugagg

SEQ ID NO: 4149585 - RNA, 63 nt, Human
ccucauauuugaguuggaauccuggagaucauuuaguccaguucuaucauuuuagagaugagg

SEQ ID NO: 4149586 - RNA, 79 nt, Human
ccucaucguguuguuucuuugcuuguuuuaguuucuucuaugugugcuaagcauuaugguaaagaaguaaaugaugagg

SEQ ID NO: 4149587 - RNA, 100 nt, Human
ccucaugaaugggauuugugcccuuaugaaagaggcccaagggagcuuguuugcccccucugccacaugagggcacagcaagaaggugccauccgugagg

SEQ ID NO: 4149588 - RNA, 89 nt, Human
ccucaugucagcaugugcagugccacagaggugaagcccacugcccuuuuguagucagcucucucuguggccaugcgcacucauucagg

SEQ ID NO: 4149589 - RNA, 69 nt, Human
ccucauguguccuauucuuggagcuaaaggagccugcagcucagaaaugccaguagguacaugugaagg

SEQ ID NO: 4149590 - RNA, 97 nt, Human
ccuccaaaggacucugauaggccaagguuagaccaauugcuguguccagaauggggcacuuuggcuaaccuggguuaucagccuacccuguggcagg

SEQ ID NO: 4149591 - RNA, 90 nt, Human
ccuccaaauguuuagcaauaggagggaaggagguggguggugucaggcugauuuacauauugucuauuguucaagugcuacaugaggagg

SEQ ID NO: 4149592 - RNA, 74 nt, Human
ccucuuacuaagacauugauauuaggcaguguaggggaugucuuuuguugccuacuuauuaaaauuguaagggg

SEQ ID NO: 4149593 - RNA, 76 nt, Human
ccucuuagcuuagauucagcauugcaaacucuguucuguccaagagccaggcaggcaauguugacugguggagcgg

SEQ ID NO: 4149594 - RNA, 78 nt, Human
ccucuucuaggcaugcuuacuccugggcucauaucauucaggcuaagagacugaaagagccccaggggccugcagagg

SEQ ID NO: 4149595 - RNA, 57 nt, Human
ccucuugauugguuggaagcggcacuuacuacguggcggauucugacugugaagagg

SEQ ID NO: 4149596 - RNA, 59 nt, Human
ccucuugcugagguaaccauauccugcagccauggcuggagaagguggcucagcaaagg

SEQ ID NO: 4149597 - RNA, 75 nt, Human
ccucuugggcuuuggucuuagaaucaguauuuauuuauuaggagcugggagaaggacuaaauggccuagaagagg

SEQ ID NO: 4149598 - RNA, 81 nt, Human
ccucuuggguccccagcugaaggagagaaugaaagauaccccuucucauuaucuuggcucauuucuguuggaacuaagugg

SEQ ID NO: 4149599 - RNA, 64 nt, Human
ccucuugucuaggcugccauggugugacagcugaccacuucuggcucuaacuaggcaucagagg

SEQ ID NO: 4149600 - RNA, 81 nt, Human
ccucuuguuucuacauuuguaaccagauucaagucucaccaggccccagagugugaguuacaaagugugaaccaugagagg

SEQ ID NO: 4149601 - RNA, 59 nt, Human
ccucuuucugguuuguggauggcugccuucuagcuauagccucacagggcagagagggg

SEQ ID NO: 4149602 - RNA, 113 nt, Human
ccccuccagccucuuucauuugcaaccuuccauucaguucugcugguucugcucugugucaagagugucagagaauuggggggaaggugaauuaugagguggcuggcaggagg

SEQ ID NO: 4149603 - RNA, 107 nt, Human
ccccucccccacgcccacugccuccccagaacccuccaggcugcagcuccugugugagaucgggccccaguccugcggggacuggauggguggggguggggaagggg

SEQ ID NO: 4149604 - RNA, 65 nt, Human
ccccucccuccugcuccuccugcugugugaugcccagcaguguggaagcugaggggcagcugggg

SEQ ID NO: 4149605 - RNA, 130 nt, Human
ccccucgacgugugggcucauggggugauggcacuggucucgucgcuggcagaagacggucauaccgcgaugcccuugguuuccaggaugaggcugggcacaugccgcacagacaagcccacgcggaugg

SEQ ID NO: 4149606 - RNA, 76 nt, Human
ccccucucugaauccuugcccaggugcauugcauugagccagcacuagcacccagauagcaaggauuagagagggg

SEQ ID NO: 4149607 - RNA, 66 nt, Human
ccccucuuuuuguuguauaagcccuuucuacucccagacaggcugauagaccauaaauaagggggg

SEQ ID NO: 4149608 - RNA, 66 nt, Human
ccccugccauagucaaaucuaaacauguuccagaaguguauauguuuggguauggucauggagggg

SEQ ID NO: 4149609 - RNA, 88 nt, Human
ccccugcugaaacacuaccgccagccagcgggcucaugcaccuuggccuguugcuccuaggggucaccugugcuauucagccaagggg

SEQ ID NO: 4149610 - RNA, 104 nt, Human
ccccugcuuaguaggagcucuggguggcaggugucuccuggugcauaguggggcugggcgugggaggcccugcccagagcuccucgcugguguugcagcagggg

SEQ ID NO: 4149611 - RNA, 59 nt, Human
ccccuggacucuauaaauguuagggguuugccugacagugagcuugggguacuuugggg

SEQ ID NO: 4149612 - RNA, 87 nt, Human
ccccuguucucacacucccagagcuggcagcagcuucuccucaugucugaggagccuagccaugcuugugggagaugauggcauggg

SEQ ID NO: 4149613 - RNA, 77 nt, Human
ccccuucuuguucuguccucacugcaggccuauuaaacacagugaagccacaguggggcggagauuuugguaggagg

SEQ ID NO: 4149614 - RNA, 72 nt, Human
ccccuuguuugugggauuguucuggauacugacuguguuccucuugagaaagaacagccaauaaaagagggg

SEQ ID NO: 4149615 - RNA, 76 nt, Human
ccccuuuccuccugugaggcuuaagcccagggucaccuccucugugaaucuucccuucccucauaggagguggggg

SEQ ID NO: 4149616 - RNA, 123 nt, Human
ccccuuuccuuucgucuggccgugcuggcggggcuggcucugggccucagacacucuggaaucgccaaggucugagcucagggccuggcccccuucccaggcuaacagccgggaggacggggg

SEQ ID NO: 4149617 - RNA, 58 nt, Human
ccccuuucucccgcgucuggcccgccccgcugugugaggcuugcgugggaggaggggg

SEQ ID NO: 4149618 - RNA, 104 nt, Human
cccgaagugugaccuuccaggcccacaggguggcuggcgcugcgcuucuucguggcccgcgacagugcggccaccuucaucggccaguggcgcacugaucuggg

SEQ ID NO: 4149619 - RNA, 69 nt, Human
cccgagagaguucugagcuuuccaaauauggaugcuuuuugcauucccaaagcaucacgaacauuuggg

SEQ ID NO: 4149620 - RNA, 90 nt, Human
cccgagcccuggaguccucuccuagguccugggcauccagacaacaaauggggggcacaggccaugggaggacagcaugagagguuuggg

SEQ ID NO: 4149621 - RNA, 70 nt, Human
cccgagccugguggugucuuccucuggccgccgcguggagugcucggagcagaaggcgccgccggccggg

SEQ ID NO: 4149622 - RNA, 64 nt, Human
cccgcagggccugccugguuccuggaagucuucccagucuucccagccagcccgggcccugggg

SEQ ID NO: 4149623 - RNA, 67 nt, Human
cccgccggcccgcaggugacccagcgcuggaaaaacgccagcgacguggccuggcgagcuggcgcgg

SEQ ID NO: 4149624 - RNA, 100 nt, Human
cccgcgccgguggaguagggggcaggagagaccugcugccucuggcgccaaccuuuccauucagugcgucuuuccugccuagcccacguucccgggccgg

SEQ ID NO: 4149625 - RNA, 75 nt, Human
cccgcuccccuccaccgggcgagagaaccggggcgcgccccucuccagcucuccccgguacgagcggccgcgugg

SEQ ID NO: 4149626 - RNA, 77 nt, Human
cccggaacaaacacggguagauggcaccaccugguggccgcacugccacagagccaucccagccugugguuccaggg

SEQ ID NO: 4149627 - RNA, 69 nt, Human
cccggagucccggguccugcuuccugcucagguuuuggucuggaaucuucaggguccuggggcuccggg

SEQ ID NO: 4149628 - RNA, 70 nt, Human
cccggcccccgccuggcccauugcagggcagcacccaguuguuaucguggaggcccaggcggcagccggg

SEQ ID NO: 4149629 - RNA, 60 nt, Human
cccggccuggaauccugcaugcuccagcuccugcugugucugccugggauccauucuggg

SEQ ID NO: 4149630 - RNA, 56 nt, Human
cccgggaggaggaaguugcagugagcugagauggcacaacugcacuccugccuggg

SEQ ID NO: 4149631 - RNA, 77 nt, Human
cccgggagugccugggggaggugcaaggccaccugcugagcauggguucuggagggccucccuuggugucucccggg

SEQ ID NO: 4149632 - RNA, 103 nt, Human
cccgggccacgugcguccccgguucgcgggcagcucugacccucuccaggccagccuggaccgcagggaugcccggcacuggcuggagacuguggcgcccggg

SEQ ID NO: 4149633 - RNA, 107 nt, Human
cccgggcccgcccugcccgccgugcgccucagccucgugcgccucggggagccggacagcgccggggccggggagccgcccgccacgcccgcggggcugggcucggg

SEQ ID NO: 4149634 - RNA, 58 nt, Human
cccgggcuacagguagcccaggccacccccagagggcuguggcugccucuggcccugg

SEQ ID NO: 4149635 - RNA, 129 nt, Human
cccgguaauuaguguaaacccuuugucugccuuugauacccacagcuucuccccgcugcggcuuccuccgccuggagcgcgggcggggagggccuguggggagggcggccagaccccugauccccgcgg

SEQ ID NO: 4149636 - RNA, 57 nt, Human
cccgguagcuuaggaugcggcccccuugguuagggagggaucugcuaggcaaugggg

SEQ ID NO: 4149637 - RNA, 102 nt, Human
cccgguaucuuauuaauucugcauguuaugaaauaaauauagaucagacaauugcagugaugguucuaucuuuuuauuaugcauuugguucuuggugccggg

SEQ ID NO: 4149638 - RNA, 86 nt, Human
cccggugugucugcagggcaggcuggcccccgggggcugcaaccgcaguccucaguaaggaucgucagcucugacaggcgacuggg

SEQ ID NO: 4149639 - RNA, 74 nt, Human
cccgguuuuacagagcaggcuacuggggcuuggaugggucaagggaccuacuuaaguucacagagccagcuggg

SEQ ID NO: 4149640 - RNA, 79 nt, Human
cccgucccuuccuggucagguaacugggcugaagggcacucacccuugggcuggggacucuguccuucuggagagcggg

SEQ ID NO: 4149641 - RNA, 62 nt, Human
cccgugaguuacagagugagauuuuaaaagguaaaaugaaauuccauuaugauaauuucggg

SEQ ID NO: 4149642 - RNA, 82 nt, Human
cccgugaucccugagguuucugcauucugacccuaugauuuaaguccccagggacuucagcugcaguuauguuuagggaggg

SEQ ID NO: 4149643 - RNA, 63 nt, Human
cccguuccucccugaguggggacagcuucagcaucugcagcauccacucacugggagaggggg

SEQ ID NO: 4149644 - RNA, 69 nt, Human
cccuaaaccacccaccucacagcauagugcagagauguccuggcagugcuucuggugugugggaugggg

SEQ ID NO: 4149645 - RNA, 113 nt, Human
cccuaaauguacuuguugaagcccuaacucaaauaccucuccaugugacuuuauuuggaaacagguuguuacagagguaauuaguuaagaugaggucauaacggaguagaggg

SEQ ID NO: 4149646 - RNA, 74 nt, Human
cccuaacuagcgguuugacuuugagcacaucacugccuccuccgugccucaguuuccucuucuguugaaugggg

SEQ ID NO: 4149647 - RNA, 63 nt, Human
cccuaacuuuauuugcuaaguagagccuagcuuagguaaaucuaaugcaauuagaaauuaggg

SEQ ID NO: 4149648 - RNA, 61 nt, Human
cccuaaggcagcccagucuguguauaauuggugcggcacagaccccaggagggccucaggg

SEQ ID NO: 4149649 - RNA, 66 nt, Human
cccuaaguccugugcccauaucuuagcuuccagauauaauguggcugugaaguagcaggggcaggg

SEQ ID NO: 4149650 - RNA, 126 nt, Human
cccuacagcuuacuggcacuuggauuuucuuugaagauggcaaauuuagaaacuuauuuucucauaguucuggaguuugagcacuucaauaucaaggugccagccaauucagaaucugcuaaaggg

SEQ ID NO: 4149651 - RNA, 78 nt, Human
cccuaccuccuuugggucugcccacuacucuccauucccaaggauuguuggcugagagugggacagugggagggaggg

SEQ ID NO: 4149652 - RNA, 130 nt, Human
cccuaccuucugagaaucauuugcauguaauccucucuuaugaaaauuucuacaccaguuaggguucuugguugaaaauaacagaaauauuuccaggugaaggaaagugcauucaaaucuaugguacagg

SEQ ID NO: 4149653 - RNA, 59 nt, Human
cccuacgugauagcuauuaccaucuuuauuucacaaguaaggaagcugagauguagagg

SEQ ID NO: 4149654 - RNA, 76 nt, Human
cccuacuaucaagguuucauggaaaaucuaggcaaggcagaacuuccucagaaggacaagagacaaagaagugggg

SEQ ID NO: 4149655 - RNA, 70 nt, Human
cccuacuccagcucuuaacugcggaagcuuucauugauuugauuuguuuuuagcaaaggagggagaaggg

SEQ ID NO: 4149656 - RNA, 90 nt, Human
cccuacuuuuguucuguuuaguuuugacaguaagucagagacuuggucaauaaaaugauugugcuuacuguuuacugucgaaccuuaggg

SEQ ID NO: 4149657 - RNA, 77 nt, Human
cccuagagugugugucuccacugugcuauuuuucagaagaauaugaggaacaguacucggaggccagacuugugggg

SEQ ID NO: 4149658 - RNA, 92 nt, Human
cccuagcugucuucggcggagggcggggccgcuaaucacuuuccagaguggggccgcgguccugcccucgcuugugagggcccaggcugggg

SEQ ID NO: 4149659 - RNA, 57 nt, Human
cccuaggagcuucagagagaaccuggcccugccagcaccuugauuuggggcuucggg

SEQ ID NO: 4149660 - RNA, 64 nt, Human
cccuaggcugggcucuuggcuuuauuacccaugcacauugaaaguucagcgcaaaagucaaggg

SEQ ID NO: 4149661 - RNA, 71 nt, Human
cccuaguucaauguacuuuuccagaaggcuuaaguuccuugucuaugucauaagauucauuguaauuaggg

SEQ ID NO: 4149662 - RNA, 100 nt, Human
cccuauccccuccccagguggcuucuuggagacauacgaggcucugugugacuacaauggcuucccuuuccgagaggagauucagugggugaggguaggg

SEQ ID NO: 4149663 - RNA, 59 nt, Human
ccuguauuuuaauucguguuuucuugggaggagagagggcauggaguguagguggaagg

SEQ ID NO: 4149664 - RNA, 82 nt, Human
ccugucacagaccaggaaaaccacuuuugauaccugaaagucaaaguuacuugugguuuucuuugguugcacugauuaaagg

SEQ ID NO: 4149665 - RNA, 130 nt, Human
ccugucagaucagcugugguauuagauucucaugggagcucaaacccaguggugaaccaugcaugcaagagacauggguugugugcuccucaugagacucuacuaacuaaugccugaugaucugaagugg

SEQ ID NO: 4149666 - RNA, 69 nt, Human
ccugucaugaagccugcuggaccaagcucaugcuguagccaguacaagugaaaucagaggcuuugcagg

SEQ ID NO: 4149667 - RNA, 55 nt, Human
ccuguccagaauuuuugcaaccggaaagagggcaaagaacaucggagugggcggg

SEQ ID NO: 4149668 - RNA, 77 nt, Human
ccuguccaucauuuugguuguugcuuuccuuuuccuggcagacagggccuaaaguuucaauagaggaaguggggagg

SEQ ID NO: 4149669 - RNA, 78 nt, Human
ccuguccuggcccagcgaggccaccuacaggugagacguccccuguagacgggguuccuggugucaggagguaucagg

SEQ ID NO: 4149670 - RNA, 96 nt, Human
ccugucucucuuguagaguagucaaacuguaguguccauuuuuguauuuacuagggugaugcauuggaaaacuauggcucaacaaaagaguucagg

SEQ ID NO: 4149671 - RNA, 94 nt, Human
ccugucugagauugugcagggaagugcagggccugcccagcaggauuuccguucugugugugcugcccucaaaaugucuacacacucagauggg

SEQ ID NO: 4149672 - RNA, 58 nt, Human
ccugugaagccaggaaaaggacccuaccaguggguccugagagccuuggcuucagagg

SEQ ID NO: 4149673 - RNA, 59 nt, Human
ccugugacuuggcaaaccuccaugaggaaggcucaagggauuggaagagcagucacagg

SEQ ID NO: 4149674 - RNA, 80 nt, Human
ccugugagcuggcuuuucagaugcugcggaguaauucccucuaacccacacugaagcuccaggaucugaaaguucgcggg

SEQ ID NO: 4149675 - RNA, 123 nt, Human
ccugugauucuuggcaugcugcucaccacugucugacccuggcccauugcugugccucugagccaggcggcgccugcccaugggcuagagagagcagaguggaggggcaugacccugcacagg

SEQ ID NO: 4149676 - RNA, 90 nt, Human
ccugugcaggagucaguugcagucaggacacagcaugaacaugaggauccccgcucagcuccuggccuuccugcugcucugucucccagg

SEQ ID NO: 4149677 - RNA, 122 nt, Human
ccugugcaugauccgagcuaaggagugggacccugcuggcuugacagaggccugggagaagcagggcuuagcuccuucugugcaccagccauccaucuucugugcuuuggaucagguaaggg

SEQ ID NO: 4149678 - RNA, 68 nt, Human
ccugugcauugaguuugcacccugcagagaaugaacacaggaguguaauaaagugacucagagccagg

SEQ ID NO: 4149679 - RNA, 58 nt, Human
ccugugccagccccuucugcuguucuccucccugcagcacggguacagccuggccagg

SEQ ID NO: 4149680 - RNA, 61 nt, Human
ccugugcuggacccuggaaggugguaagcagcuugccugcccuuucugauccagucagagg

SEQ ID NO: 4149681 - RNA, 55 nt, Human
ccugugcugggaaaacacggagguugcuaagcccuuugugugucacgugcacagg

SEQ ID NO: 4149682 - RNA, 61 nt, Human
ccgggccgccccgcguuucuuagauguccgugugcuauugagaagccgccgggcagccugg

SEQ ID NO: 4149683 - RNA, 69 nt, Human
ccgggcggugcagggcucacucggcuggcgucccgggggaugggccaccaggagucuccgcuggcccgg

SEQ ID NO: 4149684 - RNA, 70 nt, Human
ccgggcguuggcauuugccuguaguccuagcuauucgggaggcugagggaggagaauugcuugaacccgg

SEQ ID NO: 4149685 - RNA, 95 nt, Human
ccgggcucaaucaauucuuccaccucagccuccagaguagcuugcauagucccagauacuugggaggcugagguaggaggauugauugagccagg

SEQ ID NO: 4149686 - RNA, 69 nt, Human
ccgggcugucugcugugcacugagcagaaacaaguuuuuaauucucuccuugacaggcaggcagacugg

SEQ ID NO: 4149687 - RNA, 77 nt, Human
ccggggaggcugaggcaggaguucaggcugcgggacaccccugcagccuggcuucgcgccuccguuucugcaucugg

SEQ ID NO: 4149688 - RNA, 61 nt, Human
ccgggggcaggguaaaccgagguaaguagcucuguguuacugccugcuacuaugcccacgg

SEQ ID NO: 4149689 - RNA, 65 nt, Human
ccggggguugucagguuugguacgccaagcuggucggcugguuccacuaaccugagagccuuugg

SEQ ID NO: 4149690 - RNA, 90 nt, Human
ccgggucgggagccccucguggccaggcguccgcgcggcucaagaccgagguccgccacgcugggccgcucgugggcggcucucacccgg

SEQ ID NO: 4149691 - RNA, 63 nt, Human
ccgggucugcuccaccugcagcccuucggucgcgccugggcuucgcgguggagcgggacgcgg

SEQ ID NO: 4149692 - RNA, 56 nt, Human
ccggguugagguucccauagaugguuuuuguccguuucuuggucuucccgaccugg

SEQ ID NO: 4149693 - RNA, 115 nt, Human
ccggguuugcuuucuucucagccugcgaggcuccucauucaguaugcuguguugugugguuagcuguuccauagucauacugaaaguggcuucucagaugcugcuugaguccugg

SEQ ID NO: 4149694 - RNA, 68 nt, Human
ccggucaaguugacacuuuaaaacugaucaucagagcagcucucaagugugaguuuuaaagucacugg

SEQ ID NO: 4149695 - RNA, 129 nt, Human
ccggugagggccaaggggagcuggaagggucucucuuguuagcccaggaagcccagggaccaguggguccccccgaaagccccugugcuugcagcaguguccaccccagugucuaacaguccucccggg

SEQ ID NO: 4149696 - RNA, 95 nt, Human
ccguaaucagguaaaaaaggaucacagaugaugagcaguuccucccaagacacacaggcuguaggaacaggccucguuuucuauuuucaccgcgg

SEQ ID NO: 4149697 - RNA, 84 nt, Human
ccguacucuccugaggggacaggacucauccaggcucucaucaagucugcaacuugugauuugucucuuccaagcagaguuugg

SEQ ID NO: 4149698 - RNA, 98 nt, Human
ccgucauucauugaacagauguuuuaugcuucagaugaggguuuuuaguaccugagaccaacauugacuaauagaacuuuuuguaaugauugaaaugg

SEQ ID NO: 4149699 - RNA, 83 nt, Human
ccgucguaccaguguucuggaauccuaugagagggacaaacaaucagaacccaguagcaguauuccggaauacuuuuugaggg

SEQ ID NO: 4149700 - RNA, 77 nt, Human
ccgucuucaccuccuuucuggggcuucagcaccugcaaggaugcuuaggcuggagaaacaggaggaggaagaggagg

SEQ ID NO: 4149701 - RNA, 71 nt, Human
ccgugaccucaguacugcaguuugguuggugucuuaaccaagcucaauggucugaguauucaggguuacgg

SEQ ID NO: 4149702 - RNA, 82 nt, Human
ccgugauggggggggaauggaggaaaagucuguuuaugauuaugaauugaacuuugaaccauuccuauuguuccugccaagg

SEQ ID NO: 4149703 - RNA, 71 nt, Human
ccgugcggccucggggcccggcucucagcgcccuccagcagagccccgcggccagccucgggccgcaaugg

SEQ ID NO: 4149704 - RNA, 73 nt, Human
ccgugcgugccucgcgugaaagcuccgccuuccgucagacggacgugggucgggacuccgccucgcacguggg

SEQ ID NO: 4149705 - RNA, 62 nt, Human
ccguggcgagcaugagucacucugggccucaucugaacccuaucuuggcaucuugcuugugg

SEQ ID NO: 4149706 - RNA, 72 nt, Human
ccgugguuacuggcugggccugagggcugugcgccaucugggcaagguucagggcuaccaguggguggacgg

SEQ ID NO: 4149707 - RNA, 83 nt, Human
ccguguaauaaaugacuguugguguugauuaaauagugagacucagccgaggcacuuaaucaaucuccgaagccguuuacagg

SEQ ID NO: 4149708 - RNA, 86 nt, Human
ccguguccucggaucccgcgggcccgcauugccaggcgcugcgcccagcgcugggccgaccugggcugcagguacaggggucacgg

SEQ ID NO: 4149709 - RNA, 71 nt, Human
ccgugucuuguaugcugaugacaccaccuaagucucucucucaggauaaugguguugcauacggagcuugg

SEQ ID NO: 4149710 - RNA, 63 nt, Human
ccgugugcauauguguguauacaaacacgcaugcaugccuggauggacauacguaugcacagg

SEQ ID NO: 4149711 - RNA, 123 nt, Human
ccguguuugcugugccuucgggaucguuugugcuauucuagcugcuguuucacaauaaaggcgaacagggugaaagcaguuuagauaggcaaaggaaaagaaucaagggacagacuggcaugg

SEQ ID NO: 4149712 - RNA, 129 nt, Human
ccguuaauuauaucacaguuaauuguuggaauguaugggaggcagcagggcaccuaauuuuguuuuguuuuguuuuaagacagggucuugcucuguugcccaggcuagaguacaguggugugaucaugg

SEQ ID NO: 4149713 - RNA, 62 nt, Human
ccguuauuuucuucuuaaaaaaaccuuuuuaaaggaaggugugaagagaugggaagagaugg

SEQ ID NO: 4149714 - RNA, 85 nt, Human
ccguucguggcccaccgugguggucaccaaauugagggcuuccuggaaggaccuccucacggugcccauccacugggucaugugg

SEQ ID NO: 4149715 - RNA, 61 nt, Human
ccguugacagcugccacaaaggccaugaugagagucaauggagaugaugacaguguugcgg

SEQ ID NO: 4149716 - RNA, 70 nt, Human
ccuaaacccccuguugggaaucaccuuuauuugcuguugcgguuaaagugaucuugucagguuguuuagg

SEQ ID NO: 4149717 - RNA, 97 nt, Human
ccuaaagcaaauccuugaaagauucuaauuuuaaguugaacauguacauguaaucauuaacauuucucuuagaguuggacuuugcuuuugcugcagg

SEQ ID NO: 4149718 - RNA, 108 nt, Human
ccuaaauggucucagaaccaugaucuugucuuuauuucauauuccaacuuaagugguguaauaugcuuaacaauggguggaauaaaucaguucugagaagcacuaagg

SEQ ID NO: 4149719 - RNA, 88 nt, Human
ccuaacaagccagaugguauaguagggagagcacuggucugagaguuaaagacccaguucugccacuacuuuacccuaggaucuuggg

SEQ ID NO: 4149720 - RNA, 78 nt, Human
ccuaacaguucguucuucauggguucuuuuaggauauguugaagccgaccucuuccuccccaaagagagcgugucagg

SEQ ID NO: 4149721 - RNA, 94 nt, Human
ccuaacauuuaacugcagugaaagggaaguuugguucaagacagucugaggaaucucuccauacuugccuuuggccucugcaguugacucuggg

SEQ ID NO: 4149722 - RNA, 59 nt, Human
ccuaaccugucucccauuucuccagccugggcggaggcagggaaaggagagacaguagg

SEQ ID NO: 4149723 - RNA, 57 nt, Human
ccuaagaccucaaucaauaguguucucaaaggagaaagcaauguuagaggccuuagg

SEQ ID NO: 4149724 - RNA, 102 nt, Human
ccuaagccuagcgcccucaccuguucaacagcaauaaucaggccugucuugccuaccucacuagauuauugcaagcagugaagggacgugaacaggcucugg

SEQ ID NO: 4149725 - RNA, 73 nt, Human
ccuaagcgcuuggcacugugccuggcacauuuacuauuugugaauuggaagcuagugaccgaguuaacaaagg

SEQ ID NO: 4149726 - RNA, 67 nt, Human
ccuaaguugagaagccaguagcugagagcuaucucuccccaauucuuacugguguuucagucuuggg

SEQ ID NO: 4149727 - RNA, 68 nt, Human
ccuaauauguggaugaauaaagugcagacauacuaucuugccuuugcuuuuguucuucaauaaauagg

SEQ ID NO: 4149728 - RNA, 67 nt, Human
ccuaaucacagaaggcagucuucuagugaauucaauuaacuggaaaaugccuugugugaguuaaugg

SEQ ID NO: 4149729 - RNA, 58 nt, Human
ccuaaucucuugagugcuuaguuacauuacaugucuuaagcacuguuaguagaaaagg

SEQ ID NO: 4149730 - RNA, 74 nt, Human
ccuaaugcaguagguauuaaagaaguaaauccuauuccuuaauucugcuucucacuucuugccucugcauaagg

SEQ ID NO: 4149731 - RNA, 80 nt, Human
ccuaauucugccuucuuggccacuucccugagagcacaucugacacacuaucauggcuucaaggaagcaggcagaauggg

SEQ ID NO: 4149732 - RNA, 87 nt, Human
ccuacaauggaucauuagaaugggacagauuccuggaagaguucuagaacauccaguaucaaaguccuaguccaaucucccuguagg

SEQ ID NO: 4149733 - RNA, 69 nt, Human
ccuacaauuuaauuucugaagccagaaauauaaauggauuuuuauaauggcuucugaguauuagguggg

SEQ ID NO: 4149734 - RNA, 55 nt, Human
ccuacagacaaaccagugacuagauacauuagcucuuucuggaguugucugaagg

SEQ ID NO: 4149735 - RNA, 68 nt, Human
ccuccaacaauuauaaauauuuucuagggguaacgauaugugcccuugugacuguacuuguguggagg

SEQ ID NO: 4149736 - RNA, 57 nt, Human
ccuccacucuggccucucagguucagacaccauucaggcagcacacagcaguggagg

SEQ ID NO: 4149737 - RNA, 83 nt, Human
ccuccacuuuuccccucuuugguuaaucacacagauucugcugagaauugugccuuuacacaaagauugaacagccuuggagg

SEQ ID NO: 4149738 - RNA, 78 nt, Human
ccuccagcucuggagggggcggccccugugggcacagcccagcguguguuccuggggaccugccuucccugagcgagg

SEQ ID NO: 4149739 - RNA, 58 nt, Human
ccuuccucacccucucugcuucccacugggggagcccuggcaugagaugugagggagg

SEQ ID NO: 4149740 - RNA, 64 nt, Human
ccuuccucagcaggucuguguaccagcuucguacaaggcuggugcaaauccauccuguugaagg

SEQ ID NO: 4149741 - RNA, 63 nt, Human
ccuuccucuagccuaguaaugccuguucauccuucagcucagguaucacuuccuuagggaagg

SEQ ID NO: 4149742 - RNA, 78 nt, Human
ccuuccucuugggcccuggaaaugaggcaugugcgcgccuccuccgugcacccagggccaggcguugaagacggaagg

SEQ ID NO: 4149743 - RNA, 60 nt, Human
ccuuccugcuuaacauauggucaaguugggaaccaauugcuaaguuaaagcgggagcagg

SEQ ID NO: 4149744 - RNA, 129 nt, Human
ccuuccuggugggacucuggucuuugcugccagaacagcucaucuggcccagaguguaucccuucuguuggcacaggugggguucuuguguuagcaacagccaccgagaccaccagccaccuggaagag

SEQ ID NO: 4149745 - RNA, 67 nt, Human
ccuuccuuccugucuuccuuacugaucuugggaaaggccugccuagugcgggaggauggagguaggg

SEQ ID NO: 4149746 - RNA, 69 nt, Human
ccuucgccccggaggcugacggcaccaucuucuucccagagaggaggccgucacccuuccugaagaggg

SEQ ID NO: 4149747 - RNA, 85 nt, Human
ccuucguguggagauguuucugcauugccuuaaauacagccuaugucugcuuuugagaauuaauagcaggaaaaauugucgaagg

SEQ ID NO: 4149748 - RNA, 111 nt, Human
ccuucuagguguucaucauccugaggacuggcaguggcagcagaaagagggcuccucuuucccaguagcucucccagaauucaaggauugacucaaacuagcccaguuagg

SEQ ID NO: 4149749 - RNA, 57 nt, Human
ccuucuauuguacugaggaauaaagcuuuaauuuagagcaugucucagucaacaagg

SEQ ID NO: 4149750 - RNA, 68 nt, Human
ccuucuccccuaaauccccaguguucucaguuuccagggcacaggagaaggaucuggcugggaggagg

SEQ ID NO: 4149751 - RNA, 56 nt, Human
ccuucuccuuucuuuuaaaaugucagguuaagucugauaaacuggagagguggagg

SEQ ID NO: 4149752 - RNA, 58 nt, Human
ccuucucuaggccuuauaggucuucuugcucaagagaagauuaaaaucugugagaagg

SEQ ID NO: 4149753 - RNA, 74 nt, Human
ccuucucuuuaauccuugauacugguacuagugcucuccacaugcaaugcaccuuggcagggauucagaugggg

SEQ ID NO: 4149754 - RNA, 62 nt, Human
ccuucugaauuuaaaauguuuaaaaagguuuaaaagccuuuuaaacugcagaauuuagaagg

SEQ ID NO: 4149755 - RNA, 62 nt, Human
ccuucugggaggcuggcugucauaacuccuuauguuugcacagcauuccacgguuuauaagg

SEQ ID NO: 4149756 - RNA, 62 nt, Human
ccuucugucucccucauauugaugcaugacuggugugaauggguagagagagagaaaggagg

SEQ ID NO: 4149757 - RNA, 58 nt, Human
ccuucuucgugaucucaguugauuuuugcaucugcauuuaucuagauuauugagaagg

SEQ ID NO: 4149758 - RNA, 76 nt, Human
ccuucuucuggccauccucccuugacuccugcuuuuccagugggagauggagcugggagguggugguagaagaagg

SEQ ID NO: 4149759 - RNA, 62 nt, Human
ccuucuuugaaauacugagaguuacacaaugaaugugauaucucuuucauuuuagagucagg

SEQ ID NO: 4149760 - RNA, 57 nt, Human
ccuucuuuggcuuggauaugguuggcuacucguugccaaucacaugucaagagcagg

SEQ ID NO: 4149761 - RNA, 91 nt, Human
ccuucuuuuccacucuuuuccucucuuuccuggcuggccucuaggucaggccugaggaauugaggggguaagucaggaucccagcaggagg

SEQ ID NO: 4149762 - RNA, 101 nt, Human
ccuucuuuuccucuaccaguaaucuuaacacuggcgggauugcuaauaacagcaauggaaugaauagcagggcccacuaggggagauuacugagaagaagg

SEQ ID NO: 4149763 - RNA, 72 nt, Human
ccuugaaacaggccaggcucccaccuugcuugugcaacagccacuccaggggccagaagccuggccucaggg

SEQ ID NO: 4149764 - RNA, 60 nt, Human
ccuugaaaugagaaaaaguuggagcuuaaguaagugaauugaagcuauuuccauucaagg

SEQ ID NO: 4149765 - RNA, 64 nt, Human
ccuugaagaagaguuggugaauuaaggaaauguucucaaugagucacuaucacuuucucugagg

SEQ ID NO: 4149766 - RNA, 118 nt, Human
ccuugacagcuuugagcauaaauguagguauuuaggaagaugaguaucaacuugcaacucucacuuuuugcagacgcauuguuccuaaacaucccuaaugcugaucauagcuccaggg

SEQ ID NO: 4149767 - RNA, 67 nt, Human
ccuugacucaagugcaagcccugcaugacacggugcaugcaggcuccaggugcacauaugagcgugg

SEQ ID NO: 4149768 - RNA, 94 nt, Human
ccuugagagguugcugaaagcccugacuggcuccagaaaugggcaguguuaccucuucaguggguuucaguagcuguaaacuugaaacuuaagg

SEQ ID NO: 4149769 - RNA, 60 nt, Human
ccuugaggaaccugagucugaucauuuuuguguugggaaaugacauaugguuucugaagg

SEQ ID NO: 4149770 - RNA, 80 nt, Human
ccuugaguuugcaaccuuaauagguuaacuguggugaggaaaaaacacauagacagcuagggcugcagggaccucagagg

SEQ ID NO: 4149771 - RNA, 66 nt, Human
ccuugauccuugcucagccacuacuccugauaugcccucaagaagugcauaguaauggagucaagg

SEQ ID NO: 4149772 - RNA, 68 nt, Human
ccuugauuagauauuuuuauugcaaaaaguaaaaaauauuuuuauugcaauaaaguguguauuugagg

SEQ ID NO: 4149773 - RNA, 55 nt, Human
ccuugcagaccucccauggcugccugcucuguagggccucaggagggcugcaugg

SEQ ID NO: 4149774 - RNA, 65 nt, Human
ccuugcaggggaacaggcagugaguauauaaauuaauaaaacauuguugucaccucuguacuagg

SEQ ID NO: 4149775 - RNA, 55 nt, Human
ccuugcaguuguuacuguagccucucugagccucaguuuccucaacugcaaaagg

SEQ ID NO: 4149776 - RNA, 97 nt, Human
ccuugcccacgcccaccggccaugccccaggccucaccugcccaccuagaaccucugaguaggauaggguggggcuuuuagcaggcagguuacaagg

SEQ ID NO: 4149777 - RNA, 87 nt, Human
ccuugccccuugccccuuuccauggcucuccuagggugcggguugcggggcuuugggcagcuuggacuggggagacuaggugcaagg

SEQ ID NO: 4149778 - RNA, 70 nt, Human
ccuugcucggucaugcuguccccagccuagcucagugggaggggagugggacaggugauucagagcaggg

SEQ ID NO: 4149779 - RNA, 130 nt, Human
ccuugcucuuguaggagcucccugggccccuggguuccccacucugggccaccacaauccaugcagcaugcagguuuguuccguuucccagauggagaggcugagggcuuaccacaggguuccgucaagg

SEQ ID NO: 4149780 - RNA, 83 nt, Human
ccuugcuuucaaaggccagcuuguagggcugguggaaacaaccaaauacccaucgccauauagaaaggcccaagagagcaagg

SEQ ID NO: 4149781 - RNA, 68 nt, Human
ccuuggaaagagguucuaauuuaacuauccugguaaacaagaaggaaauaaaggauuucugaccaagg

SEQ ID NO: 4149782 - RNA, 96 nt, Human
ccuuggaaccuccuaugugcugcaucuuuggauggaaauuggagucccagagacaaaugaggcuccacccugcuuccagaagcucagaguccaggg

SEQ ID NO: 4149783 - RNA, 99 nt, Human
ccuuggacaaauucuuaccucaguuugcauaucugugaaauggagauacuauugguacucauuuuauagaguuguguagauuaagugauuaauccaugg

SEQ ID NO: 4149784 - RNA, 59 nt, Human
ccuuggagaagacagugccaggaagaggaguugcuuggcacaugacauucuccauaagg

SEQ ID NO: 4149785 - RNA, 79 nt, Human
ccuuggcagggggagcuccucaaccccgaaccuugcacagcugagugggagaaaccagaggggucuuuuguugucaggg

SEQ ID NO: 4149786 - RNA, 64 nt, Human
ccuuggcgaaucagaccacagcaggacuuuauuaauuaaauugcuguaggcugauugcugaagg

SEQ ID NO: 4149787 - RNA, 63 nt, Human
ccuuggcuauaaucucugaauguaucauacuccuauacauuucaugaguuauuauaguggggg

SEQ ID NO: 4149788 - RNA, 55 nt, Human
ccuuggcugguaagccaaaugaaagcaggguuuucauagaggaagccagucuugg

SEQ ID NO: 4149789 - RNA, 69 nt, Human
ccuugggccugccccaggcuucagcucauacaaaaggugcaaggguccauauggggcaggagccugagg

SEQ ID NO: 4149790 - RNA, 83 nt, Human
ccuuggggaaagugagccuauaaacaaguccacacugaaauauuagugauggguaacuguuuagggagcucccucucccaggg

SEQ ID NO: 4149791 - RNA, 58 nt, Human
ccuuggggaaauagagacccuuguaagaaugaggucuuguauuugauuccuuccaagg

SEQ ID NO: 4149792 - RNA, 70 nt, Human
ccuuggggccuccccaagcagcagggauucaccagggaaccccgcucaggcugggugaggcucuggaagg

SEQ ID NO: 4149793 - RNA, 59 nt, Human
ccuugggucuaggccagggaguauucaaggauguucuccagguaugccugaauucaagg

SEQ ID NO: 4149794 - RNA, 71 nt, Human
ccuuguaguacucagcauuaaaggaaauccuguggaaaacgagguccugaugaucucugagagccccaggg

SEQ ID NO: 4149795 - RNA, 68 nt, Human
ccuugucccuggaaguguuucaagcaaaggauaaaugcuccucacucaggacagauuccagagaaagg

SEQ ID NO: 4149796 - RNA, 63 nt, Human
ccuugugacuaacuuacaccauuacacauacuuugcuucugaugguuaaguucugucaaaugg

SEQ ID NO: 4149797 - RNA, 102 nt, Human
ccuugugauagagaagaucacuaucuuauguucugaugacucuccaaagaggguaggauucuguuuaaguagucucagggccugguuaucuuuauuucaagg

SEQ ID NO: 4149798 - RNA, 56 nt, Human
ccuugugcucaguagccugagaaggacgguaacaggucaaggcugcugggccaggg

SEQ ID NO: 4149799 - RNA, 67 nt, Human
ccuuguggcaucggagagauagaggggccaguucaucggcuucucccuucuucugauugagaugggg

SEQ ID NO: 4149800 - RNA, 73 nt, Human
ccuuguuuucagugguaguugcuaaucuaauguguucauuacugagcuuguagcugcaucacuccaaauucgg

SEQ ID NO: 4149801 - RNA, 63 nt, Human
ccuuguuuuuaugaacauccaggaugcccaggagagugucccugguuacguauaaagaugagg

SEQ ID NO: 4149802 - RNA, 73 nt, Human
ccuuuaaaugcaaggcacauuccuuuucuuagaacagagaucaggaaacuuuuugugugauuuuguguaaagg

SEQ ID NO: 4149803 - RNA, 86 nt, Human
ccuuuaaugguugcacacaguuagagguagaguccagcccacagcuucccagguaagggcucuauccuacuguuuacccaccaagg

SEQ ID NO: 4149804 - RNA, 68 nt, Human
ccuuuacuucuuuuuuauauacuguacuuccuuuuaaucgugcagaauauuauggaaaaaguacaagg

SEQ ID NO: 4149805 - RNA, 67 nt, Human
ccuuuagcugugacguaucucuauggaagaauguggccuuucucuaaagauauuuauggcaaaacgg

SEQ ID NO: 4149806 - RNA, 76 nt, Human
ccuuuaguucccaugagagggugguggugacugauuucauuagauacagcagcccaccuucuucugaggcugaggg

SEQ ID NO: 4149807 - RNA, 62 nt, Human
ccuuuaguugcuuuaguugagcugcuccucuagcagcagcuccagcccaggcagcuccuugg

SEQ ID NO: 4149808 - RNA, 74 nt, Human
ccuuuauguuccuccucugaagugaauuuuaugccuguggaaagugccagaauaggaggccaggaaaaugaagg

SEQ ID NO: 4149809 - RNA, 60 nt, Human
ccuuuauuuucuguagcuuuucuaaacuccacaaggagaaauaggcacuggaauuaaggg

SEQ ID NO: 4149810 - RNA, 78 nt, Human
cuacccgcaccggggaccccagucugaaauccuggcauuuauuuaaggaugcagcugguaucccauggauucgaaugg

SEQ ID NO: 4149811 - RNA, 57 nt, Human
cuaugaugucccuaggcagguaguuggcaauugauagugaaagaugggauaucauag

SEQ ID NO: 4149812 - RNA, 76 nt, Human
cuaugcaccccuaguguaugcacaaugaucauaggcaguacauagcuacagcauuguucaacacugacuugcauag

SEQ ID NO: 4149813 - RNA, 60 nt, Human
cuaugccauuagcuucugaagcccuugaaucaagauuuaagaggaguagcuguggcacag

SEQ ID NO: 4149814 - RNA, 130 nt, Human
cuaugcccucaguuugucccuuucugggggcccugccgucugggcaucagacugcgggcgggucuaccaucagccaagcgcaggggaugcauucuccgagacgguucccagguggugcugugagggcagg

SEQ ID NO: 4149815 - RNA, 63 nt, Human
cuaugccuggaccccaucuaccauuauuuaauuuauuugguauaggaugagggucaggcauag

SEQ ID NO: 4149816 - RNA, 64 nt, Human
cuaugcuuugauuuccucagcugugaguugugaacaaugcuuguuguugagaguuagaacaugg

SEQ ID NO: 4149817 - RNA, 55 nt, Human
cuaugggauguggucuaaaugcuuugccugggcaucagagguugccacucccugg

SEQ ID NO: 4149818 - RNA, 85 nt, Human
cuaugguauucuugaugcaagguauguuauuguuaucauuuauuuaucagaugcucaguauaugcucuuucaucaaauaguauag

SEQ ID NO: 4149819 - RNA, 60 nt, Human
cuauggucuggaccgagguccuugaaugccaggccccaugggccucggacuucaucguag

SEQ ID NO: 4149820 - RNA, 57 nt, Human
cuaugguuucugccacaacuacucaucucuaccauuguagugcaaaggcagccauag

SEQ ID NO: 4149821 - RNA, 79 nt, Human
cuaugucaucagagagugaaaaggauaugucuuguguuagauggaaaaaaugggcaugucacaauucuuaaugggaugg

SEQ ID NO: 4149822 - RNA, 65 nt, Human
cgcaucgcccagcucaucucccacaaccaggcggugguggacgaugcccagcuggacaacgugcg

SEQ ID NO: 4149823 - RNA, 73 nt, Human
cgcauggagcuggaggccuugccugcaggcacaggaaccugcugcuaguggagagccuugaggguuccaagug

SEQ ID NO: 4149824 - RNA, 129 nt, Human
cgcauuaaaaagaccuagagagauucagcaguacugaggccuggccccaccacagaccaaugaaagcagaauaucuggggaggggucaggcaucuuuauucuuugaacuccucagcugauuuuaagagg

SEQ ID NO: 4149825 - RNA, 90 nt, Human
cgcauuuuauuaaaauaagaacaagaacaccuacaguucuagauucagaaagcuggauuguaguuguguccuuguaacuuaaaagaugug

SEQ ID NO: 4149826 - RNA, 78 nt, Human
cgccaaugcaagcaagauggucacaacacacuaagauauguguucaguacuuguaucauuggguuuguguuacuggug

SEQ ID NO: 4149827 - RNA, 63 nt, Human
cgccaccaugccuggcuaauuuuuuguauuuuuaguagagacagguuggucaggcuggucuug

SEQ ID NO: 4149828 - RNA, 64 nt, Human
cgccacuaggcucgcuacgaggaagcgccgcugaggguccaucuuuuuaagagaucuagugacg

SEQ ID NO: 4149829 - RNA, 79 nt, Human
cgccacuuaaugaaccuguuuguggagaguccaccuggugccugccuggcuuuaggaacccgcagcaguccgaguggug

SEQ ID NO: 4149830 - RNA, 75 nt, Human
cgccagcccugggucccggcuucuauccaccgggugugacccggcugggcggccugcuugggacccagggcggug

SEQ ID NO: 4149831 - RNA, 61 nt, Human
cgccagggcucccgcgguguccgggaagugacucuuccuggcagagggcggccucgaggcg

SEQ ID NO: 4149832 - RNA, 61 nt, Human
cgccagggcucgcucuugcccuucgccuggaaggccgaggaacggagcgggccgagcagcg

SEQ ID NO: 4149833 - RNA, 65 nt, Human
cgccagggcuucagagguuuuggcagggacucauguuuggccgggugacccaggagcccuuggcg

SEQ ID NO: 4149834 - RNA, 73 nt, Human
cgccauagugaauugucucagacguugauagaugaagugucugcgugggaguaauacagcuucuuuaugaacg

SEQ ID NO: 4149835 - RNA, 59 nt, Human
cgcccaccuccaggcggaugcuuuccguggaggccagcagcuccuggaggugagaggcg

SEQ ID NO: 4149836 - RNA, 89 nt, Human
cgcccccaccgcugcucgugccaggacgcgcaguuugcaguugcagcucuggcacuggcgcgggauggcggagcuucccuuggauggcg

SEQ ID NO: 4149837 - RNA, 74 nt, Human
cgccccuggaaccucaggucggacuugggcgggacccggcaggucuggacagggcagagaccgagucaggggcg

SEQ ID NO: 4149838 - RNA, 70 nt, Human
cgcccuaagggaagaugcugggugauugccacgccucccucugagcuccuggcuucauucucuuagggug

SEQ ID NO: 4149839 - RNA, 86 nt, Human
cgcccucccaccucugggggcuuccuuacccucuuauuuugauuguaaaacaagcaucccagggucagguuaagggagucauggug

SEQ ID NO: 4149840 - RNA, 58 nt, Human
cgcccucugucaccuugcagacggcuuucucuccgaaugucugcaagugucagaggcg

SEQ ID NO: 4149841 - RNA, 90 nt, Human
cgccgagacaacugggagaggcgcgggacucgcccguuccgcggaacgccgggaaggggucaccuccugaugaaguuuccgguuccggug

SEQ ID NO: 4149842 - RNA, 76 nt, Human
cgccggcagccaggacaugcacggggccgggagugcauucacccccugcgcccggcacgucauaaagcugugggug

SEQ ID NO: 4149843 - RNA, 66 nt, Human
cgccuccauguuucagcaucuacaucaugggcuugcuccuggaauggacuaaaaacaauggaggug

SEQ ID NO: 4149844 - RNA, 95 nt, Human
cgccuccgcagcauccucgcggccucugcggccuuucccuccucucgucugggcuaggcccaguagucgacggcgcuggucggcugaggcaggcg

SEQ ID NO: 4149845 - RNA, 82 nt, Human
cgccugcccccgcagcuccacagccugcgugcgccggacccacuccugcagcuccugugcugagugugccuuggugcaggcg

SEQ ID NO: 4149846 - RNA, 57 nt, Human
cgccuuccuucuaaaaauagccaaccccccaaugcgggaaaggugggaggugaggug

SEQ ID NO: 4149847 - RNA, 56 nt, Human
cgcgaggccaggacaugaaagcugaggggccauccucucauguggcuggccacgug

SEQ ID NO: 4149848 - RNA, 63 nt, Human
cgcgcucauuuccgccuccuucucgggcacucagcauuccggacgggggcggagagaggagcg

SEQ ID NO: 4149849 - RNA, 57 nt, Human
cgcggcuccucccugccugggcagugaccauugcuaggggcuggcguggagccugcg

SEQ ID NO: 4149850 - RNA, 69 nt, Human
cgcggcuguaacaaaauaccuuggauugggugauuuauaaauaauagaaagguauuuuuugcaguucug

SEQ ID NO: 4149851 - RNA, 65 nt, Human
cgcgggccaauuccaggagccggcggcggcgagccgcgcccuggcugauaccggaaaggccugug

SEQ ID NO: 4149852 - RNA, 69 nt, Human
cgcggucucagcccucgccagcagccacgcgcgucugggggcggcgcgcugcgagcggcugagaccgcg

SEQ ID NO: 4149853 - RNA, 62 nt, Human
cgcguggcuccgcaggcuccauucuccacacagucgucuaggggggcgccaggagccccgcg

SEQ ID NO: 4149854 - RNA, 62 nt, Human
cgcuacaugcccuugaugugaaagucauucccauauggagucaucaucugggcuugggggug

SEQ ID NO: 4149855 - RNA, 55 nt, Human
cgcucagacagacaccagccagcuucaccuugugcugccucugcgacucugggcg

SEQ ID NO: 4149856 - RNA, 62 nt, Human
cgcucgcgccgcaccgguccaccagguacuccaccacguccagguggccguagcgggcggcg

SEQ ID NO: 4149857 - RNA, 65 nt, Human
cgcucugcucccuuccuccuugauguuucuguaaagagcauuuggauuuugaagagaguauugug

SEQ ID NO: 4149858 - RNA, 64 nt, Human
cgcugacucugggauuuucuuauaaaaaugccugauggacgggaggaagaucuggaggucggcg

SEQ ID NO: 4149859 - RNA, 55 nt, Human
cgcugagaggugacagcgugcuggcccuccucacagcccucgcucgcucucggcg

SEQ ID NO: 4149860 - RNA, 55 nt, Human
cgcugccugcgccaccaccacgucccugacgugaaauaugggggcgcaggccgcg

SEQ ID NO: 4149861 - RNA, 59 nt, Human
cgcugcgaggcgcccuuguugcugcccaucugcaggcugacauugagcgugucgcagug

SEQ ID NO: 4149862 - RNA, 56 nt, Human
cgcugcuuaugagacuggcacgugccgugugugacgugugggccugugaagcggcg

SEQ ID NO: 4149863 - RNA, 55 nt, Human
cgcuggcucccaugagcucucacgguuuugcugugcuuuguugaugacggccacg

SEQ ID NO: 4149864 - RNA, 55 nt, Human
cgcugugccauggauucaguucaggucaagugauguuccugguuuaugggcagug

SEQ ID NO: 4149865 - RNA, 60 nt, Human
cgcuguguggcugugccgucacguguguaccccugcuuuguggcugugccgucacacgug

SEQ ID NO: 4149866 - RNA, 109 nt, Human
cgcuuauuaggguguaaccguggucacaguacuuaauucucuaaauuugauuccugagcaacaaaguggggaaugauaguauuggugcuguuacuauuaugauaaugug

SEQ ID NO: 4149867 - RNA, 73 nt, Human
cgcuugaaccugggaggcggagguuguagugagccgagauugcgccacugcacuccagccuagcaaauaagug

SEQ ID NO: 4149868 - RNA, 70 nt, Human
cgcuuguucuuuucggccugugagaaggccacaaacaguuguuacuuuuucaagucaaagaggguaugcg

SEQ ID NO: 4149869 - RNA, 76 nt, Human
cgcuuuaacaccagggcagcagccuagucuugcagugacuccugaugggcauuagugcuguuugcugaggagggcg

SEQ ID NO: 4149870 - RNA, 85 nt, Human
cgcuuuugcgugggcagcugcagggauggugacucgggcuagcucagauguggcugccguuaguccccagcugcgcgcucccccg

SEQ ID NO: 4149871 - RNA, 64 nt, Human
cggaaagaugcagaguugcuuaagcauccaagcaaaauuguauguugucaucugcauuccacug

SEQ ID NO: 4149872 - RNA, 77 nt, Human
cggaacccggaucccacgaccccggcccuaccuuucuccgugccgcugggcugcgucggggaagccacgggguuccg

SEQ ID NO: 4149873 - RNA, 56 nt, Human
cggaagacaguccgcucuuucaaugcuguggcuaucuuggagagcugcugcuuccg

SEQ ID NO: 4149874 - RNA, 90 nt, Human
cggaauuuacuguuucuacuguugccaaggucacagggaaguggacacuuucaugugcaauuagcaauauaaguuaggacaauauuucug

SEQ ID NO: 4149875 - RNA, 75 nt, Human
cggacgcagaugagcagccuggauguugggcagcccaccccagagagcggcccagggucccugcucucugugcug

SEQ ID NO: 4149876 - RNA, 80 nt, Human
cggacuuggguuuuccuggcagucaggugcuuugcacaauuuauauggcacagugacaacccaggauaaauuugucucug

SEQ ID NO: 4149877 - RNA, 75 nt, Human
cggagcagcugcagagggcucccccuuccuaagcuucuucucauuggcaggguggcaucucucugagcuguucug

SEQ ID NO: 4149878 - RNA, 125 nt, Human
cggagcaucucagaaucuacgguuugaccuccugccaauucucauggugucuuuauacauuuuaacacaaaaauaagauguuuucacuugagagcgagagggaaaugaacuguuaaggugcucug

SEQ ID NO: 4149879 - RNA, 77 nt, Human
cggagcgcagagagaggggcugccuggccaggcagggucagcgggccccagcagacccuccucugcucccagcucug

SEQ ID NO: 4149880 - RNA, 67 nt, Human
cggaggccuggcugucaguccccaacuaguagggccugugggguacccugggaccgccaggccaccg

SEQ ID NO: 4149881 - RNA, 78 nt, Human
cggaggcuggaauucugcggcuggggacagcuguugcugcaauugagcugcacugacuuccccggcugcacagccacg

SEQ ID NO: 4149882 - RNA, 63 nt, Human
cggaggguggcuguccagccgggagccucugauccacggggcuuggaccagccaccccacccg

SEQ ID NO: 4149883 - RNA, 76 nt, Human
cggaucucuuagauccugcccuaagauguuauauuuagaucugugaaaauauuuuagggccaggagauaagaucug

SEQ ID NO: 4149884 - RNA, 72 nt, Human
cggaugcuaggcuguguuucagacccuguucacacucucuuuguccaugggcccagacacagucuugugcug

SEQ ID NO: 4149885 - RNA, 78 nt, Human
cggcacagucaaaggcaugcauggucugcuccccaggcuggcuguaggaguagugagaugcagucauugcuguuguug

SEQ ID NO: 4149886 - RNA, 64 nt, Human
cggcagagcccugagucagccucguaaauugugugacaggcaagaccagaaagggcugauguug

SEQ ID NO: 4149887 - RNA, 58 nt, Human
cggcagcugagagcacagcagaggcgguagcugcucuuugugccaugcagugaggccg

SEQ ID NO: 4149888 - RNA, 65 nt, Human
ccuggccgauggaguaggcucugauccuguaaguacaggaugcggccugacucuaagcaggcagg

SEQ ID NO: 4149889 - RNA, 91 nt, Human
ccuggccucuucccacugagcuauuuacgcugcuggggaucaauacuauugauaaauccauguaaaugguaauguggcugucaggcccugg

SEQ ID NO: 4149890 - RNA, 73 nt, Human
ccuggcgcaguggcucacgccugugauuccaacacuuugggaggccgaggcaggcggaucacuggaagucagg

SEQ ID NO: 4149891 - RNA, 63 nt, Human
ccuggcgcaguggcucugcuccacacuccuccucuucacccuggggccagccaccucgccugg

SEQ ID NO: 4149892 - RNA, 73 nt, Human
ccuggcggaagaaguguuugcccgguguugcagugagcuccugaaaagcgcuugcuuccugcacucagccagg

SEQ ID NO: 4149893 - RNA, 67 nt, Human
ccuggcuaaggcuauguguuaaggcagauugggaaaucccagcugccucaccuaugaccuugccagg

SEQ ID NO: 4149894 - RNA, 60 nt, Human
ccuggcucaggcacgcauggcucagcuagcuccacagacagccaagccuugggagccagg

SEQ ID NO: 4149895 - RNA, 64 nt, Human
ccuggcugagggggcucugcucaggaccacccauuuccauggcaaccagagcccucuggcuggg

SEQ ID NO: 4149896 - RNA, 78 nt, Human
ccuggcugaggguagcggcauuucugggaucgggcacuuuucuuggcuuuggucucuguaggcuaccccauagugagg

SEQ ID NO: 4149897 - RNA, 64 nt, Human
ccuggcugcauuuugcuggauguauuggaguagaaugaggauggauucaaggacagcagugagg

SEQ ID NO: 4149898 - RNA, 71 nt, Human
ccuggcugccagccaguuugcugauggcugucuucaaagacaacugccauuuccugguuucaucagccagg

SEQ ID NO: 4149899 - RNA, 69 nt, Human
ccuggcugugcauugccggcccagcccucuucugaagaaucccagcagccaggccagcaguguaccagg

SEQ ID NO: 4149900 - RNA, 61 nt, Human
ccuggcuucccugucuuauggaaugcaauccuguugcuuucugucuuauggaagcuguagg

SEQ ID NO: 4149901 - RNA, 68 nt, Human
ccuggcuuccuucaugaccuggucugcaaugcuaacuauggugacgugaaaggaacauuucagccagg

SEQ ID NO: 4149902 - RNA, 85 nt, Human
ccuggcuugaaaguggcucauguggcuucugcccugugguuucacuggccuggacucaggcacguggccacauuucacugccagg

SEQ ID NO: 4149903 - RNA, 74 nt, Human
ccugggacacagaccaccaggcccuggucaggaccccucccauguggcugugugguuuauuuguggcucaaagg

SEQ ID NO: 4149904 - RNA, 56 nt, Human
ccugggaccucgcgggaagcgggacugggaaaggguauccgccgggaggucccagg

SEQ ID NO: 4149905 - RNA, 125 nt, Human
ccugggacugcugugucuaguggggagaaggccacggaauggagcugggaauuuuaaaaucaaguggcuauuucuucuggguucacuucuaccucacuggugaauuggcuguucucugacccagg

SEQ ID NO: 4149906 - RNA, 84 nt, Human
ccugggagcuuguuagaaaugcagaaucuuggccccaugccagaucagcuuaaucagaaucugcauuuuaacaagauucccggg

SEQ ID NO: 4149907 - RNA, 66 nt, Human
ccugggaggccaggguagggcccauugugggagcaaccacggcaccucccuuccuggcuuccgagg

SEQ ID NO: 4149908 - RNA, 57 nt, Human
ccugggaggcuguuuccagccucagcgccuccgcuacugcuguuccagcugcccggg

SEQ ID NO: 4149909 - RNA, 98 nt, Human
ccugggaucuuaucugccuccacucugcugccucgguguggguaccauccuaaggguggauccccugugguagcaagauggaugcagguggcaacagg

SEQ ID NO: 4149910 - RNA, 80 nt, Human
ccugggaugaugacucuuccgcugagaaguuuggcuuucuguggggcucuaagugaccuuagggaaguguuauucucagg

SEQ ID NO: 4149911 - RNA, 72 nt, Human
ccugggcaagcucuggguggacacaucccuuuagucuugaagauuccgugacccccuagagcugagcccagg

SEQ ID NO: 4149912 - RNA, 76 nt, Human
ccugggcaagucuuggucccucucugggccccuuugccguaggucccugguggggccagacuugcuacuuucuagg

SEQ ID NO: 4149913 - RNA, 59 nt, Human
ccugggcacaggggagcagagucacuuaagccaauggggacugggcugacuugugcugg

SEQ ID NO: 4149914 - RNA, 65 nt, Human
ccugggcgccuugggggacagauccaucaacagcugcccucagaucguccucucaacaacccggg

SEQ ID NO: 4149915 - RNA, 68 nt, Human
ccugggcucaggcuugggcagcugcaccuaucaccccuggagaaggcagaccaagccuggcacccagg

SEQ ID NO: 4149916 - RNA, 57 nt, Human
ccuggggagagaaagcccagccacacccuccagccugacuauaauucugucuccagg

SEQ ID NO: 4149917 - RNA, 79 nt, Human
ccuggggagccuggccuggggggacacaucccaccaaggcuucuggaggggugggcccagcccagugcugguccccagg

SEQ ID NO: 4149918 - RNA, 84 nt, Human
ccuggggcagggaucggggaaaagggaggcuguggcccccuucacaccuggcauauuccuccuucccccgacauccccuccagg

SEQ ID NO: 4149919 - RNA, 78 nt, Human
ccuggggcuccagagcagcggaguccguggugagaccagaccccaucagagggcugcucugcaaagagccccacgagg

SEQ ID NO: 4149920 - RNA, 74 nt, Human
ccuggggcucugcacagagcagcagagcuagagccaugaaacccacagacuuggugccugagcgcagcuccagg

SEQ ID NO: 4149921 - RNA, 63 nt, Human
ccuggggcugggcaugguguucccucaggagggcugacccucuggaggaugcucggucccagg

SEQ ID NO: 4149922 - RNA, 76 nt, Human
ccuggggcugggcugcaggcuggauuugcuuuugugcaggauauuacugcaggagcucagccugcagggagcuggg

SEQ ID NO: 4149923 - RNA, 59 nt, Human
ccugggggccaggaaggugugagcaacagugcugaccggccacucuuucugcccacagg

SEQ ID NO: 4149924 - RNA, 55 nt, Human
ccugggggugugcuaugaucugugacugggcauuucagaagcaugcccucuuagg

SEQ ID NO: 4149925 - RNA, 78 nt, Human
ccuggggugggaccaacaggcaguucccauaauauucuuuaaggcacccgugagcugccagcuggcccggcuuccagg

SEQ ID NO: 4149926 - RNA, 63 nt, Human
ccugggucagaccuugaggagaccucaaguggcacccuuggucuggcagggucagggcccagg

SEQ ID NO: 4149927 - RNA, 55 nt, Human
ccugggucccugagagaugauugcuccugagcaguggccucuccccagacccagg

SEQ ID NO: 4149928 - RNA, 68 nt, Human
ccugggugccaggcuuggucugccuucuccaggggugauaggugcagcugcccaagccugagcccagg

SEQ ID NO: 4149929 - RNA, 64 nt, Human
ccugggugguuccggcaaggagagcuccacugugagagccaaaggcuugucugcaauccccagg

SEQ ID NO: 4149930 - RNA, 59 nt, Human
ccuggguuaauucuccggcuuuauuggaggcagagaaagagaagaggaggaaacccagg

SEQ ID NO: 4149931 - RNA, 82 nt, Human
ccugguauugugacacauauaccucuucuugaguuuugacagcuuucagauaggagaugggaguguggaguauguaaccagg

SEQ ID NO: 4149932 - RNA, 88 nt, Human
ccuggucccugcccccaccuggccuacagggaccagccccacggaaggcucuugaggccagguaaccauggggaggggaggaaugggg

SEQ ID NO: 4149933 - RNA, 79 nt, Human
ccugguccuugggcggggcagagggcuaucuuugugggaguggaguggcuuuucuugcuucuggcugaugggacuaagg

SEQ ID NO: 4149934 - RNA, 83 nt, Human
ccuggugauucugauaggcccagcccgagucagccuucagcuguguggucuguggugacugggguguggguacagacgccagg

SEQ ID NO: 4149935 - RNA, 57 nt, Human
ccuggugccgguagacgcgcagaaauuccaccugugcgcgcugcccggcgccccugg

SEQ ID NO: 4149936 - RNA, 56 nt, Human
ccugguggcuucuggguggacgauggguugguaguuuaaucaggagccuaauuagg

SEQ ID NO: 4149937 - RNA, 91 nt, Human
ccugguggggccccucaggggcugguuccagggcacuguugagggagcagggcucgcugccagcuucagggacgguggccccacguccagg

SEQ ID NO: 4149938 - RNA, 63 nt, Human
ccuggugguguauaauagaauguuuguaaauaaaaauaaagcauuauuauaaagaccacaggg

SEQ ID NO: 4149939 - RNA, 60 nt, Human
ccuggugucauguuaguaaggucaacuauuuucauguuuggacugcugcaggcacucagg

SEQ ID NO: 4149940 - RNA, 68 nt, Human
ccuggugugccuuccccgguggucuguuucuuuaggacaggaacgcagcugucuggaaggcacccagg

SEQ ID NO: 4149941 - RNA, 79 nt, Human
ccugguugccugcccgcuaguaucugcacagucuugcuagaggggauaaaagcagaaagcuuagaggguuugcacuagg

SEQ ID NO: 4149942 - RNA, 88 nt, Human
ccugguugguuaucucauacacucagauauuccauaagucagccuguggcuucugaaacuguauugagaaaaagcuguauaaacuagg

SEQ ID NO: 4149943 - RNA, 81 nt, Human
ccugguuugccaacugcagccagacuuugugcgaaauuguauuuuaccacuuuuuaaaagguuaugagcugucaaaccugg

SEQ ID NO: 4149944 - RNA, 127 nt, Human
ccuguaagaacuccacaggcaagccgaaagaccugcucuacaggcaggaggugcuucccugggguuaaugccuccaugggaccuaccuccugugcuggagggaaggaggcuaaagccagggagauug

SEQ ID NO: 4149945 - RNA, 81 nt, Human
ccuguaaguuuccugggcuacguguugacagcauacaagaaauuugucaugucugacucucacguaccuacagaaugcagg

SEQ ID NO: 4149946 - RNA, 129 nt, Human
ccuguaauacuugguuugguucuguacaacugaagugaauuuuuagugacaagcccaucaacagugaauuugcucagaggcucacugucuacuuuaguccucaguugucaggaucccauguggcuaugg

SEQ ID NO: 4149947 - RNA, 84 nt, Human
ccuguacaggacucuucccuggguccauccuuuuggucuacaacacuaggccugagggguauccaagggguaacaguuugcagg

SEQ ID NO: 4149948 - RNA, 62 nt, Human
ccuguacuagggucucauugccucagcauagauuuagcagcuagugggacauaugguacagg

SEQ ID NO: 4149949 - RNA, 57 nt, Human
ccuguaucuucucuguugaaguaucuguucagaucuuuugugaggacaagguacggg

SEQ ID NO: 4149950 - RNA, 61 nt, Human
ccuguauuugcaacuuuucuuaguuugaaauucuuuaaggaacagcaucugcaaacacagg

SEQ ID NO: 4149951 - RNA, 78 nt, Human
ccugucacuuuuuauagguguugagauguccgauagauaugaaauaagcaucuccaccucaauaaauaaaaagacagg

SEQ ID NO: 4149952 - RNA, 55 nt, Human
ccugucauacuaacguagugggccagcugccucuauaauaucguuaauaggcagg

SEQ ID NO: 4149953 - RNA, 94 nt, Human
ccugucaucucuaggguuuauuaauucucuggaauucuaguaaauugcuaauuuaucagaaguuagagaaagacuuuagucaaaaagauucagg

SEQ ID NO: 4149954 - RNA, 74 nt, Human
ccuguccaagcccaaggcuucccugcuggccccuggucuuccaguagccagcugggccuuagggcugggccugg

SEQ ID NO: 4149955 - RNA, 108 nt, Human
cggccgcuccucagccuguccccucccuccugugggcucucaaagugcggcuugguuucuccaucucgacccugaggccuggagguggggacgggacugugggcgccg

SEQ ID NO: 4149956 - RNA, 94 nt, Human
cggccucacgugcugcugccgucagauaaugguggggcugaaacaucaagauggcuucccucaugugucugguaggagcuuagugguggggcug

SEQ ID NO: 4149957 - RNA, 73 nt, Human
cggccugcuccuggcaucucugcguccuugccaugagauguaugucgggcagagauuccaggaaaaauggcug

SEQ ID NO: 4149958 - RNA, 56 nt, Human
cggccuugacccccggcgccggcgccgcagccgccgcgccgggcccggguuggccg

SEQ ID NO: 4149959 - RNA, 59 nt, Human
cggcgaugggccagguccuccgaauccccaaggccuccagggcuacgggcaccguccug

SEQ ID NO: 4149960 - RNA, 88 nt, Human
cggcggcgguggggugccugacucgaaaugcggcuggugcaggccaagccacacacugucugcuucgacucuucaccuccaauccccg

SEQ ID NO: 4149961 - RNA, 73 nt, Human
cggcggcugcggccgggcaucguauggcgcuagagaacuucggcggcgagcgggaccugcgccugggccgccg

SEQ ID NO: 4149962 - RNA, 77 nt, Human
cggcgggaggaagcccagacaaugagcccuuguucccuguccucgggcccagggccagcgucucgggcuaucagccg

SEQ ID NO: 4149963 - RNA, 104 nt, Human
cucaggcuccauaugguguggcaacuguggcaaaguuuaaaaaaaauccuuuugggauuucuacuugaacuugcuaaauaagcaccaccaauauugaccuugag

SEQ ID NO: 4149964 - RNA, 85 nt, Human
cucaggcugugacccuccagagggaaguacuuucuguugucugagagaaaagaaagugcuucccuuuggacuguuucgguuugag

SEQ ID NO: 4149965 - RNA, 58 nt, Human
cucagggaaaagggccagggagaugcuacugaugcucucugggcagcccaguccugag

SEQ ID NO: 4149966 - RNA, 111 nt, Human
cucagggcgagaccagcggggcacaugcagagggagggccaggcagcucccagggggccaggccaggcauguccucugcagaacuuguucuuuggugggcuccuaccugag

SEQ ID NO: 4149967 - RNA, 130 nt, Human
cucagggcuaugguauggauuaaucaauguuaugcacacauuagcacagggucuggcaacuuuaacauaccuacggugcuguggugcuauauauacauucaguuauacaauuuaaaccacaugugcugag

SEQ ID NO: 4149968 - RNA, 56 nt, Human
cucaggggauagcuuaaguuucugcugugaaguaggaggaaaaguuaucugcugag

SEQ ID NO: 4149969 - RNA, 61 nt, Human
cucaggucaggaaaauaagauuguggguuuuuuuugcaaacucaucuuuucuguccucgag

SEQ ID NO: 4149970 - RNA, 91 nt, Human
cucagguccccaaaucauggucuuuguucugcacuauugucucagcuaaauguggauuaauagacacaaccaagcugauuuuggauuagag

SEQ ID NO: 4149971 - RNA, 63 nt, Human
cucaggucgcuauuucucuuaccccaauuugggacaacuuugagggacaugguggcuucugag

SEQ ID NO: 4149972 - RNA, 64 nt, Human
cucaggugggaguagaaugcuaggcucucacguuguaucagauuccuguuucuuccuaccugag

SEQ ID NO: 4149973 - RNA, 81 nt, Human
cucagguuuuucaucucugcuuuguaccuugcaggaaacaaggcgaggcacaagugcuggggaugagauuucaagcccgag

SEQ ID NO: 4149974 - RNA, 61 nt, Human
cucaguacuuugaucauuuuggccuauugagguccaaacaggucaaaauauuaacuuaggg

SEQ ID NO: 4149975 - RNA, 63 nt, Human
cucaguaguggggagcccagugucagaggcaucccucagagcacagaaucuucccaugcaaag

SEQ ID NO: 4149976 - RNA, 70 nt, Human
cucaguauucaaagaaccuuuagcauugguugucuaaacaacaucccaugcuaagguuuuuggaauggag

SEQ ID NO: 4149977 - RNA, 57 nt, Human
cucaguccgucccgcuaggugcaaagcagccucuuauccaccagagggcggacuaag

SEQ ID NO: 4149978 - RNA, 61 nt, Human
cucagucuuucccucccucaguuggccuuaaauugguccgaucuggaaucugaaggcugag

SEQ ID NO: 4149979 - RNA, 60 nt, Human
cucagugggcauaguucugaaauaugugcucuacacugucucccaggugugcccaguggg

SEQ ID NO: 4149980 - RNA, 106 nt, Human
cucagugguaaagaaaaugcaugggaacuuuuaaagaaauugcauguaauaacugaauauuccacagugcaacagcaguucucuuuauauucccaggcucauugag

SEQ ID NO: 4149981 - RNA, 129 nt, Human
cucaguuaaauuugaaguucagauaaacaacauaugcuuuuuuaguauaaguauagcccaugaaauaguugggauauacuuaugcuaaaaaauguuuuguuguuugucugaaauugcaguguaacuggg

SEQ ID NO: 4149982 - RNA, 94 nt, Human
cucauaaaagaaacugccccugcccccugcccaucgucauuuaauaaaucaacaggucuguuucaguggccugauguguaauggcauuuaugag

SEQ ID NO: 4149983 - RNA, 119 nt, Human
cucauaagaagggaacggucugggauuggugaauccucagguaauuuaaaauacuccuaauguuuaguguuucaaauuacuugaggauucaccaaucccagaccuuucccuucuuaggg

SEQ ID NO: 4149984 - RNA, 61 nt, Human
cucauaaguuaagugccuaauguuuagucuuaucgcugauuguacagacacuuaguaugag

SEQ ID NO: 4149985 - RNA, 98 nt, Human
cucauagacugaguauagcugaguuuaaauucuuaucaaaucugacaauccuuauguuuuaauuggugaauugagaccauuuguacuuaaucuauuag

SEQ ID NO: 4149986 - RNA, 69 nt, Human
cucauauuuaucucaugcuuaguaauuugucuucccgaggaaaugucugucucaugaggaaaacauggg

SEQ ID NO: 4149987 - RNA, 113 nt, Human
cucaucagccucuucucccucuggauguccucccggccagccaccaagaccaugaacuuuggcuggcagagagcuggugaggaucgcgguuuggcuggagaugggguugagag

SEQ ID NO: 4149988 - RNA, 70 nt, Human
cucaucucucuucaccuuuuuguuuccucugugaaagcagggauagaauuugaaaagugaugggaaugag

SEQ ID NO: 4149989 - RNA, 55 nt, Human
cucaugguuagagcccagaaagcaagagagaaagccuucuccagccugaccugag

SEQ ID NO: 4149990 - RNA, 89 nt, Human
cucaugguuuuauuacugacacagggguauaagagauguuugaaaaaaggucauccuuuauaagacuuguauucagggguaaaccugag

SEQ ID NO: 4149991 - RNA, 58 nt, Human
cucauuaauuugcuuagacuuaucucauugucugagacaagugaggugaauagaagag

SEQ ID NO: 4149992 - RNA, 73 nt, Human
cucauuauugugcauuuuuguguuuaaagcauuagaauagcuguuguaagggauacaaagauuaauaguagag

SEQ ID NO: 4149993 - RNA, 84 nt, Human
cucauuccauuucuguauuaggucugauuuaguagcaaguuauaggaaccaagacaaaccagcuuaagcaagaugagaacugag

SEQ ID NO: 4149994 - RNA, 70 nt, Human
cucauucuucaucacuaccuugugaguuggguuucauuaucauguccauuuuagagaugaagaaacugag

SEQ ID NO: 4149995 - RNA, 59 nt, Human
cucauugcagcugcauuacugugggagcugucccucuagagacacugggcugcaauggg

SEQ ID NO: 4149996 - RNA, 55 nt, Human
cucauugcccagauccccacagaagauccggaagucaucuggggauggggaagag

SEQ ID NO: 4149997 - RNA, 74 nt, Human
cucauuggaauugauggacagagaugaagaaaauguaaacagauuuucuaauuuuaacccauuuauuuuggaag

SEQ ID NO: 4149998 - RNA, 128 nt, Human
cucauuguaaauacauauuaacucucaccaugaugagaaggcugaugacagauucugcucaccuuaaugguggggcagggccuuggucaucuuuuuaacccggugauuagugggaugucugcagagag

SEQ ID NO: 4149999 - RNA, 77 nt, Human
cucauuguguuuuaccuacuucugaauaugugucauacuuaggaucagagugguaaguaagugaaacauccagugag

SEQ ID NO: 4150000 - RNA, 113 nt, Human
cucauuuauuuuuacuucuuuuggaacuuaacaucugacuugcagacauaauaaguauguauuauauuuacuguauuugaaguugaaagaugaaagaagaaaauaugaaugag

SEQ ID NO: 4150001 - RNA, 80 nt, Human
cucauuuuaauguguuuguacauauaaaucuuguauuuacagauaauuucagaaacacaugguauguauagacaaaugag

SEQ ID NO: 4150002 - RNA, 80 nt, Human
cucauuuuagaauuucaguguaucuuccaaaagccauuuuaaauggcuguaggucuagaugacugauccuuagggaugag

SEQ ID NO: 4150003 - RNA, 61 nt, Human
cucauuuuauuugcuccuccuuauauuuuucacuccccuaggaggguuucaaugggaugag

SEQ ID NO: 4150004 - RNA, 75 nt, Human
cuccaaacucaagucaaucaaggguguaggcaaguguaaccacugcaugcacuaucuagaugaugaacucuggag

SEQ ID NO: 4150005 - RNA, 58 nt, Human
cuccaaagcuuccacuugauagauaaguccacuaugaacaguugauguagcuuuggag

SEQ ID NO: 4150006 - RNA, 75 nt, Human
cuccaaauacauacuuucaauucccaagaccuagcaaagcugagugugucuggaaauuuaagguaugagauggag

SEQ ID NO: 4150007 - RNA, 76 nt, Human
cuccaaaugucuuucuucugcuacguggcuuguuuaaacagccuccaaaaauguguagaaagaaagaaaaagggag

SEQ ID NO: 4150008 - RNA, 129 nt, Human
cuaaguaauuuuguggcuucaucaacagaauagaauaguggcuuggagugugaacucuggagucagacaaccuggauucaaauuucagcucugucacuugcuagcuguauguccuuaggccagacuuag

SEQ ID NO: 4150009 - RNA, 84 nt, Human
cuaagugcuucagguagauagauggcugauguucagauucaaauguuacuccugccugaagguccuauuuuuugaaauacugag

SEQ ID NO: 4150010 - RNA, 59 nt, Human
cuaaguucagaguucucauuugugaugcaaaaccacugcaccuguagaaucugacuuag

SEQ ID NO: 4150011 - RNA, 75 nt, Human
cuaaguugcaugaggcucucucuccuccugguuuucugaccuagaaggaaaaccugucuuauguccccugcuugg

SEQ ID NO: 4150012 - RNA, 69 nt, Human
cuaaguuucaauucuuuucacaaagagaacuuuuaaaaguugacuuugugcuuugaaugauagcuauag

SEQ ID NO: 4150013 - RNA, 71 nt, Human
cuaauacagucucugauaacugucaguucuagguaucuagagaugaugaaaagagagacuuagguaucuag

SEQ ID NO: 4150014 - RNA, 59 nt, Human
cuaauaucuuggcauuucucaccuggaauuaggagacaguuggaaacuccugauauuag

SEQ ID NO: 4150015 - RNA, 74 nt, Human
cuaauauuuuacucagcauuugaaaaauacuuugacuacaaucaaaaguuuucuaagucugagggaguauauag

SEQ ID NO: 4150016 - RNA, 95 nt, Human
cuaaucaaucagcaggagcagccuagagagccacuuugagaagaauucugaggcugucucugggcuccacuugaaaucuuaucuugauugauuag

SEQ ID NO: 4150017 - RNA, 84 nt, Human
cuaaucaggaagcaugaugucaccguuuaauugaguuuuucacuucuucaugacagauuaaaugauggcaugucuuaugauugg

SEQ ID NO: 4150018 - RNA, 57 nt, Human
cuaaucucugcacucugccacaacucaaccaauuuguauggcagggagugauauuag

SEQ ID NO: 4150019 - RNA, 58 nt, Human
cuaaugacagcugcucccguuucugcugcuguggcagggagucuuggcacugucuuag

SEQ ID NO: 4150020 - RNA, 66 nt, Human
cuaauuaaggggcauuuuucugaugcagccuuccggugcagugaaaaaagaauguccaguuguuag

SEQ ID NO: 4150021 - RNA, 129 nt, Human
cuaauuaugugugaauugugcagaauucagggaagcuuauaaguuuucaugcucaauugugaauaguuuguuuucacagauaguauguaaauuaagcaaccaaaaaugaauuccuuaugcaucaucugg

SEQ ID NO: 4150022 - RNA, 67 nt, Human
cuaauuauguuguuauaaucaagauuuuugcacaauuuguguuuuauugaugaugacgccaaauuag

SEQ ID NO: 4150023 - RNA, 115 nt, Human
cuaauucuaacuucauuuugcuuuccagugguuuucugcuuagcauuuuagcuguuuucucugagaagcuuaagaauagggaaaaugucuagagggggaaaccacugagaauugg

SEQ ID NO: 4150024 - RNA, 65 nt, Human
cuacaacguccaggagaaggccauccagcgcuuuuucaguggcuauggccgccuccucgaaguag

SEQ ID NO: 4150025 - RNA, 63 nt, Human
cuacaaggcagcaaugaaugaaauggauuggucuccaccuccauggaacauucugccugguag

SEQ ID NO: 4150026 - RNA, 63 nt, Human
cuacaauggcccgucuuuccugagcccaguggagggucccaggggggcaggagucauugauag

SEQ ID NO: 4150027 - RNA, 77 nt, Human
cuacacaaugcauaaguuucucccagaagaucuuagaaguguugugccauuuccuggagaagcagugaauugugaag

SEQ ID NO: 4150028 - RNA, 73 nt, Human
cuacacagugccaaauugcaguuauuuaaaggugcaagauaugauguauuuuagcugggauugcacuguaugg

SEQ ID NO: 4150029 - RNA, 65 nt, Human
cuacacuggauaaaaauuuggaagucagauauacuaauucauugauuuucauuaauucagugugg

SEQ ID NO: 4150030 - RNA, 69 nt, Human
cuacagaaaaacuuggaggcuuucauugaccacaccaaaaacagagccaagcuaaguuuguuuuuguag

SEQ ID NO: 4150031 - RNA, 102 nt, Human
cuacagaugauuuuuaaugaguauuuugcauuaguuuagauuucaagugauuuauuuugaacauuagaauaaguaauugucauugguaaugucacacuguag

SEQ ID NO: 4150032 - RNA, 72 nt, Human
cuacagccaacaagaagggaaggcaugauuugugguuugcagaaugcauuuucuaucuuguacuggucauag

SEQ ID NO: 4150033 - RNA, 65 nt, Human
cuacagcugucacuccugcucuugggaugggccaauaccaagaguaaauucaugaugccaaguag

SEQ ID NO: 4150034 - RNA, 84 nt, Human
cuacaggcaauuacauuuuagcuguucacucucuuaauguuaugugggcagcuuggauuucuguaguuuuauuuauucuuguag

SEQ ID NO: 4150035 - RNA, 73 nt, Human
cgaggagcaucucuaaauccaguaaguggguuuuguuccccaucagcugggcagggagaaugccugcucuuug

SEQ ID NO: 4150036 - RNA, 78 nt, Human
cgaggaugaagugacugauccuuccugagaguuuuuaucuccgugcggggaggcuucggauuaaagccuugguccucg

SEQ ID NO: 4150037 - RNA, 83 nt, Human
cgaggcauugccuucaucuucuaucugagaauucuuuaaaguuagucuguucacaggaggguggaugcaugacacuggccuug

SEQ ID NO: 4150038 - RNA, 71 nt, Human
cgaggucuacauuuugugauuaugaaauauuaacauauauuuuacucucucuacugaugucuaggaccuug

SEQ ID NO: 4150039 - RNA, 96 nt, Human
cgaggucuggagaaugugggagaaaaggcuugaagagguuuugaagccaguuucugaaggccucuggagaguuuggacuggcuucuuuggccuuug

SEQ ID NO: 4150040 - RNA, 89 nt, Human
cgauagauacuugggugcagaaguguugagccauuuguuuugacccaaccauuuuggcucuguggauguucugaccugagaaucuuuug

SEQ ID NO: 4150041 - RNA, 130 nt, Human
cgaucaagccucuguuagauuaugguaugagaagaguaguaacagaaauuaugauggauucuuaccuucuuuccuaauauguguuacugacuuuuuuuguguggcuauucugcaugcauuggaagagacg

SEQ ID NO: 4150042 - RNA, 82 nt, Human
cgauggccuuuuugcaagguuuuggaagauuuucguuucaacggacuaaaaacuacugccaauagccucuagacaggccucg

SEQ ID NO: 4150043 - RNA, 62 nt, Human
cgaugguaucggccagccccggguugcacagcagcagccaccggcggggggugaugccauug

SEQ ID NO: 4150044 - RNA, 70 nt, Human
cgaugugaccuguuggacguuguuguuaggugcccaccugaaagccagaauucguccagccuggugaccg

SEQ ID NO: 4150045 - RNA, 62 nt, Human
cgauugcagaggcuguugcuaauuggagaagccccacuaagcagcggcagcuuccugcuucg

SEQ ID NO: 4150046 - RNA, 109 nt, Human
cgcacaucagcauuucacuuucuuucuucguggaaauucccaggcuaguuggacucauuuaauuuggagagagaaaccuuugucagugauaauguuuugaucaggugcg

SEQ ID NO: 4150047 - RNA, 61 nt, Human
cgcacaugggcaccugagggucugggaggcagcccggggcucuggaaggugcaccauggug

SEQ ID NO: 4150048 - RNA, 78 nt, Human
cgcacgcuccaccagcuucagcagccgcggcaccucggaccgcgaagccgcuucggcccggagcuggcggagcaggcg

SEQ ID NO: 4150049 - RNA, 59 nt, Human
cgcagagcggugaucaggcgcaggcgccggaaggaauccugcucuggggaccggcugug

SEQ ID NO: 4150050 - RNA, 130 nt, Human
cgcagaggcuuggggccaagcggaguuugcccugcggguccugcgcaaggccccagugccccggcuaaaccuuugccgcaggaucccggagccggcguccuucaaggagcacagagggccccguagcacg

SEQ ID NO: 4150051 - RNA, 82 nt, Human
cgcaggccugcagggcgugguggugcuggagcaguaccgcacugaggagcuggcucaggccuacgacgccuucacgcuggug

SEQ ID NO: 4150052 - RNA, 130 nt, Human
cgcagguccugggaucugguaggggauugacuucacaaauuaacguucaggugauggaaaccgugacagacgcggggcugggauugcuugcugugaggaguugccccaagggaucaaaggacaccuguag

SEQ ID NO: 4150053 - RNA, 55 nt, Human
cgcaggugaacuguucugcaguuugguuucgccugcagacaucuccaaaucugug

SEQ ID NO: 4150054 - RNA, 73 nt, Human
cgcagguggcagagccuugcggcuuuggagagagguggagccuuggugagguugggaggacugccuaacugcg

SEQ ID NO: 4150055 - RNA, 92 nt, Human
cgcaguuaguaagcagauugaaacauaggcagucgagcuggggaguccauuccucugaccaucauguuaugccaccucugcucuaugcugug

SEQ ID NO: 4150056 - RNA, 81 nt, Human
cgcauaguuauucagaauaaagacuacauuucuguuuguagaaauguacaaaccuucuuuguagcuggguauaaccaugug

SEQ ID NO: 4150057 - RNA, 74 nt, Human
cgccacgugacgcuccgcccucuuugagaucacaugauuuaacucaagucccgcaguguuccuccgcgcuggcg

SEQ ID NO: 4150058 - RNA, 75 nt, Human
cgccaggcaucucgcccacgaaguagguggcauuggcagugacgaucucaaagcaguguggguuggugcccggcg

SEQ ID NO: 4150059 - RNA, 79 nt, Human
cgccaggugcuuauuaggccgugcuccaaagucaucguccgguuucucauugugaugaugaagcaugguuacacuggcg

SEQ ID NO: 4150060 - RNA, 95 nt, Human
cgccaguuucaccaaaacccagaggcaggagugacccugacaggaacaaacccuaagguauucacuugccugcccagggucuggugcagcuggcg

SEQ ID NO: 4150061 - RNA, 64 nt, Human
cgccccgggcugcucuggaccgacagcugcuccccgggcugcucuggaccggcagcucgaggug

SEQ ID NO: 4150062 - RNA, 104 nt, Human
cgcccucagcugucgcuccuuauaaggcgggggccgggcggcgccggaggaggggccgcggcaucagcccgguccugggcucuggggcggcgcugggccgggcg

SEQ ID NO: 4150063 - RNA, 57 nt, Human
cgcccugauccgcccuccaccuuccucuccuccagguucugggccggagaaggggcg

SEQ ID NO: 4150064 - RNA, 70 nt, Human
cgccucagggcccuggacaacccucccuccuaggggguggaguggggggagcugagggggcccugaggug

SEQ ID NO: 4150065 - RNA, 107 nt, Human
cgccuccggcagccgccccaucuccgccccuuccggccagccgagccucauggcuuagauggcguccauggccgcagggguagccgugggcucggcugugggacacg

SEQ ID NO: 4150066 - RNA, 74 nt, Human
cgccuccuucuccguuugagcuagguuuaccugaacaaauaaaccaguugguuucaaugggacaggugagggcg

SEQ ID NO: 4150067 - RNA, 82 nt, Human
cgccucuuugccugguccugugggugcugugcaggcucccucagccaagcucggcauucccaggccuggcuccgaguaggug

SEQ ID NO: 4150068 - RNA, 60 nt, Human
cgccuggaaccucuaggaccagggacacaaacucuuaucuuggaaauggagguacuggug

SEQ ID NO: 4150069 - RNA, 71 nt, Human
cgccuuaugccggccugggucacucaggcaggcggggcgcggccccgucagcugugacucaggccccagcg

SEQ ID NO: 4150070 - RNA, 61 nt, Human
cgccuucuugucaauuugccauugucaccaaguccaggacacagcaucagagaagaaggug

SEQ ID NO: 4150071 - RNA, 55 nt, Human
cgcgagguggagguugcagugagccaagaucgugccacugcacuccagccuggcg

SEQ ID NO: 4150072 - RNA, 55 nt, Human
cgcgagguggagguugcagugagccaagaucgugccacugcacuccagccuggug

SEQ ID NO: 4150073 - RNA, 56 nt, Human
cgcgcccggaacugcgcccuggucucccucccagcgcccgcgcagcuccuggcgcg

SEQ ID NO: 4150074 - RNA, 123 nt, Human
cgcgccugaaggguuucuuucuaauaauggcccuggugcuugcgcaagucuagacugucagcucccagagggaaggcggcuggcagcuggcucugcgcaggcugggggcgccucccgggcgug

SEQ ID NO: 4150075 - RNA, 130 nt, Human
cgcgcgcgccgcagucccccgcccccgcucagugcggcagcggcugucggccagccggaguuggcgccgcggccugcccggcgcagccgcuguccaccugccagcgggggaggggcgcggccggcgcgcg

SEQ ID NO: 4150076 - RNA, 63 nt, Human
cgcgcugcagacagcggaggccugggccauauuccaggagcagaccguaguccugcaggugcg

SEQ ID NO: 4150077 - RNA, 91 nt, Human
cgcggagccucauggggguuggaguccccaagguuuccuuugugcgcaguauuggcggggccuuggacuaccacucccacaaggcaccgcg

SEQ ID NO: 4150078 - RNA, 80 nt, Human
cgcggccucugcuucucugcccaugagcaaucugcgggaaagaccugaugagcccggcucggcggggagggcgggccgcg

SEQ ID NO: 4150079 - RNA, 56 nt, Human
cgcggcggccggcgcucaccaugcagucccggccuggccagcgccggcugcucgcg

SEQ ID NO: 4150080 - RNA, 58 nt, Human
cgcgucccgggggagauccgugcggacgggacgccggagcagagccacucgggccgcg

SEQ ID NO: 4150081 - RNA, 78 nt, Human
cgcuacgggcgcuacguggccacccaguggugcguggccgucuacagccugugcuuccuggccacaguggccguggug

SEQ ID NO: 4150082 - RNA, 71 nt, Human
cgcuaucugucccugguccaagauuugacaaagugugcaaacaaguaaaucagacacagugaaaguuagcg

SEQ ID NO: 4150083 - RNA, 70 nt, Human
cgcucaacagacugucaugacacuauauaauagauugauuuuuaauguaguguagagauuagucucagug

SEQ ID NO: 4150084 - RNA, 88 nt, Human
cgcuccaccucccggagaggggcggggccaggcgagccucacccacggccucucguagcucacgcccccucucccggagccuggagcg

SEQ ID NO: 4150085 - RNA, 70 nt, Human
cgcuccaggcucagcgcgcacgucugcuccgagaaccgcugcggguggccaggcgccgggccuggcggcg

SEQ ID NO: 4150086 - RNA, 67 nt, Human
cgcuccccauuuauucuugagucuguuucacaaucauggaaagacucuguaucaugagggaggagug

SEQ ID NO: 4150087 - RNA, 68 nt, Human
cgcuccgacgcugggggccaggggaccggaccuucugggaggggucugggcucccagggucggcggug

SEQ ID NO: 4150088 - RNA, 121 nt, Human
cgcucuguagaugaggaaauggaggcugaaggagguagagugacauauacaaggugauauaucuaguuauuacauuuagucuucugauuccuauucuagcauucuauccacagacacagug

SEQ ID NO: 4150089 - RNA, 87 nt, Human
cgcuggugcaggacagcacaucuccugccagugucuccucccccuacagccuggucaggugagaggcgguccugcaugucaucagcg

SEQ ID NO: 4150090 - RNA, 110 nt, Human
cgcuguauacuccccaaauuaacuuguaggcucgcugggaagauuagaaagaaauuaaggcauagauccaguuccaagaagcuuacaaucuaauugaagacauacacgcg

SEQ ID NO: 4150091 - RNA, 82 nt, Human
cgcugugcaugauuugugcaguugagacaauaggcuggagaaaucuugcacuacguguguaacuguguaguuugucauagug

SEQ ID NO: 4150092 - RNA, 57 nt, Human
cgcuguguuuacaucauugcuguuaguucuugcaguuccugugugaccgagacagug

SEQ ID NO: 4150093 - RNA, 60 nt, Human
cucacggaauucucagugugguuuucaacaucacaaaacuacauuguccuuucugaagag

SEQ ID NO: 4150094 - RNA, 59 nt, Human
cucacgggaagggagacaguaggauaaauaucacagccuucugcuccagcuccucuggg

SEQ ID NO: 4150095 - RNA, 117 nt, Human
cucacuaauacauugauuuuuguaguagucucguucuuuuaaaauccgucaucaucaauauggcucauuaggaaaaagaggcuggcaaggaaauuuuucuuaaauguugaaagugag

SEQ ID NO: 4150096 - RNA, 62 nt, Human
cucacugagcuuccuguguuugucuauguaaacaccagucccaagagaggcucaguaaagag

SEQ ID NO: 4150097 - RNA, 78 nt, Human
cucacuguaucaguauuucuaaacauuggcuguacauuuaacuaugugaagaaguuuugggaaauacugauaccugag

SEQ ID NO: 4150098 - RNA, 64 nt, Human
cucacuguauuuuugaaucauugugguagaaauuuauuggaaucagauuuaaaaguauggggag

SEQ ID NO: 4150099 - RNA, 70 nt, Human
cucagaaaaccagaggcagcaguaccugagggccuccaacuugaccuuuccuccuccugcuucuacugag

SEQ ID NO: 4150100 - RNA, 63 nt, Human
cucagaauuacaucccauuuuaaagauucagcguuuucuccuuugagaagggucauuucugag

SEQ ID NO: 4150101 - RNA, 94 nt, Human
cucagaauuuaagagugugagcuucaagcuguucagaacuauuagauacagacaucauacuuacugagcuugaauucuuuauucucuuuaugag

SEQ ID NO: 4150102 - RNA, 69 nt, Human
cucagacaugaagucugacaaaagagccuugugugguguagggcucagaguccaguuucuugugcugag

SEQ ID NO: 4150103 - RNA, 59 nt, Human
cucagaccagccauuugccucuuccaaaaagcuggggcuaagcaugugggugguucaag

SEQ ID NO: 4150104 - RNA, 76 nt, Human
cucagacuguacucuuauagccaucugaaauacguuuucuagguagagauagauuguguaaggguacaguugugag

SEQ ID NO: 4150105 - RNA, 78 nt, Human
cucagagacagcaucaccaacuugagcaauuuucuuauuauacagaguuaauuaggugugugccuguuagccucugag

SEQ ID NO: 4150106 - RNA, 55 nt, Human
cucagagcucagcuuuguuaguuaauugaugacaucacuagccuuuaguucugag

SEQ ID NO: 4150107 - RNA, 77 nt, Human
cucugggccucauuuacucaucugcaaaacgugagggcuuguucuagguggauguguuggaugagugaauuccagag

SEQ ID NO: 4150108 - RNA, 130 nt, Human
cucugguaauggucacugacugcucuguugagcugcgguuucagggcacccccagggcagcccacuucccacccuggaguccccgagaggccugcacagcaccuggcccacaguugaugaccgugcaggg

SEQ ID NO: 4150109 - RNA, 84 nt, Human
cucugguacuuuauguaugcauuuauuugaauugaucuauuuaaacauuagauagguacuuaauuuaaaugcaagccuccagag

SEQ ID NO: 4150110 - RNA, 59 nt, Human
cucugguucaucgaccugacugcugauugaaagagcugacagugguagaugagcaggag

SEQ ID NO: 4150111 - RNA, 71 nt, Human
cucugucaaccuagcaagagauuaagccaagcaggccuggguuuggcuucgcugcuagcuaguugguggag

SEQ ID NO: 4150112 - RNA, 75 nt, Human
cucugucccuagcugagucaugggacuggggaagcuaccacucagauuccuccugugagcagcacagagacagag

SEQ ID NO: 4150113 - RNA, 57 nt, Human
cucuguccucacagccuuuuugcaguucaacaaacacaggcccugccagggacggag

SEQ ID NO: 4150114 - RNA, 56 nt, Human
cucugugagggucuguacagaacuuguuuaucuuugugccccuccccaccacaggg

SEQ ID NO: 4150115 - RNA, 91 nt, Human
cucugugaucauucagcuucaggacccugagccaccuccuggcaucugucauuuucagggccugucuguagaacugaagggguuacaugag

SEQ ID NO: 4150116 - RNA, 60 nt, Human
cucugugccagucugcacucggcuggaguaccagauaauccuucccgagucuguauggag

SEQ ID NO: 4150117 - RNA, 61 nt, Human
cucugugccuucuacuucacucuaggaaauuccugagaggaaugagaggaaggcaucggag

SEQ ID NO: 4150118 - RNA, 55 nt, Human
cucugugggcaauuauuaacucugcacaggaacgggaaaauagcugcucagagag

SEQ ID NO: 4150119 - RNA, 86 nt, Human
cucugugguuggagacaguuuaaccucuguaguagguucuguaguuaugguaagcuccagguccagagguucaacugugacuugag

SEQ ID NO: 4150120 - RNA, 98 nt, Human
cucugugucacuguuucaaaacaaagcuaguaauauuuuaauccccucaccacaagggcaugucuaauauagcuugucaugaggccagugacuuagag

SEQ ID NO: 4150121 - RNA, 64 nt, Human
cucugugucuuuaaagauuucauuuguuguugaaaaaaaugagugaauucaguuuaaaacagag

SEQ ID NO: 4150122 - RNA, 78 nt, Human
cucugugugcgucccuguggcuaagacaugacaagguagggcuuucaguggcauuuguuacagggccagcacacagag

SEQ ID NO: 4150123 - RNA, 57 nt, Human
cucugugugguaugauugucauuucccuuuuagagaugaggaaacugaaacacagag

SEQ ID NO: 4150124 - RNA, 57 nt, Human
cucugugugguccucuguauugaaaauacuugauguauucuaagagaccacccagag

SEQ ID NO: 4150125 - RNA, 81 nt, Human
cucuguucaccaggagcauuuuuuauuaguugcuauugugcaguuauuacugacugaaaaauacucaugggauuauuagag

SEQ ID NO: 4150126 - RNA, 89 nt, Human
cucuguuccagcaacccugguuggggggucagacuugauacacuuucagguugggaguggacccaccccagggccugcugaggacagag

SEQ ID NO: 4150127 - RNA, 55 nt, Human
cucuguucuucuaguccacugacagaacagucugucuguugagaugagagcagag

SEQ ID NO: 4150128 - RNA, 100 nt, Human
cucuguuuacucugcauugucaauuaugagguagauaucacauguguuuagccgaaaagauaaugcacaguaucucauaacaguguagaacaagacgggg

SEQ ID NO: 4150129 - RNA, 55 nt, Human
cucuguuucucagccuauuuccacuuguauggagcaagugggcuagaaaucaggg

SEQ ID NO: 4150130 - RNA, 93 nt, Human
cucuguuucuugccagccuuggacuucuaccauagcacucagacugagcuuagugucugugaugaggucaggaaggaaugcaagguagcuaag

SEQ ID NO: 4150131 - RNA, 68 nt, Human
cucuguuuguccaaaggccuuuugagauggcuggugaaccacucuuaagcaagcuguuggcaauaggg

SEQ ID NO: 4150132 - RNA, 105 nt, Human
cucuuaauuauauuaaagcuaaacacuuacuauguuuuucucggguuaauaagaaaaacuauuuuugcaacucuugaaaagcauuggauuugaaaggauagagag

SEQ ID NO: 4150133 - RNA, 76 nt, Human
cucuuacaugcacacaaaugugaacgugccucugauguuacuccaagauagguagugcauauuuuggauguaagag

SEQ ID NO: 4150134 - RNA, 86 nt, Human
cucuuaccuggugcuccucgcuaccaggugugggaucucccauaguccugggugugcaaggcagauacaaacaugccaggucagag

SEQ ID NO: 4150135 - RNA, 58 nt, Human
cucuuacgguacuaugaguugccaccaugucaugcaacauaacauauugcugaaagag

SEQ ID NO: 4150136 - RNA, 64 nt, Human
cucuuauaugcacauacauugggucuacugcacaaauuacagggcuccaagugucuuaugagag

SEQ ID NO: 4150137 - RNA, 85 nt, Human
cucuuaucuccuuuagccuggcagauugacauagccauuaaugaaaaugaacaauaugccagaaauauuuaacaggagguaaggg

SEQ ID NO: 4150138 - RNA, 62 nt, Human
cucuucacugguccuagguucagucucugccaacacagagcugccccaggccucgggaggag

SEQ ID NO: 4150139 - RNA, 79 nt, Human
cucuucaguggcuuuguuuccaaaugaaaaccagaaaaaugaugcuggaauuucauagaggcagcggcggauggaagag

SEQ ID NO: 4150140 - RNA, 67 nt, Human
cucuucauaggcacccugucugagggagaguucugcaguccccucaggcucugggugccuaccuggg

SEQ ID NO: 4150141 - RNA, 57 nt, Human
cucuuccaggaggauauggucccuuuuaccauuuagggacaguaguagucaggagag

SEQ ID NO: 4150142 - RNA, 57 nt, Human
cucuuccucuucugcugagaagugggggaauggacuuuggaggugggagggggaaag

SEQ ID NO: 4150143 - RNA, 81 nt, Human
cucuucuaaaccucuauguuaccucuauuagaauauuauuucugauguaguuuguggagaaacaaagcaggaauggaggag

SEQ ID NO: 4150144 - RNA, 89 nt, Human
cucuucucaccuugcagaauggagugagaguuaccaaauguagagcaaggucacagacuugucuccagggaugcuaggugaugacagag

SEQ ID NO: 4150145 - RNA, 70 nt, Human
cucuucuggccgccuccucacagcagccugggagcauucccuccacagcagacagggaggcggcugagag

SEQ ID NO: 4150146 - RNA, 60 nt, Human
cucuugaccucgugauccgcccaccuuggccucccgaagugcuaggauuacaggugugag

SEQ ID NO: 4150147 - RNA, 72 nt, Human
cucuugagcccaggaaguggaggcugcagugagcugucacugcaccacugcauuccagccugggugacagag

SEQ ID NO: 4150148 - RNA, 57 nt, Human
cucuugcuugcaaguggggauaaaaauagcuaccccauagauaauuguaagggauag

SEQ ID NO: 4150149 - RNA, 77 nt, Human
cucuugggcaccuuucagucaguuaacucagaaaguguuuacuuucaugacuuaacugacugaaagcauccaaggag

SEQ ID NO: 4150150 - RNA, 79 nt, Human
cgcuuagcugccagcccagcugccugccugcugucuccccacagggcugcaguagagccagcaugggaaacauugagug

SEQ ID NO: 4150151 - RNA, 56 nt, Human
cgcuuauguguauagggccaguaacauuuucagaguugucuuguaacacauaagug

SEQ ID NO: 4150152 - RNA, 90 nt, Human
cgcuucccgagucuaguuaggaguauaggaaugccuguuucuggcacauuaaccagucugggcauacaugagcucuaaagcagggaagug

SEQ ID NO: 4150153 - RNA, 108 nt, Human
cgcuucgcucccggccacgccuaucccaugaugcccccaaaucuggcucaaaagcugcuaguacugagcgcugguaaggggugcggggguggcguuggugggaaagug

SEQ ID NO: 4150154 - RNA, 72 nt, Human
cgcuucuccagccaccaccacugaaagguuauagaauauucuauuucaggacaccuuuaaaaacgagaagcg

SEQ ID NO: 4150155 - RNA, 55 nt, Human
cggaaacuugagaaccagccagaacauguagccuggcucuuggugcuaguuucug

SEQ ID NO: 4150156 - RNA, 69 nt, Human
cggaaagguggcuuccagcaguuauuacauucuucccucuucggaaggacugcuaggaagccgugucug

SEQ ID NO: 4150157 - RNA, 78 nt, Human
cggaaccagagucaggggcuauucagacuggcacagccaauguguccuacugaggagcuccuuugcugcuguguuuug

SEQ ID NO: 4150158 - RNA, 73 nt, Human
cggaagggcccagcgugguuccaucugcacauuccccuaccuauuccagaccuacacacgcauggguugucug

SEQ ID NO: 4150159 - RNA, 58 nt, Human
cggaagguggccggaagagccccgucccagcucagaugggcuuccccgccaucuuccg

SEQ ID NO: 4150160 - RNA, 65 nt, Human
cggaaucggaagaggugcacaugaacucagaaaaacugcguuucuaagugugauuuuagauuccg

SEQ ID NO: 4150161 - RNA, 129 nt, Human
cggacagaguuccuucucaggcagccggccaaggacaccagaaauuaagcaggggucuguggcucugccgucuagcuaugaccaaauuuaaauuugugcuuuuugccuugccugccagugaaccugcug

SEQ ID NO: 4150162 - RNA, 80 nt, Human
cggagagcagccgcgggcccuuuaagggccgcgaggugcgcggucucuuuaaggcggguccuggugguuucuguuuucug

SEQ ID NO: 4150163 - RNA, 62 nt, Human
cggagaugguauuugggugguaguuugcucuccaucagugcuaaagcaaaugccccucucug

SEQ ID NO: 4150164 - RNA, 69 nt, Human
cggagccuucaaaggaggugcugggucuuguccuccagcccgagcgcaccuguggaaaucaugguucug

SEQ ID NO: 4150165 - RNA, 113 nt, Human
cggaggcuagaaaucuaagaucaaaggugacaggauugguugcuucugaggccucucuccuuggcuugcagguggccaucuucguucugugucuucacaaggucuucccucug

SEQ ID NO: 4150166 - RNA, 125 nt, Human
cggaggugggaaggggccuaacggucagggcucagagaagcgguuucgccuucuuuuccgcggagggauccagacacgaccgcguccugaggcgguucugaaaagccgggccccuuaaaccucug

SEQ ID NO: 4150167 - RNA, 92 nt, Human
cggaguuuguguuuugcuaacagaguuuguaaggcucagaggguguugaaauguuucugagguuacugcuuuguagaacacauaggauuuug

SEQ ID NO: 4150168 - RNA, 79 nt, Human
cggauagcgcaauugauuugcucuuugcuuuuuacuugggagacaugcccagcugaacauguagagcaucucaggucug

SEQ ID NO: 4150169 - RNA, 55 nt, Human
cggaugagccacuuuggaugggauguucacuucccagacaaucauuggccaccug

SEQ ID NO: 4150170 - RNA, 78 nt, Human
cggauuauuaggcaaagauauuacguaguaaaguuuacuuaaacuaagguaagauuuuggacugugccuaaugauuug

SEQ ID NO: 4150171 - RNA, 64 nt, Human
cggauuuuaguagucuuuagagaucauuuaccgcaaugauuuccaaaaggcuucuaagggccug

SEQ ID NO: 4150172 - RNA, 55 nt, Human
cggcagaacgcuuguggccgccguuacgcucguguggaaacagcgccaucugccg

SEQ ID NO: 4150173 - RNA, 60 nt, Human
cggcagaugagguguguggccacuagaggcggcucugaauggcaggcaccucaagugcug

SEQ ID NO: 4150174 - RNA, 57 nt, Human
cggcagccagcggcucgagcaugcgcugagaguuugugcagcuggcccuggcugccg

SEQ ID NO: 4150175 - RNA, 69 nt, Human
cggcccaugguggcuuggaccagucacagugguccgggggcccagaugaggucugagcagaguggggug

SEQ ID NO: 4150176 - RNA, 78 nt, Human
cggcccauuugcguucuaauuucaggcguuccucaauccucuguggaaccaggaagggcgcaaauuauaaagggacug

SEQ ID NO: 4150177 - RNA, 57 nt, Human
cggcccuccagcugggguccuugcccacaggugacaaccucccagcuggcagugccg

SEQ ID NO: 4150178 - RNA, 55 nt, Human
cggccgcgacccgcagcucaaucgcagggcaaaccgagcugccugugcgcgcccg

SEQ ID NO: 4150179 - RNA, 81 nt, Human
cggccuccucuagggcuggguacacucuugccauggacaucugccuccugguuccuguuuggcccaguucagcccaggccg

SEQ ID NO: 4150180 - RNA, 70 nt, Human
cggccugcuaggcucugguagagccagggcuggaauuucccuggccccagaucccagagucuagagguug

SEQ ID NO: 4150181 - RNA, 64 nt, Human
cggccuggagucuuagguuauggugagcccaguguuggguuuuacuguggcaggcccaguguug

SEQ ID NO: 4150182 - RNA, 125 nt, Human
cuccuucccuuccccacccucuggccccagaaucuccuuggucucguuccaggccccccagcccugggccucagggucugaggagaccgucuggagccaggccugagucgggggugggaagagag

SEQ ID NO: 4150183 - RNA, 77 nt, Human
cuccuuccgcggucuuucuuacgcauaccuaguauauagagaaauuugaaccuuuugcuaagaaguuauggaggggg

SEQ ID NO: 4150184 - RNA, 87 nt, Human
cuccuucggugguggagauucagggacucacuccuauaauuccuucagcuugggucucuguugccuccaucaaguggccguaaggag

SEQ ID NO: 4150185 - RNA, 112 nt, Human
cuccuucuccucuucuccucaaaggcaggucauggccacuuuuuaaucugcaaaaaaaggauuacuugaguuucacuaaugaccuuuuuugacaagaaaaaaugggaaggag

SEQ ID NO: 4150186 - RNA, 99 nt, Human
cuccuucuuuccucccucucucugggcuuuguccugagacauccggaaaggaaagggcagucagacagcagccacagggagagggugguaaguggggag

SEQ ID NO: 4150187 - RNA, 103 nt, Human
cuccuugccucuccgguguguuuccugugucccgggcacccugcagaccuccuguuccugccacgggccuggggcaggggcaucaccaggacaggcuugggag

SEQ ID NO: 4150188 - RNA, 110 nt, Human
cuccuuggccaucauuccguucacaaucauuccguucacaacagggccaugcugcaucuggggaaaggccggugaucaugugagcaugaguggucauggucuauaaggag

SEQ ID NO: 4150189 - RNA, 72 nt, Human
cuccuugguguaguacugagcaauucaucuuccucuugacacugcccucaccuguaucugaaugccaagggg

SEQ ID NO: 4150190 - RNA, 109 nt, Human
cuccuuuaggaugguagauuuaguuagagaagccacaguggacaggucaaauccugugaucuuugguaaucuggcacauucauugauuuuauuauuuuguaaauuggag

SEQ ID NO: 4150191 - RNA, 63 nt, Human
cuccuuuucauagucaaguguguaugaguuuuuuagcugauggacguaggacuguugaaggag

SEQ ID NO: 4150192 - RNA, 128 nt, Human
cuccuuuuucagcacauuugguuugccuugauuuugacaagagugugauugcugcuaccccauuaugaaauuggggauagagaucuguggauucauugucaagguggaggaugcaggcagggaaagag

SEQ ID NO: 4150193 - RNA, 87 nt, Human
cucgaacauguuccagccuagcccuggagcagggaaauacaguuugcuggauuccucccuucuuugggugguaggggcagauuuggg

SEQ ID NO: 4150194 - RNA, 64 nt, Human
cucgaggcuuuaggucuugguuugaauccagacuagaaaaucauuacuuauuaaaagccuugag

SEQ ID NO: 4150195 - RNA, 81 nt, Human
cucgagguggagguguugggugaggugccugcagcuggcagcaguucccuccgccagcacuucuuuguuacccgcuucgag

SEQ ID NO: 4150196 - RNA, 110 nt, Human
cucgccaugaggacacuggaaccucggagccuguagcugggccucggcagugcagccacgguguauggcacugcagaguguuugcuaggcucaaagccggaaucugcgag

SEQ ID NO: 4150197 - RNA, 71 nt, Human
cucgccccugccugugggcaucaacaugucugucgagguccuggauugaacauaggcagaggaagagcgag

SEQ ID NO: 4150198 - RNA, 72 nt, Human
cucgcccgcacaggagcaagaguccucgucguuuuuaaucuggaaaugcacucugcuucugugacggguggg

SEQ ID NO: 4150199 - RNA, 75 nt, Human
cucgcgccugcgccaucucccggaaaaauuucgcgccacgcagagaugacagccaaggagaugaaggcgaccgag

SEQ ID NO: 4150200 - RNA, 68 nt, Human
cucgcguggcccgaagauccgagggucacacuacgugacuucugggugucuguggguacugcuguggg

SEQ ID NO: 4150201 - RNA, 67 nt, Human
cucgcugcagcccugcggaucacuucuccaggccuagggcugagggaucucuggggacugcacugag

SEQ ID NO: 4150202 - RNA, 62 nt, Human
cucggcuuccacauuuuuucaugucauuauuaaacucauggagaauacaaccagaagcugag

SEQ ID NO: 4150203 - RNA, 69 nt, Human
cucggguccuucucuagccuccuggguaaucucugcauauagagugcccaagcagaggagugauucggg

SEQ ID NO: 4150204 - RNA, 67 nt, Human
cucgggugccugcccugaaagaggugaaggaacucugaccuugccuaaacccagcccaggccccggg

SEQ ID NO: 4150205 - RNA, 62 nt, Human
cucgguagccauuggcaaugaagccucagaaauguuuucaggagucaugucaaugucucuag

SEQ ID NO: 4150206 - RNA, 80 nt, Human
cucgguagccguguggcgcagauuuccuccuccguggucucccgggcaacgcggagcugccugccaagccugcugccggg

SEQ ID NO: 4150207 - RNA, 80 nt, Human
cucggugguggcacugacaccuggcugaggucaccaguagcugagagacuccuuagcuagugcucagcugucacacuggg

SEQ ID NO: 4150208 - RNA, 62 nt, Human
cucguagggagagugcuacacuccagaacuagcagaagugggagcuguuacucucucuggag

SEQ ID NO: 4150209 - RNA, 64 nt, Human
cucgugugagaaucacagccaggucagcugguagccucuggcaagugauuuaucaugucccgag

SEQ ID NO: 4150210 - RNA, 65 nt, Human
cucuaauugaauaguuauucugcucaucucugagagauugagcaggcaaaguaucauauuuagag

SEQ ID NO: 4150211 - RNA, 97 nt, Human
cucuacacagcuuccgagcuagcagcagcacacauucagggaacauuggagggauuuucuucuucuuuugugggugguaauguuggugguuguggag

SEQ ID NO: 4150212 - RNA, 101 nt, Human
cucuacccugaaaaagccuccacaauuguaagugugcacuaauaaugaaaggugcauugaugaugcacauuuauaauugugggggcuuugucaaggugaag

SEQ ID NO: 4150213 - RNA, 84 nt, Human
cucuaccuuguacaagcugugugacuauuucugagucauucaugagcucuuagaggaccaucaguuugcucauaauggguggag

SEQ ID NO: 4150214 - RNA, 75 nt, Human
cucuacuaagcugucuagauuuuauccauuuuaccuugaugauccagauuuugggcaguucaaaaaugaguagag

SEQ ID NO: 4150215 - RNA, 65 nt, Human
cucuacucgauguguccacuuggcugucuaauuggugucccaaaguuaacacauccagaauagag

SEQ ID NO: 4150216 - RNA, 60 nt, Human
cucuacucugcuuucaguucaacaauuccuuccuaguuagaaggacugagguaaggugag

SEQ ID NO: 4150217 - RNA, 85 nt, Human
cucuacugaauaccuaagagaaucagugagcaguugugauaugaugguaucuaccacugauuccugaugugaaauuguucaaggg

SEQ ID NO: 4150218 - RNA, 67 nt, Human
cucuacuuauucaucugcaccaguucugacucucccagugagcagccaauuggaggaugaaguggag

SEQ ID NO: 4150219 - RNA, 78 nt, Human
cucuagaaacaaacaauuaguuguguggaagaaaugaaauaauagaguccagacuguccugacuguuuguuccugggg

SEQ ID NO: 4150220 - RNA, 58 nt, Human
cucuagaacugauugggaagaaaggaugugcaagucuacuucccggaagaucuuggag

SEQ ID NO: 4150221 - RNA, 107 nt, Human
cucuagacagccucggugccuuacucugagggauguacaagaaacauuuuuccagugauggaaagauucuuaccuauacccagugagaggaaagagagcauuugaag

SEQ ID NO: 4150222 - RNA, 81 nt, Human
cucuagagguaaaguauguuguggcuuuuaaaauagaauuucuguguuuaaaaaauguccauuuaugcauuguuucuagag

SEQ ID NO: 4150223 - RNA, 63 nt, Human
cucuagaguacgggcuggcaugccucuuuucuguuucagcguguuggcagcagugcucugggg

SEQ ID NO: 4150224 - RNA, 130 nt, Human
cucuagcucuugaccuugggcaagucacugucccugucugaacuguuuccucaacugucaaaugggggaguaaaugccuuccccacagcuuguggagagaaugcagugggcucaugguugguggcaagag

SEQ ID NO: 4150225 - RNA, 82 nt, Human
cucuaggcuggcugguuugcauucugaaaggcucacucacaggugagccauuaccaccugcaggaaucagcuagccugggag

SEQ ID NO: 4150226 - RNA, 60 nt, Human
cucuagucaccuuuggcaccugcaaaauagaaguuuugcuauaguggucuagggugagag

SEQ ID NO: 4150227 - RNA, 61 nt, Human
cucuagucauuugcggugucugcggaggucugcaagaucacaaucuucaaaucgauucgag

SEQ ID NO: 4150228 - RNA, 60 nt, Human
cucuaguuaguauucuucagugguuggaaaucucucuaaacuguuaagacguagcugggg

SEQ ID NO: 4150229 - RNA, 77 nt, Human
cucuauacaaguuucacuuugacauguuaccuuaucauauacuuaauaagaggaggcugaucauaugagguauagag

SEQ ID NO: 4150230 - RNA, 113 nt, Human
cucuaucucuuuuuuaacugcuuuauugagguauaguugacaauuuaaaauuacauauauuuaagauguacaaccacuucucuugaagacagagugaaaagguccugaaagag

SEQ ID NO: 4150231 - RNA, 97 nt, Human
cucuauguugugaaugcucauucucuugucuguauuuugaagguucacucuggugaacccaggaggugacacagggcuuggcacaaucacuauagag

SEQ ID NO: 4150232 - RNA, 113 nt, Human
cucuauguuguucacggguuguucgcaguuuaguccugccaccauggguugaaggcacaaaauaaauaaauccaaugcagauaagacaaacaccucauggucauaaccuagag

SEQ ID NO: 4150233 - RNA, 58 nt, Human
cucuauuugucaguuuggcuuuaagguuuucauuuuguuggcuagaagacagauaaag

SEQ ID NO: 4150234 - RNA, 81 nt, Human
cucucaagcguggcugcucugauggacgcugaacacugauuucugaacgaagccuuucccacagaugccacacuuguaggg

SEQ ID NO: 4150235 - RNA, 84 nt, Human
cugcugagggcuauucucuguuuccaagaugaaacuuuuugguaaauccuuggaggggaggaaugcuguguccucaaauggcag

SEQ ID NO: 4150236 - RNA, 68 nt, Human
cugcugagguccuugcucagacucaccccuauccauaagucugagacaaaguugccuuuacaaagcag

SEQ ID NO: 4150237 - RNA, 57 nt, Human
cugcugauguaagccaugcucugcugaucucaacggaguguaccuaugcaucugcag

SEQ ID NO: 4150238 - RNA, 56 nt, Human
cugcugcauuccucuuuaugagccuucucuggggugcuuaagguacaaugcagcag

SEQ ID NO: 4150239 - RNA, 77 nt, Human
cugcugccucugcauguuugcaucugaggaauuuucucuaguacugcaaguccuccugucagcacgcaugaggccag

SEQ ID NO: 4150240 - RNA, 66 nt, Human
cugcugcugagaaaaaugaaaagcucuuaaaggccauagacaaagcuucauugaccuccgcagggg

SEQ ID NO: 4150241 - RNA, 55 nt, Human
cugcuggaaucuuuaagcuggaaagaaauccagucuugaaagguagagucuacag

SEQ ID NO: 4150242 - RNA, 57 nt, Human
cugcuggccuagcccauccucucuggagcucaggcugaggcagggcuggcucagcag

SEQ ID NO: 4150243 - RNA, 55 nt, Human
cugcuggcuucuagucauucaaaucacuaauuugaauagugaagaagugagacag

SEQ ID NO: 4150244 - RNA, 68 nt, Human
cugcugggaagucaggcuauauuuuuggcaucacagugaucuccuuaguaccugauuucacagaccag

SEQ ID NO: 4150245 - RNA, 58 nt, Human
cugcugggguuuccugcagauggagcugcagcucagggacaaggggagaccccggcag

SEQ ID NO: 4150246 - RNA, 126 nt, Human
cugcuggguagcauaagaaguggauauuauggguauauggcuaaggggaaauugaguugggaaauuuaguuaggauuuggugguauaaaauuaugugguauauagucaccucuaugucucauuaag

SEQ ID NO: 4150247 - RNA, 91 nt, Human
cugcugggucaggaguccugccugcagccuucauccagugcauguugauggagcacgggaugcauggcaggugcuaaucucagaucugcag

SEQ ID NO: 4150248 - RNA, 121 nt, Human
cugcuggucuugcuuuugaaaacugugacuuuguuauucuagggccucaaguccugaucagagcagguucuagaaccuaggaguacuaaagucaguguaagaaaaauugaaagagaagcag

SEQ ID NO: 4150249 - RNA, 93 nt, Human
cugcuguacucaacuacauggcugcaguugugugaaggccgccccuccuaggcugucuggucaacaacugaguguggugagagacuaaggcag

SEQ ID NO: 4150250 - RNA, 56 nt, Human
cugcuguagagaaggguugucacuauguugcagcucugagacucuacagaagucag

SEQ ID NO: 4150251 - RNA, 75 nt, Human
cugcugucaugucugaggucauuccaaggacaugggagacugcuguccaugguuggauccucuuaacaucagcag

SEQ ID NO: 4150252 - RNA, 107 nt, Human
cugcugugaucaaggaauuagauaaucuggcuuguuugcuuaaggggucuguaucuugagacuuuuauagggcaguauuaaagcucugagccuccuuauuaugccag

SEQ ID NO: 4150253 - RNA, 58 nt, Human
cucucucuccuggguaaaaggguugauugccauccaggcacauccccaugagagagag

SEQ ID NO: 4150254 - RNA, 56 nt, Human
cucucucucggucuucugacccgaggauccuaccauguuaugaaggcuggggggag

SEQ ID NO: 4150255 - RNA, 62 nt, Human
cucucucuuugauauuuuuagccaucagauaccuugucugcaaugugugcucagagagugag

SEQ ID NO: 4150256 - RNA, 61 nt, Human
cucucugcaaguuuugaaauagauuuuugcauucauuuugacuuacggacuugcaagagag

SEQ ID NO: 4150257 - RNA, 80 nt, Human
cucucugcccccacucucggucuacccccuccaaggaguccaaagacccaggggagguccucagggaaggggcaagggag

SEQ ID NO: 4150258 - RNA, 61 nt, Human
cucucugcuuuacucauaggguuucaguuguuugaccuauuucucagaauagagcugagag

SEQ ID NO: 4150259 - RNA, 89 nt, Human
cucucugggagucuucugaauuacagcagguguuagguucaguagcgccuagcuuugccugaaguaaucagcaaacuucaaacagaaag

SEQ ID NO: 4150260 - RNA, 80 nt, Human
cucucugggauacacauuuuagcuuugucuuuauuggagcaaagacagcuaauaaaugaguguguucucaugaaugagag

SEQ ID NO: 4150261 - RNA, 62 nt, Human
cucucuggggcuuguagcagguuuuaauccugagauuacacucugguugugggccuugggag

SEQ ID NO: 4150262 - RNA, 57 nt, Human
cucucuggucccagauuccagaagcccucucaucuggcuuuggcucuggucagagag

SEQ ID NO: 4150263 - RNA, 66 nt, Human
cucucuucucccucccaugucuccaugcacucuauguaaugaggaaauagagggaaugaaggagag

SEQ ID NO: 4150264 - RNA, 58 nt, Human
cucucuucugcagaauuucucagagccuuugcuaugcucugagcgucuaagaggugag

SEQ ID NO: 4150265 - RNA, 67 nt, Human
cucucuugaaggggggcaguguugaucugaaucuuuuugucuaaugcuuuuucuuccucugggaggg

SEQ ID NO: 4150266 - RNA, 63 nt, Human
cucucuuggaugguauaagaauaauagaugaggaagcuacuauucaccuuucaugcaggagag

SEQ ID NO: 4150267 - RNA, 75 nt, Human
cucucuugggcucucugggccuuuguuccucuuuauuuacagagagagaagcauucuucucagggcacaagagag

SEQ ID NO: 4150268 - RNA, 76 nt, Human
cucucuuuacuggcugggugacucaggcaaguggcuuugcaucacugagccucaguuuucucaucuguaaaauggg

SEQ ID NO: 4150269 - RNA, 69 nt, Human
cucucuuuuucgugugccgaagccaugauuucucaaauucauucaguugugucauacaggaaaaggaag

SEQ ID NO: 4150270 - RNA, 59 nt, Human
cucugaaagacaagcucucauuauucccaucuuccugaugaugagcaguguguucagag

SEQ ID NO: 4150271 - RNA, 84 nt, Human
cucugaaagguggugggcagccuccuuuauuuuccuguuuucaugcuggaagauggaaaauggguuggaucacacucuucagag

SEQ ID NO: 4150272 - RNA, 67 nt, Human
cucugaaaguuagagaaaauagguggccauaagccuuaagccauauaaugaguuuaaacauucagag

SEQ ID NO: 4150273 - RNA, 56 nt, Human
cucugaacaacuugucauuccaagaaacacuugugaagaacaguuuguuccuugag

SEQ ID NO: 4150274 - RNA, 101 nt, Human
cucugaacuuggugaaaucaauuuuugacaaauugagaugaagaacuaauaugaggcuuggcauccacuuugcaaguuuaugaucuaaguugcauacagag

SEQ ID NO: 4150275 - RNA, 66 nt, Human
cucugaagggagggccaagcccuccauccaaccauucacugggccugucccccuccuccuucagag

SEQ ID NO: 4150276 - RNA, 59 nt, Human
cucugaauacuuuaagaauuguggaaagguugcacuccagaaaaguagaguuuucagag

SEQ ID NO: 4150277 - RNA, 65 nt, Human
cucugaaugaaguuauauuggcagcgcuacguuuaucacauuggccacuguagacucauucugag

SEQ ID NO: 4150278 - RNA, 73 nt, Human
cucugaauucuuuuguuuauggauuguagaaacugcuuuggggguaguuggauguagaagcagaaggacagag

SEQ ID NO: 4150279 - RNA, 60 nt, Human
cucugacuucaugaguguucaugaagcucuuauuuuagagcuauauucaagaagacagag

SEQ ID NO: 4150280 - RNA, 67 nt, Human
cucugagcacagcugucugaagcaggaguccugacccaggaaacucaaauggacaguugggccagag

SEQ ID NO: 4150281 - RNA, 59 nt, Human
cucugagcagaggccguggcuacuugaucugccgggaccagggcaacgcugucucagag

SEQ ID NO: 4150282 - RNA, 58 nt, Human
cucugagcccgcugcagccccagguccuuggggcagggguagccaggcgugcucagag

SEQ ID NO: 4150283 - RNA, 70 nt, Human
cucugagcccugugcagauggcagcuggggcaggccuccugcagacccaggugacugacagggcggugag

SEQ ID NO: 4150284 - RNA, 65 nt, Human
cucugaggauggggaaaaaauggaucuuuucuacauaaagacucaauuguucccuaaucuuagag

SEQ ID NO: 4150285 - RNA, 77 nt, Human
cucugaguagcugggacucaacugucugggacccacugucugggaacucagccgggugagcccugcuuggcugagag

SEQ ID NO: 4150286 - RNA, 64 nt, Human
cucugaucuagaccagaagcuguuguaagaauaucuugacaacaucucucacuggaagccagag

SEQ ID NO: 4150287 - RNA, 123 nt, Human
cucugauguugccaucucugucagcaagccgaaccaaacuguucacacacggaggccacaggacacugaccauugccugggcagggugugggggucggcagggcugggcagaccggcaaaggg

SEQ ID NO: 4150288 - RNA, 96 nt, Human
cucugauuauuggccugcuguuuguauggaccuguucuaugcauacuuuguaaugguucacauccuauaauuacagcaccaacauuuccuucaggg

SEQ ID NO: 4150289 - RNA, 76 nt, Human
cucugauuuucauugacaguucuuuaaguugcuuuggaaguguuguagcauuuugcuccuuaaggcagagucagag

SEQ ID NO: 4150290 - RNA, 76 nt, Human
cucugcagccagaggcaugaaaacuuuuuaaaaaguaucuucuuuucaguuucacucaguuggcuguaaauuagag

SEQ ID NO: 4150291 - RNA, 87 nt, Human
cucugccucauaucgggaaaguuuauaaugcucucuucaucaggugauagcagaagaacgucuuauaaauucacugauuagacagag

SEQ ID NO: 4150292 - RNA, 80 nt, Human
cucugcucauugcuguugguaguucugcuuguggccagcaaagccacauaauaccuaggacaguuugaugacaugcaggg

SEQ ID NO: 4150293 - RNA, 112 nt, Human
cucugcuuauaaugugugcuuuucggaggcuuuucuuagcauuaacggacgcucugggagaggagaaaguuggcagagagaagccuagcaaauauauaaauaagcuuuggag

SEQ ID NO: 4150294 - RNA, 100 nt, Human
cucugcuuuacauggcuacguuguuugagggcaggaguuggugagaauuaguuuggaaaacugacuucucucauucagacauagcuuuucuggagcagag

SEQ ID NO: 4150295 - RNA, 76 nt, Human
cucuggaacacagacagggcugaacugagcuugugagacuucaggucuugaggaccggccagcccuugggccagag

SEQ ID NO: 4150296 - RNA, 76 nt, Human
cucuggaccacagugcauggccuguaggcugacugcuuguuucugcuuuaaucuacauucugcucuguguucagag

SEQ ID NO: 4150297 - RNA, 66 nt, Human
cucuggacuuguacauacucaguuuugcccuauccggguccacccugagcauguagaguacuggag

SEQ ID NO: 4150298 - RNA, 57 nt, Human
cucuggagaacgcuauggaucuguagagagucccauagauuuguggagugcucugag

SEQ ID NO: 4150299 - RNA, 60 nt, Human
cucuggaggcagcaccagccagccaggaccagggcauggguggacugcagugucccagag

SEQ ID NO: 4150300 - RNA, 59 nt, Human
cucuggagugcagccugguggcuuuuaagaggagacacccggcgaaaugcucuccagag

SEQ ID NO: 4150301 - RNA, 59 nt, Human
cugaggcagaagaaaacuaaaagauucugaaggauugaaagaguuuucugcugcaguag

SEQ ID NO: 4150302 - RNA, 104 nt, Human
cugaggcaggagaaucacuugaacccaggagguggagguugcagugagccgagauugugccacugcacuccagccuuggcaacaagagcgaagcuccgucucag

SEQ ID NO: 4150303 - RNA, 104 nt, Human
cugaggcaggagaauugcuugaacccaugagguggagguugcagugagucaagauugugccauugcacuccagccugggcaacaagagcgaaacuccaucucag

SEQ ID NO: 4150304 - RNA, 78 nt, Human
cugaggcauccacugagcagaccauggcagaggucuucuuaaagcaccuacugugagcauggcugccccagugccuag

SEQ ID NO: 4150305 - RNA, 64 nt, Human
cugaggcauguuacaggacauaggaggagggacagccacccugaauguccuguugcugccccag

SEQ ID NO: 4150306 - RNA, 83 nt, Human
cugaggccaacuucugggcaugcugaguagccagaaguuuuauucaccauaauagaagcuuuucucaguguccuugguaucag

SEQ ID NO: 4150307 - RNA, 60 nt, Human
cugaggccugggggcguggacgugacuauuaugaugcuguccaagugcuuuugguuuuag

SEQ ID NO: 4150308 - RNA, 80 nt, Human
cugaggccugucauugucuuguucacauaccagggcgaguugaagaugaaggaugggaccaagacaaauggaguccugag

SEQ ID NO: 4150309 - RNA, 84 nt, Human
cugaggccuuucaagcucccagggcugggcaaguuuuaugaaacgucuucccagaagccacugggagaaccagggcagccucag

SEQ ID NO: 4150310 - RNA, 58 nt, Human
cugaggcucuuuaaaucuuuuggaucuacccagguuccaggagaauuccagggcccgg

SEQ ID NO: 4150311 - RNA, 56 nt, Human
cugaggcugggcaugggguccacaucugguagaaaggucccagugcucagucacag

SEQ ID NO: 4150312 - RNA, 79 nt, Human
cugaggcuuaaugaguuaaaucacuugccgaauaucaugguuugaaaauggcagaagugaauuaaaaagugggccugag

SEQ ID NO: 4150313 - RNA, 55 nt, Human
cugagggaauggaaggagguggccgcgcuaccaccaucugcuugccuguccucgg

SEQ ID NO: 4150314 - RNA, 61 nt, Human
cugagggagaagugaucucuacugauagcuuucuucaguggaggaucuugguuucuuucag

SEQ ID NO: 4150315 - RNA, 77 nt, Human
cugagggauugacucaugggcuugacccuacagaaaguuaugaacuggucuguguguuugcccugucccuucuuuag

SEQ ID NO: 4150316 - RNA, 78 nt, Human
cugagggauuuuuuuugggaaaaguaaacuuugccuuacacuugggcauuuguugaguugccagcuaacaucucuuag

SEQ ID NO: 4150317 - RNA, 64 nt, Human
cugaggggcaggauuauugggauuuuucacuucuaaaauuuuguuuaagugaucugcuuuuuag

SEQ ID NO: 4150318 - RNA, 126 nt, Human
cugagggggucuuucaaccuucccucuacauauccggcaucugaagcaaaugaaacagcucucaaucugaugaguugacaguuuuucaaaucuggcauguagugggugcucuuggagaagccucag

SEQ ID NO: 4150319 - RNA, 72 nt, Human
cugaggguccuggaggaauaaucuccuacccuuaaguaagggggagggaggcaguucuucuggggccagcag

SEQ ID NO: 4150320 - RNA, 72 nt, Human
cugagggucugacaaugugacuuagccaucaucaagguaagugaugucugaggacaaaugucaagaucucag

SEQ ID NO: 4150321 - RNA, 61 nt, Human
cugaggguugucuagauuuccucccuuccugcucaagggggcagguuuuuauaggcuucag

SEQ ID NO: 4150322 - RNA, 76 nt, Human
cugagguaauuuuccagauaauccccaccccaaaucggguaaugccuggccugauugaucaggacaguugccucag

SEQ ID NO: 4150323 - RNA, 63 nt, Human
cugagguaccuggagcaggucccccugagcaccgucaacagggucuccuucucaggcauccag

SEQ ID NO: 4150324 - RNA, 81 nt, Human
cugaggucauggggagcucguggcagaaaggaauagaagcuuccaucuggcuggcuucucuguuacagcccccugccucag

SEQ ID NO: 4150325 - RNA, 59 nt, Human
cugaggucugcagggcugugcauacgaucugagccguacugaaaggccaaggacuucag

SEQ ID NO: 4150326 - RNA, 58 nt, Human
cugaggugcuagggucccugcuggccaacccugccauccagagacugggcaccagcag

SEQ ID NO: 4150327 - RNA, 88 nt, Human
cugaggugggcccuauauuaguuaaggguauucuuuuaaauuucacauucucagaaggagaaagaaauuuuugauuggcccagcuugg

SEQ ID NO: 4150328 - RNA, 85 nt, Human
cugagguugugcagacagcugaaggaugauucagggagcagaucccagcucauucucaauucuccuaucagcuggccagcuuggg

SEQ ID NO: 4150329 - RNA, 78 nt, Human
cugcauccuuuucugugcagugagcagcugacguggugugccagcucucauuguauaggcuuuuaucacaggaaguag

SEQ ID NO: 4150330 - RNA, 81 nt, Human
cugcaucgaugagugccucugagccacaugcguuuguucagguggaugggaugaggcagcucagggggaaauugagggcag

SEQ ID NO: 4150331 - RNA, 59 nt, Human
cugcaucucaaccagacugcucucugcaacgauuccagagaugcaguuaugagaugcag

SEQ ID NO: 4150332 - RNA, 56 nt, Human
cugcaucucugcuagucagucauuccagccgugacuugguagcuccaggggugcgg

SEQ ID NO: 4150333 - RNA, 57 nt, Human
cugcaucugcauaaucaacuucuuaaaauuuuuuaggaguuguauugagcagauuag

SEQ ID NO: 4150334 - RNA, 60 nt, Human
cugcaugagccugaggcuccuugagaagauucugggcagggagcuaaaaggcuggagcag

SEQ ID NO: 4150335 - RNA, 73 nt, Human
cugcaugagugaggugucugaguggggaccuguggacagcguggcuuggcucaggcccuggcuuuacauggag

SEQ ID NO: 4150336 - RNA, 73 nt, Human
cugcaugucugugucuaaucaggucagucagaacucugcgaugucuaguugccuuuuagcacaacccaugugg

SEQ ID NO: 4150337 - RNA, 57 nt, Human
cugcauguguguuaagaugcuuucugcguugucagccaaggaaagccccauaugcag

SEQ ID NO: 4150338 - RNA, 72 nt, Human
cugcauucagucuguuguggcauauuguuuugguugaaguauauaaagauauggccucauacagacauguag

SEQ ID NO: 4150339 - RNA, 83 nt, Human
cugcauucccccaguagggccccaaaaugccaggcucuguggaaagcagaccuugccugcuggggcuggggcuggggaugggg

SEQ ID NO: 4150340 - RNA, 55 nt, Human
cugcauuccuuccagacacaagaccuagaauacauaggcuggagaaaggaaucag

SEQ ID NO: 4150341 - RNA, 92 nt, Human
cugcauuugaucgauguaucaucuuaaaucuagaauguggugcugcuaccagacucuacauuuuccuuggggauauuaguuguuacaugcag

SEQ ID NO: 4150342 - RNA, 126 nt, Human
cugcauuuuaggccacccagucuaagacagagagguaaaauauauagugcuugggccacucguuuguuauuaaauucacuauguauucagcuucacuuauauccuuagaaaaguuugcgaaugcag

SEQ ID NO: 4150343 - RNA, 82 nt, Human
cugccaccauuaaugaacuaaaucagccuuugcuauuuuaugaucugucucauuaaaauggaguugauuuucucugugguag

SEQ ID NO: 4150344 - RNA, 130 nt, Human
cugccacccaccacuucacccaagggcuuccaagaacacauguucuuaacuucuguuuccucugaggccuucgagcagugggaaggaacagggugucacuuggagcccaagugucucccaagggguuuug

SEQ ID NO: 4150345 - RNA, 86 nt, Human
cugccaccuucgaauauuuagguuucucucauaugaccuggugcuuucucugugguccuagagggugagcuaggcucgagggguag

SEQ ID NO: 4150346 - RNA, 56 nt, Human
cugccacguaccauuucuuaggguccuuuucaucuccagacuggccuaugugguag

SEQ ID NO: 4150347 - RNA, 55 nt, Human
cugccagcucucuggaggcucuuggggcccauccuacccucaggggaccuggcag

SEQ ID NO: 4150348 - RNA, 80 nt, Human
cugccagguuuugaggccugauaacacacugagauuaauacauggcucaaugauaguacaaucagccuaugaccuggugg

SEQ ID NO: 4150349 - RNA, 95 nt, Human
cugccaucaauguccccaagguucaugaagggugaauauagucuaacucaaaaggacaucuuuauccucaugagaaaagagacucugauacccag

SEQ ID NO: 4150350 - RNA, 93 nt, Human
cugccaucccugcugguggaagggguccgggcucuccacggcgggacaaugucucccacaagccuugguccucauucaggacagggaaggcag

SEQ ID NO: 4150351 - RNA, 84 nt, Human
cugccauggccaggacuagagggaggugaguaaagcacuggaccccagcucauuucacccuaguucuggcccaaaucccugcag

SEQ ID NO: 4150352 - RNA, 73 nt, Human
cugcccaagaaacucacuuugguugaacuuuuaaaaaauuguuccaggcaugucugaguccuucucugggcag

SEQ ID NO: 4150353 - RNA, 100 nt, Human
cugcccacuucuuuucuauuuucaggauucuuucagacuggggguguagcuccagcaggcuguggaaauccuggagcugaucagaaaaggaagugugaag

SEQ ID NO: 4150354 - RNA, 64 nt, Human
cugcccagcacccagcaugaugccugguacaauacagaugccccauaauugugugcugaggaag

SEQ ID NO: 4150355 - RNA, 63 nt, Human
cucuggaguucuucaagcuacuacaggcaacagaguuuaguagucugagugugaaccccagag

SEQ ID NO: 4150356 - RNA, 57 nt, Human
cucuggauugcugugagaugcucaugaaauaaugucugucucgugguuaauccagag

SEQ ID NO: 4150357 - RNA, 66 nt, Human
cucuggcacacuccuuccagguccuuucugcugcaggcaguuaccaaggacagagugugcaaagag

SEQ ID NO: 4150358 - RNA, 76 nt, Human
cucuggcaccagccugucugagucgugggacaccuggcuucagccacaauccacucugcccagacaggcugcagag

SEQ ID NO: 4150359 - RNA, 89 nt, Human
cucuggcauuaggauagacaauaagaguugauuauuaaaaugguaauacucuuaauguuuuauagauugaaauuuaugaugcccaagag

SEQ ID NO: 4150360 - RNA, 60 nt, Human
cucuggccugacugccuuugcuccugggcagaaccguccgugaagacagacagacagcag

SEQ ID NO: 4150361 - RNA, 55 nt, Human
cucuggcugccucucaggccugcuguagcuggugugccugcagagaaggucagag

SEQ ID NO: 4150362 - RNA, 61 nt, Human
cucugggaacacacgucacuucaugcuggaaaaaguugcugcacaaacuugugucccaggg

SEQ ID NO: 4150363 - RNA, 87 nt, Human
cucugggauuuggcgcgcaccauuggaauuauuuaacagcacuaggaggugauguugggaucgaaugguggaacguuggacuugggg

SEQ ID NO: 4150364 - RNA, 57 nt, Human
cucugggcaaguaugauagaaaacuuuucuuuguaaggccaaaucuacuucccagag

SEQ ID NO: 4150365 - RNA, 80 nt, Human
cucugggcaccucuagcucucucucagggcccuggggccacacugguggucaggccucgaggagacagcuacagccugag

SEQ ID NO: 4150366 - RNA, 97 nt, Human
cucugggccucaguuucaccaacaguauagugaagggguggacaaauuggcccaagauccuuucugugcugucagguccuccacuacugggccugag

SEQ ID NO: 4150367 - RNA, 56 nt, Human
cucugggcucagucugcuugguccugcagcccacugcguggcggcugagcccguag

SEQ ID NO: 4150368 - RNA, 59 nt, Human
cucugggucauucaucaaugaauguauuaagcauuuauugaacacuugcacuggcagag

SEQ ID NO: 4150369 - RNA, 70 nt, Human
cucuggucuucaaggccaccucuucucuaccauuuaacucuguguaaauuagggcuuugaagaacuggag

SEQ ID NO: 4150370 - RNA, 61 nt, Human
cucuggugucuccccuaagcuaccacuuacuguguguugaccagcugggggacgcguagag

SEQ ID NO: 4150371 - RNA, 58 nt, Human
cucuguaagugugcauuuucgguaacuuuuguaaacuaguuaggaaccacuugcagag

SEQ ID NO: 4150372 - RNA, 69 nt, Human
cucuguauuccugagaaggaacuauucucaaggaccugaguccaaguucaucuuacuuagaguacagag

SEQ ID NO: 4150373 - RNA, 64 nt, Human
cucugucaacaccaaagccucccagaaguggugauaccccugaggauaacuggugcugacagag

SEQ ID NO: 4150374 - RNA, 71 nt, Human
cucugucaccuaggcuggagugcagugacgcaaucucugcucacugcaaccuccaccagccugggcucaag

SEQ ID NO: 4150375 - RNA, 70 nt, Human
cucugucacugggcaucggagcugaaaggaggacaagacccugaggcuuggaggcuccaguggaacuggg

SEQ ID NO: 4150376 - RNA, 113 nt, Human
cucugucacuuacuacuagugugugugacuuugggcaagcucacugauucauucauuuaacacauauguauugagugcuugcucuguucuagacauuguacuaggugcuaggg

SEQ ID NO: 4150377 - RNA, 59 nt, Human
cucugucacuucuccagcugagugaccuuggcaagucgcucaggcugucugugcuagag

SEQ ID NO: 4150378 - RNA, 59 nt, Human
cucugucuuagcaucuuugcucagggaacucauccugagacaucucuccugagacaggg

SEQ ID NO: 4150379 - RNA, 80 nt, Human
cucugugaauccauugccuccccucugugauguauggggacugagcgagaucacagaggaaaggcaguugguaugcaggg

SEQ ID NO: 4150380 - RNA, 127 nt, Human
cucuguggaaagcacuucuguuccccuugcuuugaaacuggcaggagauaggcucagugcuggugggaaguagcuagccucucuuaucccuucaaagaagcaagaacaggacugaauuuuauuagag

SEQ ID NO: 4150381 - RNA, 60 nt, Human
cucugugugguagauuccauuauuucccucauuuguaaauaaggaaacugaggcacagag

SEQ ID NO: 4150382 - RNA, 61 nt, Human
cucugugugucaguaaggcagaaagaauacucuggagaguaagucuuacaggcaacaugag

SEQ ID NO: 4150383 - RNA, 55 nt, Human
cucuguguuccggguugcugcugccaucucgcgguaggcaucggaacugcagcag

SEQ ID NO: 4150384 - RNA, 74 nt, Human
cucuguuauccauauugaaaaagacaaauucagauuuuuucuaacugauagguuauuuucagugagauauaggg

SEQ ID NO: 4150385 - RNA, 72 nt, Human
cucuguucccaguguguuuaaugcauuccaggagucuguuugcauuuuaaaugcauugcauuuugaacugag

SEQ ID NO: 4150386 - RNA, 66 nt, Human
cucuguugcaguuacucaccucugcuguuguagcacaaaagcagcugugggcaauauguaaaugag

SEQ ID NO: 4150387 - RNA, 72 nt, Human
cucuguugccuaggcuggagugcagugacgugaucucggcucacugcaaccuccgccucccugguucaaggg

SEQ ID NO: 4150388 - RNA, 65 nt, Human
cucuguuuguugggcugucuugccuggaggcucuuuccuucuacaagccagcuccugccacagag

SEQ ID NO: 4150389 - RNA, 102 nt, Human
cucuguuuucucaguucgguugaucacaucuuuaugaguauuugugcuucaaaacuuaccaagaauguggcaaugccuaagauagaugagagagcuauggag

SEQ ID NO: 4150390 - RNA, 70 nt, Human
cucuuaaagcuggguuuugaugucucaccugaaauguucucaguacacucaagaaaccgguaauaaggag

SEQ ID NO: 4150391 - RNA, 67 nt, Human
cucuuaacugucugaaacugggguuucuuauuuucaggggaagaaacaggacacaggcagucuagag

SEQ ID NO: 4150392 - RNA, 79 nt, Human
cucuuaaguauauccauuugacuggaucauaaaucaguacacugccagugagauagugguauaugcuuauuuguaagag

SEQ ID NO: 4150393 - RNA, 58 nt, Human
cucuuagaguuuuuaauacauugugucuccaaacacaggaaaauaaaagaucuaagag

SEQ ID NO: 4150394 - RNA, 56 nt, Human
cucuuaguaaugccaugaagcagccacuuugggcagcuuuuuguguugucugagag

SEQ ID NO: 4150395 - RNA, 60 nt, Human
cucuuauacauauuuuuaggcgaccaaauggauggguugcuacugagugaauguugggag

SEQ ID NO: 4150396 - RNA, 72 nt, Human
cucuuauuugcaggucuccauuuugaugaguuuuucugaucugacaaaguaaaauggggacugugaacugag

SEQ ID NO: 4150397 - RNA, 71 nt, Human
cucuucaaagcagcagaaagcuggccccugggguaauuagcagagggccuauucuuugcugcuugggacag

SEQ ID NO: 4150398 - RNA, 74 nt, Human
cucuucaauuucaccuaucacuuaagccucucuccucuucagaggcuaaauaaaaggugggaagaaaagaagag

SEQ ID NO: 4150399 - RNA, 55 nt, Human
cucuucagcaaugcuuuaguccagcuuuggcugcauauuaaaauugcuuggagag

SEQ ID NO: 4150400 - RNA, 61 nt, Human
cucuucagcucugaggcucuggcucaaaugugaccacauguugucaccuuugacuguugag

SEQ ID NO: 4150401 - RNA, 64 nt, Human
cucuucaguuguugcauauucuacuguuggcuuuaauuuuccuuuguauaugagcacuggagag

SEQ ID NO: 4150402 - RNA, 92 nt, Human
cucuuccaauucauuugacuauuaggucgucugugauaaagugcuguugcuaggcaacaaggguagucagugagacucaugagcaugaggag

SEQ ID NO: 4150403 - RNA, 79 nt, Human
cucuucccaagccauccucugagcacuaggcaugacuucagaguuauauuaaggagcagcaggggguggguggggaggg

SEQ ID NO: 4150404 - RNA, 86 nt, Human
cucuuccccagcgcccaggggcagggcucucuggccuggcuugugcugguucccagagucccugcugucaggugcugggaguggag

SEQ ID NO: 4150405 - RNA, 89 nt, Human
cuggccuccagggcuuuguacaugguaggcuuucauucauucguuugcacauucggugaaggucuacugugugccaggcccugugccag

SEQ ID NO: 4150406 - RNA, 77 nt, Human
cuggccugaggguuuaaaugacuguuccucaaggacuuauacaauagucauuuggagcaccuuauuaaagaagucag

SEQ ID NO: 4150407 - RNA, 101 nt, Human
cuggccugaugugugacuuaggcaucacgggggaugcagguagcccaccccugggaccugugccuccaaguggucucuggggagaacaacgacaaggccag

SEQ ID NO: 4150408 - RNA, 94 nt, Human
cuggccuggguccccggugcacucacccgguccuucccaguccuggaccucaacguggacugggccaggugugggugaguggagggacggccag

SEQ ID NO: 4150409 - RNA, 56 nt, Human
cuggccuggugucugcgaggccugucgaaaggggauagguccauucaucaagccag

SEQ ID NO: 4150410 - RNA, 72 nt, Human
cuggccuucuucaggcuggggugcuaagguguuuuguggaagaggcugguggucgccugagccugaggccag

SEQ ID NO: 4150411 - RNA, 62 nt, Human
cuggccuuuucucuggucagauuuugagggguugccaccucagaguuggccacgagagccag

SEQ ID NO: 4150412 - RNA, 122 nt, Human
cuggcgaggaccaauaccuaauccccaggucgagugcagagccuugcgucaugugccaugugccguaguggccucagagaaggcugugcgggcgggcuccuggggaugcagucaccuugcag

SEQ ID NO: 4150413 - RNA, 96 nt, Human
cuggcgcacagucagggcaggauaggcaugaggcaucuucuaucauuuauauguugugguuguuuugcugucugucuuagaccugcucuuagccag

SEQ ID NO: 4150414 - RNA, 68 nt, Human
cuggcggcagggcccgggcauggcggcuccaugcaggacaggccauguccugggcaucugccacccag

SEQ ID NO: 4150415 - RNA, 55 nt, Human
cuggcuaaguaguugaguuaguuucuaaaaccaggccuuugaacugcugagucag

SEQ ID NO: 4150416 - RNA, 75 nt, Human
cuggcuauuuggaaugaaacagcagagccccaaagagaaaaauuuugaaagggcuccauguucauuuaauaccgg

SEQ ID NO: 4150417 - RNA, 69 nt, Human
cuggcucaccucuugcuacauuccuaggcugcgacucaggaggccugcagggaagcaaggguggcucag

SEQ ID NO: 4150418 - RNA, 79 nt, Human
cuggcucauuuucuuucacugcucaauaggggaaauuaaaagcaccuacuuuauagggauguggugagaacugagugag

SEQ ID NO: 4150419 - RNA, 72 nt, Human
cuggcuccugggcccugggcuaacucacuggcucagccuuggagcccagggggccagggcaccagggaccag

SEQ ID NO: 4150420 - RNA, 57 nt, Human
cuggcucugcugaaccuagugcaaagccucuucuggauaggacucacgcagagcugg

SEQ ID NO: 4150421 - RNA, 70 nt, Human
cuggcucugggcauagaaggaagcuuucagcugggguucccugcuuccuauucucuacugccaggcccag

SEQ ID NO: 4150422 - RNA, 66 nt, Human
cuggcucugucacccuuucuccugcauucuaaaucuggcuugagagagaggagagagagaggacag

SEQ ID NO: 4150423 - RNA, 79 nt, Human
cuggcucuuggcuagggagagucacaaguggguagaacauguuuuccaauucuggagcagucuuuggcccagagcucag

SEQ ID NO: 4150424 - RNA, 88 nt, Human
cuggcucuuucccuugcaugcauuugaagaucaugagucacgagucugugaaaugagacaggacuguaugcagggcugggagaguugg

SEQ ID NO: 4150425 - RNA, 119 nt, Human
cuggcucuuuccuuuuuaaauccgucuauagucuuggcaugccaguagccggcuugacuuucacaguuaagguuaucagagagucacuguucugucaugucaagucagccaggagccag

SEQ ID NO: 4150426 - RNA, 58 nt, Human
cuggcugaagggagugcugagucugugggagccauagcccgccccacccuuuaggcag

SEQ ID NO: 4150427 - RNA, 62 nt, Human
cuggcugauuuucucacuucucaacuaguuuuccuagcguucuaugagaaaguccuggucag

SEQ ID NO: 4150428 - RNA, 57 nt, Human
cuggcugcaggaaggagugggcuuugugccacagaccccgaguuugcagaguuccag

SEQ ID NO: 4150429 - RNA, 63 nt, Human
cuggcuggagucuggaggugugccaagggcuuuggcauugacaacuuucaguuccacugccag

SEQ ID NO: 4150430 - RNA, 91 nt, Human
cuggcuggcaggcaggcuggggagcuggggcucagucguaucccucccuggcuagcauuccaucacucagcaccccacccuccccaggcag

SEQ ID NO: 4150431 - RNA, 60 nt, Human
cuggcuggucaucagcaguacguggagagcucugaaaaacugcagaugcccaggacccag

SEQ ID NO: 4150432 - RNA, 57 nt, Human
cuggcugguuuuuaaagcuaggagaaauuuuaguuuguaaugaggagaaguagccag

SEQ ID NO: 4150433 - RNA, 55 nt, Human
cuggcugugcacaagguugggucucggugcucaccgggagccgggcauggaccag

SEQ ID NO: 4150434 - RNA, 65 nt, Human
cuggcugugcugacugagaggggacccaggaggucuaacuccucuauguacacauuuccagccag

SEQ ID NO: 4150435 - RNA, 63 nt, Human
cuggcugugucuuggaggagcugggcuggcccuccaggccaacuuugccaggagacagcacag

SEQ ID NO: 4150436 - RNA, 91 nt, Human
cuggcuucacauuccugaagagugaauguggcagugugccacccuauaggcuccacucuaccaugccacuccauaggcccagugacucuag

SEQ ID NO: 4150437 - RNA, 70 nt, Human
cuggcuuuuuagccugaaguuuucugagcaggggaaugucaugaucagagcugugcuucaggaaagucag

SEQ ID NO: 4150438 - RNA, 74 nt, Human
cugggaaaacugugaccccuguguuucccuaaugagucuggcauauagagagggguuaaaugaguuggucccag

SEQ ID NO: 4150439 - RNA, 78 nt, Human
cugggaaaggcugggugggacagcggggugggacagggguaagcccucagacugcugucccugccuggccccucccag

SEQ ID NO: 4150440 - RNA, 81 nt, Human
cugggaaaguaaacaggcuugcauuuggaauagauuaauaaacuauaagucccuucuaugucaauucugauuguuucuugg

SEQ ID NO: 4150441 - RNA, 107 nt, Human
cugggaaaguuacugaaccucuuugugcuucagcuuaucuuuuaacuaccugagagcaaagcugugaagagcaagugaggacaucaguauuaaaagcacuuugucag

SEQ ID NO: 4150442 - RNA, 93 nt, Human
cugggaaccuuacuggggaguguggauucuuugacagccaagacgccuugggcucuaaagcacauaucuuacaauaaggccaacucuuuucag

SEQ ID NO: 4150443 - RNA, 60 nt, Human
cugggaagaauccaagggcccucacuccaucuuuaaagagcccacccuggcuuuucccag

SEQ ID NO: 4150444 - RNA, 110 nt, Human
cugggaagaccuuuccgucggucugucagucugucccugccuggcgggcuuucucugggaaccgcugcagacgcgcuggcgaaagcaccaccgccaagagucaugcucag

SEQ ID NO: 4150445 - RNA, 105 nt, Human
cugggaagaggcgcuccucacuuccuagaugggauggcggccgggcggagacgcuccucacuuuccagacugggcagccaggcagaggggcuccucacaucccag

SEQ ID NO: 4150446 - RNA, 68 nt, Human
cugucuguggccuguuauaaugagaacaaccuauauauaucuugcuauuagcaauucccacagagcag

SEQ ID NO: 4150447 - RNA, 68 nt, Human
cugucuuaaauguuagguuguacugaguccaguaggucgcugaccuagcucagcuuguuauuugacag

SEQ ID NO: 4150448 - RNA, 81 nt, Human
cugucuuaccuaauuuacuacuucauugacuuacgggcagaaggauucagugguuaucaaguauuaaaguagaaaggauag

SEQ ID NO: 4150449 - RNA, 83 nt, Human
cugucuucucuguauguuuuaaaucggaauguuucaaaauguccugaaaucauuacuccuguaaaauuguccagaugaaacgg

SEQ ID NO: 4150450 - RNA, 81 nt, Human
cugucuuugaguggaaaauguagcagcuacgggaauuaaguuauaugguagcaugugugguuaccuacuugacggagacag

SEQ ID NO: 4150451 - RNA, 70 nt, Human
cugugaagcagaucugauagggcccugcugcgacaccaacagcagcucagggccaaggaugcuguugcag

SEQ ID NO: 4150452 - RNA, 122 nt, Human
cugugacuacagugaccagaccauacuauuacuaggagcaggauagaugccuacuagucugcggcauguaaggauauccucuccuaaguaaagaauaagcuguugcaccuuguaugccacag

SEQ ID NO: 4150453 - RNA, 57 nt, Human
cugugacuggaaucuggcucuuuauucagugguauuuggaacuaggcuccagugcag

SEQ ID NO: 4150454 - RNA, 62 nt, Human
cugugacuuagagugaguagagaggcaauuagggcacaugcuucgaucauuuugagugacag

SEQ ID NO: 4150455 - RNA, 77 nt, Human
cugugagaagguccugguguggcccugugacaugagccauuggcuuaaugucaaggucauucuagaggagaucauag

SEQ ID NO: 4150456 - RNA, 57 nt, Human
cugugagaccugauuucuucauuuggacaaugagaaugauaauaaucugucuuacag

SEQ ID NO: 4150457 - RNA, 66 nt, Human
cugugagaccuuggcucugcuggaaaggaccuuaacauuuuggucagcaggucuacagguucauag

SEQ ID NO: 4150458 - RNA, 83 nt, Human
cugugagaugaauccacacauggcaaaaaauuuucacagauugcuuguuucuaguuuuugucaugggauauuccauuuuucag

SEQ ID NO: 4150459 - RNA, 59 nt, Human
cugugagauguuucugguuagaguuucucucuccaagaaucugacuuaaacauuuauag

SEQ ID NO: 4150460 - RNA, 64 nt, Human
cugugagccagcacggauuucccaggaacguugcuguucgcuaggccacgugcuggccucacag

SEQ ID NO: 4150461 - RNA, 56 nt, Human
cugugaggccuuuggccagauauccuggcaagucugggcaauggaugcacucacag

SEQ ID NO: 4150462 - RNA, 62 nt, Human
cugugaucuggcugggacuucagggucauugugacccugccaggguccugacagacaagcag

SEQ ID NO: 4150463 - RNA, 76 nt, Human
cugugaugcuguuauucuaaugugugagcuggugaaugagaguucaugcuaaaauaaccguaucauucaaauucag

SEQ ID NO: 4150464 - RNA, 83 nt, Human
cugugauggaggucaaaccagggauccuguggucagccgugaacaggauguaugcagaguccucuggagggacuuguaagcag

SEQ ID NO: 4150465 - RNA, 66 nt, Human
cugugcaaggcagugcucuuggccaagguaucaauauucuugggaggggagcauuggccucagcag

SEQ ID NO: 4150466 - RNA, 56 nt, Human
cugugcaagguacauccuugauguguuacccacaucgucucaugaaucuugucaag

SEQ ID NO: 4150467 - RNA, 81 nt, Human
cugugcacgacuguuaccggacccaugcagcugaugucuccaucaugaaccaggugugccgggagcaguuugcuugcacag

SEQ ID NO: 4150468 - RNA, 86 nt, Human
cugugcacgacuguuacuggacgcacgcagcugaugucucuugucaugaaccaggugugccgggagcaguuuguccgcuugcacag

SEQ ID NO: 4150469 - RNA, 58 nt, Human
cugugcacuuuccacguguuugcaaguuuugauugaacaaacacuggcuggggcacag

SEQ ID NO: 4150470 - RNA, 57 nt, Human
cugugcagcaucuuucuaccaggaaucugugccccuguguguaaggaagcuuuaugg

SEQ ID NO: 4150471 - RNA, 83 nt, Human
cugugcagccccaggagacgcccaggcaagagacgaguggucgccacgccacacucccugggccacugguggcuguggaauag

SEQ ID NO: 4150472 - RNA, 130 nt, Human
cugugcagggcgccugggcgagggcaggggccacacccgcugucccugcugagcucgguccugaguuagaaccgucaggcucucagcaggcacggacaggcugcauguccucggaggcauggcccugcgg

SEQ ID NO: 4150473 - RNA, 68 nt, Human
cugugcauugccucuauucauuauauauuucuucuagcuuguaaucaugguagaggcaaaguggacag

SEQ ID NO: 4150474 - RNA, 55 nt, Human
cugugcauuguaggaucuuuagcagcauuccuggcuucucccuacaacaugccag

SEQ ID NO: 4150475 - RNA, 64 nt, Human
cugugccacucaguuugauuguuucagugauggaugggaauuugaagcugucagagguggacag

SEQ ID NO: 4150476 - RNA, 58 nt, Human
cugugccagggucuauuccagagagucagugguuucuuuugaaagaguccugcuacag

SEQ ID NO: 4150477 - RNA, 63 nt, Human
cugugcccuguggcuggcaccuggauuccacuuccucaguaaugcuugucaugaaugggccag

SEQ ID NO: 4150478 - RNA, 57 nt, Human
cugugccugccuuguucacugauguaucucuagcgccuacaacagggucgggcacag

SEQ ID NO: 4150479 - RNA, 55 nt, Human
cugugccuuaguauucucauuuuugcaauauaaaauuaggauauuaagaguacag

SEQ ID NO: 4150480 - RNA, 74 nt, Human
cugggggaugggagucauggggguggcccugucccugggggagccaggccacacagaugacugcuuuccccaag

SEQ ID NO: 4150481 - RNA, 60 nt, Human
cuggggggcuucuugcaggggcaacaugaucugauguacacuuuggaagagucacucugg

SEQ ID NO: 4150482 - RNA, 120 nt, Human
cugggggucugaggaaagacuguuuugaaagaggcugucagggaauggaaaggguuaagcuuuucauccugaagaaccugcuucccaaaucaggccuuccucccaucacuagacccugag

SEQ ID NO: 4150483 - RNA, 70 nt, Human
cuggggucaauggcaugagcuucaguuuaugauuuuugauuaagugacuaaaguaaugcuuaaaucucag

SEQ ID NO: 4150484 - RNA, 71 nt, Human
cuggggucagagagaugagaguggauggcggcggcggugguguugcuucucagccugucuggaaaucucag

SEQ ID NO: 4150485 - RNA, 60 nt, Human
cuggggugcauccacguggaguucucaaacauggagacuggccuggagaugcagcugcag

SEQ ID NO: 4150486 - RNA, 57 nt, Human
cugggguggguaaggaggggaggaaggagaggcucuugaacucuggacccaugccag

SEQ ID NO: 4150487 - RNA, 83 nt, Human
cuggguaagaaugaaguagauaugaaucuuacagccucuccguucugggaugugauucugucuccuucacuccggguauccag

SEQ ID NO: 4150488 - RNA, 93 nt, Human
cugggucaaaugguauuucuaguucuagaucccugaggaaucgccacacugacuuccacagugguugaacuaguaaaucauacauuuaaccag

SEQ ID NO: 4150489 - RNA, 56 nt, Human
cuggguccccucagugacacugagagacauaagucauugucacugucauggcccag

SEQ ID NO: 4150490 - RNA, 90 nt, Human
cugggucuagacuacaagcccagaagauuauuagagacuuuguccuuccagcacaugggaucuaaaauaaucuugcugucugaagcccag

SEQ ID NO: 4150491 - RNA, 58 nt, Human
cugggucuucagcagcaggcggggugggacuuuucaggcucucugcaugguggcucag

SEQ ID NO: 4150492 - RNA, 62 nt, Human
cugggucuuuuucuuccauugacaaaggaggguugacaagucugggaagaaaaggaacucag

SEQ ID NO: 4150493 - RNA, 79 nt, Human
cugggugaagaugaaugguucaaguuuuaaucauccucguuugcaacaucugaacauuuauccacauauguuuccccag

SEQ ID NO: 4150494 - RNA, 66 nt, Human
cugggugagcuggccagaggguagaagggaggcaguauagucugcucugauaccagcuacaucuag

SEQ ID NO: 4150495 - RNA, 93 nt, Human
cugggugauaauggaauacuaugcagccauaaaaaggaaugagaucaucuccuuugcggggauguggauggagcuggaagccauuauccucag

SEQ ID NO: 4150496 - RNA, 72 nt, Human
cugggugcucccaaaccugacaggcuccaggagaaacacagaccccugggcaugucgccugggcagcccgag

SEQ ID NO: 4150497 - RNA, 57 nt, Human
cugggugcuccggccucccccuucccgaaccucagacggggguggcuggggcuccag

SEQ ID NO: 4150498 - RNA, 98 nt, Human
cugggugcuggggacaggugugggcugggcucugaguuaggacgagccacugucccauuugagagucuccagccccaucauguucaaucccagcucag

SEQ ID NO: 4150499 - RNA, 60 nt, Human
cuggguggaucgcagccccaggacagccacgcugaggcccaggggugucugucuuuccag

SEQ ID NO: 4150500 - RNA, 64 nt, Human
cugugugcagggcacaauggaaguaaacaccacccacuauauauccccugugccuggcauacag

SEQ ID NO: 4150501 - RNA, 66 nt, Human
cugugugcuggggggagcccaugggaacucgauauggguuaaggcugguccccucugcguccacgg

SEQ ID NO: 4150502 - RNA, 68 nt, Human
cuguguggcuucucaucuuccacccacagcuucagaauugggcaaagguucuaagggaagccaugcag

SEQ ID NO: 4150503 - RNA, 83 nt, Human
cuguguggggacagcgagggcagacuugaguggauaggcacccucccgccacguccacccaggcugcccaggucuucccaggg

SEQ ID NO: 4150504 - RNA, 87 nt, Human
cuguguguaaguaguuagaauagucagauuguagauauacuuugaaaguagaccuaggauuugcugauuuaauuugucaugugauag

SEQ ID NO: 4150505 - RNA, 75 nt, Human
cugugugucgcaaaguuuguuuuagucuaaugauuuuuaugaaagaaguugcugaaauuaauauuggagccauag

SEQ ID NO: 4150506 - RNA, 122 nt, Human
cugugugugaggcuggcuggcugcuuuaggauaaauacuuccaggugagugugagcacagaugcugcuaggcauugucugggaguacccuggaaggucaggcccagcgucucuucuccacag

SEQ ID NO: 4150507 - RNA, 57 nt, Human
cuguguguggcuggagcuguugagcuugaugucagaugaugcugcagcgguaggcag

SEQ ID NO: 4150508 - RNA, 57 nt, Human
cugugugugguaugaguaaugcuauagucaaggcaugugcaaagugcuacaguauag

SEQ ID NO: 4150509 - RNA, 92 nt, Human
cuguguucagauucagauacugucuucacauuguugccuagccaugaguggggccacuuagugcuggugaacagugggcagcuuggagccag

SEQ ID NO: 4150510 - RNA, 89 nt, Human
cuguguucaggauguggcagggaccuuguagggaagugguuugaucaucaaggacuuccagcuagguucugcuaaaccauacaacacgg

SEQ ID NO: 4150511 - RNA, 71 nt, Human
cuguguugaaucagccugcugcugagucacagggaguaacugcagcugccuagggcuggcuucuagcaugg

SEQ ID NO: 4150512 - RNA, 76 nt, Human
cuguguuguuucaaugucuuuaaagugcaauagaucuuuacaauauaucuauuuuaagguaaaggcggcaaagcag

SEQ ID NO: 4150513 - RNA, 87 nt, Human
cuguguuuccuucaugagugaguaucucaagauacaggaaauggaaauugcugguaucuuagguccucggcucagaaacuggcacag

SEQ ID NO: 4150514 - RNA, 55 nt, Human
cuguguuuggacaacuuuucagauuucucuugucucuggggcuguguagaugcag

SEQ ID NO: 4150515 - RNA, 94 nt, Human
cuguguuuuaaauugcagaucuaaacagagugcuaguucacgggaaauuacauucucagauuaaaguagcauuuuguugugcagaaagcagcag

SEQ ID NO: 4150516 - RNA, 83 nt, Human
cuguguuuuagaacacaguaggauaguuugaggaugaaccuugaauuccaguuuucucagauuuucuauugugcuagauaugg

SEQ ID NO: 4150517 - RNA, 75 nt, Human
cuguuaagaacugugaaguaugugaaauuuuaucuuacuuauaauuuuacaaguuuacuucauggaugcugacag

SEQ ID NO: 4150518 - RNA, 57 nt, Human
cuguuacacggaccuucaaaucugggaagauucccucugaagcaaaugugauaauag

SEQ ID NO: 4150519 - RNA, 65 nt, Human
cuguuagaagggcugcaauccaaaacacugacaagacaaaugccggugaggauguggagcaacag

SEQ ID NO: 4150520 - RNA, 74 nt, Human
cuguuauuuggaagguauaaacacaauuuggagguauuuuuuaaaaauauuugcuguuuguucuccagaaacag

SEQ ID NO: 4150521 - RNA, 56 nt, Human
cuguuauuuuauaauucaagaaagggauuuucuuucccuugaauugcaaguaaugg

SEQ ID NO: 4150522 - RNA, 96 nt, Human
cuguuauuuuuuacaucuaaacugugaacaauuagaguaucaauucuuauaugaaagagugaccauuguuacagauuggcauguaauguugagcag

SEQ ID NO: 4150523 - RNA, 123 nt, Human
cuguucacaccuaaugucuugaagaguagguagcagcagugugggcugaaccuaggccagcuugcuuagcgggucacccugcugugaaguccuggcagguguugguaauguguggaaaugcag

SEQ ID NO: 4150524 - RNA, 75 nt, Human
cuguuccaugucucucucugagugccagaaagguucuuacccuugucugagugcacuaggaggggcaaaaggcag

SEQ ID NO: 4150525 - RNA, 58 nt, Human
cuguucccugucccucugaagccucccuugaugggacagugugguggacaaggagcag

SEQ ID NO: 4150526 - RNA, 80 nt, Human
cuguuccuaccucauugggcugggcaagaaucaauggagagucauggaaagcacucagcccagugccaggcaaggagugg

SEQ ID NO: 4150527 - RNA, 59 nt, Human
cuguuccuccaccucaacaaaccuuuacauccucacugguuugugaggccagagaacag

SEQ ID NO: 4150528 - RNA, 84 nt, Human
cuguuccucugucguuuagccaguugcccagaguagaaaggacaacuuacuuuucaagcagcugguuauuuuacugaggggaag

SEQ ID NO: 4150529 - RNA, 124 nt, Human
cuguuccuggcuuccccuuccaggaggggacguuugcaggucuggggguccuggugacuaagcuguuagcuccacucccugccuguuuccguccucacagcccugggagggccccgguggacag

SEQ ID NO: 4150530 - RNA, 59 nt, Human
cuguucgggcccaggccgaggaccugccaguagggcucaguugccuggagcccguucag

SEQ ID NO: 4150531 - RNA, 62 nt, Human
cuguucuagcuucuugggcuauaacuagauagauguuagcuggcccaagucugcuagaagag

SEQ ID NO: 4150532 - RNA, 65 nt, Human
cuguucugcugcauaaaaacuugaacacuccgaugaaugguuuuuauucuuugcagcagcuccag

SEQ ID NO: 4150533 - RNA, 84 nt, Human
cuguucugguggacacgauggaauucccucaacuauaacauuauuauauguuaugauugaaauuccaguuucuauaagggauag

SEQ ID NO: 4150534 - RNA, 77 nt, Human
cuguucuuuucacaguguuguggcucuuaauaggcuccccuggcgggccguucagagcccacgcugccucugagcag

SEQ ID NO: 4150535 - RNA, 61 nt, Human
cuguugaaauuguggagcucaaauauuuaacuuguguaaugcaguggaacaauuucaacag

SEQ ID NO: 4150536 - RNA, 76 nt, Human
cuguugaguuguacaaauucaguucuaggguggggcuuccacucaccuuucaagagaauuuagugcagcuuuuaag

SEQ ID NO: 4150537 - RNA, 75 nt, Human
cuguugcaugacugugcaugcuacuuaaucauuaaauuccguaauuacaacagcaagcacacuucaugugaacgg

SEQ ID NO: 4150538 - RNA, 84 nt, Human
cuguugcccaaagagugucccucacuggaccauaugaaaacaauuuuucucugguugguggggacccuugaauuugggauaugg

SEQ ID NO: 4150539 - RNA, 59 nt, Human
cuguugccucuuggcagucaccaaucugggguucauauauucugcacaagagacaauag

SEQ ID NO: 4150540 - RNA, 61 nt, Human
cuguugcugagguucaagggucuaaaacuugcugcucuccaggcccuggaccuauggacag

SEQ ID NO: 4150541 - RNA, 101 nt, Human
cuguugcuuugugccuaguugucugcuucugcuuugcugcauugcgacugggaaacugcaggagcuggagcuggcaguugcgauaaugcagaaagcagcag

SEQ ID NO: 4150542 - RNA, 79 nt, Human
cuguuggcaauauuuacugaaguugaaaauaugcauguucucucaccaccaguucuacuuccaguuauauagccagcag

SEQ ID NO: 4150543 - RNA, 67 nt, Human
cuguuggcucauggaauuagcuauuauuucggcaauggaaaggaauuaugguuaucuagagcaagag

SEQ ID NO: 4150544 - RNA, 107 nt, Human
cuguuggucuucuguuuagccauuauucucaguucugugcaggagugagcugaaacaaaguuguauagcccagagagugagaagcugcauuucaugucucccaacag

SEQ ID NO: 4150545 - RNA, 60 nt, Human
cuguugguuacaaguuugcucugccccaucaaagagggccaagaugucuugugacuacag

SEQ ID NO: 4150546 - RNA, 66 nt, Human
cuguuguaaagcuauucauuugguacugacacugacaggggcugagacagacggcuuuauacacag

SEQ ID NO: 4150547 - RNA, 57 nt, Human
cuguuguaucauuuguucacauuuccuuuagugguuguggaauagaaauuauaauag

SEQ ID NO: 4150548 - RNA, 80 nt, Human
cuguuguuuguuguuguuguuuuugaacggugguggccaaucugccuccacaauccagacauaauuucggcacuaaacag

SEQ ID NO: 4150549 - RNA, 59 nt, Human
cuguuuagaauucuaacuuuaaggagaaaagcucuuuuugguguugguucugaucccag

SEQ ID NO: 4150550 - RNA, 57 nt, Human
cuguuuauggagguaaggcaucuagcaaauaccugaguggcuuguuucuaugggcag

SEQ ID NO: 4150551 - RNA, 74 nt, Human
cuguuucuaagcaguuuuuagcuuuaccaguaaaucauauacaucauaggcauuauaaaaacugaaggaagcag

SEQ ID NO: 4150552 - RNA, 71 nt, Human
cuguuucucagaagucccuugcaucuuagucugcugcagcugcuaaugccaagacugcuguaaagaaacag

SEQ ID NO: 4150553 - RNA, 125 nt, Human
cuguuucugcuaagaugaagcauugcuagagggauaggcacaggaacaggaaaagaggaaaaugaaauccuuuccucauccuuaacuguccaguuucccucuggugcuugcauuuaaaaaaacag

SEQ ID NO: 4150554 - RNA, 92 nt, Human
cuguuugcacgggccagggcagggaggcuuucugggagugaggugagagcaaggcuguucccagaggcuccagucucuauuugugcagacag

SEQ ID NO: 4150555 - RNA, 81 nt, Human
cuguuuggaaagugugauuucaaggacuucaaucugugaggcuagcuucacauacuuuggaaucauugcuuauucauucag

SEQ ID NO: 4150556 - RNA, 101 nt, Human
cuguuuguaagcaagauuuuuuaacagguuauauuguacaggaucaauauuuugcuuuuuaacaaggauauuuguguaauaagaaacuuugccuuaggcag

SEQ ID NO: 4150557 - RNA, 86 nt, Human
cuguuuuguuuugaugauuacacuuuuaaaacagcuuucaguaugcuuuagcuguuugaacagugagacaucuuuuucauagauag

SEQ ID NO: 4150558 - RNA, 101 nt, Human
cuguuuuuaauuguuugguauuuugggaaugcaaguuauuguuuagaauuuauaugaccauuuaauaaguauuuccauagcuacuuugaaguguugugcag

SEQ ID NO: 4150559 - RNA, 85 nt, Human
cuguuuuuguucucacuacucuagcucuagaaagaucuagccucucuagaugucagagguggagauaguugggaaggaguaacag

SEQ ID NO: 4150560 - RNA, 88 nt, Human
cuuaaaaagggaaacacucaauuuaguaauucgguugccuagaugaaaucgaguggcuauugauccgugauguuucuagauuuuuaag

SEQ ID NO: 4150561 - RNA, 86 nt, Human
cuuaaaauuguuguuacuuucuugagugaugcuuaguguggaggcaacucuacagaggguuucuaaggauuuggcaauuuguugag

SEQ ID NO: 4150562 - RNA, 105 nt, Human
cuuaaagccuguuucagauuugauguccacacauuaugcucaccuggcaacuuguaucuuugcuuuuaagaagugcagcagguggcaggacauuuaggcugugag

SEQ ID NO: 4150563 - RNA, 72 nt, Human
cuuaaauuccacugccgaaugauacauuuaacccaucagggagauuguguguguguggcagggggugguggg

SEQ ID NO: 4150564 - RNA, 68 nt, Human
cuuaacaauugaacagcuguuacauuguuacgaguuuuuguggugguggcgauagcaguuggugugag

SEQ ID NO: 4150565 - RNA, 78 nt, Human
cuuaacagcacuuacuaggacuuagucuaauuuuucucuuuauauucuuaggcuguguggaugagucuuacuguugag

SEQ ID NO: 4150566 - RNA, 61 nt, Human
cuuaaccucuggggaccucaguuuccuuuucugcaaaacugagguaauugugaggauuaag

SEQ ID NO: 4150567 - RNA, 71 nt, Human
cuuaacuccgcuucugugagucaguguuucugagguaacaacacagaacaauaaccauagggagaguugag

SEQ ID NO: 4150568 - RNA, 130 nt, Human
cuuaacucucagaagauugacucuuugcugccaccuugcugauaccaugaauguuaaugcccauggcacugggcuuugcacagaguggauauucaguaaauggguaguucuuguuucucucccacauaug

SEQ ID NO: 4150569 - RNA, 68 nt, Human
cuuaacugaagcuggaagcgcuggcauagcccggggaggucagcacuguguccagucucccgguuaag

SEQ ID NO: 4150570 - RNA, 82 nt, Human
cuuaagaccauucugaugcaucauacuguuuacacucaaagcuuuguagcuaagauguuuacaguauggagaauguuuuaag

SEQ ID NO: 4150571 - RNA, 68 nt, Human
cuuaagcagcugaauucuucagacuccagugagcggagauugaguguguuugaagucagcuggugaag

SEQ ID NO: 4150572 - RNA, 106 nt, Human
cuuaaggguaaaggcugcgucuucuguuuccucugcgucuucucgaagcacuguguguaagggccagagcacagaggauguuucauacacgugccuuugcccugag

SEQ ID NO: 4150573 - RNA, 75 nt, Human
cuuaagucucauggcuucugucuuggaaacuuuaccuuuaaaagauuauuuaagacaggaaccaggagguuuggg

SEQ ID NO: 4150574 - RNA, 68 nt, Human
cuuaaguucacucuuuaugagaaagugcugccaaauuuagcauuccuuauucagggggagcuacagag

SEQ ID NO: 4150575 - RNA, 95 nt, Human
cuuaauaauacaguaccuuagucgagcucucuacucccucacaagaaggacuccaaauggaggguuccugagcuaggugugcagauaugaguaag

SEQ ID NO: 4150576 - RNA, 79 nt, Human
cuuaaucacucaggagggaucagcuaucacugccauuaaaagacaaaugcuuugaugguucuuuaccuggaagaauaag

SEQ ID NO: 4150577 - RNA, 67 nt, Human
cuuaaucucaccugcaaagucccuuuugccauggaaggucaccucuucacagguucaggggauuaag

SEQ ID NO: 4150578 - RNA, 77 nt, Human
cuuaauguaaaauuucuauaugaggagcuaaaguuuucuaucccaaauauuucuaguccuuguguagucacauuagg

SEQ ID NO: 4150579 - RNA, 63 nt, Human
cuuaauguggaagauguuaagugaaugucuaaaugguguugcugauaacauguuuucauuaag

SEQ ID NO: 4150580 - RNA, 98 nt, Human
cuuaauuuugauugagaauucuagugcaaagaagucugguaaguguagauuuuuuagcucaccagugucugugguauagaaaggcaguuuagagggag

SEQ ID NO: 4150581 - RNA, 63 nt, Human
cuuacacacuuacuggagaugaagcacaaaauugcuucaagcuuucuuguagguaaugugaag

SEQ ID NO: 4150582 - RNA, 81 nt, Human
cuuacagagaaaaaggcacuauagaagaaaacauuuuggauugagauuuagaaguucaggucuguaaucugguuuugugag

SEQ ID NO: 4150583 - RNA, 78 nt, Human
cuuacagaucuuaguuucuuggucacaguuuucaauuuagacacacuggcugaaauauggagugagaaggauuugaag

SEQ ID NO: 4150584 - RNA, 71 nt, Human
cuuacauuauucagguaccuauuaugugcuauucauauuggcacauaauaggugccugaauauuuggcaag

SEQ ID NO: 4150585 - RNA, 64 nt, Human
cuuaccaugggaaaaaggaagaagagggaacuuaccuucuuuucucuuacauuccacuggugag

SEQ ID NO: 4150586 - RNA, 82 nt, Human
cuuaccauugaacaguuauucuuuaugcaaccagcaucacagugcucuacuuugcuuggaaggaaugauggcauaauguagg

SEQ ID NO: 4150587 - RNA, 60 nt, Human
cuuaccuggccucaucaguaaaucaggggucuuccuggcaggucugagaggucuucugag

SEQ ID NO: 4150588 - RNA, 68 nt, Human
cuuaccuuguaaaggcccugucuccaaauacagccccauucugggguacggggucggugcaggguggg

SEQ ID NO: 4150589 - RNA, 112 nt, Human
cuucacaacugcuauuucacuucuugaaccaccugaggcuguuagucuaggucucaccuucacuggugagaccaaagcagagguuucagagugguagaggagcagcaugaag

SEQ ID NO: 4150590 - RNA, 78 nt, Human
cuucacacuauuuuguuuuccccuuucacagucaauuaguaauggcugccaauguggggcaaggcagaagaguuggag

SEQ ID NO: 4150591 - RNA, 74 nt, Human
cuucacaggaaggcaggagcagcaccaccugaggcuuuuucccuccagaggggcagcccugugcuuuggugagg

SEQ ID NO: 4150592 - RNA, 101 nt, Human
cuucacagggacuucucaccucacugucuauagcaggcuggagcacggauguaugcaugccccugcuauagaggcauggauguagcagugacccccugagg

SEQ ID NO: 4150593 - RNA, 104 nt, Human
cuucacauaggagcuggauguguagaaagaucuccaagauuuguggccaucacgauaauuuuggaggugucuuuuuaaaaggucucauuggcuccuuuacaaag

SEQ ID NO: 4150594 - RNA, 73 nt, Human
cuucacauauaaauacaacauguguuaaaggacuaaauuucuagugucacaguuuguacuuuauaguuugaag

SEQ ID NO: 4150595 - RNA, 86 nt, Human
cuucacaugcucaucuaguuugaacauuggggaggaaauuauuuucuucugaaacagugacagacagcaagaaagagcguaugagg

SEQ ID NO: 4150596 - RNA, 93 nt, Human
cuucaccacuucaccacugugcauccugggaaguggccuccuccuuuaaauagggauggaggucuccagggugugcucuggaaguuugugagg

SEQ ID NO: 4150597 - RNA, 118 nt, Human
cuucaccucccacuggccaaaagcagauuacaaaugcugacacacugagcauuugauagcaucucuuucugcuaucacgcagauguguuagcucuaacuguuuuuaaaugaggaaaag

SEQ ID NO: 4150598 - RNA, 75 nt, Human
cuucacugaaauguguucuaguguuuugcagaagguggaacuuuugggcaacaacaugggauucauuucuguagg

SEQ ID NO: 4150599 - RNA, 66 nt, Human
cuucacugugcucuggccaagcgcgugcgacuuccugucacaccuuaggccugagcgcuuauuaag

SEQ ID NO: 4150600 - RNA, 82 nt, Human
cuucagaaauugguuuagcucuuuccuguacagagacucacauaucugucuaaugugcucuguaggggaaagagagcugaag

SEQ ID NO: 4150601 - RNA, 71 nt, Human
cuucagaaucuaugugccagcuccaaauagucugcuuacugcaccuggagcuagcauuuagacaucuggag

SEQ ID NO: 4150602 - RNA, 79 nt, Human
cuucagagaguuugugaguccuugaagcaaaaggaaaaauuuugcugugaagugcaagcauucacgugugcuccuggag

SEQ ID NO: 4150603 - RNA, 61 nt, Human
cuucagauuguacacauaauugccuuuggcugccaaccaaaggcuuguguguucagugagg

SEQ ID NO: 4150604 - RNA, 64 nt, Human
cuucagauuuuguuuacugguagcuguuggagauauucugacuuccuguaaauagaauuccaag

SEQ ID NO: 4150605 - RNA, 75 nt, Human
cuucagcaggccaggcccugacuggaugcuggcgagucgagaaaaacacaaucgggccuccggccuugucugagg

SEQ ID NO: 4150606 - RNA, 55 nt, Human
cuucaggaaaaucucuaaggaugaaaauuccuuggccaccuagauugucuugaag

SEQ ID NO: 4150607 - RNA, 56 nt, Human
cuucaggagguugaccacggggcaaaggauuugcucuccuucucagcuuucugagg

SEQ ID NO: 4150608 - RNA, 89 nt, Human
cuucagggagugaucguauuuuaaaccagucaugguggacuauuucuccuuugacagugauugguuugggggugaacacgugacuggag

SEQ ID NO: 4150609 - RNA, 58 nt, Human
cuucagggcauauuauuggcucucgauaaaaggcaaauaguaaugauaagccuugaag

SEQ ID NO: 4150610 - RNA, 76 nt, Human
cuucagggcugccgggcagaccgugggcauggccaugaguguccccacaagaacugucaugccaggagcuuggaag

SEQ ID NO: 4150611 - RNA, 55 nt, Human
cuucaguagccacuggaugcacugggccugccaggcuccagggaacagacuggag

SEQ ID NO: 4150612 - RNA, 70 nt, Human
cuucagucuagggugcacuugauacaacuuuuaauuuggcuuuuuaucgugcauucuagcagcucugagg

SEQ ID NO: 4150613 - RNA, 69 nt, Human
cuucagugucugagacugggcacauaccuacaaaucucauuaggauguuaaauucucagagcucucaag

SEQ ID NO: 4150614 - RNA, 59 nt, Human
cuucaguuagccaauucagguccuagggucuauccucaugccugaaugcuuaacuggag

SEQ ID NO: 4150615 - RNA, 93 nt, Human
cuucaugaaaauuaugugcccuguuauagucugaggccucagcuccaugcuaucaggcuucaaggacagcagccacaggauaccucuaugagg

SEQ ID NO: 4150616 - RNA, 59 nt, Human
cuucaugaggguuauucuuguuggcauggagugcccugcaaggcagcauccuuuugagg

SEQ ID NO: 4150617 - RNA, 71 nt, Human
cuucaugccuguuuuuaaauuuuauaaguggggauuuguugcuuaacgaauugugggacugggucaugaag

SEQ ID NO: 4150618 - RNA, 82 nt, Human
cuucauggccugcagugcugccacagccccgccacccuccacgaugaugcggcuguugucgggcuuacgcagggccaggaag

SEQ ID NO: 4150619 - RNA, 67 nt, Human
cuucauggcugcaguccgugcccugggccacugucagccuagaggcucagcagaugccugccauaag

SEQ ID NO: 4150620 - RNA, 96 nt, Human
cuucaugggauuucuagaaacacugccuacacuuuaugaaaacuacauaguauucaccugugacagguagaguuuaucacuauuaauuuuaugagg

SEQ ID NO: 4150621 - RNA, 82 nt, Human
cuuccaagguaugcuaauuguuagucacauguucugcuuuuuaauaugguuugugucuugcuaacaaugaguaggacugaag

SEQ ID NO: 4150622 - RNA, 61 nt, Human
cuuccacuguggauuccaucauugaucuguauuaaggacucuaauggcuucugaguggagg

SEQ ID NO: 4150623 - RNA, 82 nt, Human
cuuccagaagaccuaagauacauggggccugggucagccuggcaacaugaggucuccaggccaauguagcaggcccuggagg

SEQ ID NO: 4150624 - RNA, 75 nt, Human
cuuccagaagcacaggcuuuuuugcucucgaauaucaggaugauaccuggaguucugagucugaugaccuggaag

SEQ ID NO: 4150625 - RNA, 80 nt, Human
cuuccaggaggcaauaguagaguccaggauuugagcucuguaucccuaauggcucaccuucuggauuuccuccugugaag

SEQ ID NO: 4150626 - RNA, 81 nt, Human
cuucuuuuaagugauuauaauaagaaaaggaaacgauguguuugggucuuuccuacuuuauugugaacuacuugagagaag

SEQ ID NO: 4150627 - RNA, 65 nt, Human
cuugaaaaaguuauuuuucuguuauagacgaugauuuucauaacagaagaugaaacuucuuuggg

SEQ ID NO: 4150628 - RNA, 71 nt, Human
cuugaaagaguuuggagacaagaucagaaagcaaauuuugacugucucuauggcucuaaaaucuagucaag

SEQ ID NO: 4150629 - RNA, 67 nt, Human
cuugaaaugaaugaugaucugugaaauuuucagugaaugagaguuacacaacuuaucacaucuuaag

SEQ ID NO: 4150630 - RNA, 65 nt, Human
cuugaacaguguaucuagaucaugguugccaugguugccuugacacaaugaacaucuguaucaag

SEQ ID NO: 4150631 - RNA, 70 nt, Human
cuugaacccaggaaguggagguugcagugagcugggauugcaccacugcacuccagccugggugacagag

SEQ ID NO: 4150632 - RNA, 69 nt, Human
cuugaacccgagaggcggagguugcagugagcugagaucgcgccacugcacuccagccugggugacaag

SEQ ID NO: 4150633 - RNA, 69 nt, Human
cuugaacccgggggguggagguugcagugagccgagaucgcgccauugcacuccauccugggcaacaag

SEQ ID NO: 4150634 - RNA, 61 nt, Human
cuugaacuggggcaguggagguugcaauuagccgaggucgcaccauugcacuccagccagg

SEQ ID NO: 4150635 - RNA, 66 nt, Human
cuugaauagcuucugccccuguagccugagucuuagaauaaacucauguggagcagagcugccaag

SEQ ID NO: 4150636 - RNA, 63 nt, Human
cuugaaugggccauaagacgguccaauucccucauuuacuggauuauggugcuucauucagag

SEQ ID NO: 4150637 - RNA, 56 nt, Human
cuugaauguguggccaggauaaugacagaaacuguccaguucaagccaacaucaag

SEQ ID NO: 4150638 - RNA, 77 nt, Human
cuugaauguuuggcagucuggguuggcaguuagcuaguuggaggaggugacugaaagcuagcuguccagcacccaag

SEQ ID NO: 4150639 - RNA, 84 nt, Human
cuugacaaggugaucacuuauucuguguguguauguguguguguguaugcauaugcacauacauacauaggugcacuggacagg

SEQ ID NO: 4150640 - RNA, 129 nt, Human
cuugaccggacagcugaugaccaggccuuugcagggagagagagcccagugauuaggccauucaacugccaucucaucucccucugcagacaauccacaguggccuguggucccacaccuguucccugg

SEQ ID NO: 4150641 - RNA, 72 nt, Human
cuugaccuggcagucacggccaugugcuguuuccaacacagcgcuccuccuggccaggcugcccagcucagg

SEQ ID NO: 4150642 - RNA, 115 nt, Human
cuucagauauacgaguuucuaccacucauuggucauuucuuaacuagagugaacaaaauuguuggcuuuuuaaggaaauugccugucugguggguaaagcguaucuauuuguaag

SEQ ID NO: 4150643 - RNA, 64 nt, Human
cuucagauguuugugucugauuaugggaaauagaaauauuuauagucauguaaaauauuugaag

SEQ ID NO: 4150644 - RNA, 118 nt, Human
cuucagcacucagcuuugaagacgucuuguuaaccucuauuguuuuguaucagugggcuacaugcucaucugaagaaugaauggaauuagcacaguauuuuuaagcaauuaguuggag

SEQ ID NO: 4150645 - RNA, 58 nt, Human
cuucagcauuucugccuucacaauuucugcuuagggaugaggauaaguaaagcugaag

SEQ ID NO: 4150646 - RNA, 90 nt, Human
cuucaggagaguaggagagacugaaguagucauugucauuaccucagcagguuaauauaauagcuuuucacucgcauuuaaauccagagg

SEQ ID NO: 4150647 - RNA, 81 nt, Human
cuucagggcucugccgugugcucacauggacacacguggagaacaggugcaacguggaggcauagcagaugcaacguggag

SEQ ID NO: 4150648 - RNA, 62 nt, Human
cuucaguaucagaguuauuuuucucucaggagagcuaggaacacuuaauucgauacuagaag

SEQ ID NO: 4150649 - RNA, 56 nt, Human
cuucaguaucugcaaaauggggacacuuguaccugucucccaaggagguccugagg

SEQ ID NO: 4150650 - RNA, 78 nt, Human
cuucaguguuuuuuuggaauaaaguaguguaugcauacauacauauaaaucuuuguuccuagaauuuagcacuguuag

SEQ ID NO: 4150651 - RNA, 78 nt, Human
cuucaguucugcagaaggcaaguucugaucacagauagaaauauaggguuucucaacaugcuuucuaacagguagaag

SEQ ID NO: 4150652 - RNA, 75 nt, Human
cuucauaccugagguagcugugaauguucugggucuccugcccaggcauacucagagcaugccacaagugggaag

SEQ ID NO: 4150653 - RNA, 102 nt, Human
cuucauaucauaggacauuguguugaaggcuguaggcaaaguaggagggcuguguugucuuccagcucugcuucacagucucuucugauucuaguugugagg

SEQ ID NO: 4150654 - RNA, 93 nt, Human
cuucauauuuuaaguuguggagggugggaugaaaaugagaggguaauugcuugagaugauuucuaauaucacuuccagcuguaaaaugugagg

SEQ ID NO: 4150655 - RNA, 63 nt, Human
cuucaucgaguuagaaaaacaaagggcugauauugccucuuugcagaaauaaacuugaugagg

SEQ ID NO: 4150656 - RNA, 75 nt, Human
cuucaucgguuggaaagggauaucuguacuucauuugacuuuaagagcagucaucauuuuuaccaucugauagag

SEQ ID NO: 4150657 - RNA, 64 nt, Human
cuucaugagcacagcugagcaggugcggcugccggaugacugcacaguuggcuacaucguggag

SEQ ID NO: 4150658 - RNA, 57 nt, Human
cuucaugaugaccaacugccaugauuccacaucauuguuugguaguacaucaugaag

SEQ ID NO: 4150659 - RNA, 56 nt, Human
cuucauggagacacgcgucugccuuguagaauguuacaggcugccuguuccugaag

SEQ ID NO: 4150660 - RNA, 67 nt, Human
cuucauuacaucuuggccaaaacucugccuaccacagggggauguuugaugccugguguguuuggag

SEQ ID NO: 4150661 - RNA, 94 nt, Human
cuucauucgggugcaauuguaacagaauuugcuaaacuccgcauuugauuucugaaguggauuuuaauuauucugucauaaacuugcaauggag

SEQ ID NO: 4150662 - RNA, 110 nt, Human
cuucauucuccagcaaugaagaggaaacauggccauucagacuguggaggaacuggaugaggagacaucuggaaguacagucuggaggccuguguuggggagagauggag

SEQ ID NO: 4150663 - RNA, 61 nt, Human
cuucauucugccaucugcagaaggggaacgaucaugucuccauuaguggguggcagugagg

SEQ ID NO: 4150664 - RNA, 71 nt, Human
cuuccaagaguaugcaugcauguuuguguguguaagcagucuauacgaguauguuuguauuuucuuggaag

SEQ ID NO: 4150665 - RNA, 86 nt, Human
cuuccaaguuccucauccagucaugacuaaggcagcaaauaaucaaguugcuucagcuacauaguaguggcuggaagaggguuuag

SEQ ID NO: 4150666 - RNA, 62 nt, Human
cuuccacagauaaaaacagagguucugggaagauacaugaauuccuggccuguauguggaag

SEQ ID NO: 4150667 - RNA, 56 nt, Human
cuuccaccucacgcuuguucagcacaaaaaguggggagcaauaguugaggugugag

SEQ ID NO: 4150668 - RNA, 81 nt, Human
cuuccaccucugaggcugagccaugaggccucuugccccaggggacaguaggacaguucugccuccagcaaaggugugaug

SEQ ID NO: 4150669 - RNA, 82 nt, Human
cuuccaccuggagcugcaguguccuucccuguugucaaagcacuagaguuucuggaugcugauuccagucuccagaagggag

SEQ ID NO: 4150670 - RNA, 106 nt, Human
cuuccaccuugaccauguucccagacuauuccggaagguucucuagaauugcugacccagucuaguaggaucucugggcucacuggguacuaugaugagcaggaag

SEQ ID NO: 4150671 - RNA, 65 nt, Human
cuuccagagauccaugaauaccugagcugugagcaaaacaucuguauauauguauuuuuaggaag

SEQ ID NO: 4150672 - RNA, 81 nt, Human
cuuccagcccaggagacagggauggccuggagaggucaugggacccuguggggccaucucagucaccuccagccagggaag

SEQ ID NO: 4150673 - RNA, 117 nt, Human
cuuccagcccucaagcuuuugcugcuccccaggaaggcccuuccuggugcuguucccuccccuccugcaggugccuuugggguccugccugggcugcagcaccagcuuggcuugagg

SEQ ID NO: 4150674 - RNA, 64 nt, Human
cuuccagcugcagugcugccuccugaaagugaucacaauuuagaagcaucaccuguucugggag

SEQ ID NO: 4150675 - RNA, 83 nt, Human
cuuccagcugugcaccaucuccccaggggcaucucucugcuggggcucccagcugggaggcuccucugugacugcacuggggg

SEQ ID NO: 4150676 - RNA, 85 nt, Human
cuuccauucgaauuugacugacugaggcagccugaguuauuuguaaagaacaacaaggcuuuucauucauaauuuuaguaggggg

SEQ ID NO: 4150677 - RNA, 77 nt, Human
cuuccauugucuucccaaauguaccucuuuuagaagggcauucuaggugagggagcauugugagaaaauacagggag

SEQ ID NO: 4150678 - RNA, 71 nt, Human
cuucccaaagugcugggauuacaagcgugagccauggcaccuggccacauuguuuccuauacuuguagaag

SEQ ID NO: 4150679 - RNA, 59 nt, Human
cuucccaauaugcagucauuuuaccaacucuuggagugauuuacuaccauauugggcag

SEQ ID NO: 4150680 - RNA, 75 nt, Human
cuucccagaccuguaggaucagaaauucagggggauuggacccuguagucuguguuuuauuggccuggguuugag

SEQ ID NO: 4150681 - RNA, 55 nt, Human
cuucccagacgggguggcagccgggcagaggcugcaaucucggcacuuugggagg

SEQ ID NO: 4150682 - RNA, 64 nt, Human
cuucccaucuccaacauuuuucuuuagggaaaucugaauaaaaugaacugguagaguugggagg

SEQ ID NO: 4150683 - RNA, 69 nt, Human
cuucccaucugguucuuuguauuuccuucagugacuaagugagaaauucuaugggggccaggugggagg

SEQ ID NO: 4150684 - RNA, 57 nt, Human
cuucccaugggggcugugcucgagaaggcugcaugccucuccaggucccaggggaag

SEQ ID NO: 4150685 - RNA, 85 nt, Human
cuuccccagcuuugcugauguggugcuggaguuccgacgaggcagccggaauuucucuccgugcuauuuuaguaucgcugagagg

SEQ ID NO: 4150686 - RNA, 56 nt, Human
cuuccccaggaccucugcuaaauagcucagagcuaaggcagagggccugggagaag

SEQ ID NO: 4150687 - RNA, 76 nt, Human
cuuccccauagucucuuuuauguacacccugacuucccagcagcagagugccgagauggaagcggaugaggggaag

SEQ ID NO: 4150688 - RNA, 86 nt, Human
cuuccccaucagugcuggugccccuugaggagaagccuuacagaggaagaguuggccaaaaggggcauuuaugugugauuuggaag

SEQ ID NO: 4150689 - RNA, 62 nt, Human
cuucccgguuuucuagaugaucaggaaauucagcaggccagaacuuuagaaagacugggaag

SEQ ID NO: 4150690 - RNA, 64 nt, Human
cuucccuaggggcuuugguaugcccaucagcaagaggugaaucaugcagagaacuccagggaag

SEQ ID NO: 4150691 - RNA, 130 nt, Human
cuucccuccccucacaccuuuuacauucucuucccauugucucuggaauguguuuugggugggugggugugggaggagauugaagaaugaagauggaugaaaggcuguguuccccaggagaggcuguuag

SEQ ID NO: 4150692 - RNA, 58 nt, Human
cuucccuuucuuaaagaguuaggcagugauauacaugucauuuagaaguaaagggagg

SEQ ID NO: 4150693 - RNA, 72 nt, Human
cuucccuuugagucaucagcaggcaacacucuuggcaacuaggucaaagagugccuuggucuggaagggagg

SEQ ID NO: 4150694 - RNA, 60 nt, Human
cuuccggucucgcuggguuuggggcaaguuaccaaggccccaggacagcgcaaucggagg

SEQ ID NO: 4150695 - RNA, 102 nt, Human
cuuccguggcacguguucguccuucugagccugcagcuuucacagcauccacuuggaugagggcuuugcaggacuuuagcagagcaugugcucacuuggaag

SEQ ID NO: 4150696 - RNA, 55 nt, Human
cuuccgugucaguuccagguggcacagcgccagcuuguccgaggagacgcggaag

SEQ ID NO: 4150697 - RNA, 130 nt, Human
cuuccuacgccggagaaagcugccauugucgaacauguccugggaggcgggguccaggcuccaguaguugcccuugccugggcggcccggcucgcgggggaucuugacgaagcagucguucagcgagagg

SEQ ID NO: 4150698 - RNA, 78 nt, Human
cuuccuauaauagaaucaguucucugggcaugaagguaaauuacuucuguucuaggcaaaagcugauuuuccaggagg

SEQ ID NO: 4150699 - RNA, 93 nt, Human
cuuccucaugucacuuccuggauucccaagggcugaggggaccccacagagagaagagaaccccgagucugggggucaaggagccugagggag

SEQ ID NO: 4150700 - RNA, 104 nt, Human
cuuuuaaucgcuucgucuuguuuccuuugcuuuuuaaauaauguauugaucauuuuuguaagccacuuuaaggauguaaaggaagaaggaggaaagugagaaag

SEQ ID NO: 4150701 - RNA, 80 nt, Human
cuuuuaauguuuauaacucaacuuggaggguucuuuuccaauggauucaggagccacuuaggugagauaaacaaggagag

SEQ ID NO: 4150702 - RNA, 68 nt, Human
cuuuuaccuccccaguguaucagcugcuaaucugagaaggguuuaccugcugaggcugaggguagagg

SEQ ID NO: 4150703 - RNA, 77 nt, Human
cuuuuaguauagaaaguuuaguauaaaagguuauagaggauuacuuuacaaaaagaaacuggaguucaugcuaagag

SEQ ID NO: 4150704 - RNA, 59 nt, Human
cuuuuagugcaucagacacccucucucacuguucagaaaugagaggaugcaucuaagag

SEQ ID NO: 4150705 - RNA, 80 nt, Human
cuuuuauuuucaaugccguagagcagagguggggaguauuucaagaaguucuugucauccuucccccuuuuggcauaaag

SEQ ID NO: 4150706 - RNA, 86 nt, Human
cuuuucaucugcuucuugcaguuucagguugaccuaaucgaacagauucugcagaucaacuugacugccucauagccucugagaag

SEQ ID NO: 4150707 - RNA, 55 nt, Human
cuuuuccacugagccucacaaaagguggcagagaccugagggcuccuuggaaaag

SEQ ID NO: 4150708 - RNA, 57 nt, Human
cuuuuccagaauaccucccugggagucuccgucugcacccaggagagcuuggagaag

SEQ ID NO: 4150709 - RNA, 62 nt, Human
cuuuucccaagauucagcccuccugaccuuaauggguuaccacacugaguuuuaggacagag

SEQ ID NO: 4150710 - RNA, 76 nt, Human
cuuuuccucugucaugacaucuguuuaucucaaaauucugggcugguauugagcuaaaagguucauguuggaaaag

SEQ ID NO: 4150711 - RNA, 78 nt, Human
cuuuuccuucauucucauuucauagugcuuaauuugauaagaguucuaguugcauuggcugcuaugcugggggaaaag

SEQ ID NO: 4150712 - RNA, 77 nt, Human
cuuuucuaggauaugggucauggucauguguagacaauacuuuugauacagucagcucacaauugucccuagaaaag

SEQ ID NO: 4150713 - RNA, 106 nt, Human
cuuuucuauuuuuguuguuguuguuguuguuguuguucuucacugcuuuuguagcaggacaagccucagacaaaacuccucagacaccgaguuaaagaaggaaggg

SEQ ID NO: 4150714 - RNA, 84 nt, Human
cuuuucucaugagguagggaguuuguuguuguuuugauaaauacuuagaugaacauauucaggcacuuuacccagugggagggg

SEQ ID NO: 4150715 - RNA, 70 nt, Human
cuuuucucugcgggucuuucauaguuugggaaaauaauaaacgaggagcugaagaaccuggagaggaagg

SEQ ID NO: 4150716 - RNA, 66 nt, Human
cuuuucugauauucauaggcagguauuuaauuuuacuaauuagcauccugugugaauguauuaaag

SEQ ID NO: 4150717 - RNA, 61 nt, Human
cuuuucugcuguguaaaaugaggguacuacuguauacccugccagcuucacaggaggagag

SEQ ID NO: 4150718 - RNA, 61 nt, Human
cuuuucugugucacccccaacccuaugacauuaguuuguguucguaccugacacagaacag

SEQ ID NO: 4150719 - RNA, 68 nt, Human
cuuuucuuguauuggaugccccaacccucaugugcaugggggaaagaggcauugcagugcaggagaag

SEQ ID NO: 4150720 - RNA, 72 nt, Human
cuuuugagaagugcugagugauugcaaaggagcccagccuagcuccuuagcaggcauucaggaccuuguaag

SEQ ID NO: 4150721 - RNA, 80 nt, Human
cuuuugaguggggcuacugcaaaguuugguccugguggaaacauagcaggucccuaggguuuggccagagcccccaaaag

SEQ ID NO: 4150722 - RNA, 106 nt, Human
cuuuugcucugaaagaauaaagucuuuuuccaucauuuuuacucagaaagaaauauaaauugaggaaggcugaggcuggagaauuacuuuaggccaggaguucaag

SEQ ID NO: 4150723 - RNA, 89 nt, Human
cuuuugguggcuuggcauuguguugauagaaguuauuuuucaaggauuccuaagcuuuuucuaaucauaauugucuccgccaugaaaag

SEQ ID NO: 4150724 - RNA, 130 nt, Human
cuuuugguguacuuuucauauaaggaugauuuuguaauauugauuucuauugagagguuaggaagauaacucauucuuuucucaaauggacaauauuguggggguuuuuuguacuaauaguauagguaag

SEQ ID NO: 4150725 - RNA, 61 nt, Human
cuuuuguagauaucgcccaaggugcucaccaauggucagcacugauagaagucaauaaaag

SEQ ID NO: 4150726 - RNA, 67 nt, Human
cuuuuguagauucauugaacuuuuguaaacacaccaggugaacaggaaaggaaagggucugggagag

SEQ ID NO: 4150727 - RNA, 78 nt, Human
cuuuuguagucaguaacguuucguaucaguucuuugcaauauaugugagaauggguggaugaugagugacuacagagg

SEQ ID NO: 4150728 - RNA, 55 nt, Human
cuuuuguccuuccuugguagucaccagacagaaugcuucagaggaaaggcaaaag

SEQ ID NO: 4150729 - RNA, 58 nt, Human
cuggggugaaaaagccaggacauguaguugccauauuuacaugcccuguugacuucag

SEQ ID NO: 4150730 - RNA, 60 nt, Human
cuggggugacagagugagaccuugucuucaaaaaagaaggcaaguuaaccuuucaaccag

SEQ ID NO: 4150731 - RNA, 94 nt, Human
cugggguuccuuccacccucaggccugaguggcagucccccuuuaaggucaugguaccuugggaggccauggucugagagucuagaaaccuggg

SEQ ID NO: 4150732 - RNA, 100 nt, Human
cuggguaaguguugcauuucucaugcuggcuggagugccucuggaggggugacugacagcugcuccugguuucccagcagcaugagcagggcccauccag

SEQ ID NO: 4150733 - RNA, 69 nt, Human
cuggguaucuuccugggagagucuguggggaugaaaaguuccagagaccagaacauggggauagcccag

SEQ ID NO: 4150734 - RNA, 58 nt, Human
cugggucaggcauuuaggaugaguuccgcuaggcggaucuucugcuugucuugccugg

SEQ ID NO: 4150735 - RNA, 66 nt, Human
cugggucucagucuucccacagugagaccggggaugucccugaagcugugugaaaacugggccugg

SEQ ID NO: 4150736 - RNA, 81 nt, Human
cugggucuccgguucugccgccuccugucccuccuuccggcugccccggccagaggggcucgaaggcgcguuggggcccgg

SEQ ID NO: 4150737 - RNA, 65 nt, Human
cugggucucuguccuggcugcccuggacucuaaccugaguucugggguccugggaugggauccag

SEQ ID NO: 4150738 - RNA, 65 nt, Human
cugggugacagagugagauggucucagagaaaaaagcacacaccagacucuaucaacucacccag

SEQ ID NO: 4150739 - RNA, 58 nt, Human
cugggugccccucagugccgagcacagguaucuggcccagagcacugcugggcaacag

SEQ ID NO: 4150740 - RNA, 62 nt, Human
cugggugcgugagcgcaugcgugcauguuuguguguguguguguuccacgcacauuugccag

SEQ ID NO: 4150741 - RNA, 60 nt, Human
cuggguggaaagugcugagaauguugagagaaaggagacauuccagcaugcgccuuccag

SEQ ID NO: 4150742 - RNA, 100 nt, Human
cuggguggagacucugccuuuggcccugaggaggcagcugcucccuuuugagcugggaggagcagcuucuguaggugucacgcccagaaacuccacgcag

SEQ ID NO: 4150743 - RNA, 126 nt, Human
cuggguggcuguuggugcuggcucaguggcuuggggagguuggggcugggauguaugucauuccugggcuuuccccucugguugugaguggcugcagcagcuccagguaucacggcuacaucccag

SEQ ID NO: 4150744 - RNA, 64 nt, Human
cugggugugugaagacaagauauauugcagcugaaaaaggcugggagggucuuuauucacuuag

SEQ ID NO: 4150745 - RNA, 69 nt, Human
cuggguuagaauucugguccuguccaaggucacaguuauuuugagcuaacaugacuagaagcuucucag

SEQ ID NO: 4150746 - RNA, 102 nt, Human
cuggguucuuagaccugguagggcuuggcuggggccaccagaccccagggagaagggaucauggcacaugcccuccagggagccagguacugcagaccccag

SEQ ID NO: 4150747 - RNA, 55 nt, Human
cuggguuucuaaggaaucucugagcacuuagacucagagauuuuaguagccacag

SEQ ID NO: 4150748 - RNA, 81 nt, Human
cugguaaaggggugggcauuagagcaguaccuaacguguagcaaaacagauggacugcucugagcccuuauccuuugccag

SEQ ID NO: 4150749 - RNA, 84 nt, Human
cugguaaugaagggaccugggccagagcucuuaaacuucucaaaggacaagcagccacagcccacaggacucuuuauuuuucag

SEQ ID NO: 4150750 - RNA, 83 nt, Human
cugguacacacgcaccucuggccuggcacgggucacggcugccauguaacacugggcugggcuccaggccagggugaacccag

SEQ ID NO: 4150751 - RNA, 129 nt, Human
cugguaccugugucugggagccacggaccaaggcugaggagggccugcaggaggucagagguggccccugugcccuacaccuuuccaggccugaccucugugagccccuuggaccugcuagagggcugg

SEQ ID NO: 4150752 - RNA, 88 nt, Human
cugguagugacugcccauccauguggcagggcuggccuccaggauggguccagccaagcauggcguggggcaugggcagggacaccag

SEQ ID NO: 4150753 - RNA, 64 nt, Human
cugguauguuuuuguccuccagggaucugguuuuaaucuggagcccuugauaauaaagcaccag

SEQ ID NO: 4150754 - RNA, 65 nt, Human
cuggucaccaagcucucuucccggcucuccuucuggaggggcagugggaggagggcuggggucag

SEQ ID NO: 4150755 - RNA, 59 nt, Human
cugguccaagugagguggccucugggaacauucuuaagaccuacaugucauuggagcag

SEQ ID NO: 4150756 - RNA, 109 nt, Human
cugguccaugagcugggucugcagcaguaacugccugugcugcgccuccuucucagaggucagcugcugauaggcagccacguacugcugcaggugacccagggacugg

SEQ ID NO: 4150757 - RNA, 63 nt, Human
cuggucccugcccaccugggagcuccuaccucgcaggcagugccagucucuggcaggggucag

SEQ ID NO: 4150758 - RNA, 99 nt, Human
cuggucucuuuggagggcccuuucauuggcagagcucucugggcaagaggagcuggggagccucacuccaguugagggguccucuggguccaggaccag

SEQ ID NO: 4150759 - RNA, 129 nt, Human
cuggucuucccucugugugccccacugccagguggcaccuuacccugcgcaggcgcucagccugcgcggugguacagaugcuucacucacacuugccgggggcuaaaaucacagccuaugaccaaccug

SEQ ID NO: 4150760 - RNA, 65 nt, Human
cuggucuuguuucuuaaacuaugugcuagaggaauuaagguauauuuauaagcaagcaggacugg

SEQ ID NO: 4150761 - RNA, 59 nt, Human
cuggugacucccucucccgcuucucccaacucugaggcccagggacugggaaucagugg

SEQ ID NO: 4150762 - RNA, 111 nt, Human
cuggugagagcagaccuauuugugaggcucuuuucugcugugucugacuucaggccaagccaggaagcagcaagaaagaacucacucauggagcccuuuguucugggccag

SEQ ID NO: 4150763 - RNA, 126 nt, Human
cuggugaguaggguagaggauggaggacauuggggaaaguggccccccggcgagagaggucgugugcacugagcgggagcagcuugagcuggggcuggcucucaggucgcauccuguggccaccag

SEQ ID NO: 4150764 - RNA, 66 nt, Human
cuggugcacauucgcucucauacacaucuaaacugaugcuaauagagaguaaagugaugcuaucag

SEQ ID NO: 4150765 - RNA, 68 nt, Human
cuggugccagcuguuucagagcccagugcgggauuuuccugaagcuccuccacggcagguggcaccag

SEQ ID NO: 4150766 - RNA, 63 nt, Human
cuggugccuccucucccaggucaaauauuaacuaucuggccuuggaaagaggggaggaaucag

SEQ ID NO: 4150767 - RNA, 82 nt, Human
cuggugcuauugaaauucuucauguccucuugaauguuuacaucuauaugaguauggggaauggccaauccaaaggcacuag

SEQ ID NO: 4150768 - RNA, 86 nt, Human
cuggugcucuuuccaccucucuuccuaucagguuuugcacucaaccuuccccagaaccaaauggaugguaagaggggcagcaucag

SEQ ID NO: 4150769 - RNA, 64 nt, Human
cugguggaaucugcuuagagcuuugaggagagaauucccagagccaagcuauggaugguacuag

SEQ ID NO: 4150770 - RNA, 70 nt, Human
cuggugggaagaggagcacuggaaugggaguuaggcgcucuacauucuccccggcuuccuccccaacuag

SEQ ID NO: 4150771 - RNA, 77 nt, Human
cugguggugguuuccuucugucauuugucaguucacuacauuuugaaauaauggcuuuaggaauccagugccaucag

SEQ ID NO: 4150772 - RNA, 65 nt, Human
cuuucacauccauuaacucauuuguuucucaaaagagaacagaugaggaaauggaguccagaaag

SEQ ID NO: 4150773 - RNA, 69 nt, Human
cuuucacuuauuuacuuauuuuuaaauuuuccacagcagagggagaagaguuaaaugaaugaguggggg

SEQ ID NO: 4150774 - RNA, 77 nt, Human
cuuucagaaagccaucugcugguucgcauguguauguaauccagguggaaccagucucugcaggugcacuuugggag

SEQ ID NO: 4150775 - RNA, 55 nt, Human
cuuucagcaucccugggauuacacaaguacuuguuucuccagggauccaugaaag

SEQ ID NO: 4150776 - RNA, 126 nt, Human
cuuucagcugaacuccucuucuugucuugaugagaaucucuuugacaagcagauaugauuucuguuaucaagaguucugcuuggucaggggcuguguuaacucaucuccagauaaucagugucuag

SEQ ID NO: 4150777 - RNA, 68 nt, Human
cuuucauucauucaucugcugacuugacaaguaccagagugguaauugugggcuuaguagagugaaag

SEQ ID NO: 4150778 - RNA, 89 nt, Human
cuuucauuccaauuugauguaagccauaaaugaaaugacuuggcugauuauaagucaguuccccaugaacauuuguuuacaucugaaag

SEQ ID NO: 4150779 - RNA, 130 nt, Human
cuuuccaaagcauuuugaaaaauguguuaguguguauuaauguuuguauauguuaguuaacuuuacaauuaauuuauuuguaauauaagcauuaauaguugugcuuauguguccauugugcaaaauuugg

SEQ ID NO: 4150780 - RNA, 88 nt, Human
gaaaccuggagacaugggguuggcauccuaacauuuuccuuauccuuugugugauguuggaaaaauugccugaugucuucucaguuuc

SEQ ID NO: 4150781 - RNA, 69 nt, Human
gaaaccuguuuugauuaacaaguaacgcugugacggcauaucucuuacaauuuaaugaaaagagguuuu

SEQ ID NO: 4150782 - RNA, 105 nt, Human
gaaacgccucacuaugucaaggagucgucucaugguggcugucacaugaagcaugaaggagugugauggaggacccagcgugggaggacagacagugaagccguc

SEQ ID NO: 4150783 - RNA, 68 nt, Human
gaaacgggguuucaccauguuggccaggcuggucucaaacuccugaccucaggugauccgcccgucuc

SEQ ID NO: 4150784 - RNA, 62 nt, Human
gaaacggugaugaaaagugccuuuauccaggaagucuucccugauggauuucaacaccuuuc

SEQ ID NO: 4150785 - RNA, 55 nt, Human
gaaacguuguggaaaauccucuggggaauagcugagaggacuuuuuugauguuuu

SEQ ID NO: 4150786 - RNA, 65 nt, Human
gaaacucaagagacugugacaccuguucaagcaaagcuaugcuuaacagauacaucugugguuuc

SEQ ID NO: 4150787 - RNA, 78 nt, Human
gaaacucacauucuugggccccacccucagaauuuccgacucaaugggucugggcuggugcucaugaauuugcauuuc

SEQ ID NO: 4150788 - RNA, 67 nt, Human
gaaacucucagauguuucuggaggguugcaucauuuuucgcccucaucagcaguggaugagaguuuu

SEQ ID NO: 4150789 - RNA, 81 nt, Human
gaaacugaaacacagguguaauuugcccgagguuacagagugugugccagaagggagguuugcaucuauguauccuguuuc

SEQ ID NO: 4150790 - RNA, 84 nt, Human
gaaacugcauuuugggggccagacagcacagaacacaauuccauguuucucuguguucuagccuggggcuccuuggcagaauuc

SEQ ID NO: 4150791 - RNA, 63 nt, Human
gaaacuggcugguuacuauuucuggugacacucaaaggaaguugugacagccaacuguguuuc

SEQ ID NO: 4150792 - RNA, 78 nt, Human
gaaacuuuuaugauuaaucuuguuuuguguugacacaacuaagguaauguuaacauguuaagaaauuagauaaguuuc

SEQ ID NO: 4150793 - RNA, 56 nt, Human
gaaagaaagcuuuuccuuugguggcauuugcuuagugugaggaaacauuuucuuuc

SEQ ID NO: 4150794 - RNA, 73 nt, Human
gaaagaaauugaggcuaaguaacuguccaugggcacauagcucaugaguuuaagguuuaggcuuaggucuuuc

SEQ ID NO: 4150795 - RNA, 82 nt, Human
gaaagaacaagaguaguuugguugacagcuguggcagaggagccgauagccgaguucuuaggcaaacaacucuuugacuuuc

SEQ ID NO: 4150796 - RNA, 57 nt, Human
gaaagaaugcuauagugacuuccauuugagcaguugcuguuggcuagcauuacuuuc

SEQ ID NO: 4150797 - RNA, 55 nt, Human
gaaagaccagcaugaggcuuuagcagguguguaagcucucagaacacuggucuuc

SEQ ID NO: 4150798 - RNA, 56 nt, Human
gaaagacuuccuuugagaguacuuucuuguacuugucaacccuuaugaagucucuc

SEQ ID NO: 4150799 - RNA, 62 nt, Human
gaaagagaaccugggccuagaugcuaauggaaacuaucccaugcuuucucagacucucuuuc

SEQ ID NO: 4150800 - RNA, 85 nt, Human
gaaagagcacuggauaggggguuagaugacuaagccugcugugugacuuccagcugguugcuuaaccucucugggcugcacuuuc

SEQ ID NO: 4150801 - RNA, 79 nt, Human
gaaagaugcacuuuuucucagaaggauugguuucccaaagggagagccuuagcccuuuucugaguagaagaccucuuuc

SEQ ID NO: 4150802 - RNA, 57 nt, Human
gaaagaugucagcuuagcuuuuaggaugaauucuugauguauaaguugauauguauc

SEQ ID NO: 4150803 - RNA, 79 nt, Human
gaaagauugcuuuuagaaguuaucaggauuaaaguugcauacagugcuacaagucauuccagguacuucuaaaucuuuc

SEQ ID NO: 4150804 - RNA, 66 nt, Human
gaaagccaggcuggccugggguuccauccucagaaacaugugugaaacccugagcaagucgcuuuc

SEQ ID NO: 4150805 - RNA, 72 nt, Human
gaaagcccugccuggggggaaguagggggcagcuuuugucuuccccugagaccccucagcacugaaguuuuc

SEQ ID NO: 4150806 - RNA, 59 nt, Human
gaaagccuguauuuauugagaguguaccauugcagguggcucuugagaugcagguaguc

SEQ ID NO: 4150807 - RNA, 70 nt, Human
gaaagcgccggcuauuugagcuacugaaagaaaaucaguuucuuucaauucuccuaaugcuaugacuuuc

SEQ ID NO: 4150808 - RNA, 81 nt, Human
gaaagcuggcaggugagguggcuggaacaaacuggucucaucagggaggccugugacaaacccgccuauuccuccgcuuuc

SEQ ID NO: 4150809 - RNA, 68 nt, Human
gaaaggagauauagacuucauauauuggugggauuuaaaucaaaccaguaggaagucuauuauuaguc

SEQ ID NO: 4150810 - RNA, 80 nt, Human
gaaaggagaucaugaggcugagugagccugcugggaguugguccaggcuacgugaggcugcguuagccucacuccccauc

SEQ ID NO: 4150811 - RNA, 96 nt, Human
gaaaggagugaaaugaauguuuggugaucagauagguaaauuguggcagacaaugacaaugcuaugugaucaucaaaccugauuuccuuuucuuuc

SEQ ID NO: 4150812 - RNA, 80 nt, Human
gaaaggauggacccugcuguuuucuucacuucagagagagaauccccuggggugacuuuaagacacaauguucaccuguc

SEQ ID NO: 4150813 - RNA, 61 nt, Human
gaaaggcagacaaggacacagugggccacaggacuggccuucugugcauuugucuccccuc

SEQ ID NO: 4150814 - RNA, 55 nt, Human
gaaaggcaucuucagucucugagcuucccacgcacauuugcuggaauugucuuuc

SEQ ID NO: 4150815 - RNA, 61 nt, Human
gaaaggcuaaaauuauaaggguuagagcaaguauuagcuauaccccuugauuuuagauuuu

SEQ ID NO: 4150816 - RNA, 60 nt, Human
gaaaggcuugguuuugaauauaugaacagcaaccauauauauucagacaagggcucuuuu

SEQ ID NO: 4150817 - RNA, 70 nt, Human
gaaagggauggcagucugcaugagaaaggaccugaaaugguauuuucugugugauugacuauuuucuuuc

SEQ ID NO: 4150818 - RNA, 55 nt, Human
gaaagggccuuggaacucaaagacuuagauuugagucuugguccaggcucauuuc

SEQ ID NO: 4150819 - RNA, 72 nt, Human
gaaagggcuuaggcagggcuggaagaucuugcucucacauuggcauagacuggaagccugccaagcaaauuc

SEQ ID NO: 4150820 - RNA, 113 nt, Human
gaaaggggaagccaaagauuguaucugguguucucuguuaucuucuuucugugaaagcccuagcuuucauuaguaugacagcacgcagaucaucuuuauuggcuuuuacuuuc

SEQ ID NO: 4150821 - RNA, 58 nt, Human
gaaagggguuaggcucggagauaguugacuaaccaacugcucugguagaaacucuuuc

SEQ ID NO: 4150822 - RNA, 102 nt, Human
gaaaggguguaacaaguaauccaugggagcagcagguaucuuuaaggggguccaaaagcugcuugagauccacugccuguugucauaucacguccacccuuc

SEQ ID NO: 4150823 - RNA, 75 nt, Human
gaaagguacaagguagagaaggauuugauuccaugacccuggauucaaagaucaugaucucuacugcugcauuuc

SEQ ID NO: 4150824 - RNA, 124 nt, Human
gaaagguagauaccuacaaacauggcaucuaaaaggugguuugauuaucccacugucaaguaucaguguuaugucaccuauuacugugauuuucaugugauguuuguagcagcaauuacuuuuc

SEQ ID NO: 4150825 - RNA, 81 nt, Human
gaaaggugaaauccuuuucuguucccauuaaguguuguuaaggccauuagcagaaauuggaauagagaaauaugaccuuuc

SEQ ID NO: 4150826 - RNA, 80 nt, Human
gaaagguugggguauuacuaguauaugucaagcaacuuucacgcagagauguuccacaaauauuggugccccauucucuc

SEQ ID NO: 4150827 - RNA, 64 nt, Human
gaaaguagaugacccaucucugagccaaugacaacaggaguacucauggauuuucucugcuuuu

SEQ ID NO: 4150828 - RNA, 110 nt, Human
gaaagucauaugguuggaaucauauaguauguauagaaucauacagucuguauauucagacuaguuucuuucacguaguaauaugcacuuaaauuuucuccaugccuuuc

SEQ ID NO: 4150829 - RNA, 119 nt, Human
gaaagugaaaacaauucuuaccuugugggccuuaaaaaagcaggcagcaggcuggauuuggcaugcaagccgguuugcugaccucugcucuacacuuggguuuuuuugucuuuuuuuuc

SEQ ID NO: 4150830 - RNA, 68 nt, Human
gaaagugcuaggaaguguuagagacugaauuucaaaccaaaggcuaacaccaaaauccaguacucuuc

SEQ ID NO: 4150831 - RNA, 84 nt, Human
gaaaguggaguuuggguacagccucaucacgggagcugcucugcguucucgggucaugcaggcuggcaucuaaugccaacuuuc

SEQ ID NO: 4150832 - RNA, 63 nt, Human
gaaaguggcagagucuguacuuggauccagaucuacauuuccauuagguacaaacccauuuuu

SEQ ID NO: 4150833 - RNA, 81 nt, Human
gaaaguuauguauguuuuuguauguguguguauauaugauucauauaugacacauaaaacaaggacugcuacaagaaauuc

SEQ ID NO: 4150834 - RNA, 57 nt, Human
gaaaguucguccuguggcuucucugucaaaccaaggagugcuccuggauggauuucc

SEQ ID NO: 4150835 - RNA, 60 nt, Human
gaaaguugcaaucauggcuuuugcaguaagcacugcuaugugaaguaguugcaaacuuuc

SEQ ID NO: 4150836 - RNA, 84 nt, Human
gaaaguuuucaccccuguuauagaaccaccucauucuuuuuaaugacugaauaguguucuauaauauggaugugucauauuuuu

SEQ ID NO: 4150837 - RNA, 73 nt, Human
gaaauaaagcccagaaucaagucuacuguuucccaauuggugugaccaugggcugaauucugcgcuucuuuuu

SEQ ID NO: 4150838 - RNA, 72 nt, Human
gaaauaacuauugaguaucugugaugucuggggcccuaugucaggugcugacacugcaaauauaaauauuuc

SEQ ID NO: 4150839 - RNA, 108 nt, Human
gaaauaagcagaaaaugcuuuugggguauuuuuuccaguaaauagcagagugacaacaagccuguuauuugcuggaagaguuuguuuaagcuuuuuuuguugcuuuuc

SEQ ID NO: 4150840 - RNA, 61 nt, Human
gaaauaauacagugcucuucuccauuugcuguggagcccugugguucauuguuauuauuuc

SEQ ID NO: 4150841 - RNA, 91 nt, Human
gaaauacagagugaccccaauauggccugaguccuugccucuucccaggagcaaggcuccagggcugugugggagcacacuuucugauuuc

SEQ ID NO: 4150842 - RNA, 85 nt, Human
gaaauacugacuugaaagaagggucuuuuaauugaugaaaucaaagauucucaaaaucuuucuuuuacugucuugaacguauuuc

SEQ ID NO: 4150843 - RNA, 109 nt, Human
gaaauaggagagagaaauggacgaggagaggaaaagcgaggcuauuauugaauaguaaaauggaagccauuguugucuucaucuucagcccauccccaacacuccuuuc

SEQ ID NO: 4150844 - RNA, 61 nt, Human
gaaauaguuugaauagugucuccuaggaucaaucuuuuggcugcucuuuucaugcuguuuc

SEQ ID NO: 4150845 - RNA, 76 nt, Human
gaaauaugaccucagugagugucaaaguuuacacuggaaaauaacuuuaaggugacaguauugauggcaggauuuc

SEQ ID NO: 4150846 - RNA, 73 nt, Human
gaaaugaugacugucuucugauguaaucagcuaaccaacacaaagaugaauaacacaacaggcagucauuuuc

SEQ ID NO: 4150847 - RNA, 87 nt, Human
gaaaugcaauagcaaaguuaucaaauuaauguuacaacaaaaucaauacauauuaaugggguuuucuuuguuuuuccuugcaucuuc

SEQ ID NO: 4150848 - RNA, 77 nt, Human
gaaauggaaugcauaaauauuguugggaguauucauuugaauuuugagcuuuacuuaaaacacauuuagcauuuuuc

SEQ ID NO: 4150849 - RNA, 55 nt, Human
gaaauggaucagagcaagcuuuuuuuggucauucaucagucuucugauccauuuu

SEQ ID NO: 4150850 - RNA, 74 nt, Human
gaaauggugagggguaaguaaaggaauugcaggaauaaaaaugaccaccugcaaaaguuagcccuucccaucuc

SEQ ID NO: 4150851 - RNA, 86 nt, Human
gaaaugguggguuggcucuuaaggucccugugcuauuuugauaagacucuaguaucuccagaccuugguaguucuaccaccauuuu

SEQ ID NO: 4150852 - RNA, 77 nt, Human
gaaaugguguaaaauaaaugccucagaaucaucccacccaaggggcaagggagcuggggcauuuauaccccaauuuc

SEQ ID NO: 4150853 - RNA, 70 nt, Human
gaaaugguuacagagauuuuuaagauguguuuuccaugccuacaugcucuuguaacugcuguaccauuuu

SEQ ID NO: 4150854 - RNA, 65 nt, Human
gaaaugguuucuugggagaagucaggagcugucaucagcaucugaugagcccaggugaccauguc

SEQ ID NO: 4150855 - RNA, 55 nt, Human
gaaauguagaguaucugaggauuucgucuacuuccuugauacuguauuauauuuc

SEQ ID NO: 4150856 - RNA, 99 nt, Human
gaaauguagcuguguagaaaugacagaguccuugaaaaauauucggguuauaagauaugacaucaaguuaccuggucauuacuauaacagucacauuuu

SEQ ID NO: 4150857 - RNA, 58 nt, Human
gaaaugucaagauauguuuggacuuugccuuggacaucgccgagcagauugauguuuc

SEQ ID NO: 4150858 - RNA, 81 nt, Human
gaaaugucacaucugucugcaauuggcuaccucuccauaggagaaacacugcuggaagccuggagaccagauguugcuuuc

SEQ ID NO: 4150859 - RNA, 61 nt, Human
gaaaugucugccaggcacauaguaggcacucagugaguauguguuauuugguauacauuuc

SEQ ID NO: 4150860 - RNA, 125 nt, Human
gaaaugugaagcagaaaaaucucgacaaugcuguugagacauucuuuuucuugggaaggccucaugucaaagcagcaaauauuaauccauuugucauaacagauguuuuucuguugaaacccuuc

SEQ ID NO: 4150861 - RNA, 59 nt, Human
gaaauguguucgugauuauuuguccauuuagggggacaucuguuuaacgaaggcauuuu

SEQ ID NO: 4150862 - RNA, 70 nt, Human
gaaauguuaaaaugcagauucugauucaguagauucuaggugaggcugaaauucugcauuucuaacaagc

SEQ ID NO: 4150863 - RNA, 62 nt, Human
gaaauguuaugagauauguacuauuggguggaaaccaaguauggaaauuccauaaacauuuc

SEQ ID NO: 4150864 - RNA, 63 nt, Human
gaaauguuuuguuugugacuaagcauaccauaguugggugcuuugcaaauaauagaaugucuc

SEQ ID NO: 4150865 - RNA, 63 nt, Human
gaaauuaaagcagguuaugaccauggcccgugaggcaugguuuuaugacucugcugaaaucuc

SEQ ID NO: 4150866 - RNA, 86 nt, Human
gaaauuacgggaacacagcuucucuuuccaaauauuaagaaaauguacguauuuaggcaauagauggcaguguuuccacaaauuuu

SEQ ID NO: 4150867 - RNA, 55 nt, Human
gaaauuauuuucagaauggagaaggcaguugucuucaucagggagaaauaauuuc

SEQ ID NO: 4150868 - RNA, 100 nt, Human
gaaauucccaggaagucucccuccuaaaacauguagcaguuuuucauuauccagagugaucauucugaaauugcuuuagggggaaagacgugggaacuuc

SEQ ID NO: 4150869 - RNA, 57 nt, Human
gaaauucuaucagcuuuuagugcccugaauacaguauuaacaguuguagaggguuuu

SEQ ID NO: 4150870 - RNA, 72 nt, Human
gaaauucucuggugcugugauacgaggcacuggaguuguaagcaaccaugucucucaugaccaaagaagcuc

SEQ ID NO: 4150871 - RNA, 63 nt, Human
gaaauugacacaugcaccagucuuuaaauggguuggaguuuagagauuucauguguuuauuuu

SEQ ID NO: 4150872 - RNA, 61 nt, Human
gaaauugauaucucugaagccugcugccuuaauggcagucuucagagaaauuaacucuuuc

SEQ ID NO: 4150873 - RNA, 73 nt, Human
gaaauuguuggggcuguacuaugaauaucuuguuucuaaagauacagucagacuuuagccauuuaacaauuuc

SEQ ID NO: 4150874 - RNA, 90 nt, Human
gaaauuuuauuuuuagauauacugcacgauauggugaauguacuuaacaacaguguauuguacauuuccaaauugcugagaguaaauuuc

SEQ ID NO: 4150875 - RNA, 81 nt, Human
gaacaaauaugagaaagaaaugagaauacauuuggaaaacucuuuuugaaucuuucaaauuucuuuggguuauguucuuuc

SEQ ID NO: 4150876 - RNA, 126 nt, Human
gaacaaaugcuaaauagaguaacaguuaaauguauguguacacucuucccaaaugccaagagugcagcgguggggugagauucagauauucauuuauuucuaagucuguaguuaacauuuauguuc

SEQ ID NO: 4150877 - RNA, 99 nt, Human
gaacaaauguuguggauucuuuuucaauugccauugcugucuugguuaaaacaaaaguguguaauguguuuugaaaaacaguauuuaaaguauuuucuc

SEQ ID NO: 4150878 - RNA, 75 nt, Human
gaacaaauugagaugauaaacaccugcuggguauguauacacccuuguacacacuguuugaucauuucuaaguuc

SEQ ID NO: 4150879 - RNA, 69 nt, Human
gaacaagccauacugggugaaaucaaagcacguguaaaggacgacugacacccagaccaugguuuauuc

SEQ ID NO: 4150880 - RNA, 85 nt, Human
gaacaauuguuccucucuguugcuaaauguauugccuaauuagagaaugaauaaaaugucauagcaaagagagugauauuuguuu

SEQ ID NO: 4150881 - RNA, 56 nt, Human
gaacacagucaagggcugcuguccucucauccuuggacaguccugcacugguguuu

SEQ ID NO: 4150882 - RNA, 69 nt, Human
gaacaccaugaaauguuuuguaagcaugcaucuguugaguauuugcuauacggagcaucuucagguuuc

SEQ ID NO: 4150883 - RNA, 129 nt, Human
gaacagauuuuauuagaugcuaaauauaguaagccucuccagagacaguauuacauuucaggggauuagaggauuuguaaaaccacugucugcucauaauggagggcuuaucaacugaaaaauauuuuu

SEQ ID NO: 4150884 - RNA, 95 nt, Human
gaacagcacaugggggaagagagaagaaugaucuuuacaacauagccuuagucgagaacauaucuguuuucuaacucccucucucuggguuguuc

SEQ ID NO: 4150885 - RNA, 55 nt, Human
gaacagccuggaguugcagggccucucaagcugggggcccugaccuuggcugcuc

SEQ ID NO: 4150886 - RNA, 75 nt, Human
gaacagcuacacaucaagucuuauggucacuuugaagagaauaaagccagagggauuccuggugugucuccguuc

SEQ ID NO: 4150887 - RNA, 66 nt, Human
gaacagugccagcacacaauaagcgcucauaaauauuaacugcuuuuaugauugucagcauuguuc

SEQ ID NO: 4150888 - RNA, 116 nt, Human
gaacaguuagacccauucccagucuuacaugagauuagucacaggauauuucauuuuaaguccaguggaauguuuuccuaaaucagacaagacucuuucaguguuuauggcuguuu

SEQ ID NO: 4150889 - RNA, 57 nt, Human
gaacaucauuguuugguucucuucuuugaggcuagaaugagaaucucuuugauguuu

SEQ ID NO: 4150890 - RNA, 62 nt, Human
gaacauccaugccaacuuuuucagagaacauuccaaaacaguauggcaugugguccauguuc

SEQ ID NO: 4150891 - RNA, 100 nt, Human
gaacaugagaaaacuuugaagugauggauguguucacuaucuugaguauauagugauauucucauugguauauacaugugucaaaaguuuauugcguguc

SEQ ID NO: 4150892 - RNA, 65 nt, Human
gaacauggccuuucucaguggugcuuuuuuucuaggaguuucacguagaucaggguccaggguuc

SEQ ID NO: 4150893 - RNA, 67 nt, Human
gaacauggcucuguuuuuuaugcucuauugaaaaugaucaucagaagcagaaacugggcuuguguuc

SEQ ID NO: 4150894 - RNA, 87 nt, Human
gaacauuagacucaacuucaaauggcuuaaguauaagugagauuuauuaucacacauaaaaagaagacuagagguaguguagugauc

SEQ ID NO: 4150895 - RNA, 61 nt, Human
gaacauuuccagaaaggaacuaggcauugcuuucuguucauuuguuccuuuagaaguguuc

SEQ ID NO: 4150896 - RNA, 81 nt, Human
gaaccacgacagggauugauauguuauagcccaggacaugaaccuagcaauaaagauaucauuucgauugucuguggcuuc

SEQ ID NO: 4150897 - RNA, 60 nt, Human
gaaccaggaagcaggcccucaccagacacugaaucugcaggcaccuggaucuuggaauuc

SEQ ID NO: 4150898 - RNA, 72 nt, Human
gaacccaaaccuggaccucccucugggugaucuucucuucuacagcccugucuaggugcagcuuugggucuc

SEQ ID NO: 4150899 - RNA, 64 nt, Human
gaacccaggaggggagcccucaggggauggggcugguccugucucugaagcccccuccuuuguc

SEQ ID NO: 4150900 - RNA, 61 nt, Human
gaaccccaacuuauaagacagaaagaacugagcuguucaggcuggguuggagauggggguc

SEQ ID NO: 4150901 - RNA, 129 nt, Human
gaacccgggagcggcuccggggcugucagcugcccgccuggcuccuccaaggccuggagcucggacgcgggcucugggggcuucuggggcgcggaagcgggcucgcggggagcaguggccgcccccggc

SEQ ID NO: 4150902 - RNA, 72 nt, Human
gaaccgaggauauggcauucuuuuuaaggguguguguauucacaacuuagggaagaaucccaaauugaauuc

SEQ ID NO: 4150903 - RNA, 69 nt, Human
gaaccuagguuuaggguacauguuuuucucuguuucaugaacuuacagugugguuugagcacuggguuc

SEQ ID NO: 4150904 - RNA, 61 nt, Human
gaaccucagugaaacuggaggugagcgaugugguucaggcauuuccauuucagugggauuc

SEQ ID NO: 4150905 - RNA, 63 nt, Human
gaaccuccaagaugguccaugcacagauauggcaaucaaugcugacuguuggcuaugagguuc

SEQ ID NO: 4150906 - RNA, 67 nt, Human
gaaccugaaagcagcugcucuggccuugaccaugggucaugccuggugccaguugcuagucugguuu

SEQ ID NO: 4150907 - RNA, 77 nt, Human
gaacgaacaggcaaacugugggaucccggccugccagggaggguucaggguaaagccuucaguuugcuuguucauuc

SEQ ID NO: 4150908 - RNA, 56 nt, Human
gaacgcugugcacuggguccaggaugacuugcacacccuguucacugcgcaguuuc

SEQ ID NO: 4150909 - RNA, 56 nt, Human
cuuuguauuuuaucauaguuuuauauguaccauaaaacugugaagcaaguacaagg

SEQ ID NO: 4150910 - RNA, 95 nt, Human
cuuugucaccucagugccuggaaagugucuccauccugguuauacuuaggguuguauccagugauuaugcacaucuggcauaaggccucacauag

SEQ ID NO: 4150911 - RNA, 77 nt, Human
cuuugucauauacaucaagauaaaaacugucagacuacacuagauucacagacaauuguuuugguguuaagagaaag

SEQ ID NO: 4150912 - RNA, 71 nt, Human
cuuugucuuuauaaugguucuaagaucaucagaaguuacuuuugugcauaaagggcuauaguacagcaagg

SEQ ID NO: 4150913 - RNA, 87 nt, Human
cuuuguggcucauggaacaguaugaaugcagaauguagcuuucuccacuuguggacugcuuugcauagcugccagaggccuccagag

SEQ ID NO: 4150914 - RNA, 59 nt, Human
cuuuguuagcagccaauuuguucuacuugauccagagcauuuaggcaacgcuaccaaag

SEQ ID NO: 4150915 - RNA, 66 nt, Human
cuuuguucucugcuucuguuuguauugagucagcuugcuuaggaauauagaucagugagacuaaag

SEQ ID NO: 4150916 - RNA, 81 nt, Human
cuuuguuggcuaccuuuaguugguuggaugcuggaccuguugaugaccagacagcagugacaagacuaagaaggcccaagg

SEQ ID NO: 4150917 - RNA, 55 nt, Human
cuuuguuucuuggcugggaucuuaagcugguaggauggacagccuggaaggaaag

SEQ ID NO: 4150918 - RNA, 85 nt, Human
cuuuuaaagaguggagaauaaaauaggagaugaaaauguauauuauuguuaauguuauuuuauuuuauuuacuacuuuguagaag

SEQ ID NO: 4150919 - RNA, 58 nt, Human
cuuuuaaaguauauguagggcccaaauauugcaugggcauacauacuuauucuaaaag

SEQ ID NO: 4150920 - RNA, 125 nt, Human
cuuuuaagaauauauuuagcaguguuaaacuugcugaaguugcucagcuccauccaauaaaaggauugaccaagagcaaauuagcauuucauuaacuauuuuaaauauaauacuaacuuauugag

SEQ ID NO: 4150921 - RNA, 76 nt, Human
cuucaugccugaaaggaggccacauggcuaggacagagcugugucuaaagccgaaggccuccaugaucagaugagg

SEQ ID NO: 4150922 - RNA, 73 nt, Human
cuucaugcuaaauaguuuaggaggcuaagugguuugagaauaaggcaaagugauuucuuaaaaaggcaugaag

SEQ ID NO: 4150923 - RNA, 99 nt, Human
cuucaugcucuggcagacagcgguccugggcaugaugcugcgaggcugggagccccagcauccguucucaggacugaacaucaaacggcggcgguggag

SEQ ID NO: 4150924 - RNA, 81 nt, Human
cuucaugcuuauuaccgggaucaucaagaauuuauugcaucauuaguuuuuaaaauauuggucucacuugguaagaugaag

SEQ ID NO: 4150925 - RNA, 62 nt, Human
cuucauggcccaucagacccagggcuggcaggaggcuagacagucuugaaggggucauggag

SEQ ID NO: 4150926 - RNA, 115 nt, Human
cuucaugucuauagaaaauuuucuucagaggagcugaauauauuuauauuaauuucucuuuaugggcaaauguauauuuugcuauuuuuggcagggauuuacuuuuugacggggg

SEQ ID NO: 4150927 - RNA, 55 nt, Human
cuucauuguucaauacacucaucauccauccaggacugaguggagugcaaugaag

SEQ ID NO: 4150928 - RNA, 61 nt, Human
cuucauuuuauuuccuucuguaucccccuccaccuggggaaaggaggggauagaaucaaag

SEQ ID NO: 4150929 - RNA, 61 nt, Human
cuucauuuuuaccgcgugucaaagagauaggucuguuuggauuuggggauggaguaugaag

SEQ ID NO: 4150930 - RNA, 124 nt, Human
cuuccaaaagucuccuucuggugaugacuucucuugcccuguggggccuccagccaguaagaauagcggcaaaucugggggcuucaugggguugugggcuuagagcugggaacgggacaggaag

SEQ ID NO: 4150931 - RNA, 57 nt, Human
cuuccaaagcacuuuauggaccuuguauuuggacaacaccuccaugaagcuuggaag

SEQ ID NO: 4150932 - RNA, 126 nt, Human
cuuccaaauuuuagacaugugugugugcuucuaauuauucccuugucccaaguccuucaaauguaaggaauaggccugguauagauaagugaguaauuaugaagcaauaugaugaaauuaugggag

SEQ ID NO: 4150933 - RNA, 62 nt, Human
cuuccaagaugaacagcaagcggauuuguagggguuucugcugugguucuguaauuggcaag

SEQ ID NO: 4150934 - RNA, 71 nt, Human
cuuccaaguugcucugcugaccugagcucauuacuuuuauauaaugauugcagcagaagcaucuauggaag

SEQ ID NO: 4150935 - RNA, 58 nt, Human
cuuccaauugagauugaggauggacaaacccuuccugaaccaaauucagugcuggaag

SEQ ID NO: 4150936 - RNA, 88 nt, Human
cuuccacuccucugagguuuaauuaggagaaucugucuuucugguacuuccgagagccuugcucuaaauuucucagaggaaagcgaag

SEQ ID NO: 4150937 - RNA, 61 nt, Human
cuuccacuuuccuuuccagauuacagcaaaaugucaagaagugguaaaggagggcuggagg

SEQ ID NO: 4150938 - RNA, 73 nt, Human
cuuccagaaacaggauugcuggcagggacaggcuuugcacaaggucugucucucaagggccguccuguggagg

SEQ ID NO: 4150939 - RNA, 58 nt, Human
cuuccagagccagucucugcgggacagagcccgccgcuucgaagaggccuugaggaag

SEQ ID NO: 4150940 - RNA, 56 nt, Human
cuuccagcugauuacaggcuauggcaggcuccauaaccuccccaauuagccggagg

SEQ ID NO: 4150941 - RNA, 83 nt, Human
cuuccaggucucacucuucucuuucuucgcuuguuggaugauagaucucaagaaucuagggaggauucugagacuuaagggag

SEQ ID NO: 4150942 - RNA, 96 nt, Human
cuuccagugugccuguggauccuuaugggaauaggauauuagguguucauagacccaugugaggaaggcuugcauuucuagcaggcuagcugguag

SEQ ID NO: 4150943 - RNA, 60 nt, Human
cuuccauacgcacaaagauagggguaggggaauauucccugugacacuguuugugguaag

SEQ ID NO: 4150944 - RNA, 99 nt, Human
cuuccauagucauuccacaaagauguguuuccaagucucucaacacccagaaaacgucaagggguuggaugccuuggaaauugugagauuguuaggagg

SEQ ID NO: 4150945 - RNA, 71 nt, Human
cuuccaugagucaauguauuuaacagcauuuuguaaauuacauagaauuacauaaauacaugaauuggagg

SEQ ID NO: 4150946 - RNA, 74 nt, Human
cuuccauguaucugcugcacagauugccuuuuacucccaauauacuggggugcuguugccuggcugcacggaag

SEQ ID NO: 4150947 - RNA, 115 nt, Human
cuuccauuuagaacuauuagguuggugcaaaaguaauugcaguuuugccacuuuuguuggcaauauccacaauuacuuuugcaccaaccuaauacuauuuuguucaauauagaag

SEQ ID NO: 4150948 - RNA, 130 nt, Human
cuuccauuuguccucauuucuuacuguggcuccauucacaugcccaagcagcaccagggcaacacauaguagcaggagaggugcucuggucaugguggagugaagcugagugaaagaggggaugcgggag

SEQ ID NO: 4150949 - RNA, 59 nt, Human
cuucccaaucucuucuccugcagggauaauaucacaugauuucugaggagaacagaaag

SEQ ID NO: 4150950 - RNA, 97 nt, Human
cuucccacuggagcugcugagcugauaggcugugagccuggggcugcuggggcucuagaggacagccugcucgagagugaagcuagcacaggggaag

SEQ ID NO: 4150951 - RNA, 69 nt, Human
cuucccaugucuagcuucagggucaaggugcucauucacccagcuacugaugauguugguugugggagg

SEQ ID NO: 4150952 - RNA, 85 nt, Human
cuucccccaaggccacuccagagacuggucucucauaucucaaacccgagaggggcucuuuacugugaggguggucugagggagg

SEQ ID NO: 4150953 - RNA, 115 nt, Human
cuuccccuaacucccaagaggacaugcuuauggccugcacugacuagggcagauuuucaaaccaguccuagcucuagcaaggcuggccugggguucugugggguugguggggaag

SEQ ID NO: 4150954 - RNA, 72 nt, Human
cuuccccuucccagcuucugccagaucugccuucagauuccucagucaugaagccucccugagaggggugag

SEQ ID NO: 4150955 - RNA, 86 nt, Human
cuucccuccuccccuccagagccuggacauucuggaaaagugucuuccuuuaagaauggucauucuggcaggacaggaaaggggag

SEQ ID NO: 4150956 - RNA, 66 nt, Human
cuucccugagcccaggcgggagcugagcucuucugagcggccgcccgaggaccuggguucuggaag

SEQ ID NO: 4150957 - RNA, 73 nt, Human
cuucccugguguucugucuguuugggaaacaguugagaauucccaucuuccagcuuucagggcuuuagggaag

SEQ ID NO: 4150958 - RNA, 81 nt, Human
cuucccuguguuaagccaaaccuuguggucccaggucaugauccaccaaagaccacaacuguuggaggaacacagggccag

SEQ ID NO: 4150959 - RNA, 63 nt, Human
cuuccgucgcguccaggguuuuauccguacucaucuugagccggcaucuggaugucauggaag

SEQ ID NO: 4150960 - RNA, 64 nt, Human
cuuccuaccaggacaugcauuaauaauggcuccuugugacucguaaagugcaugcuaggggaag

SEQ ID NO: 4150961 - RNA, 62 nt, Human
cuuccuaccauauuuagugcuuucuccaauuuucggagaaucuucaacagaaugguaggaag

SEQ ID NO: 4150962 - RNA, 67 nt, Human
cuuccucuguguccugggcuuguuucauucugacccucugugcuagaagcccaggacacagaggaag

SEQ ID NO: 4150963 - RNA, 61 nt, Human
cuuccugaacaaugccaucaauuauccccaaguguggauuaaaggauauaguucuagggag

SEQ ID NO: 4150964 - RNA, 59 nt, Human
cuuccugagcaaggaacuauagguauccuuaauggaguccauuaaucuuugucagggag

SEQ ID NO: 4150965 - RNA, 70 nt, Human
cuuccugagcuuccaguuccuccaggaugccuccagugcaaggcccuggcaagagacugaagauaggaag

SEQ ID NO: 4150966 - RNA, 57 nt, Human
cuuccuggcucggugccucacccuggaggguggcagugugggcugugagaugggaag

SEQ ID NO: 4150967 - RNA, 64 nt, Human
cuuccuggcugaaccaaugaagugggcuccugcucacugcaugggagaucagcuuucagguaag

SEQ ID NO: 4150968 - RNA, 66 nt, Human
cuuccugggcagcagcaggaggucucugcucuaaacugcagaccccagggcugcaugcugggggag

SEQ ID NO: 4150969 - RNA, 57 nt, Human
cuuccuggucuccagugguucuuacuggguagugcuggacaacagaguaccaggaag

SEQ ID NO: 4150970 - RNA, 67 nt, Human
cuuccuuaacuugucuagagguuagacaaaguuagcugcugucccaacccugagaagauucuggaag

SEQ ID NO: 4150971 - RNA, 108 nt, Human
cuuccuuagaggacuuaucacugggccauccugggaagcauguuguccuauggaagauugugaccgugggcagacagugcuuugcagcugaggcagucccugaugagg

SEQ ID NO: 4150972 - RNA, 64 nt, Human
cuuccuucucacuagcagcgcccucccugccugcacaggaggugcugugagguugagaaggaag

SEQ ID NO: 4150973 - RNA, 63 nt, Human
cuuccuuggaauaccauguugacagaggugcaaagugacuguaccugcugggugcugagggag

SEQ ID NO: 4150974 - RNA, 85 nt, Human
cuuccuuguugcugaugaaugucauacauaaugaaagauuauauccauuuauccucagcaguaaaucauuuaucacacaaggggg

SEQ ID NO: 4150975 - RNA, 80 nt, Human
cuuccuuucuuuaaccugaagugaucugcugaauuuuaauccuuuauccacacuucauagcaagguuggagaauuggaag

SEQ ID NO: 4150976 - RNA, 84 nt, Human
cuuccuuugacuuguuguagacgcgaagugacugaauugaaauugaauuaaguagagucauguguauagaagcucagauggaag

SEQ ID NO: 4150977 - RNA, 73 nt, Human
cuucgacucugugccugaagagcagcccagaagcaaaacaagagagcgaagcucaucaggcuuagagucaagg

SEQ ID NO: 4150978 - RNA, 62 nt, Human
cuucgauagcccaaggggcuggggguggcgagggggcccccauggcuucgaggcuggggaag

SEQ ID NO: 4150979 - RNA, 81 nt, Human
cuucggccucauuuuuacuuaaggaugcuugaaauaacuuucucaacaucauucugcuaguaacagaugaaggaaacgaag

SEQ ID NO: 4150980 - RNA, 63 nt, Human
cuucgucuagacaguuuccaaaagagccucuuuuuagagcccucuuuugugugcuagaugggg

SEQ ID NO: 4150981 - RNA, 104 nt, Human
cuucuacuccucaugaccaaagcuggcuuucaugguuuacucauguacuuacugaugaaacccugagacuuggggccagugacuguucagagguccaugugaag

SEQ ID NO: 4150982 - RNA, 71 nt, Human
cuucuauaaacugugaucuuucuuccaauuuuaacuugaaugucaggcaauaggaucacaguuccaagaag

SEQ ID NO: 4150983 - RNA, 68 nt, Human
cuucuaugaggagagacaugcacaggaacaaaagaauaacucuucagcauuuuucucuccuauaggag

SEQ ID NO: 4150984 - RNA, 68 nt, Human
cuucucaaaacucugcccuucucaaccccugcgcuagaguaggcagggcagaaggugcugaggagagg

SEQ ID NO: 4150985 - RNA, 69 nt, Human
cuucucaccuuaauguggucuuguguuauauugagagagggauuuuaaagaucaccuugacaugaaaag

SEQ ID NO: 4150986 - RNA, 91 nt, Human
cuucucagccuugcucugggcacuggaagccugcuguguaugucuuaucgaggugguguuucuugcccugagaugaauuaaggaagagaag

SEQ ID NO: 4150987 - RNA, 100 nt, Human
cuucucagggacuuucuuuauuaauucagugguuucugcaacaagaccccgagugcuagugcugaccauugauuuauaaagguagggagagauggaggag

SEQ ID NO: 4150988 - RNA, 73 nt, Human
gaaggcaggagaguuuggggaagggucagagcuuggaaaggcugcuggaacuuagcaugcucuccuagucuuu

SEQ ID NO: 4150989 - RNA, 64 nt, Human
gaaggcaggcaggugggaaucagggcaugaauugagaaaacuagagauuuaccuuugagccuuc

SEQ ID NO: 4150990 - RNA, 59 nt, Human
gaaggccacaaaaaaugucauaguaggugauaaugucuuugauaucauuuuuuggccuc

SEQ ID NO: 4150991 - RNA, 71 nt, Human
gaaggccucucagggauugcaaaauucauccucuaaaccaggaucaacccucucacacccuggacaccuuu

SEQ ID NO: 4150992 - RNA, 80 nt, Human
gaaggccugcuuccuagaaagaugucuuuucacuguagccucacaugacagaaauggggcgauaucucucuggggccuuu

SEQ ID NO: 4150993 - RNA, 58 nt, Human
gaaggccuguuggcgugggcucuagagcgcuggcuccgacaccaacaggcaugacuuc

SEQ ID NO: 4150994 - RNA, 98 nt, Human
gaaggcuaaggagcuaauccauugcacaucugagaagagauuggaccuugcaacucuuucucauuugcuguagagucuaguuuccuugauaugcccuc

SEQ ID NO: 4150995 - RNA, 112 nt, Human
gaagaaaugagagcucacaucuggccccauuuucugcauggagaaacugaguccugugggggcugcucaggcucaugcgaacuugaggguaagugagagcuuagcuuucuuc

SEQ ID NO: 4150996 - RNA, 66 nt, Human
gaagaacauugacagccuuuguugcuuugggaaucgaaguacaguagggugcuguuaguggacguc

SEQ ID NO: 4150997 - RNA, 61 nt, Human
gaagaacugacaaacuagaucacucugggguggcccuguaugugucugucugucucucuuc

SEQ ID NO: 4150998 - RNA, 84 nt, Human
gaagaacuggguccuugagucuagaguaagaguaauuaugaaaaaagaaucuguucugauuuacagagggcccagucacacagc

SEQ ID NO: 4150999 - RNA, 76 nt, Human
gaagaagaagaauggguuuggugagaggguuccaauauuaacaacccaacuucaagcucauuccucuaaccucuuc

SEQ ID NO: 4151000 - RNA, 70 nt, Human
gaagaagaaggguaaggaguguugacugugugugauccugucagugggccguccucucauucuuauuuuc

SEQ ID NO: 4151001 - RNA, 55 nt, Human
gaagaagagaacuggcauccuaaucuggugaucuggugauccguucuccuuuuuu

SEQ ID NO: 4151002 - RNA, 78 nt, Human
gaagaagguagaggacauugcuaaauaaugaaugaauggaugaaugaauaucuuuaacuugcaguauuuaccuucuuu

SEQ ID NO: 4151003 - RNA, 101 nt, Human
gaagaagguggcgccauaacaggggauugauuggaagucucuugaguucaauugcaagauccuacaguccauucuuuguggccaggcaaucaucuuucuuc

SEQ ID NO: 4151004 - RNA, 95 nt, Human
gaagaauaauucaugaacaugcuguugauggccugaguguuuucacuggugcuacagugcugucaucagugugugcauuguccugagaguuccuc

SEQ ID NO: 4151005 - RNA, 55 nt, Human
gaagaauccaugcuaauuuaccuguuuuauuaugggguagauuaugggguccuuc

SEQ ID NO: 4151006 - RNA, 87 nt, Human
gaagacagaugaauucucauauauuucugcauucaaucuguuauaauauguugucuugguugaaauauaugaagaaaaucuggcuuc

SEQ ID NO: 4151007 - RNA, 70 nt, Human
gaagaccagagggcuguguaaggauguuguggggauuucagagauggaucagauacagccuuuguacuuc

SEQ ID NO: 4151008 - RNA, 79 nt, Human
gaagaccauuaggguaauugaacacuuaucuugguacucacauuuucaaaggauagguauuaaaccccaaugaaucuuc

SEQ ID NO: 4151009 - RNA, 92 nt, Human
gaagaccucauacgauuuucaucgcuagguuggccuuuuaaauuaggaaguagguauaacuuuaugcauggaaaaccauuguuuguuucuuc

SEQ ID NO: 4151010 - RNA, 79 nt, Human
gaagacuucugaauauugagauaagaacugacaugggucacucaaggaaauggcaguguuucaguuuuuggagaacuuu

SEQ ID NO: 4151011 - RNA, 111 nt, Human
gaagagaauuaaagugucugacuugcaucuuaaaggagucugaaaagcagauauauacauaagcuuuuaaguugacaaguuuuauuucaagacucuuguuaaauucucuuu

SEQ ID NO: 4151012 - RNA, 61 nt, Human
gaagagagagugggguucugcggggcagagagagauacuguggaacaaacuuaaacuuuuc

SEQ ID NO: 4151013 - RNA, 57 nt, Human
gaagagaggcaggaauccugggugagggcaggggcucccuggguccugcuugcucuc

SEQ ID NO: 4151014 - RNA, 79 nt, Human
gaagagauaacagguugcuuuggugaaaugucuauuuguuaacacuuagguuuucauuaaagucaaaucuggucuaguc

SEQ ID NO: 4151015 - RNA, 100 nt, Human
gaagagcuagauuuacuucagguuuauugacuauuuaguagaaggucucugcucaggaaaacagucuaguaauugcuuagcaauaaucugguaugucuuc

SEQ ID NO: 4151016 - RNA, 76 nt, Human
gaagagcugucagaaaagcuaaugcaucucuugaucuaaaagagcuaguuuagaauggguuuucugaaagguuuuc

SEQ ID NO: 4151017 - RNA, 65 nt, Human
gaagagcuuaguuguccuagaagccaaacguaguauuugagguucaugugggcaucugauucuuc

SEQ ID NO: 4151018 - RNA, 105 nt, Human
gaagaggauauacaaugucauuagaaugugcugggacaguaaugguuguuuuauuauuauugcugcuaacauuuuauggcauagcauucaagaccuguccuguuc

SEQ ID NO: 4151019 - RNA, 73 nt, Human
gaagagggauuaguaguuaagacauaggcauguuaaaauguuauuccuuuugauucuagaaucuucccucuuu

SEQ ID NO: 4151020 - RNA, 81 nt, Human
gaagagucaacugccuuugcacuccacaugacucugagacacauggggauguggcccagcggucaggcugucugauguuuc

SEQ ID NO: 4151021 - RNA, 87 nt, Human
gaagagucccaaccaaaagucggcugcucucugguaaagauggauggucuuuuccucugcagagcaguuagaauguguuagcucuuu

SEQ ID NO: 4151022 - RNA, 84 nt, Human
gaagaguggcagguaagaccagaacagugguuuguauuucauaagauugggaugcucacauuucugauuauaccaaagcuuuuc

SEQ ID NO: 4151023 - RNA, 68 nt, Human
gaagaguuuaaaaugaaauucuaucuucagcucacaccagugaguugaagcauuucuuugagcuucuc

SEQ ID NO: 4151024 - RNA, 78 nt, Human
gaagauaaauguucaguagaauaggaauggaaucuaaugcuuuuucaugcugugguaaaucacugaaaaugugucuuc

SEQ ID NO: 4151025 - RNA, 69 nt, Human
gaagauaaugguaguagaaucucugcuaacagaaaauagagcggagcuuuucagcuaccagguaucuuc

SEQ ID NO: 4151026 - RNA, 71 nt, Human
gaagauaugaagaaacaacuuaguauuggccaugcauuugggugaaaguauagguauuucuaucaugucuc

SEQ ID NO: 4151027 - RNA, 56 nt, Human
gaagauauucucuaaauacuuucgaggcuggcauuuaaaagaaagagaaugucuuc

SEQ ID NO: 4151028 - RNA, 58 nt, Human
gaagaucacaccaaggaauuccacagguucugcugcaggaaggcuaugguguauuuuu

SEQ ID NO: 4151029 - RNA, 114 nt, Human
gaagaucuacccuuugaucuggagcuuuauuuguaauaauaguuggcgcagaaggaaucauuugcacauuuaauccuuuauaaguagcuuucuuugaucauuuuguagaauuuc

SEQ ID NO: 4151030 - RNA, 107 nt, Human
gaagaugccuccgcugaauuuuuuacuuucuugagucaugugcaaauacugaauguuaauuacaugcaauuaagagggugaauacaugauucucugguuguagauuc

SEQ ID NO: 4151031 - RNA, 64 nt, Human
gaagaugguaccuguaauauuaguccugacugugauuggucaauacaguguuaguuaucaucuc

SEQ ID NO: 4151032 - RNA, 67 nt, Human
gaagauggugagcaauucaguuccaggaaacaacccucuuccugaguucuaggcugccaccuucuuc

SEQ ID NO: 4151033 - RNA, 61 nt, Human
gaagauguuauggagagcucagacuucucauggaagccuucuugcuaucucuaagaucuuu

SEQ ID NO: 4151034 - RNA, 67 nt, Human
gaagauuaaugcaggaguuggaaaaaaugauuaaucaaaugucauucuaguuuuccuguagauucuc

SEQ ID NO: 4151035 - RNA, 69 nt, Human
gaagauuauccagaaugucuugcuggagaauuuguacaauuuucugcagugaugugcuggcaaauuuuc

SEQ ID NO: 4151036 - RNA, 67 nt, Human
gaagauucuaggcccuaccccacaccuaccaaaucagaguaucugaagguggggcuuaggaaucuuu

SEQ ID NO: 4151037 - RNA, 80 nt, Human
gaagauugcgucugagagcaggaggagcugcuggaacucuucuucccagccuuguuuuaaugcucuugagcaucaccuuc

SEQ ID NO: 4151038 - RNA, 64 nt, Human
gaagauuugugcuuuugaaucaguagacaauucagaaauugucuacuaagaaagacaauucauc

SEQ ID NO: 4151039 - RNA, 68 nt, Human
gaagcaaagagcuagugccgcuucagauacucauucccacagaagaggaugguuuuaguucuuuuuuc

SEQ ID NO: 4151040 - RNA, 72 nt, Human
gaagcaaauaccuuccacagugaccuugaagcagcuuucccccugcagcaaugguuaggaaaguaucguuuc

SEQ ID NO: 4151041 - RNA, 102 nt, Human
gaagcaagaaugcagauggauuacuucacauuugcaaugaaaaagaguagcaaagaaggcuguugcaaauguguggugaggcauuucaaacucacaggcuuc

SEQ ID NO: 4151042 - RNA, 62 nt, Human
gaagcaagcaggagaggacaagccuggaagcacagguguuucuucaugucucugcuugaguc

SEQ ID NO: 4151043 - RNA, 59 nt, Human
gaagcaauagaauuuaaaugcaguggcuuuguaaauugccacuacaguucuauaacuuu

SEQ ID NO: 4151044 - RNA, 83 nt, Human
gaagcaaugcugacauuugaacucagcuucagacaacaaauucagguuuguuuguuuguuuugcugaauacuucaauugcuuc

SEQ ID NO: 4151045 - RNA, 82 nt, Human
gaagcaccagcugcacugguuuguugaaauucaguaauggguuaaaccgugaugagacaacagcuugugcugcuuugccuuc

SEQ ID NO: 4151046 - RNA, 95 nt, Human
gaauaaugugagcagcagaucauguacuugacaaauaugugacuuugguuuaaaagcagaauguucauguaugugagcugcuauuaacuguauuu

SEQ ID NO: 4151047 - RNA, 111 nt, Human
gaauaauuugcucaaggucauacaacuaccaacaggaugggcgcacagagcuaggauuggaacccaggcaguuuggcuccgcagucuaccugcuugaccagcauuuuauuu

SEQ ID NO: 4151048 - RNA, 122 nt, Human
gaauaauuuguaggauuguuaucaggaucauguuaacuaagauuaacuauauuaaagugcuuugaauaguggcuggcucauagugagcauguaaguggugacgguuaaagacaauauuguuu

SEQ ID NO: 4151049 - RNA, 76 nt, Human
gaauacaaaacacacacacagauauuuugaauacauauguguauauaugugugugugucuguguguguguguguuu

SEQ ID NO: 4151050 - RNA, 100 nt, Human
gaauacaacuggccuuuggugauagugcagagaaauggggaaagggagggguauuuuugugcaguguuaucaaaauaaguuacacagaauaaaaguauuu

SEQ ID NO: 4151051 - RNA, 60 nt, Human
gaauacauaucagauguguuucuaggaaaccuggacagauuuuacaucuauauaguguuu

SEQ ID NO: 4151052 - RNA, 65 nt, Human
gaauaccaugaauucuugccuccacagucaagaugaacagaaaagguaggaguugauggauguuc

SEQ ID NO: 4151053 - RNA, 76 nt, Human
gaauacgggauuuugagauuaagcaaaauuuucaagaucagaaaguuuguaagugguagaucuaagauucugauuc

SEQ ID NO: 4151054 - RNA, 89 nt, Human
gaauacugccgugaugaaaguguuuacucaccuccaguggaguuuggccuaauuagaugguaaucacauuuaucugguacacaguguuc

SEQ ID NO: 4151055 - RNA, 72 nt, Human
gaauagaugggcgugacucugggacaaguaugaagacacugcucccuucuuccaagcuuaugcucaauguuc

SEQ ID NO: 4151056 - RNA, 81 nt, Human
gaauagcuaauaauacaugagauuaauguuuccagggccuaacaccuuguggauauuggauucucaucuaauuugucauuc

SEQ ID NO: 4151057 - RNA, 79 nt, Human
gaauaggaaguuuauugaguucaaguacuugaccuuuugugguccgucauuaaauuacuugaaaaugugcuuuuuauuu

SEQ ID NO: 4151058 - RNA, 58 nt, Human
gaauagugcuuuuguacauaggauuuuuaauaagaauuccuaugacugaguaauguuu

SEQ ID NO: 4151059 - RNA, 67 nt, Human
gaauagugggagaagguacugguuuagaguugggaaaccuggccaaggcauuggcuucucucauuuc

SEQ ID NO: 4151060 - RNA, 64 nt, Human
gaauauaauauguauguuuauauguugguauuuuucuaacgaauauguaugcauguugguauuu

SEQ ID NO: 4151061 - RNA, 66 nt, Human
gaauauaugccaaaauguuacauuucuuucggaaaaugggaagaggaagcauuauggcauacuguc

SEQ ID NO: 4151062 - RNA, 71 nt, Human
gaauaugacucagaaguugcaugcuuuggcucacauuccauuggucagaauuuagcuccuuggucauauuc

SEQ ID NO: 4151063 - RNA, 98 nt, Human
gaauaugccccugucaguauuuaacauuucuucugaaacugagucuagauacucaaucugcuccaguuuuuugaacaagaugaguagcaagguuauuc

SEQ ID NO: 4151064 - RNA, 130 nt, Human
gaauauggucaauaaaugguagcugccauuuuuguagucauuagaagaggcgagccuugaacgacuagccucuguugaaaauuacaaacaagagaguggccuacauuugcaaacagugagcauagccacc

SEQ ID NO: 4151065 - RNA, 68 nt, Human
gaauauguguuccuggacaagaggguccuaggaaggaccaggguaucuugugcaggcagcauauauuu

SEQ ID NO: 4151066 - RNA, 81 nt, Human
gaauauguuugucuuggacugcaucaacacaguugguuuucuccgagauugaguucauauaguucaagauacaccuuguuc

SEQ ID NO: 4151067 - RNA, 77 nt, Human
cuuauuuuauauugugcauuuauuuguuuaucuguuagccugccugcugcaguaagauguaagugcuauaaagucag

SEQ ID NO: 4151068 - RNA, 65 nt, Human
cuuauuuuucucuccagagcuuauaacauugggaaccaguuccaaagagcuggaucaaggauaag

SEQ ID NO: 4151069 - RNA, 88 nt, Human
cuuauuuuucucucuguaguccucaugccugcuacaguagcugccccacagcagacaccuuguagguguguacagaauggagaacgag

SEQ ID NO: 4151070 - RNA, 108 nt, Human
cuuauuuuucuuaaucagugucauugaagugacugaaagauugaaagcagagucugauaguauuucaguuacuuuaaaauuugaaccaaauuugaaaaagaaaauaag

SEQ ID NO: 4151071 - RNA, 66 nt, Human
cuuauuuuugguaaccuugcauucuuuacugugaaaucugugauaaugaggguuugccagguuaag

SEQ ID NO: 4151072 - RNA, 81 nt, Human
cuucaaagagcaacuguaagacaaaugacuucuaaacagaaaaaguagaagucagaaaguaauggaguggcaucuucaaag

SEQ ID NO: 4151073 - RNA, 112 nt, Human
cuucaaagauuguugugaggauuuaacauuugugaagcauuuagcauaguuccugcugcguaugugcuuaauacaugguguuuuguucuuauuauuuuaagaauagauggag

SEQ ID NO: 4151074 - RNA, 83 nt, Human
cuucaaauaagguacaguuuuaagaauaagcacaccaauaaacguuuguucuuaguauugagacugccgaccuggaugugaag

SEQ ID NO: 4151075 - RNA, 68 nt, Human
cuucaaaugcccugcaucaagugacacuccauggaaccaagggaguaucacacugcagucauuugcag

SEQ ID NO: 4151076 - RNA, 67 nt, Human
cuucaacugauuuagucugugccaucguauuuccugaugccccugggauaggcaaauauaguagaag

SEQ ID NO: 4151077 - RNA, 69 nt, Human
cuucaagccagugauguuugcugccuugguacauuguccguggcuccacaauuacacacuggaggguag

SEQ ID NO: 4151078 - RNA, 85 nt, Human
cuucaagucaacagugaugucuguggcucggaugaagauggacaggccaugcucagagaauucucagaugacucaagacuugaag

SEQ ID NO: 4151079 - RNA, 80 nt, Human
cuucaagugauggaggaaggcuaauaaugcaagaaaugauauuuucaacguacuuauuaucuucucccaaguacuaagag

SEQ ID NO: 4151080 - RNA, 56 nt, Human
cuucacaaacaccagaauggcuauuaucaaaaagaugauaacaaguguuggugagg

SEQ ID NO: 4151081 - RNA, 110 nt, Human
cuucacaaucauggugcuggguuuggaaggauacacugaugauaaugguguccagguuuucagcuguauccugagaacagccuggauggcaccgacacugaaugcugagg

SEQ ID NO: 4151082 - RNA, 68 nt, Human
cuucacagucacagccauuccucuagugggccccauccuggguccaucuggaugguauguguaagagg

SEQ ID NO: 4151083 - RNA, 59 nt, Human
cuucacauguuggaguccuuugcuuccagacuagaggacugggacuggaggauguggag

SEQ ID NO: 4151084 - RNA, 68 nt, Human
cuucacauucacuagaauggcuguaauuaaaaagagaaauaauagcaaguguuggugaagaugugcag

SEQ ID NO: 4151085 - RNA, 59 nt, Human
cuucacauugggcuugauaugaccuuuugcugcugcugaugucagucaguccugugaag

SEQ ID NO: 4151086 - RNA, 69 nt, Human
cuucaccaggaggcgucuucaguuuguucuuuaguuagcagcaauacuugagugccuuucuuacugaag

SEQ ID NO: 4151087 - RNA, 60 nt, Human
cuucacuacggucacgacccugggcuucagagggcuguucucaggaugugcugagugaag

SEQ ID NO: 4151088 - RNA, 84 nt, Human
cuucacucacccagucuuccacugucccgccuccacgcuggggacaggcaggcuugggacgagcuggaggaaggggaggggagg

SEQ ID NO: 4151089 - RNA, 61 nt, Human
cuucacuucacagaugccaagauuccuaaguaaagggaaagcuguggcaucuugaaggagg

SEQ ID NO: 4151090 - RNA, 78 nt, Human
cuucacuugcugagccucucuuauuugccgggcccucuucuuggagcugaagguguguggagagaggugggaaggagg

SEQ ID NO: 4151091 - RNA, 82 nt, Human
cuucagagaugagacuugcagauacuguaaaauuucaguauggucaugcuguugagaaacauaucucaggcucacuguggag

SEQ ID NO: 4151092 - RNA, 70 nt, Human
cuucagauccaucgucucugauccauugguaaugguucucuagggaucuguguugcgauggauucugagg

SEQ ID NO: 4151093 - RNA, 61 nt, Human
cuucagcagaugugcuagagauaggggcagugaucccaaauagcauguucucugcaugagg

SEQ ID NO: 4151094 - RNA, 58 nt, Human
cuucagccauuguggcuuuuguguuguauaaguguugcagaugcagagauggcugggg

SEQ ID NO: 4151095 - RNA, 60 nt, Human
cuucagcccugagugccagcagugggccaaagagucucucuugccagcauuaggcugaag

SEQ ID NO: 4151096 - RNA, 70 nt, Human
cuucagcuguggaaaggcuguaaggcuguucaggaagaagagcuagacuuucccuuuccaugucauggag

SEQ ID NO: 4151097 - RNA, 62 nt, Human
cuucaggaguaguuaccuagcauuguaugagaaagaucacucuucagagguaacuauugaag

SEQ ID NO: 4151098 - RNA, 64 nt, Human
cuucaggaugccuuugaacucuggaucucuccaccuggucugauucuguccagaggccugggag

SEQ ID NO: 4151099 - RNA, 129 nt, Human
cuucagggucaccuggggugccaguucagaauucagaguccuggccccacgccugaaaauacugacucacuaggccugggguggggccuggaaaucucuaucuuuaacacgccacugcugacucugacg

SEQ ID NO: 4151100 - RNA, 63 nt, Human
cuucaggguguguucagcaagagguaaggggucuaguucugcuggaaaugagcgcacaugaag

SEQ ID NO: 4151101 - RNA, 64 nt, Human
cuucaggugagcaggagauaaacagguaggauucaaggcuuaccagucugauuccuguuagaag

SEQ ID NO: 4151102 - RNA, 80 nt, Human
cuucagguugcgcccuuuaccacaaggacagaacuuaggucaaguuaccucucugugagagagaaaaggcaaacuuggag

SEQ ID NO: 4151103 - RNA, 59 nt, Human
cuucaguauacuucauaacauuuguuggaaagcaggaaaugaaaacgaaguauuugaag

SEQ ID NO: 4151104 - RNA, 56 nt, Human
cuucagugugccuaagucaguugugcuauguugcauaauuccagaggucacugaag

SEQ ID NO: 4151105 - RNA, 76 nt, Human
cuucaguuaugggcaacugaaaaauuguauucauaugaauugugcaauauaaccaguugucaugcaauaauuaaag

SEQ ID NO: 4151106 - RNA, 72 nt, Human
cuucaguuucuucuuauuuaaaaugugaauacuaauguguaucucauaugauuguaaugagaauaaauggag

SEQ ID NO: 4151107 - RNA, 75 nt, Human
cuucauaaucaaggcuacccuuucaccaaaaauuguauuauaaauuuugaagagccagggugguagaauguaaag

SEQ ID NO: 4151108 - RNA, 66 nt, Human
cuucauaguccucagaguuauuugaagugaacauuaguucagcuccuuauuucugagcaugugaag

SEQ ID NO: 4151109 - RNA, 114 nt, Human
cuucauccuuaaucacucacuugcuacucugucauuuauuuugcugucuguaaagacuugcaagcagacauucagguaggucaacagaguuucaggaaagauuauaggagaaag

SEQ ID NO: 4151110 - RNA, 88 nt, Human
cuucaucuaccagugaguacaugcacugagagggucucggcuccccuggaggccucccuccaccacugcaggucacuuacucaugagg

SEQ ID NO: 4151111 - RNA, 65 nt, Human
cuucaugaagaccucacaguggaaauaggugauuuuggucuagccacagugaaaucuugauggag

SEQ ID NO: 4151112 - RNA, 82 nt, Human
cuucauucaacuacuuugugugugaguuucuucuguaaaauugggacgcuaauuauauucauaucauagaguuauugagaag

SEQ ID NO: 4151113 - RNA, 68 nt, Human
cuucauuuggcaggcuggccucagcagcccggggucgucucucuguauccagcucugcaaugauggag

SEQ ID NO: 4151114 - RNA, 125 nt, Human
cuucauuuguacugcauuucuucaauuugauuugauuguaauggcucuuaaguuaggucaaacuuaaaggggccauuuuacagugaacaaagugagaguaaguccagaaaagccugcaugugagg

SEQ ID NO: 4151115 - RNA, 55 nt, Human
cuuccaaauguaaauaaguuucauccaauuaggugcacuuguugagauuuggaag

SEQ ID NO: 4151116 - RNA, 88 nt, Human
cuuccaacuccaugccuuaaucuugaguaucagaccaagaauucuggauuuuugucguuguuauuagaggcaaaggacaugauggaag

SEQ ID NO: 4151117 - RNA, 70 nt, Human
cuuccaagugucugcuuucagcuaguagguaaauaauggugccacuuacgaaaauaggagacaguggagg

SEQ ID NO: 4151118 - RNA, 74 nt, Human
cuuccacaaucugggucaucaguggcaugguucuucuauacagaaugucugggcccugaagacagucagggaag

SEQ ID NO: 4151119 - RNA, 88 nt, Human
cuuccagaagacagaauguauaugaucuaagguauugagcauaccaccucauguuugcccugucauaagcauuuuggucauucggaag

SEQ ID NO: 4151120 - RNA, 56 nt, Human
cuuccagagcugggcugaccuuuccaaucgacauuggcagguucagggcucugcag

SEQ ID NO: 4151121 - RNA, 74 nt, Human
cuuccagguacacugugagguuuccaagggcaaggauauucuuauuccucuuuggaucucaagguggcaggagg

SEQ ID NO: 4151122 - RNA, 71 nt, Human
cuuccaguaguaucauucucauucggaauacauuaaauuccauucuauaugcagaauaaucuaauugggag

SEQ ID NO: 4151123 - RNA, 61 nt, Human
cuuccaguggcuuccuucauaagcuuuaaaaaccuuuuaaagugaaggaagacacuuauag

SEQ ID NO: 4151124 - RNA, 66 nt, Human
cuuccaucacagaauuuuugcuuccagucacauguggacuuacgaaugauuauucuguuagggaag

SEQ ID NO: 4151125 - RNA, 64 nt, Human
cuuccaucccugccauuauagcccauuguucauaagcucauugggugaugacagggguggcugg

SEQ ID NO: 4151126 - RNA, 66 nt, Human
cuuuauagccagugcacaaauaaauauuaugugcgugugugccugugugugugcgcuugugugagg

SEQ ID NO: 4151127 - RNA, 64 nt, Human
cuuuauccaccuuacccuguuccaccuaagagagaaaaaugguggguggggaggaugggaagag

SEQ ID NO: 4151128 - RNA, 83 nt, Human
cuuuauccuacauauaacacagaagcuuuuucuauucccuggaugaacccacagggacagaaauucuuguuggacaggugaag

SEQ ID NO: 4151129 - RNA, 95 nt, Human
cuuuaugagggucccugucaucaaggauuuagcuguuucauuuacagauuccuguaaauguucaccagauccaugaccaguaauuuucacuggag

SEQ ID NO: 4151130 - RNA, 85 nt, Human
cuuuauguucugagcacugaacuuuaaucauuucugaagguggacagagucuaagaggucuuuaaaucaguccucaaauauaagg

SEQ ID NO: 4151131 - RNA, 57 nt, Human
cuuuauguuggggugucuuaguaauccguaaggaacaugauaggcauugacauaagg

SEQ ID NO: 4151132 - RNA, 71 nt, Human
cuuuauuuacaaaacaggcagugggccagauuuguaccacaggacauaguuugccaacugcuaauauaaag

SEQ ID NO: 4151133 - RNA, 89 nt, Human
cuuuauuuguguguguguuaacuuauuuaaugucagaucucauagaauaucacagauauuaaaugugauaauacauguacagugauuag

SEQ ID NO: 4151134 - RNA, 114 nt, Human
cuuuauuuuucuuaaauggcaguaauuauagcauggcuauauuguugcuccaaguuucucuggcuucuguauuuuauuugguuugcuguaaaugccuccuuaaggaacauaagg

SEQ ID NO: 4151135 - RNA, 112 nt, Human
cuuucaaguaagugcaauaaaugguucuguuggaaugggaaagaagggaggugcauacauacaugcauauaucuuauuuuucuguauagccaguaauuccacucuuuggaag

SEQ ID NO: 4151136 - RNA, 84 nt, Human
cuuucaaguauuuuaaggacuagugguaaagugagucucacaugugaguaaucacuguucacuguuguaaaauacuggccaaag

SEQ ID NO: 4151137 - RNA, 124 nt, Human
cuuucacucuuuccaucuguauguguguguauuuuuauguguguguguguguguguguguguuuguguauuaaguacagcaccaugagcacagggaaauagcaauaugaggguaaggguaagag

SEQ ID NO: 4151138 - RNA, 63 nt, Human
cuuucagaagguacugaagacauggaauuucugagggccaguuuuuccagugcuuucugugag

SEQ ID NO: 4151139 - RNA, 84 nt, Human
cuuucagcagcccuggagccgcauggagcagggaagggaguugucuacccuccggcauccuguguguuccaggcugugugggag

SEQ ID NO: 4151140 - RNA, 56 nt, Human
cuuccugcauggagucugaaugcuucaccagaaacucagagaacccggcaggcaag

SEQ ID NO: 4151141 - RNA, 69 nt, Human
cuuccugcuccccugccaauuccccuggaaagaaagaaagaagggagggagggaaggagggagaggaag

SEQ ID NO: 4151142 - RNA, 63 nt, Human
cuuccuggaaugucugcucaauguuuggggccuagcuccagugacacugcugcauucaggaag

SEQ ID NO: 4151143 - RNA, 90 nt, Human
cuuccuggaauuggagcucuuacaagaaggaaaagggagcacuuuugauaacaaguuucccuuuuucuugugaggcaguuuuccuggaag

SEQ ID NO: 4151144 - RNA, 72 nt, Human
cuuccuggagcuggugucuuucccucugggcaauauaagugccuuuugggaggaggcaucagcuucaggggg

SEQ ID NO: 4151145 - RNA, 64 nt, Human
cuuccuggaugagcaggcugauaaacauggcauucaugacccgcacguccgccauaccuggaag

SEQ ID NO: 4151146 - RNA, 61 nt, Human
cuuccuggcaacuggcugcaggugaggagggggaccugacuccuggcacucaguguggaag

SEQ ID NO: 4151147 - RNA, 55 nt, Human
cuuccuggcaugggucucaugaggacagcccccuguggagaccugggcaggcaag

SEQ ID NO: 4151148 - RNA, 60 nt, Human
cuuccugggcucuacuuggugcuugucaauaccaggcacacagaagaagacccaaggaag

SEQ ID NO: 4151149 - RNA, 76 nt, Human
cuuccuggugccaauuugccccuuugcugaagcacacucuucggugcaucuaaggggcaagcuuggugccguggag

SEQ ID NO: 4151150 - RNA, 85 nt, Human
cuuccuguacuccuggcucaggccccuggugccuuuggguccccacgccaucugcccaugggccugaggcccuaggccuggggag

SEQ ID NO: 4151151 - RNA, 72 nt, Human
cuuccugucauaugugcaaccccuaccuucauccaugucauugacugaaauguauauugccaguguaggaag

SEQ ID NO: 4151152 - RNA, 58 nt, Human
cuuccuuaagauuucccaagucaucuuugcaagguggcugaggcuuuucuuaaagaag

SEQ ID NO: 4151153 - RNA, 58 nt, Human
cuuccuuccuuccccgaaaugcuuuugccaauuacccagccagggugaaggaaagaag

SEQ ID NO: 4151154 - RNA, 61 nt, Human
cuuccuuuagugucauauacuuucucugaaacuuaacuuagaaaguguucuuugggggaag

SEQ ID NO: 4151155 - RNA, 76 nt, Human
cuucgaggaaguggccugaagugaaugcucucgugaaggacacauguggcacagagcaggccacuaaucugauaag

SEQ ID NO: 4151156 - RNA, 116 nt, Human
cuucgauggggaaugugaucuacaugaauuuggguaggagaaagaacagaucaugugugacuuuggggaacuuuucuccucugcucuugugauugugugaaacaugggaaaugaag

SEQ ID NO: 4151157 - RNA, 55 nt, Human
cuucgauugucuauggcccauagggcucugccaaaugggucccugcaguuugaag

SEQ ID NO: 4151158 - RNA, 61 nt, Human
cuucgugcuguaacaacagagugucugcaagugugguagauacgugcuugugcagauggag

SEQ ID NO: 4151159 - RNA, 88 nt, Human
cuucguuaucgugauaccugccagggugugaggcccggugugacaggugucaguuucacagucugugcagauccucacauguacugag

SEQ ID NO: 4151160 - RNA, 61 nt, Human
cuucuaagaacuuuguagccuguucuggaggcauuagaaagcuacuuagguuuuaaggaag

SEQ ID NO: 4151161 - RNA, 62 nt, Human
cuucuaauauaaagucuuugcaaacaaaccugugcuacaguugccagggcuuuaaguugagg

SEQ ID NO: 4151162 - RNA, 79 nt, Human
cuucuaauaugugugugugagaaaagcugguaaaggcaaauuuacucaacagaagcuuuguacaugugcauaucagaag

SEQ ID NO: 4151163 - RNA, 87 nt, Human
cuucuaauuaguuuaucuacugccacuuaagacauuugcaagccuaucugcaaagcucuuuguauaguggaaugaguaacagggaag

SEQ ID NO: 4151164 - RNA, 76 nt, Human
cuucuaccacaaucuuguguguuuuuucauuguuaagggaaggaaaacacaguauugauggaauccgcuuuagaag

SEQ ID NO: 4151165 - RNA, 69 nt, Human
cuucuaguauauuaauucucacgguuuagguuauuugaacuaagcugagagaacagaauaccaaagaag

SEQ ID NO: 4151166 - RNA, 80 nt, Human
cuucuaugagaucaucuuuuuuagauuccacauaugguuagggagauucuggucaaaagaugcacaauucucauuagaag

SEQ ID NO: 4151167 - RNA, 84 nt, Human
cuucuauguacucauacucggaugucaagucagacauguuagugaaacauuugaaaugccaugugaggagugcuacaauagaag

SEQ ID NO: 4151168 - RNA, 71 nt, Human
cuucucaaagcaccuggguuauaucuuagagaaauuacucauauuuaaggaaccacagcauguuagagaag

SEQ ID NO: 4151169 - RNA, 88 nt, Human
cuucucaagcucagaaucagcccuugcuauuaacaucuccuucaaggaucauuagaggcucccaagggccaaugggacuggguggaag

SEQ ID NO: 4151170 - RNA, 69 nt, Human
cuucucacauuagcccaucugguauuuggaguaaaauauacacccccgugaugugcuaauugucugaag

SEQ ID NO: 4151171 - RNA, 85 nt, Human
cuucucagagucccuugcuggcagucacuguugcgggagguugaauuuauccuguuuaauaguaguuguuauauugaaugagaag

SEQ ID NO: 4151172 - RNA, 70 nt, Human
cuucucaggcuaguaaaagaugggaaggagguuccucgccccccauccuguuucacuagcacacgaggag

SEQ ID NO: 4151173 - RNA, 59 nt, Human
cuucucagucuugguuagagagacuaguucuucuaggaggcucugcuggggcugaaaag

SEQ ID NO: 4151174 - RNA, 82 nt, Human
cuucuccaaccauauucaaauuacauuuacuaaugagucuggguuguuacugaguuauagaugccuugaguaaauggagaag

SEQ ID NO: 4151175 - RNA, 128 nt, Human
cuucucguaccugggccagggcacaggcgcuggagagcagccagaaagggcagucgaggcaaagugggcacaucucgaagcuguccuugcugccacacaguuccugccugcaaggcauggagcggagg

SEQ ID NO: 4151176 - RNA, 58 nt, Human
cuucucuaugauguucuaaggucuuuguagaccucaaggaaaaucuagacaguugaag

SEQ ID NO: 4151177 - RNA, 75 nt, Human
cuucucucccagugucauucuaagggaggugcuguguaggacgagagacuucucccaagugaggcuggagggagg

SEQ ID NO: 4151178 - RNA, 62 nt, Human
cuucucucugcauaggcauggguuuucaaacacaacccuggugccaugcgugcaaagggaag

SEQ ID NO: 4151179 - RNA, 55 nt, Human
cuucucugggaaagaagacaucaacccuugaguguuccuugcuuucccagaggag

SEQ ID NO: 4151180 - RNA, 58 nt, Human
cuucucuguguagagauucagagccugaaaagggugagaaggcuucugccuggaggag

SEQ ID NO: 4151181 - RNA, 67 nt, Human
cuucucuguucuuauguuugagaguccuugauauacagguggcauuuacaccaugggacuggauaag

SEQ ID NO: 4151182 - RNA, 62 nt, Human
cuucucuuccucuccucacugagcccucaagcuggaggcucuaugcaugggagcaggagagg

SEQ ID NO: 4151183 - RNA, 74 nt, Human
cuucucuucucugguggaggugcggugagugucaucucacucacacaugcuaagccagagaugagucagggaag

SEQ ID NO: 4151184 - RNA, 75 nt, Human
cuucugagaaaucuuugaguguaaggaauguggggcguuuuauagccacacuaaauaccuuagaguucggagaag

SEQ ID NO: 4151185 - RNA, 57 nt, Human
gaccuacucccaggucaguggagaaugagccugcuucaccaacaccugggauagguc

SEQ ID NO: 4151186 - RNA, 96 nt, Human
gaccuacugugaucucagaagcccuaaauuaucuuuauuuucuauaugugaacagaaaagccagcaggacuuuuagggaauucggaacacacuguc

SEQ ID NO: 4151187 - RNA, 99 nt, Human
gaccuauuuaagaugugcuucugcagagacuauuuauuuacuucuaucaagugccugggauacaacugacaugaaucacuuuaaauuuauuuuuggguc

SEQ ID NO: 4151188 - RNA, 66 nt, Human
gaccucagccaugggguggaucagcccgugggagagaccgagcugaagcccacguggcuuguaguc

SEQ ID NO: 4151189 - RNA, 60 nt, Human
gaccuccagcggcccugcagagccuguucggugagcugcucgggaaccgccuggaggguc

SEQ ID NO: 4151190 - RNA, 75 nt, Human
gaccucugagacuugaauuccucggcuggucugagaucuuccucugcaggcugccgugggguccaggcagugguu

SEQ ID NO: 4151191 - RNA, 67 nt, Human
gaccucugcaagagcuucaagguagaaagcacaauucugacaucuuucuggguucugcagacuuguc

SEQ ID NO: 4151192 - RNA, 79 nt, Human
gaccucugggaagccaguccugcuuccccccauguccacccuucagaggugcugguuggcuggacugccucccagaguc

SEQ ID NO: 4151193 - RNA, 66 nt, Human
gaccucuguccauucagaauggcccuggaacuaggucacaggagccauugcaggauggcagagcuc

SEQ ID NO: 4151194 - RNA, 79 nt, Human
gaccugaugugggccagcuuuucuccugggugugugacugaauccuucuucccagagcaugugcugccuuuguuagguc

SEQ ID NO: 4151195 - RNA, 75 nt, Human
gaccugcaauaacccaguaucugugauaaguuaaggggagacuaacccaucacagacacuggguuauugcaaguu

SEQ ID NO: 4151196 - RNA, 75 nt, Human
gaccugcaauaacccaguaucugugauaauuuaaggggagacuaacccaucacagacacuggguuauugcagguu

SEQ ID NO: 4151197 - RNA, 58 nt, Human
gaccugcaggugggagccugccucucaucgacaguggccagcaggcuuuuccuggguc

SEQ ID NO: 4151198 - RNA, 56 nt, Human
gaccugccugagcugccucugcucuccugacagagcaggccgugggaguguagguc

SEQ ID NO: 4151199 - RNA, 80 nt, Human
gaccuggauauauguuuuucuaauuagggaauuggagauacaugaacagucucucauagagaaaaauauauccauuaguc

SEQ ID NO: 4151200 - RNA, 74 nt, Human
gaccuggaugaccaaggagcaaguuuacaccugcugggcuuucuucaggaauugaguucuaugugcuccauguc

SEQ ID NO: 4151201 - RNA, 55 nt, Human
gaccuggccauccagcuggcaucuacuguuaucagagugcuagcccuggcugguu

SEQ ID NO: 4151202 - RNA, 77 nt, Human
gaccugggguuugggauggggccgguaccagggggcuguccccagcccucagcacacucccaucuaauucccaaguc

SEQ ID NO: 4151203 - RNA, 97 nt, Human
gaccuuacaaaucauuaggaucaaccugcccugagguuacagaugaauaaacugaggcccagagaugggaggugaucgggcuggugaguuguugguu

SEQ ID NO: 4151204 - RNA, 63 nt, Human
gaccuuguguuuuuacgugucauuugucugucugagaucaaauguuaagacaggaucaagguc

SEQ ID NO: 4151205 - RNA, 111 nt, Human
gaccuuguuguaggcuacagacaacuggagaguaaucucuguguuaacucaucucuagcugaccagaaggugcuauuuuagcugacugugggauaauggugacaagauguc

SEQ ID NO: 4151206 - RNA, 92 nt, Human
gaccuuucugucaacuccauuucccugccuccugcacugcgaggcuaccuucuugccuagggggccgggcagaagagagaacugagagcguu

SEQ ID NO: 4151207 - RNA, 79 nt, Human
gaccuuuguuacugauuucagugggcuuuuacagaaaugauaacgcugaugucuuggucccugaaaaugacaagagguc

SEQ ID NO: 4151208 - RNA, 67 nt, Human
gacgaaccuuggccgcaguccuugcgaacuguucgcaaaacagugcgggcugcggugggucagcguc

SEQ ID NO: 4151209 - RNA, 60 nt, Human
gacgcagagcagaagccgccagcugcccgaggacgcugaacuggcuucuguuuucauguu

SEQ ID NO: 4151210 - RNA, 73 nt, Human
gacgcuuacaucacuccagaaccacuggcagggagagccugggccaaaggaccugugggugacauugaagcuc

SEQ ID NO: 4151211 - RNA, 74 nt, Human
gacggagacaaggcugaacagugaagccggccucagagggcacaguggcuggggaguuugugcuuuguccuguc

SEQ ID NO: 4151212 - RNA, 76 nt, Human
gacggaucaguguucagggaccaggucccagggcugugaaugugcccauaggauuugauguuugcgcacugacguu

SEQ ID NO: 4151213 - RNA, 68 nt, Human
gacgggagcgccgccccugcugguguuggggugcccccuccugccaccggggguggcgauggcccguu

SEQ ID NO: 4151214 - RNA, 66 nt, Human
gacggggcugcuucaccuuuuuacggaggcagaaaguaagucuuguaagguacugagcuccccauc

SEQ ID NO: 4151215 - RNA, 58 nt, Human
gacguaggaugaaagauauguauauacguauguauguauugucucuuuuccuuaaguc

SEQ ID NO: 4151216 - RNA, 108 nt, Human
gaccuccuggcuccaugcccuacuccugcugauccugccagccagcagaaauuguguuggggguggaggcaggggcaggacaggauagaaacagaggagucugggguc

SEQ ID NO: 4151217 - RNA, 77 nt, Human
gaccugaaagagauuaaaugacuuccuaaguuuacccagcuaagcucccuggcucuuauucuaguuuucuuuagguu

SEQ ID NO: 4151218 - RNA, 105 nt, Human
gaccugacccucggggauccauccacguggcccacccaaguaaugcaccuuuuagaauauuugcugaaauaacugccaccugguggcaucuucugggucaauguc

SEQ ID NO: 4151219 - RNA, 81 nt, Human
gaccugaccugacaguuuaguguaauaguuacccagugauuggguuuuauacacaugaacaugcagaucuuuauuaggguc

SEQ ID NO: 4151220 - RNA, 90 nt, Human
gaccugcugaaguguguaugcuuuguuuaaagauuuucaaauaaaaauuugugugggucaaagaaagcaugucugcaggcugaggcgguc

SEQ ID NO: 4151221 - RNA, 64 nt, Human
gaccuggaaugaagggucccucaucuuucuguagagggaaaagcauguuccugcauugaagguc

SEQ ID NO: 4151222 - RNA, 68 nt, Human
gaccuggacgugcaggaagacaggcacaaaggcuggccuuggggacugaggccugcugcguucagguu

SEQ ID NO: 4151223 - RNA, 84 nt, Human
gaccuggagugcaucaggaucugaccagauaggaguuuuugccucgugucugggugcuacgauuuugugccguucucugagguc

SEQ ID NO: 4151224 - RNA, 110 nt, Human
gaccuggcccuggagcugcuuucaaagaucagggggcucacggguucuggggcuuuccccagccucuguuugcuccucucuugaaauccacaaucuccugggcugguguc

SEQ ID NO: 4151225 - RNA, 56 nt, Human
gaccuggcuuugggccccggcaguagucuuccugcugggcggaccuuggguagguc

SEQ ID NO: 4151226 - RNA, 92 nt, Human
gaccugggcagggugguagcaaugauagauuuuacaaauuaaggcauuguucuuuauuucaaaauuuucauuuaccuauauuuuccuugguc

SEQ ID NO: 4151227 - RNA, 93 nt, Human
gaccuguaggcagaauggguuguaggccauuuaggaaagguguauccuaaggaccagggcuuccagccuguggagauuccugugugcaagguu

SEQ ID NO: 4151228 - RNA, 83 nt, Human
gaccuuagggaaguuaccgaaccucuccaugccucaguugccucuucuguuacauggagauaauggugccuaccuuguagguu

SEQ ID NO: 4151229 - RNA, 55 nt, Human
gaccuuagggcagagguggugaccuccaccaccaccacccucuccccacuggguc

SEQ ID NO: 4151230 - RNA, 94 nt, Human
gaccuuagucuagacccaugguucucaaagagugguccugggacucuuggggauuccugagauccuuuuagggaucugugaggucugugagguc

SEQ ID NO: 4151231 - RNA, 65 nt, Human
gaccuuccaugccuucuuccaaaaggagcaacucaaauggcagauacccaggcaaauggaggguu

SEQ ID NO: 4151232 - RNA, 130 nt, Human
gaccuucuaugcccucucagcuccagaaaaacuugaucguauuggcgccuaccucucugagaggcucauccgugacgugggucgccaucgauauggguaaguaguuuggaagagagggagagagauuguc

SEQ ID NO: 4151233 - RNA, 130 nt, Human
gaccuugaaagaacuagagucuuuaagagaacagagacauucuaugaagauaauuuuaaggaccuugaaagaacuagcaucuucaagagaacagagucauucucuuaaagacgcuagugcucucuaaguc

SEQ ID NO: 4151234 - RNA, 75 nt, Human
gaccuugcuuccugcagccuguucagugggggcugcuuuaucccucagacccucccucugcuggguguagagguc

SEQ ID NO: 4151235 - RNA, 84 nt, Human
gaccuuuagcauagcauccaguucagauguugccuuuucacgaauuuaacuguuuguagcaucuguuggcugcuccuaaauuuc

SEQ ID NO: 4151236 - RNA, 114 nt, Human
gacgaaugcagagguagguacucaggaugcaauaugguggcuccauaguccauccgagaccugagcuauuucugcccucuguuauugcauccuuagcacauggcuuccaucguc

SEQ ID NO: 4151237 - RNA, 70 nt, Human
gacgagguucaggcacuugcccaacaucaccaagcaagucagugaugaagcuaggauuugagccucaguc

SEQ ID NO: 4151238 - RNA, 74 nt, Human
gacgaugugcauguauugggguagggaagccagugggucccaccuuggcuucuuuuuaguaaaugucaguuguc

SEQ ID NO: 4151239 - RNA, 88 nt, Human
gacgcacgcaaauuguccaccucguguugcuaagcgauuguuugucggccccgcacgcacagcucagcaugggaggaccgcgagcguc

SEQ ID NO: 4151240 - RNA, 89 nt, Human
gacgccuaccaagcagcuuaaaguguuguaucuccauuugcauauaaccugaauacaaaugcaauucaaugcauauuuuaaguuguguc

SEQ ID NO: 4151241 - RNA, 79 nt, Human
gacgccuuaaacuuuguucguccagacucaggcuuggguugggugcuugaguugcagagaugacagaguuuuugcuguc

SEQ ID NO: 4151242 - RNA, 67 nt, Human
gacgcggacugguuaauccauaaacagagagcaucaggcucuuggaucccugggaaccagcugccuc

SEQ ID NO: 4151243 - RNA, 80 nt, Human
gacgcugaagcacagauaauucaaguauccuggggagaaauuggaagaaaggaaauuugaacuuaucugucugacagcuc

SEQ ID NO: 4151244 - RNA, 69 nt, Human
gacgcuuaaguuguccaagaggcugagguugcaaagugauaguauuagaucuuggcaaaugggaguguc

SEQ ID NO: 4151245 - RNA, 127 nt, Human
gacggaaaccaauuugagugugacagcugauuugagaaagaaugaauuaagagauucaggcucuucugcuauguugaaaucauuuuuacugaaagauuagcuguuuggaacagggauugacuuuguc

SEQ ID NO: 4151246 - RNA, 92 nt, Human
gacgggcacagaaaccuggccgcggcuuuccgggagcugugggcacgcgagcugcucgaagccgguggcccggggaucgucgcugcccaguc

SEQ ID NO: 4151247 - RNA, 62 nt, Human
gacgucucucuucuugucuaaaugaggaauugaacccauggccaggccaagagaguacaguc

SEQ ID NO: 4151248 - RNA, 73 nt, Human
gacgucugacaauacgucugaaugcauucucauguuuaauaaugagugcugaucgaggcuguuuucagaaguc

SEQ ID NO: 4151249 - RNA, 77 nt, Human
gacgugcuuuccggaauggcaggguagcucauaagccuuugcagggucuggcucugccauccgcagaaggcagaguc

SEQ ID NO: 4151250 - RNA, 61 nt, Human
gacguggaaggggcgaggcacuuuccacccacaggugcgaugaccagugccccauccuguc

SEQ ID NO: 4151251 - RNA, 58 nt, Human
gacguggccgaaacucucuuuaaugcuacagcacaaaggccagagagaggcuaguguc

SEQ ID NO: 4151252 - RNA, 81 nt, Human
gacguuaaaagaggaaaugauugacuauauagauaugguucugacaauaguauucauuuccucugcuaagaaauugauguu

SEQ ID NO: 4151253 - RNA, 83 nt, Human
gacguuagcgcuccgccuucgccuggcaaacccugcgcgggcuccgcugccaggucaccagggguagcgccgggcgcgacguc

SEQ ID NO: 4151254 - RNA, 67 nt, Human
gacguuauuauggggaugugauucagagaagaaaacaaugauaugcacaggugucucuaguagcguu

SEQ ID NO: 4151255 - RNA, 124 nt, Human
gacuacaucacagcagcauacguggagaugaggcgagaggcuugggcuaguaaggaugccaccuauacuucugcccggacccugcuggcuauccugcgccuuuccacugcucugguaagugccc

SEQ ID NO: 4151256 - RNA, 81 nt, Human
gacuacccagggagugcuccuguucucccagcgccaaccaccaacagugcagugaccaggagcaggagacccuggggaguc

SEQ ID NO: 4151257 - RNA, 60 nt, Human
gacuacucagcaaacauuugcugguuacucucuguguucuaggaacuguucugagugguc

SEQ ID NO: 4151258 - RNA, 76 nt, Human
gacuagauggagaggaaagugcaguuuugggaaaugaaaacagaauuuuaagugcugguuuucuucucuuuugguu

SEQ ID NO: 4151259 - RNA, 111 nt, Human
gacuagccaaaagcugaaagguugcguuuuuuguaaaguguugacagaauuacccaagcaaaacucagcacuauuccaaugauccaauuucuuuuuuuuuuuuuuuuaguu

SEQ ID NO: 4151260 - RNA, 69 nt, Human
gacuagcuacagaagccguggucaggaaauaucuguugaauucaugaauaccccuucuguaauguuguc

SEQ ID NO: 4151261 - RNA, 129 nt, Human
gacuaggugaauuucucaaagucacauagcuacuaaaugaucagauaugagauuuuagcucacuaauuugggcuccaaaaucuaugucuucuauagucaagugguauuggaugagauacacauuaaguu

SEQ ID NO: 4151262 - RNA, 57 nt, Human
gacuauggguugagauuguuuagugugacuuugacagauccuuaacucagcuugguc

SEQ ID NO: 4151263 - RNA, 67 nt, Human
gacuauuaaacagccuccccuuucacucucaaaaaugucuugaguguggaugauagguugugugguu

SEQ ID NO: 4151264 - RNA, 73 nt, Human
gacuauuauuuauugacugucccaaaacgugaugaaauugguaaaugugaggagggucaaacugaguuauguc

SEQ ID NO: 4151265 - RNA, 130 nt, Human
gacuauucugcuuggaugguuaugugagauuuuuugggucuuguugaaguggccaaacugcaccuuagugaguacaguuucuacgacuuaagcacagaauccagauacaucacagccaagcagaacaauc

SEQ ID NO: 4151266 - RNA, 127 nt, Human
gacuauugaaucgaugcgaaggcauuaucccaggguuuaaaguuuggaaacauucuggucaacagacuucuguucaaguacuguagauuucaggaucaugccuagaaaacaucgcauuucccaaguc

SEQ ID NO: 4151267 - RNA, 65 nt, Human
gacuauuuucccauaugguugacagagcuucaccagguccuggucggugguguggggaggcaguc

SEQ ID NO: 4151268 - RNA, 66 nt, Human
gacuauuuugggcucuugcugaccugggccaaagucagguccagucaagagggcccaaaguggcuc

SEQ ID NO: 4151269 - RNA, 80 nt, Human
gacucaagucauaggcuucuuucagucuuuaugucaccucaggagacuuauuugagaggaagccuucuguacuugaaguu

SEQ ID NO: 4151270 - RNA, 70 nt, Human
gacucaaucauaaaacauaaggcccacaaauaccuagagagguauaguaacuggcauguuuaugauaguu

SEQ ID NO: 4151271 - RNA, 82 nt, Human
gacucacugcuccggucucaucuuucagcgucgagaugcguccgcucagaagacugcagggaagggacaccgagcaggcguc

SEQ ID NO: 4151272 - RNA, 59 nt, Human
gacucagauuuagaggguaagaaaagcuuucuuagaagaagcgcuuuuugagcugaguc

SEQ ID NO: 4151273 - RNA, 102 nt, Human
gacucagcucccugaaacagcuguuauugcugggguaacgcccagaggcugccugagggcaguucugggugcaacucuguucuggcagauguaugcugaauc

SEQ ID NO: 4151274 - RNA, 63 nt, Human
gacucagucccagacauaguaagggauuuaaugaaggucauuuugcugguaagggacacaguc

SEQ ID NO: 4151275 - RNA, 78 nt, Human
gacuccagcgcugggguaggagcaccuugaaggugaaggagcccagcgagcugcagcuuccuaguccagccucacguc

SEQ ID NO: 4151276 - RNA, 55 nt, Human
gacuccagggauuggaagaugugcugccacgcgacuuuccccucucccugguguu

SEQ ID NO: 4151277 - RNA, 78 nt, Human
gacuccaguacagugcauggcacugagcagguaugcaaccauuuuuguugcaugagcgaauguguccuguacagaguu

SEQ ID NO: 4151278 - RNA, 130 nt, Human
gacuccauaguaaagcagggugaucuucugcccuucagcacuauaguugggugugagaucuguugggcuuuugaauacucagccaugcaacaugcugggggcagcugucacauuggcucuuugugggauc

SEQ ID NO: 4151279 - RNA, 58 nt, Human
gacuccauuucugucccuauggcuuuggcuacuccaagugcaucagaucaguggaguc

SEQ ID NO: 4151280 - RNA, 61 nt, Human
gacuccuuucaugaacagguuucauauugcuuugugguguuccuggagccuggaaggaguc

SEQ ID NO: 4151281 - RNA, 80 nt, Human
gacuccuuuuuggcucacugcuuugcccaagagggcagccuuugucuuucugacccaagguaguugcuggagcucaaguc

SEQ ID NO: 4151282 - RNA, 71 nt, Human
gacucggagcagugaugggaggacgucaauuuugcaagggcagcauuauuugacgcucuuacugcucaguc

SEQ ID NO: 4151283 - RNA, 74 nt, Human
gacucuccuugggguuugggggcuugaccugggugcgcuuucuggacagacuuuacagccccgggggcacaguc

SEQ ID NO: 4151284 - RNA, 76 nt, Human
gacucugaacuuaccagcaggugaccuugggaaaggcagugccuuaccugagccccugcugguguauucucugguc

SEQ ID NO: 4151285 - RNA, 80 nt, Human
cuuugauauuuguuuggcagaguucaggccaaccccaggcuucugcccuugccagacaaguaagcugaugauauucaaag

SEQ ID NO: 4151286 - RNA, 64 nt, Human
cuuugauuucuauucagauguagaucugcugagagccugauccugcagccauuagaggucaagg

SEQ ID NO: 4151287 - RNA, 60 nt, Human
cuuugccauacagcaagacaaaucucagcaaacguaaaggauguaggauguauggcagag

SEQ ID NO: 4151288 - RNA, 66 nt, Human
cuuugccauuauaucaaaacuuaauucauuucaguuuucucugaaguuuugacuaagauggcuugg

SEQ ID NO: 4151289 - RNA, 66 nt, Human
cuuugcccacaucugcuuauuucauucccauucuuuuguggggaugaggaaguagugggggcaagg

SEQ ID NO: 4151290 - RNA, 88 nt, Human
cuuugccccugaguuuccaaaaacuaaguauuuugaaauuaauguuuuagcaaaaauuauauugaaguugaaugucagggaugcaaag

SEQ ID NO: 4151291 - RNA, 73 nt, Human
cuuugccucaccuucccaacucucagucagggaaggauuucucaaguagguuguggaagggagauggcaacag

SEQ ID NO: 4151292 - RNA, 69 nt, Human
cuuugccugugucagcagguggaagugcucaccagacauuaaauauucagcuugcugacugcggcagag

SEQ ID NO: 4151293 - RNA, 88 nt, Human
cuuugccuuaguaguaauuauaacugguuuuguuaauaccaauccuaaaguauuaacaauacccauucuaauuacuauuaaggcuuag

SEQ ID NO: 4151294 - RNA, 114 nt, Human
cuuugcuagucuucuauuuuuguuugaauacugaaucacauuacagcauaucuguauaaauaaauaguaguacaguagguugaauguaauucaguuuguagauugacugcaaag

SEQ ID NO: 4151295 - RNA, 58 nt, Human
cuuugcugcauucaggagcacaguuguauuucaucuacugcuugagaaugcaguggag

SEQ ID NO: 4151296 - RNA, 64 nt, Human
cuuugcugguuuggcguucugaugaguaaaaaucuauuugcucugacagugccagagagcaagg

SEQ ID NO: 4151297 - RNA, 61 nt, Human
cuuuggaagugaccacaauccugguccauuugccacuccaaggauucuggaacuuugaagg

SEQ ID NO: 4151298 - RNA, 89 nt, Human
cuuuggaaugaugaaucaggcagugggugauaagaccaaggaggacauuuucaccugguccuguuaacccuacuauuuggguucuaaag

SEQ ID NO: 4151299 - RNA, 62 nt, Human
cuuuggagggaaggaagauuauuugugugaacauauuuaaucuguauuccuacuuugcagag

SEQ ID NO: 4151300 - RNA, 81 nt, Human
cuuuggaguucccuaauuucccaauuggggguuuuaguuaaucuguccccagaaguuaagcagggaaaaaauucuucaaag

SEQ ID NO: 4151301 - RNA, 60 nt, Human
cuuuggcaagauuguguggcugaaguaauauuaguuuucuuccuauguaucuugcugggg

SEQ ID NO: 4151302 - RNA, 63 nt, Human
cuuuggcccugaaucaaggccagcaguuugcugaagcuguugguuucaagcaggagccuaaag

SEQ ID NO: 4151303 - RNA, 79 nt, Human
cuuuggcgcauaccugauucucagcagugugcucauuagaugcucagugugagugagaagugcagugugguugcuagag

SEQ ID NO: 4151304 - RNA, 55 nt, Human
cuuuggcugacagguuucuggucccugaaugcacucagaccaaugucagacaaag

SEQ ID NO: 4151305 - RNA, 100 nt, Human
cuuugggacuaucucuuggcacauccacagaaucuggacuccucuaagcauuugugacugcuucccgauucaguggcugugccaagagauagccucaaag

SEQ ID NO: 4151306 - RNA, 93 nt, Human
cuuugggggugaugcagaugucucggggugcaugcagauguuacaggugaugcauucugcacauccaagaacaggaaugcaaguccucugagg

SEQ ID NO: 4151307 - RNA, 66 nt, Human
cuuuggguuucuacuuucaguuucagcugaaguuggagacauuuuagauaaacgaaagaugcaaag

SEQ ID NO: 4151308 - RNA, 129 nt, Human
cuuuguaauauaauaaaauacaaaaaauguugagugauucacauauaugaaaugaggaauuaaaugagcaaaaaauuaaugguuuuucaggggucaugauauccacuuaauauauguuauauuaugagg

SEQ ID NO: 4151309 - RNA, 89 nt, Human
cuuuguaguauugagggcagugaugucaaacagugaauaaaguuauauaucuauguggugaucuuauuuuaaccucaauauuauuuuag

SEQ ID NO: 4151310 - RNA, 64 nt, Human
cuuuguaguuagguaaagcagaaaacacuccuucauuccugugaucugccuuggaucugcaaag

SEQ ID NO: 4151311 - RNA, 64 nt, Human
cuuuguauuucgcuagguacucccugauuaccugcaauuagguuaccauguggcgaauacaaag

SEQ ID NO: 4151312 - RNA, 62 nt, Human
cuuugucugagaaagugaguugcuugaggucaaggcucaagucuuacugucccagaacaggg

SEQ ID NO: 4151313 - RNA, 72 nt, Human
cuuugucuucaguuacucccaccugaaagcccacuguacaaaacgugcagguggagcugacugagggcagag

SEQ ID NO: 4151314 - RNA, 59 nt, Human
cuuugucuuccccacacuggguuggagaaaaagccuucagccuggaggcagagauaaag

SEQ ID NO: 4151315 - RNA, 59 nt, Human
cuuugugagcuucugguucaacacucguuuuacaagcaaagaaauggaggcucagagag

SEQ ID NO: 4151316 - RNA, 67 nt, Human
cuuugugcacuaguucacaaaauaggaaauuacucaaauguccaaauacguuugcugguguauaaag

SEQ ID NO: 4151317 - RNA, 129 nt, Human
cuuuguuaggacuuggguuuuuauuuagcucuacauaugcgaucauaggaugcagaagauauaucuucuacuggacacguauauauagaugcuuaaauguggcuaucccaagguuagguaauaauaaag

SEQ ID NO: 4151318 - RNA, 67 nt, Human
cuuuguuaucgggcccucucguucuuccagguaaacaucccugagcgagggaggucugaggacaggg

SEQ ID NO: 4151319 - RNA, 62 nt, Human
cuuuguuccucacuggaucuuuuaaagugcaaauccuagcaaaugaaaccugaggaagaaag

SEQ ID NO: 4151320 - RNA, 56 nt, Human
cuuuguuguuaauuggcgcuuaccucaccugaaggccuuugccaagaagagcagag

SEQ ID NO: 4151321 - RNA, 127 nt, Human
cuuuuaaaaaaugcagcuuaacccguauuuguuauaggugguuaugucagccuagaugcugcucucauuugaguugggauuucuucuuaaauaauaaauauuacaacaaauguauucuguaugaaag

SEQ ID NO: 4151322 - RNA, 121 nt, Human
cuuuuaaaauuucuagaaaaucugguauucuucugaagguaggaagcauuuugaauuaaaaaugucuuuggaaauguggauccuuacagauaccagaauauuuaagagagauuauucaaag

SEQ ID NO: 4151323 - RNA, 60 nt, Human
gaacuauaucuucaagaaaaugaaugucaacaguucaaauucuuggaaaggcuaugguuc

SEQ ID NO: 4151324 - RNA, 63 nt, Human
gaacucgucuuuugcauccuuguaauaguauuccccuuuuauuugaggagugagaguggguuu

SEQ ID NO: 4151325 - RNA, 83 nt, Human
gaacucucuauaauugccaaccuucaguaaaggucuguuuacaacaugcaacagcuuuaguguggguggugcuucgaagguuc

SEQ ID NO: 4151326 - RNA, 83 nt, Human
gaacugaaaauagagacugggaggugauauuuugauaaaaauaaauauuuuaacauugccaugguuaauuuuacuuucaguuu

SEQ ID NO: 4151327 - RNA, 57 nt, Human
gaacugaguuuucugccuggacaguguccuaagacucucuggcaagaucucugguuu

SEQ ID NO: 4151328 - RNA, 86 nt, Human
gaacuggccagccccagccuucucccuguccccucccucugccagccccaguggagaggccugagaggcugcggacuagcuaauuc

SEQ ID NO: 4151329 - RNA, 78 nt, Human
gaacugggcaaaaguugugaagcagcaauucuguuauauggacaguguucugcuuuuuaauccuauuuagcucauuuc

SEQ ID NO: 4151330 - RNA, 58 nt, Human
gaacuggucuuuuagguuuucugaaaaugcuuugaaagcuccugggaauuaccaguuu

SEQ ID NO: 4151331 - RNA, 70 nt, Human
gaacuguccuuuuaaugcagccgugaaaauuguuaccaagcaacaagcgggucuugagagguaagcauuc

SEQ ID NO: 4151332 - RNA, 86 nt, Human
gaacuuaagccaucccucagcagacagcaaaauaacuaaucccuauuuugacugacgcuaaggguuuuuaacuguggcuucuguuc

SEQ ID NO: 4151333 - RNA, 70 nt, Human
gaacuucuucuuuaagagacucuuaagaaaccaaguuauuaugaggagcucugagucuuaggagaaguuu

SEQ ID NO: 4151334 - RNA, 55 nt, Human
gaacuuggccugucugucuggcucgugaugaauggugagacccgcugacaaguuc

SEQ ID NO: 4151335 - RNA, 96 nt, Human
gaacuuguucgaaacagauuguggucuccaccccagagaguuucugagucaguaggucugggguggagccugagaauuugcauuucugacagguuc

SEQ ID NO: 4151336 - RNA, 72 nt, Human
gaacuuucucuggcuggaaacaggagauucagcagaaguugaagucagaguuuucaagcaugagaaggauuc

SEQ ID NO: 4151337 - RNA, 104 nt, Human
gaacuuucuuugucaacauaagauuauacuuauuuaugauguggcuaaagaaaugauaagaagucacagaaauaagauaguuauugcuugcauaauaaaaguuc

SEQ ID NO: 4151338 - RNA, 86 nt, Human
gaacuuugugagggugcagggugccucugcucccaccagcucugaggggcucccugggaccggcagcucacaucucacacaaaguc

SEQ ID NO: 4151339 - RNA, 105 nt, Human
gaagaaaaagagaaaaugguaugaggaagacaaagggaauuuuucguagcuuguuuauucuauguuaggaucuaugaaaagucuauucauuccuucucauucuuc

SEQ ID NO: 4151340 - RNA, 118 nt, Human
gaagaaaaggcauuugacaaaauccugcuaagauucuguucuuaaagauucaucaagcacaaccuguguugagaaggaucauuugagagggaggaacauugauaauugucuauucuuc

SEQ ID NO: 4151341 - RNA, 111 nt, Human
gaagaaaauuugcacugcuuuccacuaauuuuauuguggcagauuggcauuauuccuagagugcaauaaguauugcuuacaugaaagaggagagcgggacagggaagcuuu

SEQ ID NO: 4151342 - RNA, 74 nt, Human
gaagaaacagguguucuuuuuguacuccagagaaacuucuccugagcccagauaaaguacaaccauguuuuuuu

SEQ ID NO: 4151343 - RNA, 64 nt, Human
gaagaaagauuggcaugcuucacaagacuuugaccuuuaaacaaagcauggucagucuguuuuc

SEQ ID NO: 4151344 - RNA, 70 nt, Human
gaagaaagcaucuguguuucuagcuaggaaaucgauuauuucagcuaaaggaaacucagauauucguuuc

SEQ ID NO: 4151345 - RNA, 84 nt, Human
gaagaacagcguuguauucuucaauaucagagcgaagugacuucguaaaaauucuauagauguuagaaaucguugccauucuuu

SEQ ID NO: 4151346 - RNA, 56 nt, Human
gaagaaccugauauaggaaguaaaaacauuuuagucucuucuugauaagguucuuu

SEQ ID NO: 4151347 - RNA, 80 nt, Human
gaagaacuguguuugaaucuccuagcgauguuuuuugaaucugcauugaauagauagcuuggaugguuguuuaguucuuc

SEQ ID NO: 4151348 - RNA, 79 nt, Human
gaagaagaaauugcgucauccuucucaggcagagaugaucuuccugaccugcggggaggagggccgccuuuucggcuuc

SEQ ID NO: 4151349 - RNA, 66 nt, Human
gaagaagagcuaaggagaguucaauuuaacuuguuuuuggauacuguccuggagcucacacucuuc

SEQ ID NO: 4151350 - RNA, 56 nt, Human
gaagaagcauucugcuguuuuggauaauugguuuucagucaguaucuugcuuguuc

SEQ ID NO: 4151351 - RNA, 60 nt, Human
gaagaaggucaaauguguuuaguggaaaguuugcucuuuucaauagaaaugacauucuuu

SEQ ID NO: 4151352 - RNA, 62 nt, Human
gaagaaggugccagaggcuuacuguuugcuuaaacucacagaaggcccugugcaucuuguuu

SEQ ID NO: 4151353 - RNA, 69 nt, Human
gaagaaguggagcuuuuccuaucagagcuacucugugguacugguggagaggucuuccaugaugcauuc

SEQ ID NO: 4151354 - RNA, 79 nt, Human
gaagaaguugcuggcagguuuggugucuggugagggccacuuuccagguucacagacgccgacuuguuguuuugucuuc

SEQ ID NO: 4151355 - RNA, 60 nt, Human
gaagaaucaagcaguaauuuguguuccagauaaagagcaaacugauugugccuggucuuc

SEQ ID NO: 4151356 - RNA, 63 nt, Human
gaagaauggcauuuagaaaacaacauguuuguaggauauuguugccucuaggugcccucuguc

SEQ ID NO: 4151357 - RNA, 67 nt, Human
gaagaaugugcuaaugaaaacuuucaggaacagugauuuccucaagguuucuaccagcauguuaauc

SEQ ID NO: 4151358 - RNA, 82 nt, Human
gaagacauucaugaagaagggauauaauuuggugaccaauuccaugggagcugugaagaaaugccuuccuuagaauguuuuu

SEQ ID NO: 4151359 - RNA, 79 nt, Human
gaaaaaaaauucugguucaauacuaaacuucuuuaagauuuacugaggguguuuaauauuagaacaacuguuuugguuc

SEQ ID NO: 4151360 - RNA, 94 nt, Human
gaaaaaagaaugaccucuuccaguuuacauaucaggcguuaagauugaaugcccugugguucaugugagacucuggaagaguuuacuaauguuc

SEQ ID NO: 4151361 - RNA, 99 nt, Human
gaaaaaaugucuucuuguaaacuuucuaggccuaugauucagauacauuuagaggaacagggauuauaaagccuuucuguuuucagggagacagaauuc

SEQ ID NO: 4151362 - RNA, 70 nt, Human
gaaaaaggacauggauacuugauaagggggaaaucaaucuuucuuucuuucguuuauuuauuuaguuuuu

SEQ ID NO: 4151363 - RNA, 74 nt, Human
gaaaaagggagacaguugugugaggacauucccugaguggaaauuuggucuuuggcacaauuucuuuuugguuc

SEQ ID NO: 4151364 - RNA, 73 nt, Human
gaaaaaugaauggacugaucccugggagggugacuaugggcuagcagugcuccuauggaucaguuguuuuguc

SEQ ID NO: 4151365 - RNA, 58 nt, Human
gaaaaaugguuacauguguuagguguccagccucggggaaacaucuguaacuauuuuc

SEQ ID NO: 4151366 - RNA, 92 nt, Human
gaaaacaccccuugguuuuugcaaaguucccuacacauguauugaauuuccaauaacauuuaggauguuuugagagaugaagaauccuuuuc

SEQ ID NO: 4151367 - RNA, 69 nt, Human
gaaaacagaucugccaugaacagcagcugaggugaaaaucaucagugucucucugguacuucugucuuc

SEQ ID NO: 4151368 - RNA, 66 nt, Human
gaaaacaggaggagcuguuucagggaaagucaaguuccaugcaaagcuaguuccuuucgguaguuc

SEQ ID NO: 4151369 - RNA, 59 nt, Human
gaaaacaugauuugcaugauuuguaauuguuuaaaucaugagucugcaaauuauggauc

SEQ ID NO: 4151370 - RNA, 67 nt, Human
gaaaacuaacggaaaaguuaggaaaauucuccauuuuucacuccuaacucaucugggugaguuuguc

SEQ ID NO: 4151371 - RNA, 78 nt, Human
gaaaacucugaugccagucaaagaagaugacaagaaaaccuuguuaaaaauacucauuuacuuguuaacagaguuuuu

SEQ ID NO: 4151372 - RNA, 92 nt, Human
gaaaacugaagcuggacgcuggccuccaguccugucuuugccauuagcagcccugggaucuuagugccuucaccagccgagcuucaguuuuu

SEQ ID NO: 4151373 - RNA, 73 nt, Human
gaaaacugaguuaaauauuuucugaaguuucaguagcugcuggaauuggcuauauuauuuagccucaguguuc

SEQ ID NO: 4151374 - RNA, 68 nt, Human
gaaaacugcccagaagagaugaaagucuucagcaugaaaagcacuucaucucucucuggaguaacuuc

SEQ ID NO: 4151375 - RNA, 56 nt, Human
gaaaagacagcuccucuugaagucagaggugacucaugaagcacagcucucuuuuu

SEQ ID NO: 4151376 - RNA, 77 nt, Human
gaaaagaggagggcucaguaaacgguggauugaauuccuggauuacaauagcuacuugacuggccuuucuaaauuuc

SEQ ID NO: 4151377 - RNA, 70 nt, Human
gaaaagagugauggagucaaggcuagaacagcaucaugagggcuguucuauaaauacuuucggacuuuuc

SEQ ID NO: 4151378 - RNA, 67 nt, Human
gaaaagccaagagacagaugcccacccaggugaaggaagaucgagggggcucuguuucauggagggc

SEQ ID NO: 4151379 - RNA, 94 nt, Human
gaaaaggaaguugcuguugcugcauuuuuuuuaagcuguaaaaucuaauaugccccagcucugaugaaauguaccaggaggaaccugccuuguc

SEQ ID NO: 4151380 - RNA, 55 nt, Human
gaaaagucuaauagagugcuaguccacaguucaccagcauucuacuagacuuuuc

SEQ ID NO: 4151381 - RNA, 79 nt, Human
gaaaauacauagagaaaguauuagccuagaagucaggucccuugacuucuagauuuugaugcugcuucugcuguuuguc

SEQ ID NO: 4151382 - RNA, 80 nt, Human
gaaaauacggacaccagaagaugcuuuguaaaaugacagguauaacuucuaucagcaugucuuuugguaggcagguuuuc

SEQ ID NO: 4151383 - RNA, 55 nt, Human
gacuuguagucacauccaagaauuaacucauucggugagauuuguauuauaaguc

SEQ ID NO: 4151384 - RNA, 74 nt, Human
gacuugucacaggaaaggguguaagggugcagcucccugacccugcaaauauauccugugcacaaaauucaguc

SEQ ID NO: 4151385 - RNA, 76 nt, Human
gacuuguuuaauaauaccuuagcaaguggucuauggcuuucuccaccauuacaugcaaguguucaaaaacaggcuc

SEQ ID NO: 4151386 - RNA, 92 nt, Human
gacuuuagaccucaugguuuauuuggcauucugugaucuuaaaaauagauuauuuuucacuucaggauagaaaggccauggaguuaggaguc

SEQ ID NO: 4151387 - RNA, 55 nt, Human
gacuuuagagaaauguagaaguaccccacuggguaugaguaaguucuccagaguc

SEQ ID NO: 4151388 - RNA, 87 nt, Human
gacuuuauuuuuccaucguggggcuccuguaauuuuuaaaagucuguuugaagauauuaauuuggcaggaaugaggaagauggauuc

SEQ ID NO: 4151389 - RNA, 92 nt, Human
gacuuuccuccaaugucauauuugagaaugucauauugccacaauuguuaucuuggcaauaaugacauuuuaaaaacaggaaugggaagguu

SEQ ID NO: 4151390 - RNA, 63 nt, Human
gacuuucuucucuggcgguguguuuuccucuguuuccaggggagcucccaagagaagguuguc

SEQ ID NO: 4151391 - RNA, 84 nt, Human
gacuuuguagugucauauauuaccugccugaucuauaucuaaaugauguuaugaggaucaggugaaauauguggcugaaaaguc

SEQ ID NO: 4151392 - RNA, 92 nt, Human
gacuuuuguuugcuugcuugcuuguuuaguucacagauuaggaauaaaucuggacuggaacuuguaacaauuaacuagggcauuugaaaguc

SEQ ID NO: 4151393 - RNA, 116 nt, Human
gagaaaaagcaguuguuucuggguauauggacaggaguuaaggcugaguugacaagucaaaacuucuuguccucagcaccccugacuuuccucuauguguccuuuuguuucuucuc

SEQ ID NO: 4151394 - RNA, 91 nt, Human
gagaaaaaugaauggaaauuggaauuugaaucacuuccuaauuguuuuacuugguucaaauggcugcaguuaccauauacacauuuuucuc

SEQ ID NO: 4151395 - RNA, 67 nt, Human
gagaaaacugggaagaaggagugguuuacucuucaggcagagugcaaguucuuccuucuucuuucuc

SEQ ID NO: 4151396 - RNA, 80 nt, Human
gagaaaagaucugauaggcuucuuucuaucuggcugaaaugaaggccuagaaucuccaaguuuacucacuucugauuuuc

SEQ ID NO: 4151397 - RNA, 78 nt, Human
gagaaaauagucaggaugagggaugaggaguacacauaggaaauuuuugugauuuucuucauuuugauuguauugcuu

SEQ ID NO: 4151398 - RNA, 97 nt, Human
gagaaaauauugcuagacaaugacagugguuccaaggcagcuuuaagaacagaagugccacauguaacucacugugauucauaucuguguuuugcuu

SEQ ID NO: 4151399 - RNA, 57 nt, Human
gagaaaaucuugggucaagaauauauugccccuuauggucauguccaaauuuuucuc

SEQ ID NO: 4151400 - RNA, 97 nt, Human
gagaaacaggaggcaagaugaggaaggagggaaagcgcgcggggcucccuucuugucuccuugcgcuuuauccugcuucugucuccuuuugucucuc

SEQ ID NO: 4151401 - RNA, 97 nt, Human
gagaaaccauggagcaaggcuggucagauguggugaaauaaauacagaaagcucccuggaaaccuuuccuacaucuguaucucucuuucccuuucuc

SEQ ID NO: 4151402 - RNA, 77 nt, Human
gagaaacggaaacuuuuuccaaaguggcugcaucauuuuucauucccaccagccauguaugaggguuuccaguucuc

SEQ ID NO: 4151403 - RNA, 80 nt, Human
gagaaacucucucuuuggacaacaugauguguggaugugagguucacaguaucagucauuuugcuaaaugaggguaacuu

SEQ ID NO: 4151404 - RNA, 75 nt, Human
gagaaagaaaaagagaauacaggguaacaggaagcgcauuuucuugaauucaucugguucuuuuuguucugucuc

SEQ ID NO: 4151405 - RNA, 63 nt, Human
gagaaagauuguccuucaggggacaugacaucaauagguuucuggaaugagggacucuuucuc

SEQ ID NO: 4151406 - RNA, 56 nt, Human
gagaaagcuaaauaaguugauuacuguaucugguauggacuuauggaguguuucuu

SEQ ID NO: 4151407 - RNA, 117 nt, Human
gagaaagcuaacuaauugcuuuaaaacagauuuguauauucuuaacauuugcuaguuucaagaacuguggagauucggaagguacacauuaguuuagugaggaagauuuauuuucuc

SEQ ID NO: 4151408 - RNA, 104 nt, Human
gagaaaggaaaggagagaggagugaggggcagaaugugaucagggucuucugaguacccugacccugguuuguacucccccaccugcucuugaugcuuuaucuc

SEQ ID NO: 4151409 - RNA, 76 nt, Human
gagaaaggaaguauaaucaaagcagggcuacuaaaaguucccuagguaaguggcccaguauguauaaucuuaucuc

SEQ ID NO: 4151410 - RNA, 58 nt, Human
gagaaaggcauuccuaugcaaaauauuaaauuuuauuuccccaauaggggccauucuc

SEQ ID NO: 4151411 - RNA, 87 nt, Human
gagaaagucuugcuuugucacccaggcuggagugcaguggugcuguauuggcucauugcaaccuccuccuggguucaagcgauucuc

SEQ ID NO: 4151412 - RNA, 55 nt, Human
gagaaaugagggaugggcagaacccaagacucgggaccccagcccaccauuucuc

SEQ ID NO: 4151413 - RNA, 77 nt, Human
gagaaauggggacagaacuuuugacauuagccacagaaaaugaggauuuuugucauaaguguuugcacccaguucuu

SEQ ID NO: 4151414 - RNA, 86 nt, Human
gagaaauguuaauuuaaaaauuuuguccuuuggugaagcuauuuauacauguauaucuuaggguucuguuuuuaaguauauuuuuu

SEQ ID NO: 4151415 - RNA, 63 nt, Human
gagaacaaaagauagcccaaacauacaucucuaaugauaggugugccuuuaucuucuguacuc

SEQ ID NO: 4151416 - RNA, 68 nt, Human
gagaacagaggccaugagcugccaccuggaaaacauuagcuacaguuugguugugagaggccuuucuc

SEQ ID NO: 4151417 - RNA, 64 nt, Human
gagaacagaguguaccuuagcauaaaauaaucucuuuguuucugagauuaaaggaugcucucuc

SEQ ID NO: 4151418 - RNA, 71 nt, Human
gagaaccaggagcuguuugugacaggcuguggcagcugccuagaaaagcagagacaagcuucugggaacuc

SEQ ID NO: 4151419 - RNA, 63 nt, Human
gagaaccccacaucccuggccagcagagccgaugaguaaugaaggaaugagggagugggucuc

SEQ ID NO: 4151420 - RNA, 89 nt, Human
gagaacgucugguggugauuuagcccugcgcucacguucugcagcgugaugcagucacacugcgggcagcgcuggcccaccacguccuc

SEQ ID NO: 4151421 - RNA, 81 nt, Human
gagaacuauagaaaccuggucucucggugagaauaaauauaccccagauuuucuaauauaccaucaggcuucuauuuucuc

SEQ ID NO: 4151422 - RNA, 72 nt, Human
gagaagaaaaauuauuuagaagcuaauuuuucagaaaucucugguugacagagcuucaagucaugacuacuc

SEQ ID NO: 4151423 - RNA, 129 nt, Human
gagaagaauaaaggggccagaugggucguguagaggaugaagaggcacugacauauuuuaaauaguggggugguaaauguggguugguccuuuuguugaauauugcaugauggcucugagcagaagcuu

SEQ ID NO: 4151424 - RNA, 73 nt, Human
gagaagauugaaggcugggaauuaacaacugaaccuucucucacucauaauucuucaggccuuuugucuccuc

SEQ ID NO: 4151425 - RNA, 60 nt, Human
gagaagcagaaggaagcagggccuuucccacuuggcccuucuuuuaauagccaguuucuu

SEQ ID NO: 4151426 - RNA, 60 nt, Human
gagaagcagggucuuccucaguuggugggaagccugccaggggaguggacacugugucuc

SEQ ID NO: 4151427 - RNA, 61 nt, Human
gagaagccccgugugcuuucucauuucucagaggaguaagcugaggcagaggggcauucuc

SEQ ID NO: 4151428 - RNA, 111 nt, Human
gagaagcggcucaucccagauggcuguaggguccgauacauccccacucgcggcgcccugggcaaguaucggacucugagcucaugagagauuccacugugcuguccccuc

SEQ ID NO: 4151429 - RNA, 100 nt, Human
gagaagcuaguauagaaugaucugguaaagugguuggugaugauaaaaauauaaagacauuacacaaacacauuccagauaucuaaaucuaaugcaucuu

SEQ ID NO: 4151430 - RNA, 88 nt, Human
gagaagcugggaacuuacuuggguagaugauuuggcaauauucacucuuuccuuugccaccccaaccucccuaaguugagugcuuuuc

SEQ ID NO: 4151431 - RNA, 56 nt, Human
gagaaggagcagaaggaggaggggcugucugagaucuuuucucugugcaccuuuuc

SEQ ID NO: 4151432 - RNA, 77 nt, Human
gagaggacacaauuauagaagaaagcauagaauguauaauauugaaugugugacuuuuauaguuaacagugccuuuc

SEQ ID NO: 4151433 - RNA, 55 nt, Human
gagaggagagagaaacagccaccuacuaaggaagaagggcuuuuucuccccucuu

SEQ ID NO: 4151434 - RNA, 79 nt, Human
gagaggaggcuaugccgaggccugagcagaggaguggacguucugugcuggaugccucugcucggacuuugccucccuc

SEQ ID NO: 4151435 - RNA, 102 nt, Human
gagaggagguuuacccacucccugcacgccugccgucccugccccgcugggcagcccuucaguguggcuggcguuggggccagugaguugccucuuucccuc

SEQ ID NO: 4151436 - RNA, 56 nt, Human
gagaggaguagacacuuugguuuccauucuaaaaccaaagcuacagauuccauuuc

SEQ ID NO: 4151437 - RNA, 58 nt, Human
gagaggauccacaaaccaggaagucuaccuuccuaugggaguguugggaucucugcuc

SEQ ID NO: 4151438 - RNA, 66 nt, Human
gagaggccuggugcuccugaaugcagagcacgcaucggcucaguggggggacugaggccugaucuc

SEQ ID NO: 4151439 - RNA, 61 nt, Human
gagaggcucuaauaccagcaugguauguuauacaguugaugccauugcuuggaguccuuuc

SEQ ID NO: 4151440 - RNA, 81 nt, Human
gagagggagcagccaaggaguggccacugggucacauggcuccagcagggcccaugccccuccuucuggcauuucucucuc

SEQ ID NO: 4151441 - RNA, 96 nt, Human
gagagggcgagggagaggaggaugcugugccuggaaagcggcucuugaggagagcuggaaucucggcaaagcguccacucccuccccuccccuuuc

SEQ ID NO: 4151442 - RNA, 56 nt, Human
gagaggggagcaucuggcaaggggcccauuucucagcacaguacauuuccugucuc

SEQ ID NO: 4151443 - RNA, 58 nt, Human
gagagggguuuggguagguaagaaauucauuucuuacagaguuuacagagcccaucuu

SEQ ID NO: 4151444 - RNA, 56 nt, Human
gagaggguagaguaucaggcccccagggagcugggagcuggacccuuacaccuuuc

SEQ ID NO: 4151445 - RNA, 82 nt, Human
gagagggucugauugccugugucucccuguaccuccacucccaggccgaacugggcagaggacagggaagaucagaccccuc

SEQ ID NO: 4151446 - RNA, 60 nt, Human
gagagguaacaguuguguuuuguacaggccaagagaaagacagcuuagaguuugccucuc

SEQ ID NO: 4151447 - RNA, 81 nt, Human
gagagguacacgagaugcccugaggaaugucacgcuccaauucagaguuucccagcauuuugggcacugcuguacucucuu

SEQ ID NO: 4151448 - RNA, 85 nt, Human
gagagguccaagguuagagugucugguagcugcucuggcuuuaacaguuggcucgaauggcaaccaacacuaauaucugccuuuc

SEQ ID NO: 4151449 - RNA, 88 nt, Human
gagagguccuaaaaacugaugcuagaagagacguuuuuuguuguuaauaaaugauucugcugguacauuuuuauuaacacauucucuc

SEQ ID NO: 4151450 - RNA, 55 nt, Human
gagaggugaaauaguuguccggguucuugcugugaccaagaauguuuuaucucuu

SEQ ID NO: 4151451 - RNA, 64 nt, Human
gagagguuccucuuccuccauccuguuagaaggcagccaucugcaggcuaggaagagagccuuc

SEQ ID NO: 4151452 - RNA, 99 nt, Human
gagagguugaguaauuugcccacagccacacagcuuaaugacagaaucagaaugaaggauucacaucaaggacugucuggcugcaaaaucccagcccuu

SEQ ID NO: 4151453 - RNA, 88 nt, Human
gagaguaauaucugucuugugggggguugaaaggacuuuauucauagcuaaaguucagugccuucuauacacacuuauuuuuaaucuc

SEQ ID NO: 4151454 - RNA, 57 nt, Human
gagaguacaucagcaacagggcugaggacaggggcagccagagcugaugucauucuc

SEQ ID NO: 4151455 - RNA, 60 nt, Human
gagaguaucagugcucccagcuuagcauuaaaaugcagccugguggucacuggaguucuc

SEQ ID NO: 4151456 - RNA, 77 nt, Human
gagaguccguggcaggaguucaauugcccaugauuugcaguagaggucauuggacucaaaagaacuccuuggcuguc

SEQ ID NO: 4151457 - RNA, 88 nt, Human
gagagugauacaaggacauuuaggcagcagugaggaugaauaggccucuucuuucugccucucucugcuuggauuuguauucauuuuc

SEQ ID NO: 4151458 - RNA, 65 nt, Human
gagaguguguuauuaaagauggaacccaggagcaccaagauuccauguucuaaauaacagcucuc

SEQ ID NO: 4151459 - RNA, 65 nt, Human
gagaguucuugccuggguauuauuuucuuuguccuaaaagaaugggcccaagucagugaacucuu

SEQ ID NO: 4151460 - RNA, 94 nt, Human
gagaguuuaguuuaacuuggaguccuucaggccugaaguguggaguggggcuuuagagugucacucccuggggcuggacuccuggcugucuuuc

SEQ ID NO: 4151461 - RNA, 58 nt, Human
gagaguuugacccugcugggaaugugcaaaaauauuuggaggcaggauuucaacuuuc

SEQ ID NO: 4151462 - RNA, 75 nt, Human
gagauaaagaaucugacauaauuuccuguacuugcauagcaggaaguggaaacagauucaaauuuauuuugucuu

SEQ ID NO: 4151463 - RNA, 64 nt, Human
gagauacugcaguuaaguaauuagcugucugcaacuaguuaauuaagagauacugcaguaccuu

SEQ ID NO: 4151464 - RNA, 87 nt, Human
gagauagaggcugccuugugagccagcacccaccguaguuugcugacucagaaucuaggcagggugcugugccaugguuucugucuc

SEQ ID NO: 4151465 - RNA, 77 nt, Human
gagauagguacacauauauuaaaaauuguuauaucuucaugguaauaauuuuuuacuguaugaaguggcuuuaacuc

SEQ ID NO: 4151466 - RNA, 60 nt, Human
gagauagugaccucaugcuucccagagaacaucuucgcugggcuguccugaggucaccuc

SEQ ID NO: 4151467 - RNA, 62 nt, Human
gagauauaagaucuagaaaggagcagggccagagugaaugcugcuuuuuaagcuugaguuuu

SEQ ID NO: 4151468 - RNA, 62 nt, Human
gagauaugacuuugggagauauuacauaaccucagcagguuucuuuccaauauucaugucuc

SEQ ID NO: 4151469 - RNA, 91 nt, Human
gaaugucucauugucauuggaacagccagggucaggcagcuucugcucggacugacguggcgucugacccuugguggguugccagacauuc

SEQ ID NO: 4151470 - RNA, 92 nt, Human
gaaugugacaaauguuauuucuguucacaaucauauugccccaacucaacucugggggagucugggaauuggagagaagcauaugcacguuc

SEQ ID NO: 4151471 - RNA, 56 nt, Human
gaaugugggggaugcuagcuuguggugaaacucccaggaagaggccauccacaguc

SEQ ID NO: 4151472 - RNA, 85 nt, Human
gaaugugguggcagugaaguuugucaguuuugggguccaggcuugaagacaauggcagauuccccuccugucucucguaauauuc

SEQ ID NO: 4151473 - RNA, 62 nt, Human
gaaugugugucagagucuccaugguucgauggaagaggacucacaggacucugcauauaguc

SEQ ID NO: 4151474 - RNA, 88 nt, Human
gaauguguugccuguggagugcuuggcucagugccugcuacauauauagcacucguuaagugauaaguauuauuauaggcauauauuc

SEQ ID NO: 4151475 - RNA, 115 nt, Human
gaauguuccucccaccuccucacuucaggcucuguuauucuagagggcuggccugguuacaaggguagccagauuaacuagggucuaaaugggagagcuggggcacggaucauuc

SEQ ID NO: 4151476 - RNA, 75 nt, Human
gaauguugacucuaccaagcagauuaaauuuagucucugugaggcuugauuuguccugcuuaagauugagcauuu

SEQ ID NO: 4151477 - RNA, 61 nt, Human
gaauguuuaaaaggugcaguuugagcuuauuuaugcucauaggauguauucauggacauuu

SEQ ID NO: 4151478 - RNA, 80 nt, Human
gaauuaauuggagaaucuugaagaagcuaaauauaauguuuacauugaugaagcuaaaucuaagguuugucuaguaauuc

SEQ ID NO: 4151479 - RNA, 68 nt, Human
gaauuacagagggucggucguuuuaucaucacgguuugcuuuggcuaaaaccugacucuguguguuuc

SEQ ID NO: 4151480 - RNA, 61 nt, Human
gaauuagagggcacuugaauguuuuauugauaguccaauggcauuccaagucuucuuuuuc

SEQ ID NO: 4151481 - RNA, 102 nt, Human
gaauuauaacauggaaggagucaucacuggggccaugugagggacuguguaucaccacagaccuugcccuuaggaagcuuaaagccuuuuauauuauaauuu

SEQ ID NO: 4151482 - RNA, 66 nt, Human
gaauuaugcaauuuuuaucaauucagcaaaauguacacaugugcuguggugaggguuucaucuuuc

SEQ ID NO: 4151483 - RNA, 83 nt, Human
gaauucaggauucucucccauuuaccacuagggaaaacccuacugcuaaggaccguaaaugucggaggaucccccugagucuc

SEQ ID NO: 4151484 - RNA, 71 nt, Human
gaauucaguuugcuaguguuugguugaugguuuuugcauuaauaaucaucaaggauauuggucuguaguuu

SEQ ID NO: 4151485 - RNA, 68 nt, Human
gaauucauuugccaucaguguaauguguacuauuuuccaaaccauuuugcauuugaggcaaugaucuc

SEQ ID NO: 4151486 - RNA, 129 nt, Human
gaauuccucagcuuuaaaaauaguggcaucugguuccuuuucccugaagguauuuacucaagccaaggaaugaagcaccugugggugaagagcagaugaaagcuggaacuauaaaagccggagggaagc

SEQ ID NO: 4151487 - RNA, 60 nt, Human
gaauuccuuaggcucuugacuguuucuccacuauaaucagucuacggagaguaggaauuc

SEQ ID NO: 4151488 - RNA, 62 nt, Human
gaauucugagggaccccaucauuucuauggugccuccuaaaugcugugucaccuuaggauuu

SEQ ID NO: 4151489 - RNA, 83 nt, Human
gaauucuguaucacuuccuagauacgagauugaaaauaggccuuuuuucauguuggcauguuuuuaggagguaguuggaauuc

SEQ ID NO: 4151490 - RNA, 98 nt, Human
gaauugacaucuguuuaauggcuugcagagaaaagagguagagcuuguuauauuccuaucucuauuucuaugcagcugaaauugaucaguacaaguuc

SEQ ID NO: 4151491 - RNA, 127 nt, Human
gaauugagggacuguagaauuuacuuucugcuucuguauuuugggcuugaaucugggacaaugaucuuuucccucagcuggagaugagaaccgaacaacgaaaguagugccugcugugccuucaguc

SEQ ID NO: 4151492 - RNA, 91 nt, Human
gaauugcucuguaauugaaauugccuuggguuuucacuacgauuacuauaaauuguauaauucagguauuuucggguuugcugacagauuc

SEQ ID NO: 4151493 - RNA, 72 nt, Human
gaauuggcccagaaaauauggcuaaggugaccaauuuucuugguuuccccaggaauuuucuggcuuuaguuc

SEQ ID NO: 4151494 - RNA, 55 nt, Human
gaauuggggcucugggcagggagcucuguuugguucacugcucuagcccuaauuu

SEQ ID NO: 4151495 - RNA, 76 nt, Human
gaauugggguuugaggggagaaauucagagccgucaagccugacugagccucucuucccaccuccucccucacuuc

SEQ ID NO: 4151496 - RNA, 77 nt, Human
gaauuuaaagaggcacuccuuuuuaaggcugacccuguauuuacgggacccugagagcgaguggccucaugaaauuu

SEQ ID NO: 4151497 - RNA, 67 nt, Human
gaauuuaaauuuaaaucuaccaggggugucaugaugccaacuggaaaauuagauuaaaauugaauuc

SEQ ID NO: 4151498 - RNA, 88 nt, Human
gaauuuaugucauucacucaucuccuuuuaauuaaaaccuagugagauugguggcaauguugggaagcagauggaugagcaugaauuu

SEQ ID NO: 4151499 - RNA, 62 nt, Human
gaauuuauuugccauaagaaacaaaagccauuuugcuaaauggcugugaauggcaaauaauc

SEQ ID NO: 4151500 - RNA, 61 nt, Human
gaauuucccauucugaguggagacuggagcaaauccggagaaucucuagaaugggagauuu

SEQ ID NO: 4151501 - RNA, 85 nt, Human
gaauuucuaaaacuccucaugccgggucucacgcuacagauucagauuuaaucaguguaagauguggucugagcaucaggauuuu

SEQ ID NO: 4151502 - RNA, 69 nt, Human
gaauuugacuggagauaaugcuggcauacccaaaagcugcaugucugcaaauaucugccaguucuauuc

SEQ ID NO: 4151503 - RNA, 67 nt, Human
gaauuuggagagagauuaauguuggcucacuaugcauagaaaaacgucacuuucucucucucuauuu

SEQ ID NO: 4151504 - RNA, 68 nt, Human
gaauuuggccaaauaaucuugcagauggauaauuucagacugggaugaguguuuugaaggcgaaguuc

SEQ ID NO: 4151505 - RNA, 80 nt, Human
gaauuuggccuugaaauauuaguuccuucuggagagcccuauauucuaaccagaauaagcuguguugucaagcuguuuuu

SEQ ID NO: 4151506 - RNA, 74 nt, Human
gacagcuaccucaugcuguacagcacguguccaucugggaacacccucagcaugauguugucaguggugguguc

SEQ ID NO: 4151507 - RNA, 72 nt, Human
gacagcuaugcugugcaucuugccuggauguuuuuucagaggagggugcaggcaagagcaaaagcagcaguc

SEQ ID NO: 4151508 - RNA, 60 nt, Human
gacagcucguaccugcuuucucaccuaaaaggggaagaaggcuccaaguagaguuugguc

SEQ ID NO: 4151509 - RNA, 68 nt, Human
gacagcugaaaaauguaagguaaaugaaauuaugcuucuaucgccaacuuuauuuuguuccagcuguc

SEQ ID NO: 4151510 - RNA, 61 nt, Human
gacagcuggcaguggaaagguggccaggagguuuauauguuccuuuccugcagguacuguc

SEQ ID NO: 4151511 - RNA, 57 nt, Human
gacagcuucuaugugacgagcacuuucagugugacaggcucugaaccaagagcuguc

SEQ ID NO: 4151512 - RNA, 103 nt, Human
gacaggaaucuggugggcaggugcaccugagccaucugaacccguucagagucaccuuuuccucaggaugccuccguuuugcuccuagguuacaccuacaguc

SEQ ID NO: 4151513 - RNA, 107 nt, Human
gacaggagggaucaggacaggugggccuugggguggccuugucccugugccucucuagggcugggccugaccccaggaugaagcauccucauuccaucccuucuguc

SEQ ID NO: 4151514 - RNA, 68 nt, Human
gacaggauuuugauuucuugauuaugcccucugugacgaggccauaaauugcuggucaaaauucaguc

SEQ ID NO: 4151515 - RNA, 68 nt, Human
gacaggcagcagggcauagaggcacggaggcugcauggagaucccucacugcauuguccgcugucuuc

SEQ ID NO: 4151516 - RNA, 70 nt, Human
gacagggaaagaacaguaacuuuugacagaaauuuugcuuccugugagaugugguuauucucuuccuuuc

SEQ ID NO: 4151517 - RNA, 86 nt, Human
gacagggagaugagacagguguauaaucgggccucaagaaugcucuuuggaucuggaguccugcauuugcucuuagaucauuuguc

SEQ ID NO: 4151518 - RNA, 57 nt, Human
gacagggaggagcagagcuucugagucacacagucugcugagcucugccucccaguc

SEQ ID NO: 4151519 - RNA, 91 nt, Human
gacagggaugucccagaacaaaggccacagucagugggugcugagccccacagcccugcagccauggccuguggucuuggugguuccuguc

SEQ ID NO: 4151520 - RNA, 62 nt, Human
gacaggguccauucccagcggcacuagaaggcaggcugcucuaggggcagggcccuuggguc

SEQ ID NO: 4151521 - RNA, 59 nt, Human
gacagguaccggucagacuacggugacacaggcggcgugcgguuagacagguaccgguc

SEQ ID NO: 4151522 - RNA, 92 nt, Human
gaagagaggagguguagaaagagugugggcuuuggacucaggaacccucagcugaauucacaguucugcaccuuacuaggccugcucccuuu

SEQ ID NO: 4151523 - RNA, 80 nt, Human
gaagagcagaaagaaaguuucccccuucacagcuuaacaagguaugcuguuaagcucccagaagagggagaauggucuuc

SEQ ID NO: 4151524 - RNA, 56 nt, Human
gaagagccauuuaaauaguugucagugacaacuacaacuuacuugaauggcuuuuc

SEQ ID NO: 4151525 - RNA, 64 nt, Human
gaagagcuggaagugaagauaaccugaaaugcaggauguuuuccccuccuuucccugcucucuc

SEQ ID NO: 4151526 - RNA, 76 nt, Human
gaagaguggccucagagaaauacacaccucuuuuuaaagugauggauucuguauuagaucugagaacuucuucuuc

SEQ ID NO: 4151527 - RNA, 83 nt, Human
gaagaguuggaaaaacaaaugccauauauaaauucuaagccauaugaggacgaggaguaauggcauuuucuuccuuuuuccuc

SEQ ID NO: 4151528 - RNA, 66 nt, Human
gaagauaacauguugcagauucugccuccauagugaucagaguagcaaucugugauguguguguuc

SEQ ID NO: 4151529 - RNA, 57 nt, Human
gaagauaacuuuaaaaaguggccauacuguuugaggucugcuuuuuagugcaucuuc

SEQ ID NO: 4151530 - RNA, 102 nt, Human
gaagauagaaagcaagugugcuuacuuuacgggaucauagacuucaagauagaaaaaggaaucagugauccuauaaagugagcacaccugcuuucuaccuuc

SEQ ID NO: 4151531 - RNA, 127 nt, Human
gaagaugaaaguaaauuggucuagguguaucaauggcaaaggaaccuauuuuaaaaagucaagaauacuuuuaagaugguauuuuauaaagaugcauauaauaauaaacuuaaacuuucacaucuuc

SEQ ID NO: 4151532 - RNA, 89 nt, Human
gaagaugagaccugaaagaugcaugcugaagcuggcucagacugucucaaaagagcuaauugugugcaccucuucucaacuccaucuuc

SEQ ID NO: 4151533 - RNA, 60 nt, Human
gaagauuaccugagaccacuuguccccccucaaagaagcaaggucucagccaaaaucuuu

SEQ ID NO: 4151534 - RNA, 62 nt, Human
gaagauucuuugaggauuuuacuugagucagaaaaccucaguaaaaggaacaaagaguuuuc

SEQ ID NO: 4151535 - RNA, 77 nt, Human
gaagauugcguuuagaagauggcauuuuaaauguggguuucuccaaaggaagugccacucuucuuccagcuaucuuu

SEQ ID NO: 4151536 - RNA, 90 nt, Human
gaagauuugaaauuuauuuaaugcaugguuguuugccuacauauggccuaggccuguuugguacaaucugccaaguaucuucaaagguuc

SEQ ID NO: 4151537 - RNA, 102 nt, Human
gaagcaaaaaaguaauaggcaaaguuuaaaguagauuucagcuagaucauaaacagcuugggaugcugguuuaaauuuguagauguuuuugacuuauguuuc

SEQ ID NO: 4151538 - RNA, 67 nt, Human
gaagcaaauaacaugaccugugcuucacagaugaacaucuaggggcucagaaauguuagguggcuuc

SEQ ID NO: 4151539 - RNA, 79 nt, Human
gaagcaaguauaaucaauugcuuuuugaaucaauauuucaacaaaaugaugauaagauggaguugaauucucuugcuuc

SEQ ID NO: 4151540 - RNA, 66 nt, Human
gaagcaagugcaaggaagaggcagacacagaucagcaauacuugcuaaauccuugaguuuugcuuc

SEQ ID NO: 4151541 - RNA, 87 nt, Human
gaagcaauguaguuucuaaacugaacugucauaaaagaggauaugggcuuccaacuggcaugucaguaguaauuaaaauauuguuuc

SEQ ID NO: 4151542 - RNA, 61 nt, Human
gaagcacagggcucgaucucagcaggaaaacaucccuggcauggggacagcccgugcguuc

SEQ ID NO: 4151543 - RNA, 66 nt, Human
gaagcacauacauaggacuuagaccuggauucaggucugccacacugguucaguggaugugaguuc

SEQ ID NO: 4151544 - RNA, 109 nt, Human
gaagcaccccugggccucaugagcuaacccuugcaucccauguguggccauccaggggaagucggccugugcacaugugcaggaaagcacgggggcccccggggugguc

SEQ ID NO: 4151545 - RNA, 65 nt, Human
gaagcacgagccuuugaaaaugacuagcuauugauaauucaaaaucauuucagggccuuggcuuc

SEQ ID NO: 4151546 - RNA, 60 nt, Human
gaagcagaacccacuccccaacuucuccacucucugaaugaggagugauuuuuuugcuuu

SEQ ID NO: 4151547 - RNA, 62 nt, Human
gaagcagacaucaccugcuggcagcaggcaguauccucucagucagccuugauguccccuuc

SEQ ID NO: 4151548 - RNA, 72 nt, Human
gaagcaggagugaguguccucagcagaguuucccuaacucgaaucuccuggguugugacuuucuccugccuc

SEQ ID NO: 4151549 - RNA, 71 nt, Human
gaagcagggaugcauuuucugaguaauacaaaaaguuaucaaaagacaacaaauguguuccauaaugcuuu

SEQ ID NO: 4151550 - RNA, 56 nt, Human
gaagcaguucgaaagcaguuggggauuuccccaaaggcuuguuugaggacugguuc

SEQ ID NO: 4151551 - RNA, 71 nt, Human
gaagcaucacagcugugagagugcauugaagggggauucucuugaugcagaucauagccaagguauguauc

SEQ ID NO: 4151552 - RNA, 65 nt, Human
gaagcaucuuucagugcugucugaaguuguucuucauucaucagauggguuuugaaggauguuuu

SEQ ID NO: 4151553 - RNA, 67 nt, Human
gaagcauggagagcuauuuggaccuccagguuaaaacugaugcagccuggagcccuggccucccuuc

SEQ ID NO: 4151554 - RNA, 123 nt, Human
gaagcaugguacucagacauuuuaagggagggcauuuucugggucaucagggguuaaaggguugccagucuugacagcugaggcccagaguaccccccaccucuggacuucuaggcaggcuuu

SEQ ID NO: 4151555 - RNA, 74 nt, Human
gaagcauuuauuuagaagaguuuuaaaguacuuaggcgcaguccaaagcacucaauuucuaagcuaaaugcuuc

SEQ ID NO: 4151556 - RNA, 130 nt, Human
gaagcauuuggggacuuagaggaaugauaaaugcaaacagcccagaauccagaaacugucuugaacauuuaaacucuagacucugggaaugugugcaugucuucaguuagucagauguagauaauuuuuc

SEQ ID NO: 4151557 - RNA, 72 nt, Human
gaagccaccaaugagaguguuguuuuuccaaccgugguaucuggagacauuucucauuaaaaaauggucuuu

SEQ ID NO: 4151558 - RNA, 68 nt, Human
gaagccagagaggccuuagaauccauagcccauucccuucuggcuucugagucuccugacauugcuuc

SEQ ID NO: 4151559 - RNA, 70 nt, Human
gaagccaugcaggagacuggcugugguaguuuucaugugaauuuuuaucuucagugcuuuucaugucuuc

SEQ ID NO: 4151560 - RNA, 55 nt, Human
gaagccaugugacuauuucuagcucuaaaagugagcagaauuguuuuaugucuuc

SEQ ID NO: 4151561 - RNA, 67 nt, Human
gaagcccagaguucaaggcugcagugagcuaugaucgugcccaccacugcacuucagccugggcuac

SEQ ID NO: 4151562 - RNA, 63 nt, Human
gaagcccagcugucugguuccagagccaguguuacauggcucugaccucccaggcaguucuuc

SEQ ID NO: 4151563 - RNA, 71 nt, Human
gaagccuaaguauaaucagauaaccucaacaucaguaggacaacugaugcugaaccuuaacuuggagcuuu

SEQ ID NO: 4151564 - RNA, 65 nt, Human
gaagccucaacaucucugcgucugcaacuaauuauuuauaaugaccucaaagaugaugggguuuc

SEQ ID NO: 4151565 - RNA, 85 nt, Human
gaagcgcuugaaccugggaggcggaaguugcagugagcugagaucgugccacugcacuccagccucagugacaaagcgacacuuc

SEQ ID NO: 4151566 - RNA, 88 nt, Human
gaagcuaaagagaauuuguaagaauccagcgcaauucagaaucagagguuuuagagcugggauggauuuuccagaaaucuucuguuuc

SEQ ID NO: 4151567 - RNA, 84 nt, Human
gaagcuaaguacagagagaggcccgaggcugcuuguaguuucccagcuaggcaugccuauugccuccucugucuauuugccuuu

SEQ ID NO: 4151568 - RNA, 77 nt, Human
gaagcuagaagaggcaagaaaggacuuucuagagccuuuggaaagcaugauucugccacaucuugauuuuggacuuc

SEQ ID NO: 4151569 - RNA, 86 nt, Human
gaagcuauuuagugagucacauccuuuuagggagcaaaaguaucuaaggaauaagaugggugugaguugggacuagguauugcuuc

SEQ ID NO: 4151570 - RNA, 79 nt, Human
gaagcucagagaagggugugauuugccugagaccacacagccgguaacaggcaaggucacaccuugaacccgugucuuc

SEQ ID NO: 4151571 - RNA, 86 nt, Human
gaagcucccagaguccucugcccauguuuucuuagccagguuuguaaaagggaucauucuggagcagagggcguuugaggaaauuc

SEQ ID NO: 4151572 - RNA, 81 nt, Human
gaagcuccuguggcugaaagaggacuaaaguggcauuuucugccaggcuuugucacgcucccuuuugcccacaggugcuuu

SEQ ID NO: 4151573 - RNA, 76 nt, Human
gaagcucugcagggaaggguguggggagugauggacccauucuucuccaguucauccuaccauuuguugagggcuc

SEQ ID NO: 4151574 - RNA, 84 nt, Human
gaagcucugccucugaguuagagaucuagauuguuucucugcaucaaaaagcgacuagguuuuccagccagaaguggagguuuc

SEQ ID NO: 4151575 - RNA, 82 nt, Human
gaagcucuuggcaugugaguaauguucauaaguaguagccacuauugcuaugagcauuguucuuguccugaccuugagcuuc

SEQ ID NO: 4151576 - RNA, 106 nt, Human
gaagcugcaacaccuuucggaccuuugggcucagaccaucgauaccucugauucugauaacaaacaccaauuuggguucugcagguauauagaaguugccagcuuu

SEQ ID NO: 4151577 - RNA, 60 nt, Human
gaagcugcaggaaguagaagcggaguggguggcagcucccucccuugcuuccucagcuuu

SEQ ID NO: 4151578 - RNA, 73 nt, Human
gaagcugccauaacuucauggguucaaagcuggguucucuugggaccugcuuccaugcaauggcagucaguuc

SEQ ID NO: 4151579 - RNA, 61 nt, Human
gaagcugcucugccaagacaacaucaucaaucaauaagagaaugugucagcagggggcuuc

SEQ ID NO: 4151580 - RNA, 93 nt, Human
gacaccuggucugugguauuuuauuaugacagccuaagcagacuaauacagagugggaggguggcaguaauugaguuaccuggaccagguguu

SEQ ID NO: 4151581 - RNA, 92 nt, Human
gacacuccuagcagagggacaguguaaugcauaaaguuacggagaaaggaagguguguucugugcucauacacguucagcugcucagagguu

SEQ ID NO: 4151582 - RNA, 60 nt, Human
gacacucucucaggcuuuccuuguuuuugaugaccuggagucauuugaggaguacugguc

SEQ ID NO: 4151583 - RNA, 68 nt, Human
gacacuugccauaaaugaaaauacugucaacaugaauuuaaaugaaguauucucauauugguaauguu

SEQ ID NO: 4151584 - RNA, 75 nt, Human
gacacuugugcuguuucugagcuccggaucuuauucuuucagucaaccgguauuuacugagcgcacagucguguc

SEQ ID NO: 4151585 - RNA, 108 nt, Human
gacagaaguaccaggagggagggagagaagggcauguacacugcccuucagaacacguuucgggcaugacauguacugcucucucaucucauugggcaaaaucuaguc

SEQ ID NO: 4151586 - RNA, 84 nt, Human
gacagaaguccccgccccagcuguguggccucaagccagccuuccgcuccuugaagcuggucuccacacagugcugguuccguc

SEQ ID NO: 4151587 - RNA, 63 nt, Human
gacagacugugucugagguauucucuugcaaaucccugaggguacugaauaacaaagucuguc

SEQ ID NO: 4151588 - RNA, 71 nt, Human
gacagagaagagacucaugcgggccaugugcaggggaucccuugggccagcacugggugcucauucgaguc

SEQ ID NO: 4151589 - RNA, 72 nt, Human
gacagagcagaacauuucacaguaucuuguaguaaaagcaaaaacuguaaauguuucucaugauaagauguc

SEQ ID NO: 4151590 - RNA, 65 nt, Human
gacagagcccugauacccugagaccaggcuugcucucucugggugucuuaggagcucacuauguc

SEQ ID NO: 4151591 - RNA, 76 nt, Human
gacagaggaugggggcggcugaagcccagggaggggcuccccaucuucucggcucccaaugcucgccuucucuguc

SEQ ID NO: 4151592 - RNA, 73 nt, Human
gacagaggcaccagccccgcuagccugggaggcagccugguacccaggagggaggagggugggggccuggguc

SEQ ID NO: 4151593 - RNA, 60 nt, Human
gacagaucauugauuuucacucacugugcauaaaacacaguugacucucaagauccuguu

SEQ ID NO: 4151594 - RNA, 86 nt, Human
gacagauuuguuuaucuuggaaccuuggaggcucugcacccaaaagcuuuggcccuagacucuaaguccgcccccagcaaacuguc

SEQ ID NO: 4151595 - RNA, 64 nt, Human
gacagcaucucuuuuugcauuccuccuauucuggagaaauggagaagagauaguucuucauguc

SEQ ID NO: 4151596 - RNA, 117 nt, Human
gacagcauuuuguguaacucuuugcacaggggaguuuuaugcaacagacagaaacuuucugaguuguucugauugccugaagaugcccuguuuuagaggagcaaaauuuucccuguu

SEQ ID NO: 4151597 - RNA, 63 nt, Human
gacagcugugacagccaguugauguuaaacacagaagccucaacagacaggucuacagcaguc

SEQ ID NO: 4151598 - RNA, 69 nt, Human
gacagcuuaaggacucccugcauuaucuuccagggcaaccugacagccaggagagcuccuucagguuuc

SEQ ID NO: 4151599 - RNA, 61 nt, Human
gacaggagccagggagggucugguauagaacaauugugcgaagaaacuucuggcuguuuuc

SEQ ID NO: 4151600 - RNA, 82 nt, Human
gacaggauuccaguacaggucucucauuuccuucaugauuaggaauacuacuuugaaaugagagaccuguacuguaucuguu

SEQ ID NO: 4151601 - RNA, 79 nt, Human
gacaggcaugcuuucaggacuaacuaagcauggugaggaaacaagaaugauaauaguaucugaaaauguguugccuguu

SEQ ID NO: 4151602 - RNA, 79 nt, Human
gacaggcuuagggagggugcucugcccagguuccaauccugguuccacugcauaugagccuuguaucucugagcaaguu

SEQ ID NO: 4151603 - RNA, 121 nt, Human
gacagggaaauaacgaguaccccaggaagacugaauuugcauaguuggcaaaugcugccagacaaguucgcauucaacuguugcaucagauucauuuggaaagcuuuuaaaaaauauuguu

SEQ ID NO: 4151604 - RNA, 59 nt, Human
gacagggcaagacucugucuaaaauucuuuuuuaauuuuaggcagagucucgcucuguc

SEQ ID NO: 4151605 - RNA, 83 nt, Human
gacaggugcuguucaguucauaauuuggcuuccuagauguagaagucuccggcuucugagccaaaaagcgagcgggcccuguc

SEQ ID NO: 4151606 - RNA, 94 nt, Human
gacagguuagucuuuucugccauuuauuggagauaggcauauaaaacacugaguuuuauugagcacauaguauguggcaggcacuagcacuuuc

SEQ ID NO: 4151607 - RNA, 80 nt, Human
gacagguuggggagcuggggaagaaccaugggaagcaaacccuggucucuccaugcccuccacccucucaauaaccuguc

SEQ ID NO: 4151608 - RNA, 81 nt, Human
gacaguaaaauauagcaauuugcccaauuaccugcuugguagucugaguacugauuuugggguagauaccucuuuauuguc

SEQ ID NO: 4151609 - RNA, 78 nt, Human
gacaguaaacucguucccaaacccaagcacgacugugacuuguucucuggguuaggggaacuauugagucagaauguc

SEQ ID NO: 4151610 - RNA, 106 nt, Human
gacaguaaggauaccagugauuacugugcuuuugguaccuucgcuuucagugccuucagcggaggcauuuccaccaaugagcaagucaucaauguuacccucuguc

SEQ ID NO: 4151611 - RNA, 63 nt, Human
gacaguagugccaugaccuacagcccacugcccgcccgggcuguagaagaaucacuugcuguc

SEQ ID NO: 4151612 - RNA, 55 nt, Human
gaggcugccaaugugugcaugugugugugugugugugugcgcacaggugugccuc

SEQ ID NO: 4151613 - RNA, 76 nt, Human
gaggcugcccuggccauccagguugacugugacugacacaggcuugcacuaggguggcagugguggagguggccuu

SEQ ID NO: 4151614 - RNA, 89 nt, Human
gaggcugcguggcuuucugagcugcuuuggggaugaaugagauggccagagcugagcauccuucguccacagaggggcuuguaguucuc

SEQ ID NO: 4151615 - RNA, 124 nt, Human
gaggcuggaucacaggcagaugcaucugagaggccagaucaggcacgcggcagacccaaggagcuucucggcccagcucugccugcugccugggggcuccagcugcugaaugccuugaagccuc

SEQ ID NO: 4151616 - RNA, 122 nt, Human
gaggcuggcuuggggaaguggcagagccagaggacagcugggugucccacuucugaccccucaaggcagcaauggcagcuuucggcucucaccuggacuccucgucuucucgagacagccuc

SEQ ID NO: 4151617 - RNA, 64 nt, Human
gaggcuggggacuccccaccauagcucggucccagcuggguuaaaguggcugucacucagccuc

SEQ ID NO: 4151618 - RNA, 66 nt, Human
gaggcugguggaucaugaggucaggaguucgagaccagccugaccaacguggugaaaccccaucuc

SEQ ID NO: 4151619 - RNA, 57 nt, Human
gaggcugguuugccuuuuggcacaguggaaauagcaugugcucuggagccagcucuc

SEQ ID NO: 4151620 - RNA, 66 nt, Human
gaggcugucaaauggcucuaaaaguucugaugcaucauagguccuauaggugucuuugccagcuuu

SEQ ID NO: 4151621 - RNA, 84 nt, Human
gaggcuguuaauugauauaaagaacuucagguagguccuaaccccuuauuugaugguugauuauaaaucaguuauucuugccuu

SEQ ID NO: 4151622 - RNA, 59 nt, Human
gaggcuguuauguuguaaacuguaaaauuccaagugcuguauuuacaacuuagagccuc

SEQ ID NO: 4151623 - RNA, 73 nt, Human
gaggcuuaauuaaggcauagcuuguguugacauggguauaaagucaaugcuuaguuugccugaagaaaguuuc

SEQ ID NO: 4151624 - RNA, 81 nt, Human
gaggcuucccagcagaggaaagacucugaccuuaacaaugaagaguuuuagacccccuuaugcaaggaagaagaguaccuc

SEQ ID NO: 4151625 - RNA, 60 nt, Human
gaggcuugacuuuaagaugcuuuuuuucagagaagucucaaucuuuggcucagaagccuu

SEQ ID NO: 4151626 - RNA, 64 nt, Human
gagggaaaggaucacagaggcgcugagccgggauggcuacguguacaaguacgaccucucccuc

SEQ ID NO: 4151627 - RNA, 63 nt, Human
gagggaaagguuaauacaugauguuaccuuguaugagcaacagaauauuuugccuuucucauc

SEQ ID NO: 4151628 - RNA, 78 nt, Human
gagggaaugagcugcaggauuauggaauggagucacaggugguuccagcucuucaguucugcaaauucucacucuguc

SEQ ID NO: 4151629 - RNA, 76 nt, Human
gagggaaugggcaggcgugauccugguggguucuggagcucuccgauuccacggcucagccucaacguuccgacuc

SEQ ID NO: 4151630 - RNA, 67 nt, Human
gagggacacaggauuccuggcucugccuguagccacagaaguacgccugagggauucaguuucucuc

SEQ ID NO: 4151631 - RNA, 84 nt, Human
gagggacauugaguuaaaggcacuuaacgugggaggaugcauucauagguaaccuuuugcaagugccuugaccuauuuuuccuu

SEQ ID NO: 4151632 - RNA, 74 nt, Human
gagggacgggcaccuuuuucuuaauauucaucauaaucacuugguacuuauuaugagccaggugcugucuacuu

SEQ ID NO: 4151633 - RNA, 79 nt, Human
gagggacugaggggcuuucaggcccagcuuugcucugcaaaagguuuacuguggcugugaaacuucucagucaccccuc

SEQ ID NO: 4151634 - RNA, 81 nt, Human
gagggagaaacagaagggaaagcuuuuacagaagguccccaaagggccaaagagaguuucuucuuucuuuucuuuaaccuc

SEQ ID NO: 4151635 - RNA, 66 nt, Human
gagggagagugauggaccauugauggaaaaugcuuuucugaagcuuaaugguuuucccuuucucuc

SEQ ID NO: 4151636 - RNA, 127 nt, Human
gagggagcgaaagauccuaaccugcuacaggggucacucagagauagccucauuuccauacucaggagacaggaugcauacucuugguuaaucuucugugugucucauuagucuuuauccuucccuu

SEQ ID NO: 4151637 - RNA, 66 nt, Human
gagggagcuucaacuuacuaaaagauagaagaaauucucuugcuugggaauuggagauacucucuc

SEQ ID NO: 4151638 - RNA, 72 nt, Human
gagggagcuuuccugcagguuucccccggacggaauguguuucguccugugcaccugccugcagagccccuc

SEQ ID NO: 4151639 - RNA, 66 nt, Human
gagggagggggaguccggggcgugccucccggcgauccuggcaagugggcucccagaucuucucuc

SEQ ID NO: 4151640 - RNA, 96 nt, Human
gagggagucuugcucuguugcccaggcuggagugcaguggcgcgaucucggcucacuacaaccuccgccuuccagguucaagcaguucucugccuc

SEQ ID NO: 4151641 - RNA, 98 nt, Human
gagggaguuucgcucucguagcccaggcuguagugcaguggagcaaucuuggcucacugcaaccucugcauccuggguucaagugauucuccucccuc

SEQ ID NO: 4151642 - RNA, 67 nt, Human
gagggaugcagaaacagaggcccuauguaacagauuaacacagccccucucauagucuguauccuuu

SEQ ID NO: 4151643 - RNA, 96 nt, Human
gagggaugugaacagagucaguggucaggggcuucugagcuguaguucucuacagcuuccaguauucuugaaaggccauuucuguaaacccccuuc

SEQ ID NO: 4151644 - RNA, 89 nt, Human
gagggcaagugaaacaucccuaguuacaguggucauuugggaaaaucuaaaugugcucccaaacgaccuacuguguuuacauuugaauc

SEQ ID NO: 4151645 - RNA, 58 nt, Human
gagggcagaguuagggucauaguggucaucacuaacacuuuccacugacucugacuuc

SEQ ID NO: 4151646 - RNA, 69 nt, Human
gagggcaggauggcagagaaaagggugcgugaaggcauaagcaccugaaauuuucuccauuucccccuc

SEQ ID NO: 4151647 - RNA, 102 nt, Human
gagggcaggauuaauugagcugcucuggucccugcuugauuuuauaguguuugcggagcaccuugagaucaagcaguguagaguuacugacuucugccccuc

SEQ ID NO: 4151648 - RNA, 85 nt, Human
gagggcaggucgaggugcugcuguacuucuugcggcuggaggccaucccugcccuggacagcaagagacagagcauccuguucuc

SEQ ID NO: 4151649 - RNA, 81 nt, Human
gagggcauucaaagccucugugccucuugcgcuguugcuuuugucgggggaguugaggcacauggggagauggacaccuuu

SEQ ID NO: 4151650 - RNA, 61 nt, Human
gagggccacguucagggcucucugcaaccaaauugaacgcacagcccuguucguggcucuc

SEQ ID NO: 4151651 - RNA, 55 nt, Human
gagggccaggcagcaagaaggccucccagagaggacaaucuuuggccuggcucuu

SEQ ID NO: 4151652 - RNA, 86 nt, Human
gaccaugauaaauguucuauccauucauugagaguaaacacagcagucaacucaagaaggaugagcuauugcuauuuaaaaugguu

SEQ ID NO: 4151653 - RNA, 78 nt, Human
gaccaugucuauuucuuacccacaauuuuaucuggcauagugccuggcaugcagcugugggcaagaaaugacaugguu

SEQ ID NO: 4151654 - RNA, 57 nt, Human
gaccauguucacuuucucagaaggccucccugccccucugggagugggaaaaugguc

SEQ ID NO: 4151655 - RNA, 59 nt, Human
gaccauuucaggggcagggacucuguuaaacauuacagagauguccucuccaaaugguu

SEQ ID NO: 4151656 - RNA, 57 nt, Human
gacccaacacuuuagauauucccuucuguuauuagaggaaauuuccaaggugagguc

SEQ ID NO: 4151657 - RNA, 67 nt, Human
gacccaaguccaggcuggcguagagucgcugcugggucaggagcguucuuguggcaggauuugcguc

SEQ ID NO: 4151658 - RNA, 114 nt, Human
gacccaauggcuuuuagugugucucaguuuuaauuuugcaaaucuggugcuuugcuucuaugaguuaccagcaaugcuagucaacucugagucagacauccugguguguggguu

SEQ ID NO: 4151659 - RNA, 59 nt, Human
gacccagagacaguuucacagggucuacaaagagauagacccagagacuggcucugcuc

SEQ ID NO: 4151660 - RNA, 57 nt, Human
gacccagcaugacaccugcacauggcagcugugugguaggcggucacugcuguuguc

SEQ ID NO: 4151661 - RNA, 62 nt, Human
gacccagccuaugaaacaccaaaaagaaggcaauuuucuuuguauucaguugggcugugguu

SEQ ID NO: 4151662 - RNA, 103 nt, Human
gacccaggccacgcuggccccgggguguccugugccaagcugggauagagccucucucccccagcaaguggacggcccacgcuagggcucgggugcugagguc

SEQ ID NO: 4151663 - RNA, 84 nt, Human
gacccaggugcuuuuagcaauuagaauccagcaugccaacuaaccggccauguuauguucaaauaugucuacuugcacccuguc

SEQ ID NO: 4151664 - RNA, 65 nt, Human
gacccauaggaaucuguuguccuugugaaucgaaugacugaaacagcuauucacuacuauggguu

SEQ ID NO: 4151665 - RNA, 74 nt, Human
gacccaucgauggcucuagaacuguucagaaaacucuguauggguuggcuggaauauguggagaccauuggguu

SEQ ID NO: 4151666 - RNA, 62 nt, Human
gaccccaggcagaucagggggugcuucugguccauguccccuguccugaguucuuggagguc

SEQ ID NO: 4151667 - RNA, 72 nt, Human
gacccuaaagaauguggcauaaaagccaagcccauuaggcuaggcaaguggaccagagguuuauuggagguc

SEQ ID NO: 4151668 - RNA, 63 nt, Human
gacccuagagaaauguacuagucuaacuccuuugcaggauuuggaaggcguuucucuguaguc

SEQ ID NO: 4151669 - RNA, 65 nt, Human
gacccucgcugucuuuuccacaccgcaaagcagccaugguuugggccugggcuggacagccuguc

SEQ ID NO: 4151670 - RNA, 61 nt, Human
gacccuggaggcuuggaacugcacugacagacaucugugcagcccuuccuuccucuggguc

SEQ ID NO: 4151671 - RNA, 63 nt, Human
gacccuucuucaaaugcuaguaauaucaucaucauggugacuguuuuuguuuggggcuggguc

SEQ ID NO: 4151672 - RNA, 87 nt, Human
gagaauuguguugucugugacacauucagaauuaagaguuggggauauuuuaauacuauaauuugaaguacuauagucauauuucuc

SEQ ID NO: 4151673 - RNA, 80 nt, Human
gagaauuuaaaucaugcuguggcuugcagcuggggcuguguauagcugaagaaaagccucacagcacaagauuguuucuu

SEQ ID NO: 4151674 - RNA, 83 nt, Human
gagacaaaauuggagcagugagugaauguugccuugaccucauggguguaguguuugcaucucauugauuuccacuuugcauc

SEQ ID NO: 4151675 - RNA, 84 nt, Human
gagacaacagauguauacaggguugacucauagauuuagaaaguuauuagugcauguuaaugguguacaaauguuaauuguuuc

SEQ ID NO: 4151676 - RNA, 75 nt, Human
gagacaaccugauagaagcagaagcauaccaauucccaggaguuaaugcuguuuacuuuagucuccguuguucuu

SEQ ID NO: 4151677 - RNA, 69 nt, Human
gagacaagccaauuacugugccagguuagagaagaaaggagacaggccacaggcacagaggcuugcauc

SEQ ID NO: 4151678 - RNA, 101 nt, Human
gagacaauucauaucauauggccuuuacuuucucaaguauauaggaggcgagauuccuauuggcugaaagugaagaagauacacauggauuugaggguuuu

SEQ ID NO: 4151679 - RNA, 60 nt, Human
gagacacuggagagagaaacaggacugucagauaaagggcgucugugacuccuagaucuc

SEQ ID NO: 4151680 - RNA, 94 nt, Human
gagacagaguuucacucuuguugccuaggcuggaaugcaguggcgcaaucucggcucacugcagccucccagguucaagugauucuccugccuc

SEQ ID NO: 4151681 - RNA, 88 nt, Human
gagacagaugaggcccaaacauuacaaaugcuuuggaaaaauacacucauuuuauuugguguuugugcuuugacuaaacaucugacuc

SEQ ID NO: 4151682 - RNA, 82 nt, Human
gagacagauucaugaagcggagcauuugaacuugaacuuuacaccagugauuuaaaacaguguuuugcuuagaauuuggauu

SEQ ID NO: 4151683 - RNA, 63 nt, Human
gagacagccuacuccagucucagauuggaccacacaggguugggccugguuugugggugucuu

SEQ ID NO: 4151684 - RNA, 99 nt, Human
gagacaggagaaucgcuagaacccgggagguggaggucgcagugagcugaggucacgucacugcacuccagccugggcgacagagugagacuccgucuc

SEQ ID NO: 4151685 - RNA, 100 nt, Human
gagacaggagaaucgcuugaaccuuggaggcggagguugcagugagucgagaucgcgccacugcacuucagccugggcgacaagagugaaacuccgucuc

SEQ ID NO: 4151686 - RNA, 102 nt, Human
gagacaggaggaucgcuugagccuacggaggucaaggcuacagugagucgugacugcaucauuguacucuagccucugggcaacagaaugagauccugucuc

SEQ ID NO: 4151687 - RNA, 74 nt, Human
gagacaggaucuucuauagauauucugaagggaacuuccagacuuuuucagaaggcuuaggaguuuacgguuuu

SEQ ID NO: 4151688 - RNA, 67 nt, Human
gagacaggauuaguguucuuaucuucuaggucaagugcaaucuaggugguagaucacuaggcugcuc

SEQ ID NO: 4151689 - RNA, 77 nt, Human
gagacaggcagaaaagagcccugaaggacaaggucuggggaaccuggauguccucaggaaggcuuucugacuguguc

SEQ ID NO: 4151690 - RNA, 65 nt, Human
gagacaggggagagugaagagguagggagcccggcagucuuugcugaguacaucuccaaagucuc

SEQ ID NO: 4151691 - RNA, 68 nt, Human
gagacagggugaucgcuugagcccagaaguucaagaccagccugggcaacacagggagacccugucuc

SEQ ID NO: 4151692 - RNA, 111 nt, Human
gagacaggucugaagucaggugauuuccaugcaucuaauaccucauuuaaucucacaacaaaucuacuggagaugggaugacauuaauggagcugauauuaugcccguuuc

SEQ ID NO: 4151693 - RNA, 86 nt, Human
gagacagguuccugaguccccagacucccucccagacaggcagccagguggaagggaaaguuugggguccagcgccugcacuucuc

SEQ ID NO: 4151694 - RNA, 79 nt, Human
gagacauaauuuccaagugccuuuugaauuguuuucauuucccuagaaauaaacauugagugccuuugguauuggucuc

SEQ ID NO: 4151695 - RNA, 64 nt, Human
gagaccaagcuguauauuauugguuacaguuuucaguaacuugauaauuuaaguuuggguccuc

SEQ ID NO: 4151696 - RNA, 64 nt, Human
gagaccagucaucuuuuuaccagaauguuguauguuucugagugaucagaugcauugcuuucuc

SEQ ID NO: 4151697 - RNA, 74 nt, Human
gagaccaugugagcacgcccgaggcggcccggagaggggcggggcuucggaaugggcgaggccugauguggcuc

SEQ ID NO: 4151698 - RNA, 63 nt, Human
gagacccaucuucccagaccuuacaugugauccuuucagagaugacucaugggauuggguuuc

SEQ ID NO: 4151699 - RNA, 93 nt, Human
gagaccguaaucacugagcaguggcugaagauguuccuggaaaccauucuagccagaagccaaacugugaaucaggaagauacgggacaccuc

SEQ ID NO: 4151700 - RNA, 107 nt, Human
gagaccucucagaaucuuacgagguuggagaguuguuuggaaugcuggguucuggucuugucucugcuuccaaccagcuauggaaucuuguguauucuuucagucuu

SEQ ID NO: 4151701 - RNA, 73 nt, Human
gagaccuucuagcucaaaauuccguuuuaguacaauugaaaaacugaauuucaaagagguuaagagguguuuc

SEQ ID NO: 4151702 - RNA, 81 nt, Human
gagacgaggagguuggggcugcagugagcugugaucaugccacugcgcuccagccugaguaacaaagugagacccugucuc

SEQ ID NO: 4151703 - RNA, 110 nt, Human
gagacggagacggagucuugcugugucaccaggcuggagugcaauggcgugaucucagcucaaugcaaccuccgccuccuggauucaagcgauucuccugccucagccuc

SEQ ID NO: 4151704 - RNA, 55 nt, Human
gagacggaggauggcaucaucugugaauaacacagaugaugccauccuccaucuc

SEQ ID NO: 4151705 - RNA, 98 nt, Human
gagacggagucuugcugugucaccaggcuggagugcaauggcgugaucucagcucaaugcaaccuccgccuccuggauucaagcgauucuccugccuc

SEQ ID NO: 4151706 - RNA, 68 nt, Human
gagacggguagaucaccugaggucaagaauucaagaccagccuggccaacauggugaaaccccgucuc

SEQ ID NO: 4151707 - RNA, 68 nt, Human
gagacggguggaucacuugaggucaggaguuugagaccagccugaccaacauggugaaaccuugucuc

SEQ ID NO: 4151708 - RNA, 70 nt, Human
gagacucuuaagccaguggccuuccuguguuugucaaacuaaacuuuggauugugauugugccgaguuuc

SEQ ID NO: 4151709 - RNA, 90 nt, Human
gagacucuugggucagaggcaaagaacuuuauuacagcaauagcaguagcuagagcauuugcuuuaucuuguacugauucucugagucuc

SEQ ID NO: 4151710 - RNA, 61 nt, Human
gagacucuuucguuuccugguucucacacguggaauuuggaucuuugauagaguaggucuc

SEQ ID NO: 4151711 - RNA, 89 nt, Human
gagacucuuucuauuauuauucacuugacuuugucauuugugcugacauacagccaaagaucagugugcaaguuauuaaagagaguuuc

SEQ ID NO: 4151712 - RNA, 72 nt, Human
gagacugaaacugaggaaguaaaauuccuuggaguaugaaaauaacagggaguuuuuguuccucuagguuuc

SEQ ID NO: 4151713 - RNA, 99 nt, Human
gagacugaggcaggacaaucacuuagaacccaggaaguggagugagcagagaucacgcuacugugcuccagccuaggugauagagcgagucucggucuc

SEQ ID NO: 4151714 - RNA, 82 nt, Human
gagacuuaagacagacuuugaucuggauguugauaucacauugguucauagacaucgguucaaaacucuguaugaagcuuuc

SEQ ID NO: 4151715 - RNA, 61 nt, Human
gagacuuaugaggccucagagaaacauguuucagacagaggagcucgugcagaucgguuuc

SEQ ID NO: 4151716 - RNA, 68 nt, Human
gagacuucuucccagcuucccucacccuggugcuccucaggagaggccaaaaugagaagagaggucuc

SEQ ID NO: 4151717 - RNA, 61 nt, Human
gagacuuguacaaagauuucacagcuccccuuuugggauggauucuucuuuguacuaucuc

SEQ ID NO: 4151718 - RNA, 61 nt, Human
gagacuuuuuaaucacuaggaaugcuuucacauuugcauuuucgguuuaagaaaaaguuuc

SEQ ID NO: 4151719 - RNA, 129 nt, Human
gagagaaaaggagaggauaaugagugaaaugcaaugcagcaccuccuuggaacacacaguuacaauucaguucacagggcacacuggcucaccguauuuuuaacuaguuucucuccccaccuccuuuuu

SEQ ID NO: 4151720 - RNA, 119 nt, Human
gagagaaagauuuguccagggaauauagaaaauacugaguuagaguuaauuuccuaacacaugacuuguguucgauaaagguuuaaaguacuuuuuguuuggauuucgucuguucuuuc

SEQ ID NO: 4151721 - RNA, 75 nt, Human
gagagaaugaaaugaauggcuaucggauuauuaggaucuuuuuuaaacacccaagucauuucuuucuaucugcuc

SEQ ID NO: 4151722 - RNA, 65 nt, Human
gagagaaugugguauuuuaguuuaaguuagaaagaaagcacuuacuuuaggaaaccacuuuccuu

SEQ ID NO: 4151723 - RNA, 67 nt, Human
gagagaauuagggcguaauucagacaauugaaugcauacuuucuggagcuacaguccugaaccucuu

SEQ ID NO: 4151724 - RNA, 95 nt, Human
gagagaauucaaaguucgaaauuuagggagauggggcagaguagcuaauuucuggccaaaacaucuuuuuauauuucuuagcacagaaaucucuc

SEQ ID NO: 4151725 - RNA, 97 nt, Human
gacucaagcccaguagacuuuccuuugucccucuguguugggcaugccucagccuccugaaucagccccuggagggcauugaggcuggcuugauguc

SEQ ID NO: 4151726 - RNA, 73 nt, Human
gacucagguauaaaagcuagguagucucaguaaaaauaauugggccaaauagcuauuuacuacccaugagauc

SEQ ID NO: 4151727 - RNA, 60 nt, Human
gacucagugguugagagccugggccuccuagccagaggaccuggcuuugaaucuugacuc

SEQ ID NO: 4151728 - RNA, 85 nt, Human
gagagcagacacugccuucuuugaaguuccccuggaagaggccagacuuuuccacucugacauucagugagcacuguugcuacuc

SEQ ID NO: 4151729 - RNA, 84 nt, Human
gagagcaguagcagacuucuccagacugccugguaacucgaaagauuagugggaagacagaggaaaggaugugaacugcaucuc

SEQ ID NO: 4151730 - RNA, 69 nt, Human
gagagcccaucuuagcauagacccucugcccauguggucgggagggugcugugccaagaugaccuaguc

SEQ ID NO: 4151731 - RNA, 74 nt, Human
gagagcccuccuccagcugaguaagaacacuaugcuuugguuaugguuucaugagaggccgggggagccuuguc

SEQ ID NO: 4151732 - RNA, 72 nt, Human
gagagccuacuucuagggagacaaccugucugauacaguuagagcauccagaaaacucucagaagagcucuc

SEQ ID NO: 4151733 - RNA, 59 nt, Human
gagagccucugugacucacaggucacacauccgugaagcuguccuugauaggggcacuc

SEQ ID NO: 4151734 - RNA, 56 nt, Human
gagagccuggagguucugcugaagcaagucguugcuuucuagaaugacugguucuu

SEQ ID NO: 4151735 - RNA, 103 nt, Human
gagagcuauaaauucuuagcaguuuuuaaguuugaaaauaccuuuugugauaccuuaauuauagcauuuauuccagauuuggagaauggaguuugaaguuuuc

SEQ ID NO: 4151736 - RNA, 57 nt, Human
gagagcugcaacuucauaggccuucaggaguggcccugagguggguaagcaguucuc

SEQ ID NO: 4151737 - RNA, 56 nt, Human
gagagcuggauccugauucgucuuugagcuccucaaaggaacaaggcuucagccuc

SEQ ID NO: 4151738 - RNA, 63 nt, Human
gagagcugggcaugugaccaacagaacugcacauguguucugcgggcugucugccuuuuucuc

SEQ ID NO: 4151739 - RNA, 56 nt, Human
gagagcuggguucaaguagcugacaaaaugcagaaugagauuuguaacuagcucuu

SEQ ID NO: 4151740 - RNA, 79 nt, Human
gagagcuguggucaggaaguggcauuggagaauaaagagaggcacagauucucccucccaaccuugauaaacagaguuu

SEQ ID NO: 4151741 - RNA, 62 nt, Human
gagaggaaacugauguuuuuuacaauggccaacuguaugucuaaauuuucaguucuccuuuu

SEQ ID NO: 4151742 - RNA, 57 nt, Human
gagaggaaagaaccaaugacccaacucaaagcagucaggcagcaggaguuuccucuu

SEQ ID NO: 4151743 - RNA, 61 nt, Human
gagaggaaggaugcauauccaaagauuuuauguuuaucuugaggguucuaucuuguuucuc

SEQ ID NO: 4151744 - RNA, 81 nt, Human
gagaggaaguggagagcccuggaggucucacaacuucuauuuggaauuaacagauccacacagggcaucuugacucuucuc

SEQ ID NO: 4151745 - RNA, 56 nt, Human
gagaggagaagccugcgcuucagcucgugggccuuuuucuguagcuucuccuucuc

SEQ ID NO: 4151746 - RNA, 62 nt, Human
gagaggagcccugaggugaaggacugggaaaauguacagaaaaucucacaucagcuccuagc

SEQ ID NO: 4151747 - RNA, 71 nt, Human
gagaggaugggcugcuguggaugcaggaccucaggaaagguugaggcugagccacuggcagagcgcugcuc

SEQ ID NO: 4151748 - RNA, 84 nt, Human
gagaggcaaagauugugucuuguuugugucugucagaggccuagcaaagugccuagcacagagaagauuucaauuaacacuuuc

SEQ ID NO: 4151749 - RNA, 83 nt, Human
gagaggcagguuugaaaucugucccacuuuagcugagccacuuggggcagguuauaggacagauuuguuauacuccagcucuc

SEQ ID NO: 4151750 - RNA, 73 nt, Human
gagaggcauuauugagggagcagcugaaauuuauauucccgaucaguggcagcauucacaagugaugucucuc

SEQ ID NO: 4151751 - RNA, 58 nt, Human
gagaggccaaaaucccugccccauugcccccagcuggcagggugggguugguuuucuc

SEQ ID NO: 4151752 - RNA, 56 nt, Human
gagaggcuccgccacugcucagggucaaaagcccugcgcuagaacccaagucucuc

SEQ ID NO: 4151753 - RNA, 68 nt, Human
gagaggcugugugccauuguugcuagaggauugaaaaguauuucacacaggcugcgcauaagcuucuc

SEQ ID NO: 4151754 - RNA, 58 nt, Human
gagaggcuuaagggcugugaaggaaacaccugaaauuccauaauagcuagugccuuuc

SEQ ID NO: 4151755 - RNA, 59 nt, Human
gagaggcuuggaggugcaagguuugaaauugcuuaaaagcugaauauguccaucuucuu

SEQ ID NO: 4151756 - RNA, 57 nt, Human
gagaggcuuggccucaguucuguaggcaucuggggagucauugaagucaggccccuc

SEQ ID NO: 4151757 - RNA, 55 nt, Human
gagagggagccagccaggaaccgggaaacuugccucugcucuuggauucccucuc

SEQ ID NO: 4151758 - RNA, 68 nt, Human
gagagggaggaagggaggaagugaagaaggaaagagaaagaacuuuuaucagccauuccuuaccuuuc

SEQ ID NO: 4151759 - RNA, 63 nt, Human
gagagggagguaggcagggcacccuggaccuucuggcaccuuccuucuugccugcacccucuc

SEQ ID NO: 4151760 - RNA, 58 nt, Human
gagagggcaggccaucacccgaggucacacagaaaacccacaguggcagccccuucuc

SEQ ID NO: 4151761 - RNA, 90 nt, Human
gagaggggaggacagagggaaggagaguuguagcugaacaaaagagccaugaaaugcuuagcuguucucucuuugccauacucccucauc

SEQ ID NO: 4151762 - RNA, 78 nt, Human
gagaggguccccaaaagacaggugucugcggcccuuccagcugucggagugggagggacgggcacggagggcccucuu

SEQ ID NO: 4151763 - RNA, 59 nt, Human
gagagggugggaugaggaggaagagaaaggucuugaacguuuauucagccuacccucuu

SEQ ID NO: 4151764 - RNA, 63 nt, Human
gagagguguggcccaaagcacugcagccauuuugaaugccagagcuuucugucacauuaguuc

SEQ ID NO: 4151765 - RNA, 61 nt, Human
gagagguuccucccugcuuuacggccuggcugucagcuuuuuaguucaugagggauuucuc

SEQ ID NO: 4151766 - RNA, 79 nt, Human
gagagguugcuggaagcuaugguccaguucuauuuuuauauauggucugaccauggucuauuuagauauucagccucuc

SEQ ID NO: 4151767 - RNA, 94 nt, Human
gagaguaaaauucuacuguagagauuaacucaugguuuuaccgucaggaaaacugguaguuuugaguuaaucucuacgauagaauuucuuucuc

SEQ ID NO: 4151768 - RNA, 90 nt, Human
gagaguagaucuuauagaaguggcagcucagccuucccacuccuugacccuucagaggcccagggcugcucucugaauuuccccacucuc

SEQ ID NO: 4151769 - RNA, 61 nt, Human
gagaguagcagcaggaagcccuggcuugcagaccuaagcuggggcuccagcugugauucuu

SEQ ID NO: 4151770 - RNA, 75 nt, Human
gagagucagaagaccagggguugaguccuagcucugucccugacuugcuaggucacuguuggugggucuggccuc

SEQ ID NO: 4151771 - RNA, 61 nt, Human
gagagucgccugcacaugucaggguuagccagggagccauggcaggaaccaggaggcucuc

SEQ ID NO: 4151772 - RNA, 77 nt, Human
gagagugacagaagcagccgucacagauaggagcucucauuccucaugcucuuugaauguuucuucugaagucucuc

SEQ ID NO: 4151773 - RNA, 67 nt, Human
gagagugagggagacgcucaagacagauucucauauuuuaauaucugaagcaauauccccucacuuc

SEQ ID NO: 4151774 - RNA, 74 nt, Human
gagagugagugguggaguuuggguuuugaacacaacguguugucuucagggccugagcuuuuaauuaccaccuu

SEQ ID NO: 4151775 - RNA, 93 nt, Human
gagagugccugagggaucuauuuugggaccgcugucacuuggcucuucugcuaauaagcuuccagugugguggcccuccuucaggcauguuuc

SEQ ID NO: 4151776 - RNA, 71 nt, Human
gagagugcucacugcagucuucaucaaccaacuucuaagugggugucaaugaggagcagccucacgcuuuu

SEQ ID NO: 4151777 - RNA, 89 nt, Human
gagaguggaggcgugcggacauggguugcucaccuggcacuguugcagccacauugccgccacccuuaucccaugcuucucaaacccuc

SEQ ID NO: 4151778 - RNA, 56 nt, Human
gagaguguggagagguaguaguguggcuaacccagugcugaaucugccauauuuuc

SEQ ID NO: 4151779 - RNA, 77 nt, Human
gagagugugggaugcuguauuuaaggggaagucugaagagggacuugcuguuuuacuuacaagcucucucacuacuc

SEQ ID NO: 4151780 - RNA, 81 nt, Human
gagaguguuuccacugcucauuccacaggcaagccacagauccuggccacuccuugccuuggaggcaguacagacacauuc

SEQ ID NO: 4151781 - RNA, 63 nt, Human
gagaguuccacucauggcuucagggucaaccaacuuguugacccugagagcugaauggcuuuc

SEQ ID NO: 4151782 - RNA, 63 nt, Human
gagaguuccaguaaguggauucaggccuuuccuuuaggcccuaaguccugcuucugaacacuu

SEQ ID NO: 4151783 - RNA, 73 nt, Human
gagaguuugggauaagacagggacagggcacaguuaguugucagcuguuaucacugucuguccauggauuuuc

SEQ ID NO: 4151784 - RNA, 74 nt, Human
gagaguuuuuuacacuaugaaugagaauauaucuaguaaguaguucuggguauguuguggccugaauaacuguc

SEQ ID NO: 4151785 - RNA, 89 nt, Human
gagauaauuccagcucauauuuuaugugcagugccauacuauauuuuuaaguacaaugcauauauugauggguaaucaugguuuuucuc

SEQ ID NO: 4151786 - RNA, 92 nt, Human
gagauacaaucccaagguagccucuugagaugaacauggauaauugcuccaauguuauuaucuagaggcaaggaccuugagaaaugagucuu

SEQ ID NO: 4151787 - RNA, 68 nt, Human
gagauacaugcaucagccaguggcaaaggcuguauccagcuuccagcaaacacuggcugcuuugccuc

SEQ ID NO: 4151788 - RNA, 62 nt, Human
gagauacauuugugugcauguauguguacgugugugugcauguaugcauauauauguauuuu

SEQ ID NO: 4151789 - RNA, 83 nt, Human
gagauacauuuuuaaaccuaucuaagaaauagcccugauauugaaauggcuucuguggaauagguuugacagguguaagucuu

SEQ ID NO: 4151790 - RNA, 91 nt, Human
gagauacuaguaaguuaaaaacacuugauaggucaaaucagucugaacuuucauauugguagaaguaugaagugcuaaauaacuaaauuuc

SEQ ID NO: 4151791 - RNA, 75 nt, Human
gagauacugauuuuaauaagauccauuuggugccuuaaucaccaaaucucggacaggauuaaguauagauaucuu

SEQ ID NO: 4151792 - RNA, 65 nt, Human
gagauagcacucccacaccugcugacuguugacucugugugggcagggcaugaggugugcuucuc

SEQ ID NO: 4151793 - RNA, 66 nt, Human
gagauagugcuggcaggauagaagucuaaucaugaaaaugacauaccuuugcuuuugccauaucuu

SEQ ID NO: 4151794 - RNA, 90 nt, Human
gagauauguagggcaguuuagcacaacaucuggcaccugguaagcucuugguaaauguugauuguggcuauuuuugucccugguguguuc

SEQ ID NO: 4151795 - RNA, 60 nt, Human
gagauauuaggaggauucauaaugcacauggaaaugucaacuaugguauucugauguuuc

SEQ ID NO: 4151796 - RNA, 64 nt, Human
gagauauuuuuaaguguaauugaauuucauaaauaugacauuugguaacacuugagcauguuuu

SEQ ID NO: 4151797 - RNA, 90 nt, Human
gagaucaagguucauguuuucguuauucaauacuuuaucaccaggacuccccacagugaugaauuaguaacaaaugaggaaucuggccuc

SEQ ID NO: 4151798 - RNA, 75 nt, Human
gagaucauaauaauagcaguagcugccacugaggccuggcccugugccagaugcugcuuuguuuugcaugguuuc

SEQ ID NO: 4151799 - RNA, 56 nt, Human
gagauccccacaggagaagagcgggcuccgcauuccugcuuuuccccuuuggacuc

SEQ ID NO: 4151800 - RNA, 121 nt, Human
gacuccaguuuccaucccaggcccuuggggcucacauccuucuccaaaacuggcucccuggcaaggccaggccaggccaggcaggggaaggggcagucugggcccauaacucagccaaguc

SEQ ID NO: 4151801 - RNA, 70 nt, Human
gacucccgcggcuucccagaaugagggcuuugcagagcccucucuguaggcaaguacuuggcaggggguc

SEQ ID NO: 4151802 - RNA, 69 nt, Human
gagagagcauuuucaucguggcagaaauccuauuugcaacauugcccuggacaaugaauguguucucuu

SEQ ID NO: 4151803 - RNA, 58 nt, Human
gagagagcuaacagaagagcaaauguuuauugagugcucuauguguuauagcuguuuu

SEQ ID NO: 4151804 - RNA, 84 nt, Human
gagagagggagagaugguacagagaagguuacauaugaacacggagauucuguagcacuuuuguauucuccuuggaguacucuc

SEQ ID NO: 4151805 - RNA, 71 nt, Human
gagagagguggucucugagauuccaggacaaugaugauaauggcaguucugacucaucccaccaccuccuc

SEQ ID NO: 4151806 - RNA, 55 nt, Human
gagagauuacaguaaucucuguucacuggggcagcagaaaauaccuguaacucuu

SEQ ID NO: 4151807 - RNA, 106 nt, Human
gagagcaacugagacgggagggcuggugacagaagugccauacugugguccaccaaaaggugggaaacugcaguuccugccaagcccuuauccuguaguuccucuc

SEQ ID NO: 4151808 - RNA, 99 nt, Human
gagagcaagcuaguggauuugccucucagagucuacacagccaagugucacaacuuagagggugagugccuuugauugggcauguuccuggccagccuc

SEQ ID NO: 4151809 - RNA, 88 nt, Human
gagagcagaggguaggucagggaucugggcucagcuggagggagguccuccaagcauguggucaggagcccgccucucuccagcucuu

SEQ ID NO: 4151810 - RNA, 84 nt, Human
gagagccaaagguuuagggguucuauguuuaaguuucauccuuuuagcagagaucauagaacaccuaccuaccugucugcccuc

SEQ ID NO: 4151811 - RNA, 73 nt, Human
gagagccauuucauaaguugguguugacuuucucacaaaacugacaaaaguuggacgauuugugaaggcuuuc

SEQ ID NO: 4151812 - RNA, 68 nt, Human
gagagccgggaggggagugggcaggccuauuugucauagugcuuuggagcuuucuccuuucaucuuuu

SEQ ID NO: 4151813 - RNA, 71 nt, Human
gagccuagagacauaaguucaagaacaaagucuuugaccacaacaaguuuuugagcauguacuuugugcuu

SEQ ID NO: 4151814 - RNA, 90 nt, Human
gagccuaggaauugagcuucuuuuccuguggcucauccaugggucagacaccauggugaggaggaggaagagugcugagugucugagcuc

SEQ ID NO: 4151815 - RNA, 75 nt, Human
gagccucuguggcagggcucugcuguaguccuagugguagccauuggaacagugggccuugccugugcaggguuc

SEQ ID NO: 4151816 - RNA, 56 nt, Human
gagccugcgagggaguaaggcagagagcacuauuuugcagauuugaaagcaggcuc

SEQ ID NO: 4151817 - RNA, 72 nt, Human
gagccuggagucagcaagaugaaucagcaggagcccgaaggcccugccaucagccuugcugcagccaagcuc

SEQ ID NO: 4151818 - RNA, 59 nt, Human
gagccugggccugcacuaggcacagaguacagcccuuguccuugggcagugcccagcuu

SEQ ID NO: 4151819 - RNA, 75 nt, Human
gagccugucaaccaaggacagcuagugaugccacaaauguggcuguucucacuucccugucugugcagacaucuc

SEQ ID NO: 4151820 - RNA, 84 nt, Human
gagccuuacugucuucaguggcaaauggaucugucaacaggcuccauugccugggguuguugcugcugagauuaagggaagcuc

SEQ ID NO: 4151821 - RNA, 64 nt, Human
gagccuuaggaggucugcuuaucucucacagcaaugagcuggcagaggauggggacccaggcuc

SEQ ID NO: 4151822 - RNA, 62 nt, Human
gagccuucagugauuacccagaguuaagagaaugauuuaguuucuggcacacugagaagcuc

SEQ ID NO: 4151823 - RNA, 82 nt, Human
gagccuugauuuccucaucuguaaaacggggcugggaaggccuagcucccaggcagucaugaggacagaagagaacaggcuc

SEQ ID NO: 4151824 - RNA, 93 nt, Human
gagccuuggggugagacuucauugguucaagauuguucucuaccacuuuacacauucuuggacuuccaggaaguauuuaaccuacuaaggcuc

SEQ ID NO: 4151825 - RNA, 59 nt, Human
gagccuuucuugguuugucaggcagauacaccucuggccugauuuugcuaagagaauuc

SEQ ID NO: 4151826 - RNA, 90 nt, Human
gagcgagaguucagaacacacugggggaaacaagaugguccauuugcuaagaaacuuguggaacucccaggugagaaggggucucuguuu

SEQ ID NO: 4151827 - RNA, 66 nt, Human
gagcggaggcuuggaggccagcccugcuccucuuucugccugaacugggccucucaagccucccuu

SEQ ID NO: 4151828 - RNA, 73 nt, Human
gagcggcuagggcuucaggugugaggcaggagggguggggccagaacugcccacaccugagcugggccggcuc

SEQ ID NO: 4151829 - RNA, 61 nt, Human
gagcggugggaagcccaagagucacuguaguuucaccaggacacuggcuugucccgccauc

SEQ ID NO: 4151830 - RNA, 84 nt, Human
gagcuaacaucaaagggggagagguguuuggaugcuuagagagccagccuccgcacguuucucauccuccauugaaugcagcuc

SEQ ID NO: 4151831 - RNA, 62 nt, Human
gagcuacaaauccacaaggcacuuuauggcaauuccaagaaggggcugaaagguuuguguuc

SEQ ID NO: 4151832 - RNA, 62 nt, Human
gagcuacaacucagaguuccugugcauagugguuccauugaauucacagaucugagaaguuu

SEQ ID NO: 4151833 - RNA, 116 nt, Human
gagcuacaugguggcugagaaccuguuggggcagggguggugcuaucuccacagucccaccuggagacuguguggaccacucugaggcucaggagggaacaaaagcugccaagcuc

SEQ ID NO: 4151834 - RNA, 60 nt, Human
gagcuaggcuagggggagucgcugauucugcuuuucucugugguccccugagucuggcuu

SEQ ID NO: 4151835 - RNA, 55 nt, Human
gagcuagucaucugguugaacaagccugaaaggcagaagucauccaugacagcuc

SEQ ID NO: 4151836 - RNA, 65 nt, Human
gagcuauuggcagcauccaagucucgggauccaguuguuccugagaccaaguugcagccaugcuu

SEQ ID NO: 4151837 - RNA, 76 nt, Human
gagcucaaauuuuccagugagcaaauguagaauuuuaauuagcuucgaguccauuucucugcuggaaauagaucuc

SEQ ID NO: 4151838 - RNA, 82 nt, Human
gagcucaagacaaaugaaaacggaccagagcuauuccaccacguagugaaauccuggauuuuucaagucauguccugagguc

SEQ ID NO: 4151839 - RNA, 99 nt, Human
gagcucaccuccagcagaggaagagacaaauggugccgaccugcuccacuccugggacuggcagagguuggacaccauuccuuucucagagaggugcuc

SEQ ID NO: 4151840 - RNA, 57 nt, Human
gagcucagggcauugagcaagaaaacauacuuuuguaacaguagugcucugagacuc

SEQ ID NO: 4151841 - RNA, 69 nt, Human
gagcucagguggucaaaacaauucuaaugaaguugaguuucuacuucaauuguuuuguaucugagacuc

SEQ ID NO: 4151842 - RNA, 97 nt, Human
gagcucauugccuuccaaggccaguuucuucgccuaaugaaucacugcaugagggcgugacuagggcgaggacugacucugggcaggccuggggcuc

SEQ ID NO: 4151843 - RNA, 72 nt, Human
gagcucccguuagugauuauaaaacaguuuuuuucucuuugaaaagcagaaaaugaucacaaccuugaguuc

SEQ ID NO: 4151844 - RNA, 96 nt, Human
gagcucccucacuggcccaccaggcagcucugauuuaugucugauccucuucagauguccagcgucuggcugccuguggccuggagggacccccuc

SEQ ID NO: 4151845 - RNA, 119 nt, Human
gagcucgauagagagggagcagaggguuagcagauuuggaaaaugagaugaaaugaaguucaaauuaggaauuuguacaaauuuauguuaguucuucuguuacuauuacuagugggcuu

SEQ ID NO: 4151846 - RNA, 77 nt, Human
gagcucgcccccucaucugugagugcagaagccuggaagccugagcucaucugccuggaugauggcagggcgagcuc

SEQ ID NO: 4151847 - RNA, 108 nt, Human
gagcucuagaacuuccuucgugguacucaaggcuuccugggaauuccuucgucguucucaaggcuguccuggagcuuccuucaugguacccagggcuuccuggagcuu

SEQ ID NO: 4151848 - RNA, 59 nt, Human
gagcucuauguggcuggcaugucugccucgcucgggggacauugcuguucagugggcuc

SEQ ID NO: 4151849 - RNA, 129 nt, Human
gagcucuccagaugaugcuaaucugcagccagggcugagaaccacuggaugagaugagcucucaggacccugacaucucaggucugugguucacuaccccuggugcacaauaacaucuucugggagcuu

SEQ ID NO: 4151850 - RNA, 80 nt, Human
gagcucuuuuccaugucaauaaauauaacugcaugcuaucauuuuuaguggcugcaauauguugcauuguauggaugcuc

SEQ ID NO: 4151851 - RNA, 63 nt, Human
gagcugaagaugucagaaccguucagaaauacugccuggggaaaguucuugguucuucggcuu

SEQ ID NO: 4151852 - RNA, 103 nt, Human
gagcugaggaucuggacaguccaaaaagugcagcccaagagacucuguugaccucaaucacagauuuuucuccagggcuuuguguuuuuguccucuuuggcuu

SEQ ID NO: 4151853 - RNA, 61 nt, Human
gagcugaggcucaggcuggcguuaucuggcugcagcagccgccgccugcaggccucggguc

SEQ ID NO: 4151854 - RNA, 56 nt, Human
gagcugaguagaggcugcucccuucaggacaagguguacggucuccaacucaguuc

SEQ ID NO: 4151855 - RNA, 102 nt, Human
gagcugcagagugggaaacuaugggaugggcugggaauacacaggggaggaugccuccuuaaaguaggcuucggacuauguauauggauccccuuugggcuu

SEQ ID NO: 4151856 - RNA, 71 nt, Human
gagcugcauucaacauauucugaguaaaauaggccaauggccauuuuaaagacauuauaugugaaucacuc

SEQ ID NO: 4151857 - RNA, 84 nt, Human
gagcugcauucaauggaggaugagaaacgugcggaggcuggcucucuaagcauccaaacaccucucccccuuugauguuagcuc

SEQ ID NO: 4151858 - RNA, 55 nt, Human
gagcugcugcaguggucuugcuggaaaaccccucuagcaccuguguagaagcauc

SEQ ID NO: 4151859 - RNA, 60 nt, Human
gagcugcuggaaagugagcugucgccgauggcacucauaccagcuccuguucagcagcuc

SEQ ID NO: 4151860 - RNA, 93 nt, Human
gagcugcugugaaaauuggagcucagaggaggcagcuuaacucaguagcagagcagaaagcacugauaaguugcuugcucucaauggcggcuc

SEQ ID NO: 4151861 - RNA, 55 nt, Human
gagcugcuuuguuucagauuacauuuguaccucugaaaucuguaagcacuagcuc

SEQ ID NO: 4151862 - RNA, 73 nt, Human
gagcuggagccuccaugcccaacucugcucugcucuucuauuuccugacagcagcuaaggcauguuccuguuc

SEQ ID NO: 4151863 - RNA, 57 nt, Human
gagcuggcaagucuguccuuggcaguugccaagagguggguuggacagauacagcuu

SEQ ID NO: 4151864 - RNA, 58 nt, Human
gagcuggcuccgccaugcugcuccccacucaugcagagcaagcauugcugguuagguc

SEQ ID NO: 4151865 - RNA, 59 nt, Human
gagcugggacuuggaauccacagaggugaaacgguggggcaaauccaaucacucggcuu

SEQ ID NO: 4151866 - RNA, 66 nt, Human
gagcugggagcugggauuuggaucugcagcugggcgacuccgaagcuuuugcucuuucuaaugcuc

SEQ ID NO: 4151867 - RNA, 59 nt, Human
gagcugggaggacugggaacuugggaagccagggugaauuuucucauuccuuuccacuu

SEQ ID NO: 4151868 - RNA, 75 nt, Human
gagcugggaguuauagcauguuuuuaaauuguuuaaaguaaagcuuugcuguuaacaagcacucaucccuggcuc

SEQ ID NO: 4151869 - RNA, 56 nt, Human
gagcugggauuugaaccugggacuuccaccuuuguagucccuguuucucccggcuu

SEQ ID NO: 4151870 - RNA, 56 nt, Human
gagcugggcacacgccacuugacuguguggaagaggguggaugucugcaccagcuc

SEQ ID NO: 4151871 - RNA, 64 nt, Human
gagcugggcucugcggugucgcucucugggacuggagcggugaggacgcagaagccccaaccuc

SEQ ID NO: 4151872 - RNA, 58 nt, Human
gagcugucuugaaaauaagcuggagggauuaucacucucucugggucgagacagacuu

SEQ ID NO: 4151873 - RNA, 87 nt, Human
gagcugugcuauacuaaaaaguaggagauauauuuguuuauucagggggaggaaaaugucuuucuugguucugguuugcaauggcuc

SEQ ID NO: 4151874 - RNA, 59 nt, Human
gagcuguuuuuuaaaguuaggacccagagaaaucugacaucuacuacagaaagcagcuu

SEQ ID NO: 4151875 - RNA, 77 nt, Human
gagcuuauuucagcccuacuacuuggccaucugcagaccuaagagagagcaagugcaaauggguugagagaaagguc

SEQ ID NO: 4151876 - RNA, 87 nt, Human
gagcuuccauuacucauucgccuugcccaaggccucagcaaccgacguucgaaagccaggagaaaaggcgaaugauaaagggcgcuc

SEQ ID NO: 4151877 - RNA, 62 nt, Human
gaugaguccuggaacccugaaugcuuucuccaaagcauacucugguuuucagagauuacauu

SEQ ID NO: 4151878 - RNA, 55 nt, Human
gaugaguuugccuggccugcagcugggaaaggcugguuguuagggaagauucauc

SEQ ID NO: 4151879 - RNA, 92 nt, Human
gaugauagaauacuugguuacuguguugguuuauauauaugucuuuuaaguuuucauaagugauauuuagcuauagagcuuauuuuauuauu

SEQ ID NO: 4151880 - RNA, 65 nt, Human
gaugauauauauggaaagccuagugcaaaaacuggcaccuagcagguccuucaugaauauucauc

SEQ ID NO: 4151881 - RNA, 117 nt, Human
gaugaucuauaagccuggaauaggacaguuuuggaccaugguagggaacuuggaaauguuaguuggucuaaauuccugguuauggaauuaaaacaaguuguaucuacuuuaguuauu

SEQ ID NO: 4151882 - RNA, 76 nt, Human
gaugaugaggccagaccacucugcauggauccacagcagguacgcaauggaaugaauguggcuggcugccauuauu

SEQ ID NO: 4151883 - RNA, 78 nt, Human
gaugaugccuccccaaaccauggaguaaguucacaugcuggagcauguuaacagcugcuucuggugucaggcauuguu

SEQ ID NO: 4151884 - RNA, 56 nt, Human
gaugaugugauuugcauuucagaaggcugucucugcuccugaauuaucucaucauu

SEQ ID NO: 4151885 - RNA, 126 nt, Human
gaugauuaaacaaaauguagcauuuaguggugccccuguuauuucaugugugugcacuacaccuaccugagugcacacacaugaaguagcaugaacagcagcaagguccauuucacccucaucauc

SEQ ID NO: 4151886 - RNA, 64 nt, Human
gaugauuguugcauugcugcuuuauggaggagggaccagagaggcaggcaguucagcuguuguu

SEQ ID NO: 4151887 - RNA, 55 nt, Human
gaugcaaagcauuuuuguguguguguaugugugugugcaagaaugucuguguauc

SEQ ID NO: 4151888 - RNA, 60 nt, Human
gaugcaauuuggggaagaaagagacagcacgagugggucuuuucuguaacagauugcauu

SEQ ID NO: 4151889 - RNA, 77 nt, Human
gaugcagccuccaggccuggaccaugccagggcugggagucuuuucuccaggcaugucccaagccggauggcucauc

SEQ ID NO: 4151890 - RNA, 127 nt, Human
gaugcaggcacaguauuggcuacagagacauagcaggugguaaucaguaguuguucaggcaucaagggacagacauuuauugaacaccuagcaagagucuuaccuguugaacugacugccccugauc

SEQ ID NO: 4151891 - RNA, 60 nt, Human
gaugcaggcaugcuucugucugggcaggucugucugcuugugugggaguguguguguguc

SEQ ID NO: 4151892 - RNA, 76 nt, Human
gaugcagggucuccgugugacgaaugaggaggaaaaaggcaagacacucuuucucacaugaaugacugaguaauuc

SEQ ID NO: 4151893 - RNA, 58 nt, Human
gaugcauccuuucugucuucucugcuaaacagugagcuccaggaagaaaaggaucauc

SEQ ID NO: 4151894 - RNA, 58 nt, Human
gaugcaugcagaagagugaauacuugcuguggugaguuuucacauuucuguagugauu

SEQ ID NO: 4151895 - RNA, 80 nt, Human
gaugccacccccgugagcagcuggggccugugacgaugaccgggaacacgcacucccugccucagcuuuugguggccauc

SEQ ID NO: 4151896 - RNA, 61 nt, Human
gaugccagcuggcccuuugguagccuugagggggacugaggucacucacggccaguguauc

SEQ ID NO: 4151897 - RNA, 80 nt, Human
gaugccauuacaaaugccuguggagauauuuaaggagccagaugcuacuguuucaugucuuccgcagcucugaauguguc

SEQ ID NO: 4151898 - RNA, 66 nt, Human
gaugccccagaguggacucaggaggauggcauguguuagcauacugagcacagcucugugggccuc

SEQ ID NO: 4151899 - RNA, 93 nt, Human
gaugccuggcucuagggugugcggcagggcuacaggacugagaguguccaacucucuuggcccugccgcacuauccucagguuaacugguguu

SEQ ID NO: 4151900 - RNA, 67 nt, Human
gaugcgagcuguccugacccaggcacuucugcaacccagcagagagcccgggccagggcacaguguc

SEQ ID NO: 4151901 - RNA, 70 nt, Human
gaugcuccaggugucuccuaugagcacagcgaugccauuugccaaucuccuggugacaugccugagcauc

SEQ ID NO: 4151902 - RNA, 58 nt, Human
gaugcucccuuugaaugucaguuaccagcugcuuauggaagcuaagacaagggacauc

SEQ ID NO: 4151903 - RNA, 80 nt, Human
gaugcugaagaaugagcucaaagaucuuaagccccagaagcauggggaguguggguuuguaguuaaguucuuagaguguu

SEQ ID NO: 4151904 - RNA, 61 nt, Human
gaugcugagagguggagggaacccuuaagcuuuggacaauucucuccuccucucugccuuc

SEQ ID NO: 4151905 - RNA, 74 nt, Human
gaugcuggcucagagaaccuggguaacggaaaggagaggcagcuuuucccacucacugucucugacacaagcuc

SEQ ID NO: 4151906 - RNA, 57 nt, Human
gauggaagaaaaaugcaugucugggagcaaucacacucaagcauacaucuuccuguc

SEQ ID NO: 4151907 - RNA, 68 nt, Human
gauggaaggcugagugcuccccuagaugucuucaggcucuugaggcuugcauucacguggguucccuc

SEQ ID NO: 4151908 - RNA, 128 nt, Human
gauggaaguggcucucaaugggacggggagcuggaaaggggauggaaugggaagauaaucuuccuucuccgaacauccccagcugaacuccucuccaaccguagucuccaaugucuagccgccucuuc

SEQ ID NO: 4151909 - RNA, 55 nt, Human
gauggacagaggaggacagggauuuguagccacuucugcaaucgcucugaccauu

SEQ ID NO: 4151910 - RNA, 70 nt, Human
gauggacgcagccccaacaaaugggacaaggaccacauccggugucccaugaguggcggucaugaucuuc

SEQ ID NO: 4151911 - RNA, 82 nt, Human
gauggagaaagcccuggcggguggagggcccugaggcuccuacugcucccggcucugcgccugcggggacuuugaauucauc

SEQ ID NO: 4151912 - RNA, 73 nt, Human
gauggagaagcccagggcguggccgggcucagaagagcucugucgauuuacgguuacuucuuaggcugccguc

SEQ ID NO: 4151913 - RNA, 61 nt, Human
gauggagaagggaugggauagggagaaagucuguaagcuucuacccucuccugcucauauc

SEQ ID NO: 4151914 - RNA, 70 nt, Human
gauggagacaguuucugggcguucacagguaagcugauacuuugagauucucggagauuaguguucuauc

SEQ ID NO: 4151915 - RNA, 79 nt, Human
gauggagagccagaaaauagaguuucucugaguggcagccccuagacacuugauuuuucugaaagauaggcucuugauc

SEQ ID NO: 4151916 - RNA, 55 nt, Human
gauggagauaggcuccuggguauuuugaauaacaauacaaagagccccucucuuc

SEQ ID NO: 4151917 - RNA, 83 nt, Human
gauggagccaggccuauucacaugacccaggcauaggcaagcccaugauacugacugguucagugaaaggcaugggauccauu

SEQ ID NO: 4151918 - RNA, 64 nt, Human
gauggaggcaggagacagggcaaaccuugggccugggucugcgauuguccaccguggcuuuguc

SEQ ID NO: 4151919 - RNA, 63 nt, Human
gauggagucugaagcugggaacgacccuguccacccccaaguuccuuaagucagacgcuuauc

SEQ ID NO: 4151920 - RNA, 93 nt, Human
gauggauggaaggagaacucugagucugcagacaacuuagaagcauguuguugcuccuuuuugucuguagacagggcauccuguaguucuguc

SEQ ID NO: 4151921 - RNA, 62 nt, Human
gauggaugggcacagggguaggaaugagauuuuccauuccaaaacucuuguguucuuuuuuc

SEQ ID NO: 4151922 - RNA, 75 nt, Human
gauggcaauuguaauuuuguaaagauuuaugaguuguaauuuuguaaagauuuaugaaguucaauuagagccauc

SEQ ID NO: 4151923 - RNA, 126 nt, Human
gauggcagcucugagagagggcuugccuuauauuacaaagucugagaaaugaaaccuacaucguuagccucgagaucuuugucccugaugauauucugcagaugcccucucaaggguaaguccauu

SEQ ID NO: 4151924 - RNA, 67 nt, Human
gauggcaugauggcuuggggugcugugugggcuuauuuagcauuuguucuucaggccaaugcucauu

SEQ ID NO: 4151925 - RNA, 55 nt, Human
gauggccacauacauggcugggguguugaaggucucaaacaugaucugggucauc

SEQ ID NO: 4151926 - RNA, 88 nt, Human
gauggcucgaaccugggaggucaaggcugcagugagcugucauccuugccacugcacuguagcuugggcaacagagcaagagucuguc

SEQ ID NO: 4151927 - RNA, 70 nt, Human
gauggcugaggagagggcggaaguguccgcacgucgggccuccgaggcuucucuuucuccccuggcgguc

SEQ ID NO: 4151928 - RNA, 63 nt, Human
gauggcuggauaguugaagcucucaccauuaagauuuugaaugccucuuuucuccaguccauu

SEQ ID NO: 4151929 - RNA, 92 nt, Human
gaugggaucacucuuucugggcuccuugggagcaagugagaggaagcccuuaccugcaccagcagccuccauaaggaagggagcauccgauc

SEQ ID NO: 4151930 - RNA, 90 nt, Human
gaugggauggguggcgagccccaggcugggccgaccucacacugugcucugugccccugccguggaccaggugagccauacgucgccauc

SEQ ID NO: 4151931 - RNA, 68 nt, Human
gauggggaagggcagcugacagaugcuuaagaaggcuuaaaccauccugcugcugcuguugcuugguc

SEQ ID NO: 4151932 - RNA, 86 nt, Human
gaugggggcuggugaaggccuggugagaugcaacggccaaaccccuuguucugggccagugauuuuuccagcagccagcucccauc

SEQ ID NO: 4151933 - RNA, 67 nt, Human
gaugggguagcccugcccauuuggccugggauugcugccccuguggcucucugcaggguccccacuc

SEQ ID NO: 4151934 - RNA, 129 nt, Human
gaugggguuggggugggagucugugugugaaagcuuguccucuguagcucacuggaucucagcccagacugcuccucagaaucaccuggcagcuuucaaaaaacucugaugucugccccucaccuccuc

SEQ ID NO: 4151935 - RNA, 84 nt, Human
gauggguuggaggaaggauaaccuggauauaaacagauggguuagaagacucaugauguugcuucaggcuuuagcuuccccauu

SEQ ID NO: 4151936 - RNA, 103 nt, Human
gaugguacuggggccagaaacagggggaugacugcauugaaauuuuuugccuugauuucagcaagaaaucuucaguguucucccuggagccugguucaccauc

SEQ ID NO: 4151937 - RNA, 82 nt, Human
gaugguagaaagggcaaggcuuuggagcuugucaugugacaugagcaggcugccuuccaaagccucagucuucucagcuguc

SEQ ID NO: 4151938 - RNA, 75 nt, Human
gaugguagcccagaaagugugugcaguuguuuuuccaggagcauaagcaaauccacacacucugagucuucuauu

SEQ ID NO: 4151939 - RNA, 67 nt, Human
gauggucaggucaucucauggauggaaagagcuuaaaccacccacccauuuuugaaaccuugaccuc

SEQ ID NO: 4151940 - RNA, 77 nt, Human
gauggucucgaacucuugaccuugugauccacccaccuuggccucccaaagugcugggauuacaggcuugagccauc

SEQ ID NO: 4151941 - RNA, 57 nt, Human
gaugguggaggaaucgcugaagagcccaguaccaguucagcaagugucucuacuguc

SEQ ID NO: 4151942 - RNA, 83 nt, Human
gagguggggaagggccugaaaccuucagggcuuuggaagcuggagacaaagaccaugacaggguuucagggccugggcauguc

SEQ ID NO: 4151943 - RNA, 65 nt, Human
gaggugggugcugucaggcagggaaacuaaacaucuuuccuuacucuacuagcucccaggaccuc

SEQ ID NO: 4151944 - RNA, 76 nt, Human
gagguguagccccugccuuugaaccuggagauccugaccaugaucuccuggugcugcuaucagggguagauucuuc

SEQ ID NO: 4151945 - RNA, 58 nt, Human
gaggugugguccucagcccccagcggaugcuuaugugggggugcacgggccacaucuu

SEQ ID NO: 4151946 - RNA, 55 nt, Human
gagguguguuacagauugucauaacugauaaaucaaugacaaauguagccacuuc

SEQ ID NO: 4151947 - RNA, 125 nt, Human
gagguguuagagaagauaauaugauaauaaucaguuacuauaguuuuguuaggagaaccucccucauuuuuuaacuguaccuagauaacgaacuuugucaguuuauuuauuuuuuuuaauuucuu

SEQ ID NO: 4151948 - RNA, 87 nt, Human
gagguucacacugcaaauauuuuuccuuuuggaaaauagcacuuuuacuauucccagcagucagagcuaugugucuuugugaaucuc

SEQ ID NO: 4151949 - RNA, 55 nt, Human
gagguuccccauuguacuggcugauuuucucagacugcacuucaguuggagccuc

SEQ ID NO: 4151950 - RNA, 61 nt, Human
gagguugagaggugucaacgugcuggugguccucgcucgcucucagcgccuccucggccuc

SEQ ID NO: 4151951 - RNA, 74 nt, Human
gauaugccucugagcuguguccugggggcaguguacaaugugcuguacgaauccacacagcuggagcaggauuc

SEQ ID NO: 4151952 - RNA, 55 nt, Human
gauauggcuuggagacaugcacuugacggcagugacaacagcucucagccauguc

SEQ ID NO: 4151953 - RNA, 56 nt, Human
gauaugugaccuccauaugguuucaucuuucugaacacacagggagaccacauguc

SEQ ID NO: 4151954 - RNA, 64 nt, Human
gauauguguuccuuuaguucagaagaucauaucacuuauucugaauuucagagguaacaucauc

SEQ ID NO: 4151955 - RNA, 87 nt, Human
gauauucacucagcaagaaaaccaccucccaucaagcagccuccuggauaauguuuaaugaagaugguuuuucacugcugacauguc

SEQ ID NO: 4151956 - RNA, 77 nt, Human
gauauucagagcuuuauauuuaguaagggauucacuugguuuauauuguccauauuauaauuuagggcuuggauauu

SEQ ID NO: 4151957 - RNA, 65 nt, Human
gaggccucuucuuuguuaaccucuguaccuguguuuugucucugcucguuuucagagaagaccuc

SEQ ID NO: 4151958 - RNA, 56 nt, Human
gaggccugaaaggggaccuauggcugucacugaggccugugugccuucugggccuc

SEQ ID NO: 4151959 - RNA, 62 nt, Human
gaggccuggagaguuggaagauggacucugaggaucaagucuacucuugcuuuccugggcuc

SEQ ID NO: 4151960 - RNA, 55 nt, Human
gaggccuggcugggaggagguggguggaaaguccaaggcuccuccucuaggccuc

SEQ ID NO: 4151961 - RNA, 68 nt, Human
gaggccugugaagggacggaugcugcugcucacucguaacagcuugcugcaccuuaauagcugguuuu

SEQ ID NO: 4151962 - RNA, 81 nt, Human
gaggccuguuucauguuccugaacacaaagggucccgucagauguuucuuuguguuuaaagaggaagugagauucgcucuc

SEQ ID NO: 4151963 - RNA, 72 nt, Human
gaggccuguuuccuuggguugcuuaugaaggaagcagagcaacaaacccuuucagggaaacaauaugcacuc

SEQ ID NO: 4151964 - RNA, 56 nt, Human
gaggcgaggggcugcggcgagucuggcagaggcggugcccggauaccccuggccuc

SEQ ID NO: 4151965 - RNA, 80 nt, Human
gaggcgcuccauugcuggaaggacgcugagagggguucaaacaugggcagauguuccagaaccuuccugcuggaagccuu

SEQ ID NO: 4151966 - RNA, 69 nt, Human
gaggcggaaggguugcuugagcccaggaguucgagaccagccugggcaacauagggagaccccugucuc

SEQ ID NO: 4151967 - RNA, 68 nt, Human
gaggcggagagaacguagaugaccuaaauucuaguccucauuaucugcaguuuguuuucucuugucuc

SEQ ID NO: 4151968 - RNA, 96 nt, Human
gaggcgggaggauugcuugagcccaggcagagguugcagugaaccaagauggcaccacugcacuccagccugggugacagagcaagacccugucuc

SEQ ID NO: 4151969 - RNA, 68 nt, Human
gaggcgggcagaucaccugagaucaggaguucaagaccagccuggccaacauggugaaaccccgucuc

SEQ ID NO: 4151970 - RNA, 68 nt, Human
gaggcgggcagaucaccugaggccgggaguucgagaccggccugaccaacauggugaaacccugucuc

SEQ ID NO: 4151971 - RNA, 68 nt, Human
gaggcgggcggaucauuugaggucaggaguucgagaccagcuugaucuacauagugaaaccccgucuc

SEQ ID NO: 4151972 - RNA, 104 nt, Human
gaggcgggucccgggcccucgcgugucggccacgagggagccgcgcccauaggucuuugagugcagugcgggccggcaggcaacgcugggcccggccuuuccuc

SEQ ID NO: 4151973 - RNA, 59 nt, Human
gaggcggguggaucaccugaggucaggaguucaagaccaacauggugaaaccccgucuc

SEQ ID NO: 4151974 - RNA, 56 nt, Human
gaggcguuuauucucuucacgcugagagcucaguguuuagucaaguaagacgcguu

SEQ ID NO: 4151975 - RNA, 73 nt, Human
gaggcuaaaacauuuaaugguaacugaaauagcacaagaaguuaauaacaguugaaauuagaguccuggcuuc

SEQ ID NO: 4151976 - RNA, 75 nt, Human
gaggcuagaaugauuuggaauguuaggugucucauauaaugagccaaaugcauuuccauauuguucuguguccuc

SEQ ID NO: 4151977 - RNA, 58 nt, Human
gaggcucaccuccccgugaccgugcagcgugcugcugguccugccaacggugccccuc

SEQ ID NO: 4151978 - RNA, 96 nt, Human
gaggcuccgacgcgcaggcgcucuccggcucccguguaggaaccugcagagauccuggacugagcguuugucaccuagcucuguggacggacccuc

SEQ ID NO: 4151979 - RNA, 80 nt, Human
gaggcuccuggaggccauuacgagcucuaaaauacuaugauugcucauguuaguguuucuuagucgguacaaggaguuuc

SEQ ID NO: 4151980 - RNA, 80 nt, Human
gaggcugaagauggagaaggcuggucuuaagucgacaucccaucuugaaguucuugaguaggcacuucucagccagccuu

SEQ ID NO: 4151981 - RNA, 105 nt, Human
gaggcugaaggaggagaaucgcuugaacccgggagguggagguugcagugagccgagaucgcgccacugcacuccagccugggcaacagagcgagacucugucuc

SEQ ID NO: 4151982 - RNA, 58 nt, Human
gaggcugagaacuacaguggccuuuccccaggaaggcuguguucugguucuuagcccc

SEQ ID NO: 4151983 - RNA, 71 nt, Human
gaggcugagccuggaggcuugaaucuggccccagaugaccggucagaagcaggcagauuucagcucauuuc

SEQ ID NO: 4151984 - RNA, 98 nt, Human
gaggcugaggcacugaguguuugagucacuuccuccauggucacaaucuugguugguuggagccagaauuugaacucaggcaaucagucuuuagaguc

SEQ ID NO: 4151985 - RNA, 57 nt, Human
gaggcugcccacaccugcgccgaagggaaacugcucggggcuaggcaggcagaacuc

SEQ ID NO: 4151986 - RNA, 62 nt, Human
gaggcugcucaguagauggagcuuacacaacaaucgcugcgggccuggauugaaguagcuuu

SEQ ID NO: 4151987 - RNA, 62 nt, Human
gaggcugcugagggauggguaggagggcuaccagagccuggcuguccacaucacagagccuc

SEQ ID NO: 4151988 - RNA, 72 nt, Human
gaggcuggagcugggccaggcauuugcuggguccccaggccaucuggcuccaugcuccgcuucuugugccuc

SEQ ID NO: 4151989 - RNA, 59 nt, Human
gaggcuggcagaaaagcacaggaaccuuccucuaggccaagcuugucccugccugcuuu

SEQ ID NO: 4151990 - RNA, 64 nt, Human
gaggcuggcuuaauagggaugggcuuuacacaguguggcucugaauuauuccugagucauucuu

SEQ ID NO: 4151991 - RNA, 66 nt, Human
gaggcugggcauccauccaugagacagauucuccuguuugguuggaaggauggauagcucaggguc

SEQ ID NO: 4151992 - RNA, 87 nt, Human
gaggcuggucugaggcuccaaggaggugcucucagaugacccuugaauuccguucuaagcacaccuccuagagcagacucuugccuu

SEQ ID NO: 4151993 - RNA, 64 nt, Human
gaggcuguagguuggacccuaaucccagagccucauucugauggaggcuucaaccauacaccuu

SEQ ID NO: 4151994 - RNA, 66 nt, Human
gaggcuguuggcugaucugagucauuuucuacauaaaaugcaaacuuggaagcagugaacaacuuu

SEQ ID NO: 4151995 - RNA, 65 nt, Human
gaggcuuagaggcucugucacuugucuaguaucauacagucaagaaauggcagagccaaggcuuc

SEQ ID NO: 4151996 - RNA, 80 nt, Human
gaggcuucauuacguuaagguucagaaaucaauaccccaaaauauggggcuuugacaugcugaauuaaagaagcagccuc

SEQ ID NO: 4151997 - RNA, 67 nt, Human
gaggcuugaugcaugaggcagccuauguuauugaccccaacuaugggccagcaccauguuaagcacc

SEQ ID NO: 4151998 - RNA, 63 nt, Human
gaggcuuuacgucuuccccugggaccagcuuuuagugacaucccaggugcugcgugaagccuc

SEQ ID NO: 4151999 - RNA, 74 nt, Human
gaggcuuucuuguccuuggggugagcuuugauguugaggcacccagggucaccccguaggguucugcaggucuc

SEQ ID NO: 4152000 - RNA, 91 nt, Human
gaggcuuuggaguuagauaaaccuggguaggauucucugccuguuacuagcuauguguuccuucccagguugcuuuacuucucagagccuu

SEQ ID NO: 4152001 - RNA, 86 nt, Human
gagggaaaguuucagaaucccugcuugucuucaaaugucuccuuuugccuccacauuugcuugauuaggauauggaauuuucuuuc

SEQ ID NO: 4152002 - RNA, 126 nt, Human
gagggaagacaucagugaugggagguuuggcagacaacugagccucugcccauccaccaucaggcuguugccgagcaggaaugcaggucaacuguugucagaucuuccaaauuuucuuuuucuuuu

SEQ ID NO: 4152003 - RNA, 56 nt, Human
gagggaaggucacccuuguagccccugucaccugcuaccuugggaggcauucccuu

SEQ ID NO: 4152004 - RNA, 64 nt, Human
gagggacaggaugggucucuuucccuuccucuucucuaaagaagagaccuuucuccugccuuuc

SEQ ID NO: 4152005 - RNA, 57 nt, Human
gagggacccuggcuggagcuggccuggggugucugugcccuccugccaggggcuguc

SEQ ID NO: 4152006 - RNA, 78 nt, Human
gagggacucugaugcuguacuaaguuaugucuuguugcuaagacauaaaacagucagcgaaacaauacaauguccuuc

SEQ ID NO: 4152007 - RNA, 70 nt, Human
gagggacuucucauuuaccuuugcaaucaaggaacucacagagcauuuguuguagaguagguaggcccuu

SEQ ID NO: 4152008 - RNA, 71 nt, Human
gagggagaaaacuucagacuccccacuucucgcagugcagagagagggaauauuugggguauucucaccuc

SEQ ID NO: 4152009 - RNA, 77 nt, Human
gagggagagacagacaguggacuugauaaaggaaaugcauugagcauccucaacuucacguucugaauaauucccuc

SEQ ID NO: 4152010 - RNA, 87 nt, Human
gagggagagggaaagauuaagggaauuccuggaggcauaauucugucuuccuccggaagaccucagucuuuuucucuuaaguaccuc

SEQ ID NO: 4152011 - RNA, 92 nt, Human
gagggagaugguugauucagugggaguggggaguggcagagggugccuuaacuuuuucuggcuugaccccuacuuccuuauguguuuccuuc

SEQ ID NO: 4152012 - RNA, 68 nt, Human
gagggagcagaggauggaggaaaaccuagucugggagauuggaaaaugcuacauguucugcuucucuc

SEQ ID NO: 4152013 - RNA, 77 nt, Human
gagggagcuguucaggacugcuucaagaagaucuugccaagccuugucuauauggggcaguuaauaaacauucucuu

SEQ ID NO: 4152014 - RNA, 130 nt, Human
gagggaggaagacagggacgccaagggcucagggagaaggccgggaggagcaagggggcucgaggaguggccagagccccuugcugcccucuagaggccccggcugagcagagggucuguuguccacccc

SEQ ID NO: 4152015 - RNA, 73 nt, Human
gagggaggcaaaagaugggccauggagucacgcgaaucugaggacuggcuccaacuccaccuuugucucccuc

SEQ ID NO: 4152016 - RNA, 102 nt, Human
gagggaggguuggagcugcugggcagagcaggggcaauguguugcaagcacaggguaaugcugccucacauuggacccugcuaggcccuuuccaccucacuc

SEQ ID NO: 4152017 - RNA, 59 nt, Human
gagggagugccagagggccagcaagagguuggguggcuggcugacucagggacuccuuc

SEQ ID NO: 4152018 - RNA, 76 nt, Human
gagggauagacagcugguagcacuuccuguguuuggcgauccauggagcaggacaucuacccaguguuucucccuc

SEQ ID NO: 4152019 - RNA, 79 nt, Human
gagggaucagcgauggagagguccugauaguuccccuaauggacuuucucuccugccucucugccuuuacuguucccuu

SEQ ID NO: 4152020 - RNA, 69 nt, Human
gagggaugaagaagcaagaggaaauguggaccuuggggaagguaaacaggcucuugcucuuuggcccuc

SEQ ID NO: 4152021 - RNA, 64 nt, Human
gagggaugugccugaaggcagggaguuggaucuggugacuucuuaaguccuuuccacaucucuc

SEQ ID NO: 4152022 - RNA, 71 nt, Human
gagggauguggagcccccagcccagggccugguacccagcaggcucucagggaaaggccuccccuucccuc

SEQ ID NO: 4152023 - RNA, 110 nt, Human
gagggauucagaauaggggaagucuaugguugucaucuugcagggaaugagccuguaaaaaggcuuaaagaaauugaggagaggauuccaugcuccccugaauauccuuc

SEQ ID NO: 4152024 - RNA, 59 nt, Human
gagggauuuuagugcagcaacugaauguccuucaccguucugcagcacuaaaaacuuuc

SEQ ID NO: 4152025 - RNA, 121 nt, Human
gagggcagagauggcagcaagcauuccuuggcugaggccugcauugaacuagaaggcuguugauaaggcuuaucauggggacugcagccuagccucggauagcuccuccauccuucuccuc

SEQ ID NO: 4152026 - RNA, 80 nt, Human
gcaauagauacagaugauuuuuaugaaaacaaugcauuugcaaccauguuuucagaaagaguuagauacauaucuggugc

SEQ ID NO: 4152027 - RNA, 70 nt, Human
gcaauaggagaaggucuuguucacuuccugccaaaagcagugaagguuuacagggccccuucuucugugu

SEQ ID NO: 4152028 - RNA, 129 nt, Human
gcaauauaagugaagcaccuuuuucacugagugacucuuuguaaauguuuuauauuuugcagcaguuugacuuuacugaggguaauauaaaacauuuaauggaagcauuugggaagcuuaaguaugugu

SEQ ID NO: 4152029 - RNA, 77 nt, Human
gcaauauuuggaauccauauuaguaaauucugacacauacaugugcagaguuuuauguaugcauguagaagaauugc

SEQ ID NO: 4152030 - RNA, 109 nt, Human
gcaaucaggaggaaaggaaaugaacagccucagugagauuaggauauaaaauauaagcccuagguucuaugcucuuucugagguugcacauaaauuuggccucaaaugc

SEQ ID NO: 4152031 - RNA, 94 nt, Human
gcaauccaaauuuaucaagaaauucuguucagauagcuuauuuguagguuagcugucuaaaucaggacaaauuuccauguggaugcuguauugc

SEQ ID NO: 4152032 - RNA, 68 nt, Human
gcaaucugaaacauucugucagauuccucuccaaagaaaacuuuggcagcugucagaaugcaaauugu

SEQ ID NO: 4152033 - RNA, 74 nt, Human
gcaaucuguaagaccccaugaaggucugucccauggaagggggagaauuuccuuucauugugguuucacagagc

SEQ ID NO: 4152034 - RNA, 84 nt, Human
gcaaugaaggaaggacuggcacagccacugcaggcagggagcuuaucugccauugcccgcggcagugccagaauccuacaaugc

SEQ ID NO: 4152035 - RNA, 78 nt, Human
gcaauggguagugaaagggacuuuuuaggaagauuauucuggaugaguggagagccuggagucccugauuaaauuugc

SEQ ID NO: 4152036 - RNA, 88 nt, Human
gcaauggugaacuuggggauuuuaaagaccucugacugcauuccucaggaaagccaaggggcuuguggaguugcugguuugccucugc

SEQ ID NO: 4152037 - RNA, 62 nt, Human
gcaaugguuuauauuguuuuucaugccuacauagcaugagaaauuuauuacaagcuaacagc

SEQ ID NO: 4152038 - RNA, 95 nt, Human
gcaaugucuauagcacaacuuucuggguuaucugauccuaauuauaugguagcuauuuuauaacucugaaaguuauagauggcugauagcaaugc

SEQ ID NO: 4152039 - RNA, 57 nt, Human
gcaaugucuucuaagcucuaagcuggcuacagacuguggcugagcaguagaagaugc

SEQ ID NO: 4152040 - RNA, 64 nt, Human
gcaauguuauacuuaugugcaaaaauauacuuaagguauauuaugguuguagguuaacaauugc

SEQ ID NO: 4152041 - RNA, 69 nt, Human
gcaauguucucggaauguccuccagagcugaguucucucagcggauggcuugggagauucucgaacugc

SEQ ID NO: 4152042 - RNA, 79 nt, Human
gcaauuaauauaugcuguuaagaauugugucccaugcuguaaaagcauguucauuuucuuaaugugccauauccaaagc

SEQ ID NO: 4152043 - RNA, 69 nt, Human
gcaauuauacuucuugucuauguuguugccagccagcgguaccaaggagacaaagguguauucauuugc

SEQ ID NO: 4152044 - RNA, 56 nt, Human
gcaauucaaguugaguacagcuucucuuuggcaggaggcugagaaaacugaaaugu

SEQ ID NO: 4152045 - RNA, 55 nt, Human
gcaauucuggaagcuccauucauagacugugaugugaaugaugccccagaguugu

SEQ ID NO: 4152046 - RNA, 60 nt, Human
gcaauuguacuagaaaacaauagugauuuucuaauagcuauuguuuucuagcauaauugc

SEQ ID NO: 4152047 - RNA, 56 nt, Human
gcaauuguauuuauccccaggcagggacuccauugccagggcccugugugcaaugc

SEQ ID NO: 4152048 - RNA, 58 nt, Human
gcaauuguguguguaugugugugcacaugugugugucuacaaacguguacacauuugu

SEQ ID NO: 4152049 - RNA, 65 nt, Human
gcaauuuaccaggagucagaaggacuaguaagcugaacccagccaggucucugacagcugguugc

SEQ ID NO: 4152050 - RNA, 80 nt, Human
gcaauuucaugaggggcaaaaucucaguuguuuuucuaggucaucugcacuaugagaagauuugcucuucugagguuagc

SEQ ID NO: 4152051 - RNA, 60 nt, Human
gcaauuucucccagggacuggaugaugcaggcuuccuucaccagguucccaugggugugc

SEQ ID NO: 4152052 - RNA, 74 nt, Human
gcaauuuuuguaaugaaaaggaggaaauagauauuggaugaaacauagcuauuuccuacuuuuuuacuuauugc

SEQ ID NO: 4152053 - RNA, 85 nt, Human
gcacaaaguugcacagugagguagggcagaggcugaaugugaacggacacaucccagcccauccuccuccccuguguaauugugc

SEQ ID NO: 4152054 - RNA, 66 nt, Human
gcacaacaccaagggagguaucauucacauagacuacaacaggaugaguguucucugggguugugc

SEQ ID NO: 4152055 - RNA, 64 nt, Human
gcacaagaagcacuuuccuacauguuuccaggaagcauaggugacaagaguagcuuacaggugc

SEQ ID NO: 4152056 - RNA, 108 nt, Human
gcacaagccccuuuccugcccucugcuugccauugcugcuggaagauuuucucuuuuccaggagagcucuaaauggcuguagccagagggcugugugugugugugugu

SEQ ID NO: 4152057 - RNA, 82 nt, Human
gcacaagccuggcuccaccuggcagcuguuggccacggcucccaguccacauggcacaccugccuggcaggccuggcugugc

SEQ ID NO: 4152058 - RNA, 65 nt, Human
gcacaaggagcaguguaugaaaucuuaaaugaacaagcaaugccaugaaauugcuccuuuggugc

SEQ ID NO: 4152059 - RNA, 82 nt, Human
gcacacaaccgcaagcugucagugaggugagacaugcaacaagccaagguaugucuuuauucucugaugcgcgguuuggugu

SEQ ID NO: 4152060 - RNA, 57 nt, Human
gcacacacucuuucucuuuugaaggaauucauaaguucugauaaaggaggaagaugc

SEQ ID NO: 4152061 - RNA, 65 nt, Human
gcacacagcaucucacuucccagaaggaucuucaccuuuucaucuggaaacugagugcuaacugc

SEQ ID NO: 4152062 - RNA, 83 nt, Human
gcacacagcugggaggcucugggaagcagugaguucagaagucaaaucagaaaacucaaguccagagauuaaagauuguaugu

SEQ ID NO: 4152063 - RNA, 57 nt, Human
gcacacaggcaguuuccagccaggugugugccaguugcuggguauaugcuuguuugc

SEQ ID NO: 4152064 - RNA, 60 nt, Human
gcacacagggcagagagcuggcucaggguucccgggggcucugugguugugcuuuguggc

SEQ ID NO: 4152065 - RNA, 55 nt, Human
gcacacaguagggauucaaugaaagaauucugagguuaauugaaugacugugugc

SEQ ID NO: 4152066 - RNA, 103 nt, Human
gcacacaguccuguugguccagcacugacgccugggggaucucaguggggccugggggacugcacuggcgucagugaguuggagucaggaaucugucaagugu

SEQ ID NO: 4152067 - RNA, 78 nt, Human
gcacacauuuaaaugaagacugacuaaauaaaagguaccacacacuucuugguugguuucauuccauugcaugugugu

SEQ ID NO: 4152068 - RNA, 121 nt, Human
gcacaccuggaggcuggggggcugguccagguugagcaaguguacgagcaggcccugcagcuggccuuggagaucacugcucauguugggcagcagucucaguagcaccugcaggaugugc

SEQ ID NO: 4152069 - RNA, 64 nt, Human
gcacacggcagccuccuccugagauaguguccaucgcaaaccaggagauggcugcugugucagc

SEQ ID NO: 4152070 - RNA, 98 nt, Human
gcacacucacauccagguaguucuccaggggcuguucaucuaccagggugggagccucccacugggggaaguacuuucuggcuggguugagguugugc

SEQ ID NO: 4152071 - RNA, 101 nt, Human
gcacacucuaagguauggaucccuguaaacacuuaaggagagaucaaaugucaaaguaugcaaggucuccccugguguaguuucacuacuuuuuugugugc

SEQ ID NO: 4152072 - RNA, 58 nt, Human
gcacacuggagccuggaagauuaguaaggcuguacuuaugaguuccaguccagggugu

SEQ ID NO: 4152073 - RNA, 89 nt, Human
gcacacuguggagaaccagcacugcucucagacugagaggauuccaaacagcuucucuggacagcaggugcuguggcugaauagugagu

SEQ ID NO: 4152074 - RNA, 106 nt, Human
gcacacuugagugaagcacagacaugacaguugagcauguaagagauccauugggugcuacuugagaaagcaguuggacugcauucugguucucucugaaguuugc

SEQ ID NO: 4152075 - RNA, 65 nt, Human
gcacagaaaccugucuggagugggagguaaagucugcuguuccaaagaagagguuuuaaaggugu

SEQ ID NO: 4152076 - RNA, 78 nt, Human
gcacagaaccaggaauugcagggcugcauaucuuguugaaugcuguagacuuccugacagcucucugguuccuugugc

SEQ ID NO: 4152077 - RNA, 78 nt, Human
gcacagacuucgaauauaacuauuucugagcuuugaggacuugagcaagaaauguuacaguuguuauuugaaaagugc

SEQ ID NO: 4152078 - RNA, 59 nt, Human
gcacagagcuggcccuccaggccucucagccaacaggguucuacauccagcaucugugu

SEQ ID NO: 4152079 - RNA, 61 nt, Human
gcacagagguggaggacaaauagcgcugagaaugcugaagagguucuuuucaccucugugc

SEQ ID NO: 4152080 - RNA, 57 nt, Human
gcacagcagacuugguggggcuaaaaucuacucugguccccacuuacgaugcugugu

SEQ ID NO: 4152081 - RNA, 61 nt, Human
gcacagcaguuacugaaauaaaguaccuccucuauggagcuuccauucuaguuugcugugc

SEQ ID NO: 4152082 - RNA, 56 nt, Human
gcacagccucuaggaucgcuuccaguagaaugagucacuggcaaggcuuugagugc

SEQ ID NO: 4152083 - RNA, 71 nt, Human
gcacagcucgagcucaggagggagggcugcaccucagcccugacuacauccugcugaaagcuccagcuggc

SEQ ID NO: 4152084 - RNA, 76 nt, Human
gcacaggaccuagaagaacaugucaaacuauaaacugcuugugauugugaaugacuuuguucuuugcuucuugugu

SEQ ID NO: 4152085 - RNA, 101 nt, Human
gaucuggaaaauagcaggaagauaagagggaggugccucagucccgugggcaguuggugacucaggcaccuuccucuuaucugccugugggcacccagguc

SEQ ID NO: 4152086 - RNA, 123 nt, Human
gaucuggagucugucagguuuggguucuaauuacagugacaguugcuaugaucaaguacaacuuucuugacucacagugucuucauuuguauaauggagcuaacaacugauuugcagaggauu

SEQ ID NO: 4152087 - RNA, 65 nt, Human
gaucuggcauuguugcaagccuggaaucugggguccccagcaggagacuagcaacauaccagauc

SEQ ID NO: 4152088 - RNA, 70 nt, Human
gaucuggucaacauuuacugcccuggcccugggaggccugggggucggaggugaaaaguauugccccauc

SEQ ID NO: 4152089 - RNA, 80 nt, Human
gaucugugagguggccagaaucuugaggccuuuggguacugaugguaacaaugcuucaugauuuggccauguaauacauc

SEQ ID NO: 4152090 - RNA, 64 nt, Human
gaucugugugacccaaggacacucucuguucaccacuccagcagggagcugggccacacugauc

SEQ ID NO: 4152091 - RNA, 63 nt, Human
gaucuguuucauucacagucuggcacacacgaggugccagauaaauuuacugaauacagaauc

SEQ ID NO: 4152092 - RNA, 82 nt, Human
gaucuucacauuucauaccacagcuucuuugugacugagcugcacugggcagagcugaguaugaaggaugugagacaagauu

SEQ ID NO: 4152093 - RNA, 109 nt, Human
gaucuucucugccacccaccaccgccauguccagcgucuucggggugucuuccacuggcacaaacacccuccugaagggggcgagggguggcggcugggcaggcagguc

SEQ ID NO: 4152094 - RNA, 83 nt, Human
gaucuuucuuuaagcugcuguguggugaaacucaguauaaaacaaguuuaaaaauaacuaagaauuagcacacaguaaggguc

SEQ ID NO: 4152095 - RNA, 76 nt, Human
gaugaaaaauccaguucuuggaagcacaggagaaacaaggaauaccuccugccuccguggaacuggagaaguaauc

SEQ ID NO: 4152096 - RNA, 65 nt, Human
gaugaaaaauugcugugucauacugagacuacuaagaacaaugugugaugcagcaauaacucauc

SEQ ID NO: 4152097 - RNA, 56 nt, Human
gaugaaacucgucuuuaugcauggcugccuccuagaaauagagacagaguuuaauc

SEQ ID NO: 4152098 - RNA, 60 nt, Human
gaugaagcuuuuccauggcaggcaggcagcaggagcuguccagaguacggaagagucauc

SEQ ID NO: 4152099 - RNA, 73 nt, Human
gaugaagcuuuuguaguggguauuugaacaaaguccagcauuucaaaugauaccuauuacuaggcaaaacauc

SEQ ID NO: 4152100 - RNA, 57 nt, Human
gcaaagcauucuguggagucuaacugugauggguaaaagaccuagagaggguuuugc

SEQ ID NO: 4152101 - RNA, 84 nt, Human
gcaaagcauugaaugauccuaucuagcacaggggagggcaaacuuuucuguaaagggccugauagugaauauuuuaaguuuugc

SEQ ID NO: 4152102 - RNA, 59 nt, Human
gcaaagcuguagggcugagcuggaccggauucccuggugccuugggccuacagcgcugc

SEQ ID NO: 4152103 - RNA, 60 nt, Human
gcaaaggguggcugugaagugcuuggcaccaugccaggcacacaauggcuuccugauugu

SEQ ID NO: 4152104 - RNA, 70 nt, Human
gcaaaguaucugaccgauuauaaaguuauugcucuucauuauuuuuguaaucauguuagaagagcuuagc

SEQ ID NO: 4152105 - RNA, 72 nt, Human
gcaaagucauuaugccaaaguagaaauauacaagcaucagcuaucauauuuauaccauugguauugaauugc

SEQ ID NO: 4152106 - RNA, 57 nt, Human
gcaaaguccauucuuccagccagcucuugcuccagcccugcugugaugagacucugc

SEQ ID NO: 4152107 - RNA, 60 nt, Human
gcaaagucugcaucuggaucaggauguuaauucucuagacuacuguccaguagacucugc

SEQ ID NO: 4152108 - RNA, 95 nt, Human
gcaaauaacccugggucuccaggccagggcugcagcgagcagggguggggccgcgagcuuccuguuguucuuggcacggcugcccagcugucugc

SEQ ID NO: 4152109 - RNA, 121 nt, Human
gcaaauagauggcugauguuuuugagagaguauaaaaacagaggagagaacaacguaauagaugucuauccuaaaggcugcuuuuauauucauuacaauaaacaauucuggcuuucucugc

SEQ ID NO: 4152110 - RNA, 75 nt, Human
gcaaaugcauaucaaagacuugaacaggcaaucucuugaaauuugaggauuuuuaguuuuuaaugcuguauuugc

SEQ ID NO: 4152111 - RNA, 88 nt, Human
gcaaaugcuaaauacuugcaagucaaagauuuucauacggauuuuaugguguagaaaauguuagcuucauagucauuguugcaguugu

SEQ ID NO: 4152112 - RNA, 64 nt, Human
gcaaauguaaacagcaagagaagggagguuuucccuggagcaucucugcugucuacgaacuggc

SEQ ID NO: 4152113 - RNA, 69 nt, Human
gcaaauuaggcagugccauuguacgguaauuauguuuucuuaauguuuccacaacagcucugccuuugc

SEQ ID NO: 4152114 - RNA, 57 nt, Human
gcaaauugcuuuguacaugccuagcaccuuguaagugcucagcauguuaagcauugc

SEQ ID NO: 4152115 - RNA, 83 nt, Human
gcaaauuuuuuucuguuaagggccagauaguaaauauuuuaggcuuugugacuauacugucucuuauagauaauaaguuuugc

SEQ ID NO: 4152116 - RNA, 57 nt, Human
gcaacaacuuguaggacugcacuguagcuuugcuaggugcuguuucccaaguggugc

SEQ ID NO: 4152117 - RNA, 109 nt, Human
gcaacaucaguaucauuuaggaguuacuuagagaugcagauucucagguccucaaaacagaccuacugaaucagaaucucuaaggugggaccugggugucugugguugc

SEQ ID NO: 4152118 - RNA, 81 nt, Human
gcaacaucccugggggcccugaaaucaggguucagcuaggcuccuaugugcccugagggucuggguucccaguccuguugc

SEQ ID NO: 4152119 - RNA, 64 nt, Human
gcaaccaagagacuccuguacacauuuuaguuuugugaugcuggaauuuugcucuugcaauugc

SEQ ID NO: 4152120 - RNA, 81 nt, Human
gcaaccacuggaaugcaaacuccacuggagcaggagcuuuuucacugcuuuuuucaccagugucuuguauguaggaguugc

SEQ ID NO: 4152121 - RNA, 77 nt, Human
gcaaccagccuucuccugcaccuaacacaacgcucuccacauaucuggagggcuggugcuuggagaaucaguugugc

SEQ ID NO: 4152122 - RNA, 71 nt, Human
gcaacccagcucuuuuaucaugaggagagguagccaugcugacucaugaacagguggaggaaagggguugc

SEQ ID NO: 4152123 - RNA, 69 nt, Human
gcaacccuaggaaacuaaugaagaaacgcaacuugaaaauagguuauuucagaagugguccuaggaagc

SEQ ID NO: 4152124 - RNA, 64 nt, Human
gcaacccugggucaugguugacauuguuccuaguuuauguaugaggacuguggcucagaguugc

SEQ ID NO: 4152125 - RNA, 61 nt, Human
gcaaccuguugaacuggcugauggcccauuugcuggggcacaaguuccacuacagaguugu

SEQ ID NO: 4152126 - RNA, 75 nt, Human
gcaacucccaugcucucucugagaagcauccauggccucagccaggcuauuucagcagaagccggagacacuugc

SEQ ID NO: 4152127 - RNA, 71 nt, Human
gcaacucuggauggauauggacaguaagcccacaacuacuuggccuagagcauucuaucuccaacaggugc

SEQ ID NO: 4152128 - RNA, 82 nt, Human
gcaacucuguaaagcucaucauuaggaggcuaccaagaagaauaggauaguccucccacccaugaggagcuaacaguucugc

SEQ ID NO: 4152129 - RNA, 76 nt, Human
gcaacugcagguggauggcacuuuaauccuuaggaguggaugauaccaaggaaggggaaaguguaccuggagcugc

SEQ ID NO: 4152130 - RNA, 88 nt, Human
gcaacugggguuuucugcacuauuguguucacuauuagcauagcucuguauaaauacuguaauaguuucauaaugugcuuccagcugc

SEQ ID NO: 4152131 - RNA, 83 nt, Human
gcaacuuccuuucauuagagaguuuaugauaugguuagggggauaacuuacuaacucaugauuuccugguuaaggacuacggc

SEQ ID NO: 4152132 - RNA, 56 nt, Human
gcaagaaaaaggcuucaugaacuuaggccacugagaucauggagguuuguuccugu

SEQ ID NO: 4152133 - RNA, 61 nt, Human
gcaagaaggguaguuguaagagugaugcaacagcacuaccucauuuuuauugcuaccuugc

SEQ ID NO: 4152134 - RNA, 82 nt, Human
gcaagaaugaaugugucccaaacuagaugccacuggguuuuauacuggaugugguuuuggauuauucaugcuauaaaaaugc

SEQ ID NO: 4152135 - RNA, 113 nt, Human
gcaagacaauucccuuuacuuuucagacucggcuuuuccccugugaaauggagaugagaguuucuccgucacuggcgugaagugaggacuaaaugagauaaguguaggcuugc

SEQ ID NO: 4152136 - RNA, 57 nt, Human
gcaagacagugacagucacaauuggaauuuaaguuuccaacacugcccauuguuugc

SEQ ID NO: 4152137 - RNA, 59 nt, Human
gcaagacauuguauuguguuccuaagcuuaacgcauagcagcaagaaugggaugugugu

SEQ ID NO: 4152138 - RNA, 58 nt, Human
gcaagacuggagagugaauaauucccuuuagaagauguauucacaaagccaguguugc

SEQ ID NO: 4152139 - RNA, 116 nt, Human
gcaagagaagccuagguugugagcacuggcucagggcugcaucugccuggugaaagggugcccuuuucaaguaacacaaaugcacccugugggcuacuggcuacccggguaaaugc

SEQ ID NO: 4152140 - RNA, 73 nt, Human
gcaagagacgcugaccguuuguuugggagaugaaaacucaccguccuggaacaaucccgguuuagcucacggc

SEQ ID NO: 4152141 - RNA, 83 nt, Human
gcaagaggcguuagaauuugagauugagagucacuuauuuaaaagccacaucacaguuugucagaaaucauaacaccuuuugc

SEQ ID NO: 4152142 - RNA, 65 nt, Human
gcaagaggcuguuagacauugccucuucuccucaccuggagugaguguucauagcaggcucuugc

SEQ ID NO: 4152143 - RNA, 57 nt, Human
gcaagaguggaacaaaggcagccagugucuguuugccauccaacaguuccaucuugc

SEQ ID NO: 4152144 - RNA, 75 nt, Human
gcaagauuagaaucaacugugaggggaacuaauuuaaacaagcccuuccuuagucuuauugagucucauauuugc

SEQ ID NO: 4152145 - RNA, 71 nt, Human
gcaagcaaauuauuuauaggcaaauaccugauccaacugccuacugaaacucuuguaaauaucuugcuugu

SEQ ID NO: 4152146 - RNA, 56 nt, Human
gcaagcagaucuccggagggaagagaaagucccacaucuccgggccacugcucugc

SEQ ID NO: 4152147 - RNA, 56 nt, Human
gcaagcaugugccugggcucaggucucucugagccugagcccuugcuuaugcuucc

SEQ ID NO: 4152148 - RNA, 87 nt, Human
gcaagcauuauuuguauguuuugucugcucuugaaggugccuaaaauuuucaaaagacucagauguagcgugcauagcagcuccugc

SEQ ID NO: 4152149 - RNA, 88 nt, Human
gcaagccaagucuagauuuugccacuaaauacuguucuuuccuaccuuaagacaauuuggaaaggcagcuggcaaauucuagagcugc

SEQ ID NO: 4152150 - RNA, 66 nt, Human
gcaagccuucaggaccuguuuuugagcaaacuugcauuugagcaaacaagucucucaauggcuugc

SEQ ID NO: 4152151 - RNA, 60 nt, Human
gcaagcugcucuuauguggagguuucuccccacucuccucuguaugggggucugguuugu

SEQ ID NO: 4152152 - RNA, 105 nt, Human
gcaaggaaaauagauaauguuggaagccacuuuagauaccaucuuagugugaauuucagcaguaguggauggguaaaguauuuuccaaaauaauguaucccuugu

SEQ ID NO: 4152153 - RNA, 60 nt, Human
gcaaggagcaccuuucuggaacccccuauagcauccaaguuucuuucugggcucucuugc

SEQ ID NO: 4152154 - RNA, 63 nt, Human
gcaaggcaaggaauauuuaagaacgucagauucauugacaucagcuuuuguauuccuuguugc

SEQ ID NO: 4152155 - RNA, 62 nt, Human
gcaaggcagggaaaguggauuaggcuuggucguuuauucucguucuuuccuucuuccuuugc

SEQ ID NO: 4152156 - RNA, 59 nt, Human
gcaaggcugccauaaaagguguuaaucaugucauuugcuaccauuaauguaagcuuugu

SEQ ID NO: 4152157 - RNA, 81 nt, Human
gcaaggguugaggacugguugaaagcuuugccacauucuauacauuugaaagguuuuuuuccaguaucucuuaucuuaugu

SEQ ID NO: 4152158 - RNA, 58 nt, Human
gcaaggugcccaaggaagguugccgucuuuucaguauaagauccuaccugggucuugc

SEQ ID NO: 4152159 - RNA, 114 nt, Human
gcaaggugugguggcgcaugccuguaaucaucccagcuacucuggaggcugaggcaggagaacugcuugaaccugggagguggauguugcggugagccaagaucgugccacugc

SEQ ID NO: 4152160 - RNA, 60 nt, Human
gcaaguaucuucaaacugccucgaggacaaacugccuugaggaguacaaagcaugcuugc

SEQ ID NO: 4152161 - RNA, 59 nt, Human
gcaaguaugaaucaaagacuaucuguaaucaguggguuaagacagucauucaugcaugu

SEQ ID NO: 4152162 - RNA, 67 nt, Human
gcaagucacaagcauauaugcauuaagauuuuaaaaucuaagaugcuuaagauguugguggcauugc

SEQ ID NO: 4152163 - RNA, 70 nt, Human
gcaagucacuugggcucugugggccuuaguuuacugaccuguaaaaugagaucucugguccaaaucuugc

SEQ ID NO: 4152164 - RNA, 76 nt, Human
gcaagucaugugauuuucuuauacgaucacaugggugggcugucuuccaucuugugugaugaugagaaagcuaugc

SEQ ID NO: 4152165 - RNA, 116 nt, Human
gcaagucauuuaaccucuucaggcuuagucuucucauaguaaaacuagagcuaucauggaaugauuugcaggaugcuugugaggacuaagugaaaugaugcaguugagugcuuagc

SEQ ID NO: 4152166 - RNA, 63 nt, Human
gcaagucguucccuuguccucucacaaccauacacagcaaaggaggugcaaggcauggcaugu

SEQ ID NO: 4152167 - RNA, 69 nt, Human
gcaagucuugucauuuuaucgauaggauacuuuuuaguauuugaucauuagaaugauucuuugaauugc

SEQ ID NO: 4152168 - RNA, 80 nt, Human
gcaagugggucauuaggaaauguguugcaagcagaagcuugaaaacugcuugcacauuggcauuuucugucuccugcugc

SEQ ID NO: 4152169 - RNA, 60 nt, Human
gcaaguguacauaucagaauuguauagcuaguugaauuugcacaaacugaguacacuugu

SEQ ID NO: 4152170 - RNA, 82 nt, Human
gaucaguugauuuugagauaggggacuuguucugaauaacuccuuucgagacuuuucugcugucuaugcaaguccuuugauc

SEQ ID NO: 4152171 - RNA, 71 nt, Human
gaucauacccaggcuuauguuggucagguagaaacaaaugugccaccuauaaguugggugacauuaugauc

SEQ ID NO: 4152172 - RNA, 108 nt, Human
gauccaaagguuuccguuuauucaguguggugcacaguuuuguaaaguucccuauugguaaaaugucagagcuguuacuauucaugaauuaaauuacaacuuuguauc

SEQ ID NO: 4152173 - RNA, 59 nt, Human
gauccacagggcccuggcccaggaagaaacucaaaccugaccccaaagcccuggggauc

SEQ ID NO: 4152174 - RNA, 58 nt, Human
gauccacaguuugaugaucauauguauuucccagugccaaugaauauggacuuggauc

SEQ ID NO: 4152175 - RNA, 84 nt, Human
gcaaucagacaaaagaaagaaauagauggcauuuaaauuaguaaagaagucaaacugucacuguuuacugaugcguaugauugu

SEQ ID NO: 4152176 - RNA, 95 nt, Human
gcaauccugggauggcacaaguuucccacaguguugaauccucucuuuugacaguagagacaagcaguguggagucuuccuccucagugauuugc

SEQ ID NO: 4152177 - RNA, 78 nt, Human
gcaaucuaugaaaugucauuuaggauuauguuuaaacuaccaauauuaaacuauaucaaugaugauggcuuauagugc

SEQ ID NO: 4152178 - RNA, 63 nt, Human
gcaaucuguuuaguucugcguaugcuucaauucaauuucauggcaauuucauaaacagguugc

SEQ ID NO: 4152179 - RNA, 72 nt, Human
gcaaucuuuguguaaguaucuuuguaucuuuguauaagugcaaagcacugcacauauauuugcaauuguugc

SEQ ID NO: 4152180 - RNA, 73 nt, Human
gcaaugacccuuguuuaucauuucugaauauuauacaaauuugcagaaaugacaaaguaagaggaagcaaggc

SEQ ID NO: 4152181 - RNA, 55 nt, Human
gcaaugagcacccagagggcaguggcgacgauguucugagucaggugcuccuugu

SEQ ID NO: 4152182 - RNA, 67 nt, Human
gcaaugagucaggguucaauucccauggucuaagauggcuaggagauugagcucugaaguuccaggc

SEQ ID NO: 4152183 - RNA, 62 nt, Human
gcaaugauuuucaucagagaagucuacagugauuuguauaggcuuuaugguagaaaguuugc

SEQ ID NO: 4152184 - RNA, 68 nt, Human
gcaaugccuugguucucuacuuggaggagcuuguaagagccaccaaaauuggaaauuaaggcuagugu

SEQ ID NO: 4152185 - RNA, 76 nt, Human
gcaaugcggggagggcugagacuggggucugggcuguuccggacuucaacacucaccccuuguccccccgcagggc

SEQ ID NO: 4152186 - RNA, 78 nt, Human
gcaauggagguucuuacauauuuucauaugguuauuuauccgguggcuguaugaguucauguguagaccacauauugc

SEQ ID NO: 4152187 - RNA, 77 nt, Human
gcaauggauaacaccgguucuguccuaaucaccacuugugaucucaaggccuccuagggcagagcuaugucuguugc

SEQ ID NO: 4152188 - RNA, 97 nt, Human
gcaaugggaguaucaaggagaaugcagcaagguagugcuggacucagaucccaccuccagagcuuugcagugauuguucuuggaaaacuuauuuugc

SEQ ID NO: 4152189 - RNA, 64 nt, Human
gcaaugggcacagcccagcccaacugaacuugagccagucguaaaggcugugguggugccuugc

SEQ ID NO: 4152190 - RNA, 86 nt, Human
gcaaugguuaaaugggcuaauaugugcuaaaaccagugacugacaaguagcacuauauguuagcuauuaucaucauuaauuauugu

SEQ ID NO: 4152191 - RNA, 68 nt, Human
gcaaugucagucaagcagcaaaugugugaguacuucuuauggauuaagcagcauugacuuggcauugu

SEQ ID NO: 4152192 - RNA, 63 nt, Human
gcaaugucuucuauaguuacucauuuacacugaaacgugauggguaacuuuuagggcguuugc

SEQ ID NO: 4152193 - RNA, 61 nt, Human
gcaaugugucaggaaaagggccaugugcuuuucugccauguccuuuucugggauagauagu

SEQ ID NO: 4152194 - RNA, 85 nt, Human
gcaauguuagaaugucuuugguucaggaguaccucucagacuucugggagggccagugcucucuagaugcaucuggcaaaauugu

SEQ ID NO: 4152195 - RNA, 69 nt, Human
gcaauguuuccgugagcauccuugagcauguauacaugaaugcuugugcuauuauuucaugggagaggc

SEQ ID NO: 4152196 - RNA, 90 nt, Human
gcaauguuuccuuaaggcagauaagaauucagcaagcuuuauucaacaaacuugcagagaaauuucugguuuacuuccaggacacauugu

SEQ ID NO: 4152197 - RNA, 62 nt, Human
gcaauuaaagaagaccugccucaaacauuuucugugugaccugaggcaaguccuuuuauagc

SEQ ID NO: 4152198 - RNA, 62 nt, Human
gcaauuagaggggcugcugaaugggaauaguucaauucucucaauucuccugucccauuagc

SEQ ID NO: 4152199 - RNA, 63 nt, Human
gcaauuauuaagcuuucuccaguguuagcuugugcuaggccacuggugggguuuaaaagaagc

SEQ ID NO: 4152200 - RNA, 77 nt, Human
gcaauuccuucugaagccuuuguguuuggcaucgcuaggcagcccagggucagcauaaaggcacuagaaagagaggc

SEQ ID NO: 4152201 - RNA, 84 nt, Human
gcaauucuuuuccuugggagguucuguucgcacuugacuuuuaucaagcggacugagauacucugcuucaacccgaagaacugc

SEQ ID NO: 4152202 - RNA, 84 nt, Human
gcaauugcucuacuucucucuccaacaauucacuuuaguaggaacaaagcuggacauuguaggggggaaaggaaggggcuaugc

SEQ ID NO: 4152203 - RNA, 73 nt, Human
gcaauuucggauguugcugcuguagcaacagcguacuuagugcuugucacauacaggagcauuccgaaauugu

SEQ ID NO: 4152204 - RNA, 56 nt, Human
gcaauuuggggagguucagacucuuggagcgagaggcugcauguccccuaaacugu

SEQ ID NO: 4152205 - RNA, 101 nt, Human
gcaauuuucauuccucuuugacacagauauuuguaguggguaagaaguuauuuggcuuauuauuacacugggaauuuguuagaacagaguaaugacauugu

SEQ ID NO: 4152206 - RNA, 76 nt, Human
gcacaaaccccugcaugucuguaauuacagagccucuugaugcuggcugcuguuggcagcaugcuggggaacgugu

SEQ ID NO: 4152207 - RNA, 102 nt, Human
gcacaaaucgccaagggguucuguuagaacgcagacucugguucaguagguccgggguggggccgagccucugcacuucuuacagguccugggugacgcugc

SEQ ID NO: 4152208 - RNA, 83 nt, Human
gcacaaauucauuaauaagucuaacucuccuucagccauaagguauuuggagugagagacauguuaacacaugaguuaugugu

SEQ ID NO: 4152209 - RNA, 67 nt, Human
gcacaaauuucuggcccuauggcauguaccugcugacagaguacacuuauauuugucaauuuugugu

SEQ ID NO: 4152210 - RNA, 78 nt, Human
gcacaacauucuggagcuggcagggcccuggacgauccuuuguguacagcccgggcucugcggcucccaucuuugugc

SEQ ID NO: 4152211 - RNA, 55 nt, Human
gcacaagccagcuuuuaaauucugcucaauuccaauuuaagaguaggcauugugc

SEQ ID NO: 4152212 - RNA, 83 nt, Human
gcacaagucccugaguucucugagccuuagccaaugggccagccaaccggaggccuauaggcaagugcugcucuugggugugc

SEQ ID NO: 4152213 - RNA, 123 nt, Human
gcacaauguuaaagcaacaauaauugguuccuccuggcuuuucccauugaaggaaauugaaauucaauugacuuucaauggaauagccauggaguuccaauugucauugcuccgacuuugugc

SEQ ID NO: 4152214 - RNA, 60 nt, Human
gcacacagaacauuuggauccucgcagaaaagacuauuagacccaacaguucuguugugu

SEQ ID NO: 4152215 - RNA, 56 nt, Human
gcacacagaaucagugggcauaauaaaauaguuguguaugcagcuagguuuggugc

SEQ ID NO: 4152216 - RNA, 62 nt, Human
gcacacagugggaaaaccugaagucuuuuuauccuucuguuuuuagguggaccauggugugu

SEQ ID NO: 4152217 - RNA, 71 nt, Human
gcacacaucagguguggucaccacagggucuaaucacagagcuuugugcacacucaccugaccaccugugc

SEQ ID NO: 4152218 - RNA, 64 nt, Human
gcacacaugcaugugugcauccauguguguuugugcaugugugugugcaugcguguuugugugu

SEQ ID NO: 4152219 - RNA, 61 nt, Human
gcacacauucggauucuuaaccaccagcuuaccagauagcuugcuguguccgugugugugu

SEQ ID NO: 4152220 - RNA, 104 nt, Human
gcacacggcugggcucucuggcaggaaggcuucagggaaggacccaugugaggcuuugucugcccaguuagaaugagagggcuuuguacaaucagcacguaugc

SEQ ID NO: 4152221 - RNA, 69 nt, Human
gcacagacauguccacaaagcauucaaaugucuuauuuggguguccugcugggauauuguucagagugc

SEQ ID NO: 4152222 - RNA, 59 nt, Human
gcacagacucuagguucagcugcaguaaucguuacugcugccaaaugcgagcucugugc

SEQ ID NO: 4152223 - RNA, 55 nt, Human
gcacagacuuugauugcagucaauucacgcacccugaggcauagcaggucugugu

SEQ ID NO: 4152224 - RNA, 57 nt, Human
gcacagagaggcugugagcgccagggcugggaaucaggagcucaugcccuacugugc

SEQ ID NO: 4152225 - RNA, 65 nt, Human
gcacagagaucggaacagaaguagagaagugaaccucugucuccugcccuucugacucucuuugu

SEQ ID NO: 4152226 - RNA, 90 nt, Human
gcacagaggggaaggggggcaccugcaugcccggcugggucucuguagacaguggaucaugcgaggccuccccucuccuugacccugugu

SEQ ID NO: 4152227 - RNA, 105 nt, Human
gcacagcaagggugggcauggcuuuccugcggcaucaccaaaccugcugccccauccccagcaggugcagggaguucaggaugaacaugucagcugggcugcugc

SEQ ID NO: 4152228 - RNA, 65 nt, Human
gcacagcccccagucugaacagcagcugccuucuccuuugggcaguuugcucugggggacugagc

SEQ ID NO: 4152229 - RNA, 56 nt, Human
gcacagccggaccgaggaaaaggauuauuccccucuucacgcgggucgggccgugc

SEQ ID NO: 4152230 - RNA, 100 nt, Human
gcacagccuguaugaacccauguugaacccuggacuuucaggacuacuguauggcuaaccacagcccugcaaggccaggcucagcaugucacaguuuugc

SEQ ID NO: 4152231 - RNA, 65 nt, Human
gcagaggugaguuucucagcugagugggcuuugaaaucaauuucagcuugauuucuuacagcugc

SEQ ID NO: 4152232 - RNA, 70 nt, Human
gcagaggugcuagggcaggaggugaggaggaugggaaaauccccagccuuugcuuccugguucccucugc

SEQ ID NO: 4152233 - RNA, 71 nt, Human
gcagaguggaagugcuugggcuuugauguuggaaggaagcuuuuuccuggccaaguuacucucugcacugc

SEQ ID NO: 4152234 - RNA, 63 nt, Human
gcagauauauguguggauucuuguagagugccuucuacacaccagacacacacuauauguugc

SEQ ID NO: 4152235 - RNA, 64 nt, Human
gcagauaugcccauaauuaugugucuauaaauaagaccauuuccaccaugggcacauuauuugu

SEQ ID NO: 4152236 - RNA, 108 nt, Human
gcagaucugcgcgucguggauugcagcugcaggcugugcaggaagaagcagcaccgccacuuccucgucccggccucgcgcuucacgcugcuccagggcgcagaaagc

SEQ ID NO: 4152237 - RNA, 56 nt, Human
gcagaucuugguggccauuggcuggacuccaggugggcacuccgcucgaggucugc

SEQ ID NO: 4152238 - RNA, 72 nt, Human
gcagaugcuaaagauuuaagaauaauuuguggcagaaacuuuaaauuauaguuaaugucuguuuuuaucugc

SEQ ID NO: 4152239 - RNA, 55 nt, Human
gcagaugcugggacuccagagcuaccuacagcaggagagccuccacggcuucugu

SEQ ID NO: 4152240 - RNA, 60 nt, Human
gcagauggagagaggggaggaggccccaacguggggcaguggcuccccuguuuucccugc

SEQ ID NO: 4152241 - RNA, 59 nt, Human
gcagauggcagcauaguggcaaguuauggagacaugcaggccaauuuauucugccaugc

SEQ ID NO: 4152242 - RNA, 73 nt, Human
gcagauggcagcccaggcugggugcaaguacaguuagugaagccagccauugccaggguuaauccacuucugc

SEQ ID NO: 4152243 - RNA, 64 nt, Human
gcagauggcccgcuagcuggccucuaguucauggguguuaagaggcuggguacgggccaccugu

SEQ ID NO: 4152244 - RNA, 55 nt, Human
gcagaugguggaggcaagaggcuuuaucugagccuuugggacccuggccaccugc

SEQ ID NO: 4152245 - RNA, 82 nt, Human
gcagauuagcagcagcugacagugggugccggcucacccacaggaguaaggcaauucauaaucgguuaaccuugaauucugc

SEQ ID NO: 4152246 - RNA, 66 nt, Human
gcagauuaucgaaugcaaggggccacaugcuagcacauuuaugggcucugcuugcaucaugacugc

SEQ ID NO: 4152247 - RNA, 81 nt, Human
gcagcaaagacaacuguuuucuguaaagggccagaggaucaauacuuugucuuuugugggaaauauggucuuugucaaagc

SEQ ID NO: 4152248 - RNA, 74 nt, Human
gcagcaagacuucagggcuugguuuaaauugcuuuuuuauaucuuaguuguaaucagccuggagucuacuuugu

SEQ ID NO: 4152249 - RNA, 81 nt, Human
gcagcaccagcccccacuuguucuggggggcagucaggaaggaucuggucaguuccugaucccccaggacaaaggugcugc

SEQ ID NO: 4152250 - RNA, 59 nt, Human
gcagcacugauccuaaacuuagagcuggggugagucugaguguggggacagugguuugc

SEQ ID NO: 4152251 - RNA, 87 nt, Human
gcagagcgaguugcuggaggacacacccagaguugaggccgggccugaucccuggucugaagcccacgugguaccagcugccuuugu

SEQ ID NO: 4152252 - RNA, 77 nt, Human
gcagagcucagccuuggcagguggaggauggagcuuagagccuuccuccagucuuggugagguugagcccaauuugc

SEQ ID NO: 4152253 - RNA, 104 nt, Human
gcagagcugacuucuguccucuagccacccagacauguggucccagaugaaucaguacauguguaacaugaucugguggccccaaggcucagagucaucacugc

SEQ ID NO: 4152254 - RNA, 86 nt, Human
gcagaggcaguacuuacuaaaauccaggcauucugacuucaaguccagaggauuccagucuaguaccuggaugcacugguuuuugc

SEQ ID NO: 4152255 - RNA, 87 nt, Human
gcagaggcuccauuuuacagauacagaagcugagguauaaagagaaaaaaauuacuuaacuuauccuucugagaaaggggucucugu

SEQ ID NO: 4152256 - RNA, 55 nt, Human
gcagaggcugggugucccagucauccuaguuggccuggaccacccuccucuuugc

SEQ ID NO: 4152257 - RNA, 67 nt, Human
gcagaggcuucagggcuuuugaggguuacuuagccaagucauugccucuguucccggagccaucugc

SEQ ID NO: 4152258 - RNA, 57 nt, Human
gcagagggcagggguguuuguuccuuuccauaacuagacaccacugcacuucagagc

SEQ ID NO: 4152259 - RNA, 77 nt, Human
gcagagggcaugcuugguggccuguuaagacaucaauaaguuuagaagcauucagcgucaucgugcaugugaucugc

SEQ ID NO: 4152260 - RNA, 60 nt, Human
gcagagggcgagcuggcuggccuucgggguguggcuccuggccgccgccuugugcucugc

SEQ ID NO: 4152261 - RNA, 67 nt, Human
gcagaggguccgcaggcagggccgagagcaggcagcccaggccuggcuccaccgccgcggagcucgc

SEQ ID NO: 4152262 - RNA, 56 nt, Human
gcagagguccuagccaggagucggccucaguuaacuugaaccucugggauguuugc

SEQ ID NO: 4152263 - RNA, 58 nt, Human
gcagaggugucaccuuccaggacuagcugcuguuggccugggagugugccaucucugu

SEQ ID NO: 4152264 - RNA, 78 nt, Human
gcagagguucaagugaaaugcuuuuugcgaaaugugcaaguuccuuuuguacauuuacaaaagcuuuauuuacucugu

SEQ ID NO: 4152265 - RNA, 99 nt, Human
gcagaguauugacaaugucauuuuugacuuugaagugagccauauaagugucacaucacaugagugcaaggaacacugacauacuucuucagcugcugc

SEQ ID NO: 4152266 - RNA, 56 nt, Human
gcagagucagccuccgagacaguucuuuugugucugucucgaaggcuccacucugu

SEQ ID NO: 4152267 - RNA, 65 nt, Human
gcagagugaauucgacuggaacuuaaauuggaguaaacuguucagauaugaauucauaucucugc

SEQ ID NO: 4152268 - RNA, 62 nt, Human
gcagaguggagauguguguggaagcauuccuccugaauuuuuuauagacucucucccuuugc

SEQ ID NO: 4152269 - RNA, 60 nt, Human
gcagaguggggugggguguuggcuuuggugcucccuggaguugacacaucuuggcuuugc

SEQ ID NO: 4152270 - RNA, 70 nt, Human
gcagauacuccaagauauuagaaaacauguuuuccuaucuuagcaaacauuuggucuaguguguguuugu

SEQ ID NO: 4152271 - RNA, 78 nt, Human
gcagauagcacagugguaagggcauaggcacugagaucaugccccaugguccaaaugcuggcccugcuacuuaucagc

SEQ ID NO: 4152272 - RNA, 70 nt, Human
gcagaucauaacagauacauagaauugaauaagauaacccugauuucuuugugugucucugugcaucugc

SEQ ID NO: 4152273 - RNA, 65 nt, Human
gcagaugacacuucuccaucaagucaaauggaauuacuuugauaugaagagaggcguguuuaugu

SEQ ID NO: 4152274 - RNA, 55 nt, Human
gcagaugcaaggguacuggggccacagccucucacaguaugaauuguucaccugc

SEQ ID NO: 4152275 - RNA, 62 nt, Human
gcagaugccacuaggugaagugcguauuuucuuuucuugcuuuuauauacuguggucucugc

SEQ ID NO: 4152276 - RNA, 57 nt, Human
gcagauggugccaugucuuguggauauuuugaaaaaauaggacaggcucccaucugc

SEQ ID NO: 4152277 - RNA, 88 nt, Human
gcagauguaaagacagcuaagggcacaggucaccugcgagaagaugagcacucgguguccuugcuccuucagcuuucgcagcaucuuc

SEQ ID NO: 4152278 - RNA, 107 nt, Human
gcagaugucuacaacuccaaggacacaugcauuggucuauuaugugaaaaaguaauccauuucuauuacauuaagccaauggauucuugaguuugauuuauuacugc

SEQ ID NO: 4152279 - RNA, 75 nt, Human
gcagaugugaucaggaaauuauuuauuaauauuggcuuuaaaauuuugugaugaauaaacuugagagucaucugu

SEQ ID NO: 4152280 - RNA, 76 nt, Human
gcagauguuagcuguuuuuugugaggaaauaaugguguuagcuaugaguuuucuuggaaagaaagagcuuaaaagc

SEQ ID NO: 4152281 - RNA, 77 nt, Human
gcagauuuaccauauguacugaguaucuaugaucaccuguaaauacaaggaaugcauaugaguaaugaggagucugc

SEQ ID NO: 4152282 - RNA, 68 nt, Human
gcagauuucacucuuaauugcuuccugauaaucuugauuagcgaaaagaauggaguggagucauaugc

SEQ ID NO: 4152283 - RNA, 56 nt, Human
gcagcaaagcucuucaugugauacgauacuguuugacaugccccagcuucuguugc

SEQ ID NO: 4152284 - RNA, 72 nt, Human
gcagcaacagcagcugaggagcugggcucuggcccuccaccccggugcccaccucugcacuguugaugccgc

SEQ ID NO: 4152285 - RNA, 70 nt, Human
gcagcaacgagcucuccuucuuucauuugugaucugaaauuucauuuagugugggagugcuuuaagcugu

SEQ ID NO: 4152286 - RNA, 61 nt, Human
gcagcaagaugcaaacauccgucccccagaagccggggcccugauuugcuuauuuugcagc

SEQ ID NO: 4152287 - RNA, 57 nt, Human
gcagcaagcacugcagcagaccaaacuaugaugguccugugaagccauguuuguugu

SEQ ID NO: 4152288 - RNA, 64 nt, Human
gcagcaaucccaagucugagugaccagggucaguguuuagguuauaaaccuuuggauugcuagc

SEQ ID NO: 4152289 - RNA, 101 nt, Human
gcagcaauuuuucuucuuauucuuucuuugcaaugaagcugagaauaaugcccuuagguuuuucucacuauguauguagauuggaagcaggaaggagcugc

SEQ ID NO: 4152290 - RNA, 130 nt, Human
gcagcacagggcagcaugaaggggaagaggaacuagcauuuuguggguucugcugauguacugauuaucccagaacagucaguugaauccaaggagccuguuaacaccauuccagcaguccuacagcugc

SEQ ID NO: 4152291 - RNA, 84 nt, Human
gcagcacagguugggcugcgaggaggagaagacucgguccagcacuugcuuccgcuucuugaagccgcuccaccugcugccugc

SEQ ID NO: 4152292 - RNA, 56 nt, Human
gcagcacccccuccaugguugugacaaucaaaaaugucuccugcaggggugugggc

SEQ ID NO: 4152293 - RNA, 61 nt, Human
gcagcacuggcuugaucagaagcacuguccuaaauacaagcagcacugucugaccaguggc

SEQ ID NO: 4152294 - RNA, 79 nt, Human
gcagcagacaaguguuauccuaauagacaaguguuaucuucacuauuuagcaaucauguuuacgugacaugucuccugc

SEQ ID NO: 4152295 - RNA, 78 nt, Human
gcagcagaccuggggcuguggggaauuggcuguugcuaccaccugcagauucuucauugccccauucacuauugcugc

SEQ ID NO: 4152296 - RNA, 73 nt, Human
gcagcagagcucuuugaaccugggcagucugcuccugacacacgucaccacucacuagguugagggccugggc

SEQ ID NO: 4152297 - RNA, 58 nt, Human
gcagcagaugugggcccagagcagaaaauguucuggcuuaagucaucccaucugcagc

SEQ ID NO: 4152298 - RNA, 63 nt, Human
gcagcaggcacggucucgacaugcagaaagacgccagcaaguucguggaucugugcgugcugc

SEQ ID NO: 4152299 - RNA, 75 nt, Human
gcagcaggcuucauuccaggauuccccucccagggcaggaaggagagggcuguggggcaugaccaggccugcugu

SEQ ID NO: 4152300 - RNA, 95 nt, Human
gcagcagggcuggaugcagguggccagggagcugugcuggagcccggcugcucaaaccacagauuuggcccagccaaugccccucagcucugcgc

SEQ ID NO: 4152301 - RNA, 57 nt, Human
gcagcauacugcaucaaaugaggguuuuguuucuagcuuucucagaacaguggcugc

SEQ ID NO: 4152302 - RNA, 84 nt, Human
gcagcaucaucguuuacccugagugauugccuugugauaggaaugcaugaagccagcacuucacgggagcgauaagguaucugu

SEQ ID NO: 4152303 - RNA, 85 nt, Human
gcagcaucccuaccauuccagacuagacuguuauaaauccucuuuaauagucuuagaaucuugaguguguuuuacagaauggugc

SEQ ID NO: 4152304 - RNA, 59 nt, Human
gcagcauccugggccacaguccucacgacuggcugggccaaagagacccaggacgcugc

SEQ ID NO: 4152305 - RNA, 70 nt, Human
gcagcauccuugggcccagcuccugcugcaggcucuggagggaugcaggagacuauggcccaaggccugc

SEQ ID NO: 4152306 - RNA, 77 nt, Human
gcagcaugagucugcccaccgucccacucaaucagcugacaacucgagugagugugaggugggagcuuggaaucugu

SEQ ID NO: 4152307 - RNA, 82 nt, Human
gcagcauggagaagacaagcugaguguuguccauggccuagaaugcuagguguaagggaaccauuuacuuucuucucugcuc

SEQ ID NO: 4152308 - RNA, 115 nt, Human
gcagcauggcuugcucaugcauuuaacuaaggaauaugacaaacucaaccaaaguaauaauaugguuggguuuuucucccuucuuucuguaauaugggcgucucacauggauugc

SEQ ID NO: 4152309 - RNA, 90 nt, Human
gcagcaugggugguccucugagcacgccaggcacgagugugcagggagcuggugcacaugccucugugugcgggugagcaucuguguugu

SEQ ID NO: 4152310 - RNA, 56 nt, Human
gcagcauguugaaagggccacacauucucuugucucagggccuuuauacaugcugc

SEQ ID NO: 4152311 - RNA, 77 nt, Human
gcagcauuuucccugcuggcuggggccaggcauugguaccugcagccugggccaguccagccccagggaaagcuugc

SEQ ID NO: 4152312 - RNA, 74 nt, Human
gcagccaaaccaaugaacaacacugaaggaagauaacuuaauguauucuacuagcauuguucacuuggccuugu

SEQ ID NO: 4152313 - RNA, 63 nt, Human
gcagccaccauggcucugcagagcacgcugggcucugagugucugcagugccacagugggagc

SEQ ID NO: 4152314 - RNA, 89 nt, Human
gcagccagcugaguggaaugcacuuccaacaucuauuagaugaugcaguuuauaaaagugggugccgaagugucccuccuguguacagc

SEQ ID NO: 4152315 - RNA, 55 nt, Human
gcagccaggggcugugaccuguugagcugguggcuggucagagcuaccuggcugu

SEQ ID NO: 4152316 - RNA, 59 nt, Human
gcagccauccaagagacauuugugaaugugcauagcuuucauaauuaucuuaggacugc

SEQ ID NO: 4152317 - RNA, 57 nt, Human
gcaucuucacacaaagccaguggcauuuauugagcaccugcuauguaugaggauugc

SEQ ID NO: 4152318 - RNA, 64 nt, Human
gcaucuuguguaggcauauucauagaguuguauagaaaugcugcuuuacugccugcuacucugc

SEQ ID NO: 4152319 - RNA, 56 nt, Human
gcaugaaagauguuuggggcuuuuucuaauccaagacccagagcacuuuuucaugu

SEQ ID NO: 4152320 - RNA, 57 nt, Human
gcaugaagggagguggcagucaggaaggccacacugauugggccacacugauucagc

SEQ ID NO: 4152321 - RNA, 74 nt, Human
gcaugaauacacuuuagaaaaacgcugcaguucucgauagcugcuugccuugugucuagaauguaacaguaugc

SEQ ID NO: 4152322 - RNA, 57 nt, Human
gcaugaauucuuccccagaaugauucccucuggagggaacugggccagaguuucugc

SEQ ID NO: 4152323 - RNA, 93 nt, Human
gcaugacuuagugaguuuagggugcagguguauacuccacuuuuuauauaaucuguuuaaguucacacuuggcucugagucacuacugucugu

SEQ ID NO: 4152324 - RNA, 91 nt, Human
gcaugacuucuggggcuaggccauaaaaggcauagaaacuuaucuugucucuuggauugcuugcucugagaaugaaaagaaaugguuaugc

SEQ ID NO: 4152325 - RNA, 121 nt, Human
gcaugagagcagcaucugaaccacucaggaggcuggacgugcauuucuacaguggauuccuaauucuguuuucugggguggagaaauauguucagcuucuucagcaguuugugaaucaugu

SEQ ID NO: 4152326 - RNA, 92 nt, Human
gcaugagcagaaugugggcuuuggagucaggaagacccagacccaaauuuugcauuuuguuuccuggcucuguggccuugucuaguucaugc

SEQ ID NO: 4152327 - RNA, 62 nt, Human
gcaacccagcucuaguuaugccagggagucucucaacuccacucaggugcuuaaguugcugc

SEQ ID NO: 4152328 - RNA, 93 nt, Human
gcaacccugggcuacucaguuccugcuucguggaucugccuggggucaggacauaacaucugugaagcaggaaggacagugcccagagcuugc

SEQ ID NO: 4152329 - RNA, 96 nt, Human
gcaacccuuugagacagggucuauuuuuaucaucuuuacuuuucagauacaaaaacuggaggcccagagaggugaagugaccugucucaaggcagc

SEQ ID NO: 4152330 - RNA, 71 nt, Human
gcaaccggguggaauuagaauuguucuacauguaugugucagaacucuauugauguccaacuggucucagc

SEQ ID NO: 4152331 - RNA, 78 nt, Human
gcaaccucaggcauaaucucaucuuguuucuauuacaauuucaaauucuggaaaaaggaaguuguggucuggaguugu

SEQ ID NO: 4152332 - RNA, 62 nt, Human
gcaaccuccucucccugucagcuccucacagccucuguggacacgagcugagaagaggaugc

SEQ ID NO: 4152333 - RNA, 100 nt, Human
gcaaccuggacuaaaucauguaggagaagaaagauguaaaaggauguuuaaaaaaacauuccauauauaccuuguuuuuuagccaugaagagagguuugc

SEQ ID NO: 4152334 - RNA, 73 nt, Human
gcaacgcucuggcggggcagaaaguugucuuuugcucccacaaaagcaaacacuuuuccuggucaggcgaugc

SEQ ID NO: 4152335 - RNA, 85 nt, Human
gcaacgugaguguacauguuuccuauaccuaugccagcaauauguuucagcuguuggcuauagagucauguuuacucuaauuugu

SEQ ID NO: 4152336 - RNA, 105 nt, Human
gcaacuaaggcagugcggucacauuguuugagaauacagaugcaaaauuacuugugaauuuacuugcucauuuuuccaaaggauguaaucuguacacuuagaagu

SEQ ID NO: 4152337 - RNA, 94 nt, Human
gcaacuacuuacauagcauuuacauugcauuagguauuauaaguaaucuagugaugauuuaaaguauaugggaagauguguguagguuaugugc

SEQ ID NO: 4152338 - RNA, 71 nt, Human
gcaacuccagaauccuagggucagcggcugggcuggccguugaugauugaacugggauucuugugacuugc

SEQ ID NO: 4152339 - RNA, 56 nt, Human
gcaacugccggcagagccacgcccgcccggccacaguuccuguaaccggcagcugc

SEQ ID NO: 4152340 - RNA, 90 nt, Human
gcaacuugaacucgugaguguucccagagaaggaugaaaaagcaagugaaaggacuuguaaauuacucugggaagaugaguuggagcugc

SEQ ID NO: 4152341 - RNA, 113 nt, Human
gcaacuuucaagagacaauggaagccugggagggcugggcuaaugccuuccauguggccaagaugcgaccucucaggcuuuaaucagacagucucagaaugagguuacguugc

SEQ ID NO: 4152342 - RNA, 76 nt, Human
gcaagaaauuauagucauauacauuacaugcuugauucucaggcucugucugucuguaauauauauaacugugugc

SEQ ID NO: 4152343 - RNA, 74 nt, Human
gcaagaccugggagccucugcggcccacgacaccuacaguuuuagaaucuggagagcagaugccucuggcuugc

SEQ ID NO: 4152344 - RNA, 62 nt, Human
gcaagacuggggugucugaugguaagggggcucggccacauugucacagauucucagcuugc

SEQ ID NO: 4152345 - RNA, 68 nt, Human
gcaagagauaguacaaagaagaauccaucccaaaaggggagcugugaaaucuuuguacaagucucugc

SEQ ID NO: 4152346 - RNA, 55 nt, Human
gcaagagcagcuuccuuuauuacuggaagaaaaucagugagauugcugcucuagc

SEQ ID NO: 4152347 - RNA, 128 nt, Human
gcaagagcccgguucuggagugggaguagaagguacaggcauugcugcagcggcaggacaggagcccauugcugacagagugccuggccucaaauuacacuguaucagagcucgggcauaaaauuggc

SEQ ID NO: 4152348 - RNA, 61 nt, Human
gcaagaggccucgugcucagcgugcagaacacugaagccacgauagcuuccuaacacuugc

SEQ ID NO: 4152349 - RNA, 72 nt, Human
gcaagaguuagcagucuuguguguuaauaguuugccuuugaauuuagaacuagaaaacaagaugcugauugc

SEQ ID NO: 4152350 - RNA, 58 nt, Human
gcaagaugguuauaaaaaauguugaaaaagagacauucuuccuuuuguagcaucuugc

SEQ ID NO: 4152351 - RNA, 99 nt, Human
gcaagcccccucgggccucgggggauggggccggccacaccccugacuccgcccuggcucugccccauaccccugccguggggccgaccugggggaugc

SEQ ID NO: 4152352 - RNA, 75 nt, Human
gcaagccuagagccucauccucaggacgacugcugggaaucucugcagggcccuugggguugaacagcugcuugc

SEQ ID NO: 4152353 - RNA, 100 nt, Human
gcaagcguagccuuagggcuggccaggaguguguggcuauguuggcuccucucuggacuuaauuggguaugugcacauccucagccaaguauacacuugc

SEQ ID NO: 4152354 - RNA, 106 nt, Human
gcaagcguugccgcgccgcuaccgucgggggccggcccccgggcugcuuuucgugcgcggagcagcucggccagucaccaggcgcgugcggaggcggcgagccugc

SEQ ID NO: 4152355 - RNA, 66 nt, Human
gcaagcuccugcacuugucgcugaagagcaagggcucaggugggcguuccggugcgggaaccuugc

SEQ ID NO: 4152356 - RNA, 68 nt, Human
gcaagcugaguuauggagaauaaagucaugcuuuucauacaccugaguuuauggccaugauucaaggc

SEQ ID NO: 4152357 - RNA, 71 nt, Human
gcaagcugcugcuaagagauaaauugcucucccaccuccccagcugagagucaugucuggguaacagcugc

SEQ ID NO: 4152358 - RNA, 63 nt, Human
gcaaggaucuguuguggggccagugugccaugacacccuuggcagcaccagcaguguccuugc

SEQ ID NO: 4152359 - RNA, 71 nt, Human
gcaaggauuucagccaacagaaucuugucaaaauuccugaauugauucuucauggcugugaguccucaugc

SEQ ID NO: 4152360 - RNA, 58 nt, Human
gcaaggcagggagcagaaaacagagccacuugaaggcuuucugucugcgucugugugc

SEQ ID NO: 4152361 - RNA, 65 nt, Human
gcaaggcauaggagggugucaggccucugagcucaaacuaggccaucauauccccugugaccugc

SEQ ID NO: 4152362 - RNA, 68 nt, Human
gcaaggcugaccucucuagacuguauuaucccagcucccuugcccuucugguugggucaggccccugu

SEQ ID NO: 4152363 - RNA, 57 nt, Human
gcaaggcugccgcagccaaugguuggcgagccgccggcuggcugggcggggccgggc

SEQ ID NO: 4152364 - RNA, 58 nt, Human
gcaaggcugcugccacccaucugcaacucuccaccagagaugggaggcuguguuuugu

SEQ ID NO: 4152365 - RNA, 58 nt, Human
gcaaggcuggccuuaaugauuuuugggagugguccaaauagagauaggccagcuuugc

SEQ ID NO: 4152366 - RNA, 78 nt, Human
gcaaggguuuucagagcaacaguuuaugguuuuucuguuugguuuauagagauacuggcugcucuugagaaaacuugu

SEQ ID NO: 4152367 - RNA, 77 nt, Human
gcaagguacagggaaggagcaagacuuagacuuuggaaaagcuggcuucaaauucugacucuauccuugugcuuugu

SEQ ID NO: 4152368 - RNA, 113 nt, Human
gcaagguggaggugagguggacucagcaggguugcaugucagcucagaccccaaacuauugagaucagauagcuggcugcuuguagacucgacugaccucauuccacugcugc

SEQ ID NO: 4152369 - RNA, 105 nt, Human
gcauuauuaggguaguaacaaugauagcuaccguuuaugcugugcuaacuagggcacaguuauaagacuaagcuauucgcauacaucuaaucuuuauaauaaugc

SEQ ID NO: 4152370 - RNA, 81 nt, Human
gcauucacaggcucuccaccaugaggccucacacacacaucuccaauccuguguuccuccauggcaagggucuguggaugu

SEQ ID NO: 4152371 - RNA, 56 nt, Human
gcauucaggaaccggaaggguagaaacacaaagaauuccggugcuuccugggcugu

SEQ ID NO: 4152372 - RNA, 76 nt, Human
gcauucaucuacccagaacuauuuuugguguguguucauagacagcacacaccaaaguauuugguauuugagaugc

SEQ ID NO: 4152373 - RNA, 71 nt, Human
gcauuccugagggcccccuacuuggcaaacaaaacccuugaaagugggccuguaggguuuucaggaacaac

SEQ ID NO: 4152374 - RNA, 65 nt, Human
gcauuccuggcacccuggacccggccugugaguuaugacgagcugaguugggugguggggggugc

SEQ ID NO: 4152375 - RNA, 61 nt, Human
gcauuccuguaccucucugcuaguaucuaaugaugcauauuaaugagaguguauuggaugc

SEQ ID NO: 4152376 - RNA, 88 nt, Human
gcauucuuccacucugaccugcuaagccccuguccgaaugaaccacccauggagggagaggugaggccggggccggacugaaggaugc

SEQ ID NO: 4152377 - RNA, 64 nt, Human
gcauucuuuuuaggagguuccuguuauaaauaaccacaaaauaacuuaccuuagugaaggaugc

SEQ ID NO: 4152378 - RNA, 73 nt, Human
gcauugacuccuuucacugauagacucgccguuagggugcaacaucagccucacaguuuauuagaguaagugc

SEQ ID NO: 4152379 - RNA, 84 nt, Human
gcauugccguuuguagcaaagcuuacuuagugaugccaggaguucauuccaauccuuaagaaaguuuucuauaauuucaaaugc

SEQ ID NO: 4152380 - RNA, 82 nt, Human
gcauugccuuugccccaguacacaagauucugaaauuauaaucuuuauuuguaauucaugugccacuggugaacagggaugc

SEQ ID NO: 4152381 - RNA, 56 nt, Human
gcauuggcagaaacagcagggccagccggcuuugccuggcccuguuuucuccaggc

SEQ ID NO: 4152382 - RNA, 67 nt, Human
gcauugggccugaggccagaacuuccacuccgcaugcugucccgagguucccccgccaggacccugc

SEQ ID NO: 4152383 - RNA, 67 nt, Human
gcauuguggaaaauacagucuugaacaagggcauuuguggaccaagauuuauauuuucacacaaugc

SEQ ID NO: 4152384 - RNA, 92 nt, Human
gcauuuaacaacuaggaagucuuaacugacaguuuaaugggugcuaaagguguaagacccauuucuguaaguugaguacuauguuauuaugc

SEQ ID NO: 4152385 - RNA, 61 nt, Human
gcauuuacugugcuagagcauuuguuucucagagcccaaaagcucuuucugcuguagaugu

SEQ ID NO: 4152386 - RNA, 88 nt, Human
gcauuuaguuucucacuuccaguagccaaguuuagaaaauuaaacaaaauugugcucuuggaaguuagauuuuuguuaaucccaaugc

SEQ ID NO: 4152387 - RNA, 67 nt, Human
gcauuucaaauggaauaccuagguggcccagggggaccccugaccccuauauccuguuucuuucugc

SEQ ID NO: 4152388 - RNA, 87 nt, Human
gcauuucaucuuguuucucaucuguauggcacauauuuuugggauagcuccagucuauguaaacgucuacauuaaccagagaaaugc

SEQ ID NO: 4152389 - RNA, 55 nt, Human
gcauuucccacaggaaaguagacauuguugccaauguauugucugugggacaugu

SEQ ID NO: 4152390 - RNA, 79 nt, Human
gcauuucccaguccccaucaauaucagaucagacaggaggcuuuuuucuagaugacuuuaugauguagacaggaaaugc

SEQ ID NO: 4152391 - RNA, 96 nt, Human
gcauuucccaugauuggcuucaaauggagcaaccagagcugaacagaauuuggggguuucauguugaguuccagauugccauauggguucagaugc

SEQ ID NO: 4152392 - RNA, 73 nt, Human
gcauuuccugccaggguuccuuuaagcuuugugauucaguucccauggccaaggggccuaggcagggaaaugu

SEQ ID NO: 4152393 - RNA, 60 nt, Human
gcauuuccugugcuuggcauaugaggaaaacaacaacaaaugcucaguaucaggaagugu

SEQ ID NO: 4152394 - RNA, 84 nt, Human
gcauuugaggauaggcacaaaaugaaaauggcagauuucguucgaauucuguuagaagagacguuuuuaaagugccccuagugc

SEQ ID NO: 4152395 - RNA, 87 nt, Human
gcauuugagguguggccugauuuugcaucucuaacaagcuucaagcuaauauagaugcugcuggucuuggaacauacuuugaguagc

SEQ ID NO: 4152396 - RNA, 73 nt, Human
gcauuugaugaaagaguucucagaaacgugggucuaaauuugauucuaguccugagggcaucuguucaauugc

SEQ ID NO: 4152397 - RNA, 58 nt, Human
gcauuugcuuccugggucuugaauuuccaccauuaaauuucagucuaguggcgggugc

SEQ ID NO: 4152398 - RNA, 80 nt, Human
gcauuugguaaauaacaaucacaguguacaaguaagugauaguuugcaaaccugaacugcugugagcaauuuccagaugu

SEQ ID NO: 4152399 - RNA, 57 nt, Human
gcauuuguaaggauuaucugcguuauggauuacuugguuaguaaggcuugcagaugc

SEQ ID NO: 4152400 - RNA, 56 nt, Human
gcauuuguguccuguuuuaccaaaggcuugaaaacaaggcucagugacauaggugc

SEQ ID NO: 4152401 - RNA, 55 nt, Human
gcacaaagccaaaugaaagaugguucuugccuuccaggaacuuuuggcuuugugu

SEQ ID NO: 4152402 - RNA, 117 nt, Human
gcacaagagcaaugacuaaguucguuacaugugaucagaaagugaaacacaucuaccauguuaauguagcuuucaauuuauggugacauuuacugaaaauacucugcaauauuuggc

SEQ ID NO: 4152403 - RNA, 129 nt, Human
gcacaauauaugaaaguucuaauauucaacaguggacaaaugauuucuaccuuuuucaaucaauaaaaccuuuagaaaucucagagagacauuuguuuaauauuaggaauuuauucacuuguauaaaau

SEQ ID NO: 4152404 - RNA, 84 nt, Human
gcacaaugccuagcacauggucaucacuugauaaauagcagcugcuauuauuauguuaacuggacugauuuuaggcagcugugu

SEQ ID NO: 4152405 - RNA, 77 nt, Human
gcacacaauagucagaagacugugccagggaguguguuugcccuggcuagcucuggccaguuacugcuauuggcugc

SEQ ID NO: 4152406 - RNA, 72 nt, Human
gcacacaccacagagggaccuggggacgcccguuggucagggcuuuccuggccagcuguggugaguuugugc

SEQ ID NO: 4152407 - RNA, 56 nt, Human
gcacacagguagagcaugcuuuuguccuugaagaggauaauuauuuacuuuugugc

SEQ ID NO: 4152408 - RNA, 56 nt, Human
gcacacuugcaggguaugcucgggcacccguguccaagaggagcaggcaggugugc

SEQ ID NO: 4152409 - RNA, 60 nt, Human
gcacagaaauuccaacccuggacauaauucugagucagaguuggccuuucuguauuuugc

SEQ ID NO: 4152410 - RNA, 84 nt, Human
gcacagacuuaacccagaaacgcaggcggucaggaaaucuaaugauggcuucggaccugggcagacuugaguugagaccugugc

SEQ ID NO: 4152411 - RNA, 61 nt, Human
gcacagagacaggagugcucccagugccaaaaggagaacuggcuucugcuucugcuccugc

SEQ ID NO: 4152412 - RNA, 87 nt, Human
gcacagaggugacgggagggagggcugcacuggcaauuaggaaaauuggauucuagcccugcuucaccauuuacuucucuccugugc

SEQ ID NO: 4152413 - RNA, 62 nt, Human
gcacagaucuuuguuggacagcuguacaucugcacaguuucuuaagacugagaucuuacugc

SEQ ID NO: 4152414 - RNA, 96 nt, Human
gcacagcagcagccgagucuggagcagcaguauuggugacaagaugucaccagagcccaucugcuccuaggcaugacuuugacuaaacuguugugc

SEQ ID NO: 4152415 - RNA, 87 nt, Human
gcacagcccgcucgcuugcaggucuccaugagugcgaggggaacaagaccuuugugugcugagggccugcugugcaggggacuuugu

SEQ ID NO: 4152416 - RNA, 58 nt, Human
gcacagcucuccccaagacgaaaccuucagcuuucgauuguaaauccaagagcugugu

SEQ ID NO: 4152417 - RNA, 73 nt, Human
gcacagcuggacaugucggauagaaugaguucaucccuucaaagaugagcuuaaagccgccaucuaguagugu

SEQ ID NO: 4152418 - RNA, 104 nt, Human
gcacaggauaucauggguguaucaagaagaggcaccagacauggccucauauagaaaauguaaaagccacuguugucuuucagauaauucccagauagagcugc

SEQ ID NO: 4152419 - RNA, 66 nt, Human
gcacaggcagucucaucaggcauguagucaaugaaugacuguucacuaaugggaauguuaaugugc

SEQ ID NO: 4152420 - RNA, 88 nt, Human
gcacaggccaucaugaaaacuugacaagugagguaguaggaauuaauacuccuuuuuuuaguuaaguugucuaugagggauucuaugc

SEQ ID NO: 4152421 - RNA, 57 nt, Human
gcacaggcuccggaggagagcuguauuggaauucugacucacuccucguagcugugu

SEQ ID NO: 4152422 - RNA, 78 nt, Human
gcacagggcgcuuggggcaggaagcaggagaagugaaggaaaacguagcugaugguccugucucaaggagccuuuugc

SEQ ID NO: 4152423 - RNA, 130 nt, Human
gcacaggguaagaagucugcaugaagucugucugaggcuagagcaggggcucaauaaggucauacaggacucagguuccuuugcucuuucugacuacugguucucagcagguugccuuuuugugcugugc

SEQ ID NO: 4152424 - RNA, 62 nt, Human
gcacagguugcaaaaguucacauuuuagcuaacauguuuugugaugcuuuucuuaaccuugc

SEQ ID NO: 4152425 - RNA, 72 nt, Human
gcacaguaggcucagcucuaucuuaauuggauuuucugacaaucaccaguaacuuggagcugagugcugugc

SEQ ID NO: 4152426 - RNA, 55 nt, Human
gcacaguagguauuuacccagugugguaugcagggguagugcaaccauacugugc

SEQ ID NO: 4152427 - RNA, 59 nt, Human
gcacaguauugcacaacucuagggggcaacaucuacagugaaagguaugugagcugugc

SEQ ID NO: 4152428 - RNA, 56 nt, Human
gcacagucacugccugcaugucuaacuucccuagacagugaggacagggacugugu

SEQ ID NO: 4152429 - RNA, 59 nt, Human
gccaaggauaccagcugugagauuugaacaaguuacucaaccuugcugaguguccuggu

SEQ ID NO: 4152430 - RNA, 64 nt, Human
gccaagguuggaggaucacguuagcccaggaguucgaggcugcugugagcacuccagccugggu

SEQ ID NO: 4152431 - RNA, 57 nt, Human
gccaaguccaguggucaauuaucuggauuacuuucagucaaugaucaauggcucggc

SEQ ID NO: 4152432 - RNA, 89 nt, Human
gccaaugcauuagaugaagcuuagaagggcauuuucuaaccauuacaaauugccuagucuagcaucucaauuucaucuacgugaagagc

SEQ ID NO: 4152433 - RNA, 83 nt, Human
gccaauguuaucaugcuucaucaucacuguuagaaaccggaugcugacuuuggagcauggcccaauaagaaccuagcguuugc

SEQ ID NO: 4152434 - RNA, 77 nt, Human
gccaauuaacuauuauuuacuauaacucuugguuguugucagagacaucaacuauauagaaauugauuguaagaggu

SEQ ID NO: 4152435 - RNA, 61 nt, Human
gccacaaaaacaggaacaugucaacucaucuugcauggcagcaauuuuccugacuuugggc

SEQ ID NO: 4152436 - RNA, 85 nt, Human
gccacaaagagggcuccagcggugucggcugccucggugugcgguucacuguggcuguguccaccugcugccuuccucucugggc

SEQ ID NO: 4152437 - RNA, 64 nt, Human
gccacaacuuuuugccccaguuaguguuuguugaguucaacacagcuaugggguaggaaacggc

SEQ ID NO: 4152438 - RNA, 90 nt, Human
gccacaaguaccagugccaaggcucuuggucuggaauucugaaaacauuuaccucugacccuggcagcccacuggccauugcuugugugc

SEQ ID NO: 4152439 - RNA, 88 nt, Human
gccacacccugcagcaggucaggcugggcugguguuagagucaagaaugggaggcuugggacuguggucugugcugcagggugauggu

SEQ ID NO: 4152440 - RNA, 56 nt, Human
gccacaccuuccucuagccuaggaauugauaacccaggcgaggaagucacuguggu

SEQ ID NO: 4152441 - RNA, 56 nt, Human
gccacaccuuucucuagccuaggaauugauaacccaggcgaggaagucacuguggc

SEQ ID NO: 4152442 - RNA, 68 nt, Human
gccacacugcuuuuuagcccucucagaaccaaauagggucucaggagacuggagagcauggguguggc

SEQ ID NO: 4152443 - RNA, 88 nt, Human
gccacagaaagcaggaauguuuuguaugccucugagcuaagaaugguuuucacaggggccugcaaaaccuaaauauuuacugucuggc

SEQ ID NO: 4152444 - RNA, 68 nt, Human
gccacagaggagugcacacucucugggaucacuuccagagucagagaggugauuauuucauuuguggu

SEQ ID NO: 4152445 - RNA, 66 nt, Human
gccacagcccgagcaccaugagcuccggagacccugcacaccucggccucugccucuggcuguggc

SEQ ID NO: 4152446 - RNA, 55 nt, Human
gccacaggcuccagcaucaguaugaaauccauuacuguccgucaagcccuguggc

SEQ ID NO: 4152447 - RNA, 62 nt, Human
gccacagggcgagcggaggccagggacaggacucaggaccuuggagaggccgcccguguggc

SEQ ID NO: 4152448 - RNA, 75 nt, Human
gccacagugguaguaguaggcuuucaauuuugucuccaaaaaaaguauauuuuuagcuuacauuaccauuguugc

SEQ ID NO: 4152449 - RNA, 57 nt, Human
gccacaguuaugggaaacguaguuucaagagcugcuauaaucugccauaacugaggc

SEQ ID NO: 4152450 - RNA, 92 nt, Human
gccacauaucagauuaccucagaacauccugguuuaaaaugacaaauauuuauuaccucggaguuucugugagucaggaaucuggguguggc

SEQ ID NO: 4152451 - RNA, 69 nt, Human
gccacaugcauaugcauggacacucagagguuguuuauuaccuuugauuucaaaauauaugcuugaggc

SEQ ID NO: 4152452 - RNA, 81 nt, Human
gccacauuggagggacugguguacaauaguuaagagugaugauguccuuucagugcuucuguuuaccgguuuuucuguggc

SEQ ID NO: 4152453 - RNA, 57 nt, Human
gccacauuuuucuuguucuuggucccagaagcuuucugcagagaugaagaagguggc

SEQ ID NO: 4152454 - RNA, 120 nt, Human
gccaccaaauaugcguuacgugauguguauuacucuacuccaaaaggcuacaaucauguuuuaguuuacaugagugacgcccucuggaguagggcacuacacucagcugaaggugguggc

SEQ ID NO: 4152455 - RNA, 124 nt, Human
gccaccaccaucagccauacuauguguagugccuuauucaggaagguguuacuuaauagauuaauauuuguaaggcacccuucugaguagaguaaugugcaacauggacaacauuugugguggc

SEQ ID NO: 4152456 - RNA, 89 nt, Human
gccaccaccuggccuuggccugggacagagcagcaguggggaggggccuuugugcaucucugcuccuacagcucagggcugggaguggc

SEQ ID NO: 4152457 - RNA, 78 nt, Human
gccaccagcuugcccaccugcuuccucgcuugggcucugucauuucugauccaggugagugcaggugcagaugguggc

SEQ ID NO: 4152458 - RNA, 68 nt, Human
gccaccauagaggccuuccuguagguuuagcauauccaucugcuaccaggaaugcauucuagaauggc

SEQ ID NO: 4152459 - RNA, 123 nt, Human
gccacccaaguucauagcugcuauuugcuggcagcacgacaggaguggaaggaaacagcguagugaccccaccuuucuuuugagcugguaggaagaaaacagaagauggacuugggguugggc

SEQ ID NO: 4152460 - RNA, 108 nt, Human
gccaccccccacagccucuccagcagagugggagcccagggcugggcaagcccccgccuuguccgcaggugcccacaucucuuggguuggcagugguaggcagauggc

SEQ ID NO: 4152461 - RNA, 57 nt, Human
gccacccuggcuacugugaaagcuacagguggggguccugacagagagcaggguggu

SEQ ID NO: 4152462 - RNA, 56 nt, Human
gccacccuugcgucacugacauugggcucuucagucauugucauguuguaauuggc

SEQ ID NO: 4152463 - RNA, 84 nt, Human
gccaccgaggagccccaggcagccaggggaccuguccuucacccuagaggauagaagcccaaaggcugcggcugcugcaguggc

SEQ ID NO: 4152464 - RNA, 74 nt, Human
gccaccuccuugcaaaguugccaagaguuccagaagaaagagaaggcuacagcuuugcacaacagagagguggc

SEQ ID NO: 4152465 - RNA, 57 nt, Human
gccaccuguaagccauuaggccuggaaugaaaaucaagccugaaagcugccaguggc

SEQ ID NO: 4152466 - RNA, 62 nt, Human
gccaccugugugggccuuugugcaaauccaaggaaagcauccggugcccaacacaggcuggc

SEQ ID NO: 4152467 - RNA, 86 nt, Human
gccaccuugcugcccaugaaaauguagggaugcauaaagccaguguuuaggucauuccuuauguugauucagggaggucacuuggc

SEQ ID NO: 4152468 - RNA, 86 nt, Human
gccaccuuuauucuacucugccccagccaauaauggguacccuugaggcuuacaggcugcagggcuagagggagaugagagguggu

SEQ ID NO: 4152469 - RNA, 90 nt, Human
gccaccuuuggcacccuccagccacggcucuuuguuuucuauagcaucccuggggaugugaagguaaggaggggcaagaggguggguggc

SEQ ID NO: 4152470 - RNA, 88 nt, Human
gccacuaauccaauuaagaaaguucagcuucccaggucacugaaggaaaaugucucucaggagagguuuggacaugauagauuaaggc

SEQ ID NO: 4152471 - RNA, 59 nt, Human
gccacuagggggccauuuaguuuucugcaacaggagaacacuaaugguuucuuaauggc

SEQ ID NO: 4152472 - RNA, 55 nt, Human
gccacuagucaagagauuggggcucucuaaugagccaagacucccaucuaguggu

SEQ ID NO: 4152473 - RNA, 69 nt, Human
gccacuccucggccuuggguucuaguagcaacugaaagcuaggacacaggcaggaggagaucaccaggc

SEQ ID NO: 4152474 - RNA, 64 nt, Human
gccacucuacucuuuuccguugcuggcccuuagaccgaggacagcaaugacggggcagcugggc

SEQ ID NO: 4152475 - RNA, 76 nt, Human
gcagauucuugggcccuccccuugugaaucagaccuacugaaucagaacuucucagggugggguucacuaaccugu

SEQ ID NO: 4152476 - RNA, 61 nt, Human
gcagauuggagacagaugggcuccagcauuauccaugugugaggucauugucccaggcagc

SEQ ID NO: 4152477 - RNA, 77 nt, Human
gcagauuuaugagaggggaugggucuaccuggagugacuugaggaauacccagaagaccccguccaccuccuccugc

SEQ ID NO: 4152478 - RNA, 55 nt, Human
gcagauuucuugaggaaauguuuugcgguguuaacaaccuucuggagauaucugu

SEQ ID NO: 4152479 - RNA, 67 nt, Human
gcagauuugcuccagugcagcugcagccccaggaaaugaggaaaggcugugcuggaaggggaccugc

SEQ ID NO: 4152480 - RNA, 71 nt, Human
gcagauuuuuagaguguuaccaguauacccccuucauaccauggcgguccagcuguugauauucuaggugc

SEQ ID NO: 4152481 - RNA, 73 nt, Human
gcagcaaaugucaaagagaaacagucaugccuaagagucauuaaaugauuuguuuuucauucacaugggcugu

SEQ ID NO: 4152482 - RNA, 76 nt, Human
gcagcacagggcagugauuaaacucaggcacucaccccacccuaccugggaaucugaauucugucuuuucugcugc

SEQ ID NO: 4152483 - RNA, 56 nt, Human
gcagcacuggcaauagaauggacaacuagaacuugucccagcugggucagugcugc

SEQ ID NO: 4152484 - RNA, 65 nt, Human
gcagcagagccagaauuggaccaguaccucucugacuggggaaccugauuuuucuguuuugcugc

SEQ ID NO: 4152485 - RNA, 73 nt, Human
gcagcagaggaaagcaaaucuaaaacaacacaaaagguaauaguuguuuacuuggucaagcugucuucuuugc

SEQ ID NO: 4152486 - RNA, 78 nt, Human
gcagcagcagcagcaauuuucugucccccugguuuugucuucuggggcaucuugaccaggauuuguugcuguuucugc

SEQ ID NO: 4152487 - RNA, 103 nt, Human
gcagcagcaucaccugggauuuugaaagaaaugcagaaucucagcccuugaccuagggaaucagagucuacauuuucacaaggucuccaaaugaugcaucugc

SEQ ID NO: 4152488 - RNA, 60 nt, Human
gcagcagcccacagcuggaggccuaggaguguccaugggcauggacuguggagccgcugc

SEQ ID NO: 4152489 - RNA, 64 nt, Human
gcagcagcccagccuugucucuuuauaggguccuagagaaccggugguggcuggguugaaaagc

SEQ ID NO: 4152490 - RNA, 75 nt, Human
gcagcagcccaggcccagcaccagcggucuuccggcuccucugagggcugccacguugggcgaggggagccaugc

SEQ ID NO: 4152491 - RNA, 56 nt, Human
gcagcagcucccuauccaggcuccuguuugcagagcuggaaauggccgagcucugc

SEQ ID NO: 4152492 - RNA, 80 nt, Human
gcagcaggcuaagacagggagggcucucagccgcuuggauuucuacacagcugcaaguccuucccucucuuuucuggugc

SEQ ID NO: 4152493 - RNA, 86 nt, Human
gcagcagugcuauggccagggugccuguccucagcaaaccucauggucugacuggagaaucagggcccaguucuuagcaagguggu

SEQ ID NO: 4152494 - RNA, 121 nt, Human
gcagcagugggagcgguucacccuggcuuuauucuguuggcccucucauccugucccugccgcuuagacaaggaucaaggaugggccaaugggaugcaaagguagcugaacccacaccugc

SEQ ID NO: 4152495 - RNA, 59 nt, Human
gcagcauacagggagaguacucauuacccaggcagugguuacccuuucuaugcugcugc

SEQ ID NO: 4152496 - RNA, 112 nt, Human
gcagcauagcauauugugaaaaucuggaaccggcaccuugagagaaugaggauuaacccccuugaguuauuaauggcugaguuugaaggauaccucacugucccuguguugc

SEQ ID NO: 4152497 - RNA, 55 nt, Human
gcagcaucuagggcacuggccuggaguaucgcaggugcuuugccuaagguggugc

SEQ ID NO: 4152498 - RNA, 67 nt, Human
gcagcaucugagggguugugagaaauguaggauuuaaagguccuacaccugacccuacagaaacugc

SEQ ID NO: 4152499 - RNA, 90 nt, Human
gcagcaugggugguccucugagcacgccaggcacgagugugcagggagcuggugcaaaugccucugugugcaggugagcaucuguguugu

SEQ ID NO: 4152500 - RNA, 90 nt, Human
gcagcaugggugguccucugagcacgccaggcacgagugugcagggagcuggugcaaaugccucugugugcgggugagcaucuguguugu

SEQ ID NO: 4152501 - RNA, 64 nt, Human
gcagcauuuguggaaugggccccaaagcauuaccaaaugggaaaucaguagcccuaaaugcugc

SEQ ID NO: 4152502 - RNA, 121 nt, Human
gcagccaaagaagaaaaggaaggaaagaucaucugaggacuaaaauaguuuguuaaagggaacaucuuuauacuaguccuugaaaaagauuuuauccacauucuguuuaaaagagguuugc

SEQ ID NO: 4152503 - RNA, 66 nt, Human
gcagccagcuggagaccacuguuugcuggcuccugccuuaaaacagugacuuccaaccucagcugu

SEQ ID NO: 4152504 - RNA, 74 nt, Human
gcagccaggcauuaucuguagucagaauaauuuuucauacaaauaauuuuucaaguacagauugaaccugcugu

SEQ ID NO: 4152505 - RNA, 60 nt, Human
gcagccauagccaccucagaaggaccugagcugaggacaccaccugaggauuaugguugu

SEQ ID NO: 4152506 - RNA, 62 nt, Human
gcagccccagucuuguauauucugggacgacuucuucccaggaugaucgagagugggaaugu

SEQ ID NO: 4152507 - RNA, 78 nt, Human
gcagcccugcacaggucuguggcuggugauuuucaugaaagggagcaagagccacacugaccuguuguuggaagcugu

SEQ ID NO: 4152508 - RNA, 62 nt, Human
gcagcccugcaggcagcuccagaagcucaucggcaucuccauuggcagccugcgcgggcugc

SEQ ID NO: 4152509 - RNA, 57 nt, Human
gcagccuaauucuuugccauguaaaguaacauuuacagauucuggguauuagggugu

SEQ ID NO: 4152510 - RNA, 61 nt, Human
gcagccucaugaagcaggcacagcuucaggaaacccugcccuaugaccagcuucacucugc

SEQ ID NO: 4152511 - RNA, 122 nt, Human
gcagccugcugcuggucagguggcagauuguguuuuccaaagacugccuccccugcacauccguccugcagggcuuugcaaugcacagugggccugucaccccugccagaagagggggcugu

SEQ ID NO: 4152512 - RNA, 60 nt, Human
gcagccuuccugacuugagcugccauuguuccauugucacgggcagcuugggaagguagc

SEQ ID NO: 4152513 - RNA, 77 nt, Human
gcagccuuuuaauuuguuuauguaauuggcacacuuaaauggaaugugucaucauaugaauguuuuuaaaauuuugc

SEQ ID NO: 4152514 - RNA, 74 nt, Human
gcagcgcuccgcagagggagccgcgggcugcuuggucggccugccccgccggccccucauguuggagccgaggc

SEQ ID NO: 4152515 - RNA, 65 nt, Human
gcauaagguuggucuuaacuaccuguuguuuauuaacuucaggaagcuuuaugaccagcuaaugu

SEQ ID NO: 4152516 - RNA, 60 nt, Human
gcauaagugacauuguguccuucucaaucaucccaucgggggcauaaaaugucaaugugu

SEQ ID NO: 4152517 - RNA, 76 nt, Human
gcauaauguugauuugggcccugguguuaagauuguaucuaggaauaugaacaucugggccuaaggcuauaugagc

SEQ ID NO: 4152518 - RNA, 64 nt, Human
gcauaauuaaauucugggcaagauuuuacagaaaugcagcuucuuuuuucuaauuuaguugugu

SEQ ID NO: 4152519 - RNA, 98 nt, Human
gcauacagugcuuggaccagcaccugauaggcaguaaacuccaaauccuuauuugcuguuacucuuauuaugugguccuucuugggcucucagugugc

SEQ ID NO: 4152520 - RNA, 79 nt, Human
gcauacaucaaggcacguacuaggaaguuccuggagagguaggagccugaucauaaacacacuaguaugauugauaugc

SEQ ID NO: 4152521 - RNA, 61 nt, Human
gcauaccauggugaccagggugacaaaaagguguccuuuccacucuggccaccaucuuagc

SEQ ID NO: 4152522 - RNA, 72 nt, Human
gcauacucucauuggcccuaccugcagucgcucuacguaaggggcguuccagagucagccacugggagucgc

SEQ ID NO: 4152523 - RNA, 59 nt, Human
gcauacuguccaugacuugcacuauaaugcuucuauuugguguuaagaaauggaugugc

SEQ ID NO: 4152524 - RNA, 82 nt, Human
gcauacuuuaaauucauuccaacuuuugacaaaaaggagaagggaauuugugugaagguaugaugaguuuaaagaaacaugc

SEQ ID NO: 4152525 - RNA, 82 nt, Human
gcauagacaaugacauuucuccuugcaggagucaauagguuuuguguugguucaugcucauggugauagugaguuucugugu

SEQ ID NO: 4152526 - RNA, 83 nt, Human
gcauagacguuccagagugcugacgcagaccccuaaguuccaagggcuuugcaaaaucggcuucuguugugaaugucauuugu

SEQ ID NO: 4152527 - RNA, 79 nt, Human
gcauagaucuggcuucauucagcaugacaguucuaaagaacgucaucuuugcguguuguggcugaguagugucagaagc

SEQ ID NO: 4152528 - RNA, 67 nt, Human
gcauaggaaaagucuagauugaugaguggguaguuaaccagaaacuucacucaauugacuuuuuugc

SEQ ID NO: 4152529 - RNA, 62 nt, Human
gcauaggaacacauggacauuucugaucuuauauaaguauuauacuuuuguuguuccugugc

SEQ ID NO: 4152530 - RNA, 86 nt, Human
gcauaggccuaauaauuagauuuuauuuuggagagccguuggucuaaugggggagauagagucugaugguggaggcaauacugagc

SEQ ID NO: 4152531 - RNA, 58 nt, Human
gcauaggcuucucauuggggaagucaggggaagcccaucuuucucaggaaguuugugu

SEQ ID NO: 4152532 - RNA, 64 nt, Human
gcauaggcuuguccauccucuuuugccaccaaagugugguugcccaagagggaaagugcuaugc

SEQ ID NO: 4152533 - RNA, 58 nt, Human
gcauagggcuacuggucucaucccagcgaucgggacagaaauugcuaauagcucaugc

SEQ ID NO: 4152534 - RNA, 99 nt, Human
gcauagguuguagaaguguaugucuuaauccuuccuuaggaaagucuuaauccuugcuuaagaaagcuuaugauauuacugauaaggcaaggcuuaugc

SEQ ID NO: 4152535 - RNA, 61 nt, Human
gcauagugucaucuccucuuuguucagauaagacaacugaggcagaguaagauacaugagc

SEQ ID NO: 4152536 - RNA, 92 nt, Human
gcauauaauagcaaaaauaguaauaauaguuguuaauauuuauuuagaacugccaauuguugacaaugcacugugcuaagugcuuuauaugc

SEQ ID NO: 4152537 - RNA, 73 nt, Human
gcauauauguuauacacauauacguuuguguguauaugggugccgcacuguguguguguguguuuaugugugu

SEQ ID NO: 4152538 - RNA, 72 nt, Human
gcauaucaauagcugggaccugaauuagcaccauauggagcagaguucucuuccagcuaaccaaggguaugu

SEQ ID NO: 4152539 - RNA, 60 nt, Human
gcauaucacgucaacagagggaguauugacaacugguugucuuccuaguagacugugugu

SEQ ID NO: 4152540 - RNA, 72 nt, Human
gcauauggcagggacugggguucuugcuuggaacuaggacccaagcacaguuccugguaucccauaaaaggc

SEQ ID NO: 4152541 - RNA, 71 nt, Human
gcauauggguguaguuaggagugggguggggcugaagcaguuaggaucccacaccugucuauuccuagugc

SEQ ID NO: 4152542 - RNA, 82 nt, Human
gcauauucuuuuaaagcaggguuucuccaccugaacauuaccgacauuuugggcuggauaagucuuuguuaugaggagcugu

SEQ ID NO: 4152543 - RNA, 64 nt, Human
gcauauuuaugucucugcagagaauaaccugaccuuauuugcugcagugaccaugaaacagugc

SEQ ID NO: 4152544 - RNA, 61 nt, Human
gcauauuuucacaagcucuuggucuuagguauuugaaaauucaagggcuaaagagaagugc

SEQ ID NO: 4152545 - RNA, 99 nt, Human
gcaucaaaguuauuuuaguaaaaugcuuuugcugucauugcuuuaaaacuagcucuucgaagugggaaaaccaaaaguuuuauugaagcaauuuguugu

SEQ ID NO: 4152546 - RNA, 68 nt, Human
gcaucaaucuuauaucugcauaucugaaccuacccuaucagaaaauuugucuucauaugagauggugu

SEQ ID NO: 4152547 - RNA, 67 nt, Human
gcaucacauauuuaagaaacauguuuucuugcagguuauccugacuguuucucaaauuauguggugc

SEQ ID NO: 4152548 - RNA, 103 nt, Human
gcaucaccuggaauacuguccucuucugcagggucaauauggcauuaucauacccaugucccagaucacaggaggggagaaacacaggaauuccaggucaagc

SEQ ID NO: 4152549 - RNA, 68 nt, Human
gcaucacugcccauuaaaggugcuuugacucuauaucucuuuuucaguagcccacuaguaugcagugc

SEQ ID NO: 4152550 - RNA, 55 nt, Human
gcaggagacaacuguaaggagaagaaaccucauuggcucuuuaauuugcucuugc

SEQ ID NO: 4152551 - RNA, 102 nt, Human
gcaggagacagcaacgccaggggccgggaccucugucccagagacccuccgcgcccagucuguggugggacagugugccuugcuccuguguguucucccugc

SEQ ID NO: 4152552 - RNA, 60 nt, Human
gcaggagccaggccgagcugguccccaggcucccacaucuggccuguguuccccaccugc

SEQ ID NO: 4152553 - RNA, 61 nt, Human
gcaggagcuuugcuuacugcugagaugaauauaaaaaugaguaguaagauacagccccugc

SEQ ID NO: 4152554 - RNA, 81 nt, Human
gcaggaguaaugauaguucacuaauagcaaaagccagcugugcugguuuccuuuaauagugauauuguaguauuaaaaugu

SEQ ID NO: 4152555 - RNA, 77 nt, Human
gcaggaguccucuccagacuuucugcaggaucgcuaaugagaucaagucugccugucuggaggggcgauuauccugc

SEQ ID NO: 4152556 - RNA, 76 nt, Human
gcaggagucugggaaggcucugcagauauguucaacaaacaccuccaggaagucuucucagcacagcaccuccugc

SEQ ID NO: 4152557 - RNA, 68 nt, Human
gcaggauccgcugcuguuuggccuguagcucccucagcaggagcugccgaugcccagcugcauccugc

SEQ ID NO: 4152558 - RNA, 59 nt, Human
gcaggaugccagggcagcagcguguguuaggacgcugacccaggccuugcauugccugc

SEQ ID NO: 4152559 - RNA, 59 nt, Human
gcaggaugcuguauuauguguaugaccuuuucagucauguccugcauaguugcuucugu

SEQ ID NO: 4152560 - RNA, 65 nt, Human
gcaggauggugcccuuucugcccccagggaggcuuuggccagguaggaaaggcagauaucacugu

SEQ ID NO: 4152561 - RNA, 72 nt, Human
gcaggauucauucuggaggcuugagcaaagaaucugucuucuuagcuuuuccagcuucuagaggccaccugc

SEQ ID NO: 4152562 - RNA, 94 nt, Human
gcaggauugaagccuguuucauggcuuguaauaaauuuauagaugcuauaaucuucauuuccaagccacugugugauaaaagcccccauccugc

SEQ ID NO: 4152563 - RNA, 80 nt, Human
gcaggcacaugacuucaggugacugccuccaggcgcucgccuggaggaaguugcuggaagucagugcaaaugagaacugc

SEQ ID NO: 4152564 - RNA, 88 nt, Human
gcaggcagggcaaauaauuacuauccucacuucacauuagguuaauaacuugccgaaagucaaaggauuaguaauuaguucugcuggc

SEQ ID NO: 4152565 - RNA, 55 nt, Human
gcaggccagcagggccuccguggcgucuugggccgggaggcagaugcuggugugu

SEQ ID NO: 4152566 - RNA, 60 nt, Human
gcaggccaggcuaggggcugucagggaccuuccccagcguccccuccucccugguccugu

SEQ ID NO: 4152567 - RNA, 76 nt, Human
gcaggccagggcugugggggccugaaccaccuccuucuuugcaaagggacagccuggagccacagcccagggcugc

SEQ ID NO: 4152568 - RNA, 74 nt, Human
gcaggcccccaaauuugugcuuucauagucaucguuaaucaaauaggcagaaacacuguauuuagggaaccugu

SEQ ID NO: 4152569 - RNA, 130 nt, Human
gcaggcccuggcuugugucuacuugcgccucagugcugaucgucccucacuccugggugcugaccagcguuguccuagugaccugggagcucaggugugggaggcagaggugcagugcagccuggcuugc

SEQ ID NO: 4152570 - RNA, 66 nt, Human
gcaggccuggggcuggcuuccaguccagagcaagugcucuuccuccugcaugagccucaggccggc

SEQ ID NO: 4152571 - RNA, 93 nt, Human
gcaggcggcagggucugcagggcaaugaucccgagaggaguguggccaggaacccucuagggaacaccugccgugguugucccugcugcuugc

SEQ ID NO: 4152572 - RNA, 69 nt, Human
gcaggcgggcugccagauccuuggaaucuucuggaaugagagagguugagcugcagcccaaaggccugu

SEQ ID NO: 4152573 - RNA, 58 nt, Human
gcaggcuccaacuggaggaguugagaaaauuuaacuuuaaucaaguuuggaguuuugc

SEQ ID NO: 4152574 - RNA, 65 nt, Human
gcaacaucuaagcaagaaugagugcaacauuuaaguaaucguugcaugcuuguuugguugucagc

SEQ ID NO: 4152575 - RNA, 95 nt, Human
gcaaccaagauguacuuaccuucucuuggagaacucacuuaacagcuuaagugaguucuccaagagaagguaugucugcaacgcauuuaaguugc

SEQ ID NO: 4152576 - RNA, 64 nt, Human
gcaaccauuuggaauguaaaaacauucaacaaauguaacauuuucuccgcauuccagugggagc

SEQ ID NO: 4152577 - RNA, 77 nt, Human
gcaacccucccucaguuuuccagugugggcuuugcuuuauguacagcccucacucaacaauugccaagggauuuugc

SEQ ID NO: 4152578 - RNA, 57 nt, Human
gcaacuaccaggcucauaguagaccagccucaagccccugcugagagccuggcuugc

SEQ ID NO: 4152579 - RNA, 88 nt, Human
gcaacuagaaaauauuuguugagguaaugccuaucaaagaacugauagcuauauuguuuuuaucuaauagcaguuaugauuuauuugc

SEQ ID NO: 4152580 - RNA, 83 nt, Human
gcaacucuggcacagaucacuugacuaaaaugagacugggaauuacaauuauuuuagauugagucauuuucccaccauguugc

SEQ ID NO: 4152581 - RNA, 85 nt, Human
gcaacuggaauguuuguguuucccauucaggcuaagguuuucuugguaugaagguucuuggaacgcugcaucauaaucuacuagc

SEQ ID NO: 4152582 - RNA, 94 nt, Human
gcaacugugugaucucagcucacuguaaccuccaccuccuggguucaagugauucuugugccucagccuccuggguagcugggauuacaggugc

SEQ ID NO: 4152583 - RNA, 84 nt, Human
gcaacuucuuguggcuuagggacaaacucaacccauucucuacauucacaguuugggguucuuaagaccacaauaaaaaguugu

SEQ ID NO: 4152584 - RNA, 128 nt, Human
gcaacuugaguggaucauuucuuccuucuggaccucagcguccucaucuguaagauggggcuaaaagaagcccaguguuccuugaggggcuguggugagagguaaagaaaugagaauuugaagguugu

SEQ ID NO: 4152585 - RNA, 78 nt, Human
gcaacuuuaauuguauucauauuaaacauaucaauguuagaacugauguaauauguuuagcaugaauaugaagguugc

SEQ ID NO: 4152586 - RNA, 55 nt, Human
gcaacuuucaagcaccauggggggaaaaccaaaugggauagagcuuggaaauugc

SEQ ID NO: 4152587 - RNA, 80 nt, Human
gcaagaaaaaugcccauacuuuugcccugacauucuuagacaccuauuaagaaugaggaaaaguaagguaccaucuaugu

SEQ ID NO: 4152588 - RNA, 63 nt, Human
gcaagaaaggcaggcuuucacaucucagacuacccugagagcaaagguuagcuccuuucaagc

SEQ ID NO: 4152589 - RNA, 74 nt, Human
gcaagaagacgacagcagaagaagcaagccaaaugguuucuuuggcuauucuuguugcuguguguuuguuuugc

SEQ ID NO: 4152590 - RNA, 72 nt, Human
gcaagacaaggacugaguugaaaauuggcaccugguucaggucacugagcuguaauucugucuuugccuugc

SEQ ID NO: 4152591 - RNA, 55 nt, Human
gcaagaccugaguaaugucaggguguccucccuccagggcaguggcugggucugc

SEQ ID NO: 4152592 - RNA, 86 nt, Human
gcaagagcuauucacauucucaggccuggucucauacagagucaccuacaaugugugacuauuaggucuuguggaauucuucuggc

SEQ ID NO: 4152593 - RNA, 66 nt, Human
gcaagagcugaggcuggagaggugaauuggaccagguccaugauauccuugagccuuaucuuuugu

SEQ ID NO: 4152594 - RNA, 80 nt, Human
gcaagaggaugaaagugcucggcgcuggucccagguaaaguuaugacucugggcagguggucugaggauugcccauuugc

SEQ ID NO: 4152595 - RNA, 105 nt, Human
gcaagauggcuuaugaucuaaggaaagagccaguguccuuccugcggcaccagaagucccagaaaggacuuugguuggcuuggcuugggucucacacccaucugu

SEQ ID NO: 4152596 - RNA, 63 nt, Human
gcaagauuuuguuauucucauggcacauguaguguggcauguaccaugugacuggagucuugc

SEQ ID NO: 4152597 - RNA, 67 nt, Human
gcaagcaagacagaaguuacugccucuuuguuaaccaaucuuggaaguaacauucugucuuuccugc

SEQ ID NO: 4152598 - RNA, 86 nt, Human
gcaagcaauuuuugaucagguuuuucucaaaucaggucaaauucaugcaugaugaccuggugggcagagccuucaucaacggcugc

SEQ ID NO: 4152599 - RNA, 80 nt, Human
gcaagcagcuggggaggucguggggaagccgugcagaggcugcugccguaaaucccucagugaucuucuccccugccugu

SEQ ID NO: 4152600 - RNA, 72 nt, Human
gcaagcaggcaagcgugaguucucuaaacaaagagcggcuuuaagcagggaauuuuaggcuuccaagcuggc

SEQ ID NO: 4152601 - RNA, 57 nt, Human
gcaagcaggguuccuuagggcaccaguugguaaguguaagaggccucauccgcuugc

SEQ ID NO: 4152602 - RNA, 73 nt, Human
gcaagccccgacucucccugagagggaggcauuauauaauaacuguccgcagagggagaggcugggugcgugc

SEQ ID NO: 4152603 - RNA, 76 nt, Human
gcaagccuuucccuuguguaggacaccccagggccucacauucucugaauccacacaaggugauggauggcuuugc

SEQ ID NO: 4152604 - RNA, 71 nt, Human
gcaagcucagagguaaggagugacgcccgccaggacuagcugauggagccaugccuggccuuuccccuugc

SEQ ID NO: 4152605 - RNA, 82 nt, Human
gcaaggacagcaugagccuguccugugcaugugaauuuaaauuuuccauauguauacacaggcuguuuagcuucaucuuugc

SEQ ID NO: 4152606 - RNA, 114 nt, Human
gcaaggaggaggugugaggaggagggagccucuggcagcuuuuuguuucaggcuagaacuuucuagcaaggcuucagagcugucugacccaccugcugacuuauucuccccugc

SEQ ID NO: 4152607 - RNA, 64 nt, Human
gcaaggagguugaugccagggaguuggggccgaugaucuccagucccaggcagaaauccagugu

SEQ ID NO: 4152608 - RNA, 113 nt, Human
gcaaggauggagguuguccugcaaaggcauuuuaauucuaaagaaaaaggagauuaguggccucuacccaucuuagagaauagaguguccugacaccuucccuuccuccuugc

SEQ ID NO: 4152609 - RNA, 68 nt, Human
gcaaggcauagggaagagucauuagauuaccccaucugccugcucuccggaucccugauaugccuugu

SEQ ID NO: 4152610 - RNA, 92 nt, Human
gcaaggccacugugcacaauuccccuuccccugaggauagggcaggaccccucgggaaugagggucuuccagggaggagggagugaccuugc

SEQ ID NO: 4152611 - RNA, 57 nt, Human
gcaaggccugaggugggugcucauuugguguguguggcaccaaaagaaggccauugu

SEQ ID NO: 4152612 - RNA, 79 nt, Human
gcaaggcggaaggggugggugagccucaggggugcuucuggcucucacgcugaggccucucccacuccagcugcccagc

SEQ ID NO: 4152613 - RNA, 64 nt, Human
gcaaggcucugggagcacccugaagcccucacagccugggccucaguguccggagccugagugc

SEQ ID NO: 4152614 - RNA, 72 nt, Human
gcaaggcugagcacauuugcaugagcagaauguaaauacaggaggcuucuugcagaugagcuucucucuugc

SEQ ID NO: 4152615 - RNA, 83 nt, Human
gcaaggcugccucuccuccagaggcuguggggaaaaggucuguuuccuagucuuuuuauagcuucuggaggucugucacuugc

SEQ ID NO: 4152616 - RNA, 60 nt, Human
gcaaggcugugcacuuugcauuuugucaugcuucgucugcagucaguagcacagccuugu

SEQ ID NO: 4152617 - RNA, 62 nt, Human
gcaagggcagauagcugguccaagcacucuugugugcuuuugagcaaaucaucuguccuuuc

SEQ ID NO: 4152618 - RNA, 64 nt, Human
gcaagggcuuucugcucuggccuuaacucacauggcauuuuuaaggcauggcaaauguucuugc

SEQ ID NO: 4152619 - RNA, 81 nt, Human
gcaaggguuucucaaauacuguuccaggagaugcugugcugaaagagaauucuguacucaaauagguuugggaaggccugc

SEQ ID NO: 4152620 - RNA, 70 nt, Human
gcaaggucauauggaaguuguugcuuaauuuuucaagaaauugccaaauuguuuuccagagugacuaugc

SEQ ID NO: 4152621 - RNA, 81 nt, Human
gcaagguuuucuguuaaagugcaggcuacucagaaguuauuuucagagucagcucugccuuaauauuucaaacagucuugu

SEQ ID NO: 4152622 - RNA, 62 nt, Human
gcaaguaauucugcaagaaaccaguggcgccgacaggaaauuggagugcaggaucuguuugc

SEQ ID NO: 4152623 - RNA, 56 nt, Human
gcaaguagugggaaagaagauggauucaacucuaugucauuuaaaaugcugcuugc

SEQ ID NO: 4152624 - RNA, 82 nt, Human
gcauuacuuguuucacuggcagguuucucuagaaauauccuggaaaaauagcuucucuugucccugaggugaguaaaauugc

SEQ ID NO: 4152625 - RNA, 55 nt, Human
gcauuagacccaagguauuuuguugauguuaacauuuucugccaaugucuaaugc

SEQ ID NO: 4152626 - RNA, 73 nt, Human
gcauuagcaauuuuugauuuucaguguauuuuuuuccuaucugcagauacugaugaaggauaaaaauuguugc

SEQ ID NO: 4152627 - RNA, 59 nt, Human
gcauuauggcuuuuauccucucuugaggucauccucuggaagguaacaaggccauuagc

SEQ ID NO: 4152628 - RNA, 88 nt, Human
gcauuauuauuuaucuuuauuuuaaaauguauuauaaauguauuugucagcaacaugguauguauuuuaagagaaguaagugguaugc

SEQ ID NO: 4152629 - RNA, 66 nt, Human
gcauuauucagaguguagcaaauagauaauauagcuuuaucuacacagcaucgcucagagugcagc

SEQ ID NO: 4152630 - RNA, 74 nt, Human
gcauuauuugguucacuguucuaggcucuggggcucugcccuguggagcuuucaggauaaugaaaaagucuggc

SEQ ID NO: 4152631 - RNA, 82 nt, Human
gcauucagacauuucagugagaaagcaaucaaauaaauucacauauucagugcuuuugucacauggucaaaguuagaaaugc

SEQ ID NO: 4152632 - RNA, 93 nt, Human
gcauucauuuucaguuuuggaagaggacacagagacauucauuguucaaaacaggcauaauucaguguucuuuucuguuagcgaagcgaaugc

SEQ ID NO: 4152633 - RNA, 59 nt, Human
gcauuccauuuaaaucaaggcaggcacaagaccugcugcuuugcauugugaugggaugc

SEQ ID NO: 4152634 - RNA, 75 nt, Human
gcauucccuaaccucagcugaauucagggcacauaugggcaagugugccuucccaagacgccugaguuagggagc

SEQ ID NO: 4152635 - RNA, 65 nt, Human
gcauuccugacuguuagaguuugcugacccucaacugaaagcaaaauaagaacagaaagggaugu

SEQ ID NO: 4152636 - RNA, 73 nt, Human
gcauuccugcucugccaaguccucuuucuucacaacacagcugggaggagaaugaauggggagaagagaaugu

SEQ ID NO: 4152637 - RNA, 78 nt, Human
gcauucugaaugauuuguagauuuuuugcuguuguuuuuacuuaggcuucauaaaguuugcaauuuauguuaauaugc

SEQ ID NO: 4152638 - RNA, 59 nt, Human
gcauucuucacuaggugagagccaaggguauuggcagcaaucaccgcaugaaaugaagc

SEQ ID NO: 4152639 - RNA, 58 nt, Human
gcauucuuuccacgaggagguacccucggccgggcuuccugagugcuggagagagugc

SEQ ID NO: 4152640 - RNA, 56 nt, Human
gcauugaagaucuuagacuaggggccugggugucuccugucucuccucuucauugc

SEQ ID NO: 4152641 - RNA, 75 nt, Human
gcauugaagcagagauuauuauaacuaauuagaagucacacaucuguuagcuuuugguuucugacuuacuuaugu

SEQ ID NO: 4152642 - RNA, 87 nt, Human
gcauugagaagagaaagugacaguucaggucagauuuauugagcaucuauuuaauacuacuuguaauuguucuugucacuccccugu

SEQ ID NO: 4152643 - RNA, 71 nt, Human
gcauugagugucacaaggcauuuaucuguaggauugggucaccaaacucacagcacuugugucauuggagu

SEQ ID NO: 4152644 - RNA, 77 nt, Human
gcauugauaagcaugagacuuauuuugagccuguuuuaggaaacagagcaauucuuggguguuuugauuugcaaugu

SEQ ID NO: 4152645 - RNA, 85 nt, Human
gcauugauuagccuugaaguucaugugucugcagacccauauaaaaauguauuaucugucaauauaugugcugcagggaaaaugu

SEQ ID NO: 4152646 - RNA, 55 nt, Human
gcauugccacaugugucuuagcggacaucauugucuccaugugauaguggccugc

SEQ ID NO: 4152647 - RNA, 79 nt, Human
gcauugcuguccagacgagggccuggcacacaguguguucuuguaaaugcuguacucggguucucauccucacagcugc

SEQ ID NO: 4152648 - RNA, 66 nt, Human
gcauugcuuucacugcaauagaugaaugucaugaaaauguucuucucuuguaauggaaucagaugu

SEQ ID NO: 4152649 - RNA, 57 nt, Human
gcauuggcaccucacaggauagacagcaacugugcaugccugguugguugccucugc

SEQ ID NO: 4152650 - RNA, 61 nt, Human
gcauuguuguuuucucauggagaauaugguuacuaugcuuuguucacauggagcagaaugu

SEQ ID NO: 4152651 - RNA, 83 nt, Human
gcauuuaaaaauguccucaaaacugauugcagcaugacaucccucagauuuuguauucaguuuuaguuuaguuacuuugaagc

SEQ ID NO: 4152652 - RNA, 77 nt, Human
gcauuuaccacagugccugucuaaugccccaaguauucaauaaauauaaacuauuggccgggcgcgguggcucaugc

SEQ ID NO: 4152653 - RNA, 75 nt, Human
gcauuuaggcccccuuugcccaguauauucuagguuagcaccagaaauauauaugggucagagccaaccuuaggc

SEQ ID NO: 4152654 - RNA, 58 nt, Human
gcauuucaagggagcagcugaaagaagaagacacugauaggcucucccuugagagagc

SEQ ID NO: 4152655 - RNA, 109 nt, Human
gcauuucauggauuuacuacuugacauugaauuugaauguauguugcaauauggcccaacaauuauuuaaauuuauguagaugagccuuguaaagauaauauaaaaugu

SEQ ID NO: 4152656 - RNA, 55 nt, Human
gcauuucauguaagucagaccagaguuaaaugguuuuuaaaaugcaugacagugu

SEQ ID NO: 4152657 - RNA, 57 nt, Human
gcauuuccauuuucagccauuacugagaaagccaguuguggugcuuggaugggaggc

SEQ ID NO: 4152658 - RNA, 61 nt, Human
gccagccuccucuaacugccgaggcaacaaauaaagaaggcuucaugcuggaggggcuggc

SEQ ID NO: 4152659 - RNA, 77 nt, Human
gccagccugccaagcugcagacccccugucucauggaggcuaucuugagggaggggaaugugugcagagcaggaggc

SEQ ID NO: 4152660 - RNA, 60 nt, Human
gccagccuggccgggcccacacccuccagucgugacccugcaggccuggcccagccuggc

SEQ ID NO: 4152661 - RNA, 75 nt, Human
gccagccuggguaguggccuccccagcaaguugcaugucacuagcuuccuguggcugucacuccugggcccaggc

SEQ ID NO: 4152662 - RNA, 57 nt, Human
gccagccugugggggcucugugagacucagguuccugugugggccugcacggcuggc

SEQ ID NO: 4152663 - RNA, 73 nt, Human
gccagcuagaggcugcagugcacuaugagaacaccugugaauagccacugcauuccagccugaguaacauggc

SEQ ID NO: 4152664 - RNA, 80 nt, Human
gccagcugaggcuucuaggcuugacaucucccuccaccccgggaagaagauggaggcuuggugccaaggagccugcuggu

SEQ ID NO: 4152665 - RNA, 56 nt, Human
gccagcuggaaaucugcuugaagagccagccuucaggccaaauauuuauagcaggu

SEQ ID NO: 4152666 - RNA, 73 nt, Human
gccagcuggcaugcucuuuguccacaguaauucaacuauugacugacagccuacaaugggcaugugaaguggc

SEQ ID NO: 4152667 - RNA, 60 nt, Human
gccagcuuuauagcuucaaaggacaggcuagcucucuuguuagaagcuaaugcagcuggu

SEQ ID NO: 4152668 - RNA, 61 nt, Human
gccaggaaagccacuggcauacugggacaaguuggucaccccaggccccagucuuccuggc

SEQ ID NO: 4152669 - RNA, 59 nt, Human
gccaggaacuggcagugucguuuacaugaauguguuauucagaagagcugccucuuggu

SEQ ID NO: 4152670 - RNA, 62 nt, Human
gccaggaaugcauaaaugaccuuugccagcuucagggcuuucacacauuuugcuuuucuggc

SEQ ID NO: 4152671 - RNA, 64 nt, Human
gccaggacagggagacgggagcccaggagcggaagagcagaggggcagcccgcccucuccuggc

SEQ ID NO: 4152672 - RNA, 67 nt, Human
gccaggagauuuagcugcuuaacuccuguuguuuuuaaugggagucauguggcuaaaucucuguggu

SEQ ID NO: 4152673 - RNA, 73 nt, Human
gccaggaggcgaugcaggccaugguuucuuuggcaggaacugacaaggcgcccagccugccaagucuccaggc

SEQ ID NO: 4152674 - RNA, 61 nt, Human
gccaggaggcuccucggggcugacggcggggacucgcacgaggcaccgaggagccucuggc

SEQ ID NO: 4152675 - RNA, 60 nt, Human
gccaggaggcuuaacuggacaggggcuucuugaacauucucugugccuaaaccuccgggu

SEQ ID NO: 4152676 - RNA, 91 nt, Human
gccaggauggucucgagcuccugaccucgugauccgcccuccuuggccucccaaagugcugggauuacaggcaugagccaccgugccgggc

SEQ ID NO: 4152677 - RNA, 91 nt, Human
gccaggauggucuugaucuccugaccuugugauccacccgcuuuggccucccaaagugcugggauuacaggugugagccacugucccuggc

SEQ ID NO: 4152678 - RNA, 61 nt, Human
gccaggauuuggcucuuggguuucucguccauucuggggagcacugagaggcagguagggc

SEQ ID NO: 4152679 - RNA, 85 nt, Human
gccaggcaagauggacuguuuaugcugggcucuggaugaucucagaaggaggccugcagcaggagcaaacccaucuucgucaggc

SEQ ID NO: 4152680 - RNA, 64 nt, Human
gccaggcacucagucuggaucccucugagaucagguauuggggguugggugaguguuggauggu

SEQ ID NO: 4152681 - RNA, 64 nt, Human
gccaggcauuuauugauugaauaaauauuguacuauauucaguguaucaaugaaugcuuuuggu

SEQ ID NO: 4152682 - RNA, 112 nt, Human
gccaggcgacuccacgauggcuuccguccucagguucaccaucaacuaagacagacugaagauguaaguaguaauggaaggacacaaaagguacaagagucagaggccaggc

SEQ ID NO: 4152683 - RNA, 107 nt, Human
gccaggcgagugaucaagacuuacacagacauggcaucaugaccaguuucaguuuuucuggcucagacaccacucuguugaggaacagacuucuuggugagccuggc

SEQ ID NO: 4152684 - RNA, 72 nt, Human
gccaggcucugcugaucucagcugggcucacucuugcaucugagccagcuggugggucagcugggggcuggc

SEQ ID NO: 4152685 - RNA, 57 nt, Human
gccaggcugccuuaucucuagcacccucucgggcuuccugcagacaaacaguguggc

SEQ ID NO: 4152686 - RNA, 56 nt, Human
gccaggcuggagugcagugucuugaucucggcucacugcagcuccgccucccaggu

SEQ ID NO: 4152687 - RNA, 56 nt, Human
gccaggcuucccugagaggcugccgugagccagguggccuccccggaaugccucgc

SEQ ID NO: 4152688 - RNA, 60 nt, Human
gccagggacaggaucaagcugcccaguuacaaaucuguuauguauauucugugcccuggu

SEQ ID NO: 4152689 - RNA, 97 nt, Human
gccagggacucaggaguauuuugcuguagaaggccaaggaucaggugccucccagcugccuguauuugcuuccuucugcaauuccagauguuuuggc

SEQ ID NO: 4152690 - RNA, 55 nt, Human
gccagggagucugggccacagaucccaaaggcugauaugagcccuuaucuuuggc

SEQ ID NO: 4152691 - RNA, 57 nt, Human
gccagggaucuggccuuccauccucuaaggaggagcagagggugggacuuccuaggc

SEQ ID NO: 4152692 - RNA, 78 nt, Human
gccagggcaguguccaggguggucugcauccaguguugugcaacucucuugugagaccauccuggcacuucccucugc

SEQ ID NO: 4152693 - RNA, 77 nt, Human
gccagggcaucggggccuucuuuugguuuuacccaaauaagggagucagaguaacagaaaggcucaggugcucuggc

SEQ ID NO: 4152694 - RNA, 82 nt, Human
gccagggcuguagucucuggagacucuaggggaaucugugccuaccuccuccagcuuccaguggcuccugacauuccuuggc

SEQ ID NO: 4152695 - RNA, 58 nt, Human
gccagggcugugcagguuuguucagguucccuccugggccuucucgguuggcccuggc

SEQ ID NO: 4152696 - RNA, 60 nt, Human
gccaggggugcccacccaaggagccucuucaccugcucuuccagggugggcacugcuggc

SEQ ID NO: 4152697 - RNA, 56 nt, Human
gccagggugugcagggacaggauccgcaugucacugucuuuaugucucacuguggc

SEQ ID NO: 4152698 - RNA, 69 nt, Human
gccaggguuucuaugaggccugaagccuggagccugucauaggcaacugcagucugaggccucccuggc

SEQ ID NO: 4152699 - RNA, 61 nt, Human
gccaggucucauaaaugcagcuagcccucauccaagggcccaaguggccauugagccuggu

SEQ ID NO: 4152700 - RNA, 57 nt, Human
gccaggucucuucuuguacccagccccugaccugcugcuuuacugaagagauauggc

SEQ ID NO: 4152701 - RNA, 66 nt, Human
gccaguaaauagugagaaagaaacugaaguuaagucuaaguucacagcuccuuuuacucaacuggu

SEQ ID NO: 4152702 - RNA, 67 nt, Human
gccacagucacugcugcaggggcuggagagucaugaaaaccggguccugcaucccaugagugaaggc

SEQ ID NO: 4152703 - RNA, 76 nt, Human
gccacauauacuaggauagggaacucauggcuggagcaagauuuuuguauuucuuuauccuauuuguaggugaagc

SEQ ID NO: 4152704 - RNA, 76 nt, Human
gccacaucauuguagugcuucaucugcacagcacagccgcaucauuguagugcuagaagauagcuagaagauuggc

SEQ ID NO: 4152705 - RNA, 57 nt, Human
gccacauccagguggaucaaauuaguuaagagggcugugaguucauuugcauguggu

SEQ ID NO: 4152706 - RNA, 55 nt, Human
gccacaugcaauugcagcacguaacaucaguauuauuucuguaugcaucuguggu

SEQ ID NO: 4152707 - RNA, 70 nt, Human
gccacauggcuagcaccgcguugcuggcgcucugcuccaccggcgcguucagcgggcuggccguggaggc

SEQ ID NO: 4152708 - RNA, 66 nt, Human
gccacauuagcccucaccaucugagauuacugaaaaaacagauuguggugagaauugcuaguuggc

SEQ ID NO: 4152709 - RNA, 64 nt, Human
gccaccacacccggcuaauuuuguuauuuuuuauagagacaggguuuugucguguugugcaggc

SEQ ID NO: 4152710 - RNA, 73 nt, Human
gccaccagaacacagguucaaauucaggucgcuucuaugugaggaaaccuaccugaaaugaauuguuggucgc

SEQ ID NO: 4152711 - RNA, 61 nt, Human
gccaccagcagaacccaccagacagaagcuccgugcucugccuggcuggucacugccuggc

SEQ ID NO: 4152712 - RNA, 64 nt, Human
gccaccagcugcauaugcacguacuugaugguuccaucugcguugcgcuccugcagcaggaagu

SEQ ID NO: 4152713 - RNA, 60 nt, Human
gccaccaggagcccaguccaaaugucaccugcccaccacacacagcgggcuuccuguggu

SEQ ID NO: 4152714 - RNA, 68 nt, Human
gccaccaggcccgcugcuaugguggcuguucccugcccuuaagucaccggcagacguggccugauggc

SEQ ID NO: 4152715 - RNA, 66 nt, Human
gcagauuuggaaguugauuuaaaaaggaauuaucacaguuuccuuguaaaggagcucuaacacugu

SEQ ID NO: 4152716 - RNA, 62 nt, Human
gcagcaaaauugaagucaauguccaauacugagguugguggacugauuuucauuuuaaaugu

SEQ ID NO: 4152717 - RNA, 75 nt, Human
gcagcaagaggaaguuuauauuguaauuguaucaugaaaaugagaaccauaauguacaacugcuuuuaauacugc

SEQ ID NO: 4152718 - RNA, 78 nt, Human
gcagcaagagggaggcugagccacuguggagagcacacaggcucugccuaggaaaccucaugcuucucaugugcuugc

SEQ ID NO: 4152719 - RNA, 60 nt, Human
gcagcaaggguuauaucaaagauguauuaaaaugucuuaagucuauuuuccucaugcugc

SEQ ID NO: 4152720 - RNA, 61 nt, Human
gcagcaaucuucacagugucauuggugcaggaaacaugcaacaccacauggagcuuguugc

SEQ ID NO: 4152721 - RNA, 70 nt, Human
gcagcacgcuacaguuagggauuccugagugacuuagucacaugggcucuagacuuuaguguggagcugc

SEQ ID NO: 4152722 - RNA, 107 nt, Human
gcagcacucuguaaaugcagggcgguagauguuuguaaacacacugcugggcuacccaguaguuguguguaugcaugucuauauaucuguaaagacuguggugcugc

SEQ ID NO: 4152723 - RNA, 80 nt, Human
gcagcagaaggccaucuagugguaacuucugucuaaagacugcuggaaguuugcuguggauuaauggguacuuuuguugc

SEQ ID NO: 4152724 - RNA, 56 nt, Human
gcagcagauuguuuuuucaccugcagagcauauggguguggggacagggguguugu

SEQ ID NO: 4152725 - RNA, 61 nt, Human
gcagcagcaggagccguggggugaggcugcagccuccauccuguccaggcccugcuccagc

SEQ ID NO: 4152726 - RNA, 57 nt, Human
gcagcagcagggagucugacuuggugcuggaggacaucucaaggccccugcuccugc

SEQ ID NO: 4152727 - RNA, 65 nt, Human
gcagcagcggggccccugcgcgcggcgcccaccgucuccuccucgcgccgggcucgcgguguugc

SEQ ID NO: 4152728 - RNA, 77 nt, Human
gcagcagcuuuugcauucucauuuuguuuauuucuggacuggagaguaguaauuaggaugcagauaccagcugcugc

SEQ ID NO: 4152729 - RNA, 62 nt, Human
gcagcaggaauaggauaagcaaaggcaugaaaauggaaguugucugguccauucuggguagu

SEQ ID NO: 4152730 - RNA, 55 nt, Human
gcagcaggcaccagggcucguccuggcacgaugaaggaggaacccguggcugggc

SEQ ID NO: 4152731 - RNA, 57 nt, Human
gcagcaggcacuuaccguugcuguacaauaacuggaguuuauaguggaugccguugu

SEQ ID NO: 4152732 - RNA, 60 nt, Human
gcagcagggcaggauuugaacccaguucugacacugaaaucucugcuucuugcccucugc

SEQ ID NO: 4152733 - RNA, 62 nt, Human
gcagcagugcgggcagcuacagaagcucaucggcaucuccaucggcagccugcacgggcugc

SEQ ID NO: 4152734 - RNA, 74 nt, Human
gcagcaguguguguguguguguguguguguguguguguguguauucacauguacauaugcucaugaacuguugc

SEQ ID NO: 4152735 - RNA, 77 nt, Human
gcagcauagcugaguagucagggaucagagccaguucauuuagauucuaauuuugacucuugucucuuguuagcugu

SEQ ID NO: 4152736 - RNA, 81 nt, Human
gcagcauaggguaacaccaugguucccaaacugugugccaaggcucaugggggcaccauggugaauucacaagagugcugu

SEQ ID NO: 4152737 - RNA, 76 nt, Human
gcagcaugagcuauacaaaguagaguggaauuaucuucauugauuugaacacaauacuuuuguagccuaauguugc

SEQ ID NO: 4152738 - RNA, 81 nt, Human
gcagcaugggugugggcaggagcacaagucaggcucauguuuggucuccugacgccuucuccuugcccacucugagguugu

SEQ ID NO: 4152739 - RNA, 116 nt, Human
gcagcauuuguggcaguggcuaaaagcuguuccagggcuuggcugggacgguaucugcugaauaacuaggccaguccuagagccaagauccacagcucagcugcuguugcugcugc

SEQ ID NO: 4152740 - RNA, 61 nt, Human
gcagccaaugggggacuuggccaagcgucaggcacugauggaagacuccucucuuggcugc

SEQ ID NO: 4152741 - RNA, 61 nt, Human
gcagccacauggagcaggagguggggcaggcauuugucuuaccugccucuccugugccugc

SEQ ID NO: 4152742 - RNA, 55 nt, Human
gcagccagaagacucagaacaaaaguacacauuuuacucuguguacacuggcagc

SEQ ID NO: 4152743 - RNA, 88 nt, Human
gcagccagaucaggaguuuucagaaggauuuuaacacauggacacccacauacaaccugucuauaauuuccuucuucuccucaguugc

SEQ ID NO: 4152744 - RNA, 74 nt, Human
gcagccaggugggcugccucuccagcuccuucuggcuuucgcccuucggcugggacaggagcacccuaggcugu

SEQ ID NO: 4152745 - RNA, 80 nt, Human
gcagccaucuugaaauuaugcagggaaggcccaccagccucugagauggcugcuuccuuuccugcugaccuccugacugc

SEQ ID NO: 4152746 - RNA, 55 nt, Human
gcagcccaggagcaggcgacccgccccagccugagccuguuacucuugggcucgu

SEQ ID NO: 4152747 - RNA, 60 nt, Human
gcagccccgcgaucuccuuguggccgugcucacaggcgcacaugagggccguggagccgu

SEQ ID NO: 4152748 - RNA, 86 nt, Human
gcagccccuguuaaauaaaucauccaguaacgguuucuaauucccagacuugguugcaaaugaauuauucacaugguaaggccugc

SEQ ID NO: 4152749 - RNA, 55 nt, Human
gcagcccuagcgacaaauugaucagugaugauggaugaguacuguaggggcuugc

SEQ ID NO: 4152750 - RNA, 56 nt, Human
gcagcccucaucccgccugcguuccacaugaacaggucucugggcuugaggguggc

SEQ ID NO: 4152751 - RNA, 118 nt, Human
gcagcccugacagcagauaacuuacucugacuggauucugcuuuggcugugguuuggguuacagaugagaaggcugaccaguuaaggcagagaaguuaaaggccuggugcagggcugc

SEQ ID NO: 4152752 - RNA, 76 nt, Human
gcagcccugagcuggccugggcuugcggggcaccagaagagauacugguacaaagccaaggccugucuggggcugc

SEQ ID NO: 4152753 - RNA, 60 nt, Human
gcagcccuugggccauccuagaaccagccaagggcuuuuuuuuggccucagggcccuugc

SEQ ID NO: 4152754 - RNA, 68 nt, Human
gcagccggccuggaguuuggggaauagaggugugcccuuucucuaccaccacacaccaggcaacgugu

SEQ ID NO: 4152755 - RNA, 55 nt, Human
gcagccucagggcacucagaugcuuacauggugucucagggccccaaaggcuagu

SEQ ID NO: 4152756 - RNA, 75 nt, Human
gcagccuccgucaguuuucuguucuacaauuugauaaauggauuauacucacacguaggauaaggaauugguugu

SEQ ID NO: 4152757 - RNA, 89 nt, Human
gcagccucuugugcccugauuuguggaacucucuucuugcaugauuuccacuucuugcagggguuuccacuaaaucuaggaguguuugc

SEQ ID NO: 4152758 - RNA, 108 nt, Human
gcagccugagcuggguucucugcuuagggccucacaaaguauuggccagacugggcucuucucugcaggcucuggagaagaauccgcuuccaagaucauucagguugu

SEQ ID NO: 4152759 - RNA, 63 nt, Human
gcagccugccuggaugaauggcgccuugugagagcgccgcagggcucaccuccauggcagggc

SEQ ID NO: 4152760 - RNA, 57 nt, Human
gcagccuggauggucugacucuagagcucacucucugaaucacagucauucagcugu

SEQ ID NO: 4152761 - RNA, 63 nt, Human
gcagccuggcccugcugaacucugugguauaugggccugagcggaccucagcagccaugcugu

SEQ ID NO: 4152762 - RNA, 61 nt, Human
gcagccuugauccuuuccuuuucugauucagaaauuaccugugggugaggaagagcguugc

SEQ ID NO: 4152763 - RNA, 65 nt, Human
gcagcgacgcuggcugguucccugcuccaggcauguuccuccgcaggggaaccugcuagagcugc

SEQ ID NO: 4152764 - RNA, 76 nt, Human
gcagcgcagcacuuuugaaguuagacaucgagaguuugaguccuagauucacaccuugcuggcugagugcuguugc

SEQ ID NO: 4152765 - RNA, 65 nt, Human
gcagcgcgcugucagacuggcucgcaggcggcgcggccggcggacccguucgagacagcgcgggc

SEQ ID NO: 4152766 - RNA, 72 nt, Human
gcagcgggcuguccgccgacuuggccaggccgaugucggagaugggcgagaagguggacuuccacuugcugc

SEQ ID NO: 4152767 - RNA, 127 nt, Human
gcagcguggaacgacgggcuccucgguggccagcagcuggugagacacagccgcagccguagcugcagggcuaagacauguccgccggccucgcgguuugagaggcggccuguaccaagcacgcugc

SEQ ID NO: 4152768 - RNA, 82 nt, Human
gcagcgugggggugaggcagaggccccugcccacuggucccagagacagagcuggcagggaccuugcccacccuccuccugc

SEQ ID NO: 4152769 - RNA, 71 nt, Human
gcagcuacugugggacaucccucccuaugcuuuggcuccagcauaggugcucuguccucaguauuagcugu

SEQ ID NO: 4152770 - RNA, 68 nt, Human
gcagcuaguccaguuauguggcuucagugcuuuaagcaccaggauuugaacauagcuggcuacacugu

SEQ ID NO: 4152771 - RNA, 63 nt, Human
gcagcuaucugaucugacaaggucuggcuuccaggagccaugugggauuuuggugucuguugc

SEQ ID NO: 4152772 - RNA, 57 nt, Human
gcagcuauguaaagaggaucucugcaagcugcagucccauaucuuuaacauaucugu

SEQ ID NO: 4152773 - RNA, 58 nt, Human
gcagcucaagagaggugcuaugaggaacugcggaaacucauagggccuaaagagcagc

SEQ ID NO: 4152774 - RNA, 75 nt, Human
gcagcucuguuucaaagucagaaaaggaggcucagcuguuguuuuugcuucaagcugauuuagagacgagaaugc

SEQ ID NO: 4152775 - RNA, 62 nt, Human
gcagcucuucugguucugacucugugggugccuuucaccugcugguccucagcagagcaugc

SEQ ID NO: 4152776 - RNA, 57 nt, Human
gcagcugaaagaaggaagugucauucuugugaccuuagaugccugacuuucaguagu

SEQ ID NO: 4152777 - RNA, 112 nt, Human
gcagcugacuugaggucagagaagucuaugaggauguuaguggacuggaggugaugaguaggaaaccucugcugagaugcccaugguuaucacugggccucugauaagcugc

SEQ ID NO: 4152778 - RNA, 61 nt, Human
gcagcugaugaaaauguuguuacacucuugaagaacaagggcuguuauguuuuuauacugc

SEQ ID NO: 4152779 - RNA, 61 nt, Human
gcagcugcagaggcuuggucacgccuggaaguccuccccagcagccaggaaucugcagagc

SEQ ID NO: 4152780 - RNA, 56 nt, Human
gcccugugcgcugaguucaggggucagauuggcugccggaugacucucacaagggc

SEQ ID NO: 4152781 - RNA, 55 nt, Human
gcccugugcucccuauguaucugguucaguuucagagauuccgggacgcaguggc

SEQ ID NO: 4152782 - RNA, 112 nt, Human
gcccugugggagaggcuagugggagggugggcaaggccagagcguguccugccuccauguggagggagauacgggaagcugguaagucucccugccaaccucuccuuggggu

SEQ ID NO: 4152783 - RNA, 102 nt, Human
gcccuguugguuccugcuugggcucaggaccccagaggcccugccuguccagggccuauggggcccuagaguugaggacccacaggaaaauggggauggggc

SEQ ID NO: 4152784 - RNA, 57 nt, Human
gcccuuacaggguggucagccauguauggauuuccagcucuguaccacccugagggc

SEQ ID NO: 4152785 - RNA, 65 nt, Human
gcccuuagguacuacuuauucucagcacuuucaacuaguccagugagugccugguauauaagggu

SEQ ID NO: 4152786 - RNA, 82 nt, Human
gcccuuaguuuuaauagcugauuagccuacaauaaggucgaacuuguguuuuguuucuaauuagcaguaaaaacaacagggu

SEQ ID NO: 4152787 - RNA, 67 nt, Human
gcccuuauuugaauguaugaguuuuaguaagcacugugauaggaggauucauauacuuaaaucaggc

SEQ ID NO: 4152788 - RNA, 55 nt, Human
gcccuucaugaguccacaggaccucacgguucacaaauaugcacuuacgaagggu

SEQ ID NO: 4152789 - RNA, 65 nt, Human
gcccuuccccuccucuccugauauggggacuucugaguucccugggagaaguugagggcuggggu

SEQ ID NO: 4152790 - RNA, 76 nt, Human
gcccuuccugcaggacagccaucugguuguugggaccaacagggacagauuuaggcuuaguccaagcaagaauggc

SEQ ID NO: 4152791 - RNA, 86 nt, Human
gcccuuccuuucucgggucuguggaguugcuugcuggaaaugccucacuucaggugcugauuuggcacacguggaagggggagggu

SEQ ID NO: 4152792 - RNA, 89 nt, Human
gcccuuggcugccuugggacagcaaccaucugcuacaccccaugucaaggguguagccugagcuggcuggcuccaggaagagcaagggu

SEQ ID NO: 4152793 - RNA, 89 nt, Human
gcccuuuagaagguugucaggauuuguuuaguauaggccuaauauaggccuaauaugcaaaauugauacuugauauacucugagguggc

SEQ ID NO: 4152794 - RNA, 77 nt, Human
gcccuuuaucaucuucauauuccucagcuuuuauucccuuccugauggcuggaauguguggaugugaugacuggagc

SEQ ID NO: 4152795 - RNA, 57 nt, Human
gcccuuuggccugggacagcaagcagaguauuaucccagcuggucagggcaaugggc

SEQ ID NO: 4152796 - RNA, 77 nt, Human
gccgaaagcagggucaacauucuaaaaucugacugccucuggguggcaguucuguugaguguagacccuggucuggc

SEQ ID NO: 4152797 - RNA, 58 nt, Human
gccgaagcuccaagguuccuccgcuuccugcccgcaggcggaaccuuagagcuucagc

SEQ ID NO: 4152798 - RNA, 83 nt, Human
gccgaggaggaggaggcuccgggugcugcucaggaacuggggacccacgagugccugcacccugaguguucagcuccagaggc

SEQ ID NO: 4152799 - RNA, 62 nt, Human
gccgaggccgcgcccguccgcccgccgcccgagccgccgcccgcccuggacguggccucggc

SEQ ID NO: 4152800 - RNA, 79 nt, Human
gccgaggccucagcuccagcccucagcagcucuggacacaagagccgucugcucugacaacugggcugaggcagucggu

SEQ ID NO: 4152801 - RNA, 70 nt, Human
gccgaggucacagcccaagucaccugcaggagcgagguucuuguuuggauuuugggcaguaggaaucggc

SEQ ID NO: 4152802 - RNA, 69 nt, Human
gccgaguggggcugcuuaggcugcgcagcaagagguugguggcuuggaagacagccucggagugagggc

SEQ ID NO: 4152803 - RNA, 63 nt, Human
gccgauguuguggcaauggggucugcaguacuggagcugcaagagcccaccacacacuucggc

SEQ ID NO: 4152804 - RNA, 107 nt, Human
gccgccgagccccccauuuccagggccagggacacgcugucaggcuccaggucauccaccucacuggcugugucccuguccagaguaggggaggacggcacgguggc

SEQ ID NO: 4152805 - RNA, 84 nt, Human
gccgcuauaucagugaccugaaauguuuuucacuugcuuacaagcaguaaagaaacugauuuuggaggcugaaaaaauaguggc

SEQ ID NO: 4152806 - RNA, 58 nt, Human
gcccaggcuggagugcuguggugugaucauagcucacugcagccucaaucccucgggc

SEQ ID NO: 4152807 - RNA, 58 nt, Human
gcccaggcuggaguucaguggugagauuucggaucacugcaagcuccgcccccugggu

SEQ ID NO: 4152808 - RNA, 124 nt, Human
gcccagggaaguuuugcucugggucacacccaccucuggguggcugccaaucugccugccagaaaccgcaggcugggccgcggcuacccagagucagggccacggagcuuaggagaccuugggu

SEQ ID NO: 4152809 - RNA, 59 nt, Human
gcccagggcucuguccauuccuucauaggcugcuaugauugagaggagagccugagggu

SEQ ID NO: 4152810 - RNA, 106 nt, Human
gcccagggcugugugcugcgggaagaacgaccaggcucgggggaguucucccaccagucccaccaggaucgcucuuaucccgggccucacuucacccacccugggc

SEQ ID NO: 4152811 - RNA, 59 nt, Human
gcccagggcuucaaagagagaacagagagcaucauccccuuccucacaagucccucggc

SEQ ID NO: 4152812 - RNA, 72 nt, Human
gcccaggggcagcuggguggccucuccucggggcguuuggggcccacggagagacauuuacuguacucgggc

SEQ ID NO: 4152813 - RNA, 69 nt, Human
gcccaggucugcaggguucggagaguucccugcuuguucacgggagcugaggagccccgucggucuggc

SEQ ID NO: 4152814 - RNA, 55 nt, Human
gcccaggucuggcaucagcugugugcucaguuucagcuauaugccaggcccuugc

SEQ ID NO: 4152815 - RNA, 58 nt, Human
gcccaguaguucaagguugcaggacaccaugaucaugccacuguacuucagccugggu

SEQ ID NO: 4152816 - RNA, 92 nt, Human
gcccagugauuucuagcccucuuuaauccuucccuacaccaacugcugcgguaaugaggggcaaggggcggcugaggauugaggucacgggc

SEQ ID NO: 4152817 - RNA, 61 nt, Human
gcccagugccacuguagccgcuggggcaacuagagcuguccuggggcucuggcaucugggu

SEQ ID NO: 4152818 - RNA, 71 nt, Human
gcccaguggcauugacauguaaacaguauggugugcuugagaugcuguaagcuguucagaauugcuggagc

SEQ ID NO: 4152819 - RNA, 58 nt, Human
gcccaguguucaucaagaaaauguggaacugccuacagguuuuuguggauauaugugu

SEQ ID NO: 4152820 - RNA, 85 nt, Human
gcccaucauagcugaugguggcauccagaccguggggcacguggucaaggcccuggcccuuggagccuccacagugaugaugggc

SEQ ID NO: 4152821 - RNA, 69 nt, Human
gcccaucaucacuguggaggcuccaaguuccagggccuugaccacaugcuccacgguccuaugaugggc

SEQ ID NO: 4152822 - RNA, 59 nt, Human
gcccauccacuaggcggcccacagcagcaccccugcgucugccugcaguguggcagggc

SEQ ID NO: 4152823 - RNA, 70 nt, Human
gcccaucucuaguccagucucaaaaugcuauuuucccucuugagugcagauugagugaggcuagcugggc

SEQ ID NO: 4152824 - RNA, 61 nt, Human
gcccaugcacuuucugugauggcugauaauugcugauacaagaugacaggugcaugauggu

SEQ ID NO: 4152825 - RNA, 110 nt, Human
gcccauggagcuuggugaugccuccuggugcuggcugaggccaugagaggaggcagaagugggagaggagagcagcaggagcccuuaucaccaggaacacacacgugggu

SEQ ID NO: 4152826 - RNA, 71 nt, Human
gcccauggucagggaggcagggaccagccucuacccucucagccugugacaccugucuccucuuaccuggc

SEQ ID NO: 4152827 - RNA, 57 nt, Human
gcccaugguggcguucggugcaucuuagaguccucugauguucuagcggcaccaggc

SEQ ID NO: 4152828 - RNA, 87 nt, Human
gcccaugugucugagcagcuggagaaauaccacccuugauccacucccugggaugggguuggaaccuccacucagccaccagugggc

SEQ ID NO: 4152829 - RNA, 62 nt, Human
gcccauuccuggcauggcucacugugguccaggauggaagauagugaggcaguucagugggc

SEQ ID NO: 4152830 - RNA, 66 nt, Human
gcccauuuucacccaauauaacuagaggaaggugacccuuccuggaaagggagugagacaguuggc

SEQ ID NO: 4152831 - RNA, 73 nt, Human
gccccaacacugggcugcccugaugguccucacaacggugcugucgagaccauggggguaacuuggguugugc

SEQ ID NO: 4152832 - RNA, 58 nt, Human
gccccaagaauaaccagacaauagcacagaaaugaccgugcuguuuucauauucuggc

SEQ ID NO: 4152833 - RNA, 108 nt, Human
gccccacaucucugacauuucaagguccuugcaauuuucaucuuucuuuguuuaacuucguaaggcauggguagaagagaagccagugacuuagucuuaaaauggugc

SEQ ID NO: 4152834 - RNA, 130 nt, Human
gccccaccuccaacaccggggauuacaguugacuaugagauuugaguggugauaugguuuggcucuguguccccacccaaaucucaucgugaauuguacucccauaauucccacauguuguaggaaggac

SEQ ID NO: 4152835 - RNA, 84 nt, Human
gccccacucccaaagugauuuucuucuuaguuauugccucauuccacauacagugauugaugagaaaggcauaggagauuuggc

SEQ ID NO: 4152836 - RNA, 59 nt, Human
gccccacuuuagggaaacaaggaaacuuuguguaucuuucaguuccagaaaaggggagc

SEQ ID NO: 4152837 - RNA, 78 nt, Human
gccccagaaaggcucagauucccccaggccaucccccauccugaggacaagguuuugggcccuuuucuguuugcaggc

SEQ ID NO: 4152838 - RNA, 72 nt, Human
gccccagacgccacucgcggcggacggcggccaguucccagggguuuggagccgggugcgcaggcguggggc

SEQ ID NO: 4152839 - RNA, 68 nt, Human
gccccagaggcuggggaaggauacagcuagccagaggauccugucucucaucucccauccucugaugc

SEQ ID NO: 4152840 - RNA, 87 nt, Human
gccccagagguagcaugcuguggcuuuagcuccaaaucaccaucuacugcaaggacaggucacauacaaaugcuccuuucauugggc

SEQ ID NO: 4152841 - RNA, 109 nt, Human
gccccagaguccacaaaacugucuguguuucugcuucacuggccuggaggugauuggauuucuucuccugggcuugguugaaguuacguucauagucaagcucaggggc

SEQ ID NO: 4152842 - RNA, 72 nt, Human
gccccagauauaugcaaacaagcccaaagucacuggaagaaguagacuauuucuuuugcauagguuuggggc

SEQ ID NO: 4152843 - RNA, 56 nt, Human
gccccaggauaaauuuguaagaugcuugaggagcaaugcaaacauuacuugggugu

SEQ ID NO: 4152844 - RNA, 61 nt, Human
gccccaggccaggggucuguguugugguaagaagcucagagcacaggguuuugugccgggc

SEQ ID NO: 4152845 - RNA, 90 nt, Human
gccccaggcuuuggugcauuguuucucuacccaucccuaccucucuuauccccgauguuuggcucaaacgagugucuccuuggcuuuggc

SEQ ID NO: 4152846 - RNA, 62 nt, Human
gccccaggucugugcuccaagcaaaugggcucuguggugguuucagagggcagaucuggggc

SEQ ID NO: 4152847 - RNA, 61 nt, Human
gccccaggugguaaaccuaagaaugacuucaauuuuuaaacaucuuguugccuuaaggggc

SEQ ID NO: 4152848 - RNA, 79 nt, Human
gccccagguuuguuucucuaaggcuacauugugcaaugccagagugcaugcaucuggucuuggaaauagaauauggagc

SEQ ID NO: 4152849 - RNA, 65 nt, Human
gccccaguggcuuccgugucuagccugacacccgugucagcccagggacagaggccccgggaggc

SEQ ID NO: 4152850 - RNA, 60 nt, Human
gcccccaacagagccugaaugccauuuugcugccugaaugugcagaggaauguagggggc

SEQ ID NO: 4152851 - RNA, 59 nt, Human
gcccccagaccucagugggcugccuuggggugcagggguacagccuuggucuguggggc

SEQ ID NO: 4152852 - RNA, 59 nt, Human
gcccccagcgcugggccuguagggugugcuccugggaucaggccccaggccuggggugc

SEQ ID NO: 4152853 - RNA, 56 nt, Human
gcccccguaguagaugaggcgcagcagcuccugcuccucguaacucuguggugggu

SEQ ID NO: 4152854 - RNA, 58 nt, Human
gcccccuagccugcccgcugcucggggaauauugucaccagcaggccaggcagguggc

SEQ ID NO: 4152855 - RNA, 86 nt, Human
gcccccucuccuugguccuccugauaucugugaucucaugaaugggaugaugaagcagacucagguggugcaaggaaggcgguggc

SEQ ID NO: 4152856 - RNA, 106 nt, Human
gcauuuccuacuucgcaggcucauccggaguuucagucuugccuggccugcagcuucagccgaggucugcaaggcagcaccagcucuuggagccaggugggaaugc

SEQ ID NO: 4152857 - RNA, 93 nt, Human
gcauuucuacguuuaugagcuggcauucuucuguuaaacugcuuucacuugugaaacaggaugcagaggaggagacuuauucaacagaauugu

SEQ ID NO: 4152858 - RNA, 63 nt, Human
gcauuucuggcaaagccuguugguuuaauucagauguuaaauauuuucagcagggucaagugc

SEQ ID NO: 4152859 - RNA, 67 nt, Human
gcauuucugucagcugcuuugucucaccauggccuguaauggugaaaguguucacugccagaaaugc

SEQ ID NO: 4152860 - RNA, 68 nt, Human
gcauuucuuccauacagacaaugcaaugcaaugacaucauuucauuauauggaauguuggaaauaugc

SEQ ID NO: 4152861 - RNA, 62 nt, Human
gcauuugccuuucaccugcugcuuuucacuucccaaaauacacaggugcuaggucaauaagc

SEQ ID NO: 4152862 - RNA, 76 nt, Human
gcauuuggaacaaguccaggucaauuuaaagccaauaccaucugguuuuuaaauaaaccugaacugaguuaaaugc

SEQ ID NO: 4152863 - RNA, 63 nt, Human
gcauuuggaacuugguugagaugagaacauguuucuuaaaaaauuacagcaguggccaaaugc

SEQ ID NO: 4152864 - RNA, 68 nt, Human
gcauuuggauggagguucaagcacuaaaagaaaaugucucuugguaugcuuauuaucuucaacagagc

SEQ ID NO: 4152865 - RNA, 94 nt, Human
gcauuuuaaggcuauugucucuucauguguuuaauuuuuacauaaaacaaugauaauaaaaaaugaauaugauggaggauucucuguaaagugc

SEQ ID NO: 4152866 - RNA, 65 nt, Human
gcauuuuaggagaucacugagcacaaucugccauuugcccaagugcuggagacucacucaggugc

SEQ ID NO: 4152867 - RNA, 78 nt, Human
gccccuuaucccuaaggcaguagugucuguagggccucaggcaccuacauucucauuuccuucauguaugcagagggc

SEQ ID NO: 4152868 - RNA, 59 nt, Human
gccccuuccacuggcgaggagacagcgagaaggcgccaucucugacccaggaagagggc

SEQ ID NO: 4152869 - RNA, 59 nt, Human
gccccuucuucuggagauucaaacuaguugcuaaaaugaauucucccagaagaaugggu

SEQ ID NO: 4152870 - RNA, 66 nt, Human
gccccuugagaucaggagcuguuagggaggagcugccucuggccaauguugugaucacaagagggc

SEQ ID NO: 4152871 - RNA, 60 nt, Human
gccccuugcaccgcccugguuccuaagacaaguggaggcacagccagggugagaaggagc

SEQ ID NO: 4152872 - RNA, 101 nt, Human
gccccuuucuuggccacaucauauuuuaacagaguaaagaugcauaugucuuugagcauuagauuugccuuugaagcauggugaggcuaugguaggccggc

SEQ ID NO: 4152873 - RNA, 92 nt, Human
gccccuuuuuauggcucuggcagcugauauuaggacuugauuacuucugaacuccugaaaacauguuugcugucaguugcaaaagagguggc

SEQ ID NO: 4152874 - RNA, 82 nt, Human
gcccgaggccacagcagaguaguuuuccaacuuguuccaguuggcaucaaguuggaaaucuagucuucuuuucauuuugggc

SEQ ID NO: 4152875 - RNA, 66 nt, Human
gcccgaggccucugugacgucacggugucugcgggaggagaccaugacgucacagaggcuucgcgc

SEQ ID NO: 4152876 - RNA, 62 nt, Human
gcccgcagagaucuuuaacaaagucccuugcaggaggagcugagugcagaugucugugaggu

SEQ ID NO: 4152877 - RNA, 93 nt, Human
gcccgccgcccuccuccaccgccauggcguuguacagguccagcaugaacaugggugccgaguugugcuugcccuggaggugcgggcgcgggc

SEQ ID NO: 4152878 - RNA, 101 nt, Human
gcccgcgcucgggccgcccucccuggcagccgcacuccugguggcagcggucucugagguaggugguggcagccauggcaguggggccccggccgcagggc

SEQ ID NO: 4152879 - RNA, 70 nt, Human
gcccgcggaguuguaagggauguggcuugugcugggaaacacaguuaucaucccuuacacuuuguggagc

SEQ ID NO: 4152880 - RNA, 59 nt, Human
gcccgcugcuucagggacgugccagcggccgcgcuggccgagggccggggucgcguggc

SEQ ID NO: 4152881 - RNA, 107 nt, Human
gcccggaggcaggccagugugccgcugcugcaauagcaccaccuccgccuugccugcgaaggaaggcagggaagcuggcaucacggaacucuuccugugcucccggc

SEQ ID NO: 4152882 - RNA, 61 nt, Human
gcccgggauguggagguugcagugaggugagaucaugccacugcacuccauccagccuggc

SEQ ID NO: 4152883 - RNA, 74 nt, Human
gcccgggcacgaagggagcaggucccuguaagacagaggccucgucccagggugcgccugcccucggccuuggc

SEQ ID NO: 4152884 - RNA, 62 nt, Human
gcccgggcagcucggcacuggggcgaacccacucccgcucuuuccucgaugggcuccugggc

SEQ ID NO: 4152885 - RNA, 84 nt, Human
gcccgggcccaugcccgugugcccccugccaucgugcagaugcugcuggugcugcaggugggcacagugggcagagggucgggc

SEQ ID NO: 4152886 - RNA, 88 nt, Human
gcccgggcguccccgaacccucgcgcgcgggcggcuccggacgcaguguccccggccucugccccgcggggcucgggccgcgccaagc

SEQ ID NO: 4152887 - RNA, 81 nt, Human
gcccgggcugcagaagccaguguggucugcccauugggcagcaaugggcagguggcguuggcucuguggucauuggugggc

SEQ ID NO: 4152888 - RNA, 100 nt, Human
gcccggggaagaaagaggaauggagacuaaacgcuuaggacgauauuucugugaaaagcucugugguagcuuuagcuccauuuccuuaaauuaccugugc

SEQ ID NO: 4152889 - RNA, 69 nt, Human
gcccgggucaccaugaggacucuccgcagguugaaguucaugaguucgcccagccucagugaccugggc

SEQ ID NO: 4152890 - RNA, 62 nt, Human
gcccgugaugcccaucuuuccagcagagaccaaaauuagcugaggggaaaagggcuucaggc

SEQ ID NO: 4152891 - RNA, 67 nt, Human
gcccguggugcuuguggagcuggugcugcuugcgcagcuuguagaaggccacgagcaucaccgcggc

SEQ ID NO: 4152892 - RNA, 55 nt, Human
gcccuaauaguucugucuuuggggaugacauuaucuggggcagagcugacagggc

SEQ ID NO: 4152893 - RNA, 75 nt, Human
gcccuagaaguacacaucguuggccccgaaggagccccagcagccaugucggaccgcgaggugaccuuggagggc

SEQ ID NO: 4152894 - RNA, 60 nt, Human
gcccuagaaucacauuucuuguguauaaauacuagauucauuauuaaugugaucuugggc

SEQ ID NO: 4152895 - RNA, 84 nt, Human
gcccuagcuaauauccuuuccagaguacaguaucaaagaaacgauauuacuguaagaaaauaucugaaggguacaguccagggu

SEQ ID NO: 4152896 - RNA, 56 nt, Human
gcccuagcugccccagcggcucugguuucaccuucuucugggaaaugagcuggggc

SEQ ID NO: 4152897 - RNA, 56 nt, Human
gcccuaggaaaugaauacaguacacaaauguugccagcaugugaguuuccuugggc

SEQ ID NO: 4152898 - RNA, 90 nt, Human
gcccuagguggcagucacugucauccuccccauuuuacaaaugaguaagucaggguacagagagaugagguaacuugccaacagucaagc

SEQ ID NO: 4152899 - RNA, 105 nt, Human
gcccucaaaagcccaggcugacguuaucagagggcaaccagaugucaguguuugcacagccugucccuguccuggugauuuuguccuuggccugggaaugacugu

SEQ ID NO: 4152900 - RNA, 59 nt, Human
gcccucagcauccucagggccagugaguguccaccugggccaguguggggcugaagggu

SEQ ID NO: 4152901 - RNA, 69 nt, Human
gcccucagguccucgggggaggccggcugcaccgagccgggugucggccuugucccuguccugagaggu

SEQ ID NO: 4152902 - RNA, 69 nt, Human
gcccucagugaccacugauucagugccccaccaauacugcacauuauuuuacuggucaucugaguaggc

SEQ ID NO: 4152903 - RNA, 85 nt, Human
gcccucauucaggaagaagauacauuccauuucuacuuaauugcuuaaguuaaagaggcaugggaauguauggcuuuuggguggc

SEQ ID NO: 4152904 - RNA, 81 nt, Human
gcccucauuccugcccauggaagcuugcaggaauagcuggaauccagccuccugaacagcuccugagcaugggauaauugc

SEQ ID NO: 4152905 - RNA, 61 nt, Human
gcccuccaagcuucaucucaaccagaaguaaaacaggcuugugguugugugcuuugagagc

SEQ ID NO: 4152906 - RNA, 64 nt, Human
gcccuccagccuguggaaccggggucaagccagggcugcgagcggagccagaggcuggagaggc

SEQ ID NO: 4152907 - RNA, 57 nt, Human
gcccuccagggaggagcacggguucagguacauguggcaccugcccucccuggcugc

SEQ ID NO: 4152908 - RNA, 70 nt, Human
gcccuccaguuuuagaagauacuguuacaaaauccaaaugugagauaauacuucuuagcuggaacagggu

SEQ ID NO: 4152909 - RNA, 116 nt, Human
gcccucccugauaggagucugauaaggcccucaugcgucagagcccugcagcugacuagugcugagcucggcucccaggagggccuggaggucaggcugggucugcaggagggggu

SEQ ID NO: 4152910 - RNA, 62 nt, Human
gcccucccuggcuuuguccugaggcaggguuauguaaccagccgggucuggccaggcagggc

SEQ ID NO: 4152911 - RNA, 73 nt, Human
gcccucccuucugcacccuccugccaccggcuguuccucuggcagcuucugcucauggagggguggagguggc

SEQ ID NO: 4152912 - RNA, 76 nt, Human
gcccucgcagucuccacagaaggcuugccgggaagcggcagaugcugcugcuggaggcaggccuucccugcagggc

SEQ ID NO: 4152913 - RNA, 57 nt, Human
gcccucuccccagagcuucccuaguuauucucugagcacagcucuggggagaugggc

SEQ ID NO: 4152914 - RNA, 86 nt, Human
gcccucuggcggggcucuucuggcaaucccagggucuuucuuguagcugagccgauccuaugccagggccucgcugcucccagggc

SEQ ID NO: 4152915 - RNA, 58 nt, Human
gcccucuggcuuacuguuggguuuguccaauggcaggcaucagcaaguaucagagggu

SEQ ID NO: 4152916 - RNA, 67 nt, Human
gcccugaaaagcaucucaaaggagcuucaagucccaggggaaaagggaucucuuuaggugucagggu

SEQ ID NO: 4152917 - RNA, 95 nt, Human
gcccugagccccuuugagcuucaguaaccccccucugcaugccuugcucagacaucauuguuaggguccugugcaggggcuggagugcucagggc

SEQ ID NO: 4152918 - RNA, 85 nt, Human
gcccugcaagcuggggagaauuggguuaucuaagggauguaauucuguccuaaagguuuaacucuuuuccaccagccagcagggu

SEQ ID NO: 4152919 - RNA, 100 nt, Human
gcccugcccaccggagggcuggcgccccagauccuaggugaguuguagccuugacuucagcagcacucugcggguccccggcgcuccucugggccagggc

SEQ ID NO: 4152920 - RNA, 55 nt, Human
gcccugcccugagccguagacccgacucccucuggcgggucuccaggguacgggc

SEQ ID NO: 4152921 - RNA, 60 nt, Human
gcccugcucauuucacguguuuccuggcccagugaaagugugugguaugaauucaggagc

SEQ ID NO: 4152922 - RNA, 64 nt, Human
gcccugcugcagguucaccuaccugaccaugacgggcgaggagguggagcugugcagccggggc

SEQ ID NO: 4152923 - RNA, 59 nt, Human
gcccugcuucuggcaugcagaaagcaaucccacuguuuuugcauagcaaguagcauggc

SEQ ID NO: 4152924 - RNA, 58 nt, Human
gcccuggacaguuucugcaugugcugcagcugcaaagacagaaagcauguuccagggc

SEQ ID NO: 4152925 - RNA, 87 nt, Human
gcccuggaguauuugcccaccaauuacugucuccugcugguguuggcagacacaggaggaggaugguggucugggggaaccuagggc

SEQ ID NO: 4152926 - RNA, 86 nt, Human
gcccuggagucagaauguccuccugcggcugcacacggucaguugucuccccaggauuugggcuuuuuggcuucaguaaaugaggc

SEQ ID NO: 4152927 - RNA, 63 nt, Human
gcccuggaugcucauggcaucaagcaccuggaauaccaaaucaugaggucagagcauaggggu

SEQ ID NO: 4152928 - RNA, 74 nt, Human
gcccuggauguuuuuggcuucaaguuucuccacaauggggagaauguauuuuuagcucagaaauccagcagggu

SEQ ID NO: 4152929 - RNA, 84 nt, Human
gcccuggcccgguucuguuuauggcucugcgugggguuucuguagagcagcuccagcagaaccagagaccugggaaaagggggc

SEQ ID NO: 4152930 - RNA, 60 nt, Human
gcccugggagguuagaauauguauugggaaggauaacccaggucuccugcuucccagggc

SEQ ID NO: 4152931 - RNA, 56 nt, Human
gccugggauggcaucagccuucuugauguaauugagagauggauguuauuaugggu

SEQ ID NO: 4152932 - RNA, 57 nt, Human
gccugggccacugcccuggcuacaccgggaagucuggagcuagaaagugggccgugc

SEQ ID NO: 4152933 - RNA, 64 nt, Human
gccuggggaacuugauccuguccgucaagugcgaggaagcagaggggaucgaguaccuccgggu

SEQ ID NO: 4152934 - RNA, 98 nt, Human
gccuggggcucccacccaccuaaggaaugccauccuugucaccggcucacggggcagcucuuugguauccuuccagggugguguguacaaguacaggc

SEQ ID NO: 4152935 - RNA, 56 nt, Human
gccuggggggcaugucauaauagggacccucugcuuugcuugucaugcacucaggc

SEQ ID NO: 4152936 - RNA, 81 nt, Human
gccugggucaccggcuccaacgaggugagugggaaccaggaugucugcucccugaugugggcugcgugacaagccccaggc

SEQ ID NO: 4152937 - RNA, 57 nt, Human
gccugggugcccggcccuucucugggcagaaacccaggggcuggccgggcuccaggu

SEQ ID NO: 4152938 - RNA, 57 nt, Human
gccuggguuccugcuuuugugaccacauuuaauaacacaaugcauggaacucauggc

SEQ ID NO: 4152939 - RNA, 122 nt, Human
gccugguccacaguuuucccaugucucaccuuaaagcagaggugauaugacuuacuauucagguacguagucuuguuacgcuuuuugcaaaaggaauucagauaucgacccuacucccaggc

SEQ ID NO: 4152940 - RNA, 94 nt, Human
gccuggucuuggaucuuguuccucacagcugguucauucaggagguuagugcucugcugaggaggcuggaggcagagcuccaucuuggccuggc

SEQ ID NO: 4152941 - RNA, 60 nt, Human
gccuggugaggagaaaugcucagagccagacaacuggcuccuucauucuccugccaaggu

SEQ ID NO: 4152942 - RNA, 88 nt, Human
gccugguguaguauuugcuccuggaguuuuuugguugacucugggggcaccgagugucacucugacuccaguaaguaaugccaauggc

SEQ ID NO: 4152943 - RNA, 60 nt, Human
gccuggugucuccucugagccuaggcuguaguccaacaggggugggaggacacagcaggc

SEQ ID NO: 4152944 - RNA, 97 nt, Human
gccuggugucuggguugugucuggggcugcucccucucuccugcccuuugccagagagucugaggcagcugcagccauggccuccaggauaaugggc

SEQ ID NO: 4152945 - RNA, 80 nt, Human
gccugguuagcccagaugauugaaccaugggacaaaacugaugaagguuaugguuucaauuucuggguaggccaguuagc

SEQ ID NO: 4152946 - RNA, 122 nt, Human
gccugguuagcuagaaguuccugccuugucacagcacuaauccugcaauuucuccauuggauuucuggacugaugagcaauuuugaugcugauaaggcagaaacacaaucacucuccugggc

SEQ ID NO: 4152947 - RNA, 73 nt, Human
gccuguaaguaaaccacaguggugggagcagugcucgggacaguggacauugcacagcccuguggugaugggc

SEQ ID NO: 4152948 - RNA, 56 nt, Human
gccuguaauucccucuugauuaagauggugauauugauuuagcugggauugcaugc

SEQ ID NO: 4152949 - RNA, 83 nt, Human
gccugucaauuuuguguacaauuuuuuuggcaaauuuaacauucaaccacuuuuguuagcuuaguaccagaguugucacgggc

SEQ ID NO: 4152950 - RNA, 57 nt, Human
gccugucacccccccaucucacggauucuccaaaggacuuugggaggugugaggggc

SEQ ID NO: 4152951 - RNA, 61 nt, Human
gccuguccacuaaacagccaagcauguugggaaauuguugugaggugguuuggaagcaggu

SEQ ID NO: 4152952 - RNA, 60 nt, Human
gccuguccauggcaaugaugcagaaggccacgaaggucucuggguucagcuuggaggggc

SEQ ID NO: 4152953 - RNA, 130 nt, Human
gccugucccagcaaggacucccaggggccugggauucucaaaggggugccaccuccauuggaugccccuuuccuugagaaaccccaaagcccuuucagaggcuguucagcuguaaccucacuccaagggc

SEQ ID NO: 4152954 - RNA, 129 nt, Human
gccugucucgacgagccgcucacccaagcccagccuaaccaaugugcagacuacuguacacauugagagccuccugaacagguagucugaacacuggguuggcggggccggcuauccauccugcagaac

SEQ ID NO: 4152955 - RNA, 56 nt, Human
gccugugaaagggaggaugagcggcgcggcacagcccuccacaccuguucgcaggc

SEQ ID NO: 4152956 - RNA, 58 nt, Human
gccugugccucagccugcagccugcaccucuauguagcuguguggccacgggccaggu

SEQ ID NO: 4152957 - RNA, 57 nt, Human
gccuguggaccccucacccgagcggacugccauccccucugguccugucuggcaggc

SEQ ID NO: 4152958 - RNA, 59 nt, Human
gccuguggcccaacugucugucuguccuaccaccucaggcuacagggccuggccaaggu

SEQ ID NO: 4152959 - RNA, 59 nt, Human
gccuguggccgacugagagccuuuaugggagaguucgugggcagucugguggcuauggc

SEQ ID NO: 4152960 - RNA, 97 nt, Human
gccugugggagccugggggaagaggcaugaaguccuguagauuuguuacaucaagauguuaauguuuuuaaucaagguuccuaggugacccucaggc

SEQ ID NO: 4152961 - RNA, 62 nt, Human
gccuguguccuucccaguggggcacugcaggcagcuccccaauuggcaagggcacucgaggu

SEQ ID NO: 4152962 - RNA, 62 nt, Human
gccuguguuaaauauauugaguuuucuuaaagagggaaaaccugugaauaguuaacucaggc

SEQ ID NO: 4152963 - RNA, 55 nt, Human
gccuguuacuucucugcaggcaucuuucccacagcucugcagggaugugcagagu

SEQ ID NO: 4152964 - RNA, 58 nt, Human
gccuguuagaaccagugagggaagcaguucagccauccugccagugaagcugacgggc

SEQ ID NO: 4152965 - RNA, 59 nt, Human
gccuguuggugacuuucuguuggccaacaugggcugacuggaauguucuccagcauggc

SEQ ID NO: 4152966 - RNA, 78 nt, Human
gccuguuuccuaaaugugcuaauagcaugaaaaugacuuauuuccauguucucuguugugcuaugcuaagaaacaggc

SEQ ID NO: 4152967 - RNA, 62 nt, Human
gccuguuucuccuccuuggccccagauccgcgacuggcggcaaggugaggacgaacacaggc

SEQ ID NO: 4152968 - RNA, 64 nt, Human
gccuuaaagacaacugcagagcaaagaauccaagcgauuuacuuuugcguagugucuccgaggu

SEQ ID NO: 4152969 - RNA, 78 nt, Human
gccuuaaauagacauuuucucaacaucucuagaauaaaugcauuauuucuaaggauaguaaaaugucugauggaaggc

SEQ ID NO: 4152970 - RNA, 111 nt, Human
gccuuaacugcaucaaccggguuuacgaaacagccugauuuccagccccacccaucgcaacugcagcugucagguuucccggcucacguuucccuggaugagcagagaggc

SEQ ID NO: 4152971 - RNA, 85 nt, Human
gccuuaagcagaaaagcuaagugaaggaaaaccgucuuucuuuucaacuuccugacuucuuuuauagugaauuuucuuggagggc

SEQ ID NO: 4152972 - RNA, 57 nt, Human
gccuuaagucucacuccagguauuauuacuuccauuuacagaugaggagaccaaggc

SEQ ID NO: 4152973 - RNA, 72 nt, Human
gccuuacaucauugagacauacauacauuucaugaggcugaaugggauuuaugcugucuuugugaagugugc

SEQ ID NO: 4152974 - RNA, 92 nt, Human
gccuuacuugccucacuacugggucaacacauuuuauguguauaacauauguguacagaaaugugaugacgcaagaggcaagaguugacggc

SEQ ID NO: 4152975 - RNA, 64 nt, Human
gccuuacuuuuuccacuaaucauuguacugcagaaaggcaaagaauagugagaagauguauugc

SEQ ID NO: 4152976 - RNA, 72 nt, Human
gccuuaucauuuucuaccagcgguuugaauuuggcuucucaaaugcagaccaguaugaaaaacauaaguagc

SEQ ID NO: 4152977 - RNA, 64 nt, Human
gccuuauguugauaggaaucugauucccauuccuuuuugggaaugaguugggcagcauacaggc

SEQ ID NO: 4152978 - RNA, 69 nt, Human
gccuucaaguacugcauuuaucaaguggcgaaauuaaucagguauugauuaaaugcaugaauguaaggc

SEQ ID NO: 4152979 - RNA, 60 nt, Human
gccuucagcggccgcucgcugcggggacaccccgguggaugaguucucgcugccaggggc

SEQ ID NO: 4152980 - RNA, 58 nt, Human
gccuucaguaacugagacggaauguuuagaauacagaucuuuaucguugucugagggc

SEQ ID NO: 4152981 - RNA, 75 nt, Human
gccuucauucauuuaugucaugggcauuuauugagggccuaacauacaugagguucugucuuugacauagagggu

SEQ ID NO: 4152982 - RNA, 70 nt, Human
gccuuccacaccuugucacaguggccacuuccuaaggaaggccucccugugugcaggugugcagaagugc

SEQ ID NO: 4152983 - RNA, 67 nt, Human
gccuucccacauucuuuacauucauaagguuuuccaccaguaugaauuuucugauguuggguaaggu

SEQ ID NO: 4152984 - RNA, 68 nt, Human
gccuucccaggaaggaucguuugggagucuucuacaccuuagauuccccaugagaucuuuucaaaggc

SEQ ID NO: 4152985 - RNA, 56 nt, Human
gccuucccuggcuaggcaagcauaggcuucaaggaccuuaucugccagggacaggc

SEQ ID NO: 4152986 - RNA, 59 nt, Human
gccuuccggagccaaauggcaggcggaagacagcagccaggcaugggcuucugggcggu

SEQ ID NO: 4152987 - RNA, 56 nt, Human
gccuuccugacuuggcuguuggcccuaggugcuagggauagagagagaacaggggc

SEQ ID NO: 4152988 - RNA, 57 nt, Human
gccuuccugguauggguugauuuggagaugggaucacuuuaccucauucaggcaggc

SEQ ID NO: 4152989 - RNA, 55 nt, Human
gccuucucagagaggguaauauccagagacaaccuuggaccagcuuucaggaggc

SEQ ID NO: 4152990 - RNA, 79 nt, Human
gccuucucccauuguugcugcuucaagauauuguguccuacuucccaagguaaugaugugugaggcaauaacagggggc

SEQ ID NO: 4152991 - RNA, 89 nt, Human
gccuucugcgggucgcguugcagcugcugcugccuguccugcccgcgcgccgccugcugcagcagcuguucggcgaucaagccggaggc

SEQ ID NO: 4152992 - RNA, 83 nt, Human
gccuucugguauccugcaguugagugcaucuuuaggauggugauaaacaucaauaaguaggauaucaagauaacuagaagggc

SEQ ID NO: 4152993 - RNA, 81 nt, Human
gccuucuuauccucaaguucacagucuggucgcugcuguauuccaaggcagugaaaaaagacuuguugaacagaugaaggc

SEQ ID NO: 4152994 - RNA, 55 nt, Human
gccuucuuauuuuccugaggaagaagcuaguguuucuuaaggggaaguggggggc

SEQ ID NO: 4152995 - RNA, 97 nt, Human
gccuucuucccgaaaccagugauuucuguguggguagcuccuguuuauccagaccaaacugaucaacuuacccauaagaaagcuguucuucaaaggc

SEQ ID NO: 4152996 - RNA, 68 nt, Human
gccuucuuucuuaauagccaggaaguguuuuagagucauacucucugguguagaaagaccuucaaggc

SEQ ID NO: 4152997 - RNA, 73 nt, Human
gccuugaggucugagcagcuucugucugaaggccaggagguaggacuggguugcaggggcugcugggcagggc

SEQ ID NO: 4152998 - RNA, 92 nt, Human
gccuugaucagcuccacaaaguccugguguauggccagaucacucucgaaggcuucaugguuguggauaagggcuuugaugucugauagggu

SEQ ID NO: 4152999 - RNA, 57 nt, Human
gccuugaugauagcaggcagggaaguaguaauuucccuuuauuguucagcaaauggu

SEQ ID NO: 4153000 - RNA, 72 nt, Human
gccuugauucuguucuccuugagaaugugggauguuuuauaaacacauuaagaguuacaaauagaguagggc

SEQ ID NO: 4153001 - RNA, 56 nt, Human
gccuugccucagccauggaaacggcugcugcccacaccccugagcugugguaaggc

SEQ ID NO: 4153002 - RNA, 55 nt, Human
gccuugcugguuucugauccugcguugucauggacagccuuauugcgagcaaggc

SEQ ID NO: 4153003 - RNA, 77 nt, Human
gccuugcuuagucccaugcugcccugccccagccaugguugauuggaugagggcugagcacugggaccaacagcagc

SEQ ID NO: 4153004 - RNA, 58 nt, Human
gccuuggaacaauuauugcugcaauauauucaacagccaguacugaaugcuccaaggc

SEQ ID NO: 4153005 - RNA, 69 nt, Human
gccuuggaucaauacuauuaagaucauaugacuugacccauaaaugauuuauguaugugaaaucaaggc

SEQ ID NO: 4153006 - RNA, 57 nt, Human
gccuuggccuuccuaggccugaccuguucuaggccucuuagcugggaaggucagggc

SEQ ID NO: 4153007 - RNA, 58 nt, Human
gccuuggcuucuucauaugugaucuuaggguuccuaagggcagcaagagaagccaagc

SEQ ID NO: 4153008 - RNA, 62 nt, Human
gcgccuugagccuccaagguugccuuauauucuuggcaaaaguacacugguuguucaagggc

SEQ ID NO: 4153009 - RNA, 59 nt, Human
gcgcgcugaggcuggaggcgcacgagaaguucucgucuggcuucuccacgguaaagcgc

SEQ ID NO: 4153010 - RNA, 76 nt, Human
gcgcggggacgugugcgcacaccuguuuccacguggacgugguccuuugcuugucugcgcgcagcuguguccgagc

SEQ ID NO: 4153011 - RNA, 98 nt, Human
gcgcucaccgcacguccaugaugcugcugcgcuggccgucacgguggcucuccaggugggacagcgugaaggcgggcagucggcggauggcgaagcgc

SEQ ID NO: 4153012 - RNA, 69 nt, Human
gcgcuccugcucgcggccucucccagucccggaauuggggcugcggaucuaaggcugggaggggagugc

SEQ ID NO: 4153013 - RNA, 67 nt, Human
gcgcuucccaucaggagaccagguccugcuccuccccgaggggcaaccugagcuuguggagaaacgc

SEQ ID NO: 4153014 - RNA, 96 nt, Human
gcucucagcgccgcccucccagaccccagagacgucggucagggcgcggcgccccgggccacugcgggcucuuuccgggcgggcgacguggggggc

SEQ ID NO: 4153015 - RNA, 111 nt, Human
gcucuccauggaccauuuuacucagccugccaagcuguguucuacaccuuuguuuuuagacacaagcagcuuuugagcggaaaccugaaagaaggucaguguugugggagu

SEQ ID NO: 4153016 - RNA, 130 nt, Human
gcucucccggaugucugcgcugggucccgcggcagcaugucuaugucucuggaaggagugugggcaucaagggcccagacagagauacuauguugucagggcccagacagagauacuauguugucagggc

SEQ ID NO: 4153017 - RNA, 66 nt, Human
gcucucccuuccugagacccucacagugaugcucacugucugugaagucauaggaggggaccccgc

SEQ ID NO: 4153018 - RNA, 87 nt, Human
gcucucuagaggaccauggaggugcugccuagaaggagacagguuugcuguuuccugggccuguacuccauccgucuuuaggagagu

SEQ ID NO: 4153019 - RNA, 103 nt, Human
gcucucucccuuuuggugcugagggugggcuuuguuccuccagugcuuccucaaagacccccugguggccgaagcccucucucaggaccuccugguggagagc

SEQ ID NO: 4153020 - RNA, 110 nt, Human
gcucucugagcauucgagcgguccuugcuaguaucacuuggacauagcagaaaggagaaguccuuucuaucuaggguuagagugagaccaacugcucccuuucagagagc

SEQ ID NO: 4153021 - RNA, 74 nt, Human
gcucucugauuuaucccauucauagcaagcuacaucugugcaggcagcauagcuuagcuguggaggcagggggc

SEQ ID NO: 4153022 - RNA, 73 nt, Human
gcucucugcggcuuggcuguagcuuuagcgcuguugggcugacggccuggaguucagccaagucccaaugagc

SEQ ID NO: 4153023 - RNA, 64 nt, Human
gcucucugcugugcuuguggccacccgauguuggauacugggugauacugcagagcaacggagc

SEQ ID NO: 4153024 - RNA, 61 nt, Human
gcucucugggagcaauuguuugcuuggccugaggaaagcagcauagaugcuauccgagagc

SEQ ID NO: 4153025 - RNA, 56 nt, Human
gcucucuuuuuccagugguggucuacaggguugcuacauuuuuggaagacuagagc

SEQ ID NO: 4153026 - RNA, 67 nt, Human
gcucugaaaucauccaagcagaaaagugagaaagcacguuuuaugguuugcugaaugauuccagggc

SEQ ID NO: 4153027 - RNA, 72 nt, Human
gcucugaaugagggauucugagggcuaaggucagagucuauagaccggguccuucuuuccccaccucaaagc

SEQ ID NO: 4153028 - RNA, 79 nt, Human
gcucugaauuaaucacuuuucauuaguaccuguuuuacuuaccguagguaccaugcuaaaaguugaucucaauuugggc

SEQ ID NO: 4153029 - RNA, 70 nt, Human
gcucugacacauuuguucuaccuccuucaucucggggagacagcgugaaggauaaaugaaagucaggagc

SEQ ID NO: 4153030 - RNA, 82 nt, Human
gcucugagcagaugcucgcucucccauccauccucagaacaggucagggcuggggaggagagacguccacugcucacucagc

SEQ ID NO: 4153031 - RNA, 67 nt, Human
gcucugaguaaaugaaagcauuccugcacauuugaauuucacagguuuuguauuucacacugggagu

SEQ ID NO: 4153032 - RNA, 63 nt, Human
gcucugcacagggcugccaggcggcuucugucugugcaaggccacaggcacccuguguucagu

SEQ ID NO: 4153033 - RNA, 56 nt, Human
gcucugcaggagugaaagcaggccugauucauacaguuugcuuauuucuguagugu

SEQ ID NO: 4153034 - RNA, 64 nt, Human
gcucugccaccuuguaucaaaauaaucuggaacagguuuccauggaagcaaagguggaaguggu

SEQ ID NO: 4153035 - RNA, 79 nt, Human
gcucugccaggauacagugagaaugcagcuaauaacuuccaggagguuuccucugcugguuuucauuguaacuuagagu

SEQ ID NO: 4153036 - RNA, 77 nt, Human
gcucugccccucaccagcuguaagaucucggacccucugugagccuguguccucaucugcagcgaagggaucagggu

SEQ ID NO: 4153037 - RNA, 76 nt, Human
gcucugccugcauccgcugggcgggcaccacccacuccacuguccucgggccugcccacggggcuggcauaagagc

SEQ ID NO: 4153038 - RNA, 58 nt, Human
gcucugccuucucacuggguucaccucccaagguuuccagucuccugaaaggcagcgu

SEQ ID NO: 4153039 - RNA, 63 nt, Human
gcucugcugcccaggccugcuaggccugcacagggccauggcgggggucccuggcggcagggc

SEQ ID NO: 4153040 - RNA, 85 nt, Human
gcucuggccccagcgcgcucgaugguuuccgcgcggccgccggggcucgcacgguccagucgccagggggcgcgcuagccggcgc

SEQ ID NO: 4153041 - RNA, 70 nt, Human
gcucuggcccuggcaaacugggauucgagcccaggcaugaggcccaguccucugccgucugggccacagc

SEQ ID NO: 4153042 - RNA, 56 nt, Human
gcucuggcuacuccacccuguuggccaaggggcugaaggguggagcacuggccugc

SEQ ID NO: 4153043 - RNA, 63 nt, Human
gcucuggcuaguuaccucuuacccuuuccugaaaagacucaggaacuaagugacugucacagc

SEQ ID NO: 4153044 - RNA, 55 nt, Human
gcucuggcuuggggcacucgucggcgaagucagcguggguguuccagacccaggc

SEQ ID NO: 4153045 - RNA, 55 nt, Human
gcucugggcuuuaguuuguuaucuggguaccagagagcauagcuugagccccugc

SEQ ID NO: 4153046 - RNA, 55 nt, Human
gcucuggggucccugggggagaaggcacagccccugcccuggagacacuuaaagc

SEQ ID NO: 4153047 - RNA, 101 nt, Human
gcucuggguucugaaaagguggugggaaaaaaacuuagaacagagaaaauucuguccaugcuuuucucucaccauuuuugccuucuaacccuuaguugagc

SEQ ID NO: 4153048 - RNA, 57 nt, Human
gcucuggucugagcuuuggcccacgcucucuccacugggccacaucuuuuccagagu

SEQ ID NO: 4153049 - RNA, 55 nt, Human
gcucugguggugaucagacgcugggugagacagcagaggggauuucuaccagagu

SEQ ID NO: 4153050 - RNA, 90 nt, Human
gcucugguugagccuuguacaggauauuauaggcuuuaaaagaagaagaagaaagaccugguaugcuguacaaaaaacugcaaaccaggc

SEQ ID NO: 4153051 - RNA, 72 nt, Human
gcucuguagcccaggcuggagugcaggggugugaucucagcuuacugcaaccuccaccuccuggguucaagc

SEQ ID NO: 4153052 - RNA, 57 nt, Human
gcucuguaugagggugagagaugaagccaauaaacauuucuugauuaucuacagggc

SEQ ID NO: 4153053 - RNA, 71 nt, Human
gcucugucaccaggcuggagugcaguggugcgaucucggcucacugcaaccuccgccugcuguguucaagu

SEQ ID NO: 4153054 - RNA, 79 nt, Human
gcucugucagagcuguguguuuccacugagcucggguuucuccgauguguuucugugguaugcaguuugucacaggagu

SEQ ID NO: 4153055 - RNA, 90 nt, Human
gcucugucaucaggggcuugaggugcaugucggguggcuggcugaccacccagugggcauagcggcucagcguccagcaggcgauggagc

SEQ ID NO: 4153056 - RNA, 85 nt, Human
gcucugugcugccuggaauggucuucuuccuccucucagucuuugagggagaggcugaacuauccuaacaaggccagcucagggc

SEQ ID NO: 4153057 - RNA, 74 nt, Human
gcucuguguguaugaaauuguucaucuagaauuauuuaucuggaaaaaaagacacuuucaaauaugcacagagc

SEQ ID NO: 4153058 - RNA, 103 nt, Human
gcucuguuucauuccccaggggccuggcaggcgguggcuucaagguccgcagccaccauggccgcccuuuccacgguuucucaucuggggaacccaguagagc

SEQ ID NO: 4153059 - RNA, 71 nt, Human
gcucuguuuuuucaugaguaguuaucuguuuucaugacagguggucacuaacugccaagagagaauccagc

SEQ ID NO: 4153060 - RNA, 84 nt, Human
gcucuuaacccugcaauccacaguguuauuuccaggacugaguuguucuucaggaaggcuuuguagaagugccaggacuugagu

SEQ ID NO: 4153061 - RNA, 75 nt, Human
gcucuuacauuugagguaguuuguuguacaguaauacauaacuaaugcagaaauuaauaccuagaaguagggugc

SEQ ID NO: 4153062 - RNA, 70 nt, Human
gcucuuacuacaugcacaauuaggauauagcuucucuugugagcaaaggcuguuuauugguauuaggagc

SEQ ID NO: 4153063 - RNA, 94 nt, Human
gcucuuagguaagagaggagcaaauguauugcuagugacuuuuuggaggacucccccuccugcgguucaugcucauucuaaauugccugagagu

SEQ ID NO: 4153064 - RNA, 87 nt, Human
gcucuuaguuguauuaaguuuggcauauacuguguaaauacucugugaccaacuaguguuuacagaguaguggaaagcuuaaagagc

SEQ ID NO: 4153065 - RNA, 85 nt, Human
gcucuuaucagaucaugaaggaauuaagguaaggaguaggaaaaauguccauuacaacuaccuuuauugagucguuaauaagagc

SEQ ID NO: 4153066 - RNA, 118 nt, Human
gcucuucaggagggaguacaugggugugugcaggguggcacucacauggaucaggaggaacaugaccagguuccccagcagaguggcuguguacaugcccaggaacaccacgaagagc

SEQ ID NO: 4153067 - RNA, 77 nt, Human
gcucuucaucagacucugcuuguaucacauuugcuaggauacuacaggguauauaggcaaagcuaaaugugaggggc

SEQ ID NO: 4153068 - RNA, 96 nt, Human
gcucuucauucuuucaauuugcagagauaaauuccuaagauuucaggggcuggauacagucuugagaguuagagaaauaucuucaauuagaagagu

SEQ ID NO: 4153069 - RNA, 68 nt, Human
gcucuuccauauuacucaggguaaggaccuaagugguaaugccaauaccucgaagauaacuggagagc

SEQ ID NO: 4153070 - RNA, 61 nt, Human
gcucuuccuguuggccugcuuuuugaucaucuugcugucagaggagaccaaggggaauagc

SEQ ID NO: 4153071 - RNA, 84 nt, Human
gcucuucuuucauaaaagcacuuguauucuauuuaacuccugccauugagaaaagguagcuaaaacaggcuuuugaaagguagc

SEQ ID NO: 4153072 - RNA, 116 nt, Human
gcucuugauagcugcugugauagcuggauuuaggacgcuaucccugccuguggggcuguuugaaccaucuugugggcagccugcuuucugauccagcugugaagcuacccaguugc

SEQ ID NO: 4153073 - RNA, 122 nt, Human
gcucuuggagcaaaucuggcuuacaugcuucugaacgccaaauggcugaaggccaccucucucuacccccuuggcuggcaguuaucuuuggaugacuuggaagaagccacaguucccgcagc

SEQ ID NO: 4153074 - RNA, 56 nt, Human
gcucuuggccgcuaguugcugcuagacacagugcagugcaggagccuggccagagc

SEQ ID NO: 4153075 - RNA, 73 nt, Human
gcucuuggcugaagguggacacuugagucacccacucugauacaaauggggacacaggagcacccagcugagc

SEQ ID NO: 4153076 - RNA, 69 nt, Human
gcucuugucagcggcugcuccgcaggcuggccuugguuagggagccaccuggcaggacgcuggcacagc

SEQ ID NO: 4153077 - RNA, 78 nt, Human
gcucuugugccuuuaagcuucauaucaaaauauggaacauagccugugauuuccaugaagcugaaggcagcuuaaggc

SEQ ID NO: 4153078 - RNA, 84 nt, Human
gcucuuuagcuugugccauaugaaacuaccagugguaaaucauuccugaccaaaaauggcaguuuuauggcucaaccuaauagc

SEQ ID NO: 4153079 - RNA, 126 nt, Human
gcucuuuaguccaucuuaacucagcccucagaguagcugggagccaggugagugagaaagaugagaggcucacaccuguaauccuagcacuuugggagguugaggugggaggaucacuuuaggagu

SEQ ID NO: 4153080 - RNA, 80 nt, Human
gcucuuucccagccuggcgagugggcccuggcaguggcccuuucuuacugucagggaacaauguuauggcuugagagagc

SEQ ID NO: 4153081 - RNA, 58 nt, Human
gcugcaaauacagucaggaauguggcaggaaauuauuucugaaaacacacuuugcagc

SEQ ID NO: 4153082 - RNA, 70 nt, Human
gcugcaaggcuuauuuuccuccuuccugugcaaugauaacagcucugggguuggaaagugaucuaacagu

SEQ ID NO: 4153083 - RNA, 67 nt, Human
gcugcaauagauuaugaucuacagugugaaaagcuuuucacacuguagaucauaaucuauugauggu

SEQ ID NO: 4153084 - RNA, 71 nt, Human
gcugcaaugacuuuccuugcacauugguuuccacucguguggguauaaaugccggagaaauucuuggcagu

SEQ ID NO: 4153085 - RNA, 56 nt, Human
gcugcaccuacucugcccuuuagccggaagcgguaggcuggcuggcagugggcagc

SEQ ID NO: 4153086 - RNA, 58 nt, Human
gcugcagagcaaguucucuguuguuggcaaauaaagccauagcagagaugacuccagc

SEQ ID NO: 4153087 - RNA, 55 nt, Human
gcugcagcuuuaggauccagugaacuuugcgccacuaguaauccugugagccagc

SEQ ID NO: 4153088 - RNA, 63 nt, Human
gcugcaggacugaaagaugaggucaaucugcucaaggacggggcucugcucacagcccgcagc

SEQ ID NO: 4153089 - RNA, 63 nt, Human
gcugcaggagcuggagcugugggccuggggacaaguguccuaacagcccccgcucccugcagc

SEQ ID NO: 4153090 - RNA, 58 nt, Human
gcugcaggcggccgugguggcggccgccgccgccgccgccauuguguccgucugcggc

SEQ ID NO: 4153091 - RNA, 59 nt, Human
gcugcagggcagaagggcauagaugcaugcuaucucaucucaucuucaugcauugcagc

SEQ ID NO: 4153092 - RNA, 73 nt, Human
gcugcaggucagcuaggcagcugugauggccuugggauccauuggcaguuggcuagccugcagugaccucagc

SEQ ID NO: 4153093 - RNA, 79 nt, Human
gcugcagugcuggguacaaccaugucaguucaaaccagauucaauuugguugguuaaugugcccauuucccauugcugc

SEQ ID NO: 4153094 - RNA, 59 nt, Human
gcugcaguugguuauaaaaacgugacggaugauuuagguggcuguauucagcuguaagc

SEQ ID NO: 4153095 - RNA, 63 nt, Human
gcugcauauuuucugauucagaaggucugagguggcauuucugaauuccuaggauguugcggc

SEQ ID NO: 4153096 - RNA, 56 nt, Human
gcugcaugacagacaggccuggucacagcagguuacgaugcacugugucauccggc

SEQ ID NO: 4153097 - RNA, 74 nt, Human
gcugccaaacagggacaaauucccuauuugcaugauauucucaagaaaucccaagggaaacacuguuuaggagc

SEQ ID NO: 4153098 - RNA, 93 nt, Human
gcugccacggagccuccuggcggccaggguagggccugucggcccaguugcccacugccugcuccuggcuccacaaagggcuugcugggcagc

SEQ ID NO: 4153099 - RNA, 71 nt, Human
gcugccagccuaggccaggggugagcacuucugggcaagggccugagcugcccccuggccugcucuggugc

SEQ ID NO: 4153100 - RNA, 60 nt, Human
gcugccagcuuuccuuggcugauguagaugcauucauuccaggccagggagagcugcugc

SEQ ID NO: 4153101 - RNA, 129 nt, Human
gcugccaggcagccucaaagcgggagagcaccugacugccguugaauguuuaccgcgagacagacacaugguaacagauggaacucucaccauacacugaggucacugccauuggcauccccauguugu

SEQ ID NO: 4153102 - RNA, 58 nt, Human
gcugccaggcccuggggcuauggcacugcgugacccugcaaguccuaccuggcgaagc

SEQ ID NO: 4153103 - RNA, 92 nt, Human
gcugccaucugcugacugugagcuagggacuagggaaggagcagacuagaacagaagcugcacuucccgccucuuugcucagcagauagagc

SEQ ID NO: 4153104 - RNA, 62 nt, Human
gcugccauuaugggaacgagaagucugggcagccaguucgaauuccguuuuauaaggcuggc

SEQ ID NO: 4153105 - RNA, 95 nt, Human
gcugcccaggauccugucccucuaggaggcccucacaaucuucccacuugcacaggaccggggcugccuccucgagacaggaucuuaugggcagu

SEQ ID NO: 4153106 - RNA, 57 nt, Human
gcugcccagugugcucaugcaguuagaauguucagagaguaggacacugggccaagc

SEQ ID NO: 4153107 - RNA, 56 nt, Human
gcugcccucuguguuuguccuugccacagucacggggugcaugugcagaggggagc

SEQ ID NO: 4153108 - RNA, 56 nt, Human
gcugcccuguccggcucuccugcaacacaaaacaagggaagggucagucgggcagc

SEQ ID NO: 4153109 - RNA, 74 nt, Human
gcugccguccacuguccccugggaggcguccagagccgucuccaccugggcaacagugccucgacgguccaugc

SEQ ID NO: 4153110 - RNA, 68 nt, Human
gcugccuccuggguucaagcgauucucuggccucaggcuccagaguagcugggacuacaggugcaugc

SEQ ID NO: 4153111 - RNA, 78 nt, Human
gcugccugccaucugcccuggccaugcccguuccgcuaaugaaggauaaacacaaggccaggccagaugacagucagc

SEQ ID NO: 4153112 - RNA, 99 nt, Human
gcugccugggcugauuucucuacugcaugggauaggguggggaggauuaucacacccucucuaaccugcauggcagcuagaagggaggggcaaggcagc

SEQ ID NO: 4153113 - RNA, 86 nt, Human
gcugccuucccaucuccguguuggcucuuggagggaagccgaggcgggaauccaccaugauuuagcacuggcuugggucuggcagu

SEQ ID NO: 4153114 - RNA, 59 nt, Human
gcugccuucccggaaugucaucucccucuuucaccuggagccuucauuuuggaaggugc

SEQ ID NO: 4153115 - RNA, 92 nt, Human
gcugccuuugcucaggcacacaggcucccugggcggacucuaccugcccagucucuucuggcccuguggccuuugaugcacacgguuccggc

SEQ ID NO: 4153116 - RNA, 128 nt, Human
gcugcgagguggccguccacuggagggcgcuggucgggggccugacggccggcgccgcgcugcuggugcugcugcugcuggcgcugggcguccgggcggugcgcuccggaugguggggcggccagcgc

SEQ ID NO: 4153117 - RNA, 78 nt, Human
gcugcgcucagcccugcagugcggagguggcaacagguucccauuuguccuguugcuggcgcugcgggcgcugugggc

SEQ ID NO: 4153118 - RNA, 92 nt, Human
gcugcggcauucguccaccuggcucucgcagcgugugcccguguagccaggagcacaggcacaugagaagcuggcgaugccauccacgcagc

SEQ ID NO: 4153119 - RNA, 68 nt, Human
gcugcgggucucagaggcccucugguccguucagggugaggacagcugagaggccugggcccgugagc

SEQ ID NO: 4153120 - RNA, 57 nt, Human
gcugcuacugagccagaggggguaaagcaacagcguuuucucaguugugugagcagc

SEQ ID NO: 4153121 - RNA, 87 nt, Human
gcugcuagugucucuaaagugguuucuuauccccugcagcaucugccaagguucuguuuggcugaggaucuaugaggcaucugaagc

SEQ ID NO: 4153122 - RNA, 75 nt, Human
gcugcuauggcagugacuugaaggguagaaauuugauuaagaagucaauauuagccucaguucuucauagccagu

SEQ ID NO: 4153123 - RNA, 58 nt, Human
gcugcucucuggcccauugucaguggucaucugccagugacaaugggccagagguggc

SEQ ID NO: 4153124 - RNA, 74 nt, Human
gcugcucugaggucgaagcaccuuguauguuaugugaaaaauauuuccaagcaaagugcuuugccuccagcugc

SEQ ID NO: 4153125 - RNA, 61 nt, Human
gcugcucugcuucugagaggugcucuguuacugcguccuuacuuggcagaacgcagaaggc

SEQ ID NO: 4153126 - RNA, 63 nt, Human
gcugcugcugagagcucagccugaaaccucgcguucagguucauuacuacuucagcaguuugc

SEQ ID NO: 4153127 - RNA, 66 nt, Human
gcugcugcuggcaucauucugaaggguagaagcaggggaccuauaucagaguguguuacagcaagc

SEQ ID NO: 4153128 - RNA, 64 nt, Human
gcugcugcugugccuggcguccugugggacaagagugcaacagggcgcugggcaccuuggcagc

SEQ ID NO: 4153129 - RNA, 57 nt, Human
gcugcuggcaagcccaguuggagcagcacauuuguuagcuggaaacaugccggaagc

SEQ ID NO: 4153130 - RNA, 57 nt, Human
gcugcuggcguucugaccagaggaugccgcauccucuccaugucucacgccacuggc

SEQ ID NO: 4153131 - RNA, 60 nt, Human
gcugcugggcacccccugagcucucaguaaauggagcuauugggguuaugcccgcucagc

SEQ ID NO: 4153132 - RNA, 55 nt, Human
gcugcugggguggagaaacgcugugacccagucaguguuucuuuuaaugagcggc

SEQ ID NO: 4153133 - RNA, 60 nt, Human
gcugcugucagugguggcaguuccuacucuuucucucgaaucucuacugcugacaucagc

SEQ ID NO: 4153134 - RNA, 64 nt, Human
gcugcugucucaugcgaugcggaggugaaguggagucccccgacauugcucauggacuggcagc

SEQ ID NO: 4153135 - RNA, 57 nt, Human
gcugcugucuggucugagggcucaugcucucugugguuugagagccgggcagucagu

SEQ ID NO: 4153136 - RNA, 91 nt, Human
gcugcugugagaggugaaguguugcugugccaccugcuugggaagaccaagcugugucuaaucuuauacaucauuuuucugcucauucagc

SEQ ID NO: 4153137 - RNA, 83 nt, Human
gcccacccagaacagcagggaaauuccaagucaucgguuucuaguucuccccaugcgugugguggcccugcuuuguggugagc

SEQ ID NO: 4153138 - RNA, 95 nt, Human
gcccacccuuuuuccucuacaaauauuugugcugugagcucucccucucccaggccuaaugggagaaagggagagccagcacacgagcucugggc

SEQ ID NO: 4153139 - RNA, 70 nt, Human
gcccaccgcagccgagaccugggagcccgccugggccucacacucccucgggucgcggacugcgcugggu

SEQ ID NO: 4153140 - RNA, 65 nt, Human
gcccaccugcagccagucuaccugguggaaaguugccuucggucugaggcugcaagguggugggc

SEQ ID NO: 4153141 - RNA, 88 nt, Human
gcccacggugauugacagcuggcacacagcagcacccagggcgccacccgcccuccaugagugugcugcugguuuaauugaugugugc

SEQ ID NO: 4153142 - RNA, 97 nt, Human
gcccacuaugcuaauguacaucaguaacuguaaaacagggguucuuuguaaguuccucuuguguauauauaguaacuuauaacaauggcaugugggc

SEQ ID NO: 4153143 - RNA, 67 nt, Human
gcccacuuaggucgggcuucuucugacaguguguaagaccccacugugagcagcgaccugaggaggc

SEQ ID NO: 4153144 - RNA, 55 nt, Human
gcccagacaucaggggcuagauccccucaagaggagguuggaccugugucagggc

SEQ ID NO: 4153145 - RNA, 70 nt, Human
gcccagaccagggucccacagagucucccacuuccuggggauguucugaugccaugggaucccugggggc

SEQ ID NO: 4153146 - RNA, 69 nt, Human
gcccagagcccuaggggagaugcauguccaggcaguugggcccaggacagccuucuggggcuucugggc

SEQ ID NO: 4153147 - RNA, 56 nt, Human
gcccagaguggagggugcagaauggguagcacuuccauuaacacugagcuaugggu

SEQ ID NO: 4153148 - RNA, 65 nt, Human
gcccagaugcuuguuggcuggucuccaucuuuuagcacuggaagaccauauucagcaggcauggc

SEQ ID NO: 4153149 - RNA, 79 nt, Human
gcccagcacugccugagccaccggcagggacaucugaguuagaugacuugcagcuggcuggcuuucagcaggagaaggc

SEQ ID NO: 4153150 - RNA, 60 nt, Human
gcccagccaacaggaagcccagccuuucagaaagagccuggcaaggcccuguugacuagc

SEQ ID NO: 4153151 - RNA, 76 nt, Human
gcccagccgcuccuaagggcuggcacacggcugcaucagagaagacgugaaaagcaacauuguggaccggcugggc

SEQ ID NO: 4153152 - RNA, 62 nt, Human
gcccagccuccaagcuccaaggcccucucccccagucagcaggggagcuugguggcuguggc

SEQ ID NO: 4153153 - RNA, 70 nt, Human
gcccagccuggggucacuugcagccgcacccaccugccggugcgccaugugcucucggcccucgcugggc

SEQ ID NO: 4153154 - RNA, 67 nt, Human
gcccagcgggggacacaucucuugcaggaaggacugaugauugcaaggcuagguucacccacugggc

SEQ ID NO: 4153155 - RNA, 61 nt, Human
gcccagcuccagagccagaaacacuuggauuugaauccugggucugcuacuggagcucugc

SEQ ID NO: 4153156 - RNA, 70 nt, Human
gcccagcugaaauuuuuuaaauuaagaaaucauuuuucguuguuuaagaaaauucauguuguucucuggu

SEQ ID NO: 4153157 - RNA, 69 nt, Human
gcccagcugccuucccgguguauacccuugggauuucuaggcagguccccuggaaggcaccugcuaggc

SEQ ID NO: 4153158 - RNA, 64 nt, Human
gcccagcuucugagcaagccaggggccuggauggaggggcccguggcugugggggaagaggggc

SEQ ID NO: 4153159 - RNA, 63 nt, Human
gcucugcagcuuauuugcugugugaccuuaagcaagucacuacaccucucugagcugcugagu

SEQ ID NO: 4153160 - RNA, 61 nt, Human
gcucugccaaggacccauucucuugauuucagcucaaugaucuugucugccuuggcagggc

SEQ ID NO: 4153161 - RNA, 75 nt, Human
gcucugccauggccuggggaagaccaugggcaaaccucagcgaccaggcugcucauggguccugccccgcggagc

SEQ ID NO: 4153162 - RNA, 56 nt, Human
gcucugcccaaagcuguggcugguuaucugcuggacuaagagcugugggcauuggc

SEQ ID NO: 4153163 - RNA, 61 nt, Human
gcucugcccaaugucccuacaccuggaaaucccaggcagcagaggggugaggcaugggggc

SEQ ID NO: 4153164 - RNA, 68 nt, Human
gcucugccuaggaccuaaaaucuuauaggacauuuccuaaucauaaagaguuuagagucuugcagagu

SEQ ID NO: 4153165 - RNA, 102 nt, Human
gcucugcgcuuccacgaggcuccacuggaccuuucuugaauucuuuccucaagccuuggaggagcugaaauucacaaggauccaaagccccugcugcggagc

SEQ ID NO: 4153166 - RNA, 76 nt, Human
gcucugcucuuucaggcauagaccuugcugguucaguggcaguggcuagaucaugagugagcaucucuuuuagagc

SEQ ID NO: 4153167 - RNA, 69 nt, Human
gcucugcugauccgcagccauccggguucagcccagccuggccagcagcugcgggucaccagccagagc

SEQ ID NO: 4153168 - RNA, 62 nt, Human
gcucugcugggugggcaguuauuuucauggcuugccagcaagcugccccauucaguugaugc

SEQ ID NO: 4153169 - RNA, 75 nt, Human
gcucuggauaaggaguacagccggaggagggucacagagcccucagcucaagccccugugccuuagucuaaaagc

SEQ ID NO: 4153170 - RNA, 127 nt, Human
gcucuggccacagcaaccaaggaaugggaggagggaaguacagaggauggaggcaguuagggccuguguggaaugggcacugaggaggccugucuucccugcccucuucucccugcagcuccagagc

SEQ ID NO: 4153171 - RNA, 62 nt, Human
gcucuggccagacccucaguggggcugcugcccagcacugggcaauucugagccuaagaugc

SEQ ID NO: 4153172 - RNA, 73 nt, Human
gcucuggcucuggcuacuccacccuguuggccaaggggcugaagggcagagcacuggccugcaagggcugagc

SEQ ID NO: 4153173 - RNA, 71 nt, Human
gcucugggccacaucagaugaagacacgcagccuccuguuuagucuucuggauugaucgugguaaagcagc

SEQ ID NO: 4153174 - RNA, 56 nt, Human
gcucugggccauccuggccgggauccacaggcugccccgcccgggagccauugagc

SEQ ID NO: 4153175 - RNA, 60 nt, Human
gcucugggugaacuuggagcaaauaaccagagaaauagcuugucuccaaggccacagagc

SEQ ID NO: 4153176 - RNA, 57 nt, Human
gcucugguagauccucaggcucugaaauaccuagaagcugacugggguccccagagc

SEQ ID NO: 4153177 - RNA, 59 nt, Human
gcucuggugcccuguguggcaggagcucuuuuucaacaauuccaccagggcaccacugu

SEQ ID NO: 4153178 - RNA, 72 nt, Human
gcucugguuaugccuccgaaaccuggagugugagauaaagcacaaaggugugugggugugagaaugcagagc

SEQ ID NO: 4153179 - RNA, 57 nt, Human
gcucugucuuguguuccugaggugccaucuggcacaggacucgacugcagacagcgc

SEQ ID NO: 4153180 - RNA, 129 nt, Human
gcucugugacacaguucaagccgaugagguaugagcagaagaguucucugacugucuggaaagucugauuuccugauacagacaccacucuuuuccccaugccugaauucuagauguguugauagauac

SEQ ID NO: 4153181 - RNA, 67 nt, Human
gcucugugcugaagugaaauucaucaauaauggccuauuuuguuggucuuuucaguuagcacuuggc

SEQ ID NO: 4153182 - RNA, 58 nt, Human
gcucuguggcugaguuccuuauguuuuaauuaagcagggcuccugaaagccgcguggc

SEQ ID NO: 4153183 - RNA, 88 nt, Human
gcucuuauaaauaacucauuugcauuuuuccugucuuccaacauaagaaugaggauucaaagaccaacaaaugaaagucuaugggggu

SEQ ID NO: 4153184 - RNA, 76 nt, Human
gcucuuaucucuuucuauuucuuaaggcaaugcugcuauaaaugccuggauuaggagugugaagaccugauauagc

SEQ ID NO: 4153185 - RNA, 60 nt, Human
gcucuucagauggccaguuguccccuucaggauccugggaugggaccauguacgucuagc

SEQ ID NO: 4153186 - RNA, 78 nt, Human
gcucuucaugcaauauauaggaacaacuuaggguuguaaugcagugccugggaguuccuuuauaucacauuuaguugc

SEQ ID NO: 4153187 - RNA, 57 nt, Human
gcucuuccauuucucuugaacuucuggagcaggagagucacaucaugggauuugagc

SEQ ID NO: 4153188 - RNA, 85 nt, Human
gcucuuccccacaggggcuaccuggccagaggcugcugggucaggcagugcucaccugucaggucaaggaggcccagggaggugu

SEQ ID NO: 4153189 - RNA, 58 nt, Human
gcucuuccuggccucuuccaccaccagucaagcuggugcaggaguuggcagggacagc

SEQ ID NO: 4153190 - RNA, 60 nt, Human
gcucuucuaaagaauguacaggucuucgauguucuauggccuggguacauccugaggggc

SEQ ID NO: 4153191 - RNA, 56 nt, Human
gcucuucucagauuguacacucucagaaccugauggagaagugacuuggaaagagc

SEQ ID NO: 4153192 - RNA, 86 nt, Human
gcucuucucuccaaggccagcuggagggaugaggcaugacaaguccaucccuacagcuggcacuuccccuacagcugagagggggc

SEQ ID NO: 4153193 - RNA, 74 nt, Human
gcucuucugagauaaauaggucacaguucucuauugggagaacauuugucgaucaauuuguauaacaguagggc

SEQ ID NO: 4153194 - RNA, 90 nt, Human
gcucuucuuuucagauuucuuugcuuguguuuuuagccucuaucacuucauaguuucaaaauuuggcaaauaauuugagggugaagcagc

SEQ ID NO: 4153195 - RNA, 59 nt, Human
gcucuuggucucagccucugaaauagcugccugcugacucauaguguaaacacaggggu

SEQ ID NO: 4153196 - RNA, 95 nt, Human
gcucuuuaacauggcauuaugggguuaaauuucuccuagcacaaauucugggucagauugagccccuggugauugucucuuuccaguugguaggc

SEQ ID NO: 4153197 - RNA, 67 nt, Human
gcucuuuaguccaagccaugucugccucuuuccccgacccagcucagggccauggaccagcagcagc

SEQ ID NO: 4153198 - RNA, 81 nt, Human
gcucuuuauuuuaucuucaacuuggcaaacauuuauuaagcccaggacccuuguuugucaaugaagauaugaauaaugugu

SEQ ID NO: 4153199 - RNA, 80 nt, Human
gcucuuucucucagucucuuagaaucgcauauugucaggcauugucacacaugugauucuaagacagcgagagaaagagc

SEQ ID NO: 4153200 - RNA, 65 nt, Human
gcugaaagagugguggccguggugucacgagaagacuuggaaucgcagcugugccacuuaguagc

SEQ ID NO: 4153201 - RNA, 75 nt, Human
gcugaaaggaagaaguauuuuuguccuguuguaauuuuuauucaaaagggacucaaaauacuuuucaaauucagc

SEQ ID NO: 4153202 - RNA, 88 nt, Human
gcugaaaucuggcuuuucaaagggagaguauccagaaacagaagaugcugcucugagaggcucuuccuaauagaacugcugcuucagu

SEQ ID NO: 4153203 - RNA, 73 nt, Human
gcugaacaguggugccuugcuccagugccucugaagggcuuggaaauugcaggacacagcuuuacugcucagc

SEQ ID NO: 4153204 - RNA, 68 nt, Human
gcugaacuguuucuggugaaagaguagccuuccuucgcgggcacugacacugagggaagcagcucagu

SEQ ID NO: 4153205 - RNA, 86 nt, Human
gcugaagaggccuguuucucagugaguagaaaggcuggaaagguucuuuccagcucuuguugcccacugcccaguucuucuucagu

SEQ ID NO: 4153206 - RNA, 68 nt, Human
gcugaagcagauccagguguggcagggcgugacauuuggcccaggucagugucuggauccugcucagu

SEQ ID NO: 4153207 - RNA, 57 nt, Human
gcugaaggauuuaguucuuugcuuacuuaaagaaagguagcugaacaaucuuucagu

SEQ ID NO: 4153208 - RNA, 71 nt, Human
gcugaagggucaauuucuaagggcaguuuucuccaacuuaauucuguccaccuuugauaggcucucucagc

SEQ ID NO: 4153209 - RNA, 55 nt, Human
gcugaauaagagucuacuuugcuaguagauuugcucuagagacucauugcucagu

SEQ ID NO: 4153210 - RNA, 64 nt, Human
gcugaauccuuguuccaaacuccaguccccaggaaagccaaggaugugggguugagggaccagc

SEQ ID NO: 4153211 - RNA, 80 nt, Human
gcugaaugaccuagguucuaaaagaagcaaguucauaggcaaacuugcuugugaguugcucuuuugcuacuguggucagc

SEQ ID NO: 4153212 - RNA, 65 nt, Human
gcugaauggcgguuugggaagggcuuucugacauuugcagaggcccaggguacaggccgcucagc

SEQ ID NO: 4153213 - RNA, 90 nt, Human
gcugaaugggcuuggaaaugcuccccacccaguccuggaaggcauguccaccaacgucuuccuggaggggacagcaugggcccaacaagc

SEQ ID NO: 4153214 - RNA, 59 nt, Human
gcugacaauugaacagucuggaagggacaggaguuugugccaggcuggcaaaugggggc

SEQ ID NO: 4153215 - RNA, 76 nt, Human
gcugacaccacaaacagaguugaaaaauaggggucucaugugcaucccuuuuguccugcuugguuucggugugggu

SEQ ID NO: 4153216 - RNA, 129 nt, Human
gcugacaggggaugacacaaggugggcagagguaugggcauggugcugugguguucccugugaacagugucucaacaauggcccuaucaccuuugcuucuggcuggccugcgccacuuccucuguuucc

SEQ ID NO: 4153217 - RNA, 59 nt, Human
gccgucaaagugucuugugcucaucuaucuccaguacaaguacuguggcuuugaauggc

SEQ ID NO: 4153218 - RNA, 59 nt, Human
gccgucagugcauuuuuaagguauuucgagauguucauuauaccaaauugcauuauggc

SEQ ID NO: 4153219 - RNA, 62 nt, Human
gccguccuggaaagcaccgucuguuguucauucaauugcauccgggcuacuuccacaccggc

SEQ ID NO: 4153220 - RNA, 60 nt, Human
gccguccuggacugggugaggcacaugugcagguaugugcagcuaguccuggacuugggc

SEQ ID NO: 4153221 - RNA, 111 nt, Human
gccguguacagggagguugcuuggaauacuuuuguuaggaaaacgcacuuuuuguaguuggagccuguuuuuguaccuggcuuaaagugaugccucccagugaauacuugc

SEQ ID NO: 4153222 - RNA, 69 nt, Human
gccgugugugucugugugugugugugugugugugcacgcacaugcacccauguacauacacaugugugc

SEQ ID NO: 4153223 - RNA, 55 nt, Human
gccguuauucugcuggccccgggagcauucccauggaucaugcacgggagcaggc

SEQ ID NO: 4153224 - RNA, 103 nt, Human
gccuacaaggacacaucauugucacccaaauuucauaguugauguucgguuucacuguuggugcuguacauucuguggguuuggacauguguccuccuauagc

SEQ ID NO: 4153225 - RNA, 71 nt, Human
gccuaccagaauagaaugaaagaaggguuuauuugauccuguguucaagucauucauuuauuccacuaggc

SEQ ID NO: 4153226 - RNA, 76 nt, Human
gccuaccgcugcacugugggagccccuuucugggcuggccaaggccagagccggcucccucagcuugcggggaggu

SEQ ID NO: 4153227 - RNA, 56 nt, Human
gccuagacuuggagagguggaaggaacauuucguuuuuagggaccaggucauaggc

SEQ ID NO: 4153228 - RNA, 58 nt, Human
gccuagagcuauucaagguuuuauggaagauucuauagaccuacacuauagcuucugc

SEQ ID NO: 4153229 - RNA, 59 nt, Human
gccuagaugugguccaauuggcuaucuacgcuaauauaauccugcuucacauugaaggc

SEQ ID NO: 4153230 - RNA, 76 nt, Human
gccuagauguuacuuaaaauuauggcccauuuggauaaaauaucucaaaugacaacgugaucuuagagcagcaggc

SEQ ID NO: 4153231 - RNA, 57 nt, Human
gccuagcaaaugagaggagaaaauaagaugaucggcucuuccugacauaugcaaggc

SEQ ID NO: 4153232 - RNA, 122 nt, Human
gccuagccugggagugcuguaucccucuuucucccucugaggcuccaugcaggcuuuguugggcaacaaugaagccugcugccuguggcgggggaagcagggagggugagucuaggcaaggc

SEQ ID NO: 4153233 - RNA, 58 nt, Human
gccuaggaagcugagauugcagugagccaugaucaugacacugcccuccagccugggc

SEQ ID NO: 4153234 - RNA, 55 nt, Human
gccuagggguacagucugccuuuacagugaucacugugagaagguuuccgugggu

SEQ ID NO: 4153235 - RNA, 68 nt, Human
gcuccagcucccugucucugggguccaugccugucauggccaaagccacagcagaggaaugcucgggc

SEQ ID NO: 4153236 - RNA, 67 nt, Human
gcuccaggaggugcaccaguugugagguuuuggaaaagaucucaugcuguagugcacuaacuggagu

SEQ ID NO: 4153237 - RNA, 63 nt, Human
gcuccaggccacggcuucuuggacuuggagaccccaccugggagccuagagggccuauggagu

SEQ ID NO: 4153238 - RNA, 73 nt, Human
gcuccaggcucugggccgggcaccagccucugggaaaauggagggggugguggugagggcucggacaaggagc

SEQ ID NO: 4153239 - RNA, 57 nt, Human
gcuccaggguggaugacaauucccuaggcucccguccuggcugugccaccuuggagc

SEQ ID NO: 4153240 - RNA, 63 nt, Human
gcuccaugcuccauauggauauucuuuggaaacaaagcauuuuugaaaugguaggauuggggc

SEQ ID NO: 4153241 - RNA, 70 nt, Human
gcucccacugugggguuuggcuggaaccucaacugcagguuuggguacaggcuucaggugccuggggagc

SEQ ID NO: 4153242 - RNA, 75 nt, Human
gcucccacuguucuggcaccaucuguuguuuucagauguccugauagcucaagaauguguuuuaacaugggaagu

SEQ ID NO: 4153243 - RNA, 55 nt, Human
gcucccagcuggagccucaacagagguugugccugcuuggggugcagcugggggu

SEQ ID NO: 4153244 - RNA, 106 nt, Human
gcucccauugcugaggguucagaaaccaggcaguggaagcuaaaauuucaggggaaaucgggcggaacuauugcagaugguuucccccuugaauagagaugggggu

SEQ ID NO: 4153245 - RNA, 61 nt, Human
gcuccccaccuggaagccugcagacucgccgagcugagagaaucaugcugcaggugggggc

SEQ ID NO: 4153246 - RNA, 75 nt, Human
gcuccccauuauacucccacaucacugacuuuuguagauuaucugaucagucagaugaugugaggaguggguggu

SEQ ID NO: 4153247 - RNA, 76 nt, Human
gcuccccuugguccuccugggaaccagggugccccuuaguggugguggcccaggagaacccgaccaaggcaggagc

SEQ ID NO: 4153248 - RNA, 58 nt, Human
gcucccgugaaggcuguagaagaugaucugugucuugucucuuccagcaucugggggc

SEQ ID NO: 4153249 - RNA, 60 nt, Human
gcucccucccaccagccugcagguggggugccugugauuaggagagggcgguagaggagu

SEQ ID NO: 4153250 - RNA, 56 nt, Human
gcucccugaaaagaacaaaguccacauuauuguuacuuguuuugguuuuagggggc

SEQ ID NO: 4153251 - RNA, 55 nt, Human
gcucccugaagagauuuggucuuuauagguuugacauucagaucuuugcgggggu

SEQ ID NO: 4153252 - RNA, 60 nt, Human
gcucccugugcucugagugauaaucucuagagauguuuauaagaaguugcauaggguagc

SEQ ID NO: 4153253 - RNA, 79 nt, Human
gcucccugugguugggagaucuuuaggaguuggacuaucuuaaagauagacuaucuuaaaguuuucugaucauuugagc

SEQ ID NO: 4153254 - RNA, 109 nt, Human
gcucccuuacaucucccuggacuguucagggccugacaggcuuucuucucauuccuagucgucacucuggccucugcagcaguuccuuagauagauggauguuuggagu

SEQ ID NO: 4153255 - RNA, 59 nt, Human
gcuccguuucucggucacggaugagacagguggccugaggcugugggcggaggaggggc

SEQ ID NO: 4153256 - RNA, 65 nt, Human
gcuccuaauuccugugccucaggucucagccuuaguugugguucagccucaggacaggauggagc

SEQ ID NO: 4153257 - RNA, 55 nt, Human
gcuccuaccaugacacugccaggcaugggaugagcaggcagucacggucaggagc

SEQ ID NO: 4153258 - RNA, 65 nt, Human
gcuccucacacccacugcaaccaugguggcugccugugguucuuguguugugugaggauauuugc

SEQ ID NO: 4153259 - RNA, 56 nt, Human
gcuccucaccagcagccucaccuuccucugguggaaaugagaaggcaguggggagc

SEQ ID NO: 4153260 - RNA, 116 nt, Human
gcuccucaucuuaagauccacugauuugggaacuuaauuaugucugcaaaaucucuucacagcaguaccuagguuaguuucugugaauaacuagaggaugugaguauaccaggggc

SEQ ID NO: 4153261 - RNA, 80 nt, Human
gcuccucccauggccaguggucagugggagggugugcccugcgccugucugcauggccacugggcauguguguugggagc

SEQ ID NO: 4153262 - RNA, 78 nt, Human
gcuccucccuugcaggcagggccuccuggagccuugugcucauccugggcucugaggccccagcccugcacagagagc

SEQ ID NO: 4153263 - RNA, 58 nt, Human
gcuccucucugucugcugucuauagaaggaggcuaauagcagcagaucuggugagggc

SEQ ID NO: 4153264 - RNA, 55 nt, Human
gcuccucuugagagcuggauccacugcuaaugcagcuuuacucuccaaggugagu

SEQ ID NO: 4153265 - RNA, 73 nt, Human
gcuccugcccuuggaucuccaguuccccucagccuccaggugggccaacaggaggucuaggaauaguaggagc

SEQ ID NO: 4153266 - RNA, 112 nt, Human
gcuccugcugcccuccugcucagcagaggcccccuccacccauucuggggagucagaauccucaucuggguccucagggggcugcaacagucggggggcaggcucuagaggc

SEQ ID NO: 4153267 - RNA, 60 nt, Human
gcuccuggcucagaugcuaaauugucaccaguaacagggagcuauuaggguuagugaagc

SEQ ID NO: 4153268 - RNA, 121 nt, Human
gcuccugggaagacaaugccagcugugcgcugaaagucugugcaagcugcucccgugaaaaggaggacauuggcauggcagggcugugggcaggucuuaguggcuggacauucccaggagu

SEQ ID NO: 4153269 - RNA, 57 nt, Human
gcuccugggcucuaccuugcuacugacaucaggcagucaaaacagaguccuaggagu

SEQ ID NO: 4153270 - RNA, 75 nt, Human
gcuccugguauuuccuggaccaacugagauugggucaaaugaauaugauaggguauguccaagaaacacaggagc

SEQ ID NO: 4153271 - RNA, 61 nt, Human
gcuccuggugcuguagagauuuccggcgcacagaggcccccauucccugccaccaggaagc

SEQ ID NO: 4153272 - RNA, 63 nt, Human
gcuccuguaaauaacuuucauuuuuuaauaugcuuacagaaagaagguguauuugaguggagc

SEQ ID NO: 4153273 - RNA, 84 nt, Human
gcuccuguguagucaaagacagaugaccucgcuugaggauuuuauagcucuuggugguuuuagaugccuuuacugcauaugagc

SEQ ID NO: 4153274 - RNA, 68 nt, Human
gcuccuuaacagcaagaucugugucagcccuucuuuguggcucccacagugccuuguucuuauuaagu

SEQ ID NO: 4153275 - RNA, 87 nt, Human
gcuccuuagaacuccugcucuuuauuuucugguaucccaauugaacagacuggugggagcuggagaguacagaguuuauuaagcugc

SEQ ID NO: 4153276 - RNA, 68 nt, Human
gcuccuuagcuagcugcacaggcccugggcacuccugucacuguugcagccagcuuugcggaaggagc

SEQ ID NO: 4153277 - RNA, 62 nt, Human
gcuccuuaugguccugacccuacaguuccugucccaugaccagggccagaucaccaaggagc

SEQ ID NO: 4153278 - RNA, 105 nt, Human
gcugacauaugccaauuauauucagcaauauuguucccccagccuguugggucacguaacagccugagagaacaaugaugcugaauuaacgauugcaaugaaagc

SEQ ID NO: 4153279 - RNA, 88 nt, Human
gcugacauuaaggcuuuguagugauugcuucauuaaagguuaaggauuuccuaaucagcuaaaguauuacuagaaagcuguuguuugc

SEQ ID NO: 4153280 - RNA, 57 nt, Human
gcugaccacaggugggcuugcucacaaggcuguggucugcagguggauguggucagc

SEQ ID NO: 4153281 - RNA, 60 nt, Human
gcugaccagaggcaggucugggccuaaaggaggucauuucuggccuugcucuguggcagc

SEQ ID NO: 4153282 - RNA, 57 nt, Human
gcugaccagcuuaauucccuaucauaacagaugaagcaagauagaaagcugcucagc

SEQ ID NO: 4153283 - RNA, 58 nt, Human
gcugaccagugaugagccauuuaggugaacucucugaacaggcuaaguauuugguagc

SEQ ID NO: 4153284 - RNA, 78 nt, Human
gcugacccugacugucucuucucccaugagccuuucagagccaaaccagcugugggagaugugcggcagcuggucagc

SEQ ID NO: 4153285 - RNA, 110 nt, Human
gcugacguuuuauacacuuuugcagaugaaccucuuugugaaugucaugagcaguuaucagucuaucaugcagaguagaaagggcaaagcugaacuguaagggcgucagc

SEQ ID NO: 4153286 - RNA, 73 nt, Human
gcugacuaacacaucauggccagaggcucgcaggaaccuaaaccuguguuuccucuagaagccaugguucagc

SEQ ID NO: 4153287 - RNA, 86 nt, Human
gcugacuaggccaagguuagaaaagguacuuuccagaaguucaccaucccaggcagacucaaggugccuggcuuugccuucucagc

SEQ ID NO: 4153288 - RNA, 56 nt, Human
gcugacucaugccuggccagagcugagugugaccagcgcgcccaggcugggugagc

SEQ ID NO: 4153289 - RNA, 78 nt, Human
gcugacuccaacagagcccagguuuuaccacgugagcuucaaaugaggaaugaggccuggacucugcauggaaaaagc

SEQ ID NO: 4153290 - RNA, 68 nt, Human
gcugacucuccugagauggggaguuuccugaaucucaaacaucaagauuccccgcugggugagucagc

SEQ ID NO: 4153291 - RNA, 92 nt, Human
gcugacugggaggaagcaaaguggauauucaaauaggacauccagguagaaugaccaucuuguccugggaaaucccuuaggccugagucagc

SEQ ID NO: 4153292 - RNA, 76 nt, Human
gcugacuuucauuggcuuccaagauccgauuguuacauauucagaauuuuggggagcuaauuuuugaugugucggu

SEQ ID NO: 4153293 - RNA, 64 nt, Human
gcugagaacacagguucuagaaucagaaagaccuggaguuuggacuaucuguguggcuuugagc

SEQ ID NO: 4153294 - RNA, 55 nt, Human
gcugagaacacugaagguucauuuggcugagaaaccuuuuuguucuguucucagc

SEQ ID NO: 4153295 - RNA, 90 nt, Human
gcugagaagauaugcuguugaguaucuuuguuauuggaauaauuguuuuuugguauacaaauauuuagcacaaaaaauauuuucucuagc

SEQ ID NO: 4153296 - RNA, 85 nt, Human
gcugagagaaagaacuaaugugcaagguuucugaaucuggauuuaaaaagaaucugagacauuguaauguuggucugaguuuagc

SEQ ID NO: 4153297 - RNA, 61 nt, Human
gcugagagcaguguggccuuaaauaauauuccuuagcugagaaauaccacuagcucucugc

SEQ ID NO: 4153298 - RNA, 62 nt, Human
gcugagaucuguuccuguagaguccaagucuuagauggaggcuugagcuggaacagcuuggu

SEQ ID NO: 4153299 - RNA, 64 nt, Human
gcugagaugucuguaauucuaagcaugugucacauggaucuuuacuuacagacacuuccauagc

SEQ ID NO: 4153300 - RNA, 113 nt, Human
gcugagauugucucuagguccucccuucugccagcugguguccagggaaguggguccucuggccugcuuccugccagccagaauuucgaggaccuuguuucucccacugcagc

SEQ ID NO: 4153301 - RNA, 65 nt, Human
gcugagcagcguggggagcuggccauuaaggaugccaacgccaagcuguccgagcuggaggcggc

SEQ ID NO: 4153302 - RNA, 60 nt, Human
gcugagcaggguggggaaaggcgagaggcaaucugguuccuuaaaugcccaacuguucgc

SEQ ID NO: 4153303 - RNA, 61 nt, Human
gcugagcauguucccaggaauguauuaaggauuuuaauuuacaugucuggucauuuuuagc

SEQ ID NO: 4153304 - RNA, 63 nt, Human
gcugagccugugacccagggcccaggagcaccagccaccuuccuguucccgucgcagcuccgc

SEQ ID NO: 4153305 - RNA, 57 nt, Human
gcugagcuaauuagaaguggccagccagcaguuagucaauaaauagcuuggcucagc

SEQ ID NO: 4153306 - RNA, 73 nt, Human
gcugagcucucuggcugaucucaaucauggcuuuaaacauuccugaaugccugucugcagcccagagcucugu

SEQ ID NO: 4153307 - RNA, 72 nt, Human
gcugagcuucuccaacuguccuccccacaugugcccaauaugcagcgggaaggcagugggaggaacugcagc

SEQ ID NO: 4153308 - RNA, 84 nt, Human
gcugaggaagggcaucacgucugucugcaggguuuuacuguauggauccuguguaaauagaucugguuguacuucauuugcagc

SEQ ID NO: 4153309 - RNA, 61 nt, Human
gcugaggaugaacgcuuacaagcugccugucucuuugcuuuuagcugcaaguguucacagc

SEQ ID NO: 4153310 - RNA, 63 nt, Human
gcugaggccucaggaaugucguguguccuccuggaaccugcuccgagaucugggggccccagu

SEQ ID NO: 4153311 - RNA, 91 nt, Human
gcugaggcuagaagggcucauaggugagguacaaucagcuagucccaagacuccaguuaccuuggcugagggcccagggcuugcuucaugc

SEQ ID NO: 4153312 - RNA, 81 nt, Human
ggaaguggagcaaauggauggaaagcaauuuuuggaagaugaauuuccaaaaguauuggccaccauuucugcaccucuucu

SEQ ID NO: 4153313 - RNA, 71 nt, Human
ggaaguuagagaaugaacaaaugugguggagagugcugauucugcucugcaagauaauguuacgugcuucc

SEQ ID NO: 4153314 - RNA, 80 nt, Human
ggaaguuauuuggcucugguucuggcuccagaaaucuacccaugauaaagaugggcaagaaccacggccuuuugauuucc

SEQ ID NO: 4153315 - RNA, 75 nt, Human
ggaaguuuauaauuuuuugcuuuugugaauaguuugcuaaauaauuuaugaugcaaagaaaagguggugacuucc

SEQ ID NO: 4153316 - RNA, 76 nt, Human
ggaaguuuguuagaaaugcagaaugcuggacccaaccugaccuacugaauuagcaucugcauuuguaacuaguucc

SEQ ID NO: 4153317 - RNA, 58 nt, Human
ggaauaaaaggagguggcgagaacguucuugccuaaaccauuccccuuccuuuguucc

SEQ ID NO: 4153318 - RNA, 70 nt, Human
ggaauaaaccugguggaacggugaauacucagaauguguaggcugguuguacacaggaccauuuuguuuc

SEQ ID NO: 4153319 - RNA, 90 nt, Human
ggaauaaaggcuuccuagguaacaaacuucugacuuaagcagguuuugcugaaaacuuaagcagguuuugcugaaaaggaagcagauucc

SEQ ID NO: 4153320 - RNA, 75 nt, Human
ggaauagaggcuuuagacauaaaguucuucaucuguagcaauauuuugacuaucuuuaugcuggaaucuuuaucc

SEQ ID NO: 4153321 - RNA, 64 nt, Human
ggaauagaugggggauaaauuguauguccuuauaaaaauaauuugggugucugucaucaguucc

SEQ ID NO: 4153322 - RNA, 84 nt, Human
ggaauagauuuauuugacagcuuagugaaaauguaaauacacaauuguuuugcauuuuagauuuaggccuugguaggcuguuuc

SEQ ID NO: 4153323 - RNA, 58 nt, Human
ggaauagggagagaaucguuugccccaaagaaagcaucaaacccucuuuuccuguuuc

SEQ ID NO: 4153324 - RNA, 75 nt, Human
ggaauaguucaguauuugaaaccauaggcaaaagguagggucaguuggcuauuaacgugaaaacugagcuaauuc

SEQ ID NO: 4153325 - RNA, 78 nt, Human
ggaauauaaagguauaggacaaggauagagacuaaacauuucuuugguuucauguuuccucuugugcugcuguauucc

SEQ ID NO: 4153326 - RNA, 121 nt, Human
ggaaucaucaggagagucuugaaaauacuggugccugaguuuaacccucagagacucugauuuaauugguuuuugguauggcuuaugcaucagaauuuuuaaaaguuccccaaauuauucu

SEQ ID NO: 4153327 - RNA, 68 nt, Human
ggaauccaaggaugugacucagucagcuacaguaauguggccaguacugcacguucccaauggguucc

SEQ ID NO: 4153328 - RNA, 130 nt, Human
ggaauccuaugugcgguaaaaacacucagaacccagcagcagugcuuuggaauccugugugagcgacaaggacucaggaauucauagcauuguucuggaauuccauguaagaggcacacacugagaaccc

SEQ ID NO: 4153329 - RNA, 75 nt, Human
ggaaucugaguccuguugucccagaugggguuugaauuccccaugccuucugacucacagguauucuaagauucu

SEQ ID NO: 4153330 - RNA, 81 nt, Human
ggaaucuggcugaauuccugaaugccugacauuucacugggagaacuccaguggaugguguguucauuuuccagauaaucc

SEQ ID NO: 4153331 - RNA, 65 nt, Human
ggaaucuuaauggcauggaguuucaagcuagaaggcaauucugauuuccaagccauuuugguucc

SEQ ID NO: 4153332 - RNA, 76 nt, Human
ggaaucuucuuaagugagcuugaauaaucuuauucagugagaagauaaguucaacucauuuagcugaaguuauucc

SEQ ID NO: 4153333 - RNA, 79 nt, Human
ggaaugaauaagcacuuagcaagauccuucccuggcgugagugacuuuacgcaagugguuuuucuauguucuucauucu

SEQ ID NO: 4153334 - RNA, 91 nt, Human
ggaaugagaagucaucaaagugcuaauugaccauuugauauagcuuuugcuaugguacaauguguuuguuaggugagagaauucuuauucc

SEQ ID NO: 4153335 - RNA, 56 nt, Human
ggaaugagaguguguauuacugucauccauaaaugaguaguacacacucuaauucc

SEQ ID NO: 4153336 - RNA, 62 nt, Human
ggaaugagaugcuucucacugauuucaugaaacaccaucuucucaaagacaagcucucaucc

SEQ ID NO: 4153337 - RNA, 74 nt, Human
ggaaugagcaugcaccgagccacuguggcuucucccaccacacggcccagcugcagagguuugugcaacauucc

SEQ ID NO: 4153338 - RNA, 76 nt, Human
ggaaugauccgagggaggaaaaaugugggggucaaaagaaaaguaacagccuccuacauuccaccuuggacuuucc

SEQ ID NO: 4153339 - RNA, 93 nt, Human
ggaaugauucacucagaccagagccagagaggugccugcccugggccccaugaggcugcgguuccacucuggcccuccucugaccaucacucc

SEQ ID NO: 4153340 - RNA, 130 nt, Human
ggaauggaaauugauggauaaacacccuagauccucacucuuuggugggaugauucugagauauguucugcaguccucagagggucuccuccagaaugaacucaaguuauccauauucaaugaacauucu

SEQ ID NO: 4153341 - RNA, 63 nt, Human
ggaaugggagcuaaguccuggaggcacaugagggccuaagagauuauugcuccugcaaauuuc

SEQ ID NO: 4153342 - RNA, 82 nt, Human
ggaauggguuuguuagcacaggagucucuguuauaaaagugagcucuuucauauaugcagucucuugcccuucuacccuucc

SEQ ID NO: 4153343 - RNA, 68 nt, Human
ggaaugugaauuuauuuggaauaagaguuuuuugcagacaaguuaaggcucuccaaaugauauaaucc

SEQ ID NO: 4153344 - RNA, 82 nt, Human
ggaaugugagcagacaugauguaagcagaggccuuaaaugugcauaauuugcuuuucuugucaucuugucuucuuaugcucc

SEQ ID NO: 4153345 - RNA, 129 nt, Human
ggaauguuucaaauguauuggauaaaaacuuaguuaggcugacauuuguuaaguucuuggccugauuaaacauagcagcugucaguuucacauaaggagaaaugaacauugaauauauuugaaacugcc

SEQ ID NO: 4153346 - RNA, 80 nt, Human
ggaauuagugcaggcacugcagauuacaggcgcaguuacuggugagauugcgcucacuucagaugccaacuguaaguucc

SEQ ID NO: 4153347 - RNA, 57 nt, Human
ggaauuccauaguacagugaugaguguuacauacuuauaagagugcuauggggaucu

SEQ ID NO: 4153348 - RNA, 72 nt, Human
ggaauucuaguuaaaaauacagauucuugggcucuaccucagaccuacagagaucugcauuuuucuuauucc

SEQ ID NO: 4153349 - RNA, 67 nt, Human
ggaauucugcaaaauguuuaaggccuauucauuccauguguaucucucccuucauuuguagaguucc

SEQ ID NO: 4153350 - RNA, 61 nt, Human
ggaauugucuaguacucacggccacuaugacucuaaggugauaugaguucauuagacuucc

SEQ ID NO: 4153351 - RNA, 109 nt, Human
ggaauuucacuugaaaaagauaaaagauuucauaguaguaauagaauguuggcuaaguagcuaauuauugcauacuuaaauuuccggucuuuaaagugacaaaaauucu

SEQ ID NO: 4153352 - RNA, 80 nt, Human
ggaauuucagggguaauaugucagccagauaaaggcaaaaaagcaugccagugucuacuguggcauaucagcuccugucc

SEQ ID NO: 4153353 - RNA, 103 nt, Human
ggaauuucaucagggauggauggagacuggugaggauguucccuggggccuccuagaaagauuaggggaaaucucucgccaucuggccccaugcugaugcucc

SEQ ID NO: 4153354 - RNA, 66 nt, Human
ggaauuuuucuggaagcaauuauacuagaaacucacuauauaauuuucuugccagagaaacaagcc

SEQ ID NO: 4153355 - RNA, 62 nt, Human
ggacaaagguagacagucucugcagggcucuaaaaacuccuuuagaagaggcccugccuucc

SEQ ID NO: 4153356 - RNA, 62 nt, Human
ggacaacugucuucuucaugcuccaccauuauugcacaggugaggacagaauuugguugucc

SEQ ID NO: 4153357 - RNA, 75 nt, Human
ggacaagaugauacagccuaguuugagucccaucugagacacgguagugggauucaccaugggcuucagaagucc

SEQ ID NO: 4153358 - RNA, 112 nt, Human
ggacaaugcaaugugacucagaaaaucuguuuauucauccuguuucaccaauuccuaguugggugucauggggaaaauaacagacuucucaggaguuaaguuuucuuugucc

SEQ ID NO: 4153359 - RNA, 78 nt, Human
ggacaauggaacauacucuggcagccuggaaucucucagccuucccaggauggguucucgguugccugcuccacugcc

SEQ ID NO: 4153360 - RNA, 75 nt, Human
gcuggagcagagggcauggccauuuaagcuuuuggucaacacagugugaugggccugccugaaggcuguaccagu

SEQ ID NO: 4153361 - RNA, 72 nt, Human
gcuggagccuucugcucuguugaagaguggacccccucaagggacugugaaggcagagcuggggccuccagc

SEQ ID NO: 4153362 - RNA, 62 nt, Human
gcuggagcggguucgggccgcugcuccugcagcagacccugugccucagcaccgccugcagc

SEQ ID NO: 4153363 - RNA, 64 nt, Human
gcuggaggaauaauggcaucuuguacacuuugcaccuguauuaaguagcccuauauugcucugc

SEQ ID NO: 4153364 - RNA, 117 nt, Human
gcuggaggcuacaaaaacuggcuucucaaaguucuauugcacacaaauaauuacuucaagaaacaaaugaaguguuauuuauuggcaguaggaccuggauccuuggugaucaccagu

SEQ ID NO: 4153365 - RNA, 75 nt, Human
gcuggaggguagggacagaggagaagaugcugugggucgaggcccagggcucugcuucugccaugacucugcagc

SEQ ID NO: 4153366 - RNA, 57 nt, Human
gcuggagucccugccuuuccuuuuguuccagugguggaggugggcaggaccuguagc

SEQ ID NO: 4153367 - RNA, 130 nt, Human
gcuggagugcaguagcuauucacagacacuaccacaguacacugcaguccugagcuccugggcugaagccauccuucugccucagccuccagaggaacugggacuacaggcaugcgcuaccauacccagc

SEQ ID NO: 4153368 - RNA, 59 nt, Human
gcuggaguggcagaacuggggguccuggggcccagggcucaccacugugcacucccagc

SEQ ID NO: 4153369 - RNA, 115 nt, Human
gcuggauaauuugauuuuguacuccugaaauuuguuuuaauucugauuaagccuaacuugcgaucucaccagaaaggauuaguuugguauaaguuaaauuaauuucuuuuccagc

SEQ ID NO: 4153370 - RNA, 79 nt, Human
gcuggauggagugcaguggcgugaucucggcucacugcaagcuccgccucccggguucacgccauucuccugccucagc

SEQ ID NO: 4153371 - RNA, 116 nt, Human
gcuggauggcucaaacagaauuuggagauuagccauggacugaauugacugcuguuaagucacaauuagcauaggcugucugucuuuucaauuggucuggauaaugcagaaccggc

SEQ ID NO: 4153372 - RNA, 77 nt, Human
gcuggcaaaugugguguuugagcugccagggaucaucagggucucucugcagcccgggacacugcauauauucuagc

SEQ ID NO: 4153373 - RNA, 62 nt, Human
gcuggcagagcucugggcugggagggccaaggaggcagauugagcucaguagcucugcuggu

SEQ ID NO: 4153374 - RNA, 79 nt, Human
gcuggcagcauuucuacuaagaaaguugauuagauccucaagucacacaucuaaucccuuuagugaauugucauucagc

SEQ ID NO: 4153375 - RNA, 67 nt, Human
gcuggcagugggccugaggaagggugagaaacucuauucugcaccccaaguucuguccacugcaagu

SEQ ID NO: 4153376 - RNA, 78 nt, Human
gcuggcauucuaccuugguagguccauauguuaaauuaaguucaaccucauaauugucccugcaguuaggauaucagu

SEQ ID NO: 4153377 - RNA, 70 nt, Human
gcuggccaggccucacuggaguaggaauuuuagaugaaacugaguccguuucuccuugaaggcaggcagu

SEQ ID NO: 4153378 - RNA, 60 nt, Human
gcuggccauauauuuugcuguuguaguuguuuuaaacaaacagaaaacugugaggucagu

SEQ ID NO: 4153379 - RNA, 59 nt, Human
gcuggccauggggagugaggaggaaagcugugccccucgaaaggaagccccgggccugc

SEQ ID NO: 4153380 - RNA, 72 nt, Human
gcuggcccaggcucaguucuguggugagccucaggggagacucaccgcugggggcugagugcaggguccagc

SEQ ID NO: 4153381 - RNA, 55 nt, Human
gcuggccccgagugcuacgcucugaaacccgccauugccuuagcacaaggccagc

SEQ ID NO: 4153382 - RNA, 69 nt, Human
gcuggcccuggacucagaggugcugguggggucccauccaugggugaagcccuugaguccuccaucagc

SEQ ID NO: 4153383 - RNA, 56 nt, Human
gcuggccugggcagccugucggauucuacccucagcggguugcugcccagcccugc

SEQ ID NO: 4153384 - RNA, 76 nt, Human
gcggacagguggggcgcgagguccuggcucccucggagaccugcgggagggaccgcgcgccccagcaaggcgccgc

SEQ ID NO: 4153385 - RNA, 61 nt, Human
gcggagccccagggaggccaggagcuguucacaacuccaggaagccacacugggccucagu

SEQ ID NO: 4153386 - RNA, 103 nt, Human
gcggaggugggagguguuggguccauggcagagcccuucugcuggguuccuaucugagagcaggcagaggguccugugccagcagacgcucuuccuccucugc

SEQ ID NO: 4153387 - RNA, 76 nt, Human
gcggaguuuucuuagcuucagaauccauagagugaaauaauguccucuaguuacucuggauuuguggaaaaucugc

SEQ ID NO: 4153388 - RNA, 92 nt, Human
gcggauuacuguggugcccuaggcucagauucugcugagucacugugacugcggauuuggaaggcugagaguccuggggagacaugcuccgu

SEQ ID NO: 4153389 - RNA, 71 nt, Human
gcggcagagagcgagggcuuuccaggagccaaugagucuuuaacuccaagaggaagcccugcauucuccgc

SEQ ID NO: 4153390 - RNA, 92 nt, Human
gcggcagaugguguguccgcuggagagggggcugccaaagaagaggagucucuucccugguuucccuccuccaguguugucuccaucgacgc

SEQ ID NO: 4153391 - RNA, 56 nt, Human
gcggcagccuuucggguggauuuuguuguugcagugccaccuggccaaggcugugc

SEQ ID NO: 4153392 - RNA, 70 nt, Human
gcggccaacucauggaugggaagugcgacaggguuagcuagguuucacagacuuuccauagauuggcugu

SEQ ID NO: 4153393 - RNA, 99 nt, Human
gcggcccggccgccggggcggaagagggacagcgccagccugggcuccuccuccggcuggacgaucuccccuuccucgaucuccgagucgccgggcggc

SEQ ID NO: 4153394 - RNA, 120 nt, Human
gcggcccugaaggcagggcgcagcugguggcugggccuuccgauucucaaggcucugacuccauuuagggccuugggagucggaaggcccaucagccugcugaguucugccuccacccgc

SEQ ID NO: 4153395 - RNA, 60 nt, Human
gcggcgccugggacccgccagcagggccgccugccacggcugggagcuccgggugcacgu

SEQ ID NO: 4153396 - RNA, 57 nt, Human
gcggcggagacagcaggaagccccaaaacccgagcuggguuuccugcuuggagucgc

SEQ ID NO: 4153397 - RNA, 56 nt, Human
gcggcggcccauugucuggcgugauagguuugcagauuugacagcugggcgcacgc

SEQ ID NO: 4153398 - RNA, 61 nt, Human
gcggcugaggcgguggccaaggagcgggagcgcgcucaccgccggggccucgcacaggcgc

SEQ ID NO: 4153399 - RNA, 77 nt, Human
gcggcuuucuuuauguguaaaaggcauguuuuauugagauugaagagacaaugucuuuuggauagguaaggaacugu

SEQ ID NO: 4153400 - RNA, 95 nt, Human
gcgggaaaaacccucagcaggcgguuccuugugggggcuccagagagaggugaaggaggccacgcggggcaccgccugcugagcgggaaucccgu

SEQ ID NO: 4153401 - RNA, 89 nt, Human
gcgggaacaucaggauggauggacagacacuggccuucuggaagguucaacuccagcagggaagcugugcuguuucacaaauuggcugc

SEQ ID NO: 4153402 - RNA, 107 nt, Human
gcgggaccucugucaaccucacccuagcacuugacccccagagcuggucccuguccccaaaggagacagugaugggggugcaggaagcaggagcucagagucccagc

SEQ ID NO: 4153403 - RNA, 78 nt, Human
gcgggagcugcacacgccccggaaaccugggacagaaacugagucccucuccuuccuggugguggugacagcaccugc

SEQ ID NO: 4153404 - RNA, 57 nt, Human
gcgggccagugucuuggugaucuggaagggugacuugcaggcagaggcuuggcuagc

SEQ ID NO: 4153405 - RNA, 70 nt, Human
gcgggcccgggguuggggcagcuugggaaauucagagggggugaugcaggagccccuaauucugggcagc

SEQ ID NO: 4153406 - RNA, 130 nt, Human
gcggggaugggcccgugcggcuccgggugugggacguacccucagagcgcccgggguuauucccacugacuccagggaggugagugugcgcccuucgcucccugccgugucugugaggguccaucguugc

SEQ ID NO: 4153407 - RNA, 71 nt, Human
gcggggauggucugggcagccacuggagguagggugcgauccaggaagcagcuacagauccaccucccugc

SEQ ID NO: 4153408 - RNA, 75 nt, Human
gcggggcacauuuguaagagugggagccagaccccuggcagaccaggagucuaauuccugcucuuacucaccugc

SEQ ID NO: 4153409 - RNA, 70 nt, Human
gcggggcccagaggaccggggcgcccuggaccacauggucaggaugaccacgagccucuaacagccccgc

SEQ ID NO: 4153410 - RNA, 58 nt, Human
gcggggccgcugcgccuccaaccgagcgccgacagagggcgcccgcggcgagccucgc

SEQ ID NO: 4153411 - RNA, 130 nt, Human
gcggggcggggccuaggucgcgggccaucugggcucuggaaggaacccuuagaggagcgggaggacgccacagguccucggcggggcuccgcucccgugagccgcauguggcuggugagcucugaaacgu

SEQ ID NO: 4153412 - RNA, 75 nt, Human
gcgggggcuccucucccagagcugcagggucaggauuuggcugauuuucagcagcagagggagggcccuauuugc

SEQ ID NO: 4153413 - RNA, 57 nt, Human
gcggguugaagggcgcaucgaagucgucuucgaagucaccggugacccucggcucgc

SEQ ID NO: 4153414 - RNA, 57 nt, Human
gcggucagcgcugagccgagacugcgccccuccaggcgggcugagcgccuuggcugc

SEQ ID NO: 4153415 - RNA, 85 nt, Human
gcggugacaucagggcccagucccugcugucaugccccaggugacgugcugggcugacagcagggcuggccgcuaacgucacugu

SEQ ID NO: 4153416 - RNA, 79 nt, Human
gcggugaugccuccagcuaggaaguccuuggcgaaggagauggcuuguuccgucaugguggccuggcgggcagcggagc

SEQ ID NO: 4153417 - RNA, 74 nt, Human
gcggugccuggcucugcgugcagcuccgugccgcagauguggaagcuggggcucagggaccaggugcccaaugc

SEQ ID NO: 4153418 - RNA, 59 nt, Human
gcgguguagugggcuggggccgggcaacuuugcagccuaaucucagugccgcugaccgc

SEQ ID NO: 4153419 - RNA, 58 nt, Human
gcggugugggugugcacgcauguacauaacaugugccuguguaugugcaugcacacgu

SEQ ID NO: 4153420 - RNA, 70 nt, Human
gcgucacucacugggauccacgggcucccaaggccacggccuugggggagagggaccugcagagugacgc

SEQ ID NO: 4153421 - RNA, 83 nt, Human
gcguccuuggaggagcccugccgugggagucugggguuagaugcugcuuccggaacucuacuugggacuccucugggaggcgu

SEQ ID NO: 4153422 - RNA, 57 nt, Human
gcgucgccggcgccucgaggugcgccacucaagcccugcccaggaauccggcggcgu

SEQ ID NO: 4153423 - RNA, 56 nt, Human
gcugggaaccaugggaaggcagaguaccuccuuccacccccuaccccaugcccggc

SEQ ID NO: 4153424 - RNA, 63 nt, Human
gcugggaaguggcagagcuggacacaaacccagggagcguggcuccaggucugcacuccuagc

SEQ ID NO: 4153425 - RNA, 59 nt, Human
gcugggaaugugagcauucauucagauccauccccaucucugagaaaaauauucccagc

SEQ ID NO: 4153426 - RNA, 68 nt, Human
gcugggagaacuggguggagcaucuuguggacugacagacacgaguuggaacccugguucuuccacgc

SEQ ID NO: 4153427 - RNA, 68 nt, Human
gcugggagagacaauuuugguuuucaaagcaaggccuuuggagucugucaccuguuucucuauuuggc

SEQ ID NO: 4153428 - RNA, 58 nt, Human
gcugggagaggcccugaagugacucauuuuccauuuguuuuucagacucaucuccagc

SEQ ID NO: 4153429 - RNA, 60 nt, Human
gcugggagccccgagccagcgcccucgguggaggcagccggcauuccgagggcucccggc

SEQ ID NO: 4153430 - RNA, 117 nt, Human
gcugggaguauuuggguuugcucuagccugcagaauagaaaggaggggcucuugucccuucuugggggcaggguccaucuuucaauauugcuguuuagguauuucacugcugucagc

SEQ ID NO: 4153431 - RNA, 56 nt, Human
gcugggaguggaugaugcagcaacgaacaaaaugcucacaggguguaacuccuagu

SEQ ID NO: 4153432 - RNA, 59 nt, Human
gcugggagugggcaagaugagacuggcgccucugcaucugagugucccccaaacccagc

SEQ ID NO: 4153433 - RNA, 63 nt, Human
gcugggauggaggggcacaauuucaaaggaacaaauguugccugaaugcuucgucauccuggc

SEQ ID NO: 4153434 - RNA, 60 nt, Human
gcugggauuacaagcaugagccaccgcagcuggucauguuuaugacuucuaaucugaagc

SEQ ID NO: 4153435 - RNA, 61 nt, Human
gcugggauuacaagcgugaaccaccgcacccggccccuuguucacaguuucuaaucccagc

SEQ ID NO: 4153436 - RNA, 80 nt, Human
gcugggcacacauggacaauguauguaagaguacagagcaaugucuauuuacauggaauauugucuugugaaggcucagu

SEQ ID NO: 4153437 - RNA, 72 nt, Human
gcugggcagaggcugaugugggaugggcugcuccuggucccuugcccuccuuccccagcccucugccccagc

SEQ ID NO: 4153438 - RNA, 55 nt, Human
gcugggcagcggcagcaggggcagugccuucugcucuggcaggcacgggcccagc

SEQ ID NO: 4153439 - RNA, 71 nt, Human
gcugggcauguaaggaggagugggccaucaggggauggaggccauaccuccugacauggaauaaacugggc

SEQ ID NO: 4153440 - RNA, 80 nt, Human
gcugggccugcaaguucuggagccgggccugggcaguggcgacauaggugcagcugggccuagggaagcagggacccggc

SEQ ID NO: 4153441 - RNA, 64 nt, Human
gcugggcgaggucccugcauccaaccaucccgauuccugaugcuggguuaccuaagccuaaagc

SEQ ID NO: 4153442 - RNA, 58 nt, Human
gcugggcucaccaggccacuagacccccaaauguguauuugccuucugguggcccagc

SEQ ID NO: 4153443 - RNA, 60 nt, Human
gcugggcucagcugggcgugcugguguauggagcauaagguauggacagccgagcauggc

SEQ ID NO: 4153444 - RNA, 127 nt, Human
gcugggcugggcugagcugggcugagcugggcugggcuaagcuggacugggcugggcugagcuggacugggcugggcugagcuagacuuggcugagcugggcugggcugggcugggcugagcugggc

SEQ ID NO: 4153445 - RNA, 56 nt, Human
gcugggcuguuuggggacccaggaagugaggaacgugagucucccuuagcccacgc

SEQ ID NO: 4153446 - RNA, 85 nt, Human
gcuggggaaggcaaggaaggcaacaccaggaugcacugaaugguagauugucucugugggcaccugggaugccaccccccuuggc

SEQ ID NO: 4153447 - RNA, 57 nt, Human
gcuggggacccugccuaggggagagauucaccuccuccauguaaagguccccucagc

SEQ ID NO: 4153448 - RNA, 104 nt, Human
gcuggggacugucccgcgugggccaguggcaggaccaggcacgagggccagcaggagcagggcuggucacgucuccuccuccuucccccaugcagguucccagc

SEQ ID NO: 4153449 - RNA, 65 nt, Human
gcuggggagugaaauucuuaaauuccuaggcagacauggcauuuaggauucuuuaucuccuaagc

SEQ ID NO: 4153450 - RNA, 55 nt, Human
gcuggggcaggguggguggugggcuuuggagaccccagcccagcugugucccagc

SEQ ID NO: 4153451 - RNA, 86 nt, Human
gcuggggcaggugcuacuggcaucuguggguagaggccaggaaugcugcuaaaucuccuacaaugcacagggcagcccccacaagc

SEQ ID NO: 4153452 - RNA, 108 nt, Human
gcugggggcuugaacguggggcucccaggugcuggcugcagauuuuagaggugugggggacagacccuagcuuagcaguuucucuuuucccaguucuuagcccccagc

SEQ ID NO: 4153453 - RNA, 71 nt, Human
gcugggggucaggaaugaguucuggugcucuguaguccggugcaggguucccagcuuccuuccccuucagc

SEQ ID NO: 4153454 - RNA, 86 nt, Human
gcuggggucccagaggcccccacaggcuugaggcagccuugacuucccuuguggcugccaggauggccagggggccagccgccagc

SEQ ID NO: 4153455 - RNA, 73 nt, Human
gcuggggugggcucccagaaggcugaaaccugaggagaggaucccagggcagcucugggagucccaccccugc

SEQ ID NO: 4153456 - RNA, 80 nt, Human
gcuggggugucuugaaggugacauaucuggagccauagcaaagcuuugcucuauguugaccuucaguggacguccugagu

SEQ ID NO: 4153457 - RNA, 76 nt, Human
gcugggucaaccacaguaugucagcuccacuucuggccauaaggauugguccaggggguagauaugugauccaagc

SEQ ID NO: 4153458 - RNA, 57 nt, Human
gcugggucuggugucaggcgacguggaucacaucauuucaccugucucagccucagu

SEQ ID NO: 4153459 - RNA, 57 nt, Human
gcuccugucagucaucaggugcugguaaccagaaaugccugccaucugaacaggggc

SEQ ID NO: 4153460 - RNA, 63 nt, Human
gcuccugucaucaaacaauccuacugcccaaccucccaaagcacugggauuagaggcaugagc

SEQ ID NO: 4153461 - RNA, 58 nt, Human
gcuccugugaaggcauuaggugucacuaaggaugagaacagcaagccuucacaugagu

SEQ ID NO: 4153462 - RNA, 79 nt, Human
gcuccuguggcuuccacgaccuaauccuaacuccagggacucgcaggaguuaggauuaggucguggaagccacaggcgc

SEQ ID NO: 4153463 - RNA, 60 nt, Human
gcuccuuacauguacaagucuccuggcuuuccucgaaacaggaagacuguacuguaaagc

SEQ ID NO: 4153464 - RNA, 55 nt, Human
gcuccuucaggugguagcuguuguggcagaauagaagagugcuggacugaggagc

SEQ ID NO: 4153465 - RNA, 58 nt, Human
gcuccuucccuaggaagucauuuauuuacauaaaugacuaaugauccugggcaagggc

SEQ ID NO: 4153466 - RNA, 58 nt, Human
gcuccuucugcaggccuuauuuuaguuugugcucaaguuagguuuggaggaaauaugc

SEQ ID NO: 4153467 - RNA, 121 nt, Human
gcucgaagaaucacaaaacauguaugcauuuaaugucgaauguuuugcacagaaagggauuccaaagucaccugugcugaacaauucugcauugaugauggcacuguaagauucuaagagc

SEQ ID NO: 4153468 - RNA, 57 nt, Human
gcucgacucauuuuccaggcugaaugcuguagcucauuuagccuggaggguugaagu

SEQ ID NO: 4153469 - RNA, 63 nt, Human
gcucgauuuccgcuugaucugaucuguccaucacaaacacagauuagagccugggacucgggu

SEQ ID NO: 4153470 - RNA, 58 nt, Human
gcucggagucccaccugggaaaccuggguuggcccggaaaccucgggaggcucagagc

SEQ ID NO: 4153471 - RNA, 129 nt, Human
gcucggucaucagaggacgcagugacaccuggucccuggcgaggucccgcucuccccuuggcagaauggugagggcuagggacuccuccucagggugcuuuuguuuuguuuuuuuuggagacaagaguc

SEQ ID NO: 4153472 - RNA, 57 nt, Human
gcucgugguuuagcacgugcuucuuccuccaggcgaagccaagugcuggccaugggc

SEQ ID NO: 4153473 - RNA, 65 nt, Human
gcucguugaaccuguccccgagggacacugggucagaaagcaccuuugggacagguucacagggc

SEQ ID NO: 4153474 - RNA, 92 nt, Human
gcucuacaaccuuugggguccagauaagaccaucagcuauguggguugugccauccagcuguacuuuguccuggcccugggagggguggagu

SEQ ID NO: 4153475 - RNA, 78 nt, Human
gcucuacaggccuuaauugcagagcaauauagggaccaacucacuuaugcuuaaugcaaucuaauucugccuuggagc

SEQ ID NO: 4153476 - RNA, 86 nt, Human
gcucuacagguugaagauuuguugcauuuuaaaaagucucacccugaugggagaagaaugcaagauaaacuuuauuacuguaaagc

SEQ ID NO: 4153477 - RNA, 70 nt, Human
gcucuagaaccuauuagaaauguauugaaauuuggaauuuaguauuuaugaaugaauauguucuagaugc

SEQ ID NO: 4153478 - RNA, 98 nt, Human
gcucuagacuccucaaugcuguuucuuuuuaaaguuguauagaguauuugacaaugagauucaaacacuuugagaaguucucuaguacuucuagaagc

SEQ ID NO: 4153479 - RNA, 60 nt, Human
gcucuagcucccagggagcgucugaaaaugcccuggccagaaucccuggggagcugcagc

SEQ ID NO: 4153480 - RNA, 68 nt, Human
gcucuagcucccugugacaguaucugcuugaguuuuucaugcaaucucuuguucaggaugcugauagc

SEQ ID NO: 4153481 - RNA, 72 nt, Human
gcucuaggauuucacgggauucucauaaaucauccaagaaaauuuggaugagguugagaaucauuuuagggc

SEQ ID NO: 4153482 - RNA, 85 nt, Human
gcucuaggggaggcagaauagaguguggguucugccaugggucacauccggguuuuaauucugccucugccacaugaccuugagc

SEQ ID NO: 4153483 - RNA, 101 nt, Human
gcucuauggcaagugugcauuguagguuaguaugacacgguuauaggcucucuguaacaaugaauauagugacugauauuuuuugagcacuuacuauaggc

SEQ ID NO: 4153484 - RNA, 56 nt, Human
gcucucaacugagacugcaugaagucuacagcuucauuucauccagccuugagagu

SEQ ID NO: 4153485 - RNA, 57 nt, Human
gcucucagaugcuccagcagccagagaggugaugauggcccuggaacugcugagagc

SEQ ID NO: 4153486 - RNA, 83 nt, Human
gcucucagcucuguguuggccuuagaaccugcucugccacaggaagugcuuacuguggcucugagacacaggcucuccugagu

SEQ ID NO: 4153487 - RNA, 130 nt, Human
gcucucauagaacagauaucagaauguuacguccauauuccugagggcucagugaugacuacuuuuccugagauucccugaaugauauauacagacgcaauaauuucugaugauucauuaaaauuacagc

SEQ ID NO: 4153488 - RNA, 57 nt, Human
gcucuccaguucuacaacugucacaagaauguggcagccagggcuaagcuggggagc

SEQ ID NO: 4153489 - RNA, 56 nt, Human
gcucuccggcgcggcagcccccaguggcgaaccgcggagcugcaggagccgaaggc

SEQ ID NO: 4153490 - RNA, 124 nt, Human
gcucuccucccuggagggcuuuucagccccagaaccaaggagcucgguauggccuccgcuuucuaaacuuucuggcccugaguccuggcuuugggauguaaaagucuucuuucuagaggagagu

SEQ ID NO: 4153491 - RNA, 64 nt, Human
gcucuccugugcagaugcugcuggcgcugagcuuugugccuggggcagaaagggugaggacggc

SEQ ID NO: 4153492 - RNA, 92 nt, Human
gcucucgaugccauuuucaugaguuucuguucacacuguaacuaaagaauuucaagugcaugagccugaacuagugacaauggaaugauggc

SEQ ID NO: 4153493 - RNA, 60 nt, Human
gcucucuggucccaccuggccauuuaugcccugguccugaaugggguggguccaggcagc

SEQ ID NO: 4153494 - RNA, 63 nt, Human
gcucucuguccugugugcgcugguauccuugaugggagccuguggaaacugggugcagagagc

SEQ ID NO: 4153495 - RNA, 56 nt, Human
gcucucuguuauuaagaucuuuagaaaagucauaaggauagaaaagacaagagagc

SEQ ID NO: 4153496 - RNA, 56 nt, Human
gcucucuuggauuuuugugguuaccucauggcaaucucacuaagaagcaggggagc

SEQ ID NO: 4153497 - RNA, 63 nt, Human
gcucucuuugugccacuuaaggacauagugagaagguggcuguccgcaagcugggaagagagc

SEQ ID NO: 4153498 - RNA, 65 nt, Human
gcucugaaagugguauuauauuacugagaggaagggagcuuagugaggaaauccauuaucaaggu

SEQ ID NO: 4153499 - RNA, 59 nt, Human
gcucugacuggugggccacagugauguuuuggaucucuuggaaugugucaguucagggc

SEQ ID NO: 4153500 - RNA, 61 nt, Human
gcucugagaucauucacuguaaagauuuuucaauugaauuuagagguaauagauccagagc

SEQ ID NO: 4153501 - RNA, 58 nt, Human
gcucugagauugagccuuugguccccaccacuuccaguuugagcucaaucuccagagc

SEQ ID NO: 4153502 - RNA, 86 nt, Human
gcucugagcugaguggagaccccacuucuacaugcagcuuccauuaugagcacccaggaagugggguucucucacugugccggggu

SEQ ID NO: 4153503 - RNA, 57 nt, Human
gcucugaggcugggagcacucugcaaggugaugggucauguuuuuagcaucaggagc

SEQ ID NO: 4153504 - RNA, 62 nt, Human
gcucugagggcuguggaaggcuaaccccacugggggacauccagcucacagcucaucugggc

SEQ ID NO: 4153505 - RNA, 67 nt, Human
gcucugagugaucagcugggaaacauggccugggcacagcccucugccuagcuguauuacuuaaggu

SEQ ID NO: 4153506 - RNA, 55 nt, Human
gcucugcaggugaggcacuuggcuuucuggaccccgagauccucaucuguaaagu

SEQ ID NO: 4153507 - RNA, 61 nt, Human
gcuuugcucugcagcagcggagccagucugccugcuggggagucgcugcagagcgauaagc

SEQ ID NO: 4153508 - RNA, 56 nt, Human
gcuuugcuuccuuccccuucaaggaaaacauccugcccugguggagggugcagagc

SEQ ID NO: 4153509 - RNA, 82 nt, Human
gcuuugcuugaaacucuuggcaucuguuccuggaggauaaaaauuuaacuauucuggcucauaugcuaagaaguagcagagu

SEQ ID NO: 4153510 - RNA, 57 nt, Human
gcuuuggaguuaggacucggccaaaaaagcagaauuuuccuggaauuaacccagagc

SEQ ID NO: 4153511 - RNA, 67 nt, Human
gcuuuggauugguguuuugaaagaggaugaaaguuauuccuggcaaagugagcaucacuagcaaggc

SEQ ID NO: 4153512 - RNA, 128 nt, Human
gcuuuggcauggccauccauccuucuuaugccuuuucugcccaggagcaugcugguccagccaacugagaaauggauuaacagcuccuggguggugagagaaaaagcugcuggccaccugccacuugc

SEQ ID NO: 4153513 - RNA, 73 nt, Human
gcuuuggccagagcaugcacugccugcagaauauagccuuuaaaacugcuggcagccaugccuuggaaucugc

SEQ ID NO: 4153514 - RNA, 96 nt, Human
gcuuuggcucacuugccuggguuucagcugcagcuacuguacuuugauacugaagaagcagggcuagauauuugcaaguccaagcaggagggcugc

SEQ ID NO: 4153515 - RNA, 67 nt, Human
gcuuuggcuguuaacuaaaggcugcuauuuccaguccuggucuggaacagacauuagugagccaggc

SEQ ID NO: 4153516 - RNA, 126 nt, Human
gcuuuggguucccugaggcgcaaccacaggccuauguguggggcgucgggggacuugaggcuuccuugugauggucuccugaggcugccacacccucugucucugugucacugggagccccugagc

SEQ ID NO: 4153517 - RNA, 61 nt, Human
gcuuuggugacugauuuuuugggaggaaauucaaugucucauuagggaucaucacugcagc

SEQ ID NO: 4153518 - RNA, 67 nt, Human
gcuuugguuguuaaacauagagcuccauuacucccuugaugguguuaaugaaaaacaacucaugagu

SEQ ID NO: 4153519 - RNA, 64 nt, Human
gcuuuguauuugcuggagauauggaaaaguuuagcgacaaauuuucuaguaaucaauauaaagu

SEQ ID NO: 4153520 - RNA, 75 nt, Human
gcuuugugagucacuugacgucuguugcaacuacucaucacagugugaaugcagccagcaagugaauacauaagc

SEQ ID NO: 4153521 - RNA, 82 nt, Human
gcuuugugccagaaagguaaacacuggauugcauuguggauuaaaacaauaagaaaucccuuuccucucaggcuuucaaggc

SEQ ID NO: 4153522 - RNA, 63 nt, Human
gcuuugugcuuuaauugcugccccgguuuuaauggggcacuuugccuuuaugcacugcuaagc

SEQ ID NO: 4153523 - RNA, 58 nt, Human
gcuuugugugaaguccauggcguagaguucagaacuaggcuaguggucugggcaaggc

SEQ ID NO: 4153524 - RNA, 77 nt, Human
gcuuuuagagauuugucuaaugaguguguacuuuuaaauauccaaaauguacuucucuuuagcagaaaacuaggggc

SEQ ID NO: 4153525 - RNA, 55 nt, Human
gcuuuuagugugcucauugaugagugaaagucgccacacaugucaagcuaaaggc

SEQ ID NO: 4153526 - RNA, 62 nt, Human
gcuuuucauuucauagaauuguguuggggauuuaccaacaaccaaaaagaugaauguaaagc

SEQ ID NO: 4153527 - RNA, 77 nt, Human
gcuuuuccuuccccgagcgccucaagcagucucugggccgcaggaacagcccucugaagaggcgcuuggguagaggc

SEQ ID NO: 4153528 - RNA, 64 nt, Human
gcuuuucugagggggacuucgcuggcaggaccucuuaaccacugcugccaccccucaccagagc

SEQ ID NO: 4153529 - RNA, 109 nt, Human
gcuuuucuuaugaggagugguacuuagugggaaggacacuggacuggaagucaagagauuuuagacaagauccuucugaauuguaauuuccauuccucuaaaauaaagc

SEQ ID NO: 4153530 - RNA, 57 nt, Human
gcuuuucuuucauaugugggcuaaaagcccacccuuuguccaauagaaaugaaaagc

SEQ ID NO: 4153531 - RNA, 75 nt, Human
gcuuuucuuuuggacauaucugaugcugggaacucuuuaacugucccaggcuuccuaaugugugcaguuuaaagu

SEQ ID NO: 4153532 - RNA, 91 nt, Human
gcuuuugaagcaggaucguuugcuucauucucaaaacagccacuucagucccuccuuguucccaccugaagcaaacgcuucuguuccuugc

SEQ ID NO: 4153533 - RNA, 62 nt, Human
gcuuuugcugaaaacaguggcaaugauacucuuucugccuugcuggaugucaguuuuaaagc

SEQ ID NO: 4153534 - RNA, 55 nt, Human
gcuuuuggagucuuuacagacaaaaaugaguuuugucuguaaagacuccagaagc

SEQ ID NO: 4153535 - RNA, 84 nt, Human
ggagagagagaaaauuaauuaauggaggcuggaagucugagaucaaggugccggcaggguugguuuucucugaggccucucucc

SEQ ID NO: 4153536 - RNA, 62 nt, Human
ggagagagagauuguguuuauucugaacuauggcauaaauuaaucuggcaauuuguuucucc

SEQ ID NO: 4153537 - RNA, 59 nt, Human
ggagagaggcaucugaguuugcaagcuuggcaacuaggugaauggagaugcuuuuaacu

SEQ ID NO: 4153538 - RNA, 75 nt, Human
ggagagaggguggcaugcuuauucauucugcuaacucauuuuaccuggaagaguuaauaaugaacacuuucuccc

SEQ ID NO: 4153539 - RNA, 130 nt, Human
ggagagagguccuuuccccuguacucgcaauuuccagguuuuguuuggcaacuugguaaagugaccauuugcuuagccagaugugccugaacauuuuggaacucugagucaagagggcgguuccugcuuc

SEQ ID NO: 4153540 - RNA, 76 nt, Human
ggagagagucccaucuauucccuucugauuuacuccagggcugccugggcacaggggaauggaugaaaugagcucc

SEQ ID NO: 4153541 - RNA, 64 nt, Human
ggagagaguuuggaaaaguccuuaauagaacagaguuuguaaaagacauuucuaagcaauuucc

SEQ ID NO: 4153542 - RNA, 72 nt, Human
ggagagcaaacuggagccaguaggaguguacuuaacacuaacaagauccaccugaguuucaguuauuucucu

SEQ ID NO: 4153543 - RNA, 82 nt, Human
ggagagcagauguuggugggggcgggagcaugggccuuggaguccugcagggccuggcucagaccccaguucugucucugcc

SEQ ID NO: 4153544 - RNA, 75 nt, Human
ggagagcgaacauugguagagauucucaagaucuuguuucaccagaucuuucaguuucauaccaauuuauaauuc

SEQ ID NO: 4153545 - RNA, 61 nt, Human
ggagagcuggggccagagucaaggcaggcaaagagacuccucgacccccuccagucuuucc

SEQ ID NO: 4153546 - RNA, 55 nt, Human
ggagaggcauacauauacccagauucucaucccauggguauauguaugccucucc

SEQ ID NO: 4153547 - RNA, 63 nt, Human
ggagaggccugcuuuggcacucugggcaaaaagaguugcuaagaucccagagcaggccugucc

SEQ ID NO: 4153548 - RNA, 56 nt, Human
ggagaggcuggcagugcacucccugggcuggauccugagacagcaaaagccucucc

SEQ ID NO: 4153549 - RNA, 61 nt, Human
ggagaggcuuccagagucgugccucugcucagaggccaaaccuuccccaccaagccucucc

SEQ ID NO: 4153550 - RNA, 71 nt, Human
ggagaggggaauggugguauaugugguaggcuaaacaauggcccuccagagauguucacauucuaaucucc

SEQ ID NO: 4153551 - RNA, 94 nt, Human
ggagaggggauacagaaucaggcaugugugaguauaucuuauccaccugaaaauagaaggugaagagcuuagacagaaucaaagugccccuccu

SEQ ID NO: 4153552 - RNA, 59 nt, Human
ggagagggggcagugagccuggcacaggcagaguggcaggcacagccucccccaacucc

SEQ ID NO: 4153553 - RNA, 83 nt, Human
ggagaggucccgcucaucaaaggauugcaugauuuggguaaauggaaagccuaagaauuuuuuaggguaagcaggaccacucc

SEQ ID NO: 4153554 - RNA, 62 nt, Human
ggagaggugugcaugagaauuuccucaucuccuuuugaggaauuuuguauggauacuguuuc

SEQ ID NO: 4153555 - RNA, 56 nt, Human
ggagagucugagccugcuggaggcucuaacacucaggcuugcuuauaggauucucu

SEQ ID NO: 4153556 - RNA, 57 nt, Human
ggagaguggagacuguccaacaaggaaaugaguucauccuucaguucugcacuuucu

SEQ ID NO: 4153557 - RNA, 93 nt, Human
ggagaguucagaggacagaguccaggcuggucaaauagcuucccagcugggcgagaucuggcagaccgugugggcuguguucucuuccucucc

SEQ ID NO: 4153558 - RNA, 83 nt, Human
ggagaguuuuguugguugugggucauuguuaaauggaaaaagaaauuucagaaacacugaaacauugauugacagaacucucc

SEQ ID NO: 4153559 - RNA, 62 nt, Human
ggagauaauggagaggugucuuaugaccaucuucauagguaagagacacaucacauuucucc

SEQ ID NO: 4153560 - RNA, 124 nt, Human
ggagauagaugugaagcucuuaaucugguuccuucuagcauggggagcagaaagucagaagccaagaugcccuggcugaucuguucuucugucuugaggaaagaguauacguuaaacuauuucc

SEQ ID NO: 4153561 - RNA, 79 nt, Human
ggagauaggucucucuucuugaugggaagaauguuaaagaauuuacagacuugcuuugaaacagagacuuaauuucucc

SEQ ID NO: 4153562 - RNA, 67 nt, Human
ggagauauuuugagcuguuucucugguggcuuuuuaaaguaaaaaagcuagaggcaucucugucuuc

SEQ ID NO: 4153563 - RNA, 91 nt, Human
ggagaucaaauaucagcuucuauuuaucuuuguguucccagaacccaacacagaguuugacacaugggagacugauuguuuguaaaguucc

SEQ ID NO: 4153564 - RNA, 68 nt, Human
ggagaucaaaucugggauuucuaaaguuaagaauucaggccuuggaaauggauuagauuagaucuacc

SEQ ID NO: 4153565 - RNA, 68 nt, Human
ggagaucaguuaagaggccacggcaguuauaccacuguucaaagcugaguaguggccucuugccugcc

SEQ ID NO: 4153566 - RNA, 73 nt, Human
ggagaucgucaguguaugcuguggguaucugugugcuaaaaaacacagucuuaugcauacacuauuaaguucc

SEQ ID NO: 4153567 - RNA, 105 nt, Human
ggaaaggaaaggggaggugacaacugcuagugagaaaauaaccaggggaaagauuaggaaguuuuggugugcaguaugcaguguaaccacauucucuuccucucc

SEQ ID NO: 4153568 - RNA, 61 nt, Human
ggaaaggcagagugcucagcuggcauuuagucaaaagccuacuguaguagcugcuucuuuc

SEQ ID NO: 4153569 - RNA, 63 nt, Human
ggaaaggcuguggccgucagggaaauggagccagaugguccucaugaucgaugccaagcuccc

SEQ ID NO: 4153570 - RNA, 95 nt, Human
ggaaagggaacaacacgagaaccucucauuugauuaggaaauuguuuauacucuuaccaagugaauaugagcuguuuuuuguuguugauuuuucu

SEQ ID NO: 4153571 - RNA, 67 nt, Human
ggaaagggcagaggccuuggagguaaccugaccauuggaauuaauguccagccuuucccucacuucc

SEQ ID NO: 4153572 - RNA, 65 nt, Human
ggaaaggguggggugcuacaucuuuacagccagguggaaguagagguauaggcuucucgcccucc

SEQ ID NO: 4153573 - RNA, 69 nt, Human
ggaaagguuuaaguaggauuuguagcuggagaaacucuuucuaaacaagccuaauacuuuugcuucucc

SEQ ID NO: 4153574 - RNA, 58 nt, Human
ggaaaguacagccagcacccagacucaggugagucccaagcgcgugggcugugcuucc

SEQ ID NO: 4153575 - RNA, 67 nt, Human
ggaaaguaguguauucugcaugggagacuuacuguuuaaaaguaaauuucuuuuggauauauuuucc

SEQ ID NO: 4153576 - RNA, 76 nt, Human
ggaaaguauuguccugguauaauuguuuaaaaaugaaaagcaauuuaaaacagcauaugcaaggcagauauuuacc

SEQ ID NO: 4153577 - RNA, 61 nt, Human
ggaaaguccuucuaaagccagagcucaggaaugaguggggccacuggugugaagacuuucc

SEQ ID NO: 4153578 - RNA, 59 nt, Human
ggaaagugcucucucuauacacauugccagaaguugugugucauggggaaagacucacc

SEQ ID NO: 4153579 - RNA, 59 nt, Human
ggaaagugcuguuggauaaugcugucuuagauagaccuucauucacaacgcaccccucc

SEQ ID NO: 4153580 - RNA, 85 nt, Human
ggaaaguugagaggagcucguggccccagaacaaagcuugagaaaaguaaacaggcggcugcugccggcgagccucccuucuucc

SEQ ID NO: 4153581 - RNA, 109 nt, Human
ggaaaguuuugcaguggggggcuaauguggaaaauauaauugguuuuauauaaaaguccauaauauaagacacaaauaucuuuuacauuaacugaugggcaacacaucc

SEQ ID NO: 4153582 - RNA, 88 nt, Human
ggaaauaaaacugauacucaaguguuuuaaaugagguuauuacauucaacaaugcacuugaguauauacaggagacacuuuuauuuuc

SEQ ID NO: 4153583 - RNA, 82 nt, Human
ggaaauaaauuggccaauccuauugggugggauuuguguuaauaugagccccaccagauggaugaagcagauuuguuuaucc

SEQ ID NO: 4153584 - RNA, 130 nt, Human
ggaaauagucuucacuaguuucuucuggaauuaauccccucugguuccauuagagucagggaacaaucuguaguguagcagggugggacauuguauucuuagacaaggccggcuagaaggaagauguacc

SEQ ID NO: 4153585 - RNA, 91 nt, Human
ggaaauauugacucaacuagguuaggaagauacagaaugucguuaccuuuacaugauacguuuuauuuauuccuucuuaggaaucauuucc

SEQ ID NO: 4153586 - RNA, 104 nt, Human
ggaaaucacuggucacuguaccuggcacagagugagcauucaacucauuuauucaacaaaaauugauugaguacuuacuaugugcagguaccgauccauguucc

SEQ ID NO: 4153587 - RNA, 94 nt, Human
ggaaaugaauguucaguaggcagggcuguggggagaagauauugcuacuguguucuagccccaauguccacccaugccuauuguuuucucuuuc

SEQ ID NO: 4153588 - RNA, 71 nt, Human
ggaaaugcuucagaauagauaucucauuguuagaaaaaccuauuucugagguauuuuuuaaagcacaaucc

SEQ ID NO: 4153589 - RNA, 77 nt, Human
ggaaaugggaauuauuagaucuguuagggauccuguaagaaaaggcacaggacuuggaguucuaauauucuguuuuc

SEQ ID NO: 4153590 - RNA, 79 nt, Human
ggaaauggucacagcugccuggagccagaguugaccaucccacgggcuucagcugccccgggcacugcccgaccacucc

SEQ ID NO: 4153591 - RNA, 104 nt, Human
ggaaauguagucugacugugugcucaagaagaagagguaaagauacauuuuuggugagaagcauuagucuuugccacacuucuguacaacagugucuacauucc

SEQ ID NO: 4153592 - RNA, 75 nt, Human
ggaaauguggccagggcccacaggaugaacgugacucuagcccaccuucaggcugugggcacuggccauauuucc

SEQ ID NO: 4153593 - RNA, 67 nt, Human
ggaaauguuuagcucuagcugcugccuuuguacacauuaaaaagguacagggcuuccuggacaagcc

SEQ ID NO: 4153594 - RNA, 64 nt, Human
ggaaauguuuucaggauuuuaagaauauggaggaaaaugcuccccuuuccugaagaauauuuuu

SEQ ID NO: 4153595 - RNA, 72 nt, Human
ggaaauguuuucugucuguaguaacuauucacauucaggauuauguauuuuuacaaggaggauagcauuucc

SEQ ID NO: 4153596 - RNA, 108 nt, Human
ggaaauuaauacaggacccacggaauuggucucugcuaaagggaggcccaggucagccucccuucaguagagcccaauagggauccaguaggcguccuguggauuucc

SEQ ID NO: 4153597 - RNA, 73 nt, Human
ggaaauuacuuuugcuaacauuacaaaaggccuaaagagcaagugaauuuuaaucuuggcaaauguagcuucc

SEQ ID NO: 4153598 - RNA, 78 nt, Human
ggaaauuaucaacccuucucuuucacucacuauuuguagagcaagugaguggguggggagaggaaaguggggcauucc

SEQ ID NO: 4153599 - RNA, 76 nt, Human
ggaaauuuuaacagaucucauuuugagucagacacuaugcugggcauagaaugaugagcaaaagaggugaauuucc

SEQ ID NO: 4153600 - RNA, 64 nt, Human
ggaaauuuugacucauucccuuaaguacuagcuguuaagugguauuuaauauaugagaguuucc

SEQ ID NO: 4153601 - RNA, 68 nt, Human
ggaacaaaaaugucugcaauuugcguuuuagauuacauaugugaaagcaaccuguaacagugaguucu

SEQ ID NO: 4153602 - RNA, 77 nt, Human
ggaacaaaguuucuacuaggaugucuugaacacaaauagcucuuucauuguguauaagccuagugaaauuucauucc

SEQ ID NO: 4153603 - RNA, 91 nt, Human
ggaacaagccuuaguuagauaagacuuugcuccucuccugggagcuccaggacacuaaaaagccaagcuugcuaccaacgcuugcccuucc

SEQ ID NO: 4153604 - RNA, 73 nt, Human
ggaacaauggagcaugagcagaggagauauaugcaagauggguguccacuguggucccuugcugccccguucc

SEQ ID NO: 4153605 - RNA, 80 nt, Human
ggaacacauuguugagauugucauugacgaugagcagcuccucugucagcugcucauuggcgaucugagggaugagcucc

SEQ ID NO: 4153606 - RNA, 55 nt, Human
ggaacagagggagaaugagaaucagugggcagaauuaugguucucucacuguacc

SEQ ID NO: 4153607 - RNA, 103 nt, Human
ggaacagcagccuaauauuucauacuuucuuaugucucuuucuuuuagccaaaugcagaggaaccacucugagaagccaccggauguuaggagccuguguucc

SEQ ID NO: 4153608 - RNA, 90 nt, Human
gcugaaugauguuuuaugucccuuuuguguugucauuguucuaacuuuagugagaccauuugacauacaguggauggcugcauccagagc

SEQ ID NO: 4153609 - RNA, 82 nt, Human
gcugaaugcaagagugagguugggauuuugaaaaaagccuauaccagagacuucuuccuggccuccguucucugcauauggu

SEQ ID NO: 4153610 - RNA, 69 nt, Human
gcugaauguauggauucaugucugugagguauguauaaacacacgaugugaauucuugccccuucuagc

SEQ ID NO: 4153611 - RNA, 89 nt, Human
gcugaauucgcgcgcugucuggagccacugcugcugcuggggccacgucggguggcagcugcugcaaguggugcuaacacgugagcagc

SEQ ID NO: 4153612 - RNA, 107 nt, Human
gcugacaaaaguacagucagagaaggauuuaccuccagcuaggcuggguaggaauuuucugcagcuaggcuguagguaaauuacuguuugguguacuuugggccagc

SEQ ID NO: 4153613 - RNA, 73 nt, Human
gcugacacaaggcuucacacaguaugaacucaaaaaaggaauugucuuucaugcucaugucaggcaacucagc

SEQ ID NO: 4153614 - RNA, 67 nt, Human
gcugacagcguuuccagugaugccucaaaccuuccuaauaugcaagguaacuuucuaugcuuucagc

SEQ ID NO: 4153615 - RNA, 74 nt, Human
gcugaccccaagcucugccuuucacccccuacaucugauaguaggcaagagagaaaugugcaguuugggcuggu

SEQ ID NO: 4153616 - RNA, 77 nt, Human
gcugaccucugaggcuucagacuguacuggucgccagcuggccccagcccagaaccucuguaggccccagggagagc

SEQ ID NO: 4153617 - RNA, 82 nt, Human
gcugaccucuguuagucuucuugccacauguugcuggagccagaacagaggcccugaggcauuuaggcagauaacagacagu

SEQ ID NO: 4153618 - RNA, 62 nt, Human
gcugaccuugagauaaugcagaaccuggaggcccaccagguuccacgguguuuggaggcagu

SEQ ID NO: 4153619 - RNA, 59 nt, Human
gcugaccuugugauccacccaccuuggccucccaaagugcugggauuacaggccugagc

SEQ ID NO: 4153620 - RNA, 123 nt, Human
gcugacucuguguggcgaguguaagacgagagugggaaagauggggcugcagagguccauguggcuguuucacaagggcccugcaguccacacuguuguugggauuuuaguccucagagcagc

SEQ ID NO: 4153621 - RNA, 108 nt, Human
gcugacugagguguguugggggguuccagggugacaaguggcaaggagcuggguuugcccuucuccccagcccugguauucugaucaccuccuaugaacuccauuggc

SEQ ID NO: 4153622 - RNA, 90 nt, Human
gcugacuuauuuccuugcuuacaacauauuuagcuugauugggucacuacucuccuacaucaggcaaguauuuguaaguggaaugcaagc

SEQ ID NO: 4153623 - RNA, 57 nt, Human
ggagaucugagagcuggaaguggggagcguguuaccuuccaguugccagauccuucc

SEQ ID NO: 4153624 - RNA, 58 nt, Human
ggagaugccuuguuucaggaacccauucagccaaguuguccuggcaagccguaccucc

SEQ ID NO: 4153625 - RNA, 59 nt, Human
ggagauggccacgucacucagugcccagacaggauaacacugggagaacgagccuuucc

SEQ ID NO: 4153626 - RNA, 81 nt, Human
ggagauggcggaggcuggugguuaguuccauuuaaaugagcccauuggggugaacucauaaaccuucaguuuucaauuucc

SEQ ID NO: 4153627 - RNA, 75 nt, Human
ggagaugggaggggcaucucuccugugugcuccucgucagccccagcacagcagccgaaaugcccuuacauuucc

SEQ ID NO: 4153628 - RNA, 59 nt, Human
ggagauguggaagagguagagauggauggauacugaaaauacaaauuuuccauguuucc

SEQ ID NO: 4153629 - RNA, 84 nt, Human
ggagauguuacaaguuggguaggaaccuggcugauguugaaaggacucacauuuacauuuucucuggccuucuguaacauuuuc

SEQ ID NO: 4153630 - RNA, 59 nt, Human
ggagauuuugggcauguuucuggaaaauggccaaaacuguaagugccucaaggucgucc

SEQ ID NO: 4153631 - RNA, 60 nt, Human
ggagcaaagcuuccauaaagcagccuugaaccaggaugcccagaaauggcagcuuuaucc

SEQ ID NO: 4153632 - RNA, 87 nt, Human
ggagcaaggccaggcccuagggcuuuugggccuguucuucccgaggggcagccuaaucauguccuccuggaucuaauggccuugccc

SEQ ID NO: 4153633 - RNA, 79 nt, Human
ggagcaauggagaaaagaugagagggagccagccauccgaaagaagcugcccugcuugguuuauuuucagcuuugcucc

SEQ ID NO: 4153634 - RNA, 72 nt, Human
ggagcacacaacuuggauuccucauaugcacaggucacaauacgguuugugcuccugugagaaucuaguucc

SEQ ID NO: 4153635 - RNA, 100 nt, Human
ggagcacagaagaguuaagcaacuuuucuagacauggucguaaguuugaaaaauguagaucaggccugugguuucuaguagguugccuaacucuuucuuc

SEQ ID NO: 4153636 - RNA, 66 nt, Human
ggagcacagcuggagguagcauuuccaucugaacaugaugucagagcagcugacagccugccaucc

SEQ ID NO: 4153637 - RNA, 85 nt, Human
ggagcacgggaacaggacacauuucuuguucaggccucagaacuugcaguucuuccagacaggggcuguuccugcucccuccucc

SEQ ID NO: 4153638 - RNA, 65 nt, Human
ggagcacuuccugagugcguguuugcuuuugacccuggcugagacuggcagcaggaaguaucucc

SEQ ID NO: 4153639 - RNA, 68 nt, Human
ggagcacuuggaagcgagcacauggaggaacugucggguccucuucuuugagcuuuuuccuaggcucc

SEQ ID NO: 4153640 - RNA, 61 nt, Human
ggagcagacgcugcagucuuggggcagaauuucuucucuaggaagccucagugucugcuuu

SEQ ID NO: 4153641 - RNA, 63 nt, Human
ggagcagcugcucugguggucucucccaggcucugggggcggacccaugggaggggcuguuuu

SEQ ID NO: 4153642 - RNA, 56 nt, Human
ggagcagcugggacuugaaccuaggcagcgggguuccagaguccacaucugccacc

SEQ ID NO: 4153643 - RNA, 78 nt, Human
ggagcaggacaaugaggcugcagugaggaugggcuccauccuugaaugacucugcccuccuugaaauuuuucugcucc

SEQ ID NO: 4153644 - RNA, 71 nt, Human
ggagcaggagguggccucucuuggaccaagugcggcgaauucauuccauaagcagguucuuccugaacucc

SEQ ID NO: 4153645 - RNA, 59 nt, Human
ggagcaggcaaagaugaaaggagaaauuuauuuccucauaacaacucuuugccuuuucc

SEQ ID NO: 4153646 - RNA, 61 nt, Human
ggagcaggcucugugguuuccacacauaguucccagcacugcaauuaacccagagccuucc

SEQ ID NO: 4153647 - RNA, 55 nt, Human
ggagcagggcuccaaugucugggcuccguccucugaagccagaugcccugucucc

SEQ ID NO: 4153648 - RNA, 92 nt, Human
ggagcaucuacaagcagaaggugaggcguccccaccaugggucugcucugcagcccugcggaugucucaccagccuguauggggugugcucc

SEQ ID NO: 4153649 - RNA, 98 nt, Human
ggagcauuguuccuagaagcugccuugauaaagcugggagacaaagaucauugagaaggacugucugcagauuuaucagcagcugcugggacgugccc

SEQ ID NO: 4153650 - RNA, 124 nt, Human
ggagcauuuggucaggucaugggaugccaagcaugccuugcaaagcagucuucugugccuaaggcuccuuccuugcagaaacagaguuuugccauguccuuauuccucacugcucauaaccucc

SEQ ID NO: 4153651 - RNA, 99 nt, Human
ggagccaauaaggaaggcaguuuggagacuaagccagggcugcgagcagacagggugaaccucacuucucccaggaccugggcccacacugcuggcucc

SEQ ID NO: 4153652 - RNA, 104 nt, Human
ggagccaggcugagagcagugcugacaucugcugcugaagccagcauguaggaaagugggcaugggggugauggcagaggugggccugccucacagccagggcc

SEQ ID NO: 4153653 - RNA, 78 nt, Human
ggagccaggcuggagagagagugccuagcucugcaggggagccggucuggggaagcugggaucucucucccgcccucc

SEQ ID NO: 4153654 - RNA, 71 nt, Human
ggagccagucccgagccgcugucauggccgcgaccaccaggcggggcccccggccgagcucucgcggcucc

SEQ ID NO: 4153655 - RNA, 69 nt, Human
ggagccauggccagcccuucccgcagcuccgaagccacuggcaagccccgaggcagggauggccggccc

SEQ ID NO: 4153656 - RNA, 72 nt, Human
ggagcccacaccucuuggucugggucggccacacagagcucuaccaccggcucauccacggagaggggcucc

SEQ ID NO: 4153657 - RNA, 88 nt, Human
ggagcccagguuguuugugcagaggagugccugcaggccugugccaggccacccucagccccaccccuggcauccaucccugagcucc

SEQ ID NO: 4153658 - RNA, 55 nt, Human
ggagcccggccucuccagcagccacacaggccugcaguaggauggggcugggccu

SEQ ID NO: 4153659 - RNA, 83 nt, Human
ggagccuagacagagaagcgaguggaggcgcuguccugggcccucacuccucccagggugcccaccgcuucugcccagccucc

SEQ ID NO: 4153660 - RNA, 129 nt, Human
ggagccugcaagccacccugagggugcagaaaucugaaugucuggggccaugugcagaguguggccaagucguagcuguggcuucagcauucagagccucugccucuacuggggauuaaugcagguuuc

SEQ ID NO: 4153661 - RNA, 63 nt, Human
ggagccuugagcugaugcugacacuagcugagagaagauccauggcagcucuagucgaggccc

SEQ ID NO: 4153662 - RNA, 56 nt, Human
ggagccuugggagucggguccucaaggaaagaccuaugggaucagcccagggcucu

SEQ ID NO: 4153663 - RNA, 67 nt, Human
ggagccuuucagagguuacucaggaaauggacuccuguuuccugugacuaaucuggacagcggcuuc

SEQ ID NO: 4153664 - RNA, 71 nt, Human
ggagcgggcauguucucuccagacugcaguggguaucaggccccugcugcuggagaggaaauggcugugcc

SEQ ID NO: 4153665 - RNA, 98 nt, Human
ggagcggggaguagacaguuuagggaugcuguggcagggcugggugccaucggcugggacucaguccugaugacaggcccaagcuaucauuccugccc

SEQ ID NO: 4153666 - RNA, 90 nt, Human
ggagcguucuggguauuccaucguccccuggaagucuggcagguacaacccccucaacacuccagggagggagggaauccacaggaagcc

SEQ ID NO: 4153667 - RNA, 56 nt, Human
ggagcuaauaaguggcagaugcagucuauuugacuccagugccuaucauuaauucc

SEQ ID NO: 4153668 - RNA, 117 nt, Human
ggagcuauuauuucuggaaguggcuccugauuucagcugcuuccugaugugauggaggacacauggcucuggagcuggcggcugaugcagaggcacacugacugguuuaguggcucc

SEQ ID NO: 4153669 - RNA, 58 nt, Human
ggagcucagagccuauaguuggucacuuggaggugacuccagaggcugcugaggcucc

SEQ ID NO: 4153670 - RNA, 61 nt, Human
ggagcucagaggucccuucccuagugcaggagccucacugaaccagggaucucuaggcucu

SEQ ID NO: 4153671 - RNA, 94 nt, Human
ggagcucauggugcucgggcuguggcagggaagaggccaugcccuucagccguccccccgucuguccucucccugaccacaacgccagagcuuc

SEQ ID NO: 4153672 - RNA, 60 nt, Human
ggagcucccaggccccagcaaggauuuugauuaacaggaccuuaugggcugggugcugcc

SEQ ID NO: 4153673 - RNA, 84 nt, Human
ggagcuccucucugagcugggcucucuugagggcuaagggagccaguucucucggcccuagagcccagaauggaaaagagcuuc

SEQ ID NO: 4153674 - RNA, 60 nt, Human
ggagcucucuugugguacucccauguuguccagcacuuucggagucaccaagagagaccc

SEQ ID NO: 4153675 - RNA, 77 nt, Human
ggagcugacuuuauccugccugaccacgcaaugagccauacaaugcuccucuguggaugaggcaggugaaauucucc

SEQ ID NO: 4153676 - RNA, 71 nt, Human
ggagcugagcacccuuugugagcauaagucuacaacuguaggcuuguucaugacaagggugucacagcucc

SEQ ID NO: 4153677 - RNA, 55 nt, Human
ggagcugaugacgucaccauggcacucaugccugagauguucuuccaucaguuuc

SEQ ID NO: 4153678 - RNA, 84 nt, Human
ggagcugcagauguucauccauuuuccuuuccuucugaaguuccuucugccauggaaagagaaguugggaggaauuucagcacc

SEQ ID NO: 4153679 - RNA, 67 nt, Human
ggagcugcugugaggggagcuucugugggggaaacugccaugggggagcugcuguugggggagcugc

SEQ ID NO: 4153680 - RNA, 62 nt, Human
ggagcuggagugcagguugggguucgugaacuaacaaauuccugaucaaguuuucuggcucc

SEQ ID NO: 4153681 - RNA, 58 nt, Human
gcugggagacagacuuggaaccaggaguucuccaggccccgccauggucucucccugc

SEQ ID NO: 4153682 - RNA, 55 nt, Human
gcugggagaggaaccucgagggucgggugaagcccacccagaguccuccccgcgc

SEQ ID NO: 4153683 - RNA, 75 nt, Human
gcugggagcugaaagaaugaaggauuuagcuguuagucucugaaggcacaacaggccucauuccagcucuccggc

SEQ ID NO: 4153684 - RNA, 110 nt, Human
gcugggagggucagaagcucacguccccuggguuugggcaugaaauccugugcaaaacugcaugaaauguuggucccaaucgcaggcccgugaguuguggccaucuuggc

SEQ ID NO: 4153685 - RNA, 79 nt, Human
gcugggauagacauauuugaaaccaagagaaaaauguuuugaaaacacauucaucuucuuuagauaguaugguugcagu

SEQ ID NO: 4153686 - RNA, 59 nt, Human
gcugggcaagugccuuggguuuagaugcuaugaauggaugaaucuagggucacuccagc

SEQ ID NO: 4153687 - RNA, 65 nt, Human
gcugggcagcugaggccucucagucugugccugagcaagcaaggagcccugagcuguccccaugc

SEQ ID NO: 4153688 - RNA, 58 nt, Human
gcugggcaggccucgugagggccacggacauggagcuugucccuccgggcuucccagc

SEQ ID NO: 4153689 - RNA, 86 nt, Human
gcugggcagguggggagggguccaggaggcacuuaccagcuucuggcaccaggugcagccgggccccgacucgaugcauucccggc

SEQ ID NO: 4153690 - RNA, 83 nt, Human
gcugggcuccacccaucaggcagaguggaagcugcaagucuuccuugccucccccuuucuuccuggcuuggauggaguucagu

SEQ ID NO: 4153691 - RNA, 70 nt, Human
gcuggggaaauucuccaagguucauauuuauccgugugcuuagcgaagggacugaacuuuggacuucagc

SEQ ID NO: 4153692 - RNA, 115 nt, Human
gcuggggauuuguaaccuuaggcuugcuucuccuccacagcucuaaacaagcauguguuaaggaaaagcaaucugaugucugccuaaauauaacaggugaauauuguaccaaagc

SEQ ID NO: 4153693 - RNA, 107 nt, Human
gcuggggcaaauuacuucaucuccuuaguacuugguuuucuucucuauaaaauggagauauuaaucguacauaagguuauugugagguugaaaagagaugauccagc

SEQ ID NO: 4153694 - RNA, 61 nt, Human
gcuggggcaagggcagcuguuucucuggggguaaacacucuuaguugccaaaaugcccugc

SEQ ID NO: 4153695 - RNA, 64 nt, Human
gcuggggcacugggggucaggaccagacccauccauguuccuaggccucccuggagcacccagc

SEQ ID NO: 4153696 - RNA, 56 nt, Human
gcuggggccacagccuccuagcuuggagcaccaggaaaggugggcugggccaaagc

SEQ ID NO: 4153697 - RNA, 88 nt, Human
gcuggggcccacuugggcccucugcagcugcccagggccccaggagggguacaaaccugggacaagcaggggcccaaccacccccagu

SEQ ID NO: 4153698 - RNA, 129 nt, Human
gcuggggccccaaauuguuggucuucucuggacuuugggcucuucugaagagguuaucauagagggcugcugugcccucuggguaggaaccuucagaugaggcugcugcugaggaccugggcaccuggc

SEQ ID NO: 4153699 - RNA, 74 nt, Human
gcuggggcucaguugucuuugggaggcccuguguguccuguguagccaagggccuggacuaauuggaucccagu

SEQ ID NO: 4153700 - RNA, 108 nt, Human
gcugggggaccugggguaaugccucuguuuucaggcaucccuacaguuagguguggccauaugccuagguugccaauggaaggugagaggcaauuucccacuucuggc

SEQ ID NO: 4153701 - RNA, 72 nt, Human
gcugggggccagugucucuuccuuggugauuugccuccacuuuguuucuaggaagagcuauagguccccagu

SEQ ID NO: 4153702 - RNA, 65 nt, Human
gcugggggcuuggcagaggccgaggugaagauuaacuucuucacugcugcgcucccaaccccagc

SEQ ID NO: 4153703 - RNA, 63 nt, Human
gcuggguaccucaccgcugcugcuggggccacucuggccagcaguccacgaggugagaccagc

SEQ ID NO: 4153704 - RNA, 82 nt, Human
gcugggucagggaugcccaggaguaagugacauuguucucauagcagagccauguugugcuacugcugccagaugacccagc

SEQ ID NO: 4153705 - RNA, 65 nt, Human
gcugggucagugaggcugugucacccucuacaacuguagccagcagcuuugauucacugccuagu

SEQ ID NO: 4153706 - RNA, 77 nt, Human
gcuggguccugagguugccaggcaacaagucauguacuuggcaugguaguuaguuuccuggaaacauuaggagaagc

SEQ ID NO: 4153707 - RNA, 72 nt, Human
gcugggugccugaggcccaaggacucugucccgccauacacagggugggacggggcagggcgggcauugagc

SEQ ID NO: 4153708 - RNA, 61 nt, Human
gcuggucagaugcugccuaagccgagugaacauucagggcauggcugcacuuggcacuggc

SEQ ID NO: 4153709 - RNA, 56 nt, Human
gcuggucagggagggcacccaucaguaggguuuaugggggucuccccugcaccugu

SEQ ID NO: 4153710 - RNA, 84 nt, Human
gcuggucccagaugcuuugacaauaucauugcacugcuucucagagcacaguagugcaaccucgucagagcaccugcggccagc

SEQ ID NO: 4153711 - RNA, 113 nt, Human
gcuggucccucuaucuggagugcauaucucugcauggcuggcucuuucucauuauuuggguaguagaaagaacuucauguaaaacugcacuguccagcauaguagccgccagc

SEQ ID NO: 4153712 - RNA, 55 nt, Human
gcuggucccuuucuacugagcacagucagccuucugugccugaaacagaccuagc

SEQ ID NO: 4153713 - RNA, 85 nt, Human
gcuggucuagcaagcucuucuguggauuugaguccugaggcauggaguuguguccaagggagagcagagggcuacagagcacagc

SEQ ID NO: 4153714 - RNA, 88 nt, Human
gcuggucucgagcuccuggcuucaggugauccucccaucucagccucccaaaaugcugagagggcagcugugagccacugugaccagc

SEQ ID NO: 4153715 - RNA, 55 nt, Human
gcuggugauugccucaggaggccuuuuauuucuuucucugugguccaaucccagc

SEQ ID NO: 4153716 - RNA, 108 nt, Human
gcuggugcccuccaaaggcaguaucucaccuccugcccacccuccucccaacccucaggagggugcuugcagugagaugagaugccgcagggaauaaaaaccaccagc

SEQ ID NO: 4153717 - RNA, 57 nt, Human
gcugguggcagagcuccgcggcagcgugcgccaggcagugcggcucuaccacucggu

SEQ ID NO: 4153718 - RNA, 86 nt, Human
gcugguggcugagaaggaggcuccccaaagucugagggcuuggccccgggcccacucgaagccuccagcacuugagagccgccagu

SEQ ID NO: 4153719 - RNA, 71 nt, Human
gcugguggggccaccuaggagccacagugacacccaguguccugcagagcugccuguguggccugccuagu

SEQ ID NO: 4153720 - RNA, 61 nt, Human
gcugguuaucucggccacagagagcuguucgugauaggcuuucucggcagagaugaugggc

SEQ ID NO: 4153721 - RNA, 78 nt, Human
gcugguucacagaagcugccaggagaauggccuuccuuaacucuuggccagagguuucucucauguggugacaccagc

SEQ ID NO: 4153722 - RNA, 80 nt, Human
gcugguucuggccaggauggcaagaccaguggucucucagaggucauguggcuuucuuuucuuccuggccauagacuggc

SEQ ID NO: 4153723 - RNA, 99 nt, Human
gcugguugcccuaaugguggauucucuguucaaggauggugagcuaguguucagcucaggaagccacuccacagagauggccaccaaaagggcuucagu

SEQ ID NO: 4153724 - RNA, 122 nt, Human
gcugguugcugcagauugugggacagaguucuguuuuugcauauugauuuucuccucagggaaacacauuuuaggaaaaucuaguguagggcggaagucaauguaccaugagcaggaccagc

SEQ ID NO: 4153725 - RNA, 102 nt, Human
gcugguugggaagaaaacaacacagggauauuucagguggugccgcacaacaaacagcgguaguuuauggucugagauagucucuguucuuuuggaaccggu

SEQ ID NO: 4153726 - RNA, 78 nt, Human
gcuguaaaguuaucccaugugacucagcugccugcuguacugccaguugauagagucacauggucaauuccuaucagc

SEQ ID NO: 4153727 - RNA, 93 nt, Human
gcuguaaauucucugguuggaauucgcuguguuucugaaguguguauuaauacacauucuugaguuacagucuaccaucuugagagacauagu

SEQ ID NO: 4153728 - RNA, 90 nt, Human
gcuguaauugcuuugccagacagcaguuaaaggacaugugcuuuggcaaucauucucuugggcuugcuugccugguuccuuaguuucagc

SEQ ID NO: 4153729 - RNA, 80 nt, Human
gcuguacaacuucugaaguuuggagcauccagguaucagcuggcugcuagccagagcuucagagcaaguguucauuaagc

SEQ ID NO: 4153730 - RNA, 56 nt, Human
gcuguagaucacuuucuguugcugcaacccaacaguaacagcagggaaauacgugc

SEQ ID NO: 4153731 - RNA, 55 nt, Human
gcuguagggugucauaugaagccuucaaggcucauucuccaugugcccuuucagc

SEQ ID NO: 4153732 - RNA, 126 nt, Human
gcuguaguucaagcacagacccucucaccccagccagcccuucuccaccuuccgggcgcacagucuuagggguggagcagaggcugagguugggggccucacagucaaaggugcugagacaacagc

SEQ ID NO: 4153733 - RNA, 68 nt, Human
gcuguauaauuccuuucccuuccuacauucuuguuuguaauuuuuucgggggaagaggaguugcuagu

SEQ ID NO: 4153734 - RNA, 67 nt, Human
gcugucaaacauugagcacuugcuauuugcaggcauacugcuaagaucgcagcuaauauuugacagc

SEQ ID NO: 4153735 - RNA, 59 nt, Human
gcugucaagguagaaaacagagaauuucuuuauaacuugcaauuucuacaguuggcagc

SEQ ID NO: 4153736 - RNA, 55 nt, Human
gcugucaagguugggaggagaugaguacucgcccauccugcugaccuucacaagc

SEQ ID NO: 4153737 - RNA, 55 nt, Human
gcugucacaucaaggcacuaaacagcugaccugguugguccuaauuauugauagu

SEQ ID NO: 4153738 - RNA, 71 nt, Human
gcugucaccgucugggcaucugagcccagggagcccccgaggucagcugucuccccagaguggagagcagc

SEQ ID NO: 4153739 - RNA, 89 nt, Human
gcugucagcucaucagcucaccauggggaccacacucugcagaagugcagaggcugggaccucaggcaugagaugcagccuuuuacagc

SEQ ID NO: 4153740 - RNA, 56 nt, Human
gcugucaguuuuacccacagacagaagagaugacugucugugugguuuuugcaugu

SEQ ID NO: 4153741 - RNA, 57 nt, Human
gcugucaucagcuuucucaaagaagcuggaagucuagaugaguugagaaguugaagc

SEQ ID NO: 4153742 - RNA, 94 nt, Human
gcugucaucccgugccugugaccggcuuuggugccagcgucagccuguggcuaacacugugcccagagucccaccacccacccauggaucaagc

SEQ ID NO: 4153743 - RNA, 70 nt, Human
gcuguccaggguuauacagcugaacaaaauuacauuaaauuaaguuauggucuuauaauccagggauagu

SEQ ID NO: 4153744 - RNA, 66 nt, Human
gcuguccagguuguggagcaacaggaacucgcauucauugcuugugcaaauacaaaaugguacagc

SEQ ID NO: 4153745 - RNA, 79 nt, Human
gcuguccauuucauccagaguccuauuagcagccaucuacucuacugcuagaguccuggcuuuagaagaaagggauagu

SEQ ID NO: 4153746 - RNA, 104 nt, Human
gcugucccauccucuccugcuuuuauuucaugcccagugugccucagaguguuacgaagugugagaaccacugguagagagaagacaaggaggagagggagagc

SEQ ID NO: 4153747 - RNA, 98 nt, Human
gcuguccuuggaguagaauucaaggcaguaggaucuuccacaguggaagcauaaacuguugaaacuaacuguuuuauauuauauucacagagggcagu

SEQ ID NO: 4153748 - RNA, 56 nt, Human
gcugucgugagagacaacacagcgauaucucauauguugcaagcuuucaagauagc

SEQ ID NO: 4153749 - RNA, 69 nt, Human
gcugucucucccaggauccaugcugcuccuagccccguucugguccugugugcccccuggaagagcagc

SEQ ID NO: 4153750 - RNA, 73 nt, Human
gcugucucucuacagauccuauauagaaagcaaucgugaaaaucacuugucuuuuagggaugagaugagcagc

SEQ ID NO: 4153751 - RNA, 57 nt, Human
gcugucugccgcaggcugccaccaucccguaggccgggggaaaccugcggaggcugc

SEQ ID NO: 4153752 - RNA, 101 nt, Human
gcugucugcuuacccuguaauugaaugucugagagugauugaaaaaauguuauuucuucucaguauuacaugcuaauguacagagggcaaaaggagacagc

SEQ ID NO: 4153753 - RNA, 64 nt, Human
gcugucugggaugucacugcugcugaaaugucgauggcgucugucuagcaguacucacagaagc

SEQ ID NO: 4153754 - RNA, 75 nt, Human
gcuucagaagucaugcucagucuguuccuggaaaacagcagcaccuaggaaaccagcugagaaugcuucugcagc

SEQ ID NO: 4153755 - RNA, 59 nt, Human
gcuucagcaccucagcuggagaguccugggugccgcccucccgcugaagugcugacagc

SEQ ID NO: 4153756 - RNA, 59 nt, Human
gcuucagcauuucuuuucucuucucauucucuguaggaagagucugagugugcaagggc

SEQ ID NO: 4153757 - RNA, 99 nt, Human
gcuucagcuggacuuugagccucuucaugccgaucuggaagccguucauggccuggauggcugccugggcgcuggccggguuaucaaagcucacgaagc

SEQ ID NO: 4153758 - RNA, 78 nt, Human
gcuucaggaauggagggagugagagccuuuuccgacaaugccgaagaaggcucaucccucaccccagacgccuguggc

SEQ ID NO: 4153759 - RNA, 59 nt, Human
gcuucaggcagacagagcugugggucuagggcagagacccaugcaucccucuccugggc

SEQ ID NO: 4153760 - RNA, 65 nt, Human
gcuucaggcagcgaagggcagugggaggggagauauuaacuugccucuggccuuuggugcccagc

SEQ ID NO: 4153761 - RNA, 59 nt, Human
gcuucagguggccauuguuagugaagccaaaagacuucaguuaacuguguuaccugugc

SEQ ID NO: 4153762 - RNA, 56 nt, Human
gcuucauagcauucauugccugugcuugccacaccuugguugaugugcuguggugc

SEQ ID NO: 4153763 - RNA, 74 nt, Human
gcuucaucaacugcaaaauggguauaauaacacuugucucaaaaagacaauugccuauucagcagagugauagc

SEQ ID NO: 4153764 - RNA, 65 nt, Human
gcuucauccccagguuccacaaggauccuugggaguccuugaacagagggccugggugagacagc

SEQ ID NO: 4153765 - RNA, 65 nt, Human
ggacugagcugacaucuguuggcuaccaguacucccaccagcuaggggaaugugagccucagucc

SEQ ID NO: 4153766 - RNA, 86 nt, Human
ggacugaugaugcuguuagcuauaaaaccugucaggggagaagaauguucccugcugcaguguuugcugaaguuacaucaaugucu

SEQ ID NO: 4153767 - RNA, 61 nt, Human
ggacugcagauagacaagagccuccacuugagguggggacccuuccugugcugcugugucc

SEQ ID NO: 4153768 - RNA, 64 nt, Human
ggacugcccuggagacagcagaguauguggcacauuccagccagcucucuguccagggaagucc

SEQ ID NO: 4153769 - RNA, 69 nt, Human
ggacugccgucucggccucuucagauuuugagauaggggugugaguagagcuggggauccaggcaggac

SEQ ID NO: 4153770 - RNA, 60 nt, Human
ggacuggaagggaagggaagaaaugaaagucauugagagguuuccuuucauuuuaguacc

SEQ ID NO: 4153771 - RNA, 82 nt, Human
ggacuggagccuggccaggcuugggacagacacauccugauagggccugacugcgcaggccaugguacggcuccuguggucu

SEQ ID NO: 4153772 - RNA, 64 nt, Human
ggacuggaggagcggugcaugugggggcugaggcacagccugcacucaaacacucucuucuucc

SEQ ID NO: 4153773 - RNA, 56 nt, Human
ggacugggaaucagggagaugcauuuuguccacuagcuuugaccaugaaccagucc

SEQ ID NO: 4153774 - RNA, 59 nt, Human
ggacugggccucacacccaccaaauggaggcuucagcugguggaagggagcccaaaacc

SEQ ID NO: 4153775 - RNA, 88 nt, Human
ggacugguaccugcuuagggcugcagaacaauggccucugacaaacuggggccuguguccucuccagcuugacucgguuugccucucc

SEQ ID NO: 4153776 - RNA, 87 nt, Human
ggacuggucccacaagauguccucagagugggcagguccucaaaacaagaagacgcacccuuugagggcacaaugcagguacagcuc

SEQ ID NO: 4153777 - RNA, 75 nt, Human
ggacugugccaggccucaggagucuccacccucuccaguuuuggggccgucagucuccugggccugcaauuaucc

SEQ ID NO: 4153778 - RNA, 91 nt, Human
ggacuguggcagcuauggucuaagggccaacaccguucagcauuagccgauuguugccguauaggacuuugggaccauggcuaccagagcc

SEQ ID NO: 4153779 - RNA, 57 nt, Human
ggacuuccuaaugggcugcugcugggccugccgucucagcagauagcgggagaguuu

SEQ ID NO: 4153780 - RNA, 83 nt, Human
ggacuucuagggaauuuaguguaagugaggauggcaugugaaacaaaugccuccugacuuacacugagcuuauaaagaucucc

SEQ ID NO: 4153781 - RNA, 55 nt, Human
ggacuugcagcauuaggcuacacgugcucuacaaugugcugaggaugcaagaucc

SEQ ID NO: 4153782 - RNA, 129 nt, Human
ggacuugccacggucccuggucuuggugggcugggcguggagcuggaaugaugugaggcucuccaggggagcagggacacacacucauauaugcacagccugcccaggcugugggguguggcucggucc

SEQ ID NO: 4153783 - RNA, 58 nt, Human
ggacuuggagcugggaguccaauacccauccaggugcugacaacacagcuucaggucc

SEQ ID NO: 4153784 - RNA, 101 nt, Human
ggacuuggauaaaguuuuccuaaaugaugcacuggccugguguagggucaccaugugacauucugcccaccagcgguugcauaugaacucuguccuugucu

SEQ ID NO: 4153785 - RNA, 73 nt, Human
ggacuuuaaguuuguaaaauuagggaauucaaaggauuuuuguaacgcucuaauuuuauguuuguaaaguacc

SEQ ID NO: 4153786 - RNA, 61 nt, Human
ggacuuuggugcgaagucacuuuagaaaacugggaucuggaaggggccaggcgcggagucc

SEQ ID NO: 4153787 - RNA, 60 nt, Human
ggagaaagcuucagaaauggccuucuacuuugggagccuugaaccuugaagccuuccucc

SEQ ID NO: 4153788 - RNA, 64 nt, Human
ggagaaagucagcuccaagcagcacccuuugugaggggcaauuguuuugagugugauugucuuu

SEQ ID NO: 4153789 - RNA, 58 nt, Human
ggagaaaucacuuagaggaagugaccagggcuggucggcuuuuuauggugguuccuuu

SEQ ID NO: 4153790 - RNA, 112 nt, Human
ggagaaaugcauuucugucauagauaagagcauuguaaaauaaucuguuuuaaaguaaauaugaaauauagaauguuuggugcucugcugauuuguauucaaaauaaauccc

SEQ ID NO: 4153791 - RNA, 79 nt, Human
ggagaaauguggggaugagaguggaggaggcaauuuaugagugugguuggcuuugcucucuguccuaguauucagcucc

SEQ ID NO: 4153792 - RNA, 55 nt, Human
ggagaaccucuccauccagaacagaaaugagauguugggugagaguguuugcucu

SEQ ID NO: 4153793 - RNA, 77 nt, Human
ggagaacucaauuuggaauugucaguaaaugauggcucacuguuauauacuugcuuccaguccaagucuguuucuuc

SEQ ID NO: 4153794 - RNA, 60 nt, Human
ggagaacugcaaccguaucaggaacccugcuggcacaggagucugaacaaugcaguuccc

SEQ ID NO: 4153795 - RNA, 59 nt, Human
ggagaagaggggacugaggcugucacuguccuuuacccagaaucauuuuucccuucucu

SEQ ID NO: 4153796 - RNA, 87 nt, Human
ggagaagaucucagcguuguuauugguuaagagaaagaaaagccauuaucucaacuaccauauaacaaguuuaggagagacguuuuc

SEQ ID NO: 4153797 - RNA, 72 nt, Human
ggagaagauuggaauuaagcacuggaagcuuuuuauuuauuuuacaugcuuuauuccuacaagauuuucugc

SEQ ID NO: 4153798 - RNA, 73 nt, Human
ggagaagcaaauuugggguuguuagaggaggcaucuagccaggcucuucuggagccccaagaucuguaccucu

SEQ ID NO: 4153799 - RNA, 67 nt, Human
ggagaagcagcauagcucccuuaguugugucuuaggugaagcaacacuuggcuuuguuuguuuuucu

SEQ ID NO: 4153800 - RNA, 78 nt, Human
ggagaagcauugagcaguuuuugccacugaaguuugaagaaaccaguuucaaagaaaauugcuagucgauacuuuucu

SEQ ID NO: 4153801 - RNA, 62 nt, Human
ggagaagccuguugagagggccgugaacaucaucaugguuuauuagcugcacaggcuuuucc

SEQ ID NO: 4153802 - RNA, 81 nt, Human
ggagaagcgagccggugucuccaaugcccccagucagccauuugguccuggaugucuuggggacuccugcuugcugccucc

SEQ ID NO: 4153803 - RNA, 57 nt, Human
ggagaaggaaaauggggagguuaaggacccuacaccuaaaccuuuagaucauucucc

SEQ ID NO: 4153804 - RNA, 70 nt, Human
ggagaaguccugggccugguuuggagcuggugaggucugaggaccucuaggccauccagggccauucucc

SEQ ID NO: 4153805 - RNA, 75 nt, Human
ggagaaguuauggcaauaggcguguuuaggaggacguggcuauguauggacuugaggaacccgccugucuuuucu

SEQ ID NO: 4153806 - RNA, 87 nt, Human
ggagaaguuugauguguguaauucaguccuugcugagaaguguucuuguugaauuggggagacuguaauugacaugucagcucuucc

SEQ ID NO: 4153807 - RNA, 64 nt, Human
ggagaauaucugucucuaaugcauauuguuuaacacuaaacuguaugcauuuggcauauugucc

SEQ ID NO: 4153808 - RNA, 88 nt, Human
ggagaaucacuggaacccaaaagguggagguugcagugagcugagauagcaccacugcacuccagccugggugacagaacgacacucc

SEQ ID NO: 4153809 - RNA, 88 nt, Human
ggagaaucacuugaacccaggaggcgcagguugcggugagccgaggucaugccauugcacuccauccugggcaauagagugagacucc

SEQ ID NO: 4153810 - RNA, 88 nt, Human
ggagaaucacuugagcccaggaggucgaagcugcagugagcugucaucgugccacugugcuccagccugggugacagagugaaucucu

SEQ ID NO: 4153811 - RNA, 89 nt, Human
ggagaaucgcuugaaccagggaggcagagguugcaaugagcugcgauugugucauugcacuccugccugggcaacaagugcgagacucc

SEQ ID NO: 4153812 - RNA, 88 nt, Human
ggagaaucgcuugaacccaggaggcagaaguugcagugaguugagauagcacuacugcacuccauccugggcaacaaagugagacuuc

SEQ ID NO: 4153813 - RNA, 92 nt, Human
ggagaaucgcuugaacccaggaggcagagguugcagugagccgagaucccaccacugcacucuguucagccugggugacaaaacgagacucu

SEQ ID NO: 4153814 - RNA, 89 nt, Human
ggagaaucgcuugaacccgcgagguggagguugcagugagccaagauugugccauugcacuccagcuugggcaacaagagugaaacucc

SEQ ID NO: 4153815 - RNA, 88 nt, Human
ggagaaucgcuugaacccggaagguggagguugcagugagcugagaccacgccacugcacuccagccugggcgacagagcgagauucc

SEQ ID NO: 4153816 - RNA, 88 nt, Human
ggagaaucgcuugaacccuggaggcagagguggcagugagccgagaucguaccacugcacuucagccugggcgacacagugagacucu

SEQ ID NO: 4153817 - RNA, 87 nt, Human
ggagaaucgcuugaaccuggaggcagagguugcaguaagcugagaucaugccauugcacuccagccugggugacagagugagacucc

SEQ ID NO: 4153818 - RNA, 89 nt, Human
ggagaaucgcuugaaccugggaggcggaaguugcagugagccgagauugcgccauugcacuccagccuggacaacaagagugaaacucc

SEQ ID NO: 4153819 - RNA, 88 nt, Human
ggagaaucgcuugaaccugggaggcggagguuguagugagccaagauugcaccacugcauuccagccucggcgacagagugagacucc

SEQ ID NO: 4153820 - RNA, 67 nt, Human
ggagaaucuguucugucugugguuguuaacccucucaauaaagcuacaagguagcauuaguuucuuc

SEQ ID NO: 4153821 - RNA, 70 nt, Human
ggagaauggcuguguuagaugcuaaguugcucauugacugaggcugcuuuaacuggacggcuccauuucc

SEQ ID NO: 4153822 - RNA, 55 nt, Human
ggagaauggugaugaugcuaccuguucuaugacauguagcaugaggcacugugcc

SEQ ID NO: 4153823 - RNA, 70 nt, Human
ggagaauuaaaauaguuuuggucgaggccaugauguucucgguaaccuaaauuaauuuauaaaauucuuu

SEQ ID NO: 4153824 - RNA, 87 nt, Human
ggagaauugcuugaacccggcaggcggaguugcagugagucgagauugugcuacugcacuccagccuugccaacagagugagacucc

SEQ ID NO: 4153825 - RNA, 88 nt, Human
ggagaauugcuugaacccuggaggcggagguugcagugagccgagaucgcgccacugcacucuagccugggugacagagugagacucc

SEQ ID NO: 4153826 - RNA, 63 nt, Human
ggagacacagcugagcucccaggccaucaugggugacagggucagagcugagcugcucccucc

SEQ ID NO: 4153827 - RNA, 84 nt, Human
ggagacaggaacaauaccucuugccagaagcugaguugcacugaguuuugaugcucugguauugaguuguugcuuccucuuucc

SEQ ID NO: 4153828 - RNA, 113 nt, Human
ggagaccaaauuacccacuugugggaaggaaggugcagcgaucaaucauggggcucauuccaggcugcucacaagcugccccccaaccccaacaagggugggucuuggacucc

SEQ ID NO: 4153829 - RNA, 56 nt, Human
ggcacugcccaacccccugcccugucacacacagagcacaugagggagggcaugcc

SEQ ID NO: 4153830 - RNA, 88 nt, Human
ggcacugcuuguuuuagccauugagcaagguggguaagcauauugaauuugcugucauauccuccuuaaaggugcagcaaugcagguc

SEQ ID NO: 4153831 - RNA, 67 nt, Human
ggcacugggcaugggggucuggacaacaggcaucacgccccaaugagccugcagaccccaccaggcu

SEQ ID NO: 4153832 - RNA, 65 nt, Human
ggcacuggugguuucuccccagagaagugacaccuuccaguuaaucuuuggccggccccugugcc

SEQ ID NO: 4153833 - RNA, 69 nt, Human
ggcacugugggggagccagucccauacauauguauuaaaggauuuggauuccuuacucccaccagugcu

SEQ ID NO: 4153834 - RNA, 58 nt, Human
ggcacuucuaggcugccaugccugugguuacagcaggcuccagcagccagaggaagcc

SEQ ID NO: 4153835 - RNA, 76 nt, Human
ggcacuuggccuaauuucucagugugaucaggccucugcagagagaguucuugcccuagaaaaugaccacagugcc

SEQ ID NO: 4153836 - RNA, 58 nt, Human
ggcacuuguucaccuguggagcuggacccaggggucagaugccaacugaacaacagcc

SEQ ID NO: 4153837 - RNA, 61 nt, Human
ggcacuuuggaaaaauaccuggcauauauaguaagcaguauguuggccauuaccaaaggcc

SEQ ID NO: 4153838 - RNA, 78 nt, Human
ggcagaaagaguaaacagccuucucccagcuuucuuacuuuccacagcugagaguguaggauguuuacaguaucuguc

SEQ ID NO: 4153839 - RNA, 74 nt, Human
ggcagaaaguauagagauggcaugucaaagugccuguuacacaacaggagccaaacacaugccagcuuccugcu

SEQ ID NO: 4153840 - RNA, 76 nt, Human
ggcagaaauuaugagguaacagcuuaucaacauuugaaaauauugauaguugauauccucuuaaggaauauuugcc

SEQ ID NO: 4153841 - RNA, 77 nt, Human
ggcagaaauuucuaagcagccacuuccaagaagcuuuggaaagaaauauccagggaagugcuguguggaagucugcc

SEQ ID NO: 4153842 - RNA, 77 nt, Human
ggcagaagaagaugauggggcacucaaguguggcagcgaaguugaagccggcaugggcgucccccucacuggcugcc

SEQ ID NO: 4153843 - RNA, 58 nt, Human
ggcagaagaauauggauguccuugcucaagacaagagagaaucuguccuuucucugcc

SEQ ID NO: 4153844 - RNA, 66 nt, Human
ggcagaaggauuuaaaggaaagaaugucaguggaaggauaugcuuacagcuuaaaauccagcugcc

SEQ ID NO: 4153845 - RNA, 64 nt, Human
ggcagaagugaaggcacaauuguguagacuuugucaugcagccaauucauucauucuucuugcc

SEQ ID NO: 4153846 - RNA, 58 nt, Human
ggcagaauuggcaaguauguauuuguggcauccuucggagaaacagcacaauucuguu

SEQ ID NO: 4153847 - RNA, 60 nt, Human
ggcagaauuugcagguaaagaggcuuagggcugcauguucucugugugccuucaucugcc

SEQ ID NO: 4153848 - RNA, 80 nt, Human
ggcagacugggagaggccaaguagccgcuguccuagaacuguuagaguaaguagguggcgggauuugagcccagucggcu

SEQ ID NO: 4153849 - RNA, 74 nt, Human
ggcagagaaguaacgaggaagauaaggguuagcuuaacaagguuuguuuguacagauuuuccucggucucagcu

SEQ ID NO: 4153850 - RNA, 58 nt, Human
ggcagagaaucuggcuguuuacuggguuugccuauaagcaaauggucagauuuccccc

SEQ ID NO: 4153851 - RNA, 56 nt, Human
ggcagagcauucgauggaccugguuauucaucauccauauuccauugugcuuuguc

SEQ ID NO: 4153852 - RNA, 58 nt, Human
ggagcggagggagggccacugugcuggugugaggcaaggggcuggcgaccuguguuuu

SEQ ID NO: 4153853 - RNA, 68 nt, Human
ggagcgugcagcaugagcucauaccugccugggcugcaggcuuuguuucaugauugcugucauuuucc

SEQ ID NO: 4153854 - RNA, 62 nt, Human
ggagcuacuguuuacagaugccacagugacaccgcaccucauggcacugcuuagcagguucc

SEQ ID NO: 4153855 - RNA, 71 nt, Human
ggagcuaggcauugagcuucaguagccacuaacaucacaaaaagcuagagaggcagauguccugugccucc

SEQ ID NO: 4153856 - RNA, 73 nt, Human
ggagcuagggcccuaggagagccugaagaggacccaggugugcuccaggccccugccugggccugcuggcccc

SEQ ID NO: 4153857 - RNA, 104 nt, Human
ggagcucagaggcaaaggguucaauagucaaguugguggggacuuucccuacuuaaaguuauaauuugcuaauucggaucuauugcuuuuaaauaucgaguucc

SEQ ID NO: 4153858 - RNA, 56 nt, Human
ggagcucaggaguugauuauuuucccaaagcaggaaaguccaauaccuaaggcucc

SEQ ID NO: 4153859 - RNA, 99 nt, Human
ggagcuccagaguauauagacugcuuuuagcuaguaacuaguacugggguacuaguucccagcuaaaaguaacugaguaagaagggggauaguagcucc

SEQ ID NO: 4153860 - RNA, 69 nt, Human
ggagcuccuuccucuucugagugagacucccuccuaucuuggagcaggaaguccucucaggagaagucc

SEQ ID NO: 4153861 - RNA, 66 nt, Human
ggagcucgggaaaucugugcgcucgaacuuggcuccgccaagaagcugggcaaggauccgggcucc

SEQ ID NO: 4153862 - RNA, 66 nt, Human
ggagcucguucuaccagaccccagacuuguaggaugauagaaguaugugcuggcuagaagagcuuu

SEQ ID NO: 4153863 - RNA, 70 nt, Human
ggagcugaauagggguaccuagaguggauaauaugucuuuugucuauuuaggagacccugguucugugcc

SEQ ID NO: 4153864 - RNA, 80 nt, Human
ggagcugagagucaggcacaggggaaugucuuuuucccaugaaaaggcagccucucccuaguucuuguacccacaucucc

SEQ ID NO: 4153865 - RNA, 61 nt, Human
ggagcugagcagcgauggcggaagcagcagcagcggccgcuccucgcaccucaccaacucc

SEQ ID NO: 4153866 - RNA, 65 nt, Human
ggagcugagggagguuaaggagacccuggggacucacuuguucugucugggcuucccccagcucc

SEQ ID NO: 4153867 - RNA, 55 nt, Human
ggagcugcacgcucugaagccuccuggcucugaggacucagaggcugcuggcucu

SEQ ID NO: 4153868 - RNA, 68 nt, Human
ggagcugcagucacaugguguggagcuacacaaaagcuguguuaaucagaacugugugaauuagcucc

SEQ ID NO: 4153869 - RNA, 66 nt, Human
ggagcuggcuguguggaaagggcaggcagcaacaagagcuacacuuuguuucccagagcucgcucc

SEQ ID NO: 4153870 - RNA, 76 nt, Human
ggagcuggguuuccagcaggcaggagaggagguaagcgcucuccgcaguguccugcuguguuuggaaaccccaucc

SEQ ID NO: 4153871 - RNA, 55 nt, Human
ggagcuguagaucagcuaaucucaucccuuugggguucuggugaguauaagcucc

SEQ ID NO: 4153872 - RNA, 56 nt, Human
ggagcugucuugucauuuuuuagaguaaauauucuagaaacacaugcaaacagucc

SEQ ID NO: 4153873 - RNA, 66 nt, Human
ggagcugugcugggugaucaggugagccccagccuaagccugcugccugggacacucaccagcucc

SEQ ID NO: 4153874 - RNA, 67 nt, Human
ggagcugugcugggugugcuuaugaugcacucugaggcaucaucaagggaacaccaagcccauuucc

SEQ ID NO: 4153875 - RNA, 78 nt, Human
ggagcuucagucucaagugcugcucacccaggccauguuccugcugacucugguggugaccgcagagcugugggcucc

SEQ ID NO: 4153876 - RNA, 59 nt, Human
ggagcuucuagauagagugcaaauuauugccaauacuuuguacucuucuggaauaaucc

SEQ ID NO: 4153877 - RNA, 69 nt, Human
ggagcuugcaggccaggguggacagaggggcugugaauggcacaggcucagcuuaucugggcaggcucc

SEQ ID NO: 4153878 - RNA, 96 nt, Human
ggagcuugucguguacuuccugguccuguugggguguugcagucuugccaguaccaauggcccacacaggcucauaggccaggacgaccuugcucc

SEQ ID NO: 4153879 - RNA, 100 nt, Human
ggagcuuguuagaaauggaauuucuccggcuccacccuaaacccuguucagucagaaccuuugagguuggagccaagaacucuguguuuuaacaagcucu

SEQ ID NO: 4153880 - RNA, 69 nt, Human
ggagcuuuacauguguuuugucauuucaauaauauaaggauuaucugagaucagcagcauauuagcucc

SEQ ID NO: 4153881 - RNA, 87 nt, Human
ggagcuuugaaaauuaauaucuuggcccaacuccagaccaauuauuuuagauuuucuggugguaggccuggauauuagcaguguuuu

SEQ ID NO: 4153882 - RNA, 108 nt, Human
ggaggaaagaugccagggguaaagugggaaaaugggaaccugaagccaggaggucaagccaagccaacagguguucuguuuuucagugaguauauccugucuuucccc

SEQ ID NO: 4153883 - RNA, 92 nt, Human
ggaggaaagcaacaucuccacauauggugagcagcgucccgaccaugggccucgacggccuggagugguccugcugcccguguguggcuucc

SEQ ID NO: 4153884 - RNA, 71 nt, Human
ggaggaacacugugaaauuacccuuacuucuuggcagaaagauauauuuuggugauuucauuuuggcuuuc

SEQ ID NO: 4153885 - RNA, 80 nt, Human
ggaggaagggaggaaagauguaauauuaucuaaauaucguagcaacauuuggagauagauacauuuuucuccauuuuucu

SEQ ID NO: 4153886 - RNA, 72 nt, Human
ggaggaaucuacuuacacugcuguguggccagaaggaaaggaaagcucuauacagcuguugguguuuccucu

SEQ ID NO: 4153887 - RNA, 65 nt, Human
ggaggacacuggcucugccuucccuguuuaugcggcuccuggggacagacagggccagugucccc

SEQ ID NO: 4153888 - RNA, 65 nt, Human
ggaggacagagccugugcagaccggaauguuuaagugccugcagucugguuucagcuuugccucc

SEQ ID NO: 4153889 - RNA, 103 nt, Human
ggaggacuuguuaagacacaugcagcugggcuccauccccaaaguuuccgauucaguaggucugagguggggcuggagcauuugccuuuuuuauaaguuuccc

SEQ ID NO: 4153890 - RNA, 73 nt, Human
ggaggagaaggguauguguggcggagagucugcacuuccucucuaggccauucucggugcccugcugaccucc

SEQ ID NO: 4153891 - RNA, 60 nt, Human
ggaggagagagguugcaaacaccaccaaagauuuaugguguucucauuuucuuuccaucc

SEQ ID NO: 4153892 - RNA, 69 nt, Human
ggaggagaggaggaguauauauuagaaucacccagagggauuuucaguuaugcccucucuuguucuucc

SEQ ID NO: 4153893 - RNA, 76 nt, Human
ggaggagaguuuuaguucucccagucuugauucugucccuugaagagguuaggaaauagggcuguaaacuuccucc

SEQ ID NO: 4153894 - RNA, 59 nt, Human
ggaggagauuccccucucacuuuccagaaaaaggacaaagggaauuaggaaucuuuucu

SEQ ID NO: 4153895 - RNA, 57 nt, Human
ggaggaggaaggggggaaggguuaaaugaacagaaggccacccucucuuauuccucc

SEQ ID NO: 4153896 - RNA, 75 nt, Human
ggaggaggcucuggggccucagggccuacuguauacuccucugugacucugaaccugaggcuugggaguuccgcc

SEQ ID NO: 4153897 - RNA, 58 nt, Human
ggaggaggggggccgcaccugaaaucucauuugcagcuguuacggacccugucauucc

SEQ ID NO: 4153898 - RNA, 60 nt, Human
ggaggaggggugacugaaugcuuucccgcacugguugcauucauaggguuucucuccacc

SEQ ID NO: 4153899 - RNA, 112 nt, Human
ggaggaguaagaaggugggaauggggacauuacagaaugcaugguuagaaacaggcagcucugaccucugagccaauuucuguguccaguuuccccguccacuugcuguucu

SEQ ID NO: 4153900 - RNA, 103 nt, Human
ggaggagugugcaggcauggccaggcaccucuggcugagggcagggcagggccuuagccaggggagcagcuuguccacuuacugccagccuuguucacgcccc

SEQ ID NO: 4153901 - RNA, 100 nt, Human
ggaggauaaaugauggucuaguucuagucaggcucaaacuuuuauccuuucugcuuuugagagcugccgagcuggggccaugggaccaacagcugaugcc

SEQ ID NO: 4153902 - RNA, 88 nt, Human
ggaggaucacuugaaccuggaagguggagguugcagugagcugagaucaugccacugcacuccagccugggcaacagagugagauucc

SEQ ID NO: 4153903 - RNA, 65 nt, Human
ggaggaucugggagugucccucugguaauaagccucuuauccccaggggcauucaagcuuccuuc

SEQ ID NO: 4153904 - RNA, 87 nt, Human
ggaggaugcaaucuuauugugucuuugaauaaguacccaggcuaguauggggacuuguguaacacagaaagaacaucugcaaccuuc

SEQ ID NO: 4153905 - RNA, 83 nt, Human
ggaggauuugacagauuugguggagcaaaugcgcgaugauacagaaggugcgugccacaccaacaucuuucagcuuuuucucc

SEQ ID NO: 4153906 - RNA, 69 nt, Human
ggaggccuuacaggguugcagcauugacggguggugcgucugucacucgcucagucccuguggcccucc

SEQ ID NO: 4153907 - RNA, 78 nt, Human
ggaggcgcauagcucaagaucagggugccagaauggcugaguugugauuagggcucucuggcuugcacaguuaccuuc

SEQ ID NO: 4153908 - RNA, 86 nt, Human
ggaggcgccggaggaggagacggaggccuggggacggcagaagaggcuucgccugagccgagcgcucuuucucucgccgcgccguc

SEQ ID NO: 4153909 - RNA, 58 nt, Human
ggaggcggggaaggcaucccaucacccuaagaccugugggugcaaguucucugucuuu

SEQ ID NO: 4153910 - RNA, 69 nt, Human
ggaggcucauggggcauggaugauaagcuggaucaccuugagcuaauggcuaagccccucugagccucc

SEQ ID NO: 4153911 - RNA, 60 nt, Human
ggaggcuccgguaguagccuugauucaacauuuuguucaguaauguuuaugggggccucc

SEQ ID NO: 4153912 - RNA, 59 nt, Human
ggaggcugaggcaggcaggaguucaaggcugcagugagcugucugugccacggcacucc

SEQ ID NO: 4153913 - RNA, 76 nt, Human
ggaggcugagguaggaggaucgcuugagcccgggaguaggaggcuccagugaacuauguucgugccacagcacucc

SEQ ID NO: 4153914 - RNA, 88 nt, Human
ggaggcuggaggcccggcccugggacuuggucugggguuucuugaggaagaucugaggguccaagggaggaaggaugcccuggccuuc

SEQ ID NO: 4153915 - RNA, 62 nt, Human
ggaggcuggcccgguucgaagcuggcugcuccagggcacuaaagcuggagaagggcccuucc

SEQ ID NO: 4153916 - RNA, 62 nt, Human
ggaggcugggcugggcuggguuccaaggcagggcggagccucccagggaagccgcagucacc

SEQ ID NO: 4153917 - RNA, 62 nt, Human
ggaggcuguguugcaaauguguauguuguguuacugcaaauaucacacccaguacagucucc

SEQ ID NO: 4153918 - RNA, 89 nt, Human
ggagggaaaaccaccagcacggguguuggcagccugaugcaagggugcucccggcucugacuuccugcgcuccagguugguggcccucu

SEQ ID NO: 4153919 - RNA, 124 nt, Human
ggagggaaaaugccaucagcacaacaguggccagcucugcauguuucccuugaguugcuucucuccagagguuuagcaggguugggguuuuccacugggguuuacaucuugggauuugucuucc

SEQ ID NO: 4153920 - RNA, 114 nt, Human
ggagggaagaaaaugaaaggggcuuuugugcagagaggaaaaggggcaaggcugcaugucaaagcaaggucagucuuuucugccagcugagcccugcaucucaugguuccaccc

SEQ ID NO: 4153921 - RNA, 92 nt, Human
ggagggaagaggcaggcugugggucucaggcucagccuaggacacuucccccagggcuggauccuccagacuccccuuccccacuuuccucc

SEQ ID NO: 4153922 - RNA, 56 nt, Human
ggagggaauugggaguggaagacaccgaaaggaaaccagcuuucccaagucccuuu

SEQ ID NO: 4153923 - RNA, 64 nt, Human
ggagggacaguggcuucuuccuagagccacuuugcaguguucccuugaggccagcuguccaucc

SEQ ID NO: 4153924 - RNA, 78 nt, Human
ggagggaccugugugccagggcaugcacagggcucgcagacaugcccugggcaucucaugcaccugcacauucucucc

SEQ ID NO: 4153925 - RNA, 77 nt, Human
ggagggacucacucaaggucacacagauagcaacaagaggcagagcuaggucuggaaccaagacguguagcuccucc

SEQ ID NO: 4153926 - RNA, 59 nt, Human
ggagggagcaaguaagguaagagcggugacaaccguaguuaccaauggcuucucuuucc

SEQ ID NO: 4153927 - RNA, 58 nt, Human
ggagggagucagcugauuagaaucacagagcuauuucugaugggucugaaaucccucu

SEQ ID NO: 4153928 - RNA, 67 nt, Human
ggagggcaaaguaauuuggagauauauauauauauauauauauaauuugaaaauacucaugcucuuu

SEQ ID NO: 4153929 - RNA, 55 nt, Human
ggagggcccucugggcacuguggcagugauuggaauugccacaaaacgggccccc

SEQ ID NO: 4153930 - RNA, 79 nt, Human
ggagggcgggggagagacgagcggcucuggccccuuaauuguacuucgggcucguauugucucuccuuucgccaccucc

SEQ ID NO: 4153931 - RNA, 115 nt, Human
ggagggcuagggaggagggcaggcuccccagcuggggcaacgcaccagcuccuugaagcuguucuguggcucggccagcugcugaagccucuccuccugcucccgaagccucucc

SEQ ID NO: 4153932 - RNA, 87 nt, Human
ggagggcucuucucucuaugccuuggggaauauccauucuucagcccccaagucugaguccccagaguaugugggaaaagucucucc

SEQ ID NO: 4153933 - RNA, 88 nt, Human
ggagggcugggcccagcucccaaggcugagguuccugagcugggcagauacaggacagcagccauuggcagucacggggcagcccucc

SEQ ID NO: 4153934 - RNA, 96 nt, Human
ggaggggcgcgcgcccgggggccgggagcucggagauccccgccagccggggcgcaagaaccaggucuuggcccccggaccugcuugugucccucc

SEQ ID NO: 4153935 - RNA, 59 nt, Human
ggaggggcucuuuaauaguaacacugaauagcaaccaguacuagcaacugggcuccuuc

SEQ ID NO: 4153936 - RNA, 89 nt, Human
ggagggggaaggaacucugaccugcaggcacagcaaugucccuacauucaaguucuucugucuuugcagucagucacccugcuccuucc

SEQ ID NO: 4153937 - RNA, 77 nt, Human
ggaggggggcagaaguagugccccugacaucuggugggucauaggugcucagucguuauuuauuuuugcucuccucc

SEQ ID NO: 4153938 - RNA, 59 nt, Human
ggagggguggucaccuggcagggcgguggugaggccggcccgugccugcccuucccucc

SEQ ID NO: 4153939 - RNA, 73 nt, Human
ggaggguaacucagagacaauuuggcuucaggaagguacaguuagaagcugccaaugauucaaguugcccucc

SEQ ID NO: 4153940 - RNA, 66 nt, Human
ggagggucugcauuccaacuuggggguuuccaguagccuaaguuugaaaaugcaaaucaacccucc

SEQ ID NO: 4153941 - RNA, 77 nt, Human
ggagggugaagggggugugcagggcagaggggagacuaccagcuccucucucuuuuuugaacccgcuccaccucucc

SEQ ID NO: 4153942 - RNA, 68 nt, Human
ggagggugacgccagcugugcuggccucgaagacgugcucgaauuccccagcauagcggcucacaucc

SEQ ID NO: 4153943 - RNA, 113 nt, Human
ggagggugaggacagaagcagggacaccaacugggaggcuguggcagggccccccgagagagaugccagggccucgggcucaguggguccaucuggccucugcuucacccucc

SEQ ID NO: 4153944 - RNA, 79 nt, Human
ggagggugcuaacguggucaccugaauuaugcaugucuauuguguucaaauaucauaaaucggugcaugaauacccucc

SEQ ID NO: 4153945 - RNA, 60 nt, Human
ggaggguugacucuaccuggcagauaucaaaucuaacuugagguuuugacucagcuuucu

SEQ ID NO: 4153946 - RNA, 59 nt, Human
ggagguaagaggcccugggccaaggugcagugacccugcaggccagcccuccaaccucc

SEQ ID NO: 4153947 - RNA, 79 nt, Human
ggaggucaucuagagaauguggacgugugccagaccuaaauuaggagugcaauagugccuauucucuugagcacugucc

SEQ ID NO: 4153948 - RNA, 60 nt, Human
ggaggucccaggggguggcgugugccucuuugagcacaugcaggccuaugguggggcccc

SEQ ID NO: 4153949 - RNA, 65 nt, Human
ggaggugaaacuguuuaguuuuugcagguagaauucuaagucuguagaaaaacaguuuaauuucc

SEQ ID NO: 4153950 - RNA, 100 nt, Human
ggaggugagcgacgcuuccuucuugggacccuccugcucucuggucuuggcaaaccugccaggcacaggugggccucagaaccagcccguuuauagcucc

SEQ ID NO: 4153951 - RNA, 83 nt, Human
ggaggugcccacuugguaaagcacaauuucaccuucuuguaaaccacagggcagagugaaaugcuaugaaugugggcacaucc

SEQ ID NO: 4153952 - RNA, 55 nt, Human
ggaggugcugaucccagucaacgaaaaacuuucaacacggcgaagaagcaucucc

SEQ ID NO: 4153953 - RNA, 64 nt, Human
ggaggugcuuccuuugggcucuggguauauuaaagaaaaugaauagaauggaaggaauaucucc

SEQ ID NO: 4153954 - RNA, 89 nt, Human
ggagguggagaauaaacuccucagcuuccuugcccuuugagaguaggguaaggaguagacagcuuggaagauuguucuacauugucucc

SEQ ID NO: 4153955 - RNA, 66 nt, Human
ggagguggagcccucaugaauaaggagcccuuauaaaaggguccugagagaggcuccuugcccuuc

SEQ ID NO: 4153956 - RNA, 77 nt, Human
ggagguggcuaucugcuucauauuucauagugaucugguuacagauucuauggguaauggagucucagcaaaccucu

SEQ ID NO: 4153957 - RNA, 77 nt, Human
ggagguuacucaagccugccuucuccuagcagaagccauaauuccacuucugaguaagguauguuuguguaguguuc

SEQ ID NO: 4153958 - RNA, 102 nt, Human
ggagguuacuugagucuuuagguagcagggagcaugccauuuuucuuuauacucuuggcauucauucaggcucccaggggcaaguuagugaccagcaaaucc

SEQ ID NO: 4153959 - RNA, 65 nt, Human
ggagguucagaggugcauggacacucuguggaugaugacuuaugagauguaccauuugaaguucu

SEQ ID NO: 4153960 - RNA, 107 nt, Human
ggagguugcguaaguguuaucaagacaggcagcagauggaguguugaaauauauggacucagggcugagucugcugccugucaaauccuagcaauuuacuuaacccc

SEQ ID NO: 4153961 - RNA, 55 nt, Human
ggagguugggaaguccaagcuggcagauuuggugucugcuaagggcccacucuuc

SEQ ID NO: 4153962 - RNA, 79 nt, Human
ggagguuuaaauuuagaaauucaucuauggccuuucccuuuauaaagaaagccaaaacaugugaguuuugaguuucucc

SEQ ID NO: 4153963 - RNA, 56 nt, Human
ggagguuuuguaagugcuccucauuuaugaaaauuuugcagcacuugaaaauuucu

SEQ ID NO: 4153964 - RNA, 60 nt, Human
ggaguaaacaguguguguuacaaaguaguacauaaaguuugaaaugcacacauuuacucc

SEQ ID NO: 4153965 - RNA, 65 nt, Human
ggaguacacagagacucaaaagggcaagaaaaauucauuacucuucccucucagaaagugacucc

SEQ ID NO: 4153966 - RNA, 78 nt, Human
ggaguacguggcagugaaaacgaguggaucaaaaccaaacacuaugaggacacuugggagcauugcacaugugccucc

SEQ ID NO: 4153967 - RNA, 96 nt, Human
ggaguagauucuguuguuggaguaaaaauaacuuacugaaucuuuuauauggaacacuauaggaaauuagaagugcucaggaauagaguuuagccc

SEQ ID NO: 4153968 - RNA, 77 nt, Human
ggaguaggaagaacauuuaggggcucaagauucuccucaaaccacugagaucacagcccccagaugccaccuauuuc

SEQ ID NO: 4153969 - RNA, 86 nt, Human
ggaguaggacaacaagaaaugggagagauguuuauguauguuuuuagaacauucugggugauguucuucaguucuuuguuccaccc

SEQ ID NO: 4153970 - RNA, 58 nt, Human
ggaguaggccccgggagagagugggauaaagaguaacuuucucccggcacuccugccc

SEQ ID NO: 4153971 - RNA, 72 nt, Human
ggaguaggcuguaugaauauaccacaauuuagggaaccagaacccugauauggugucauuuaaacagcuucc

SEQ ID NO: 4153972 - RNA, 92 nt, Human
ggaguauccuggggaucaguucaaaugcagauucaggaguucuggggccaggccugagacucugcauuuauagcaagcccccaggugacgcc

SEQ ID NO: 4153973 - RNA, 91 nt, Human
ggaguauucacagagaguaugcagagaagcuguguuuccugacugcagguccaaucauugauuucucuguaguugccugguggaggauucc

SEQ ID NO: 4153974 - RNA, 77 nt, Human
ggaguauuuugauuuacuggauauucucagagucaguaaagaaugacaguggguaauauguguggaucacagauucu

SEQ ID NO: 4153975 - RNA, 77 nt, Human
ggcagagcugauacccuggacucgcccaugcaacucucugacacugaaggcucugcaugcuucaggcuggcucugcc

SEQ ID NO: 4153976 - RNA, 77 nt, Human
ggcagaggaagcagcuggccugagcgguggcgggugagggcaacacgcugucacugggaggggcagcagucccugcu

SEQ ID NO: 4153977 - RNA, 60 nt, Human
ggcagaggaaucugucuagacacaaggcgauugucauuccuuguuccagauccuucuguc

SEQ ID NO: 4153978 - RNA, 64 nt, Human
ggcagaggagugggccguuaugguaugagccacuuagccguggccagagcccagucucucugcu

SEQ ID NO: 4153979 - RNA, 70 nt, Human
ggcagaggccaggcgagacacccggcugcggccuaagaggccaggcugggugggcuuggcugcagccgcc

SEQ ID NO: 4153980 - RNA, 56 nt, Human
ggcaacauucuccagauccuuuccaggguaggaugggcucugguugagugugggcu

SEQ ID NO: 4153981 - RNA, 109 nt, Human
ggcaacauuuguuucccagcuguuggaguuucacugcauuaguagccaaaugugaucagcugaaagaguggugagacguucaauagcugcugcuucugaugauuuugcu

SEQ ID NO: 4153982 - RNA, 67 nt, Human
ggcaacguggagagaauagggcaccagacaggguuguuuggaaagauuaaauccuccaaaguuagcc

SEQ ID NO: 4153983 - RNA, 68 nt, Human
ggcaacuagaauuuuaauuggguauauauugacaaauuauguuacaugagagaaguucuaaaguugcc

SEQ ID NO: 4153984 - RNA, 55 nt, Human
ggcaacuugugucucgacagcuccccuagggacuuuauguagagccagguuugcc

SEQ ID NO: 4153985 - RNA, 57 nt, Human
ggcaacuuucugcagcugagacagacccuaaaggagcugacaguuggagacaagucc

SEQ ID NO: 4153986 - RNA, 111 nt, Human
ggcaagacuuuccguguccauccuuccugaucuguccuccucagagcccagucucauccuggguacucaguuacgggaaagauguccuggaggggugaccacgugucugcc

SEQ ID NO: 4153987 - RNA, 73 nt, Human
ggcaagauggguaaagucuccccaaccuuaagcugacccuuggcucacucugggcggggcuuuucacucugcc

SEQ ID NO: 4153988 - RNA, 72 nt, Human
ggcaagcaugcagggaccuggaaccgaaacucagcaaagagugucauuccagggacccucgcccagcaagcc

SEQ ID NO: 4153989 - RNA, 67 nt, Human
ggcaagcuggcccuggugagaagcucccuuuagcaaccaauuuuaggagauuccacaauaguuuguc

SEQ ID NO: 4153990 - RNA, 60 nt, Human
ggcaaggagagaggaugagacuggaagucuggaguucuguguucauucuuucuacuuacc

SEQ ID NO: 4153991 - RNA, 62 nt, Human
ggcaaggccagauucucucuaggggccaagacuuucuggccucuucuagcucuggcguuucc

SEQ ID NO: 4153992 - RNA, 71 nt, Human
ggcaaggcgagggcgcugcuucaagaagccggguucauucaaaccccgaggacagcaaaccccgccucccc

SEQ ID NO: 4153993 - RNA, 72 nt, Human
ggcaagggcaaacaucuuuauuuggcaaggucuguauuuuaaaucugauguuucuagaugcuugcccuugcu

SEQ ID NO: 4153994 - RNA, 80 nt, Human
ggacaaggucagcccaggucggggagcacugggugggaugcacgguggccucagccagcucuuggacucugaccuggucc

SEQ ID NO: 4153995 - RNA, 75 nt, Human
ggacaaugaauccaggcagugauccaccaaugauaacuaacaucauaaaaagauacauggccggauaugauguuc

SEQ ID NO: 4153996 - RNA, 98 nt, Human
ggacaaugacgggguggggaggcaucccauccagccucagagggcccagagaauggcugagcaggacagugggagaccagacccuaccccgcaacucc

SEQ ID NO: 4153997 - RNA, 77 nt, Human
ggacaaugauuuuuccauugcaggauaauacucuuccauuagaaguugucuccucaggauaaaaucacaucuuguuc

SEQ ID NO: 4153998 - RNA, 80 nt, Human
ggacaaugcuaaguauuauuaaugacacaacaguuccuuccugcaggggaugggugguuccugguucacuuggcagcucu

SEQ ID NO: 4153999 - RNA, 78 nt, Human
ggacaauuuccuuaugcugguaaugguuauuucuguguacucuucugaugcggugaauugacuguuucuaguuugucu

SEQ ID NO: 4154000 - RNA, 80 nt, Human
ggacacacacuacugagagaccaagcaagaugaaaagagaaagggaacaucagcuggugagcuuaguagggugaaaagcc

SEQ ID NO: 4154001 - RNA, 82 nt, Human
ggacacaggaaagguggcccucugauagggucagggucugugacccagugacuaacagagaggcuuccucuucccugaugcc

SEQ ID NO: 4154002 - RNA, 74 nt, Human
ggacacaguggaagacagcuuggaguaggaaaaggacugaagacugcagcagccaggugaacuucuauucgucc

SEQ ID NO: 4154003 - RNA, 60 nt, Human
ggacacauuuuacugacucuugaauuagcaugauauugcuaaaugagagaaaguaauucc

SEQ ID NO: 4154004 - RNA, 70 nt, Human
ggacaccuuucggccugccuguuccucucucugcugucccccagcagcagagcuggcuucaugggugugc

SEQ ID NO: 4154005 - RNA, 73 nt, Human
ggacacucagggcacaggccuguggguucccuggaauuuucuagcaugauccaguuucuguguccaguucucc

SEQ ID NO: 4154006 - RNA, 76 nt, Human
ggacacugcaccgggcccugagguuuggcucugcaggcagaugugcagcaaacaggccuucagggcgacagggucc

SEQ ID NO: 4154007 - RNA, 58 nt, Human
ggacacugcauauguugaguuaguuguuacaguucuggcucagaguauugcacuguuu

SEQ ID NO: 4154008 - RNA, 64 nt, Human
ggacacuggagacugugucuuuugauucuucuuucugagaauucuuucaaauagcuucaggucc

SEQ ID NO: 4154009 - RNA, 69 nt, Human
ggacacuuggggugguaaggcagccugggagccagaaccccugggcugcccagcaggccccaggggucu

SEQ ID NO: 4154010 - RNA, 67 nt, Human
ggacagaagcccugagucaggcccaagccuuggaauccuccaugcaacccuggccagacuucugccc

SEQ ID NO: 4154011 - RNA, 61 nt, Human
ggacagagggcaggagcccagacuuuggcugcugucuuuggucuagcccucccuccugucc

SEQ ID NO: 4154012 - RNA, 67 nt, Human
ggacagauauauuuaagguaauaaguuugguugaaauaucuaauuuaugacagaagauaugcugucu

SEQ ID NO: 4154013 - RNA, 71 nt, Human
ggacagcaggucacagcugauuggccaggacucuccauagguuauggccagucuuagcugugccugcaucc

SEQ ID NO: 4154014 - RNA, 67 nt, Human
ggacagcugagaggccugggcccgugagcucuugcagaggaguugacacgcagaggggcugcugucc

SEQ ID NO: 4154015 - RNA, 58 nt, Human
ggacaggauaagagacacugccuaucauuaaaaccagggacgaugucucucuccuucc

SEQ ID NO: 4154016 - RNA, 57 nt, Human
ggacaggguuccaaugggcaugggguguugcaaguucuccuguucaugacucugucc

SEQ ID NO: 4154017 - RNA, 68 nt, Human
ggacaggguuggggcauauaaaacaggucccuaaagagaugacagaccuuguccuuuuacccgugucc

SEQ ID NO: 4154018 - RNA, 60 nt, Human
ggacaggugugaggcuggcacauggccgggcaacuccacugccagcugcugcaucugucu

SEQ ID NO: 4154019 - RNA, 94 nt, Human
ggacagguucaaacacagacucugggcccacccucagaguuucugauucaguacuguggggugaggcccaagaaucugcauuucugacaagucc

SEQ ID NO: 4154020 - RNA, 79 nt, Human
ggacaguggcuauggcccaggccaggauccagcuuuacaccggaagcucucccgcagccuggugggcccgcccugcuuc

SEQ ID NO: 4154021 - RNA, 66 nt, Human
ggacagugguacaugccaguccucccagcaauuugggaggccaaggugggcagaucacuugagucc

SEQ ID NO: 4154022 - RNA, 55 nt, Human
ggacaguuuccuggaugugggcuccuuaggaucuggcucauucagggaacggucu

SEQ ID NO: 4154023 - RNA, 63 nt, Human
ggacaucugucuucaucagcaugugaucugguggagauacgugcuguuuuaagauacagguuc

SEQ ID NO: 4154024 - RNA, 68 nt, Human
ggacaugcucuccucacauuucccugugucuacaccuggcaacaagacagcugggaaauggagugucc

SEQ ID NO: 4154025 - RNA, 68 nt, Human
ggacauggagcauguagagaaaagaauccaaagagagaagcuuugguguucacucauucuccauuucc

SEQ ID NO: 4154026 - RNA, 60 nt, Human
ggacauugcaguagccugggacugagagugagucuucccacauccaggccugaagugucc

SEQ ID NO: 4154027 - RNA, 77 nt, Human
ggacauuuaguuucauugggcaguuucugaguacagcuucuuuccagcuuauaucugcucugaaaucuuauaugucc

SEQ ID NO: 4154028 - RNA, 68 nt, Human
ggacauuugcaccuaccucagcgucaaaauuaagaugcugauuuuagccaagguaggccaaguagucc

SEQ ID NO: 4154029 - RNA, 78 nt, Human
ggacauuuguuuacgguuugagagcuggaacaaggcggcagagcaucguccuauacagccucagcugagauuuugcac

SEQ ID NO: 4154030 - RNA, 73 nt, Human
ggaccaagcacucccgagaggaagggcaugcucaaauuguuucuguaaaaagucucuggcgguguuuggcucc

SEQ ID NO: 4154031 - RNA, 56 nt, Human
ggaccaaggcccuguuucagcccuucccaaccugcacuagcuggggccucuggucc

SEQ ID NO: 4154032 - RNA, 95 nt, Human
ggaccacugccugucaucccuaggcgaaggucugggugggcagggagccucaugcccuaccucaggccuguccuccuggggguggcugugagucc

SEQ ID NO: 4154033 - RNA, 124 nt, Human
ggaccacuuggucacucauggggcaaugcaggcucucccaggugggugccuggagcagcagugacuaucuaugacuucacaucucugcccucacuuggggccuguugccuuuggcccuuggucu

SEQ ID NO: 4154034 - RNA, 58 nt, Human
ggaccagagaagugagcaccugcuaaggauguaacuugugcuuuguuucuuugugucc

SEQ ID NO: 4154035 - RNA, 82 nt, Human
ggaccagcgucuugccccgcccaucgccgucugagguuaggacaaagaucgagaggcuggacagggcuggggagggcgcucc

SEQ ID NO: 4154036 - RNA, 104 nt, Human
ggaccaggugaugaggaauaguuuauguagcugaaugccuagacaaguuaaaaaagaggcaauguaugugauuauuccucuaccaacugcauuacuaccuggcc

SEQ ID NO: 4154037 - RNA, 66 nt, Human
ggaccaguggggcuggaugcucccggaauacccuagggaagguagggggcuggcucaacuggaucc

SEQ ID NO: 4154038 - RNA, 60 nt, Human
ggaccaugaggagaugggccucagaagauaaauuauucuccuuucauccuucaguggucu

SEQ ID NO: 4154039 - RNA, 64 nt, Human
ggacccaccaggccgggcuccagugguccccucagcccaggacaagggagcugggccugguucc

SEQ ID NO: 4154040 - RNA, 78 nt, Human
ggacccagcgaagaaccuagcggccgaaaagagucccaggaaaugugccccccgggauuacugguauuugcuggcucc

SEQ ID NO: 4154041 - RNA, 59 nt, Human
ggacccaugcguuuaauuucucuugggcaaaugcccagaaguggaauggccgugggguc

SEQ ID NO: 4154042 - RNA, 83 nt, Human
ggaccccagcggagcugcgccgggacacgggaccgcccggcuggccgggacaagcccgcuggcgcagcccucggccuggggcc

SEQ ID NO: 4154043 - RNA, 59 nt, Human
ggacccgcugccagggaauucacaagcccgcuucugcuguggccugggagcugaggucu

SEQ ID NO: 4154044 - RNA, 65 nt, Human
ggacccuuggcuucugcagauuuaaccuuucuuauuuugugguuuguguaaaguccgugggugcc

SEQ ID NO: 4154045 - RNA, 77 nt, Human
ggaccuaggccuuggacuuguguuugguagaagaggugcucuuauuugcugggucagaagccaggagcccaggugcc

SEQ ID NO: 4154046 - RNA, 106 nt, Human
ggaccuauauuucaugaugaugguggccauucuaccgccuucuugcuuccccaugggaggagagaugggcacgugguaauacggcuucaucugauuucugcagucc

SEQ ID NO: 4154047 - RNA, 93 nt, Human
ggaccucuaaggcaacugccucauuagcaaguuguuauccuuugguggcauccagagagaaagauagcuucuaagaacuacagccucaggucc

SEQ ID NO: 4154048 - RNA, 118 nt, Human
ggaccugaucuccaggacucagaagcacuuggaggaaggccuauucacuuagaagcaguuaccagugcugggcaguguccuccaagugccagaggagugcuguggagaaaagaagucc

SEQ ID NO: 4154049 - RNA, 81 nt, Human
ggaccugaugugggccagcuuuucuccugggugugugacugaauccuucuucccagagcaugugcugccuuuguuaggucu

SEQ ID NO: 4154050 - RNA, 64 nt, Human
ggaccugcccuggcucagaugcuccauaccccacaggagccaauagcucuuggggcagcagucc

SEQ ID NO: 4154051 - RNA, 78 nt, Human
ggaccugcucgcuguccgcucgggugcagagggcagaccccggucucuccuccacaccgggugcuggcgggcgggucc

SEQ ID NO: 4154052 - RNA, 76 nt, Human
ggaccugguaacgcugcaucuuucccuucccuguuugauucuuaggguggcaaagccuuccagcuguuaccagucc

SEQ ID NO: 4154053 - RNA, 72 nt, Human
ggaccugugucuuugccucagggucuucucuggauacuuggagaaaugcuuggccugaguauaggacaggcc

SEQ ID NO: 4154054 - RNA, 74 nt, Human
ggacgaauuuagugcugggcaaaaugcauuuccugccuuuuaaaggaauauggauuugcucagcugaggacucc

SEQ ID NO: 4154055 - RNA, 61 nt, Human
ggacgcagcgagggaagcagccucaugagcaggccugagucucugcggucucacugugucc

SEQ ID NO: 4154056 - RNA, 77 nt, Human
ggcaagucaggaagaguagcagaggcagaggcagccagcaugugcugccagucuaugcugcucggcacugcuuggcc

SEQ ID NO: 4154057 - RNA, 63 nt, Human
ggcaaguuugaugaguuucuggaggcuuugaauuugaaguuuuccuaaauuuuuagauuugcc

SEQ ID NO: 4154058 - RNA, 68 nt, Human
ggcaauaauuuacauuggauaccaauugcaacacagcaaguggacuccgugaaguaaaucuacuugcc

SEQ ID NO: 4154059 - RNA, 82 nt, Human
ggcaaucucagaaacggagcugccauuuuauguaacgugaaaaaguaaaggagaggcaguuuugugaagcugaaagauucuc

SEQ ID NO: 4154060 - RNA, 113 nt, Human
ggcaaugauauucuuuuaaacaucucuuacagucuuaugguuaaauagaugcucuuugaacaacucuacagaugguaccauggguaggacaugcaugcuggaguguuacuguc

SEQ ID NO: 4154061 - RNA, 57 nt, Human
ggcaauucauguuaaacagaagcaguccaguacugccauguuuaaaguugaagggcu

SEQ ID NO: 4154062 - RNA, 75 nt, Human
ggcaauucuuguguggaguguccugugcauuguaggauguucagcagugucuuugaccuccacccacgaaaugcc

SEQ ID NO: 4154063 - RNA, 61 nt, Human
ggcaauugucguugacauccuucacuguaaacgguuggagugauguugauacaauguggcc

SEQ ID NO: 4154064 - RNA, 59 nt, Human
ggcacaauauggccucuugggaggaaauagagacagacucggagaggcccggcugugcc

SEQ ID NO: 4154065 - RNA, 55 nt, Human
ggcacacagauggagcacuagcuaaaucguaacuguugagugucacgucagugcc

SEQ ID NO: 4154066 - RNA, 57 nt, Human
ggcacacagcuuggcaggagaugcuuucauucaaguguugaucaccuacugugugcc

SEQ ID NO: 4154067 - RNA, 73 nt, Human
ggcacagacccucuuauuccuacaguaacagguccgcugcuggcccuggauaggggugggaguggccugaguc

SEQ ID NO: 4154068 - RNA, 57 nt, Human
ggcacagagcagauucucccugugucuuuucacagggcucagauuucauucugugcc

SEQ ID NO: 4154069 - RNA, 71 nt, Human
ggcacagagcccagcuuccuaguucaccaccaaugagccagguguuuugcuggguugcuuguuuuugugcc

SEQ ID NO: 4154070 - RNA, 57 nt, Human
ggcacagccacuuuggagaacuguggggcagcuuuuacuaggaaguggccaugugcu

SEQ ID NO: 4154071 - RNA, 71 nt, Human
ggcacagccugugacauugacuaugaaacuguuuccuauuaccucuuuccugucuaaagucaagguugucc

SEQ ID NO: 4154072 - RNA, 66 nt, Human
ggcacaggagagguuaaugggggccugaaagcaccaccccuggaccaucagcuaaccuucuuggcc

SEQ ID NO: 4154073 - RNA, 72 nt, Human
ggcacaggcucauaguaagcacauggacaagugggcacagguucacaggccagaugcauacuaagcauggcu

SEQ ID NO: 4154074 - RNA, 88 nt, Human
ggcacaggcucugagacugcuggccugggcucaagaccaguucacaugcugcuccaggauuucaggccagguccuuaccucccucacc

SEQ ID NO: 4154075 - RNA, 83 nt, Human
ggcacaugaugcugacauauuguuaauaacuauuacauugaugauacuugccauuaauggcuaauaguguguauucaauggcc

SEQ ID NO: 4154076 - RNA, 67 nt, Human
ggcacaugcaugguguuggguuggaugaacccauccaagaucuagccccaaccccaugacacagucc

SEQ ID NO: 4154077 - RNA, 61 nt, Human
ggcacauguacaguggaaacuaacaaauugcuucaauuuguaguucaacucgugcauuguu

SEQ ID NO: 4154078 - RNA, 79 nt, Human
ggcaccaauguuuauuuuccugcugcaaaacugucaauguucccaaauauugguacaggaauuguaaaugauuuaugcc

SEQ ID NO: 4154079 - RNA, 57 nt, Human
ggcaccagcaggcaccgaugccagcugguuggcauccagguagagcuugcggguguc

SEQ ID NO: 4154080 - RNA, 68 nt, Human
ggcaccaugcacagagcuuggucauugcugcauuucgcaccaacuaaggcaacucuggccuugcuguc

SEQ ID NO: 4154081 - RNA, 57 nt, Human
ggcaccccaacggucggcccccacccgggcuccuggagccaacgcgcuggggcugcc

SEQ ID NO: 4154082 - RNA, 61 nt, Human
ggcaccccaggccuggggccugaucccaggagcacacccuacaggcccagcgcugggggcu

SEQ ID NO: 4154083 - RNA, 94 nt, Human
ggcacccgcaggcuuggggcagcuuccagagcuuugcgcuuggaacagaagguuccccuugggcuguggaggaguagagggcuugugcgugacc

SEQ ID NO: 4154084 - RNA, 58 nt, Human
ggcacccugauggccagauuguggagugaagcucuaagccagugggccacagggagcc

SEQ ID NO: 4154085 - RNA, 57 nt, Human
ggcaccgugaccacccuggcccuggcucuacguuucggaggcucugggcauggcgcc

SEQ ID NO: 4154086 - RNA, 109 nt, Human
ggcaccucuguucacccuccaugugcaugucuuuggaggccucccagaacuugagccaugauggucugcccugcagacaugccucagcuggaggauggauggaggggcc

SEQ ID NO: 4154087 - RNA, 124 nt, Human
ggcaccugccagcucucucccuugggccuucuaccuggagcaggaggcagaaucccauucuccuagggagucuguguauauucacugcccaggaguguuccagcagauugccccaucaggugcc

SEQ ID NO: 4154088 - RNA, 72 nt, Human
ggcaccuguaaucccagcuacuagggaggcugagaaucgcuugaacccgggagguggagguugcagugagcc

SEQ ID NO: 4154089 - RNA, 77 nt, Human
ggcaccuguuuguuuguaacugacaugaucugauccacacacucggguacaauuaagugcacaaauagucauuugcc

SEQ ID NO: 4154090 - RNA, 116 nt, Human
ggcaccuucucuguguuagguuuuagaaguuaguggauaaacagcaaaaugcuuuuaagagaauguuuuguauauuuauugauuuuguuaauacucauuacacaguuuagggagcu

SEQ ID NO: 4154091 - RNA, 73 nt, Human
ggcaccuuggacauacugagaugggaguccugguauaaaugggcuuccucagaaaauacuguccaaccaugcc

SEQ ID NO: 4154092 - RNA, 85 nt, Human
ggcacgaagcugaagcuguuagggagugguagguuuggaguacaguacaugcucugaaauaucuagccuuuagcagcuucaugcc

SEQ ID NO: 4154093 - RNA, 60 nt, Human
ggcacgagccaguguguguguuuccaaaguagguuuggagcagcaggugaccucgaugcc

SEQ ID NO: 4154094 - RNA, 83 nt, Human
ggcacgcaccuguaaucccugcuacuugggaggcugaggcaggagaauugcuugaacccgggaggcagagguugcagugagcc

SEQ ID NO: 4154095 - RNA, 65 nt, Human
ggcacgccacccacgaagaugagcggcauggccuugccauagcgguauuccacgugguuggugcc

SEQ ID NO: 4154096 - RNA, 71 nt, Human
ggcacgggcaaucagcauuuuuacauucauguagcacuuugcaguggugguaaagaugcucuaauugugcc

SEQ ID NO: 4154097 - RNA, 85 nt, Human
ggcacggguuguuugaaggcuuaaaauuaguacaagagaaguuugagauguucuaauuacuggaaauuucaaauaacacgaugcc

SEQ ID NO: 4154098 - RNA, 58 nt, Human
ggcacgugcuccaggcuccuccagccgcugaggcuuuggcuugcccuggcaguacccc

SEQ ID NO: 4154099 - RNA, 68 nt, Human
ggcacuaaguugguguuaauuagugaaaauuaucuaaugcaagcucauuuuaacauuagcuuaaagcc

SEQ ID NO: 4154100 - RNA, 61 nt, Human
ggcacuagcuuuucccagccucacuugcagcuuggcaaaggcucaugaaccaggcucggcc

SEQ ID NO: 4154101 - RNA, 62 nt, Human
ggcacuaggagaccugggggucuuucuuguuuuuggcuugcuaccugguucuccugccugcu

SEQ ID NO: 4154102 - RNA, 86 nt, Human
ggcacuauuggcuuaaguaacuuauuugcaaacaggcauuauuaggcagugccuuuugcugcaguugcuucccuuuauuuguagcc

SEQ ID NO: 4154103 - RNA, 61 nt, Human
ggcacucaccuuaagauuaccguggguauuauuuuuaguuccaggucuuuaggucaguguc

SEQ ID NO: 4154104 - RNA, 72 nt, Human
ggcacucacuaauacucauauuaaauggguucaaauaccaaguuugagucucauuaauuaugaaugacugcu

SEQ ID NO: 4154105 - RNA, 69 nt, Human
ggcacucuuaugggaaaguuacacuuuauuuuggagguaccucuugcaacuuuucauuccaaaggugcu

SEQ ID NO: 4154106 - RNA, 74 nt, Human
ggcacucuugcauuuugauccucauauauugcaaacugauuuuuguaggauaaauucuccaaagugugaguguu

SEQ ID NO: 4154107 - RNA, 129 nt, Human
ggcacugaauagaaaacugaacaaccuuugcuauugugaauagugccgcaauaaacauacgugugcaugugucuuuauagcagcaugauuuauaauccuuuggguguauacccaguaauucaucuaccc

SEQ ID NO: 4154108 - RNA, 77 nt, Human
ggcacuggagcggcccucccucccucucuuuuggggaccucgaggguccaggggcgaggggagccgugccagcagcc

SEQ ID NO: 4154109 - RNA, 70 nt, Human
ggcacuggcagauucggugucuggucagggccuacuuccugguuaauagauggcaccuuucugcuguguc

SEQ ID NO: 4154110 - RNA, 60 nt, Human
ggcacuggcagauuugggaucuggugagggcccucuuccagguucacagacugcgguguu

SEQ ID NO: 4154111 - RNA, 76 nt, Human
ggcacugggcaccggcugagggacuugugcuccaggaacuguuggucuugccacuccuccgccugggcccagugcc

SEQ ID NO: 4154112 - RNA, 97 nt, Human
ggcacugguggcugcacuucugggcugaaauuagacagcaugcuuuuuaaauugcagcugcuucugacuaagcugcaugaggguaagucaucuugcc

SEQ ID NO: 4154113 - RNA, 66 nt, Human
ggcacuguguuuugugcuuuuguguaaggaacagcaaaaagcaugcaaaggcacagcaacagagcu

SEQ ID NO: 4154114 - RNA, 66 nt, Human
ggcacuguuuuuguauucaguugguuaaugaguguacuuuuucaaugcugaagcaggaauagugcc

SEQ ID NO: 4154115 - RNA, 76 nt, Human
ggcacuugguagcagaaaauaaacauuuguggaaugaauaaacaaaguucuacuuuucacauuuuuuuaccaugcc

SEQ ID NO: 4154116 - RNA, 63 nt, Human
ggcacuuugauuuugagaugcaucaauuucccacacuccagaucaucuagaacucagagugcu

SEQ ID NO: 4154117 - RNA, 56 nt, Human
ggcacuuuucuccccggucauggaagaaaagcagcacuuaggggagaagcaguguc

SEQ ID NO: 4154118 - RNA, 84 nt, Human
ggcagaaaaaugguugagaggcugugguguaguuuuccuuaugucacugccuugcaaaaacagccuugaggccuucccucugcc

SEQ ID NO: 4154119 - RNA, 66 nt, Human
ggccugggcacugcagcaggcaucagucuuaucguugagacuugguagcuagggcauggcuaggcc

SEQ ID NO: 4154120 - RNA, 58 nt, Human
ggccuggggcugugggagacaaggcaucagaggggugccaugccugugucuccaggcc

SEQ ID NO: 4154121 - RNA, 91 nt, Human
ggccugggugaguugggacugggacaggacagacaucucagccucuuggcagauuccuggcucagcuccuuuugcacaacacacucagggc

SEQ ID NO: 4154122 - RNA, 89 nt, Human
ggccuggguucagcaguucaaccccgucagagcuuugucuaucuuucaugcauucugccucaggguugcaauaugguugccccagugcc

SEQ ID NO: 4154123 - RNA, 63 nt, Human
ggccugguacacugagaugacuuugguuucaaaaucugaagaccagguucuuaguucuagcuc

SEQ ID NO: 4154124 - RNA, 127 nt, Human
ggccugguuggagcucugucuucucucucagagagcacccacauuucugcagugcaagagagugaccucaaucugguacuagaggagugcuggauguggaggcugagggcagggccucccccagacc

SEQ ID NO: 4154125 - RNA, 59 nt, Human
ggccugguuucacuuuucuugaucugcuuacacaccagaagggagauaggaaucaggcc

SEQ ID NO: 4154126 - RNA, 55 nt, Human
ggccuguagcaucugacuccugcgugcuuggugacagggucaguagcacagagcu

SEQ ID NO: 4154127 - RNA, 58 nt, Human
ggccugucucacccccgggugccugugcucucagcagacaguugggggugaacaggcc

SEQ ID NO: 4154128 - RNA, 112 nt, Human
ggccugugagucuccagaugaaagguggguuuagaucuacacaucuccuguuucagggcagugagcuguuuuggacccaucucuaguagaaguuucuuggagcucuccagcc

SEQ ID NO: 4154129 - RNA, 82 nt, Human
ggccuguggcuagaguaagccucugcucuaucugguguuuccaccagaccuuauagggcagggcauugccaggaggcaugcc

SEQ ID NO: 4154130 - RNA, 56 nt, Human
ggccuguggcuuuggcgucuaacuuuccuuaagaguugagcccauucccacuggcc

SEQ ID NO: 4154131 - RNA, 58 nt, Human
ggcacuggguuguaggaauuaaaugagcuaaugucuguaauuuauucagcacaguguu

SEQ ID NO: 4154132 - RNA, 109 nt, Human
ggcacugugccaauuucaaguuuagacuagaagcuuccacuuuucugcuuucuggggaagccagcggcuauaaagaagcauaggcuagacuucugaggggucagaugcc

SEQ ID NO: 4154133 - RNA, 89 nt, Human
ggcacugugucauucauuuaaguauguuuaagccucacauaggccugguuuauagcaaguucucagugaaugauuuaaagagacaugcc

SEQ ID NO: 4154134 - RNA, 114 nt, Human
ggcacuuacuaauuuuacaaacugaauguugaacuaggaucucuugauugauacauaaagacauacauagaucauauaugauuuuauucaaaguaguauaggaauaaaaaugcc

SEQ ID NO: 4154135 - RNA, 86 nt, Human
ggcacuucagagccaugcagaauguggacaguggguuuggaauugucauugagaugccacuuucuuauucuucuuguguuggugcc

SEQ ID NO: 4154136 - RNA, 69 nt, Human
ggcacuuccgugagauuaagcagaauucuucaugucaccagaaagcagcuaagucuuaugauggugacc

SEQ ID NO: 4154137 - RNA, 55 nt, Human
ggcacuucuccagccugccugcuuagugcugggcaggugcucccagagaagugcu

SEQ ID NO: 4154138 - RNA, 69 nt, Human
ggcacuugaaucuucugaguauuugcucccucuccuguaugguggcauugcugggagauucaaacugcu

SEQ ID NO: 4154139 - RNA, 82 nt, Human
ggcagaacccagggagacagugguagggccuaagucuggagcggcagacaaggccuugcugucuccuccuuucuucucugcc

SEQ ID NO: 4154140 - RNA, 77 nt, Human
ggcagaagaagggcuggagacugggucuucaaguucauccuugaagcccaagcuucacagcuaucucaaucugaacc

SEQ ID NO: 4154141 - RNA, 79 nt, Human
ggcagaagagacaggcugcugucugcuaggaacgccuuuuuguugguuuccccuaguugaaucagcagccacaucugcc

SEQ ID NO: 4154142 - RNA, 105 nt, Human
ggcagaagccuguuuaccacgugcauugauuacuuuugcagccacacucucuaaugugcuuagguggccagugauuaaugacgcuuggacagcagccugguugcu

SEQ ID NO: 4154143 - RNA, 60 nt, Human
ggcagaaggcagaucccacaaaaugcagggaaagcacugcaggguguuccugccuuugcu

SEQ ID NO: 4154144 - RNA, 84 nt, Human
ggcagaaugauucagcuucacucugaaugaucgucuccucuuugugcagacagaugcauguauggagugaggguguuaccugcc

SEQ ID NO: 4154145 - RNA, 65 nt, Human
ggcagacacagugaguuucuuucccaagcagaguggcaucuggguggagacggcgcuguguggcc

SEQ ID NO: 4154146 - RNA, 67 nt, Human
ggcagaccuguagacauuugccuguggcauaaaugacuuuagaauagagugucuaauccaggcuguc

SEQ ID NO: 4154147 - RNA, 126 nt, Human
ggcagaccuugggucuuucuuauucauagauuaauuccuagcacugagaauagugcauagcucucauuagcuauucaguaaauaugugcugauuugaugaaugagugaaugugggcuugcccugcu

SEQ ID NO: 4154148 - RNA, 90 nt, Human
ggcagagacuguggauugcuguaaauuaucuuauuaauuggaacaucacuuguuauauuggagcaauuauagcauguucaaagcuuugcu

SEQ ID NO: 4154149 - RNA, 96 nt, Human
ggcagagagcugguaaggcauggcucaccugggacaugaguggggagagacccucaggucacggaucugagcuggaggagccucacugugucugcu

SEQ ID NO: 4154150 - RNA, 64 nt, Human
ggcagagaggaggccagcgcagcugcgcugcccgucagcuucugcugcucugguuuccucuguc

SEQ ID NO: 4154151 - RNA, 77 nt, Human
ggcagagauccaaucugcacagaagauauuaguauuaccacuucuucuguuuuagauugcauacuucuguuauugcc

SEQ ID NO: 4154152 - RNA, 63 nt, Human
ggcagagaugagcuaucaggacagaagggaccauacuagccccugccuuguuccauuucuucu

SEQ ID NO: 4154153 - RNA, 124 nt, Human
ggcagagcuacaaucucuucagaggcagguaguugcugugcuggggccuccugcucuguugaagaagaguggacccccucaaggcagagcuggggccuccugcuggguugaagaagguucugcc

SEQ ID NO: 4154154 - RNA, 59 nt, Human
ggcagagcuaguggcuucucuuguuaaaccauggcaggaaucccgcaccagcugcuguc

SEQ ID NO: 4154155 - RNA, 59 nt, Human
ggcagaggaacagugucauguagcugcuacugcucacucacacauuucuccuucugacc

SEQ ID NO: 4154156 - RNA, 56 nt, Human
ggcagaggaggggugaauuugcccuaucugagcugggacauucaucuucuucugcc

SEQ ID NO: 4154157 - RNA, 81 nt, Human
ggcagaggccugaauugcaaacucuagagacagagaaauaaacucucuuaucuaagacacuguacuuucagucucuuuguc

SEQ ID NO: 4154158 - RNA, 88 nt, Human
ggcagagggagcggagggcgagcccgcggagccaaaaucuucccucgguuccgguugcugagcucgccgccucuccccuuccccugcc

SEQ ID NO: 4154159 - RNA, 129 nt, Human
ggcagagggcauauuaggcacucgacuuguuuuucacagugaugacgugggagcacacauaagaaggcugugugcuuguuguucucaguuguggaaauagauuugugaucaccucucuaagccccuccu

SEQ ID NO: 4154160 - RNA, 66 nt, Human
ggcagaggguaugaguggggcuaaacuccaauccaugagugagcucugcccaccaaacccuaugcc

SEQ ID NO: 4154161 - RNA, 71 nt, Human
ggcagagguggcaugcaggugaccagguguggggcuguuggcccccucauucauguccuugcuuccucucc

SEQ ID NO: 4154162 - RNA, 99 nt, Human
ggcagaggugucugagaagaggcgaggccacaccugcuucugggcaccuccugcccugguauagggguggcuugcugcuuuucgaggcugacuucugcu

SEQ ID NO: 4154163 - RNA, 59 nt, Human
ggcagaguggcagucccaggcccacgcaguagcagucaagguggcacugccgcuaugcc

SEQ ID NO: 4154164 - RNA, 107 nt, Human
ggcagaguugcuagugguuaacuucccaaaacacugguuguuaauaguaacagcugauacgcuguugucuggcugcagcugugcugggaaaucaauaguucuuuguu

SEQ ID NO: 4154165 - RNA, 88 nt, Human
ggcagauuacuucucucuggaccucaacuauuuuaucugugaagugaaagguuugaaguaguagagcuccaagaucuaaaguuuuguc

SEQ ID NO: 4154166 - RNA, 92 nt, Human
ggcagauucugugauucaccugcccuuuaccugguggcccauuuagaugccaauggcagugcaaggaagggacagcugagaccagaacugcu

SEQ ID NO: 4154167 - RNA, 83 nt, Human
ggcagauugggucaguugauuuguuuuuccuucaugcauuuauuauauauaugacuuuggaaaaauuacuugaucuuucuguc

SEQ ID NO: 4154168 - RNA, 69 nt, Human
ggcagauuuugauauggguauucaugaccugggcuccaacagccuaguucucuauucaaggaucaagcc

SEQ ID NO: 4154169 - RNA, 62 nt, Human
ggcagauuuuuagcugugacucgguuaaauugucucuccagauuucaggcuggaaguuugcc

SEQ ID NO: 4154170 - RNA, 86 nt, Human
ggcagcaaagaagucaggccaaguucauucacacccagacugaggcccuuaucaucugggcuuuaagaacucuguuucuuguugcc

SEQ ID NO: 4154171 - RNA, 101 nt, Human
ggcagcaacugugagaggaugaacuugauucugcugaucucggacggaaacugauucuugggagagagacagaaucaaacggcucugacauuugaaaagcc

SEQ ID NO: 4154172 - RNA, 75 nt, Human
ggcagcaaucuguuuccauguuuuauugugagauacagaaaucuuugcagaggauggaagcaccaguuggaugcc

SEQ ID NO: 4154173 - RNA, 73 nt, Human
ggcagcacugacuccaggccucuggcugcuuagucauucuccaugaaggcagcaagugucugcagugccgguc

SEQ ID NO: 4154174 - RNA, 60 nt, Human
ggcagcacugucuugucuuaggacucagaaaguccaguccugagaugagacagugcugcc

SEQ ID NO: 4154175 - RNA, 117 nt, Human
ggcagaaacaucuggucucccucaagugucuauguuaaaugguuuauuauuaauuuuguauguuaaugauuuggaacccuuuaauuuuaugaagccaggaggauuauuauuuuugcc

SEQ ID NO: 4154176 - RNA, 72 nt, Human
ggcagaaagauggaauguaaaggguaugggauuuggauacagacagaccuggauuugcguuuuaacucuucc

SEQ ID NO: 4154177 - RNA, 65 nt, Human
ggcagaaaggacacacaggaggugucuggggaacccccuccaacauagccagaaugucuccugcc

SEQ ID NO: 4154178 - RNA, 98 nt, Human
ggcagaaauuagaugggucguuguccuggaaacuagaggauuuaugagacauagcaucuaacaucuuaggacucugauucaucuauguucauaaugcc

SEQ ID NO: 4154179 - RNA, 59 nt, Human
ggcagaagaaaggcuaagucucccucucucuucuggagcugagacaaacuucuucugcc

SEQ ID NO: 4154180 - RNA, 56 nt, Human
ggcagaagauaggacagggaauuacaauuuucagagcccccgucccauuuucuccc

SEQ ID NO: 4154181 - RNA, 62 nt, Human
ggcagaagcagcagaugggcgcagucagcaagaugcccuuugcgcccaugaacugcucuacc

SEQ ID NO: 4154182 - RNA, 56 nt, Human
ggcagaagcugggcagcgagguggcguaaagcagggucaccgcguccagccucucc

SEQ ID NO: 4154183 - RNA, 66 nt, Human
ggcagaaggcuuggaccagcuacagugggucaugggaggccccugcugguguccaggcuuuggacc

SEQ ID NO: 4154184 - RNA, 60 nt, Human
ggcagaagugaugggauauaacuuccaagacaagguuauaaaaagacuguggcuucugcc

SEQ ID NO: 4154185 - RNA, 69 nt, Human
ggcagaauucaguuccucuguugugacaugccaaggagcgggcuguccucacaggaaugaacuuucgcc

SEQ ID NO: 4154186 - RNA, 82 nt, Human
ggcagacaacccugggacuuccgaguugagcgagccaguaaauucaguuuagcugaaagcaguuuuagguuaguuuuuuguc

SEQ ID NO: 4154187 - RNA, 65 nt, Human
ggcagacguggaggcugcgcagggcucugucacaguuguggacacugccaggcugcacgccugcc

SEQ ID NO: 4154188 - RNA, 83 nt, Human
ggcagacuagauugcaaacucuagggaggcaggaagcaauuacaucuugucccugcuguacuuagagcauccaguucccugcc

SEQ ID NO: 4154189 - RNA, 63 nt, Human
ggcagagaguaaggcaggcucacucgggguguugacccaggugagcccuaccugcucaucucc

SEQ ID NO: 4154190 - RNA, 65 nt, Human
ggcagagaguugccuuauuugaccucagcugagaacaugcaugucaggcaacucaaguuuuugcc

SEQ ID NO: 4154191 - RNA, 65 nt, Human
ggcagagcagaggugcagguuggagccagguuacuagcaaucuaaucccagcucugccaucugcc

SEQ ID NO: 4154192 - RNA, 55 nt, Human
ggcagagcauuggagggacccugggggaccuucucccugguucugauguucugcu

SEQ ID NO: 4154193 - RNA, 63 nt, Human
ggcagagcuaucuucuggauuuggcuccuuucacauuuugccaaugccaggagauggccuggc

SEQ ID NO: 4154194 - RNA, 112 nt, Human
ggcagagcugagccuggagccccuagguggagugugcagggagagcagcagcccugagcugccuacagcuauccugcagcacccagcccugcuuggggcaucggcugcugcc

SEQ ID NO: 4154195 - RNA, 60 nt, Human
ggcagaggaaggaugaauucacuuccuuuuuuugagcuaggauauccaucuuuuccugcc

SEQ ID NO: 4154196 - RNA, 62 nt, Human
ggcagaggaggacccaggaauuauaagacgugucaauguauugaucuguggcaccucuuccc

SEQ ID NO: 4154197 - RNA, 98 nt, Human
ggcagagggcaggugcagcuggaagugacacucuguguuucccugcaucccccugaggucacagguccucaagucagcugggaagccguucucuggcc

SEQ ID NO: 4154198 - RNA, 72 nt, Human
ggcagaggucacuuggagcaaaguuuacaagccuuuucuugauuacauugugcuuaaaguguuaacccuguu

SEQ ID NO: 4154199 - RNA, 68 nt, Human
ggcagagugcucugggcaggggcugggguccgggagucagcccacuccucugcccagggccuccugcc

SEQ ID NO: 4154200 - RNA, 55 nt, Human
ggcagagugugaggguccugcucagccaguaagaguuugacucaggccuuuagcc

SEQ ID NO: 4154201 - RNA, 116 nt, Human
ggcagaguuugcuauuuugugugugugcuuuuuugcuauugaaguggugaagcucucuuuucaaacuaauucucaugcagaagcuggcacaugaaacagauacaagcagagcugcu

SEQ ID NO: 4154202 - RNA, 73 nt, Human
ggcagaucagcuuggucucgggagcuauuucuacacaaaucacguggggcucagaaggccaugcucugcugcu

SEQ ID NO: 4154203 - RNA, 93 nt, Human
ggccaggcugaucucaaacuccugaccuugugauccacucaccuuggccucccaaagugcugguauuacaggugugagccaucaugcccggcc

SEQ ID NO: 4154204 - RNA, 93 nt, Human
ggccaggcuggucucgaacucuugaccucgugauccgcccgcuuuggccucccaaagugcugggauuacaggugugagccaccaugcccggcc

SEQ ID NO: 4154205 - RNA, 93 nt, Human
ggccaggcuggucuugagcuccugaccuugugauccgcccacuuuggccucccaaagugcugggauuacaggcgcgagcuaccgcgccuggcc

SEQ ID NO: 4154206 - RNA, 93 nt, Human
ggccaggcugguguugaacuccugaccuugugauccgcccgccuuggccuccuaaagugcuaggauuacaagcgugagccaccacgccuggcc

SEQ ID NO: 4154207 - RNA, 55 nt, Human
ggccaggugacagaacucagagccuuuggcugcuucaggagaugucaccauggcu

SEQ ID NO: 4154208 - RNA, 93 nt, Human
ggccaggugcgguggcucacaccuguaaucccagcacuuugggaggccgaggugggcagaucacagagucaggaguuugagacuagccuggcc

SEQ ID NO: 4154209 - RNA, 81 nt, Human
ggccagugcggggucugcggcugcccggcgagguuccggcuuccccgggacuggcagggggagccccgagaacugcaggcc

SEQ ID NO: 4154210 - RNA, 83 nt, Human
ggccagugggagaaagguggccggugccagccgggccagacacccauaggccagcccuggccuggccgccagccaccugggcc

SEQ ID NO: 4154211 - RNA, 58 nt, Human
ggccagugggagcuucaucaagcaguuccugggaacuucuugcacagucccacuagcc

SEQ ID NO: 4154212 - RNA, 130 nt, Human
ggccagugggguccuuucuccauguucuguaggcucugcugaggaugguguggucuucucauugguaaaugggguccuuucuccauuuucuguaggcucugcuggggauaguguggucuucucauuggcc

SEQ ID NO: 4154213 - RNA, 69 nt, Human
ggccaguucaugaggccacaggaaagggcccgggcuucccgggucucuuggggccugugugcuagaacc

SEQ ID NO: 4154214 - RNA, 64 nt, Human
ggccaguuggagacccuuggaaagcccuucaagugagagcaugaggcuuggaucuagacaggcc

SEQ ID NO: 4154215 - RNA, 87 nt, Human
ggccauaauuccugagguuuggaucucugauacaacagguguuguauucaguuugauugucuacaaucucagaugauaaaacuggcc

SEQ ID NO: 4154216 - RNA, 76 nt, Human
ggccauacucuuuuguguauguacugcucuucauacuauaauagaauuuggcaguuuuaacagagguaguaugguc

SEQ ID NO: 4154217 - RNA, 80 nt, Human
ggccauagauuauaucauucuauuuauaugaaauuuccagaauaggcaaauucauagaagcagaaaguaaacuaguggcu

SEQ ID NO: 4154218 - RNA, 82 nt, Human
ggccauagcuacuucguaagucuguguacaaaaacauaauaaaacuguugucuguacaaauuuucugugucagcuguaggcu

SEQ ID NO: 4154219 - RNA, 63 nt, Human
ggccauccugcuagcccaggaugcagggacccccaggucccuucggccuggcugcagcuggcc

SEQ ID NO: 4154220 - RNA, 123 nt, Human
ggccaucgcagcuggaaaggcugguuuuuagccacaggagccaagggcccugcagacgcccgcucccgggugccucuccagaggucccuugucucuuuuggcacccuccugcuguaagcagcc

SEQ ID NO: 4154221 - RNA, 71 nt, Human
ggccaucuuggagccaggcggggcagguuuccugagccaggauuuauggccugccugccccauugacugcc

SEQ ID NO: 4154222 - RNA, 56 nt, Human
ggccaugcaccuauaugugaagcuuuauugauguuuaaacauaaccuuguauggcu

SEQ ID NO: 4154223 - RNA, 65 nt, Human
ggccaugcauuccuccucugccuuauaaaucuugaugugccagguacgggagggauugcuuaguu

SEQ ID NO: 4154224 - RNA, 121 nt, Human
ggccauggcaauugaaaacaaggcuaucagaagagcugugggugguaguccugucucugagaaaggaacagggccacuggcugacggcugcauuccagaacgccuccagaugcagagggcc

SEQ ID NO: 4154225 - RNA, 68 nt, Human
ggccaugggcaguuggcagggcucagaaaaagggcuucaugggcugugacggaucagcagcucuggcc

SEQ ID NO: 4154226 - RNA, 73 nt, Human
ggccaugguaaggcuuagauaagugaggauauguaaauagcaacugucaacauuuaucaaguuauugugugcc

SEQ ID NO: 4154227 - RNA, 59 nt, Human
ggccaugucccugggccuggcacucccuagcucggugggguguggccuggggacaggcc

SEQ ID NO: 4154228 - RNA, 81 nt, Human
ggccaugugggaaaguuaaguugguuuaaaaaauggagagaaacauugccuugucuguccauuuauaagcccccaaagguc

SEQ ID NO: 4154229 - RNA, 63 nt, Human
ggccauuggcagcgccagacaauuaacagucgaaaguaauugcucuuggccgugccagcagcc

SEQ ID NO: 4154230 - RNA, 89 nt, Human
ggccauugggcaccaaucuccuauuuuguuucaaagccuaaacagcggaggcagcuuuggaaauagauguaggaaauuggacaguggcc

SEQ ID NO: 4154231 - RNA, 81 nt, Human
ggcccaagaaugucaauuaccagaacagaauaacaaaauacaccgaauucuuaccuuuguaauguaauggacaacuggguc

SEQ ID NO: 4154232 - RNA, 60 nt, Human
ggcccaaggugccaaggccuccagaagaagagaagaaggagcaggcuuuggaguggggcu

SEQ ID NO: 4154233 - RNA, 113 nt, Human
ggcccaauccacuucuuggucacacugauagugguuaggaauacaggcccuggggucaaacugguugggucugaauuccagccccucuguguaccagcuuagugaccauggcc

SEQ ID NO: 4154234 - RNA, 86 nt, Human
ggcccacaagauuuucugccuuucucaagggcaaaagauuacuguuuuuacauguccuucaagagcaguggaucucugccugggcc

SEQ ID NO: 4154235 - RNA, 56 nt, Human
ggcccacagcaccugcagccaguugggagcuuccugcaaguccagggcugugaacu

SEQ ID NO: 4154236 - RNA, 75 nt, Human
ggcccacugcaggcuguguuuauaacuugaaaauuaugagcagguauugggagccacagacuguauuugggaacc

SEQ ID NO: 4154237 - RNA, 56 nt, Human
ggcccagaagccagaagccuccugaccacccccagggaugcuucuccagcugggcc

SEQ ID NO: 4154238 - RNA, 64 nt, Human
ggcccagaauacaugaaguauaaucaaagaaacaggguauuuggguuacuauggaauucgggcc

SEQ ID NO: 4154239 - RNA, 64 nt, Human
ggcccagagcucccuggcaccucuuggacacgaauacaccccuaaggaugcugacuucugggcc

SEQ ID NO: 4154240 - RNA, 107 nt, Human
ggcccagagggagagagacauacagggaggcugcaguggagcagggcaaccucacacuucugcuuccagcucucuguaaggucugacuucacuucucucguuggguc

SEQ ID NO: 4154241 - RNA, 83 nt, Human
ggcccagauucacaggugcagaggugcugaucuaucuaccuagugggucagagcagaccucuggaagcuguggcgucugagcu

SEQ ID NO: 4154242 - RNA, 59 nt, Human
ggcccagccucagacauucccuggcaccuccccagcagggcacagucuaaaguugggcc

SEQ ID NO: 4154243 - RNA, 108 nt, Human
ggcccaggaauccacauccgcucucuguagcaacuacucaacucugccauugugggaaagcagccauggacaguacugaguggacuaggauggcuguggucacgggcu

SEQ ID NO: 4154244 - RNA, 61 nt, Human
ggcccaggcaaguguggcuuacucagaaaccagucagaguggagaaacgcuucgucgggcc

SEQ ID NO: 4154245 - RNA, 73 nt, Human
ggcccaggccuggcuuugguuugcugaguauccaggcuagcagggagggccagugucaagaaagaggagggcc

SEQ ID NO: 4154246 - RNA, 57 nt, Human
ggcccagguccagcgaguaccuggaaacccaggcacacuguguccuggagcugggcc

SEQ ID NO: 4154247 - RNA, 120 nt, Human
ggcccagguuuuauuuaauucuuuucucugggcuguucugggaaauaucuuuuucucccuagaaacaugauaaccaggcugccgaggaaagaaagaaaagauagaaacucuuccugggcu

SEQ ID NO: 4154248 - RNA, 62 nt, Human
ggcccagugucaccaacaggacacucucugaccccugagugcgcccuguagugacuuguguc

SEQ ID NO: 4154249 - RNA, 86 nt, Human
ggcccaucucaauggccaccucauggauaagauaaacugaugguauuucaccaguuaaacuuugccagaugggauucagauaggcc

SEQ ID NO: 4154250 - RNA, 74 nt, Human
ggcccaugguguuugaugcuaaccccuagggcaaaagcugaucuuuuagguuaaucaacaaacauuuuuuggcc

SEQ ID NO: 4154251 - RNA, 67 nt, Human
ggcccauguacacucauguaacuauaugcagauuuaguguucuagaaugauaugagguacucaggcc

SEQ ID NO: 4154252 - RNA, 121 nt, Human
ggccccaccugaggcacagcgcugacucaucacggugguaccaguaggucagccaucuggaaacagaaguggcccuaauugggccaaaaugugguaagacucgcuggccucaggcagggcc

SEQ ID NO: 4154253 - RNA, 87 nt, Human
ggccuagggaggggccgaugagaaaguccuagggguugcggggaagccacaaccucccuggccuucugauucccucucucugaggcc

SEQ ID NO: 4154254 - RNA, 103 nt, Human
ggccuaguaaaguuuggggacuuugaucuuaccauuauuagguggacuugagaucuuuucuuguaccaggugauggagucauaucuucacuguugccagggcu

SEQ ID NO: 4154255 - RNA, 74 nt, Human
ggccucaguguuccugaugcuuugaaauucacguugaaaagcuggaauucauucuuucgguuaacuugacugcc

SEQ ID NO: 4154256 - RNA, 65 nt, Human
ggccucaguuucuugugaaaugaaaucugguuucuugauggaaagggccucacaggucucaggcc

SEQ ID NO: 4154257 - RNA, 57 nt, Human
ggccucaugcuucugaacucacugcucagaaugagaaguggggucucuguggaggcc

SEQ ID NO: 4154258 - RNA, 55 nt, Human
ggccuccaccgucuggcccugucggcugaguggugcccagcaaggugagaaggcc

SEQ ID NO: 4154259 - RNA, 69 nt, Human
ggccuccagguuccgcgagaagggucgguauuaaaggauuccuuggagcggucagcacugguccgggcc

SEQ ID NO: 4154260 - RNA, 71 nt, Human
ggccucccaaagugcugggauuacaggcaugagccacgaugccuggacuguucuaccauuuuuuauaggcc

SEQ ID NO: 4154261 - RNA, 71 nt, Human
ggccucccugcaguaguggcuaagaucaucugugaguuuauccuacugagcuguuaggucccaagagagcc

SEQ ID NO: 4154262 - RNA, 74 nt, Human
ggccuccggccucggcgcgggcucagccgcccggggcugggcgcggcagcuccgcgccguaggacgagggggcc

SEQ ID NO: 4154263 - RNA, 56 nt, Human
ggccuccuaucguuucaaaacacagcuucuuguugaugaagaggaagaggacggcc

SEQ ID NO: 4154264 - RNA, 56 nt, Human
ggccuccugcuucacgggcaccgccaccuccauggggccucccggaccgcagcgcc

SEQ ID NO: 4154265 - RNA, 68 nt, Human
ggccucuccagguaauuuggaugcuaguuaaaguuuaauagccacugcucuaaauuaucuccaaggcc

SEQ ID NO: 4154266 - RNA, 58 nt, Human
ggccucucggaugcaucuggaguguucuggggcugggcaccaggccuccugggagguc

SEQ ID NO: 4154267 - RNA, 63 nt, Human
ggccucucuggcauggcugccccaggagaaugggcagguaguuaauuuccggugaggggggcu

SEQ ID NO: 4154268 - RNA, 66 nt, Human
ggccucugcagcgugcaggcuggugcucuuccagcauuuccucaaucacgcugacacccccaggcc

SEQ ID NO: 4154269 - RNA, 58 nt, Human
ggccucugcaggccucgacaaggcccagccuccugccucccgaaggccugcacaggcc

SEQ ID NO: 4154270 - RNA, 58 nt, Human
ggccucugcaggccucgacaaggccuggccuccugccucccgaaggccugcacaggcc

SEQ ID NO: 4154271 - RNA, 77 nt, Human
ggccucuggaucuggcauuuagacccacagcaacagcuuguguuugcucagggcuaagaaugcaggacucagacacc

SEQ ID NO: 4154272 - RNA, 57 nt, Human
ggccucugucaggugaacgcgcuccugcgggagcagcuggaacauaugaagaaggcc

SEQ ID NO: 4154273 - RNA, 108 nt, Human
ggccucuuaauaaauucaacuuuucauugugugguguuauucuucuucaagaaauggauuagaaauguuaccauacagagcuagaagucaugaauuaauuaggaagcc

SEQ ID NO: 4154274 - RNA, 79 nt, Human
ggccugaaggaugaugguuuuguccucuuugguucucaccugcuugagaaguaaaacaguaacuuuguucuucugggcc

SEQ ID NO: 4154275 - RNA, 61 nt, Human
ggccugacauuugcaucaacacagaugaacugugaggauguuuuuuuaggugaaauaggcc

SEQ ID NO: 4154276 - RNA, 102 nt, Human
ggcgugguggugcaugccuguaauccccgcuacucgggaggcugaggaaggagaaucacuugaaccgggaagguggagguugcagugugccaagaucgcgcc

SEQ ID NO: 4154277 - RNA, 80 nt, Human
ggcguuggagucuucagauagaguauuuaagguaacgauauuaacauauucagaaagcuagaaaugaaaauuccaaagcu

SEQ ID NO: 4154278 - RNA, 99 nt, Human
ggcguuuccucccgggcucccuccauccccccaggcaagcaugacacaugugucuugagggggauggaguguacuggggaccagaugggaagcugagcc

SEQ ID NO: 4154279 - RNA, 58 nt, Human
ggcguuuuuuuggggggaucagggaugggugagagcucuacugcuuacaaaaauaccc

SEQ ID NO: 4154280 - RNA, 61 nt, Human
ggcuaagaucucuuccagccugaaauuuccucaacucgaaggcaggaaugagguaauggcu

SEQ ID NO: 4154281 - RNA, 58 nt, Human
ggcuaagcacagugccuggcucugggucagcuuugcccaugugcaggcuguuauagcc

SEQ ID NO: 4154282 - RNA, 95 nt, Human
ggcuaaggcggguguaucaccugaggucaggaguucaagaccagccuggccaagauggugaaaccccgucucuacuaaaaauacaaaaauuagcc

SEQ ID NO: 4154283 - RNA, 58 nt, Human
ggcuaaucucuucuuaaugauuacaaaauggacauuaaucaggagcugagguuuagcc

SEQ ID NO: 4154284 - RNA, 68 nt, Human
ggcuaauggcuaaauauucggaggagcuguaagugcagacccugacucuaaugcuuggcuuuauagcc

SEQ ID NO: 4154285 - RNA, 63 nt, Human
ggcuaauugguguugaauuuucuuaccaagcugucucacagugacucugcaccaaauuaagcc

SEQ ID NO: 4154286 - RNA, 70 nt, Human
ggcuacaaauauaaaacacagauacucucuaaaggcucacaagggauuguguguguguguguguuugucc

SEQ ID NO: 4154287 - RNA, 67 nt, Human
ggcuaccaguauugaucauugcaagaacauugcaagcuuagcaagaaucagcugcugggucauagcc

SEQ ID NO: 4154288 - RNA, 85 nt, Human
ggcuaccggugcugccuugguucccagccagcaaggaccugauugguaguggggcaugaauagagcuaagaggggcccggagacc

SEQ ID NO: 4154289 - RNA, 78 nt, Human
ggcuacuccgcccagcugagaagcgcggggcccugacgcgggcgcgcuccucgcauucuuccguugggcugggaggcu

SEQ ID NO: 4154290 - RNA, 65 nt, Human
ggcuacuugcuggguguaauuuucuuugagcuauuuuauaaagaugauuaaugacagcaugugcc

SEQ ID NO: 4154291 - RNA, 55 nt, Human
ggcuacuuuguuuaaguugccaugggaagacgguggcagcuauuacaaggaaguc

SEQ ID NO: 4154292 - RNA, 66 nt, Human
ggcuagaaagcccccgcuggcgcacgcugggccacugguccauuugcccuguggggauuuccagcc

SEQ ID NO: 4154293 - RNA, 61 nt, Human
ggcuagaacuuuacacuuugcauaggccuccaaucuugagaacaugcauuguaggcuagcc

SEQ ID NO: 4154294 - RNA, 55 nt, Human
ggcuagagcucucuuacaugggauuauaaaagaaaccccagagagaucucuugcc

SEQ ID NO: 4154295 - RNA, 67 nt, Human
ggcuagcugacagugcacccagggcuggcaggggcaggcugggcagcagcuguuaagcagggaggcu

SEQ ID NO: 4154296 - RNA, 61 nt, Human
ggcuaggcaauguucuaaggaaugaggauacaacagcucaccgagauauacagugccugcu

SEQ ID NO: 4154297 - RNA, 82 nt, Human
ggcuaggcacuacaaggacuaggcuggccccuucuggaauucuguccaaaagucagucucuccuagcucugugguaucagcc

SEQ ID NO: 4154298 - RNA, 70 nt, Human
ggcuaggcucaccuggagaguugagaauagaaugacaaaccuacagauuccccuggguggggucuaaguc

SEQ ID NO: 4154299 - RNA, 55 nt, Human
ggcuagggaaauccugauccaaggaagaccuuugaucucauuguucuccucagcc

SEQ ID NO: 4154300 - RNA, 68 nt, Human
ggcuaggggaagggcacuccuuggcagcucugcccaggguagaaccuccagaguggcccccucuuucc

SEQ ID NO: 4154301 - RNA, 69 nt, Human
ggcuaggggagccgagccacauucaaucugcauccugcuccgcgucugacaggcuuugcuccuucugcc

SEQ ID NO: 4154302 - RNA, 62 nt, Human
ggcuaggugcagcagacagcuuaggggcuuugaagucaaauacaugggccugcauccuaguc

SEQ ID NO: 4154303 - RNA, 66 nt, Human
ggcuagugguguggaaggggcagggaauggaggagcccaagccuuccuucaagcacacaucuagcc

SEQ ID NO: 4154304 - RNA, 112 nt, Human
ggcuaguuaaugcuaaauugagguuuaaaauaauuauaacaguuacaucuuacauaucaggugagaugucauaguucaguucagguaauuuucguguggcagugagcuaguc

SEQ ID NO: 4154305 - RNA, 61 nt, Human
ggcuauaugacauugcuuuuuagaacuuaucugugaguuuuauguagacaauucauuugcc

SEQ ID NO: 4154306 - RNA, 71 nt, Human
ggcuaugaaagcaaugggucuaagguaaaguggcaacaucuuugauaaaagacaccauguuugccuuagcu

SEQ ID NO: 4154307 - RNA, 92 nt, Human
ggcuauggacagcuuucaacacugccuucuuggccuucaaaaccuucgcuuugguuuuggcuuuaggaggggcaggagcuuucuucuuugcc

SEQ ID NO: 4154308 - RNA, 76 nt, Human
ggcuauguacauucaugguuccaccagggcacaggaauauuuuagacaugcccauggaagaacugaugugccagcu

SEQ ID NO: 4154309 - RNA, 74 nt, Human
ggcuauugugaauagagcugcaguggacauugguguacaaggaauugagucgcugcuuucuauucuuuuggguc

SEQ ID NO: 4154310 - RNA, 79 nt, Human
ggcuauuuucauugauucuaccagcuacuuugacagacacguucaaaagugauauguggagccuucgagaggaaaagcc

SEQ ID NO: 4154311 - RNA, 90 nt, Human
ggcuauuuugagaagucuugcagugucuaacagauuuggguucagauaauauuuucaaucuaagggaaauuggagauguaaaggauaguc

SEQ ID NO: 4154312 - RNA, 64 nt, Human
ggcuauuuuuuguuaguggagaauaauggggucuuuugcauuuucuuccaccaauauccaagcc

SEQ ID NO: 4154313 - RNA, 120 nt, Human
ggcucaacaggccccagagccugccuggugucucccucuguaagaucagggguugccucugagcuccagccaggacccugcgccugcucuucagaagggaggggcucucccuguugggcc

SEQ ID NO: 4154314 - RNA, 67 nt, Human
ggccccagcaccacaucaggcccacgaggcccagcucauguggcccugacacgugguacuggaggcu

SEQ ID NO: 4154315 - RNA, 63 nt, Human
ggccccagcagugcuuguuuauuaauuacccuaaugauaacaacagcagugcuggcagcagcc

SEQ ID NO: 4154316 - RNA, 63 nt, Human
ggccccagcucccugguauuugugcuacagaacucuggcaggcacccagggacuuggcuggcc

SEQ ID NO: 4154317 - RNA, 57 nt, Human
ggccccagcuguggugaauagaucuauucacauugaucauguucuacuucaggggcc

SEQ ID NO: 4154318 - RNA, 65 nt, Human
ggccccagcuugcccaggacugagggcuugagagaguccuuggcaaaccagggcagcuggucacc

SEQ ID NO: 4154319 - RNA, 65 nt, Human
ggccccaggaccuccacgguccucugaauagugucaguggcaugagccuagaggucuuaugggcc

SEQ ID NO: 4154320 - RNA, 83 nt, Human
ggccccaggcagugcugcaggcgccugcggucccugcugaccccgugucaccacugccggcgccugcggucccuccuggcccc

SEQ ID NO: 4154321 - RNA, 107 nt, Human
ggcccccacccucggcagugguccuggacuuaggcaggcaccccgugcccacgugcaugggacacccucacgccugcacuagauccccagugccagggcuggaggcc

SEQ ID NO: 4154322 - RNA, 82 nt, Human
ggccccccggggcguaccugucucuuauggucgagucugcagagaugaaauacacuccagucucccauagcgcucccaggcu

SEQ ID NO: 4154323 - RNA, 103 nt, Human
ggcccccuccuccuucccuugcuuccacuuucaguuggguagaucuuucugugaucuuagaaaacacguguuuagcugauggacaguaggaagagugugggcc

SEQ ID NO: 4154324 - RNA, 65 nt, Human
ggccccgggaacauaaagcagugaggaagggaagccauuuggcagcugcguuguguuucugagcc

SEQ ID NO: 4154325 - RNA, 72 nt, Human
ggccccgucguggggccagggaugacccacgcagcaggugguggggcggauccgggggccucgggcggggcc

SEQ ID NO: 4154326 - RNA, 58 nt, Human
ggccccguggagcuggacccaggccucugaggaggggccacaggccgguuccagggcc

SEQ ID NO: 4154327 - RNA, 122 nt, Human
ggccccuaaauuuguaguuccuggguagggauuuguuuguucggcuugauuucuaaucuaauuuggguucugggcucaaauccuggcccugacaaggacuggcugugagaccuugggugguc

SEQ ID NO: 4154328 - RNA, 56 nt, Human
ggccccuggaaaugagugccugggcuuucuucuguccagccucagaucagggagcu

SEQ ID NO: 4154329 - RNA, 71 nt, Human
ggccccuguuauucuugguggcccugcugaaacuuguucuuaguauugucaccugggugaagccuggggcc

SEQ ID NO: 4154330 - RNA, 64 nt, Human
ggcccgaauccccgccuuuccgagcggggacgcugauaggugcagaggcgggguuuuggaggcc

SEQ ID NO: 4154331 - RNA, 107 nt, Human
ggcccgagccaccacugcccugcacgccuggaagagcaggcagacaaugccgaggugcuagagaaacccagccgcugggccugccugcugugugcaaguucugggcc

SEQ ID NO: 4154332 - RNA, 58 nt, Human
ggcccggggguugggugauauccccggcuacagcugaauuucacagacuuacugggcc

SEQ ID NO: 4154333 - RNA, 64 nt, Human
ggcccguagauccccggaagcgccuuugguugccagcaggugucggcgagggucuucaguggcc

SEQ ID NO: 4154334 - RNA, 75 nt, Human
ggcccuagcgggucuugcagagucaaccugccuugagaagggcagccaggcucaaggccugcuccuagaagggcc

SEQ ID NO: 4154335 - RNA, 72 nt, Human
ggcccuaggaagccugcugugcacagcagugauuaggaagcugaguuaugcuggggcagaggcccgaggguc

SEQ ID NO: 4154336 - RNA, 55 nt, Human
ggcccucauuccugauguggcgcccuccagacauggcugcccaggaaggacggcc

SEQ ID NO: 4154337 - RNA, 78 nt, Human
ggcccucccugcuugcucucagcccuuggcugccuggggggcaugcagaaggagugcugaaaggaagcggagauuucc

SEQ ID NO: 4154338 - RNA, 81 nt, Human
ggcccucgcauacaaggaguuuggggauuagucaggagcccgauaaacagcucaggaaucacaaaacuccaugugagugcu

SEQ ID NO: 4154339 - RNA, 61 nt, Human
ggcccucuuuuauccaucauaaaucaucaucagauuuauacuuuguuagcaaaagggggcu

SEQ ID NO: 4154340 - RNA, 56 nt, Human
ggcccugcaagguacccaggcccacaaacaaaagcaauggguucugcccacgggcc

SEQ ID NO: 4154341 - RNA, 66 nt, Human
ggcccugccugcugcccuccagagccugagaacacaugacuucagccuuaaacaucaggcaggguc

SEQ ID NO: 4154342 - RNA, 78 nt, Human
ggcccugcucacuaagcccuggagcaaaggugucuuauucucaagaacacaaaguucucaugggugcuagcagaggcc

SEQ ID NO: 4154343 - RNA, 62 nt, Human
ggcccugcucaggcugcgaugaaaaugcgaagcaccuacuauuuucagccugagcagcugcc

SEQ ID NO: 4154344 - RNA, 112 nt, Human
ggcccuggaaguggggggcagagaugugggucagaauccuacacagccccucaaagucuccacuguacugauuccccacacugccgaucacuuucuguguaacucaagggcu

SEQ ID NO: 4154345 - RNA, 63 nt, Human
ggcccuggcagccacgaaagcccuccagaugccuugaggacgccgucucuagccgggugggcc

SEQ ID NO: 4154346 - RNA, 61 nt, Human
ggcccuggccucucugagcagggagcaggaguccugccucccuguagaggccagccuggcc

SEQ ID NO: 4154347 - RNA, 95 nt, Human
ggcccuggcuccaacucugugucucugccaucucacuggguccugaaaugucagccugugucuguggcgugaggcucggcuuugccuccugggcu

SEQ ID NO: 4154348 - RNA, 72 nt, Human
ggcccugggguccuugccaugugucagcagcugcguugcuguguccugagaucauguguggaccccagggcu

SEQ ID NO: 4154349 - RNA, 55 nt, Human
ggcccuggucauuuugggaggauccuaggagaucuucaaagggauguccaugguu

SEQ ID NO: 4154350 - RNA, 74 nt, Human
ggcccugucccuguguggguggggccucuuccauuucccugacuuagaaaccacacuccacuuagaacaggguu

SEQ ID NO: 4154351 - RNA, 57 nt, Human
ggcccugugugaaaggaacacuugcucaggauuccuggauuuaguucuucacaggcc

SEQ ID NO: 4154352 - RNA, 60 nt, Human
ggcucagaggccagcagguagaagacaaucucagucaaauucauauuuuugcccugggcc

SEQ ID NO: 4154353 - RNA, 65 nt, Human
ggcucagcuacuaugugaaagccaggccaggcaggccuugccagcugcaaaguauguugaaagcc

SEQ ID NO: 4154354 - RNA, 58 nt, Human
ggcucaggaugagccuucucauugaacuaaauccaggaagaagcaucauucugauguc

SEQ ID NO: 4154355 - RNA, 100 nt, Human
ggcucagggcuccccucuuacaagcucgggcagcucauuaaggaaaauuccccguaacuguuugccugggcucagucaguguacagacccaaacagagcc

SEQ ID NO: 4154356 - RNA, 60 nt, Human
ggcucaggggccaggccugucccccagaaaccugccuugagaccucuggccccuuagacc

SEQ ID NO: 4154357 - RNA, 75 nt, Human
ggcucagugcagccuuucuguaucucacuguauucugcaagaugcuccugugaagaaaguugugcugcaucagcc

SEQ ID NO: 4154358 - RNA, 76 nt, Human
ggcucagugggguggaggagggcacaggucauucuggagcacuggggggccucucccuucucacgcaucaacagcc

SEQ ID NO: 4154359 - RNA, 81 nt, Human
ggcucagugucugggcucagaggcagcuggccuuugauccaggucccagacauaggcugccucugaugugcagacgaugcc

SEQ ID NO: 4154360 - RNA, 87 nt, Human
ggcucauuccacuacaucaugcugugccaggagauggaacacuuuucccuguucuccacaagcugaugcuaggauccugaaugagcc

SEQ ID NO: 4154361 - RNA, 79 nt, Human
ggcucauuuuaacaugcaaaugguggcuaaauggauugcuaaauugugagucacuuuaguuuguaaccuaguuugagcc

SEQ ID NO: 4154362 - RNA, 111 nt, Human
ggcuccaagacagcuucaggaggaguggcuccuuacaaguuccaugaggucaaugggauauuguucugggaguccuuacugaaggcucuaccuagaguuguacuuucagcc

SEQ ID NO: 4154363 - RNA, 62 nt, Human
ggcuccagcugcccuuaauaggcauucacugaagauaguggaauucuggguagccugggacc

SEQ ID NO: 4154364 - RNA, 69 nt, Human
ggcuccaggagaugcugggcagccgcagaagccccuuccagggcccagggugcucagcuccugugaguc

SEQ ID NO: 4154365 - RNA, 129 nt, Human
ggcuccaguguuggcaggucuccuccuccaugcagcccucccagggaacuggcucugcuugggaagucuguggggucccuggggcagcagcugggugaguccuggaaucaauccucaugucuggcugcc

SEQ ID NO: 4154366 - RNA, 58 nt, Human
ggcuccaugcugagcuuugaauaccugauacagcugugucagagcaaggaaugggguc

SEQ ID NO: 4154367 - RNA, 61 nt, Human
ggcuccauuaaugagcaaagacaguuauacugaccagucuugaaauucuguuaaaggagcc

SEQ ID NO: 4154368 - RNA, 68 nt, Human
ggcuccauuuccuacagccaugggauaaggguugcauguaaacaauaauauccugugcuguuugggcc

SEQ ID NO: 4154369 - RNA, 76 nt, Human
ggcucccaccugcuggggcuguccaucagcacuaauacuggcagugccugaggccaggacccccagcaggccagcc

SEQ ID NO: 4154370 - RNA, 87 nt, Human
ggcuccccugugaaccugccucuguugggcauggucuggagggggacccuguucacaggaucaucuacagcagggcaggagggagcc

SEQ ID NO: 4154371 - RNA, 81 nt, Human
ggcucccuccgcaguuaucccaagacggacaccugcggcuucugcaggaacauagguuccuugggaacugccgggcgggcc

SEQ ID NO: 4154372 - RNA, 112 nt, Human
ggcucccuggggaaaaugcagagggccacagccauuccagggaggcugaggcuaagugugggcagccuugaaugcgcugcauugguccuaggcacucaguguccggggcgcc

SEQ ID NO: 4154373 - RNA, 61 nt, Human
ggcucccugggggucggagagucuagccuucugcagcguggcugccugccccucgggggcu

SEQ ID NO: 4154374 - RNA, 57 nt, Human
ggcucccuguucuauucccugggguucagcagccccccuaaaugguucagggauguu

SEQ ID NO: 4154375 - RNA, 68 nt, Human
ggcucccuguuuccugaugagcccagacuucgauuccguguggguuuaagaggcagcauguaagaguc

SEQ ID NO: 4154376 - RNA, 82 nt, Human
ggcuccgcucaugagguggccgaggagcaggacauggcacacucauucgccuguccuuccacauggccaacuucugcuggcc

SEQ ID NO: 4154377 - RNA, 84 nt, Human
ggcuccgggagaccuggagcgauugcgggggucagagguuagggucaagggucagaccucucugucgccgccccuccuggagcc

SEQ ID NO: 4154378 - RNA, 72 nt, Human
ggcuccucaggggcagccggggaagccagucccagggcacaggcuggcaucacacucugccucugagggacc

SEQ ID NO: 4154379 - RNA, 74 nt, Human
ggcuccucuagucacuucuggucccagugucacuugcaggauucugggucugggugugaucacauuagggggcc

SEQ ID NO: 4154380 - RNA, 81 nt, Human
ggcuccugagcuuccucucugcacuggcccugcccaguauccuaggcagauggggugacaagagagagagacacaggcccc

SEQ ID NO: 4154381 - RNA, 66 nt, Human
ggcuccuggcaucugguggguagaggcagagaugccgcaaaauauccuccaaugcacgggacagcc

SEQ ID NO: 4154382 - RNA, 76 nt, Human
ggcuccugggaaggcugugccagaagaacuggaggauucugauagccuggaaguucugggccagcccccagguguc

SEQ ID NO: 4154383 - RNA, 62 nt, Human
ggcuccugucuguaucccuguugguaacacugcguacaccagugggauggggacuuugggcc

SEQ ID NO: 4154384 - RNA, 58 nt, Human
ggcuccugugccauccugagcaucccuuugauggaaagggagguggcagcaggaagcc

SEQ ID NO: 4154385 - RNA, 62 nt, Human
ggcuccuucacuccuccacccccgggggggauacuccuugggccuggcccuguggaggagcu

SEQ ID NO: 4154386 - RNA, 98 nt, Human
ggcuccuuccuccucgugacucaccugggccucacccagcucuugccugccugcgggaucaugggugaggcccauggguuucgggggcuuccccagcc

SEQ ID NO: 4154387 - RNA, 86 nt, Human
ggcuccuugaugaauugaauucauuuacucaaaugugcaggcuuaaacuuugcagaaaugaaauugaaugaccaucaagagaagcu

SEQ ID NO: 4154388 - RNA, 56 nt, Human
ggcucgugcgucacugcuauucaucuuguuuagugcuuggcuuggcugcagaugcu

SEQ ID NO: 4154389 - RNA, 57 nt, Human
ggcucuacacuagaccuacugaauuaagaaaucuagguugaagagucagguagggcc

SEQ ID NO: 4154390 - RNA, 56 nt, Human
ggcucucucuuggggauucagcagugaacaaagcaguguggccucuagagacagcc

SEQ ID NO: 4154391 - RNA, 85 nt, Human
ggcucucucuuuucuccagcuccccucagcagguaaucuauauaauagauuaccugcugaggggaagcuggggauagagaggacu

SEQ ID NO: 4154392 - RNA, 64 nt, Human
ggcucugaagauuaccagcuaaaugaucuuaccaaauuauuuagucucucuggcuucaguuucc

SEQ ID NO: 4154393 - RNA, 79 nt, Human
ggcucugaccugagaccucuggguucugagcugugauguugcucucgagcugggaucuccggggucuugguucagggcc

SEQ ID NO: 4154394 - RNA, 71 nt, Human
ggcucugcagggguggcugcagcagagguggcuuguucagggaagcuaccugcuccauccgugcugggacc

SEQ ID NO: 4154395 - RNA, 72 nt, Human
ggcucugcccagaugaagaggacauacaaaggguuggcaacucuuaaaguuucucuccauggguaagagacu

SEQ ID NO: 4154396 - RNA, 57 nt, Human
ggcucugcgcgguaaagugacucacugaaggucacacagccaaguagugacagaacc

SEQ ID NO: 4154397 - RNA, 88 nt, Human
ggcucugcuccccaggcugccugaggcugaggcccgucugcccccgcugcugcgugggcucccccugaggcagcgagggggcggcgcu

SEQ ID NO: 4154398 - RNA, 60 nt, Human
gggagggaggagccccggccauccccacccucguggauguaacugguuuucuucccucuc

SEQ ID NO: 4154399 - RNA, 76 nt, Human
gggagggaggaugggagaagaaugagagaaauauauagaguauaaaguucuucuuuaucucaguauccucuuaccc

SEQ ID NO: 4154400 - RNA, 67 nt, Human
gggagggaggcgacuuguccaaggccacaaagauggcaaauggcagaaccaggucugucugccuccc

SEQ ID NO: 4154401 - RNA, 115 nt, Human
gggagggaggguaaaagauuccagccucuuaauuuaaugucaacauuucugaagagcccuuauagcuccagagcucuucacaggauggcagaggcuguuauguauccucucucuc

SEQ ID NO: 4154402 - RNA, 79 nt, Human
gggagggcaagagaggaagagauggcagcuuuuuaagugaaauuuuaaucuuaucuaucuuuuguucauuuugaguccc

SEQ ID NO: 4154403 - RNA, 118 nt, Human
gggagggccagcucuguggcggugcagggugcuggagguggccugcggcuugacugauucccagggccaggcuccacuguaggcagcuccacaucagcuaacacaggcugucccuucc

SEQ ID NO: 4154404 - RNA, 81 nt, Human
gggaggggaaagaggguaaaggauguaacaguugcuguguccuccugacacuuuacacaucuuuucucauuuaacccucuc

SEQ ID NO: 4154405 - RNA, 55 nt, Human
gggaggggaacguggggcagaugcacaggaaugugcucugcccaguugucugccc

SEQ ID NO: 4154406 - RNA, 71 nt, Human
gggaggggcagccauggaacuccaugggccaaagccccagggcauuaggaguuaauggcugguccuaaccc

SEQ ID NO: 4154407 - RNA, 75 nt, Human
gggaggggcuccagccaccacaccccugccaagcagcugcgccgggaugaggggucauuggcugggaaccuuccc

SEQ ID NO: 4154408 - RNA, 58 nt, Human
gggaggggguugggguccugccuuagggucaaccagagagcaucuccuuccuccugcu

SEQ ID NO: 4154409 - RNA, 72 nt, Human
gggagggguuugugggcuggcucugucuagaaaggccucaggcccuaggcuauccccagucccuuccuuccu

SEQ ID NO: 4154410 - RNA, 68 nt, Human
gggaggguggacaggcaggcugucggggccggccgcgugcccagagaaccuucugugccacuguuccc

SEQ ID NO: 4154411 - RNA, 56 nt, Human
gggaggugauacuuuuucaccuguucauugaucaauugagggaguauugauuuccc

SEQ ID NO: 4154412 - RNA, 75 nt, Human
gggagguggcacuggagucaguggcuauugggcaccucccagugcccuggagucaguggcuauugggcaccuccc

SEQ ID NO: 4154413 - RNA, 55 nt, Human
gggagguggcugcggcgcgugcucauuggcugguguauggcuugcagccacccuu

SEQ ID NO: 4154414 - RNA, 90 nt, Human
gggaguaagucccauucacuaggcccaugauauguguucuauuuuaacuuuuuagcacaaggcaauuccuggugaauuauuuaguuuccc

SEQ ID NO: 4154415 - RNA, 130 nt, Human
gggaguagagagucagucugagauaaggcauagaaguugaucaaguagcgaguucauguuuccuggccagguaaaggaauagaaagcuguugaaauuuuugggcaauguuuuaauuuuucucucucucuu

SEQ ID NO: 4154416 - RNA, 65 nt, Human
gggaguagcaggcugguccguccacauuccaucaggcccugggaaacuuggaugccagcacuccc

SEQ ID NO: 4154417 - RNA, 90 nt, Human
gggaguauguguguguguauauauguauguguguguguugcuaaaagugauuuacuacaguauguguguuauacuucaauaaaauuuucc

SEQ ID NO: 4154418 - RNA, 59 nt, Human
gggagucuagcgugaggucugccugucaccaucaggcaggcaggauggcaguggacccc

SEQ ID NO: 4154419 - RNA, 62 nt, Human
gggagucugaugucccccaggccaggaaacagaaccacugagucaaaggauaucagauuucu

SEQ ID NO: 4154420 - RNA, 90 nt, Human
gggagucuugcucugucacccaggcuggagugcaguggcaucaucucaacucacugcaaucuccaucuccuggguucaagcaauucuccu

SEQ ID NO: 4154421 - RNA, 65 nt, Human
gggagugagaacauacaaacagagaaagggauauuuucuuuauaaaguauguuuuauaguuuccc

SEQ ID NO: 4154422 - RNA, 77 nt, Human
gggagugagacacaagugaauauuuuaaggagguuuauaagauuaaacucuaaaauuucgacauuguaaucagcccc

SEQ ID NO: 4154423 - RNA, 67 nt, Human
gggagugucuggagggaagagaugucaggcugaccuagacuagauguccuuuauuccagugacugcu

SEQ ID NO: 4154424 - RNA, 56 nt, Human
gggagugugcagaagcugggggguaaaugcaaucuugagaaauucagcacaguucc

SEQ ID NO: 4154425 - RNA, 81 nt, Human
gggaguuauaugaagugucuguuguaucugggaaccucauuggaggcucauagauaguuuuagagauuucagauaccucuu

SEQ ID NO: 4154426 - RNA, 60 nt, Human
gggaguuauuacccugauuuucaaaugaggaaaucaaaaccuacagagguaaugacuucc

SEQ ID NO: 4154427 - RNA, 126 nt, Human
gggaaaaaucgaaaaacaaauguaagucuaaaucuccuuacagagaagaaaauguaguguggccuggccuaauauuacgacuuuuccaaggaguuacuauauaugguuuaacagaagauuauuucc

SEQ ID NO: 4154428 - RNA, 61 nt, Human
gggaaaaguccugacugcaggggaugcugagcgaggggcugcagaccccucaggaccuccc

SEQ ID NO: 4154429 - RNA, 67 nt, Human
gggaaaagucucucugugugggauaagaaaaauaauuugugauuccacgucagcagaggaaaccccc

SEQ ID NO: 4154430 - RNA, 56 nt, Human
gggaaaagucugcaagaaagcuuauccuccagaugggcugccuuuuaauucuuccc

SEQ ID NO: 4154431 - RNA, 81 nt, Human
gggaaacaagcagggagcaucaagggaggggccccugcucagcaucccuccuauuuggagcuuccuugucugaugucuccc

SEQ ID NO: 4154432 - RNA, 67 nt, Human
gggaaacacaagagcaaggugcugagguaaaaaacaccugaggcagcuuuuucuguguguuuuuccc

SEQ ID NO: 4154433 - RNA, 60 nt, Human
gggaaacagagugaagcugugaggucaucuuggaggagcucacaucuuuauuucuuucuc

SEQ ID NO: 4154434 - RNA, 62 nt, Human
gggaaaccaaucuauccuucauccugggguccaaaauucccagguaagagacggauuggccc

SEQ ID NO: 4154435 - RNA, 76 nt, Human
gggaaacccuaaagaauaauacccauggagcuuaauaaauaaggcccacagguccuaccucuuucucuuguuuccu

SEQ ID NO: 4154436 - RNA, 68 nt, Human
gggaaacuuugcaagguacuaacuguaagucccaugcugugcagucugccugugcaaaggaaaauccc

SEQ ID NO: 4154437 - RNA, 58 nt, Human
gggaaagaccuuccugggguguggccuuugucuguuuugucccgggugggcuguuccc

SEQ ID NO: 4154438 - RNA, 60 nt, Human
gggaaaggaaucauauccugugaaguacauuuccagguguaagacaugguccuacauccc

SEQ ID NO: 4154439 - RNA, 84 nt, Human
gggaaaggaggaggaaacccuguuccucugauguuugguggccugggugucagcaggcagcaugggacccuccugucugaucuc

SEQ ID NO: 4154440 - RNA, 55 nt, Human
gggaaaggguggccagaagaugggcuuugugcugucaacuuugcuacccuauccu

SEQ ID NO: 4154441 - RNA, 63 nt, Human
gggaaauaccuauuggcuaucugagagacugauccccaucucucagacuccccaugguuuccc

SEQ ID NO: 4154442 - RNA, 60 nt, Human
gggaaaucucguccucuauuuacccuucguuuugaagaugggugcaaugacaugauuccc

SEQ ID NO: 4154443 - RNA, 68 nt, Human
gggaaauucaggacaaagacucuuguguuuuaaaacaugcucaagucucuuuucuuccuguauuaccc

SEQ ID NO: 4154444 - RNA, 59 nt, Human
gggaaauucuuagaaagcaaugcuuugcaaccacaaugcaucaaagucugaaauuucuc

SEQ ID NO: 4154445 - RNA, 70 nt, Human
gggaaauuucaaggggcauugugaguaauaggaguuuucuucuccuugcagcauccuuugcugguuuccc

SEQ ID NO: 4154446 - RNA, 105 nt, Human
gggaaauuugcaaagguguaaggaaauugaguccgcucaggccaggcauaggccugugugaggcuugggcauggcuccugucuuacucccuugcuaaugcugccc

SEQ ID NO: 4154447 - RNA, 55 nt, Human
gggaacacagacuugaugaugauuccugguuccgagcucaugucacugugcuccc

SEQ ID NO: 4154448 - RNA, 89 nt, Human
gggaacagaaaaacgaguucaucugcucugugguccaugagacagcgacuggcucacagaccgucaaguaacuguugucuguaaauccc

SEQ ID NO: 4154449 - RNA, 83 nt, Human
gggaaccaagcagguaguuagaagagucuauuaccugccuagaaaagcaaaauagauuugaauuuaagacuugcaugcuucuu

SEQ ID NO: 4154450 - RNA, 57 nt, Human
gggaacccaugauuaugguuagguccuauggggaucguugugagaacuuggguuuuu

SEQ ID NO: 4154451 - RNA, 59 nt, Human
gggaacccuaucaugguagaacaggaaucugauuuuguuauuaucuguuagguguuccc

SEQ ID NO: 4154452 - RNA, 72 nt, Human
gggaaccuccauacuguguuccaugguggccgcaccaacuugcauucccaccagcagugugcaaggauuccu

SEQ ID NO: 4154453 - RNA, 55 nt, Human
gggaaccuuugugcuccacuggguuuucccagcaguuguuggugcacaucuuccc

SEQ ID NO: 4154454 - RNA, 83 nt, Human
gggaacucaagauggguauagacuuucugaaauacauuuucacagagaacuauaauccaucuuccagaagagccagagauucc

SEQ ID NO: 4154455 - RNA, 56 nt, Human
gggaagaggcagacuggaaaccugggccgguccagcccaggcagcagcaucuucuc

SEQ ID NO: 4154456 - RNA, 61 nt, Human
gggaagcaucugaggguccacuugaacuccagugaaaauggcuccaggauuagaugcacuc

SEQ ID NO: 4154457 - RNA, 61 nt, Human
gggaagccaugcucagagguacaucucuaugcucuuucuaccucuaguaauaaaguuuccc

SEQ ID NO: 4154458 - RNA, 77 nt, Human
gggaagcggcggcacgggaggcguccucgggagccggggucucacgguccagggaacgcccccgccgccggcuugcu

SEQ ID NO: 4154459 - RNA, 75 nt, Human
gggaagcuggagcugggaguccugggcugcugggugaccucugcagaccccuccucucugggccuuagcuucucc

SEQ ID NO: 4154460 - RNA, 66 nt, Human
gggaaggaaggagggagcggcgcggauucugccucugcagcagagcccccaucccucuuuccgccc

SEQ ID NO: 4154461 - RNA, 55 nt, Human
ggcucuggggaagcucucuucagguauccccuugaggagugccagccguggaguc

SEQ ID NO: 4154462 - RNA, 59 nt, Human
ggcucuggguucugcaaugcguacuacaggaaucauugaacuacgcaugagcccgugcc

SEQ ID NO: 4154463 - RNA, 96 nt, Human
ggcucuggugacaccuugauuucagacuucagaacugauaccauaaauuucuguuguucuaagucacucagauuuugguacuuuguuacgguagcc

SEQ ID NO: 4154464 - RNA, 59 nt, Human
ggcucuggugugaagcagccuccaugaggucacacagguagcugcggcaucccagggcc

SEQ ID NO: 4154465 - RNA, 58 nt, Human
ggcucugugguggagugggucaccccccugggcguccccaucauccagccguaucgcc

SEQ ID NO: 4154466 - RNA, 69 nt, Human
ggcucugugugguauacagcaacacaguuugagauauuucugugauguucuguauaucauauaguugcu

SEQ ID NO: 4154467 - RNA, 63 nt, Human
ggcucuguuguauuuccaacuauguaugguaugugguuguuuuagauacacccugcaguagcu

SEQ ID NO: 4154468 - RNA, 111 nt, Human
ggcucuucuucagucacuucccaucuccccagccuugccucugcuuacuggaguguuacucugaggguuguagagagggacggagugagggggaagugauuguuggugguc

SEQ ID NO: 4154469 - RNA, 62 nt, Human
ggcucuugggagcucagaguugaagcuuuuucaaugguauuuacucuggugcuccaagagcc

SEQ ID NO: 4154470 - RNA, 55 nt, Human
ggcucuuuggcgggccuugaacuugcuggaaaagaccaggccugcacacagggcc

SEQ ID NO: 4154471 - RNA, 84 nt, Human
ggcucuuuugggaaccagagacucuuucuaguccugaaugugugguugggggcaggagguguucucuuuuuccuucucuggguc

SEQ ID NO: 4154472 - RNA, 58 nt, Human
ggcugaaacucuuuugcauauuagaggcagaagucucucuuggcuuaggaguguagcu

SEQ ID NO: 4154473 - RNA, 75 nt, Human
ggcugaaauaaaacuuuuucuaaugcaguguuugcaaugcaagauauucuauguagaaugagcuuuauuacaguc

SEQ ID NO: 4154474 - RNA, 65 nt, Human
ggcugaaaucauuccagaacuuuuagagcuacauggaagcucagaaauguucuaaugauucaguc

SEQ ID NO: 4154475 - RNA, 59 nt, Human
ggcugaagaacugggagucucauuuauugaguugugaccaucuuucaguaauuucagcc

SEQ ID NO: 4154476 - RNA, 73 nt, Human
ggcugaaggaguggaguugaguugauggauucuugauccuucuuggagucuaaucccucaucuucaaucagcc

SEQ ID NO: 4154477 - RNA, 77 nt, Human
ggcugaagugcaguggcgugaucuuggcucguugcaaccuccaccucccggguucaagagauucuccugccucagcc

SEQ ID NO: 4154478 - RNA, 99 nt, Human
ggcugaaugucagaagcccuggggauaucaaacccacuguucuggggugagagcucugcagcagcagacauuugaucuucccuguuuccuuggccagcc

SEQ ID NO: 4154479 - RNA, 73 nt, Human
ggcugacaucugucauaaaauguauaaacaagaaaaccaacaauauauauauuuuuugagacagagucuugcc

SEQ ID NO: 4154480 - RNA, 67 nt, Human
ggcugacccugccaugagugacagggacuuucuucuccuugacugccuucaggcugggacaucaguc

SEQ ID NO: 4154481 - RNA, 127 nt, Human
ggcugagagucaggugccaggcuuugucugaauuccagccugcuggaugggcugucccccaggaaguccucucuggggcuagaauccugcaggaacuggggaagagcuguuugcacacacuccagcu

SEQ ID NO: 4154482 - RNA, 60 nt, Human
ggcugagcuuuucaugaugguuccugcugaccuggaaacaucuuaaauggaagguuagcu

SEQ ID NO: 4154483 - RNA, 120 nt, Human
ggcugaggaaaaaggguaacaccgugagucaugagcugcugggagccugucgucuuggauauggcaggacagucccaguucaaacauucuggccuuuuuaccguuugguucacucagacc

SEQ ID NO: 4154484 - RNA, 76 nt, Human
ggcugaggcagguggaucaccugaggucaagaauuugagaccagucugaccaacauggugaaaccuugucucuacu

SEQ ID NO: 4154485 - RNA, 93 nt, Human
ggcugaggcaugaggaucgcuagagccuaggaguuugagacuagccugggcaauauagugaggcccugccucuggaaaaaaaaaaaaaaagcc

SEQ ID NO: 4154486 - RNA, 74 nt, Human
ggcugagggucaggggccaugggccaaggaggucagucagaucuccuuggaucuggaggcccuggcuuucagcc

SEQ ID NO: 4154487 - RNA, 70 nt, Human
ggcugaguccacauuccuggguagauccgugauacacagaauguaaggcccauggagucuggaucuggcc

SEQ ID NO: 4154488 - RNA, 82 nt, Human
ggcugagucuuucucggagggagggcaugcuggcagacagagcuuuguaaacagcauccuccuucccagagaugcuucugcu

SEQ ID NO: 4154489 - RNA, 61 nt, Human
ggcugaguguccuuuuauuagucugagccccuagagagaccaaagaggcaacccucgagcc

SEQ ID NO: 4154490 - RNA, 67 nt, Human
ggcugauacuuccagcuccucucuaaugaacacaaacaccuuauuauccaaagagcugggagcaggc

SEQ ID NO: 4154491 - RNA, 62 nt, Human
ggcugauagacaaucaccaugggaauaggaaugucucucucccaucuauugugaucaaugcc

SEQ ID NO: 4154492 - RNA, 64 nt, Human
ggcugaucauuagcuuuucaaaggagucuaggugaauuuuaaagugauauggcuaugaacaguc

SEQ ID NO: 4154493 - RNA, 57 nt, Human
ggcugaugagcccacagagugcagcccggaugggaccaccugugagacucucagacc

SEQ ID NO: 4154494 - RNA, 64 nt, Human
ggcugaugaguuaguauuagucacuuccugaaaggauaguaucacacuguucuaacuugcagcu

SEQ ID NO: 4154495 - RNA, 63 nt, Human
ggcugaugcaggguugagaggagcugguuuccuccuuccucucucauccuugcaggcuuagcc

SEQ ID NO: 4154496 - RNA, 69 nt, Human
ggcugaugcugcuuugggguuuggaaguacagccccaacaacugggcuguucccacaccagccucagcc

SEQ ID NO: 4154497 - RNA, 73 nt, Human
ggcugcaccugcugccauuagggcacagaccccagcuaauggcaugucuucugcccaggcagacggagcagcu

SEQ ID NO: 4154498 - RNA, 56 nt, Human
ggcugcacuuggugaggcagcccacagccaggggcccgauugccuugcugucaguc

SEQ ID NO: 4154499 - RNA, 60 nt, Human
ggcugcaggcugcaggucugggucaugucuauucuacgugucucauucugggguccagcc

SEQ ID NO: 4154500 - RNA, 64 nt, Human
ggcugcagggugaagggaugugucucacccagggaaagcagagcacacacuuugaucuugagcc

SEQ ID NO: 4154501 - RNA, 106 nt, Human
ggcugcaguacaguggcaucucggcucacugcaaccuccgccugccagguucaagugauuugccugccucagccuccggaguagcugggacuacagaacuacagcc

SEQ ID NO: 4154502 - RNA, 67 nt, Human
ggcugcagugcugagggggaaggaaagcugaugugcaucacugccggucuccucaugcccuguaccc

SEQ ID NO: 4154503 - RNA, 55 nt, Human
ggcugcaguuugcacauccaaggccccagaugggccuuggcuggcaucuagcacc

SEQ ID NO: 4154504 - RNA, 56 nt, Human
gggcacuggugcugccaucuugugagcgccuggugagacuggugcugccgguggcc

SEQ ID NO: 4154505 - RNA, 83 nt, Human
gggcagaacauagccuuuaagucauggucacugauugccucacuuggcagcguguccuuuuagcuucaggucauuuucuguuu

SEQ ID NO: 4154506 - RNA, 59 nt, Human
gggcagagcaguuucuggccauuagaugaacaucugugugcccuaaagccugcucuccu

SEQ ID NO: 4154507 - RNA, 68 nt, Human
gggcagaggcucuggcccauccuggccuccugcucagccuuggccaauggggcuagaggguucugccc

SEQ ID NO: 4154508 - RNA, 61 nt, Human
gggcagaggggauaacagguguagauguuaaaugauuuucugggcaaagucccauuugcuu

SEQ ID NO: 4154509 - RNA, 88 nt, Human
gggcagaucauaaaauguucgaagucaggacaagcuggugagacugacucacacacuguaaggacuaucacugaacauuuuucugucc

SEQ ID NO: 4154510 - RNA, 83 nt, Human
gggcagaugcuuccaucuccaccugaacccucccugaugcauauucaugaggcugugucuugggguggaagugccuucugccu

SEQ ID NO: 4154511 - RNA, 57 nt, Human
gggcagaugggcugccagaacuugucauaguuccagcacagaauuuccuagcugccc

SEQ ID NO: 4154512 - RNA, 101 nt, Human
gggcagcaaggagccaggggcacugcuuuucagagucugccuggccaucggggcaggcgagggcccugaggagcccugaggagcccugaggagcccugcuc

SEQ ID NO: 4154513 - RNA, 57 nt, Human
gggcagcagaauuggacagaaacagcaugagguuuugaugccagucucugccugucu

SEQ ID NO: 4154514 - RNA, 78 nt, Human
gggcagcagguugcagauggauguggacggcgccaaggacccccacugggucugucuucccaaucguggccucugcuc

SEQ ID NO: 4154515 - RNA, 65 nt, Human
gggcagccacguaaggaagcagccucucuugugccuggaggucaggcuggcccuacuggcugccu

SEQ ID NO: 4154516 - RNA, 76 nt, Human
gggcagccaguccagaggagcugagaguagggcagggaguugacucccugagucuuggcuucuuggcuguguuccc

SEQ ID NO: 4154517 - RNA, 60 nt, Human
gggcagcccauaacauuugaggccuccccuaugccaucuggaggcuuuggugggcagcuc

SEQ ID NO: 4154518 - RNA, 65 nt, Human
gggcagcucggaagugggaaagagggccaggaauccauagggcaucauucucccgccagcugccu

SEQ ID NO: 4154519 - RNA, 60 nt, Human
gggcagcugcaaaucugcucuguaggacuucacuucaacaccagacuaaugcaguagccu

SEQ ID NO: 4154520 - RNA, 59 nt, Human
gggcagcuggccagguauucugggcuguccccaagggagccaggggccagcuauuuccc

SEQ ID NO: 4154521 - RNA, 82 nt, Human
gggcagcuguggaugccgcaggcuucauggagcuccccuaggcuggagggggcuggaugggagccuuggccuucaggguccc

SEQ ID NO: 4154522 - RNA, 80 nt, Human
gggcagcuuuaccggagggcaaaacagagaagaugugaauccccuucacccucucuuccguguguuuugcuagcaugcuc

SEQ ID NO: 4154523 - RNA, 92 nt, Human
gggcaggacgagcugcaagggggaggaugccaagcugugcacacggaaagcaccuacuguuacggccauggcaaccucagcugcuccugccu

SEQ ID NO: 4154524 - RNA, 58 nt, Human
gggcaggagaagguggaugucccagauccaggagggcaaauucgcccuuucucugccu

SEQ ID NO: 4154525 - RNA, 59 nt, Human
gggcaggagaggcagccagguaggaggacccacccccugaagcaguucccucucugccc

SEQ ID NO: 4154526 - RNA, 61 nt, Human
gggcaggaggcuaauucugcauacuggaugcaugggccagguucaggugggucuccugccc

SEQ ID NO: 4154527 - RNA, 60 nt, Human
gggcaggcaccgcggcggcagguuguuauuuuugggggcucagcgccgcgcguccugcuu

SEQ ID NO: 4154528 - RNA, 73 nt, Human
gggcaggcacuugggucugaaaauggugaccaccagcagguugcuggcuucuggccauucagccuccugaccc

SEQ ID NO: 4154529 - RNA, 83 nt, Human
gggcaggcgggguagcucugaggccaucuccgguaaaacugugcugggaugcgucuucccaggcuuuguucccuucucugucu

SEQ ID NO: 4154530 - RNA, 57 nt, Human
gggcaggcuguccugggccugccuucaaugauaaggcugugcacagggcaccugccu

SEQ ID NO: 4154531 - RNA, 117 nt, Human
gggcaggcuucccuucccuggggucagauggacaggccucaagacacccaggugguccuagguggaugauguggguccagaugagcccacaugaccccagguggacgaggugggucc

SEQ ID NO: 4154532 - RNA, 58 nt, Human
gggcagggcagggcaagaacuggguguggcuuccuuuggcccaggcucugcccugucc

SEQ ID NO: 4154533 - RNA, 63 nt, Human
gggcaggggcagugguggcauucuggggacaugucucuugcaguaccaucucugccucugccu

SEQ ID NO: 4154534 - RNA, 83 nt, Human
gggcagggggcugaguccagggacagaggcguucccaggaggaaggggcacaaacucugcaccugugauuccaacucaugcuc

SEQ ID NO: 4154535 - RNA, 66 nt, Human
gggcagguagaccaccagaaccuccauuucuuaaagccccaauggacagcuggaaauuacuugccc

SEQ ID NO: 4154536 - RNA, 74 nt, Human
gggcagguaggaaauuuauagagguguuucaaaaagaaauucuagaauaaucacuuuaaguauugcauuugccc

SEQ ID NO: 4154537 - RNA, 71 nt, Human
gggcaggucucauuaaaauaucucaugguguugauuuguggaaguuacucaacauggagguggcacugcuc

SEQ ID NO: 4154538 - RNA, 65 nt, Human
gggcaggugauuuuggcuccauguccccugacuucagguuguaagugugcuagaaucacucaccc

SEQ ID NO: 4154539 - RNA, 56 nt, Human
gggcagguggcagggucucugguuccuggguugggccucccgcucugucccugcuc

SEQ ID NO: 4154540 - RNA, 59 nt, Human
gggcagugcacaugugugcauuuguauguguguguuuugcauauuauguguaucugucu

SEQ ID NO: 4154541 - RNA, 64 nt, Human
gggcagugggacagagggacccaaacagucagccgauugcaggagcuuggcucugucccagccc

SEQ ID NO: 4154542 - RNA, 57 nt, Human
gggcauaguguaaucacagcacuuugggaggccaaggugggaggauugcuugagccc

SEQ ID NO: 4154543 - RNA, 62 nt, Human
gggcaugagggccuggcaguuuucugucuucuggggcaaggugcugccagugccugaugcuu

SEQ ID NO: 4154544 - RNA, 84 nt, Human
gggcaugcaauuaguuuccaaauuuucauuauuaagaaaacagaauuaacaucugugugaacauuucugguuauuugcuggccc

SEQ ID NO: 4154545 - RNA, 65 nt, Human
gggcaugccugagccugccacucuuguugguuugacagcuuuguuggcucugcucagagcagucc

SEQ ID NO: 4154546 - RNA, 65 nt, Human
gggcauggaaguacuaaggggugcccuggagaaucccuggguuccaaacauagucuuccuugucc

SEQ ID NO: 4154547 - RNA, 65 nt, Human
gggcauggaggucugucugcagaggcccgggccugggcacaaagggagagaggccuccauugucc

SEQ ID NO: 4154548 - RNA, 59 nt, Human
gggcauggcagggggagcugcagggccaucugaggggccccagcaucugagccgugucc

SEQ ID NO: 4154549 - RNA, 85 nt, Human
ggcauauggagaugagguaacaagccuggauaaucuacaaacuccugaguccaugcuuaaauaccuuaaagugcgccauauugcc

SEQ ID NO: 4154550 - RNA, 62 nt, Human
ggcaucagagguguguucugcuccacugcuauugccucugcacagaaugcauuucugcuguc

SEQ ID NO: 4154551 - RNA, 63 nt, Human
ggcaucaggaucugucuugcuucuguaaauauuuaaacacugggaggauuauuuuugguagcu

SEQ ID NO: 4154552 - RNA, 77 nt, Human
ggcaucauucuggaaaugguaaacauuuuaauggucagacccuguccacuuaugcauuacuauuuccaguauuaucc

SEQ ID NO: 4154553 - RNA, 74 nt, Human
ggcaucccacugggucuggaggccaaggguggggguggccuccuccacgaagguuucuuggcuuaucugggacc

SEQ ID NO: 4154554 - RNA, 123 nt, Human
ggcaucuauuguuuccugaguuuuuaauggucaucauucuaacuggcaugaaauggcaucucauugugguauugauuugcauuucgaccagugaugaugagcuuuuuuuucauguuuauugcc

SEQ ID NO: 4154555 - RNA, 64 nt, Human
ggcaucuccaaaacaugaacucaacucccaagagcuguggugauguucauuuuauggcgaugcc

SEQ ID NO: 4154556 - RNA, 64 nt, Human
ggcaucugagacagaaguuggaauuagauacugaaccagacugucugucaacuccugggauguc

SEQ ID NO: 4154557 - RNA, 84 nt, Human
ggcaucuucuggaacacaagcguaugucuuugucuuuaaaaaaugauuugggguugcuugugauuuugggggaauauggaugcu

SEQ ID NO: 4154558 - RNA, 65 nt, Human
ggcaucuuucuggugcccaugcaauuuauaucagugagcacugauugggcaccagaugggaugcc

SEQ ID NO: 4154559 - RNA, 73 nt, Human
ggcaugaagagcuuuacuugauauggagcugaggagugauucucacacuauuucaggugacuuucuuuauuuc

SEQ ID NO: 4154560 - RNA, 105 nt, Human
ggcaugacaucaaaggucugggcccauccauaugaggcacauugguuaacugauaccaaaguuugcacauggaugauuuuguucaguccucagaucaaucuugcc

SEQ ID NO: 4154561 - RNA, 77 nt, Human
ggcaugacugaaggcacagggaggcccugguguggagucccacagacuuugacgccagcauucccagcccagcggcc

SEQ ID NO: 4154562 - RNA, 68 nt, Human
ggcaugagaaggccuggccucaaccaaaaacagugcaaauucuggguagaacucuggucuucucaucc

SEQ ID NO: 4154563 - RNA, 61 nt, Human
ggcaugagccacugcccuuggcucauaauuuccauauagccauuuccaguggcaucaugcu

SEQ ID NO: 4154564 - RNA, 91 nt, Human
ggcaugagguaauacaaucaaauucacuagcaccacuccuggcccuuaaaaggugcugcuauuugguaaguauuauuaucauuuguuggcc

SEQ ID NO: 4154565 - RNA, 124 nt, Human
ggcaugcauucuaggguguaaucguuuuagcucugggaacuauaucugguggucagacacuaagagacuaaucuaauuauguuuccagaugugaagauauguaccugcccauguaauacuugcc

SEQ ID NO: 4154566 - RNA, 73 nt, Human
ggcaugccagggcuugcugccuggcaggaccugugcacagcaaagcaccaggcaaguagaagcuguggugguc

SEQ ID NO: 4154567 - RNA, 86 nt, Human
ggcaugccuguguguacguguaugugaguguggugaguugcuucugugcacacacucguguauaugagugugcaugcaagugugcc

SEQ ID NO: 4154568 - RNA, 59 nt, Human
ggcauggaacacauuaaccacagggaagagcaacuucccaaugcuuucguuuuccagcc

SEQ ID NO: 4154569 - RNA, 63 nt, Human
ggcauguacauuguguacuagcacugcucaacagaaacauaauguaagacacaaaugcaagcc

SEQ ID NO: 4154570 - RNA, 84 nt, Human
ggcauguauuugaaacuuagaaauugagcugagaccucaaagcucaguucaguuaagaguuucauguccuggagcgaugcugcc

SEQ ID NO: 4154571 - RNA, 63 nt, Human
ggcauuaaggaauguaggcaagaagucuguucugauuuuucaaguauguauucuuuguauguc

SEQ ID NO: 4154572 - RNA, 55 nt, Human
ggcauuacuccaaguauuuuuggaagucaacuuucagaauugucuggggaauguu

SEQ ID NO: 4154573 - RNA, 61 nt, Human
ggcauuagcgucugccucguccacaugcugugcaagcucagcgaggccaaggggcugggcc

SEQ ID NO: 4154574 - RNA, 89 nt, Human
ggcauucacaggagcguauguuucccaagcuacauuucuguaaguuucaaaacuuuaaagcagaauggcuaugguaauauccuaaugcc

SEQ ID NO: 4154575 - RNA, 66 nt, Human
ggcauucagugaaugaauccuaacaaagacaaugucaaugauuuguuuuucuuuauuccgaaugcu

SEQ ID NO: 4154576 - RNA, 85 nt, Human
ggcauuccacaaugugcuggaacugugcuaagagaaggaaccgugaccuuggagcucuccugcagauucagcauuauugccugcc

SEQ ID NO: 4154577 - RNA, 62 nt, Human
ggcauugcuuuuuauaccgugccaguugagcguuacucgggugugggaguagaaagugaucc

SEQ ID NO: 4154578 - RNA, 59 nt, Human
ggcauuguuuacagcacugcacacugcuuucauuacgaagggcugauguagacaguguc

SEQ ID NO: 4154579 - RNA, 55 nt, Human
ggcauuuagagggcuuuucugauggccacugaaggagagagagcccucagauguc

SEQ ID NO: 4154580 - RNA, 87 nt, Human
ggcauuuaugaugcauugaggaugacaugaguaaaaugaaaacuuagagcacucaccagggucauucuuucauggacaucugaugcc

SEQ ID NO: 4154581 - RNA, 55 nt, Human
ggccccacagccaguggagacugagccauggccaccucucuggaaggugggagcc

SEQ ID NO: 4154582 - RNA, 60 nt, Human
ggccccagccacugugugaccagcuguccuccuguggggccagccucaauaguagggguc

SEQ ID NO: 4154583 - RNA, 86 nt, Human
ggccccagguggugcugagagaagagcgcaguuuguuuuuggauucuauaacaauuugugucuuuugcuuauucaccagcuguguc

SEQ ID NO: 4154584 - RNA, 75 nt, Human
ggccccagguguguacagaacagcacccaccugcccacgaggucacccugugcccuguugcacacuugaggggcc

SEQ ID NO: 4154585 - RNA, 87 nt, Human
ggccccagugcugugggcugacucaggcugagcuaaguuucuauucagggauuuaauuuuccugguaggccuggcaugucaagggcc

SEQ ID NO: 4154586 - RNA, 78 nt, Human
ggccccauuucucuaaauggucucuuuguucccugcugggcugcucaguaucagaugugauuaaagggagaugggguu

SEQ ID NO: 4154587 - RNA, 70 nt, Human
ggcccccaggcaccucacgugggucccacagggcgugcauccauuguggggccuggcacuuuuaugggcc

SEQ ID NO: 4154588 - RNA, 60 nt, Human
ggcccccaggguggguguagacauucaucucugcuucauuugauccaccucugcuuggcc

SEQ ID NO: 4154589 - RNA, 99 nt, Human
ggcccccucccuucagcauggccugcagcggccacccucgcagcucggcuucccccacgcugcuggugguugcauaggccagcagcugggagcacagcc

SEQ ID NO: 4154590 - RNA, 58 nt, Human
ggcccccucuuuggagccagccacccacagggcuuuggugccucagaagcagugggcu

SEQ ID NO: 4154591 - RNA, 77 nt, Human
ggccccgccccggccuucacgugaccuggcgugcggagcgcgcacgcgggaacccgcgcuggaggcgggcgagggcc

SEQ ID NO: 4154592 - RNA, 64 nt, Human
ggccccuagcacggaguucuucccgggcuccaccugcccuggaagguucucuggcucaggagcu

SEQ ID NO: 4154593 - RNA, 94 nt, Human
ggccccucauuaccuaucucacuggccagcuuugcuucuuuccaccuggaggcauuugagccauuggccugugaucuauauaaugucugguguc

SEQ ID NO: 4154594 - RNA, 59 nt, Human
ggccccugagcaaaggaaggaugacugugaccccaaagauauccaucugcucagugucc

SEQ ID NO: 4154595 - RNA, 63 nt, Human
ggcccgcagcucgcucugguucugcagcuggaagacagaagccaagagaugaggcugcaggcu

SEQ ID NO: 4154596 - RNA, 88 nt, Human
ggcccggcucggcaggagucagagcccccagcggcgcgggcgagcccgggccagcagccgagagggggcucugagcggagccgcggcc

SEQ ID NO: 4154597 - RNA, 102 nt, Human
ggcccgugggcagcuggcugaggcccugcagcuuugccuccugaacucagagcucaccagguggggcuguugggacauccuccugccgaugccaucugagcc

SEQ ID NO: 4154598 - RNA, 119 nt, Human
ggcccucaagcagguucaugaugcagugauauuuuugcagacaccugggccaugcuucagcuauaaugcaccauuuccagauguuugaagaauaccauuggcagcauccuuugagaguc

SEQ ID NO: 4154599 - RNA, 76 nt, Human
ggcccucaggaaaggugagagcggccgcgucccuccgcucacgugggccucgcacgcuccucaccgcucccgggcu

SEQ ID NO: 4154600 - RNA, 76 nt, Human
ggcccuccaggcgggaggcgguuccaggaagugaagugagcaggugcugggacuccccuccccuccuggaggcgcc

SEQ ID NO: 4154601 - RNA, 65 nt, Human
ggcccucccggugaugaagagcuggcagcacucacucuguggcgggaucuguuccugggagggcc

SEQ ID NO: 4154602 - RNA, 59 nt, Human
ggcccucugccugugcuggcgagucccuccaucucccuuaucagacaagcagcagggcc

SEQ ID NO: 4154603 - RNA, 55 nt, Human
ggcccucuguggcugccauggagacuggggggccaugggcagaggcagagaggcu

SEQ ID NO: 4154604 - RNA, 77 nt, Human
ggcccucugugggaucacaugaguuaucuaacuuuguucuccaaauaagccagcccaugugaccccucgcaggggcc

SEQ ID NO: 4154605 - RNA, 71 nt, Human
ggcccugagcagcugagccccagcugugaucauccagcaugaugcagcgugaggacagcugagcagggacc

SEQ ID NO: 4154606 - RNA, 57 nt, Human
ggcccugagcccuggcucaucagccccuuucuggggcagguggcucagggcccagcc

SEQ ID NO: 4154607 - RNA, 60 nt, Human
ggcccugcacagccuggcucucuucugguagcaggucaaggagaaucagcuggcaguccc

SEQ ID NO: 4154608 - RNA, 103 nt, Human
ggcccugggcaucccgcagcagcuccauuguguccucauugaccuucaccagccggaugggguacacguggggcaggaugcggcuguugaaaccacaggagcc

SEQ ID NO: 4154609 - RNA, 65 nt, Human
ggcccuggggaccaggagcaagcaggggggugaaaaagagcugccuguuccaggaggccagggcu

SEQ ID NO: 4154610 - RNA, 63 nt, Human
gggcuucaaagcagaaaaacccagguucagguucugacucugcuacuuucuagcugugaaccc

SEQ ID NO: 4154611 - RNA, 60 nt, Human
gggcuucagaagguggcuccacuucuggguggcagugacaggcagaccugcugagagccc

SEQ ID NO: 4154612 - RNA, 73 nt, Human
gggcuucagcuucaacauccucugugugggugagugucagggccuggccucagacagagggugggugagaacc

SEQ ID NO: 4154613 - RNA, 61 nt, Human
gggcuucaggagggucagcccaggccaagcuacuguauuuggguuguucccauccaggccc

SEQ ID NO: 4154614 - RNA, 73 nt, Human
gggcuuccccgcaggugccggcagaugggguagcgaaugguccugugccuccaccugcuccaggagggagucu

SEQ ID NO: 4154615 - RNA, 82 nt, Human
gggcuucgggauucucuguuuggcgcugcuccuucucucgugugggagggaacgggaggcagagccaggcaaguccuagccu

SEQ ID NO: 4154616 - RNA, 63 nt, Human
gggcuucuucaugcacauuuucuguguuuguagcuuucacuuuaaauggcacaugggaagucc

SEQ ID NO: 4154617 - RNA, 74 nt, Human
gggcuugagccaugcugacccugugcaggcaugaugcugucugcuuuugcucagcuucggacaucucucugccu

SEQ ID NO: 4154618 - RNA, 62 nt, Human
gggcuugauaaccacaggccagucuguaucuucaauauagaugccugccaguuauuuagcuc

SEQ ID NO: 4154619 - RNA, 91 nt, Human
gggcuuguucuugggacucagcuuccugucuucugcacaaaauccccugggcuuuguugucaucagugaugaguccucaggccccaagucc

SEQ ID NO: 4154620 - RNA, 86 nt, Human
gggcuuuaucuuccuggcuucauacuuuguacccauccuguugcaugaauguacguuguagagucaugauaugcgguguauagcuc

SEQ ID NO: 4154621 - RNA, 79 nt, Human
gggcuuuccucaggcugguucaagaugggaaaggacuuucuucuguuuucucccaaagugcaaccacaguggaaagccc

SEQ ID NO: 4154622 - RNA, 119 nt, Human
gggcuuugaagagaaacuaagaguuuuccagagggacaagagcuuauuugaggaaagagggggaaguuuuucccaauugagagguucugugucaucuuccaacuucucugccuagaccc

SEQ ID NO: 4154623 - RNA, 79 nt, Human
gggcuuugggcugcagcuggagcaucuucucaucuugcauuugagcguggugggguccuccagugcgggauccaugucc

SEQ ID NO: 4154624 - RNA, 71 nt, Human
gggcuuuggugggagaagacucugguuuccuuuguccuuggaggccucuguccccccaccuuuagggaccc

SEQ ID NO: 4154625 - RNA, 59 nt, Human
gggcuuuucccacuaugccaggcugccuuuacugauguugggcauggucggaagagcuc

SEQ ID NO: 4154626 - RNA, 67 nt, Human
gggcuuuuugguguucugauucuuuccucacuagcagaggcagugaauuuaacacucagauuugcuc

SEQ ID NO: 4154627 - RNA, 76 nt, Human
ggggaaaacagaaggauuaucuaggguacaugcuuuuaaaagcuguuacuucaaucuucucccguuuuaucucccc

SEQ ID NO: 4154628 - RNA, 99 nt, Human
ggggaaaagaaagguuaaguaacuugaacaaggccauacagcugguaggcaguaaagcugggcuucuauucaagucuguuugacuccaaagcugucccc

SEQ ID NO: 4154629 - RNA, 87 nt, Human
ggggaaaaggcugggcgguggcgggucugggguugguggugguggcagcacugcugggcugggcuugcacacagccucaguuucccc

SEQ ID NO: 4154630 - RNA, 58 nt, Human
ggggaaaauuuuauuaacuggauguagccaacacuguuggugcuccaccaauaucccc

SEQ ID NO: 4154631 - RNA, 79 nt, Human
ggggaaacauuagaagaaagugaagcuggggacugaggugggucccaucuccccagcuugcuacuucugcuccaucccc

SEQ ID NO: 4154632 - RNA, 94 nt, Human
ggggaaaggacuuuguuucccggccuggugcaaugcuuggcaggcuuccccagcacgaggaugcugcagugcaggacaauagacagcuuucccc

SEQ ID NO: 4154633 - RNA, 66 nt, Human
ggggaaaggugccucuuacaaggcuuagguuuucgcagcagagccuguuaggcaccuguguucuuc

SEQ ID NO: 4154634 - RNA, 87 nt, Human
ggggaaauauuacaaauuauaaugggagagcauuuuauuucaaagcaaugcuucucucgcuuucgauuugccuuuaacauacacccc

SEQ ID NO: 4154635 - RNA, 76 nt, Human
ggggaacagcuugggcucugccauuugcugacugcgugacccuggguggaugguucaguugcacaggcuguucucu

SEQ ID NO: 4154636 - RNA, 63 nt, Human
ggggaacaggcguaggucagggccagugaccucagggcacuugaggcugggccugcacucccc

SEQ ID NO: 4154637 - RNA, 90 nt, Human
ggggaagaaagcccagcgaggaggagggacccgccugcaacuuuuccccagguaugugcugagcuuuccccgcgugcugcuuucuccucc

SEQ ID NO: 4154638 - RNA, 78 nt, Human
ggggaagaaauaaacagcuaaucuccauugugugcacuagaaacagaaucuaguguaaugacacagguuauucucucc

SEQ ID NO: 4154639 - RNA, 91 nt, Human
ggggaaucacuuggugcuguccagggagccaggcaccuucuguguugggcuaggaggccugcauuuggcuggcucccacagcagggaccuc

SEQ ID NO: 4154640 - RNA, 90 nt, Human
ggggacacuaaaauacugagucucugggcaugguugugacagugccuggcacagucccuggcacagaguagguaguugguugguguugcc

SEQ ID NO: 4154641 - RNA, 77 nt, Human
ggggacagauaaugucuccaggggcagggucuggaggggccaacacccucaucagagcccuccucuggccugucccc

SEQ ID NO: 4154642 - RNA, 63 nt, Human
ggggacaggcagagucagguuggguucagaagucaugaggcccagaggugacugcuucccccc

SEQ ID NO: 4154643 - RNA, 61 nt, Human
ggggacaggccauauggaauacauuuugguggcugagauguaucugugugccuugauuucc

SEQ ID NO: 4154644 - RNA, 76 nt, Human
ggggacauggggaucagacucugggauguagcaguaaaaacuuuggcugugacacuuucuuuuuggugucuucccc

SEQ ID NO: 4154645 - RNA, 103 nt, Human
ggggaccacagggaggaauggaagcuaaguuggcuugagacaccaucagguagggaccucccucucugugccaggcccagcugacuucuaguccucccucccc

SEQ ID NO: 4154646 - RNA, 55 nt, Human
ggggaccaggacucuucugagcugagggugacguguucagggcaguccggucccc

SEQ ID NO: 4154647 - RNA, 102 nt, Human
ggggacccaggaccaucccccgugggagcugggguuggacgucuucaggccggagagggaacagccucaccagcccuggaggaggaggguccuggcuucucc

SEQ ID NO: 4154648 - RNA, 65 nt, Human
ggggacccaggcagggggcagcacagcgccccaagggcagccagccccucugaccucuccucccc

SEQ ID NO: 4154649 - RNA, 128 nt, Human
ggggaccccuguucgugucauccacagggugcugugggcccagaagcgcccaugccugagagcguccaggaccaggcagagcugggccuuaagggcccuuggaccagugucugucugcagggagcccc

SEQ ID NO: 4154650 - RNA, 62 nt, Human
ggggacccuacagcaagagcagucgcaaguaugcaagugauggcuaucccuggaagggcccc

SEQ ID NO: 4154651 - RNA, 124 nt, Human
ggggacccugggggcucaggauccagcaaggggcggcaggaguaaaggaggaaggaaugacaggugcaaauaccuucccaccaaagcccuuguugcccucuggcuccuccccagagcugucccc

SEQ ID NO: 4154652 - RNA, 124 nt, Human
ggggacccugggggcucaggauccagcaaggggcggcaggaguaaaggaggaaggaaugacaggugcaaauaccuucccaccaaagcccuuguugcccucuggcuccuccccagaguugucccc

SEQ ID NO: 4154653 - RNA, 56 nt, Human
ggggaccgggagugggguggcgggagaggacgcgcagaaucucgacuucuggcccc

SEQ ID NO: 4154654 - RNA, 73 nt, Human
ggggcuuauggagaccaugagauuagugacguuuugcccaaauccacuucaaauauggcuucaugagaucccc

SEQ ID NO: 4154655 - RNA, 63 nt, Human
ggggcuucaaaaggcagcagccuacuugugcaaccuugggagaggccagccuuuggagacacc

SEQ ID NO: 4154656 - RNA, 60 nt, Human
ggggcuuucagggacccagaagcagaaaacucucaguucuggaaauguugcugaggccuc

SEQ ID NO: 4154657 - RNA, 66 nt, Human
ggggcuuugacauaagacuuagaguauuguaucuuaauuacagacaaauaacuuuuuauguccccc

SEQ ID NO: 4154658 - RNA, 61 nt, Human
ggggcuuuggugauggaugagcagcuacaggguagcaugcugccugugccaggaggguccc

SEQ ID NO: 4154659 - RNA, 79 nt, Human
ggggcuuuucuaugcuccugagugugcaggagaugcuaaugacagcaccucuugcccuuguuaggacuagacaggccuc

SEQ ID NO: 4154660 - RNA, 63 nt, Human
gggggaaaagcaccuagcauagugcuuagcacaucucaagcacugaacuggugcuggucccuc

SEQ ID NO: 4154661 - RNA, 75 nt, Human
gggggaaacacaguaaaguacuaaaaaauauauauauacaaaugaugugaugcauaguuuuuauugcuuuccucu

SEQ ID NO: 4154662 - RNA, 73 nt, Human
gggggaaagcaauaaaguagcagcucaucaguauuuuacuugcaugacuuguuauuuuauagggcuuuuucuu

SEQ ID NO: 4154663 - RNA, 56 nt, Human
gggggaaaguggagguucgugaaacucuaccuugguuuccccuacuccuuucccuc

SEQ ID NO: 4154664 - RNA, 70 nt, Human
gggggaaauuuauuaucuacaucauuaaacauuaagauuguaaagugccaaguagaaaugaauuuaccuc

SEQ ID NO: 4154665 - RNA, 69 nt, Human
gggggaagagcuccugcauucuucccuggccaccuuggcuccagggcuccccagagagccucuucccuc

SEQ ID NO: 4154666 - RNA, 70 nt, Human
gggggaaguccugaggucaaauaaguuuagaaaguauucuauuaaaguuguuuaccguaggacuuuuaac

SEQ ID NO: 4154667 - RNA, 64 nt, Human
gggggacugaggcccacuugagggaauagcaagugucuuucccuuucaggguuuccaguucucu

SEQ ID NO: 4154668 - RNA, 56 nt, Human
gggggacugggggugagcaggcccagaacccagcucgugcucacucucagucccuc

SEQ ID NO: 4154669 - RNA, 79 nt, Human
gggggacugggucaguuucuguucugguuccaaacccucccaggaaggccaggcucucagugacugccccucacccacc

SEQ ID NO: 4154670 - RNA, 78 nt, Human
gggggagacaagccagagcaggacaggcccgugccaccgaaaggaaagggccaugcuguugccugcuggugcuuccuc

SEQ ID NO: 4154671 - RNA, 55 nt, Human
gggggaggaaguguggccagguggcugagaagccaucuguccaccagccucgccu

SEQ ID NO: 4154672 - RNA, 126 nt, Human
gggggaggagaguuaaucaggcugacaaggaagacaagacgcagcacagcugaaaugcacccucacccacugugaagccuugaacugcaaaccccgucaccagcagagcugacuacucuuuccccc

SEQ ID NO: 4154673 - RNA, 76 nt, Human
gggggaggaggaacagcagggaauaugggaauugggagaaccuuuagcaguucacacugugcuaucugccuuccuc

SEQ ID NO: 4154674 - RNA, 55 nt, Human
gggggaggugaaugcaauaaggguggagaugcacucugugguauggccaucuucc

SEQ ID NO: 4154675 - RNA, 75 nt, Human
gggggagucauuaguagagaauugugcccuuaaauuuauuuuuauaguuggauucugcuaguuaauaucucucuc

SEQ ID NO: 4154676 - RNA, 65 nt, Human
gggggauuucagcccugggggucauuggaaauaucacucaaaugacucugcugcagagacacccc

SEQ ID NO: 4154677 - RNA, 55 nt, Human
gggggcaggugcggcgccgccggugacgguggcccucagucuugcuccugcucuc

SEQ ID NO: 4154678 - RNA, 70 nt, Human
gggggcauggggcauggagucauucuguuugaggcagagcacaguggcuucuaugucuacauuugccucu

SEQ ID NO: 4154679 - RNA, 70 nt, Human
gggggccacaucuaagccaauuuugauuucgccuauaaugagugccgggcgaaggcuggagaaggccucu

SEQ ID NO: 4154680 - RNA, 67 nt, Human
gggggccaccucugccucaagcuucccaaguucucagaaaguguggggagugguuagaacggcuccc

SEQ ID NO: 4154681 - RNA, 58 nt, Human
gggggccccaggucugaacacgcugcccagguauucuaggcagaggcugggagcuccc

SEQ ID NO: 4154682 - RNA, 72 nt, Human
gggggcccccagauggccagauaccaugggcgcccgcaccccauggcuugucuugucuucugauuggucccc

SEQ ID NO: 4154683 - RNA, 57 nt, Human
gggggcccucucagucuguguagcccugucucaaccgcacacaugaggagggacccc

SEQ ID NO: 4154684 - RNA, 95 nt, Human
gggggccguggacccuccuggccugaagcucacuccuuccccgccuccuacaggggcaggggagccagggcugcgaguucugucuguggacucuc

SEQ ID NO: 4154685 - RNA, 74 nt, Human
gggggccucugagcuccuuugaccaccccagcuggaacugggaagcugugggccacugggaggcaagggucccc

SEQ ID NO: 4154686 - RNA, 108 nt, Human
gggggccucuuuaucuucaaaagaaaauaaugcugucuuuucuacuucauaaaguauugugagcuuuggagaagauaacguaaaugcuuuggaaccugugaagcccuc

SEQ ID NO: 4154687 - RNA, 55 nt, Human
gggggccuuauucaucugccagagcccugcugugguaagcagaauaaugccaccc

SEQ ID NO: 4154688 - RNA, 66 nt, Human
gggggcgagaggccaagggauccgugaggccaccucucuggucauccgggccggccucuggccccc

SEQ ID NO: 4154689 - RNA, 66 nt, Human
gggggcgcccucucugcuucacuguucccucuggccucccauaguggggccugggaggguuccccu

SEQ ID NO: 4154690 - RNA, 74 nt, Human
gggggcuaagagugaagguuagggagauccugagugcagcugcucaggcacccucuauuuucaucaacuccccc

SEQ ID NO: 4154691 - RNA, 57 nt, Human
gggggcucaacuugacagagagguuucacuaaaaucucuguacaucauugagucccc

SEQ ID NO: 4154692 - RNA, 120 nt, Human
gggggcuuuuggagcagguuggguucucuagggcuguagacugggcuggcugugaccaguuuccagggauguggcagcaccauagaguggccuaagacugauuggcaucugauuguccuc

SEQ ID NO: 4154693 - RNA, 74 nt, Human
ggcucaugcuggugguugauggcaggaugcagguacucaccagaggccuccuuccauuccucaccacguggacc

SEQ ID NO: 4154694 - RNA, 61 nt, Human
ggcucauucaggagccuaagcagcgaggggcuguugcuggaauuugccuucuggaagagcu

SEQ ID NO: 4154695 - RNA, 82 nt, Human
ggcuccacacaagacuuguuuuggcuaguaugaugucuucagacacaauacagggcucaaaauaugcuuguaugguggagcu

SEQ ID NO: 4154696 - RNA, 88 nt, Human
ggcuccaccccuuucucuuuccccgaccucauugagggucucuuuccuucacaggcuugguuggggcgagggaugcggggucauugcu

SEQ ID NO: 4154697 - RNA, 129 nt, Human
ggcuccaccugggaguuguaagcaggacugccagugcuuugagaggagggugcuuugcugggugggcccuaacuuucuucuccauggcagguccucagcaaagggcagccccuggguccugcgggaguu

SEQ ID NO: 4154698 - RNA, 80 nt, Human
ggcuccacgcuucuucaguggccagcugguugucagaaacauaaacguaacuaccagucccaaggaggaagcagucugcc

SEQ ID NO: 4154699 - RNA, 60 nt, Human
ggcuccagcaccuuccugcaaaggucuuuaaaagcaccuguuuggaggagguguuaggcc

SEQ ID NO: 4154700 - RNA, 121 nt, Human
ggcuccagccucaaagugcugcugacccugugcuugggccuuccagccccccaugguguguaaaaggacagggcuggacaucuaagguagcugucagcgaguuugcacagggguugcugcc

SEQ ID NO: 4154701 - RNA, 58 nt, Human
ggcuccaggaaccuccucuccuguugguuaagagccaggagugcaggcuuuuggagcc

SEQ ID NO: 4154702 - RNA, 65 nt, Human
ggcuccauccuggccucgcuguccaccuuccagcagauguggaucagcaggcaggaauacgaguc

SEQ ID NO: 4154703 - RNA, 110 nt, Human
ggcucccaagucaaugaaaaugccugaucagcuauggaauucguaacauuauucacuaugaaucaaaguucauuugaucaccacuggcauucuggauauugaccugaguc

SEQ ID NO: 4154704 - RNA, 67 nt, Human
ggcucccacuugcccuggcgcugucucuauggagcucaauguacuguaacagcugucagagcaggcc

SEQ ID NO: 4154705 - RNA, 67 nt, Human
ggcucccagacuguggugggcacuaccggucagcugcccagcagccagcccuagucccacuucugcc

SEQ ID NO: 4154706 - RNA, 72 nt, Human
ggcucccagcggaucccccagcccgggcugcaggcugagccaaggcugugcaggguccauauuggucaggcc

SEQ ID NO: 4154707 - RNA, 85 nt, Human
ggcuccccugcuggggauucuuugacaggguguugggugucagaggcccagggccagagcaccaggggccccagugggaggagcc

SEQ ID NO: 4154708 - RNA, 73 nt, Human
ggcuccggacucaccugacaauggcuccuucaucuuugggggcucugggaccuugggugggggcucuggagcu

SEQ ID NO: 4154709 - RNA, 85 nt, Human
ggcuccggcgaggccacuggcacgcccacguaggcacugcacuucacaguuugcaaagccuuccuguggccaccuuguccgagcu

SEQ ID NO: 4154710 - RNA, 93 nt, Human
ggcuccuauauguccugguggguggacgccugcugcuccagacccauuuggggccagcuccuuggcagugccucgcccaccacaugaggggcc

SEQ ID NO: 4154711 - RNA, 81 nt, Human
ggcuccucaacccacccaccugcccuuucuugcuccaccagcaggagagcaagaaaggguagguggguggguugaggggcu

SEQ ID NO: 4154712 - RNA, 60 nt, Human
ggcuccucugaccucuaggacaccccacaccccacucuuugauccagagguguuggagcc

SEQ ID NO: 4154713 - RNA, 71 nt, Human
ggcuccucuuaacugugacaguuucucagacuuuccuuguuuuugauaucauugacaguuuugaggcaguu

SEQ ID NO: 4154714 - RNA, 64 nt, Human
ggcuccugcaccugucccucugcgugaucccccucccguaagggguuugaacaggcagcgagcc

SEQ ID NO: 4154715 - RNA, 78 nt, Human
ggcuccugcuuaugaggaccuugugauuacauugagccugcccaaauaguccaggacaaucuucauauuucaagaguc

SEQ ID NO: 4154716 - RNA, 57 nt, Human
ggcuccuggcccgaucccugugaagagugcucaagccuuucuggagggcugggagcc

SEQ ID NO: 4154717 - RNA, 108 nt, Human
ggcuccugguugguggggaccaugguccuuuaggaaugcucuucagcagugccucacagagaagagcagauuccuaguggagcauacacuucagccagcacccgagcc

SEQ ID NO: 4154718 - RNA, 55 nt, Human
ggcuccuguccccucagcugcuugcguggggcugagcgucgagggcccaggaacc

SEQ ID NO: 4154719 - RNA, 60 nt, Human
ggcuccuguggcaagacagcuugcucccagggagaagcuuccucugaguagcaggagacc

SEQ ID NO: 4154720 - RNA, 55 nt, Human
ggcucggccguggagguuugcuguccucuucccccaggaaacuucacggucagcc

SEQ ID NO: 4154721 - RNA, 81 nt, Human
ggcucuauugcacugacagcccaccucacaggauuugggaacuacccacaucaaucucaugagggggccguuaaaagagcc

SEQ ID NO: 4154722 - RNA, 76 nt, Human
ggcucucaggaaguuuguucugguuguguguaugggggccucccacucagcauauggggccgcuuggcugggagcc

SEQ ID NO: 4154723 - RNA, 71 nt, Human
ggcucucauuacagcugggguuccaagugguccaagauaaaacuggaaacauccucaaguaugaagaggcc

SEQ ID NO: 4154724 - RNA, 73 nt, Human
ggcucucauuugcugaggccuucagaggcaugagcucaugccauccuugcaaaccuccagcaaaaugaguguc

SEQ ID NO: 4154725 - RNA, 61 nt, Human
ggcucuccagcaacuuccuaaagaugaucagccaucuaugcugaggcaggugcuggaaguc

SEQ ID NO: 4154726 - RNA, 104 nt, Human
ggcucucccugggcagguggggcucucccugggcagauguggcucuccuugggcagguguggcucuccuugggcagguguggcucuccuugggcagguguggcu

SEQ ID NO: 4154727 - RNA, 81 nt, Human
ggcucuccgccuucauuuucuugucucuguuguagguaauauauuugacaccaggagagaaaacacggaggacacagaacc

SEQ ID NO: 4154728 - RNA, 69 nt, Human
ggcucugagaggugcagcaguaaaauaaguacuaaauuuuacuuagacaagcauuuuagacucagagcu

SEQ ID NO: 4154729 - RNA, 60 nt, Human
gggcccgcgccgcggccgccgcggccgaccccccgcgcugcuggccucggcgcugggccu

SEQ ID NO: 4154730 - RNA, 60 nt, Human
gggcccgcugaggcuaaccucgagagacaguuauaaaaggcugugagaggcuagcugccc

SEQ ID NO: 4154731 - RNA, 88 nt, Human
gggcccggacgauggcuuauccuuuuuguauuauucacagcaccuaauaucuguugugaaauuacuuaaaggaaauauucccuagccu

SEQ ID NO: 4154732 - RNA, 129 nt, Human
gggcccuacaggagaaaauggcaccccuggaauaucuggcugagcgaggcccacagaggcgccuacccucccaccuccaucugugggccucagcaggacuccaaacucccaugucucuucugucuguuc

SEQ ID NO: 4154733 - RNA, 73 nt, Human
gggccgacucuguggccagcaagugcugccucucccagggaucuggcugaugggcagagcuggugggaggccc

SEQ ID NO: 4154734 - RNA, 58 nt, Human
gggccgccuauugggcaaccuagagcacaccuuuccucaggccaaacccagcgcgccc

SEQ ID NO: 4154735 - RNA, 82 nt, Human
gggccgccugcugggggcguaggccgacuugauguccagagagaaggagggcuugaggcggcugguguccugcagguggucc

SEQ ID NO: 4154736 - RNA, 61 nt, Human
gggccgcgccgacgggcuggcgguggacacgggcguggacgugugggccuucggcgugcuc

SEQ ID NO: 4154737 - RNA, 71 nt, Human
gggccgggcggguccacccaggcugugggucagcccugcaggguugagcugccuggcuguggcucaggccc

SEQ ID NO: 4154738 - RNA, 55 nt, Human
gggccggggccuccccgcgucgcggcucagggcugugauaggugguccccgggcc

SEQ ID NO: 4154739 - RNA, 61 nt, Human
gggccuccugauguauuuuugugagccgcccaccaucgcggucaaacuugcaccagugccc

SEQ ID NO: 4154740 - RNA, 72 nt, Human
gggccucuaauuacugauacacauaagaauuugguggcuuuccaagcuucuuugcuguugucagauagguuu

SEQ ID NO: 4154741 - RNA, 57 nt, Human
gggccucucaguaggaucaaaugcacagcacugcuauccauccuugaugagaggucu

SEQ ID NO: 4154742 - RNA, 58 nt, Human
gggccugacugagagcuccucacaucuucccccugcccggcuccuucuuucauggccc

SEQ ID NO: 4154743 - RNA, 55 nt, Human
gggccugagacugagggugagggaaaagugauguuccucccuuuuuauugggccc

SEQ ID NO: 4154744 - RNA, 120 nt, Human
gggccugagauggcugggaagcaggcggguuuaggacaaugcuuuuuaaaguucauuuuaaguacuuuuaaggauuuccaggccugcgccucgagcggcccuaaguaagcuucuaggccc

SEQ ID NO: 4154745 - RNA, 67 nt, Human
gggccugaggcagagagaacccgggcugcagggcacuaugggccaggguagcucuggcuucuggccc

SEQ ID NO: 4154746 - RNA, 72 nt, Human
gggccugcagcccuugguauuuuccgaucccagcugcucugugaggguggaaaguauuuggggaccaggcuu

SEQ ID NO: 4154747 - RNA, 86 nt, Human
gggccugcaguggcuucuguguccccacacuguauuugaggaugggcaucaccacuucaaauucugggggaagagccccuuggccc

SEQ ID NO: 4154748 - RNA, 96 nt, Human
ggggugggaggggaagcuggagggacuuucucacggauggggccaggcugggccagcagggugagguagccccucccugauccaaucucccagucc

SEQ ID NO: 4154749 - RNA, 61 nt, Human
ggggugggagugccauccuugaugccugcacgcuggccugucauugggugcagcccacccu

SEQ ID NO: 4154750 - RNA, 72 nt, Human
gggguggggcuggggcgccauugaguccaagcaccaucaggcacgccauggcccuggcccagaccccaccuc

SEQ ID NO: 4154751 - RNA, 71 nt, Human
gggguguccagcguggaaugagggugugcagggccaaggcugcagagacccagggaccccgcugacgccuc

SEQ ID NO: 4154752 - RNA, 74 nt, Human
ggggugucuagugcuuaucucuuuacuuugcacauguuaaauggcugcuugucucagauaaaacuaugcauucc

SEQ ID NO: 4154753 - RNA, 118 nt, Human
ggggugugaaggguaugagggaagcacugggcagcucccuugaacuucuccuggccggccagaggcagguuugaaugcaggggauugcaagugguccuagaaaucccauucauucucc

SEQ ID NO: 4154754 - RNA, 77 nt, Human
ggggugugacguagucccugcagcugccaacgguugccagggcaacgguugccaggggcugcugucaccugcgcccc

SEQ ID NO: 4154755 - RNA, 83 nt, Human
gggguguggggagacaggcaggccagggcuguggcuucuccauaagcacacagcucaggggcacugccagccagcgccgcccc

SEQ ID NO: 4154756 - RNA, 58 nt, Human
gggguguguauguaugacugucugauggucucuuuccacucugacacuuacacacccc

SEQ ID NO: 4154757 - RNA, 64 nt, Human
gggguguuggccuccacauuuuccaggugacaucagcugggaagagcugcaguccauccacccu

SEQ ID NO: 4154758 - RNA, 75 nt, Human
gggguuaaaagugcuuacaacuuuauugaggaauuuuugaauuccucaaugucuugucugugggauuuuuauccc

SEQ ID NO: 4154759 - RNA, 70 nt, Human
gggguuaggcaauuucaccauucacugaacauuuuguguguuuucugaaaacugaaguagugcugacuuc

SEQ ID NO: 4154760 - RNA, 88 nt, Human
gggguuagggcuugcauaggaaaaguggcucaguguucaugugugggguucugccagccacugggccacugccaggaagcccgacucu

SEQ ID NO: 4154761 - RNA, 129 nt, Human
gggguugcugaauaucuuuugaaauuuuguuuugagaacuuuuggagacuuuuaguacauccuucagggaaauuagaaaaacucaagggcucuauaaaacuaagguucaaugucacuauauuagaccau

SEQ ID NO: 4154762 - RNA, 71 nt, Human
gggguuggggaggggagguaguagcugcucccuuuagauaaagcauguacuuucuagcucuccccaguucc

SEQ ID NO: 4154763 - RNA, 69 nt, Human
gggguuucacuuguaggauguacuuaucauuucuggaaaucgauaauaucuuacaugugcuuuguuccc

SEQ ID NO: 4154764 - RNA, 81 nt, Human
gggguuuccccuccuugaccuuuuucuucaccuccugcucccauacucccguuggauggucaggcaaggagggcuggccuc

SEQ ID NO: 4154765 - RNA, 68 nt, Human
gggguuuguguuucuaaauguuuuucucgaaccaauguucuucaacaguuuuagaacacuguuacucc

SEQ ID NO: 4154766 - RNA, 79 nt, Human
gggguuuguuauuuuguuacagcgaauacugagauuauaaagggaauuucuguaaucagaguagcagauaauauuuccc

SEQ ID NO: 4154767 - RNA, 55 nt, Human
gggguuuugggaggccugguaaauuacacccccuacccuggguucuccauacccu

SEQ ID NO: 4154768 - RNA, 72 nt, Human
ggguaaagcuggugccugugggcauggugcaugcuggguaaagccagugccugugggcauggugcagugccu

SEQ ID NO: 4154769 - RNA, 72 nt, Human
ggguaaaugugcuucuuuuaacuuaaguugagcacuugcucaagguggaagagagacaggagcauagaacuc

SEQ ID NO: 4154770 - RNA, 69 nt, Human
ggguaacauugaggaguguauuccacaccacuguccacaguguucuucugggguaugcuccugucaccc

SEQ ID NO: 4154771 - RNA, 130 nt, Human
ggguaacccuuuacacuuacaguguacaguuccuuucccuucccuaguagacccagaucauuuccagguuauccuaagauuugacccuaacuaggggucuaguggcuaggagguaggugaggguagaccc

SEQ ID NO: 4154772 - RNA, 92 nt, Human
ggguaaguugggguuggauugucacagaccuugcauguugugcuaaggcaugcagagguuuccaggcaaguuuugacaugaucagauugccc

SEQ ID NO: 4154773 - RNA, 103 nt, Human
ggguaaucaacguaccacagaagcauuccagcaaauaguugagaaguaugauuauuaaugccacaauguuugcugaggauuuugugaucuuaccuuguggccc

SEQ ID NO: 4154774 - RNA, 55 nt, Human
ggguaauuggggccuugcagugcagugucugccacugugggagcuuuagguacuc

SEQ ID NO: 4154775 - RNA, 68 nt, Human
ggguacauaugcacaacaugcagguuuguuacauauguauacaugugccauguuggugugcugcaccc

SEQ ID NO: 4154776 - RNA, 68 nt, Human
ggguacaugugcacaacaugcauguuuguuacauauguauauaugugucauguuggugugcugcaccc

SEQ ID NO: 4154777 - RNA, 68 nt, Human
ggguacaugugcacaacgugcagguuuguuacauauguauacaugugccgcguuggugugcugcaccc

SEQ ID NO: 4154778 - RNA, 64 nt, Human
ggguacuucugaaagugcagcugugacacagcuuucccagcucacauucucaucagaugugucc

SEQ ID NO: 4154779 - RNA, 60 nt, Human
ggguagaauaggaaguccuggucagacccaaaagggcugucacaagacccuagucuaccc

SEQ ID NO: 4154780 - RNA, 58 nt, Human
ggguagagguaaacuuuguaucaucagcauuuaaggaugaucagauuuaacuguaucc

SEQ ID NO: 4154781 - RNA, 60 nt, Human
ggguagaguacagaaaaaggaguacgcaaccgcaaucucacuuucucaugaauuuggccc

SEQ ID NO: 4154782 - RNA, 57 nt, Human
ggguagaucaccugaagucaggaguuggagaccagccugaccaacguggugaaaccc

SEQ ID NO: 4154783 - RNA, 58 nt, Human
ggguagauggguauaauucuccuguaaaacuucauuugcaggaaaacaccuaucaccc

SEQ ID NO: 4154784 - RNA, 77 nt, Human
ggguagcauuuaucaccaucucaugcaggggucugcgaacuagcaaaccacugcccauggugaaaacugaaccaccc

SEQ ID NO: 4154785 - RNA, 130 nt, Human
ggguagccccuccgcgucccggggcuccaaccagcugugccggggaccuggggcagaauagcaaacagccuccuccagagccugcgcacuggcuggcggggccagggaaccgugggcugaggaguccccc

SEQ ID NO: 4154786 - RNA, 72 nt, Human
ggguaggggggcaucgcaucuggcacugccagcacagacuggaggugccuggcgaugucucugaucuuaucu

SEQ ID NO: 4154787 - RNA, 63 nt, Human
ggguagugguagaacuugaaugugaaaucagguaagcucaccugauuccagaguuccuaaccc

SEQ ID NO: 4154788 - RNA, 129 nt, Human
ggguauaauuuguuggauagucacaugcuuccugagguuuuaaaacuauuccuuuugaaugggaauaaucaugaaauucagugaauggcauugcuuaauuaagauaauccacaaacaguugaaguauuc

SEQ ID NO: 4154789 - RNA, 68 nt, Human
ggguauaugugcacaucgugcagguuuguuacauauguauacaugugccauguuggugugcugcaccc

SEQ ID NO: 4154790 - RNA, 88 nt, Human
ggguaucaguugcuaguuaucucuguauuuauccaugcuguuacagagggaaaguacagauggugagguuggaucagcugucauaccc

SEQ ID NO: 4154791 - RNA, 95 nt, Human
ggguaucccugucugcacagugagagggcugggcucaugaucucacccagaucugggcugaaucccaccucugucauuguagggcagcgugaccu

SEQ ID NO: 4154792 - RNA, 80 nt, Human
ggguaucuuguuaaagugaagauacugauacaauaggucuuggcugggaucuuagauuuugcauuucuaacaagcuaccu

SEQ ID NO: 4154793 - RNA, 61 nt, Human
ggguaugcaugucuuugcacacaaaucuacguaaauaugugguagaguauguauauauccc

SEQ ID NO: 4154794 - RNA, 71 nt, Human
ggguaugcuguuucagaagaguagcugaacaaguucauuagggggacuucucggcacccuuuggcagcccc

SEQ ID NO: 4154795 - RNA, 64 nt, Human
ggguauggagacaaauuuuuuagugaccauacauuuguuacaaugcuguuuguuucuacugccc

SEQ ID NO: 4154796 - RNA, 77 nt, Human
ggguauuacauugcacuuuauuagauacaaauaaaacuuuuaugaaaguguuuauaggagugaaugcuggaagaccc

SEQ ID NO: 4154797 - RNA, 70 nt, Human
ggguauuguguuuugcuucucucugguaaaagaugagaauucuuugaauacaggaagcaugagauaaccc

SEQ ID NO: 4154798 - RNA, 75 nt, Human
ggguauuuucuaguucauauucucaaagaagaucacuucuucuuugauuuugagggaggugggcagaguaugccc

SEQ ID NO: 4154799 - RNA, 81 nt, Human
gggucaaagccugguacuugggaauguuuuacagaugugaauuugcuuaugaaugaaaucauugccaaguauugagugccc

SEQ ID NO: 4154800 - RNA, 78 nt, Human
gggucaagggggcagcucuggaagggacugcaggugacccugcugcccugcuuguuuccaguggcgucucucuguccc

SEQ ID NO: 4154801 - RNA, 82 nt, Human
gggucacucagcagguauguuuguucagcacauaagacuccucagaaggccugcaaagaacaaauauacccugaaguaaucc

SEQ ID NO: 4154802 - RNA, 82 nt, Human
gggucagagagggagucuugucuugcaagggcugaggaaggcccuucuugcccucaacaagagcaugauccccacugacacc

SEQ ID NO: 4154803 - RNA, 56 nt, Human
ggcuggcuggcugguagacaagaccccaguuuucuuccaucuuucaguaguuagcc

SEQ ID NO: 4154804 - RNA, 55 nt, Human
ggcuggcuggcuuagcagaggagggaggcaaugugcccuccuggacggccuggcc

SEQ ID NO: 4154805 - RNA, 56 nt, Human
ggcuggcuugcggagucacagauguucacugugccccuucucugugugcccaggcc

SEQ ID NO: 4154806 - RNA, 73 nt, Human
ggcugggaagcgcagaaggggcccuaccagcucgcaggcgaguucagggcucagcaucuggcauuugccagcc

SEQ ID NO: 4154807 - RNA, 89 nt, Human
ggguaaacauuuaaggaagagcuugguaauaggcuaaaaacaauuuuaucaacccuagccuguaccauuuucccuagucuuuucuaccc

SEQ ID NO: 4154808 - RNA, 63 nt, Human
ggguaagaagccaugguagaaaacucaguucaugacgaaucuguucuuucuacuguggcuccc

SEQ ID NO: 4154809 - RNA, 56 nt, Human
ggguaaggucagccagaaguuccuauuguuuaugcuuacugaggccugccuugccu

SEQ ID NO: 4154810 - RNA, 81 nt, Human
ggguaagucacauaauuauauguuaaucuucaauuuucucaucuaugaaaugaaguuggaccauaugauuuugaaaguccc

SEQ ID NO: 4154811 - RNA, 55 nt, Human
ggguaauguugcucuucuuauuugacuauaaacucagugaauagagacauugccc

SEQ ID NO: 4154812 - RNA, 118 nt, Human
ggguaauuauuaauucuuugguguugucaauucucucauugguaugauguguagacuagcauagaucucauuuuucuccaaugggaauuugauaacauuaagguacuuuaaauuucuc

SEQ ID NO: 4154813 - RNA, 59 nt, Human
ggguaauucagaggcugccuggaagacaaaggaugacuagcaggugguaaucugagccu

SEQ ID NO: 4154814 - RNA, 70 nt, Human
ggguacagugagacuggcucagggacugccaaaaaaagggacuagauucuggggccaauugccacugccu

SEQ ID NO: 4154815 - RNA, 104 nt, Human
ggguacaugaacagggcaugagguauauguucauguauguguaaaugaaucccuauauacauuuauauucauguuccugcguguacuugugaaguuguguacuc

SEQ ID NO: 4154816 - RNA, 85 nt, Human
ggguacauuuuugcccagcccugugauaagguuuguuguuuauuaggcagaaaggcaagcauuuauauaggacaggaaugugccu

SEQ ID NO: 4154817 - RNA, 65 nt, Human
ggguaccugcagggccaugguggcggcugccgcguuguugcugcugcuguugucguccggugcuc

SEQ ID NO: 4154818 - RNA, 81 nt, Human
ggguacggggauggauggucgaccaguuggaaaguaauuguuucuaauguacuucaccugguccacuagccguccguaucc

SEQ ID NO: 4154819 - RNA, 68 nt, Human
ggguacuuaugcacaacaugcagguuugugacauauauauacaugugccauguugguaugccgcaccc

SEQ ID NO: 4154820 - RNA, 99 nt, Human
ggguagagugguggaauggggcgaggaagaaaccuacuagaguuucuuguguaaggaaguauuaauaacugguuccuuccuccuccuucuccccucccc

SEQ ID NO: 4154821 - RNA, 65 nt, Human
ggguagcacuggugggaaugggauauuagauauuaacaauaccaccauucuuagucaagugucuc

SEQ ID NO: 4154822 - RNA, 61 nt, Human
ggguagcagucaucggcagagaaaacaugauguauuugucaccuauggcuguccugugccc

SEQ ID NO: 4154823 - RNA, 60 nt, Human
ggguagcaugugucagaguuuguuugcaguaucuuguuagcucuuauaucaugcuuaucc

SEQ ID NO: 4154824 - RNA, 57 nt, Human
ggguagcauuuguagcuaucacagucauggugauuccacauacagcugcaagcaucc

SEQ ID NO: 4154825 - RNA, 72 nt, Human
ggguaggagccagcgccuugccucuggggcuucgcuagagaagccuagggcgcggucguuugcauccauccc

SEQ ID NO: 4154826 - RNA, 64 nt, Human
ggguaggaugguagaagggaccugauguaaaggaagguaguagguuucuuuuacucucuaauuc

SEQ ID NO: 4154827 - RNA, 73 nt, Human
ggguagggauucaaaaauaagcuccuauuuucugcuggaaaaucuacuugagauauuuuugaauuucucuccc

SEQ ID NO: 4154828 - RNA, 68 nt, Human
ggguauaugugcccaacgugcagguuuguuacauaaguauacaugugcuauguugguaugcugcaccc

SEQ ID NO: 4154829 - RNA, 57 nt, Human
ggguauauuuugcaugcaguuuguagaaauuuacaggaaccaugaagacauauaccc

SEQ ID NO: 4154830 - RNA, 67 nt, Human
ggguauguucaugugguuuuuaaaggauuauuguucuguaaucaaaaaugaacaugaacuuaauccc

SEQ ID NO: 4154831 - RNA, 99 nt, Human
ggguauguuggaaaaagagagaugaaguuuucugaggcacuggcucucccagaagaccuggggcagcuucucgggcucuccuuucuucuagccuggccc

SEQ ID NO: 4154832 - RNA, 65 nt, Human
ggguauuauuucucacaaaguugcuuaucccaacaaggauuacauuuugaugagaaagaucaucu

SEQ ID NO: 4154833 - RNA, 81 nt, Human
ggguauugauaguuaauugucugugaguaccugacagcaacggguuauggcuauugaugacaauugguaccuucagugccc

SEQ ID NO: 4154834 - RNA, 88 nt, Human
ggguauugguggggaggggaggccaguggaccgucccccugcggaagcuguguggggaccugcgccacucacuguccacccugugcuu

SEQ ID NO: 4154835 - RNA, 69 nt, Human
gggucaacugagcagcaauugcuggcccagagaccugacucugggucagagcugugcugcccagggccc

SEQ ID NO: 4154836 - RNA, 66 nt, Human
gggucacacugcagcccccuauuaggacucgccauggcguagugauggggcccugcacugauuccc

SEQ ID NO: 4154837 - RNA, 70 nt, Human
gggucacaugcagucacugagcagggacaccagaugcugggcuggacccucuuuaugcugcuugugacuc

SEQ ID NO: 4154838 - RNA, 80 nt, Human
gggucagaacaaggcacaagcuggcuguuuaucaaguaccuacuuugugcugggcagcacaugcucucuuguucaguccu

SEQ ID NO: 4154839 - RNA, 89 nt, Human
gggucagagcacagacauuuucuguauugccuguagaaacuagcacaguacaggcacccccuaagugcaaaagaaguccuugcugaccc

SEQ ID NO: 4154840 - RNA, 65 nt, Human
gggucagcugcugggggcugacgggcaagaggugcagcccgaggcacucaugcaggagcugagcc

SEQ ID NO: 4154841 - RNA, 61 nt, Human
gggucagggcugccugggcucagaugcgcccacgcccaugugcccgagcagcaccuugcuc

SEQ ID NO: 4154842 - RNA, 63 nt, Human
gggucagguccaacuauuuaucuguguuucaauugcgcaaucaaguuuugagacccaccgccc

SEQ ID NO: 4154843 - RNA, 82 nt, Human
gggucauggugcuaguuaaaucuucaggggggcaucucaguauauagcuaccuguucaagguauuaauuaucaucaugacuu

SEQ ID NO: 4154844 - RNA, 87 nt, Human
ggguccaacuaaauguucugccacuugcuuuguaucuaauguguauauuuuaaauugauauaaagaaggcacagcaagacagggccc

SEQ ID NO: 4154845 - RNA, 62 nt, Human
ggguccagacuaugaagaacuuucuagguuacaauggggaguuuuggauuuauucugggcuc

SEQ ID NO: 4154846 - RNA, 72 nt, Human
ggguccaggaaaugcugaugcuccuggagggaagacccuacucugaguaccaaguuuccagauuuugcuccc

SEQ ID NO: 4154847 - RNA, 77 nt, Human
ggguccagggaacuuugaaggauccagcacuucugaguuugaggugguuuguucuccagaauuuccugcauagaccu

SEQ ID NO: 4154848 - RNA, 112 nt, Human
gggucccagaacaggguccaugaagaggaauguauuucccugcaaauugaggcacgguugcaguugcuggaaggacauaaucaacgauggcauccugguuucucugccuccc

SEQ ID NO: 4154849 - RNA, 56 nt, Human
ggguccccucaucauggagacuccccucagaaauagucuucagcaggguuaaaccc

SEQ ID NO: 4154850 - RNA, 65 nt, Human
gggucccuaggagaauugccgcagccccagcccagggcgggccggcaggcgggucucagggaccc

SEQ ID NO: 4154851 - RNA, 57 nt, Human
ggguccgcucaagaagcaggagguggauucagccccacagcuucccaaaguggaccu

SEQ ID NO: 4154852 - RNA, 68 nt, Human
ggguccguucugggguuugucuccucccuccuggccacuguggggagucugacccuuagagaugaccc

SEQ ID NO: 4154853 - RNA, 88 nt, Human
ggguccucccugcuucugcuucagcagcaaaacccaggacagaagcugcucucuguuuuccugccugucucuagaggccggaggaccu

SEQ ID NO: 4154854 - RNA, 88 nt, Human
ggguccucgucccugaagagugugagguugugcuuuuggaugugucccagcagcaccuguccucgcugcuccagggucuggaggaccu

SEQ ID NO: 4154855 - RNA, 74 nt, Human
ggguccugggauuuugaauguuauaagagacaaaauaugucaggcuauuuaugacauuacaauaucaaggaacc

SEQ ID NO: 4154856 - RNA, 77 nt, Human
ggguccuugagggaggcaggaaaguugucugucuggauguuuccucggaccucugucugcuuccuacuccagggccu

SEQ ID NO: 4154857 - RNA, 69 nt, Human
gggucggccugguggcagaaucuaggggacccaguccuaggguaccagagccucaacacagguccuccc

SEQ ID NO: 4154858 - RNA, 79 nt, Human
gggucgguggcuccauccuggccucgcuguccaccuuccagcagauguggaucagcaagcaggaguaugagucaggccc

SEQ ID NO: 4154859 - RNA, 57 nt, Human
gggucuaggagacaugggcaagguucuuaaccuggagcagcccagaggucugggccc

SEQ ID NO: 4154860 - RNA, 104 nt, Human
gggucuauuacugugccaccuggggcaggcacagugauucagaucugcccuacaccacacugaacaucugccuuguggcugccucugguacacaagauagagcc

SEQ ID NO: 4154861 - RNA, 65 nt, Human
gggucucaggaggcagcgcucucaggacgucaccaccauggccugggcucugcuccuccucaccc

SEQ ID NO: 4154862 - RNA, 55 nt, Human
gggucuccaaaccccuuuggcucucacuggggcuucugggcaggacuggggaccc

SEQ ID NO: 4154863 - RNA, 62 nt, Human
gggucucucagaaggcugcaaucaaggugcagugcauggucuguggucucaucugaaggcuc

SEQ ID NO: 4154864 - RNA, 72 nt, Human
gggucugaagcgcugguguuguagaaauccucaucacaaagaggugacugcguuccaguugcugccaggccu

SEQ ID NO: 4154865 - RNA, 88 nt, Human
gggucugagggaagcaggggaguccacucuaugcagacacuuaauuaaucugcaaugugcacaucgucuugcccuuucccucccaccc

SEQ ID NO: 4154866 - RNA, 56 nt, Human
gggucugcgaacugucuggaauucgucccuuaaugaguuuacaacuguccagcccc

SEQ ID NO: 4154867 - RNA, 56 nt, Human
gggucuggccuccgggcaggugggauccauccacccuggacucgaggcccgagccc

SEQ ID NO: 4154868 - RNA, 105 nt, Human
gggucugguucuuguguauaagcuggccggccaccuccaggguugcagagcaggagaagcugcgcccguuguccucugggguggccuucagcaggagcugggccc

SEQ ID NO: 4154869 - RNA, 68 nt, Human
gggucuucauuuauucuacacucaacaaauauuuaucagagcaccuacugugggucagugaauggccu

SEQ ID NO: 4154870 - RNA, 57 nt, Human
gggucuuuggcucccaccucuuggugaaucucuaggaucugugagugcugcagacuc

SEQ ID NO: 4154871 - RNA, 79 nt, Human
gggugaaacugaugaauuuuguuacuaagggcccagaauauagaacaaaaccucagaggcaucauucauaguuacauuc

SEQ ID NO: 4154872 - RNA, 57 nt, Human
gggugaaaggauggggagaaagugcauacagcuagacaaauuucccuccuuccacuc

SEQ ID NO: 4154873 - RNA, 55 nt, Human
gggugaagccuuucuggguagaauucgauuuccccaggaagacacaugcucaucc

SEQ ID NO: 4154874 - RNA, 77 nt, Human
gggugaaggaggguuggggccuggggauggguucugggcaaagacccauagucucugggcccagaccuuccuuauuc

SEQ ID NO: 4154875 - RNA, 109 nt, Human
gggugaaggcagugggggccugcacaaugggaucuugcccugagggcucaggcacgggccggcccuuguccggggucccuccagugucccagccccaagcugcacaccc

SEQ ID NO: 4154876 - RNA, 61 nt, Human
gggugaauaggggaaggcuauuuauuuauuuauuuugagacagagucuuguucuguugccc

SEQ ID NO: 4154877 - RNA, 60 nt, Human
gggugaauguugcuuagcguaucgcaaugcaucauugcuucaugcuucugacaauagcuc

SEQ ID NO: 4154878 - RNA, 88 nt, Human
gggucccagacacaaagcuggccucucaggcuuuacugaaagauaagugcugauaaggccugcgggucaucuucgucuacgcgggccc

SEQ ID NO: 4154879 - RNA, 57 nt, Human
gggagagucagacuaagccauggugaaugaaauuuaccuggccaagcuaacuuugcc

SEQ ID NO: 4154880 - RNA, 76 nt, Human
gggagauauuuuauacagcagcagcaggcuauccacauugugccauaccucgcuuuugugugacuuaauaucucuu

SEQ ID NO: 4154881 - RNA, 60 nt, Human
gggagaugaaucagaagugauccaauaaccagcccuggauuaagugcaucuggcucuccc

SEQ ID NO: 4154882 - RNA, 55 nt, Human
gggagaugcuugucugucuuaucaucggggccuggugacucugcaaccgucucuc

SEQ ID NO: 4154883 - RNA, 58 nt, Human
gggagauggugaaaaaggcugagcaccugucagugcauuaaaaccaucgaccaucccc

SEQ ID NO: 4154884 - RNA, 84 nt, Human
gggagcaaaacagcauuucuauuaaguauguaaacaagccagcaggaugccuaggcuuguuaucugcgugaagaaaaugcuucc

SEQ ID NO: 4154885 - RNA, 78 nt, Human
gggagcaccaaggcucugccaugggaugcccaguucucuuuauaaaacuugacaguccacagggcucuaggcgcuucc

SEQ ID NO: 4154886 - RNA, 126 nt, Human
gggagcagaagguugcagauggggagagacagguggcuucucugcagccuuuguuccucaugugggagaggguagcagguggcuuccagauuuucugccuacaaaugucuguaacaaacaaguccu

SEQ ID NO: 4154887 - RNA, 76 nt, Human
gggagcagacugaggaaaguauugccuggugaauccgaaggggcagaaguuggagcuuuccaucagcuauguuucc

SEQ ID NO: 4154888 - RNA, 56 nt, Human
gggagcaggaaggugcuggcaugucauaguguuggggcccuggcuuuccuguucuu

SEQ ID NO: 4154889 - RNA, 58 nt, Human
gggagcaggcacgggggugaugcugccacggggccugugacacccagagccuccuccc

SEQ ID NO: 4154890 - RNA, 67 nt, Human
gggagcauaaaauaaauaguuugcaugacguuucauuuuucauguauuaugauuauuuucaugcccc

SEQ ID NO: 4154891 - RNA, 72 nt, Human
gggagcaugucagucugggucuccacagucagcacaggcacacuugcaacaggagaguucagggcaguuucu

SEQ ID NO: 4154892 - RNA, 55 nt, Human
gggagccaugcuggucuucuuuugucugcucaaaugcaccagcaccuuggcucuu

SEQ ID NO: 4154893 - RNA, 70 nt, Human
ggucaauuuuccucaagccucuggaaggcauuucuauuuguaccgcuucuuuggcaugaggagaauggcu

SEQ ID NO: 4154894 - RNA, 77 nt, Human
ggucacaggcaugugagacagauugguuaaaaaaacggucucugucguugcuuuugucauucaaaugcucuuugacc

SEQ ID NO: 4154895 - RNA, 79 nt, Human
ggucacaggccuacccuggacccaucauggcugcuggaugauggcagcucugauugguucagccugggucaugugugcc

SEQ ID NO: 4154896 - RNA, 67 nt, Human
ggucacagggcuaaaugaaggguuggaacuuaacuuuguucuaaaucuucucuguggucccugcccc

SEQ ID NO: 4154897 - RNA, 94 nt, Human
ggucacauagauugggaagaggaggagccaggcuuugaacacagaccugcuugaccccaaagccuggguuccucacuaucauauucuauugacc

SEQ ID NO: 4154898 - RNA, 75 nt, Human
ggucacaugagaugcugcccucuaccuugcagaaugggccaucgagaacccggcagccuucucucauaggugacc

SEQ ID NO: 4154899 - RNA, 65 nt, Human
ggucaccaaauuggaacuugagugacauggugauauaugucacucaaguuccaauuuacauuucc

SEQ ID NO: 4154900 - RNA, 71 nt, Human
ggucacggaagcucugggcuuuguacuuggccaggugccuggaccucccgcgacgcucgggcuccgaugcc

SEQ ID NO: 4154901 - RNA, 104 nt, Human
ggucacuaguauuaaguucagguuauucgaaugcauuccacgguagugaugacaauucaucaggcuaguguguguguucaccuugucacucccaccacuagacu

SEQ ID NO: 4154902 - RNA, 78 nt, Human
ggucacucagauuuccucuaccuuucuuuacuucccuccaaguuggugucuggaaauuaagaggagguuuaugucacc

SEQ ID NO: 4154903 - RNA, 83 nt, Human
ggucacucuaggccuuugaaaguugcauccuuuucugagcacaccauuuugauacaggaugaaaugugaaaguucugggugcc

SEQ ID NO: 4154904 - RNA, 79 nt, Human
ggucacucuguguacucaacaugccuacucagucuggaaguauccugggcagugggcaaguuguauucagagaagggcc

SEQ ID NO: 4154905 - RNA, 64 nt, Human
ggucacuggcagggcagugagauuugaacuucagaguaucagaccucugaccuugccaaagacc

SEQ ID NO: 4154906 - RNA, 58 nt, Human
ggucacuuuaccccuuggagccucagcuguggggaggauucaugggagcaaagaggcc

SEQ ID NO: 4154907 - RNA, 63 nt, Human
ggucagaaggauucugggaaauguuaaauaaccuugccuguggagaguaccuuuuuuuuggcc

SEQ ID NO: 4154908 - RNA, 60 nt, Human
ggucagacccugcgguguuuggaugacagagcccugaauggagacaccccaggucugguc

SEQ ID NO: 4154909 - RNA, 88 nt, Human
ggucagagaccuagcaggugaucgcgugugcuccccuccaggaucccagggcagcgaagcuugugaucaguugcugccucuucuugcc

SEQ ID NO: 4154910 - RNA, 59 nt, Human
ggucagagagauaagaguccagguguugaaggugacaucuggcagugauuucugugauc

SEQ ID NO: 4154911 - RNA, 63 nt, Human
ggucagagguguccaggccgggacagaggaacggaaccugggccugcuugggccccucuggcc

SEQ ID NO: 4154912 - RNA, 67 nt, Human
ggucagaguauggucauauaaguaccauaacauauagguuacaguaccuguauggccacugcagacu

SEQ ID NO: 4154913 - RNA, 78 nt, Human
ggucagagucauaacagacacaggcguggagucgcccgggcagcacgucgggggcucggcaucuguggacucugcgcu

SEQ ID NO: 4154914 - RNA, 84 nt, Human
ggucagcaaacacaagagguaauuucuccagaacauagagagaaggagagaggauuuaggaucuuuugcuguuccuagcugacc

SEQ ID NO: 4154915 - RNA, 90 nt, Human
ggucagcacuggaaguccugauuuguguuuugaaaacucaaaucuauugagcaagauaagaggggaugcagagaggcuuauguguagauc

SEQ ID NO: 4154916 - RNA, 74 nt, Human
ggucagcccuagauguauaguauguaauuucugcacagcucucuguuuaguaaauacaucacuauauacugauc

SEQ ID NO: 4154917 - RNA, 79 nt, Human
ggucagcgagauauuuuggcucacacccagaugucccacuuucuuagcuggcugugugccaggcugucugucugcugcu

SEQ ID NO: 4154918 - RNA, 60 nt, Human
ggucagcucaucuuuucauggggagccacagguucaaaagaaaauacaaugagcuugacc

SEQ ID NO: 4154919 - RNA, 58 nt, Human
ggucagcuguacuugauguuuccauucuacauggugggcuguaucaagaagucuggcc

SEQ ID NO: 4154920 - RNA, 58 nt, Human
ggucagcuuuguuggauacugcugaaaggucaaguaacaugaacacacagagcugacc

SEQ ID NO: 4154921 - RNA, 81 nt, Human
ggucaggagcagccuuggagagcgccgcugauguccucuucccccggaucccugccuccauccccgggcgggcucuucacc

SEQ ID NO: 4154922 - RNA, 59 nt, Human
ggucaggagugauaccauuugucauguguccaacuucaugacuaaaugguugcucuacc

SEQ ID NO: 4154923 - RNA, 76 nt, Human
ggucaggauugaaugggagggggaggagaggccagacuuugguguccacucagcccguccugagccagcacugucc

SEQ ID NO: 4154924 - RNA, 66 nt, Human
ggucaggcacugugguugaguggggacaguuguucugauaugugaagcuauuaguucuaggugacc

SEQ ID NO: 4154925 - RNA, 58 nt, Human
ggucaggggcugcucuacagagccucagugaagaggaccugggcgcuaguuccugauu

SEQ ID NO: 4154926 - RNA, 68 nt, Human
ggucaggguauaaucaagugagaagggaaaacacaaaaaaaucuacacccugguuccuacccuggauc

SEQ ID NO: 4154927 - RNA, 58 nt, Human
ggucaguagaaauuugaccaaaauugccucagacugguugguugaauuuuuagugacc

SEQ ID NO: 4154928 - RNA, 64 nt, Human
ggucagucucucccgaguguuguaguggggagaguugacccagaugaugcggaugagacugauc

SEQ ID NO: 4154929 - RNA, 75 nt, Human
ggucagucuucuagcaaauccaggccuuuggaacuagaaccagaaccuugagagaagcugugaagacuucugacu

SEQ ID NO: 4154930 - RNA, 84 nt, Human
ggucaguggcuguagagcugggacugagcucagcccacccgauuucugggcuucucucccccagcuccacauugcaccaccacc

SEQ ID NO: 4154931 - RNA, 62 nt, Human
ggucauacccuguaaucugaaacaugaaccaauuuauggcuuaaauacuacagggcaagauu

SEQ ID NO: 4154932 - RNA, 56 nt, Human
ggucauagagaauucaccaggaucuaaaucuugaaugcuggugagcucauguggcu

SEQ ID NO: 4154933 - RNA, 82 nt, Human
ggucaucucuaugugugucuauguccuaaucucuucuuauaaggauaccaguccuuuuggauuagggcccacccauaugacc

SEQ ID NO: 4154934 - RNA, 60 nt, Human
ggucaucuggaaauaaaauuauaguugauaguucauaaucagaaaauauuuccagaugcc

SEQ ID NO: 4154935 - RNA, 59 nt, Human
ggucaugugccagguagugagcugagaguggcagaaaggaggcugcgugggaugugacc

SEQ ID NO: 4154936 - RNA, 96 nt, Human
ggucaugugggaaaaaauuagcuuauuuuuucuguugucgcccaaagaaugucacuggugauauaaagaaguggaaaaugagaaaacuccaugauc

SEQ ID NO: 4154937 - RNA, 66 nt, Human
ggucauguugaauggccuugauuuuuuucaguaaaguugggggaaggcaaggucauucuacagacu

SEQ ID NO: 4154938 - RNA, 84 nt, Human
ggucauugguaguuuuuggcugagcaguuuuuauggaaaacgcagacagaaaggcugccagguaaaauauuuuuuuaagggacc

SEQ ID NO: 4154939 - RNA, 73 nt, Human
ggucauugucucuugucauuuaguagauggauuaucccuccuacuuuuugugucaagcagucaccaaaugacu

SEQ ID NO: 4154940 - RNA, 58 nt, Human
gguccaacugaccucagcugcagggcacugugucuccagcaggaggugagaugugacc

SEQ ID NO: 4154941 - RNA, 64 nt, Human
gguccacaaccgccauugucuggucgugccaucuaauggccacugccuccgccauggcuggacc

SEQ ID NO: 4154942 - RNA, 74 nt, Human
gguccacacugccuuuaugagcuguaacacuuaccgcgaaggucugcagcuucacucaggaagccagugagacc

SEQ ID NO: 4154943 - RNA, 55 nt, Human
gguccagagaggugcaagaggcugguggccagagacuccugugccucucugggcc

SEQ ID NO: 4154944 - RNA, 75 nt, Human
gguccagagcaggguuuuaacgaacagaagcuggcaugucaccacucucugucccuaggagccuugccuuuugcc

SEQ ID NO: 4154945 - RNA, 75 nt, Human
gguccagcaggccuggguagggccagagaugcugugcuucuaacaagcuccugggccaagcccaugcugcugacc

SEQ ID NO: 4154946 - RNA, 75 nt, Human
gguccaguacggggcaguuucccgcagaaagggucccacgguuggaucuuucucuucgaaaaccugcccuggacu

SEQ ID NO: 4154947 - RNA, 61 nt, Human
gguccagucagauauucaugcaaggcauuuuaugauguacgugauuuuguugacuggggcc

SEQ ID NO: 4154948 - RNA, 75 nt, Human
gguccagucagggugaaucucacaacucuuauguguaugcuggaucacuaaaaguguguuuuuaccuucuggacc

SEQ ID NO: 4154949 - RNA, 75 nt, Human
gguccauugucugcauaucaaauuacuccugguuccugagguccaaggaguucaguugguggcugugcguggacc

SEQ ID NO: 4154950 - RNA, 56 nt, Human
ggucccaagugcuuucaucuagagaugauauucuccggguggcagaacgugggucc

SEQ ID NO: 4154951 - RNA, 66 nt, Human
ggucccaggcccaggggucuggcccacugcuccuccugggguggugcugugagccccuuggccucc

SEQ ID NO: 4154952 - RNA, 76 nt, Human
gguccccacagggucaagggugcuacaaggccagucuguuugaccucggacuuguaagucucaugauccugguacc

SEQ ID NO: 4154953 - RNA, 70 nt, Human
gguccccaucuauuauaagauguaauugcacuuaauuuguagacauccuucaagugauaugugggugacc

SEQ ID NO: 4154954 - RNA, 130 nt, Human
ggucccgcccuugacauguggggauuauuacaauucaaggugagauuugaguggggauacagagccaaaccauaucauucugccucuagcuccucccagaucucaucuccucacauuucaagacacaauc

SEQ ID NO: 4154955 - RNA, 82 nt, Human
ggucccugaggagauccccccagaaguggugcaggaguauguggacaucauggaggagcugcuggggccuucccucggggcc

SEQ ID NO: 4154956 - RNA, 82 nt, Human
gguagggaccgaggcugccuaguccuaaccaagaccgaggucucccccuuggcucugggauuaccagccuuaggccugggcc

SEQ ID NO: 4154957 - RNA, 84 nt, Human
gguagggcaggucagagcagaauucaauuaucaguauaaguaacauguaaagauuugaguucugcuuauagaccaauggcuucc

SEQ ID NO: 4154958 - RNA, 64 nt, Human
gguagggcugaaugcaucuagggaggaaagguaccucgcaggccccagaccauuuugccuuacc

SEQ ID NO: 4154959 - RNA, 60 nt, Human
gguaggucugggacuuggcugggcaggggauagcuggaacagccaagaacaggcagaacc

SEQ ID NO: 4154960 - RNA, 63 nt, Human
gguagguggccugagagccaucugugaccugucacaucucaccuggcuccagccuccccuacc

SEQ ID NO: 4154961 - RNA, 82 nt, Human
gguagguggggauuugaagcaugguacuuguucaacauccugugaauuucauuaguguguuacuauugcuucaccuacuacu

SEQ ID NO: 4154962 - RNA, 71 nt, Human
gguaguaagcugcagaagaguguucacugcuuuuucuccaauugaaagaaauaccuuucucagcuuuaacc

SEQ ID NO: 4154963 - RNA, 63 nt, Human
gguaguacauggaagaguacacagucuagaaggcacuguaucauggcucuacauguuucugcc

SEQ ID NO: 4154964 - RNA, 55 nt, Human
gguaguagaagguaugcuuuaauggaagaacuauauaaagacauaagcuacuauc

SEQ ID NO: 4154965 - RNA, 66 nt, Human
gguagucaggguggcacaucacagcauuaacuacauuuggccugugggcugccauucuuuucuccc

SEQ ID NO: 4154966 - RNA, 96 nt, Human
gguaguccuuaagucuuaucuacuguguccuuggaucuguucuaggcacuaagacagauacagggacuugguauuuacagaauguauaguuauacc

SEQ ID NO: 4154967 - RNA, 87 nt, Human
gguaguggacaucaacaguucuguccaauuaauccuuggaagcacagucagaauuaauugggaacuuguugaaaguugaucgacacc

SEQ ID NO: 4154968 - RNA, 129 nt, Human
gguaguggccagugaugcuucucaacauaccacaaugcacaggaccacacauaaugcacagcugcccacaacaaaguauuauguggcccaaagugucaguggugauguugagaaacccuggcuuaaacc

SEQ ID NO: 4154969 - RNA, 64 nt, Human
gguaguggguaaucaacagauaucugcuaguagcuugugauuauucuguuauuauuacauugcc

SEQ ID NO: 4154970 - RNA, 70 nt, Human
gguagugguggcgugguggugcagggauguuuuugaauuggcucugugcccuacugcucagcuuucugcc

SEQ ID NO: 4154971 - RNA, 88 nt, Human
gguaguguuugcaugcacaugcaauagugcuuucguguguuuaggcaugugcagaagugcuuuguauguuugugugcaaacaucugcc

SEQ ID NO: 4154972 - RNA, 113 nt, Human
gguaguucaaaggcuggaaugggagcuuggcagugucacuagggagccacacuuccucugccugugagcuuccauccuuacugugugggcuccucaucuucagccucacugcu

SEQ ID NO: 4154973 - RNA, 56 nt, Human
gguaguucuucauggguuucauugauugaauuuccuuggcugaugacagagguacc

SEQ ID NO: 4154974 - RNA, 59 nt, Human
gguaguuugagguuuuggagcaggucaugaccaugcagcaaucuagaaacccagacucu

SEQ ID NO: 4154975 - RNA, 65 nt, Human
gguaguuuuugagcuguaaucuuguccagccuuauuuuagagaagaaugcuucugaagagcugcc

SEQ ID NO: 4154976 - RNA, 109 nt, Human
gguauacagaagggaacauucagauccgguuuguaaggggcaagcucagcacucuugccaggggcccuggauuuaagcauggacuuugcaauguacuaauuuugugacc

SEQ ID NO: 4154977 - RNA, 56 nt, Human
gguauaugcugaugugaucgguuguacuuauugauagccagucucaguacuguacu

SEQ ID NO: 4154978 - RNA, 58 nt, Human
gguauaugcuuaugaugguuaauuugaaggugucagcuugacuggagugagguaugcc

SEQ ID NO: 4154979 - RNA, 57 nt, Human
gguaucagagacccaccccaagcauguauuuagacagcuuucuguggacucugcacc

SEQ ID NO: 4154980 - RNA, 64 nt, Human
gguaucagcaguguaguuuaucauucccuaccagagaaugguauaaauuagacugcagaaugcu

SEQ ID NO: 4154981 - RNA, 73 nt, Human
gguaucgcacacuaggaacaaccaucauuuaucuaacugugauguacauguugguuguuuccagucuuuuacc

SEQ ID NO: 4154982 - RNA, 81 nt, Human
gguaucucuuagaagaucagcgucaguuagcaaguugaaugacaggccugugaaacuugcuaauugcacguaggaggaacc

SEQ ID NO: 4154983 - RNA, 100 nt, Human
gguaucugccaaaagagcaaacauguaauagugaaacacggggagcacauuaauuaaaaucaagagcucuauuauuacuccugauuguacugcagauacc

SEQ ID NO: 4154984 - RNA, 92 nt, Human
gguaugaagucuuggaaggcuaugccugcugccagaaugucuggaggaaaacaguagcaugcuuaucuuuugaaagauuuuuuaaaaauauc

SEQ ID NO: 4154985 - RNA, 72 nt, Human
gguaugacacuaacugacuucuugauuuaccauuauccauggaaucuuaggauagucuguuagaaaaguacu

SEQ ID NO: 4154986 - RNA, 70 nt, Human
gguaugacugccguuuaggggacccuaaugcugaacagguaccauggaccucugaaggcagagcagggcc

SEQ ID NO: 4154987 - RNA, 72 nt, Human
gguaugauucagaaacaucaguggauggauuggguacaaccuauccauuacugaacuguauucuuauuaacc

SEQ ID NO: 4154988 - RNA, 95 nt, Human
gguauggaagcuucuggacuuugaacaggcuaguuuuaaagcauauucaaaguauccucugacacuaguuuuguacaaaaucugcaagccaaacc

SEQ ID NO: 4154989 - RNA, 70 nt, Human
gguaugggggaggccggcagcucgccccugagcucaacuggcuggcagggcugauggcuucccucacacc

SEQ ID NO: 4154990 - RNA, 95 nt, Human
gguauguuuggauauagguacagaguuagcagaaaguuggauuuaaacuaaugugaaccaggauucagguuuugcuaagauuguguagauauacc

SEQ ID NO: 4154991 - RNA, 88 nt, Human
gguauuauagacaugaaugagacagccucugcacucauggaacucacauucuagagcaguguuguccaucagaaaaauaaugagaacc

SEQ ID NO: 4154992 - RNA, 94 nt, Human
gguauuggcaggcuuccuugguucugccuggccuggaaguguaucuuuccuuccaccgugccaugugggaccacaaaggagaaugccauguacc

SEQ ID NO: 4154993 - RNA, 80 nt, Human
gguauuguuuaauuaaugaggugauuuguauaugaguaagaacagggcuuacacuaaaguuccucaaauaaaacaugacc

SEQ ID NO: 4154994 - RNA, 68 nt, Human
gguauuuaaggugggagagcagcacuugcuucagggacacccaggagccuugggcgcucucccauccc

SEQ ID NO: 4154995 - RNA, 67 nt, Human
gguauuuauauuucuuuuguuuucauuucugcacacauguaugacugagaacucaagagaaaaggcc

SEQ ID NO: 4154996 - RNA, 80 nt, Human
gguauuugaagaugcgguugaccaugguguguacgcuuuauuugugacguaggacacauggucuacuucuucucaauauc

SEQ ID NO: 4154997 - RNA, 64 nt, Human
gguauuuggaggcagugaacaauuccuguguguugguuugcuaggaccacuguaacaaaguacc

SEQ ID NO: 4154998 - RNA, 61 nt, Human
ggucaaaagcugcccuacacggaagcacuuaauaaaugcuuacugacugggcaguuuuucc

SEQ ID NO: 4154999 - RNA, 78 nt, Human
ggucaaauggcagcagggagaggugguaggaugaauaugaauauuuuccuucuaauauucugccuguuuuuguuuacu

SEQ ID NO: 4155000 - RNA, 89 nt, Human
ggucaaaugugauuaacuugcaggggagaggaacaaacagggccaguuucccuuguagucucauacuuuguuuguguaaucaauuggcc

SEQ ID NO: 4155001 - RNA, 60 nt, Human
ggucaacgcugagaagaacauggccacaggucaccauguggcucugcaccucaguguacc

SEQ ID NO: 4155002 - RNA, 67 nt, Human
ggucaagcuggcugggagaggcacgaacuguacugaagcugugucuucccagccugcuuaagaaacc

SEQ ID NO: 4155003 - RNA, 59 nt, Human
ggucaagggacuugcucaaggccacacagcuagaaagaggcagagccaggccuuuggcc

SEQ ID NO: 4155004 - RNA, 64 nt, Human
ggucaagggggccacaccuggugugagcuuucuuggggcugcaucugguggaagccuucuugcu

SEQ ID NO: 4155005 - RNA, 59 nt, Human
ggucacaagcuuauauaccugcaggagaccacacagguaaugcagaugaguaguguacc

SEQ ID NO: 4155006 - RNA, 70 nt, Human
ggucacacagugagucagagguagauugugcaaguuaaggccaugcuuucucuuaguucauugaaagacc

SEQ ID NO: 4155007 - RNA, 72 nt, Human
ggucacaggcuccacggucacuggcucugugagaacacuugcuccagagccuugccuggggcccugugugcc

SEQ ID NO: 4155008 - RNA, 80 nt, Human
ggucacagugcucagagaccugaguucaaagcccagccccacucuuugggcaccuugggucucaggcaaaugaugugacc

SEQ ID NO: 4155009 - RNA, 80 nt, Human
ggucacaguggaguugggguagcccuagaaugaaccaaauagagguuaaggggucaguaccuuauacauugauguugacc

SEQ ID NO: 4155010 - RNA, 73 nt, Human
ggucacauagcuggugagcaaaggagaaggaugccuacugggaaucuggcuucgcagcucccagccauaaacc

SEQ ID NO: 4155011 - RNA, 69 nt, Human
ggucacaugguugagcuugaucuccagcuccccucccuucccaggagaugaggcucaucuuauguggcu

SEQ ID NO: 4155012 - RNA, 80 nt, Human
ggucaccacagggcagggguucggcugauggcugcugggcucaguggcaggucagagucccccuguccuaacagguggcu

SEQ ID NO: 4155013 - RNA, 68 nt, Human
ggucaccagguggcugaggccaugacacucccagaggagacgugaugaggacccaucaccuggugacu

SEQ ID NO: 4155014 - RNA, 66 nt, Human
ggucaccaugucauuuucuuucuuucauucacggaaguuacuguagaagagaaugauuccaugauu

SEQ ID NO: 4155015 - RNA, 81 nt, Human
ggucacccagcaguuuuaugaaggcccuuaaggugcuucaaguaccagguggccccagcgugguuuaacugucugggggcc

SEQ ID NO: 4155016 - RNA, 55 nt, Human
ggucacgggcugcggugggggcgcgaggcucccggcgcccagugcgguucugacc

SEQ ID NO: 4155017 - RNA, 65 nt, Human
ggucacgguugacauuuuguuaaauaugauacucacuauagugaacauucugucaauugaugacc

SEQ ID NO: 4155018 - RNA, 64 nt, Human
ggucacuggucucugcuuccaucagcucagggcugguucccucggaguggaggccagcguggcc

SEQ ID NO: 4155019 - RNA, 59 nt, Human
ggucagaaggagaaaugugugagugagcaguagcagcuacaugacacuguuccucugcc

SEQ ID NO: 4155020 - RNA, 56 nt, Human
ggucagacugauuccucugugugccuguugcucugaccacaggaguccagucgacc

SEQ ID NO: 4155021 - RNA, 59 nt, Human
ggucagaggccaaacugagcaggguuuuguaggcccugcuaaggauuuugccuuuuacc

SEQ ID NO: 4155022 - RNA, 75 nt, Human
ggucagagggcaggaccgcuggcaggugcccauggguagcagcucaccugccuggcccaccuugccacucucucc

SEQ ID NO: 4155023 - RNA, 62 nt, Human
ggucagaggucacaagcuggcaucccuuggagaauauggccagcacacaugcuucuuuggcc

SEQ ID NO: 4155024 - RNA, 61 nt, Human
gguccugggaugacagggaugcuguguuuuauuuacucaucuuuguaacuuccacauaacc

SEQ ID NO: 4155025 - RNA, 70 nt, Human
gguccugucuccucauacugucauauugagaguuaggcuuuuaucauaugaauuuugaggggacacaacc

SEQ ID NO: 4155026 - RNA, 79 nt, Human
gguccuuaccagaggugccacagaaagagccuggugggcagggcaugggcucugggcugcccucuggacaguaggagcc

SEQ ID NO: 4155027 - RNA, 127 nt, Human
gguccuuccagaccuggaacacuguggaagaguuugggcaagucauaaaugaugcucucgaucacucccacauucugcgacuguccccagacccuccgccucuucucagaggucugccaucaggauc

SEQ ID NO: 4155028 - RNA, 80 nt, Human
gguccuucgaggccuggagccgccuaggcgcugagccacugcccgccgugaucugugcgacuccaggucugggcaggacc

SEQ ID NO: 4155029 - RNA, 64 nt, Human
gguccuuuucccacuguauguucagucuacccagccaacgugcugacugagacagggcaggccc

SEQ ID NO: 4155030 - RNA, 83 nt, Human
ggucgaggauccuggagcugacuccguuugagaggcgaagaucccuuuuguuagaugaacagucacuuccccauccaucgacu

SEQ ID NO: 4155031 - RNA, 67 nt, Human
ggugcgaggcucaccaucccucuguguagaaaugagcauaggaagggugucaugagcccuuuguacu

SEQ ID NO: 4155032 - RNA, 64 nt, Human
ggugcuaggugagggcccaccacccauuuaauuucuggugggucuggggcaggcaucugacacc

SEQ ID NO: 4155033 - RNA, 55 nt, Human
ggugcucaaggugacaggacaugucuuuauagaucuugaaaucucaccgagcauc

SEQ ID NO: 4155034 - RNA, 103 nt, Human
ggugcucacuggccaaggccaccuucuggucugccugacagccguccuggauaggcagguacugcugggccagaaggugguggucgugcacugcaaaggcauc

SEQ ID NO: 4155035 - RNA, 66 nt, Human
ggugcucagcuggugaauggacucaucuggaggguccacgauggcuucacuuacauggcuggugcc

SEQ ID NO: 4155036 - RNA, 57 nt, Human
ggugcucaggaaaugacaggugucuccuuccugagagcugacagcuguccugagccc

SEQ ID NO: 4155037 - RNA, 76 nt, Human
ggugcucauaaaugcuccgcuugguccuucacauuuguguuccacacaggagaagccaaguugugagcagugcacc

SEQ ID NO: 4155038 - RNA, 66 nt, Human
gggugccuggucccauugcggcugccucugugccugcaugggacagacccaugggccaggucaccu

SEQ ID NO: 4155039 - RNA, 64 nt, Human
ggguggaggagaacaggccccaugaugcuaucaaugucccggguucuuuuuaucuuucuacgcc

SEQ ID NO: 4155040 - RNA, 63 nt, Human
ggguggaucaugugaugucaggaguucaagaccagccuggccaacauggugaaacucccaccu

SEQ ID NO: 4155041 - RNA, 82 nt, Human
ggguggcauaggaagcugagugcguagccucugcugguaaagugaauggccagcagcuagcuggguuucacuguggacaucc

SEQ ID NO: 4155042 - RNA, 55 nt, Human
ggguggcauggagaaggaggcaguguccgugacugugcugcucuccgcagccccc

SEQ ID NO: 4155043 - RNA, 56 nt, Human
ggguggccagcugguuccuuacugcccacagcuggcgcugaggauuccuggccccu

SEQ ID NO: 4155044 - RNA, 69 nt, Human
ggguggccucauggaggccaggaaacagccuggagucagguggguccuggcucugccauuuacgccccc

SEQ ID NO: 4155045 - RNA, 63 nt, Human
ggguggcgggacagcccugcccggggaugugggugguccaggaggcaggugcuguccccuccu

SEQ ID NO: 4155046 - RNA, 57 nt, Human
ggguggcucaugccuguaaucccagcacuuugggaggcugaggcaggcaggucaccu

SEQ ID NO: 4155047 - RNA, 61 nt, Human
ggguggcucuugcauggggucucuccugcaguugcagcuggagucccagcaaagccuuccc

SEQ ID NO: 4155048 - RNA, 56 nt, Human
ggguggcuuuacuuaccucuaucuuaaugccaaccagauggguauugaagucaccu

SEQ ID NO: 4155049 - RNA, 102 nt, Human
gggugggacggaauccguuccccgccggaaagauggaugcgcccuucccgggcgugcccggggcugugugcccacuucccauccggggagcucaccccaccc

SEQ ID NO: 4155050 - RNA, 114 nt, Human
gggugggaggcagguuaucaauccaggauguuaggauaugaaacaguauaaguauauguauauguauuuguauuacaucuauucuaaagcugaaacucugccuacuuuacaccu

SEQ ID NO: 4155051 - RNA, 81 nt, Human
gggugggauucugacgucugguuuccaccccgcuguuucagaugaggaaacugaggcacagaugcgcaaagaaucacaccc

SEQ ID NO: 4155052 - RNA, 79 nt, Human
gggugggcaccagccucuggggaggggaggugccaggccagcgguagcuccagcccgggggcaggugaccccagcaccc

SEQ ID NO: 4155053 - RNA, 78 nt, Human
gggugggcagguggucuuggcccacccaggaguggcagcaugggcucuuaccuggacagggccaggccaugcucaucc

SEQ ID NO: 4155054 - RNA, 72 nt, Human
gggugggccgggggguggaaaaugauuucagcccagcacuuccaagcugcugucauagccaucccuccccuc

SEQ ID NO: 4155055 - RNA, 73 nt, Human
ggguggggcgcaggcccgggucagggccgcagccggcugugcgccgugcccgcccggggcgcugcccccuccc

SEQ ID NO: 4155056 - RNA, 71 nt, Human
ggguggggcuggggucccgggucaggccagggaggggacucuggccacccagcugacgccuuccccugucc

SEQ ID NO: 4155057 - RNA, 60 nt, Human
ggguggggugggcugccaugaagucagaagcugccaucuggcuuuaugcucacccagccu

SEQ ID NO: 4155058 - RNA, 60 nt, Human
ggguggguggagauucagugagaugaggcuugugcagugucuggcccucacagucacacc

SEQ ID NO: 4155059 - RNA, 69 nt, Human
gggugggugguggggcgucgagcugaacgcuggucuggacaggaaaggcuccugcuucaugucccaccu

SEQ ID NO: 4155060 - RNA, 80 nt, Human
ggguggucccagauggcaguggggggcuggggaacugggaggucuugcagaggaacaacuccucacugccucuggcacuc

SEQ ID NO: 4155061 - RNA, 59 nt, Human
gggugguggaguaauucgcagagguuguuguuugauagccuaggaauucucuuccauuu

SEQ ID NO: 4155062 - RNA, 78 nt, Human
ggguguagcgugguauccuaagguaguuuuaguuuggauuucuccagacuucucuaacuugaggaccuuuucauauuc

SEQ ID NO: 4155063 - RNA, 57 nt, Human
ggguguauacauguguguucacgcaugugugcauguguguuugugguguguauaccu

SEQ ID NO: 4155064 - RNA, 77 nt, Human
ggguguccagccagcaggugagugcagccugauccaggggaaccaggcagaugcucuuuugugggcuagggacuccc

SEQ ID NO: 4155065 - RNA, 56 nt, Human
ggguguccugggucaaccaggucgagugcacaguauugugggggacccaggacccc

SEQ ID NO: 4155066 - RNA, 56 nt, Human
gggugucuggguggcugcagggaggcuuccagaguuuccugcagucgcuagcgccc

SEQ ID NO: 4155067 - RNA, 56 nt, Human
gggugucuguagucccugcuacucgggaggcugaggcaggagaauggcgugaacuc

SEQ ID NO: 4155068 - RNA, 70 nt, Human
gggugucuuccgagggcucggcggccgccgcaggugcaggcgccuccccaccgcccucggggagcagccc

SEQ ID NO: 4155069 - RNA, 91 nt, Human
gggugugaaaguaaagauaacuuauugacugaucagagagggaacucauuuucuuccacguauuugucauauuuugucauauuuuaacccc

SEQ ID NO: 4155070 - RNA, 95 nt, Human
gggugugaacauggaaggaguuaauauguacuaagugcuuggugucuauucagccuuagauaaaugcuagcucccuuuccauuccuuucucucuc

SEQ ID NO: 4155071 - RNA, 79 nt, Human
ggguguggacugagaugaggaagaaucuagaacuucggcagaaacaucugaauuagaacuuuucaacuccauuccaccc

SEQ ID NO: 4155072 - RNA, 77 nt, Human
gggugugggaugaggaggcucgaagggcacugggcagggacaugcugaaguucacugagaguucaccaucccugcuc

SEQ ID NO: 4155073 - RNA, 78 nt, Human
ggguguggugaagggaagggggauacaggggcacaauggaccauugugugcucuggaguugccuucacuucuggacuc

SEQ ID NO: 4155074 - RNA, 67 nt, Human
gggugugguggcucaugccuguaucccagcacuuugggaggcugaggcaggcagaucacuugaguuc

SEQ ID NO: 4155075 - RNA, 74 nt, Human
ggguguuaaauacugaguuggaguuggcauuggaacucuaugaauguuagcuguuagucaguauugauacacuu

SEQ ID NO: 4155076 - RNA, 75 nt, Human
ggguguuaaauggcuccuucugugcaguuuuggagggaaaagauucaagagagacaauagguagcauuaauaccc

SEQ ID NO: 4155077 - RNA, 57 nt, Human
ggguguuaacuuguuuaugacaauagacuuucucuguugugcacaagauggucacuc

SEQ ID NO: 4155078 - RNA, 61 nt, Human
ggguguuuggcuagaguagaacagcuauugucuaaauguuuuuugucuugcuaggcugccc

SEQ ID NO: 4155079 - RNA, 77 nt, Human
ggguguuuucaguaacauuucaagguagaggaacauguucauauucuucaucuuggguguuuuugaaguuuuaaccc

SEQ ID NO: 4155080 - RNA, 113 nt, Human
ggguuaaaagucguuuuagaagcagaaugcaugugaagcaaagaauguuauagguaaaugggauuuuagagaucauguucauuuaaugcuuucuacuacuaaucuuuuguucc

SEQ ID NO: 4155081 - RNA, 73 nt, Human
ggguuaaaaugaaaaacaucuuauaccagagguugaaucuucaugggaauuagagaugcuuuuuauucaaccc

SEQ ID NO: 4155082 - RNA, 71 nt, Human
ggguuaaagaacauagcuguugguuuugguguugaacucugguuugccuaccugccuaguugguucugccc

SEQ ID NO: 4155083 - RNA, 84 nt, Human
ggguuaagaggagagagcauccuggaaccaugaagaaugcuuugaaaguuagagucaagcugcauguucuguucucuccuaccc

SEQ ID NO: 4155084 - RNA, 71 nt, Human
ggguuacaugauuagagcugagacuggaacgccaaagcccauaucugugucccuucuaauuucagugaccu

SEQ ID NO: 4155085 - RNA, 59 nt, Human
ggguuagcuaagcagguaucugggggaagaacaucccuggcagagaacacggcugaucu

SEQ ID NO: 4155086 - RNA, 83 nt, Human
ggguuagguaacuggggaccagugucuguuuguucaguggguuugccuauggauuucagaaagaaggauucccucaccuuccc

SEQ ID NO: 4155087 - RNA, 76 nt, Human
ggguuauauaagacaaaucagagucugauguauugaacacaauuggaucuuauucugccauauuuguuuuuaauuc

SEQ ID NO: 4155088 - RNA, 87 nt, Human
ggguucaaaggcuugcagggaaacaguuuaggaagugcccccuuuuaggauagcuugaucucucugauuccccagugccuccagccc

SEQ ID NO: 4155089 - RNA, 70 nt, Human
ggguucaaugcagauaccuuccagagaugauagcacuucauugacugccaaagaggaugucagcauaccc

SEQ ID NO: 4155090 - RNA, 74 nt, Human
ggguuccagagggaccagaacauacuguggggaacugcgagggaacacaguauguucuggucccucuagaaccc

SEQ ID NO: 4155091 - RNA, 74 nt, Human
ggguuccaggugucccaauguucaggacggcuucagccaggggccugaccucugcuuggcggcacuuggagcuu

SEQ ID NO: 4155092 - RNA, 115 nt, Human
ggguuccuuuuggccaacagcuuguggcagaccaugagucuaagaauuaguagcuacuacaaaggcugaugggcugauggugccacaaauuugaagacagugggaaggaagaccc

SEQ ID NO: 4155093 - RNA, 67 nt, Human
ggguucugcugcuggcucugucacccacuagucacaugaacuuggguggaacagccugugcaaaccu

SEQ ID NO: 4155094 - RNA, 64 nt, Human
ggguucuuggcauaauguuuagauuaagaaaacggucuaaacacaaugcaagaaguaucucccc

SEQ ID NO: 4155095 - RNA, 81 nt, Human
ggguugacuguuucccagaggagcaagcucucuguggugaccgcaucucuagcuaacccucuggcacccaacagucaaccc

SEQ ID NO: 4155096 - RNA, 56 nt, Human
ggguugaggcggaugucggcgggaacaucggccuuguccucguccgccucgaacuc

SEQ ID NO: 4155097 - RNA, 74 nt, Human
ggguugcugaugucaguuaguggguuacucucagcccucuccuccagggcagcuagcccucuagcccacaaccc

SEQ ID NO: 4155098 - RNA, 77 nt, Human
ggguugggcaagcagcaguacauauaagacuaguguaucauuaguuuuuauuucuguauuuucuugacuugccacuc

SEQ ID NO: 4155099 - RNA, 115 nt, Human
ggguuggggugaccagugggcggcaggacauucagaguggagaccuggguaccaugggaccuuugacaugggcuggccuuucccgcucuccucuccuggccccucccccuucccc

SEQ ID NO: 4155100 - RNA, 64 nt, Human
ggguugggucgcaguggagaccaaucaucuagcauuugguccucagguucucugugcguagccc

SEQ ID NO: 4155101 - RNA, 84 nt, Human
ggguuguagcuguaucuucagcugaagcagaguccauuggagggacauuguggacuucgguagaagaacuaagccacuuacacu

SEQ ID NO: 4155102 - RNA, 66 nt, Human
ggguuguauaggaggccuuugaaagauuccagaauaucucccagaaguccucaguacaaaaagccu

SEQ ID NO: 4155103 - RNA, 69 nt, Human
ggguugucauucugcaggccgagggcugaucccuguggaggggcccuggcugcuuguagucuggcucuc

SEQ ID NO: 4155104 - RNA, 76 nt, Human
ggguuguucgcgaacuugacugugaugggcucagcugcgcccagcggcuucugcccauucaguccuuugauagccu

SEQ ID NO: 4155105 - RNA, 62 nt, Human
ggguuguuuuagucuugauguguuagagagugauaauuuuaugcaaguuaugauuaaaaccc

SEQ ID NO: 4155106 - RNA, 108 nt, Human
ggguuuagauuaggugaguuccuaaaccuuucucagugcuaaaauccugaucccaugagcuggcauugaagaaugguuaagauuuggaacucuauaaacacuaaaccc

SEQ ID NO: 4155107 - RNA, 61 nt, Human
ggguuuugugcccuuuaaagcaagaaucaguuauuaaaaugcuuucaaagggcauaagccu

SEQ ID NO: 4155108 - RNA, 77 nt, Human
ggguuuuuaagacaguguaacuauguugugugauacugucaugguagauacaggacauugugcauuugucaaaaccc

SEQ ID NO: 4155109 - RNA, 74 nt, Human
ggguuuuuugaucucuguucauuuauuuacuggggaaaaauguuaacacauuccagaaagaaugaacugaaccc

SEQ ID NO: 4155110 - RNA, 65 nt, Human
gguaaaaagaguuugagauuuggcaucuaacagacccgguuuuaaaucucaggccucuauuuacu

SEQ ID NO: 4155111 - RNA, 88 nt, Human
gguaaagaaaguuuauuucuugauggaggaacuacaaaauauuguggccauuuuugcaaucuaucaggacugcgugaaguuuuuuacc

SEQ ID NO: 4155112 - RNA, 67 nt, Human
gguaaagcaucucaccugcccccacguuagcaacuguugccagggaaguaguugugagagcacagcc

SEQ ID NO: 4155113 - RNA, 87 nt, Human
gguaaagcugaagguuuuuguuugugaaauguuacacuaagauaggagcuugugacagaucuuuaaauaaugcuuuuaaaaugugcc

SEQ ID NO: 4155114 - RNA, 62 nt, Human
gguaaaugucuguuaacaugaaugagcuaguauuuguaucuggcccauagcagauucuuacu

SEQ ID NO: 4155115 - RNA, 82 nt, Human
gguaaauuguaaacuagacagugcugagccauaucuaauuuauacuuuagguguccucaugauuuucuagaaaaaaauuacu

SEQ ID NO: 4155116 - RNA, 86 nt, Human
gguaacaaagaauuaacugcaauugaaucugaacauuuuuucaagagauccaggguuggauuugcauauuuaaaauuuauguuacc

SEQ ID NO: 4155117 - RNA, 74 nt, Human
gguaacaguaggugauaaugcaaaaggaauuuauacauuaaaagcuaaauucaaaugcaaguuacuacuuuacu

SEQ ID NO: 4155118 - RNA, 83 nt, Human
gguaacaguauguagaguaagaaaaccuucuguuuugcuauauauuuauaagaagucagcuuuacugugcacuauugugagcc

SEQ ID NO: 4155119 - RNA, 62 nt, Human
gguaacauucuagaaacuuaacaucuaauagagaagauggauaggcuaauagacauguuauu

SEQ ID NO: 4155120 - RNA, 73 nt, Human
gguaacuaagggguggagaguguugccaguucugcccagugaagcugcuggcaaaccauucccagcucagacc

SEQ ID NO: 4155121 - RNA, 64 nt, Human
gguaacuugaguguguuguucaaugagguccaaaugagaugaacaaggcauuccggaaguaacc

SEQ ID NO: 4155122 - RNA, 73 nt, Human
gguaagagccuaucagggauggaguugagaauugaaccugaguucucuggcuccaaauucugauguucuuucc

SEQ ID NO: 4155123 - RNA, 60 nt, Human
gguaagauuacccucuccauuugacugaugaggaaacuggcucagagaggguaauuaacc

SEQ ID NO: 4155124 - RNA, 62 nt, Human
gguaagcacaucugugguuauuaaauauaauuuuauuauuccauggcuggagaucugcuacu

SEQ ID NO: 4155125 - RNA, 79 nt, Human
gguaaggacagcagcuacuuuucccucaagcaugugauaggugccagcagggaggggaaaguggccaagcucuuuugcc

SEQ ID NO: 4155126 - RNA, 62 nt, Human
gguaaggcccuuugcucagccuguaacuauguaucugcaaggcuggcuucaggagccucucc

SEQ ID NO: 4155127 - RNA, 62 nt, Human
gguaaggccugaggaucaguagguaguuuguguccagcugcccagaagcuuagagcuuagcc

SEQ ID NO: 4155128 - RNA, 68 nt, Human
gguaagggcgaggggaaggcaagcaaaccugagagaaggagaagccucugccugccccugcuuuuucc

SEQ ID NO: 4155129 - RNA, 55 nt, Human
gguaagguagcaaggggccacagucuuccuuugaucugggccucucauaucugcc

SEQ ID NO: 4155130 - RNA, 67 nt, Human
gguaaguacaaagauaaaaucucaccaucuuguguaaggugauggauguguaucuuuuuauaguacc

SEQ ID NO: 4155131 - RNA, 63 nt, Human
gguaaguucuacagcuucgcaggcaugcccuacucauucaugcuugggcuuagcaaccuuccc

SEQ ID NO: 4155132 - RNA, 77 nt, Human
gguaauaauucaugauggcagaaaggauuauuuuagaagucuaucuuuucaguuuaugucuugaauuaauauuugcc

SEQ ID NO: 4155133 - RNA, 75 nt, Human
gguaauagaaauuuacagacccucccacuaagcuuuaaguaacaggcagaagggacaggguuuguagagguuacc

SEQ ID NO: 4155134 - RNA, 68 nt, Human
gguaauagcuauaggggagcaguuuucagcugaauauaagaaagcaucuucuaucaguuagacuuacc

SEQ ID NO: 4155135 - RNA, 86 nt, Human
gguaauauauacaaagugcauagaguagugccuauuuuauaaugggucuucaauaauguauaaaguaauuauuuguauauauuauu

SEQ ID NO: 4155136 - RNA, 67 nt, Human
gguaauccagcacuuguucaugugaacugaacucugauuggaccuucacggauggagugcaggugcu

SEQ ID NO: 4155137 - RNA, 79 nt, Human
gguaaucugagccagaaaugagguaguaacaguaggaauggggagauuacauucaauuucuagagguauuuagauuauu

SEQ ID NO: 4155138 - RNA, 83 nt, Human
gguaauuuuagagacauugacaaggacggucuccauggaguaguuggagccaaaguccaaaugcaguguguuugagagagacu

SEQ ID NO: 4155139 - RNA, 76 nt, Human
gguacaaaauaaauuagacagauuugucuuguuuuaugagcaagauccuguuuuucuauuucauuuucuuugugcu

SEQ ID NO: 4155140 - RNA, 60 nt, Human
gguacacauugugacuguauuagccaguagacuauggaagugaugaguuacgaugugucc

SEQ ID NO: 4155141 - RNA, 130 nt, Human
gguacagaaacagcuagauugguuacgguuggcauuauugguacacuguuugaacuguggucggccugcaauuggcugaaacucagcagcugugacuggaugagaccuagccacuuguuacaagaguacc

SEQ ID NO: 4155142 - RNA, 63 nt, Human
gguacagaagagaguaguccaguuuuguuuaacagacauacaagcugguaccuccuccguacc

SEQ ID NO: 4155143 - RNA, 78 nt, Human
gguacagacgccucggagaugcuggcugagaucuugcagcugcaguagaucuagguggacaucauccuggugaagacc

SEQ ID NO: 4155144 - RNA, 127 nt, Human
gguacagggacccagucaucauuggaauaaaccaucugcucugggccagcuauuaaccugcuucaguguugccguucccaggcagaugguacguuuuagcuggaugacugcuuugugucucugggcu

SEQ ID NO: 4155145 - RNA, 96 nt, Human
gguacagguacgucagcucuccuuuggcguguacaguggagcaaggguaagaagcacugaguucugacugugaugccaguagcacuaccugcagcc

SEQ ID NO: 4155146 - RNA, 82 nt, Human
gguacaguguguaaagagaaugguauauggaacucaucacaacuaauuuggaauccuggcuauacuauuuuucauuugggcc

SEQ ID NO: 4155147 - RNA, 61 nt, Human
gguacauauuguagcuugauuagguggcucugaaaucugagaaguuacauuguauuguacc

SEQ ID NO: 4155148 - RNA, 72 nt, Human
gguacauuucccagagguaugaauaaguuggauaacuuuccucacauugugacaguuuuggagaaaugaacc

SEQ ID NO: 4155149 - RNA, 96 nt, Human
gguacauuucuuuguguguaugcagucuuuuucuucuagcuaauuucugucugguggagaagaaacauuuguaugucaguaguggagucaugugcc

SEQ ID NO: 4155150 - RNA, 57 nt, Human
gguaccaguuauuucugaaugcaugggaaaauccauuuuguagcaaugacuguugcu

SEQ ID NO: 4155151 - RNA, 69 nt, Human
gguacccuggcacagccuccaugucgucccucugcagagagaggaggacucaggucuggccauggugcu

SEQ ID NO: 4155152 - RNA, 61 nt, Human
gguaccgagaacacagaaguagggccuugucuucacucaagcugcugugugugccucagcc

SEQ ID NO: 4155153 - RNA, 78 nt, Human
gguaccuggccgccauggcccacucuggucccggcacccccgcggggcugcugagcagggagggccgugugaggugcc

SEQ ID NO: 4155154 - RNA, 80 nt, Human
gguacugaugaacauuuaaagccucuugauauagucaguuacacugauuuacaagagguuuugugucacuuuucauugcc

SEQ ID NO: 4155155 - RNA, 61 nt, Human
gguacugcccuggcugagaugcccgggaaugccacuggagugguuaguuauuggcagugcc

SEQ ID NO: 4155156 - RNA, 55 nt, Human
gguagaaacuuauuugcagaaaagaaacaauuauuugcauuuuaaguuuacugcu

SEQ ID NO: 4155157 - RNA, 78 nt, Human
gguagaacuuccuuugcuguucggagguuagauuggggaaagucgcaaaccuacagaaaaguagaaaaagugcugucc

SEQ ID NO: 4155158 - RNA, 58 nt, Human
gguagaagugaugucauguuauagccaaugcuagguuauaaaaaggauuauuucugcc

SEQ ID NO: 4155159 - RNA, 70 nt, Human
gguagaaucuggaucugggcgcauuucuuuugaugaaggucccaugugcuuauggucucugguuguuacc

SEQ ID NO: 4155160 - RNA, 86 nt, Human
gguagaauuguacaggaaguugcuggagggggugcuauaucaaaauccaagaauccaaagacuugcuguauguaaagcauucuauu

SEQ ID NO: 4155161 - RNA, 56 nt, Human
gguagacugagcuccuugaggacagagauugacuguuuuuaaaauaucaguauucc

SEQ ID NO: 4155162 - RNA, 76 nt, Human
gguagagaaagauucugucaguuaggaggagacugugauguuacuuuuccugugauaugaugaguacuuuuuuacc

SEQ ID NO: 4155163 - RNA, 71 nt, Human
gguagagagagcuguguuuaguaguuacggcugcuuacgcuggacuggaggacauagcuugaccaccuacc

SEQ ID NO: 4155164 - RNA, 79 nt, Human
gguagagagccaugguggagauggggucuuucuggacagcacacacugagggcuccccacaccccuccauggcuagacc

SEQ ID NO: 4155165 - RNA, 83 nt, Human
gguagagauauuaguuuggagacuacaauuggagugaucauagauuacaaaagcauuauagucccagacaguaugaaacuacc

SEQ ID NO: 4155166 - RNA, 72 nt, Human
gguagagcacauuucucuaccucacacaaucguccuaggguaauugaucagggcugagaugguggcucugcu

SEQ ID NO: 4155167 - RNA, 93 nt, Human
gguagaggaacccaguagggguguuucgagagagguugggggccuggugcgucuauccuuguugaaagggcuccugaguggagguucuuuauc

SEQ ID NO: 4155168 - RNA, 64 nt, Human
gguagauccaggccuugaaguaccagugcagcgugccacuuacuaucuaagaccuggaauugcu

SEQ ID NO: 4155169 - RNA, 57 nt, Human
ggugggagcuguuucacaugcugcagccagcuaagcaucuucaacaggcauuuuacc

SEQ ID NO: 4155170 - RNA, 64 nt, Human
ggugggagguggggcugaggucagagcucgggucugcaugacuucaaaggcucuacuccuaacc

SEQ ID NO: 4155171 - RNA, 59 nt, Human
ggugggaguguggucauggagggcuggcuguuguugcccucugagaccagcucugcacc

SEQ ID NO: 4155172 - RNA, 62 nt, Human
ggugggaugugccaccccuaggaaggucggcaccuuuaccuuggggaacuggacgugcugcc

SEQ ID NO: 4155173 - RNA, 56 nt, Human
ggugggcacccgagacuggaucgaaggggagaccuaccagugcagggugacccacc

SEQ ID NO: 4155174 - RNA, 56 nt, Human
ggugggcagagccaguucaugaaggauuuaccauuucugagcugcugcugcccauc

SEQ ID NO: 4155175 - RNA, 88 nt, Human
ggugggcagagggcaaggagagggcucuguguggguacuggggagacucgguguccaagcucugucuccaggccucaguuuguccauc

SEQ ID NO: 4155176 - RNA, 56 nt, Human
ggugggcaggcuggcgugggugggcuggcgcugcccacucaggccuccugcucucc

SEQ ID NO: 4155177 - RNA, 59 nt, Human
ggugggccaaauuaaacauauauguauuuucauuuaauguaugugcaguuugguuuauc

SEQ ID NO: 4155178 - RNA, 84 nt, Human
ggugggcccagcgguuccuguggauuggagccaggcagugugauguuaccagucaccacuccaggucccaguuccuggcccgcu

SEQ ID NO: 4155179 - RNA, 87 nt, Human
ggugggcucugagagcaaggguuccaacgagaagggcagaucagcaucugccuuuuauggcuagccucagaagucacagagccuccc

SEQ ID NO: 4155180 - RNA, 58 nt, Human
ggugggcugaggggacaccaaggacccgugcuguuuccugugacccuuccagucuacu

SEQ ID NO: 4155181 - RNA, 69 nt, Human
ggugggcuggaagugcauugaugcuucagggcagagaauccucuuggcaauggauguguuccagucccc

SEQ ID NO: 4155182 - RNA, 60 nt, Human
gguggggaagaacuaaauggaagcaggcauuaacucuucuggauuuauucauuccuuguc

SEQ ID NO: 4155183 - RNA, 72 nt, Human
gguuguagauuuagauagaaauguaauaguccaaaaauacacuacacagcuucaaagucuaauucuacaauu

SEQ ID NO: 4155184 - RNA, 81 nt, Human
gguuguagcugucagugcugugccuguauccccucugcucaugccuuuuucgugcagguaggccugacuuccagcagcacc

SEQ ID NO: 4155185 - RNA, 84 nt, Human
gguuguaugaacuugaaaaaucccuugcucucucagacccucaguauggggucuggaaaaauaagggggacauacucaauagcc

SEQ ID NO: 4155186 - RNA, 83 nt, Human
gguugucuacuaguuaacaguggagcucagaugaaaaucaggucugauugucauuucagccccugccugacuucaaaucagcc

SEQ ID NO: 4155187 - RNA, 118 nt, Human
gguugugcucuuuauauaucugcugguugacauggugggccucaucacagugcauuaguucacccgggcucagagagaggcucaccauucugucagcagugcaacaucaugugcuucc

SEQ ID NO: 4155188 - RNA, 93 nt, Human
gguuguuccugagcagcagcugggccagguuccccaggucgucgaacaggccgcggggcagcguggucagguuguuguuggacagguccagcc

SEQ ID NO: 4155189 - RNA, 79 nt, Human
gguuguuccuguuauuugcuugcuaaggaaauagagggaaaaacuaguauuucagugucaguaaugcagcaggaauacu

SEQ ID NO: 4155190 - RNA, 56 nt, Human
gguuguucucuuuucuccuugggcuuuucuguugcucuuagauauggagaauuacc

SEQ ID NO: 4155191 - RNA, 60 nt, Human
gguuguucugcacccauguaugggguuaaugcuggcuccacucaccgaggcagagcaucu

SEQ ID NO: 4155192 - RNA, 71 nt, Human
gguuguuuucugauaaggucaaugcagugcucuguaauuaaacacuacagaagucuuauuagagaaagauc

SEQ ID NO: 4155193 - RNA, 83 nt, Human
gguuuaagacagggaaucauuuacauagaaacaauauaagcauucuagacauuguauacucuuguaggugaguccucuuagcc

SEQ ID NO: 4155194 - RNA, 93 nt, Human
gguuuaaugcuaaugccacuauccuuacuguucugugaguauuuguucagccacgggugauucaagagaguugggguaucagcaugugcagcc

SEQ ID NO: 4155195 - RNA, 117 nt, Human
gguuuaauuauuuuagagaaucuaaagucuuaaugaaagugaaauaucaaccggucauauaauuuucacuagugauguguguuuauuaacauuuuaaguucucugaaguccagaacc

SEQ ID NO: 4155196 - RNA, 85 nt, Human
gguuuacuaggcccuggggagaguuuuacacccagcugccaagaggcacaaaggagcuguggaagacugucagggucauuaaacc

SEQ ID NO: 4155197 - RNA, 63 nt, Human
gguuuacuguuuuuaacuaauugugccuugcuggguggcaauacaauagaaagaguaaagacc

SEQ ID NO: 4155198 - RNA, 73 nt, Human
gguuuagacuucaucucucacugugaauggcggaauuguucuaacuaacuacaguaagaggaaagcagaggcc

SEQ ID NO: 4155199 - RNA, 82 nt, Human
gguuuagagucacaaagaugggguuucuaacacugcaugccucuccugcaacucuaggaaacauccuuaucuauucuaagcc

SEQ ID NO: 4155200 - RNA, 75 nt, Human
gguuuaguuuuaaguuaaugucaucucagggcuaaaguuuguccaauugagauucccauuaauuuuauauaaacc

SEQ ID NO: 4155201 - RNA, 79 nt, Human
gguuuauuuaagcuuuggagaggcgggcaggaaucaagaagcagaaaaauauccugugccagucuucgaaguaaguacc

SEQ ID NO: 4155202 - RNA, 56 nt, Human
gguuucaaugagaagugcuuguccaugaguuaaagggagaggccucaggugaaacc

SEQ ID NO: 4155203 - RNA, 60 nt, Human
gguuucagauauugauuuuuuuggcauugucaauucugucauugaaauuuuucugagauu

SEQ ID NO: 4155204 - RNA, 79 nt, Human
gguuucagcuguuucuguguucucugaggagccugcaaagcuaaccaagcagguaacagaauagcagaaacagaaaacc

SEQ ID NO: 4155205 - RNA, 65 nt, Human
gguuucaggaggccgugugcucaguggagugucucugccugucuucgcuaagcuugccccugacc

SEQ ID NO: 4155206 - RNA, 65 nt, Human
gguuucauaugcuggagggucgucuagccgagagguucaacauggcuuuauucacauaucugacc

SEQ ID NO: 4155207 - RNA, 91 nt, Human
gguuucauggguguauacauacgucaacacuugucagauucuacacuuugaacacagugugaucguaugucaauuaccccucagugaagcu

SEQ ID NO: 4155208 - RNA, 70 nt, Human
gguuuccagggaccucccugagagcucccaggugacuggcuucaaggcucaaggcaggacccuggguccc

SEQ ID NO: 4155209 - RNA, 97 nt, Human
gguuuccugaguauuuucacauguuacaguccuuuguauuguuuaauccucacuuuaacucucagagacagggacugucauaauugccaaggaagcc

SEQ ID NO: 4155210 - RNA, 77 nt, Human
gguuuccuggucagcugaggcaaccagaggagcacaaacuuccccuucacuccaugccaggcuggcaaaaggaaacc

SEQ ID NO: 4155211 - RNA, 63 nt, Human
gguuucuaagcuguuggagauccuuaccacacaggaucuccaguauccuaguauugugaaauc

SEQ ID NO: 4155212 - RNA, 87 nt, Human
gguuucugcccucauguuguguuuauuuagccugaacugaggcacacguugcauuuucuaaguaaacacagcauacagcagcacucc

SEQ ID NO: 4155213 - RNA, 77 nt, Human
gguuucuuaauauuuuccaagauaauacacagaaacaauguuucaguagggucuuaggugaguaacucuaagcgacu

SEQ ID NO: 4155214 - RNA, 111 nt, Human
gguuucuuuaccugugggucuaaguguuccagugcuguuugaggaccugguguggggcuccuucccagcccaucucaaaggucuagagcgggacuuccaggugaagucacu

SEQ ID NO: 4155215 - RNA, 78 nt, Human
gguuugaaaugaacuuuaauuagcuuuugucuccagaauuccccaucgaugccugggcuuuaggguucuccucacccc

SEQ ID NO: 4155216 - RNA, 73 nt, Human
gguuugagcccaggaguuugaggcuguggugagcuaugauugcaccacugcacuccagccugggcaacagagc

SEQ ID NO: 4155217 - RNA, 55 nt, Human
gguuugauaaaaagggaaaggguuaucagguggccacauccuuuccuugucauuc

SEQ ID NO: 4155218 - RNA, 91 nt, Human
gguuugccacuuacagaguuacuuggagccagcugaaguuagagcuggcuucuccccuuugagucuucaauucuguguuuaugugcaggcc

SEQ ID NO: 4155219 - RNA, 84 nt, Human
gguuugccuguuuaaucagcaauaugauaggcuuugugacuguuuucuuguuauauagguuaucauauuugcccugagugaacc

SEQ ID NO: 4155220 - RNA, 57 nt, Human
gguuugcugaaacacagauugcugggccaacccuugaaaauucuguuucagcagauc

SEQ ID NO: 4155221 - RNA, 57 nt, Human
gguuugcuuagcuagcaguguagccuguucuccagaagcacuguuacaaagcacacc

SEQ ID NO: 4155222 - RNA, 86 nt, Human
gguuuggagggcugcguucauuuugagugcuguuguaaucaauuuuagauacagcauuccacaauggaucaguuugcauccaaacc

SEQ ID NO: 4155223 - RNA, 65 nt, Human
gguuuggauuugauaaguaaaauggcagcgugaaaauguuagccucaugcuuaauaggcuaggcu

SEQ ID NO: 4155224 - RNA, 65 nt, Human
gguuugucaugauauaauuucugugaauauuuauuuuuaaaauaaagagauugugucuacaaauc

SEQ ID NO: 4155225 - RNA, 76 nt, Human
gguuugucuggaguggcagucaucugaaggcuuaauugggcuggaguguucaagaugacccagucacacgauugcc

SEQ ID NO: 4155226 - RNA, 58 nt, Human
gguuugugcaagagggccaccuuaggucuccuugaggacauuuaucuuggcgcagauc

SEQ ID NO: 4155227 - RNA, 92 nt, Human
gguuugugcuagcugacuguugcuguugaugaggcacucaauggcugcagccuucuagaucuucagaaauaacaacaauuacuguacacgcc

SEQ ID NO: 4155228 - RNA, 68 nt, Human
gguuuguggcuaugguuaugucuauaagugcaggggaagccuugcagaaguauuccaggccccaaacc

SEQ ID NO: 4155229 - RNA, 93 nt, Human
gguuuguuaaggguuagaaucacagugccuucguaaauuuuucuuagauggaggugaagguaugaguagauuuauucugaagguagacaaacc

SEQ ID NO: 4155230 - RNA, 58 nt, Human
gguuuuaacuacagaauugcaaguccacaaaaccuggaguugcagcaaaguuaggacc

SEQ ID NO: 4155231 - RNA, 68 nt, Human
gguuuuaagaagagcagcagccauugaaaccagcacgaaggcugggcugacugugaaauucuggagcu

SEQ ID NO: 4155232 - RNA, 59 nt, Human
gguuuuaccagucuguuguugcagagugcuggguguauuuugcuuuagcugacuguucc

SEQ ID NO: 4155233 - RNA, 85 nt, Human
gguuuuauauugagaaauguuuuuuaagcugaaaauaagguacaacuuuagcaacauaagaaacauuuuguucauggacaaggcc

SEQ ID NO: 4155234 - RNA, 94 nt, Human
gguuuucaagaaggauguucuauacuagauuauuugcauagccagcagggcagugugauuaucuggaguagaaaaaucgcuuccugaaguggcc

SEQ ID NO: 4155235 - RNA, 61 nt, Human
gguuuucaggccagaagauagaccuagagacagaauuugggucuggaacgaggucuaagcc

SEQ ID NO: 4155236 - RNA, 68 nt, Human
gguuuucagucuuguuuuucugguccagcuaugaaauuguacuaaucacagaaacagacuguuuggcc

SEQ ID NO: 4155237 - RNA, 65 nt, Human
gguuuuccagauuaagauaccacuucaaaagugacuguucaaggugggcuuaacuuuggaaggcu

SEQ ID NO: 4155238 - RNA, 90 nt, Human
gguuuucccaugaagcagggugucuugacccauggccguguccaccugcuacugaguaaggggcauuccuguuacagaccaaggagaacu

SEQ ID NO: 4155239 - RNA, 69 nt, Human
gguuuucucccccucuucucaggccacuacccagaugcaaaaaauggccugggcagaaguuaggaagcc

SEQ ID NO: 4155240 - RNA, 129 nt, Human
gguuuugacagagucccaagugcaccugcaaagcagacaggcugccacagugcugggcggagaaaggucacccugcccuugccuguucagcauggcucugcagaaagggccuaaugacuaauuaaaacc

SEQ ID NO: 4155241 - RNA, 89 nt, Human
gguuuugaugugccuuauguuaugaauggaugaucugagcuauuugcaaagauuugcauaaucauuacauacauuauauacaaucaacc

SEQ ID NO: 4155242 - RNA, 76 nt, Human
gguuuuggcuccuccaauauggacuccucuaaacacagggagcuuagaggauguccacauggacggugcucauucc

SEQ ID NO: 4155243 - RNA, 57 nt, Human
gguuuuuccuuaaaucuguuucuagugauaacauuagcucacagguuaaaggacauc

SEQ ID NO: 4155244 - RNA, 81 nt, Human
gguuuuuguuuaaugauguuuauguuuggggauuuuuaugucucuuaguaauccaaaguaacauuaaacagaacaaaugcu

SEQ ID NO: 4155245 - RNA, 77 nt, Human
gguuuuuuguccuugugauaguuugcugagaaugaugguuuccagcuucauccaugucacuacaaaggacaugaacu

SEQ ID NO: 4155246 - RNA, 123 nt, Human
guaaaaacgguuucgaaugcuaaagccagcagagaaauuacauauuugagcucugacccuuuguaacagaauccagaucugugguaucucuauuuugggagguuuuagcauaagccaucuuac

SEQ ID NO: 4155247 - RNA, 106 nt, Human
guaaaaacuaucuauauaguuucugaccacagacaaccugcuacaaaccuuagaaaugaguuggcagguuggccuuugguucacaaacucgaugauucaauuuuau

SEQ ID NO: 4155248 - RNA, 92 nt, Human
guaaaagcacuuuaugaagugagugaaaaugcagaauacaaaauugugccuauacuguguuuucaccacuguuuagauucuaugcacauugc

SEQ ID NO: 4155249 - RNA, 78 nt, Human
ggggcucaaugaaugcuuauuaaauugaaaugaauuauaaauuaugaaggcuuuuuaaagcauuuguuggagccaacc

SEQ ID NO: 4155250 - RNA, 88 nt, Human
ggggcucagaagacaguggcuccuccccccaggcucagccucccaguggcugaguggcuacaggcagcuuacaucuccucugagccuc

SEQ ID NO: 4155251 - RNA, 92 nt, Human
ggggcucuaugggugcaaggcaggguacuuaauauuuacgggguguggggaagccugaaccuuucagugcccuuucugucccccagugcccu

SEQ ID NO: 4155252 - RNA, 83 nt, Human
ggggcugagcaaaaggaggaggagccaggagacauugggaauggacccaggaguuccggacgcccgucuuccagcgcagccuc

SEQ ID NO: 4155253 - RNA, 59 nt, Human
ggggcugagggcagaugggguagcugggcagccuuccaccccucagcucuucgugcccc

SEQ ID NO: 4155254 - RNA, 55 nt, Human
ggggcugcaaagggcagcugugacuccagggcagagcuggccugguuugagcucc

SEQ ID NO: 4155255 - RNA, 61 nt, Human
guacagcugugaaaauccacaggauggucaucacuuaucauuccacuguggaacagcuuac

SEQ ID NO: 4155256 - RNA, 68 nt, Human
guacagcuuaaguggguggcagcaugugcgagccauuucuauacaucugauuuaccuacugaaugugc

SEQ ID NO: 4155257 - RNA, 70 nt, Human
guacaggccagucacuuacaaaaauauaauaugacucacaaauugaugcccguugugacuggccuauagc

SEQ ID NO: 4155258 - RNA, 60 nt, Human
guacaggucugcgucuccucuggccugugagcuucugagguauuuuugcaugccugaugc

SEQ ID NO: 4155259 - RNA, 73 nt, Human
guacaguaucuuagggaauuaacuaaaaauuaacuaaaauuaacauuuucuguuaggacccuggagaauguau

SEQ ID NO: 4155260 - RNA, 78 nt, Human
guacauugcacaacuacaggaaaagucauucauaaagucuuugaugugaauaguguucccuggaguuguacaguguac

SEQ ID NO: 4155261 - RNA, 83 nt, Human
guacauugucuuugaaaugucagcaggaguaacauuuuuugaagucauggaauuuauguuugcauuuucaaagauggcagugc

SEQ ID NO: 4155262 - RNA, 78 nt, Human
guacauuucucuuguucuuauuauguaagucugucuuuaaggaauggugggcaaucuuaagagcaaaagaaguuguau

SEQ ID NO: 4155263 - RNA, 95 nt, Human
guaccaagguuacgugaguccagcucauugucugggaugcacugagagcuuuauucuagagaagaccuggaucuucacagugaaaucugcagugc

SEQ ID NO: 4155264 - RNA, 67 nt, Human
guaccagucucugugggcaccugggagaauccucacaccuuccuuucagcccagggggauagguugc

SEQ ID NO: 4155265 - RNA, 123 nt, Human
guaccauuaguaaaauugaaauguguguguguguguguguguguguguguguguguaauacauguauaauauacauacguacauacguauguguaugcauauauauaguuuguaaaaugaaac

SEQ ID NO: 4155266 - RNA, 66 nt, Human
guacccagcuccucagaagaccagauaugaaguccccucccaaccugguuacucuguucugggaac

SEQ ID NO: 4155267 - RNA, 59 nt, Human
guacccugaggccucagguucauuggcuuuuugucagauugccauaggucucaguuugc

SEQ ID NO: 4155268 - RNA, 73 nt, Human
guacccugguaaacaauaccagccuugaucugagaggaaggggaggcaggguguugauuacagagaugggugc

SEQ ID NO: 4155269 - RNA, 116 nt, Human
guacccuguguguugcggggaggcaguggagaagcaccuggcuggaaguuagagaacuugccaucggcaagaacagauucagccugaacuccagccaucuggccacacaccgguac

SEQ ID NO: 4155270 - RNA, 66 nt, Human
guaccugcaccaggcccagcauggugcccccagcauuuagcacacggccugguacauaguaguuac

SEQ ID NO: 4155271 - RNA, 87 nt, Human
guaccuguccuacuagauagugaguauucugguuaauuaaauguccacguuaauaccacugugcucauuauaacuguagauaaggac

SEQ ID NO: 4155272 - RNA, 70 nt, Human
guaccuuagcaaggcagaauucagacucaggcuuuucugaucacaaagcacuuucugcuuccuaaugugc

SEQ ID NO: 4155273 - RNA, 64 nt, Human
guaccuuccuggacuccguccuagauuaaugacucaaaucucuggaguauaaccagggaucugc

SEQ ID NO: 4155274 - RNA, 64 nt, Human
guacgguggaaaugcccccaaauaguguaugaauacauuuuggggaguuuccaugacaacguau

SEQ ID NO: 4155275 - RNA, 75 nt, Human
guacucaauuugucuucuuuuauuucaagggugugauuacuuuagagucccuugguaaaagggguuaucgaguac

SEQ ID NO: 4155276 - RNA, 90 nt, Human
guacucagguaauuguaaugcaauguuugauaugcuauauaauagugauauagcacugagucuagcuuuggaugugcagaacugagcuac

SEQ ID NO: 4155277 - RNA, 60 nt, Human
guacugaauggggcaguaagaaaggauuaagcaucacuuucuagacugcuuuauuuuuac

SEQ ID NO: 4155278 - RNA, 61 nt, Human
guacugagaucauuaugugaaaggaugggacacuuuacccauaaagucaugaucugaguau

SEQ ID NO: 4155279 - RNA, 98 nt, Human
guacugauuuucugccuuagaagugagugugugaauguuucccuggcguuagcuucugagcaugcacaugacuggcuuaauuagaggagaagaagugc

SEQ ID NO: 4155280 - RNA, 81 nt, Human
guacugguguugaaaccuuuuuauugaaggcuggaugcuucuaaaaugguaccugcauacaaagguuuacaacugauguac

SEQ ID NO: 4155281 - RNA, 80 nt, Human
guacuugauuacaaaacucaucuaugacgaauguaaaagaauauccaccuguuguacugaagaguuuugcaaccaaguau

SEQ ID NO: 4155282 - RNA, 70 nt, Human
guacuuggggucguauaucugugggcccaggccgaaggccuggcugcucugaugagcgcccugacuguau

SEQ ID NO: 4155283 - RNA, 113 nt, Human
guacuuuaugcugcaucuucagaagcaccuuuuuauauguauugacuuugauguuuaauuauuaccaagcaaucauaauacaaugaaauuguguugaugcuuucuuaaauugc

SEQ ID NO: 4155284 - RNA, 78 nt, Human
guagaaagugacaauaacuucuuugguuuaaagagaacuuucauucucacagugagccugaggucggucauuuucugc

SEQ ID NO: 4155285 - RNA, 68 nt, Human
guagaaauggaaucucacuauguuacccagguugguuuugaacuccugggcucaagugauccuccuac

SEQ ID NO: 4155286 - RNA, 71 nt, Human
guagaacaugauguugcauuguacugaaaagcccucuggcuucacauagcaaugugagccuucaauuucac

SEQ ID NO: 4155287 - RNA, 57 nt, Human
guagaacugggguggcaaguugagaugacccuaaggucucuguggccuacccucuac

SEQ ID NO: 4155288 - RNA, 81 nt, Human
guagaagagaucauuguaaugauacugauguagucaaccuuucauuguucaucaacauggcaaugcccaucugcauucuau

SEQ ID NO: 4155289 - RNA, 79 nt, Human
guagaagagcaucaaaauuagacauuguugagaaauucacugcuguuucugaauuaucuuguaauuuugaaccuucugc

SEQ ID NO: 4155290 - RNA, 78 nt, Human
guagaagcauaaacuguacuuuaaaaagguauuugaaaauaauguaucaaaaggcuuuaaaauguacauaugcuucac

SEQ ID NO: 4155291 - RNA, 59 nt, Human
guagaauauugaguggcagccugacucccuggacuucagagcugcucagaugucacugc

SEQ ID NO: 4155292 - RNA, 80 nt, Human
guagaauuuggagggcugaguggugcagucaaaugaauuauuuaaucucccacucucagccuaauccucuuguuuucuau

SEQ ID NO: 4155293 - RNA, 76 nt, Human
guagaauuuucuccuuuggcauagaauuauacauuuuaagauaauuaggaaaaugaacagaggaauagaauucugc

SEQ ID NO: 4155294 - RNA, 65 nt, Human
guagacaagcacaggacucagaucacucuuguuuuaccaaccaacugaauucuggguuuaucugc

SEQ ID NO: 4155295 - RNA, 58 nt, Human
guagacaauuucaaaguaauauuaucugcagauuauaucuagcuuuggaguucucugc

SEQ ID NO: 4155296 - RNA, 103 nt, Human
guagacugcagggucaaaaacaaauuagaucaguggauuuucuuccuuuacuuucauagaugagucagaaguuauuggucaaaugugcacaugaccuuucuac

SEQ ID NO: 4155297 - RNA, 87 nt, Human
guagacugggcuccgggaaauguggguaaugggacuggaccugcgccugggguccgcccacccgucaucucccgggagccccccgac

SEQ ID NO: 4155298 - RNA, 72 nt, Human
guagacuucugcugaccagugccgucuuagaaaguuucuuuguaacuuucuaguccuaggagaggagucaac

SEQ ID NO: 4155299 - RNA, 75 nt, Human
guagagaagagguggccaacucaauguuuuucaugagucuugucaugaaggaucaguggcuucuuuuuuaucuac

SEQ ID NO: 4155300 - RNA, 112 nt, Human
guagagacggcuuuucaucguguuagccaggauggucucgaucggcaggaggaucucuugaggccagaauuuugagacuacuugggcaacauagcaagaaucccgucucuau

SEQ ID NO: 4155301 - RNA, 69 nt, Human
ggggggucuagagguggccaagcgaggaaggggcaagcaguuccccaagcaggcaaucucccgcuccuc

SEQ ID NO: 4155302 - RNA, 62 nt, Human
ggggguacaaguauagauuucuuacaugcauauauugaggucugggcucuuaguguacccuc

SEQ ID NO: 4155303 - RNA, 105 nt, Human
ggggguagaaggagggguuggggaggguugugugugugugcauguguauguguguguguaucugacagcuaagcucccacaaccuguagcaugcucauuaccucc

SEQ ID NO: 4155304 - RNA, 106 nt, Human
ggggguagacaggagaccuggucaauuucgagcagcacuguguuuuucugaccuggaaaagagaaggaaacagcugugcuuugagccugaauccuuguuuaaaccc

SEQ ID NO: 4155305 - RNA, 66 nt, Human
ggggguagauaucuuugggguuccuuuuauaagggcacuaacucgccucaugagggaucugcccuc

SEQ ID NO: 4155306 - RNA, 55 nt, Human
ggggguaggcagacaaggacaugauuaaaauagugucacgucuucacauacuccc

SEQ ID NO: 4155307 - RNA, 81 nt, Human
gggggucaagacccaggagugcagagagugggagagaggaucuccuccgcccauccugggcuccugucgggccuaaccucc

SEQ ID NO: 4155308 - RNA, 79 nt, Human
gggggucacgugcaggauuuauagcccagcuuuucuaaagguaggcacuguauaaaucuagcaaguaaauauuaccucc

SEQ ID NO: 4155309 - RNA, 78 nt, Human
gggggucuguagccuugcuuuuucaguagcacuuguccaucacugucaaaggcuuugagaaggcagauacugaaaucc

SEQ ID NO: 4155310 - RNA, 69 nt, Human
gggggugacacagagcagucaggcuaggacacugcuuuccaugagcauccaggggacugcugggcccuc

SEQ ID NO: 4155311 - RNA, 60 nt, Human
ggggguggcaccacgugucuucaagaugaaaugccucuuggggacaaacaugcuacuuuc

SEQ ID NO: 4155312 - RNA, 82 nt, Human
ggggguggcugugcugugcauuguaggagguuuagcaggaucccuggcuucuacccacgagaugcaaauagcauccuccccc

SEQ ID NO: 4155313 - RNA, 93 nt, Human
ggggguggggggaggagugcaaaauucagaagcaauuaauucauuucuuucggagcuaauuuaugaaucuuuacucugaacucuccaaguccc

SEQ ID NO: 4155314 - RNA, 62 nt, Human
gggggugguggcugcuuccucaagaggaggguggaucugcucuccugccagcacacaccccc

SEQ ID NO: 4155315 - RNA, 75 nt, Human
ggggguugccuuggagacaaagcuuccuguggguaauccaagauuaucuagcucuuuguccuacaugugacccuu

SEQ ID NO: 4155316 - RNA, 60 nt, Human
ggggguugggcggagggcuggggccagagccuuccccagcccugcugagacccagcuccc

SEQ ID NO: 4155317 - RNA, 73 nt, Human
gggguaacaaugaauacuaagcaccaggcccuuaucagucucuggcacccugacuuaguguuuggauuacucc

SEQ ID NO: 4155318 - RNA, 72 nt, Human
gggguaacggccaggacagugcagguccauccucugcagauggaagacaggcacguccuuugccgcuguccc

SEQ ID NO: 4155319 - RNA, 103 nt, Human
gggguaccagaaaauugcauggaucuuuaaggcuuacccuggaggcccucugaggccuccugacugggguuucuugagggugcaugugugucauccaggcccc

SEQ ID NO: 4155320 - RNA, 58 nt, Human
ggggucacacuguggugacuggaucugccauucacuuagucaccuguugugugaugcc

SEQ ID NO: 4155321 - RNA, 129 nt, Human
ggggucaggcccuuugcuggcaucagaagaugacuuaauuacuguccaauaugcacaccugcugcauaucaagacagagauuauugcucuuuggugaucuuugccaguaaaucuuugccuugaugauuu

SEQ ID NO: 4155322 - RNA, 91 nt, Human
ggggucaugaggagguucugggggucugccuggcccaggagccugguacccgcuggcuuggccuuucacccagagcccccuucauggucuc

SEQ ID NO: 4155323 - RNA, 79 nt, Human
ggggucauuaucauugagggucucucugcugccugguccuguuaucagugugcauuugcagaagacccucuccagcccc

SEQ ID NO: 4155324 - RNA, 56 nt, Human
ggggucugggcuuagcuggaaucuccaucauuguuccuguggcucagugcagcccc

SEQ ID NO: 4155325 - RNA, 60 nt, Human
ggggucuuccuuuuguuaucugacuuugcugacuagaacaguuaaugaagaggaagccuc

SEQ ID NO: 4155326 - RNA, 67 nt, Human
ggggucuuggguagcauauagagcuggguucaaauccugucucugcccucauugcugccuggaccuc

SEQ ID NO: 4155327 - RNA, 66 nt, Human
ggggugaacagggccaggcgagcucuaccaccccuccaccccuccacccugggccuccaucacccc

SEQ ID NO: 4155328 - RNA, 78 nt, Human
gguuggacaggagccagaggcggauggagcgcggcagaggcgcccccacugucucccgugccacuggcuccugcagcu

SEQ ID NO: 4155329 - RNA, 102 nt, Human
gguuggaguggaccuccucccugagccgugcugggaaguugcgugcaccuggggcagcagggcaagugauccuggagcaccguggagaagaacuaccuggcu

SEQ ID NO: 4155330 - RNA, 103 nt, Human
gguugggauauaacggcugggucaaggaaugcuggugggcagaggagacuucuucaccaccacuauguauaucuuuauggcccuguggcuauuugccucaacc

SEQ ID NO: 4155331 - RNA, 72 nt, Human
gguugggcauagaagagcagaaagauaugacagaaccaacuccugguagcuuuugcuuaucugagugcagcc

SEQ ID NO: 4155332 - RNA, 62 nt, Human
gguugggcugggagcugcccugacauggaagaaccauaucuuaggggagaaccagccuuacu

SEQ ID NO: 4155333 - RNA, 64 nt, Human
gguugggcuugaggugaagguagggagcagcugagugcucccggucauaugcaggucacacacc

SEQ ID NO: 4155334 - RNA, 73 nt, Human
gguugggggugcccuaugaggaagcccuggguaagucuugucaaccugagcuucuugggauacccccauggcc

SEQ ID NO: 4155335 - RNA, 62 nt, Human
gguugggguagggagagcugaagggagauucaaagguucuucagcucucacagaucucaacc

SEQ ID NO: 4155336 - RNA, 129 nt, Human
gguuggguaucuuuugccuaucggagagacgugaauuguuguggccagaggacacauuguagaaaauugucuguaaagacggccaccaacaugcauguugccucucccaucaagagguagaaccuaucu

SEQ ID NO: 4155337 - RNA, 74 nt, Human
gguuggugcaaaaguaauugcgguuuucgccauuuagaauaauagcaaaaaccgcaaauauuuuugcaccaacc

SEQ ID NO: 4155338 - RNA, 61 nt, Human
gguugguuguucuuguuuugccuccuacauccuaaacuuggagcugaacaagucagcaacc

SEQ ID NO: 4155339 - RNA, 69 nt, Human
gguuguaagagugaggggauucaggcaaggugccauuagcaaccauuacccucucucauuguacacucc

SEQ ID NO: 4155340 - RNA, 67 nt, Human
gguugucauggugacugccgcucaaacucuccauuggacagagcagcagauugucuccauggugauc

SEQ ID NO: 4155341 - RNA, 69 nt, Human
gguuguccagcuuguggucucgcagaucuuugaucugacaugugggagaaggaagcaagcuggaacacc

SEQ ID NO: 4155342 - RNA, 57 nt, Human
gguugugaggccacguaggacugaagaaauuguuucuuccugugugucucaucaacc

SEQ ID NO: 4155343 - RNA, 55 nt, Human
gguugugguuccauuuguauucagucaauauggaggcaaauggaucccacaagcc

SEQ ID NO: 4155344 - RNA, 70 nt, Human
gguuguuaaaagcagagacucuggagcuagacuaccugaaucuaaaucucagccuuucugcuuaucagcc

SEQ ID NO: 4155345 - RNA, 73 nt, Human
gguuuaaacuaggucugugcugaguaaacugugauacaugguuacaauacauacagagaugcuaguuaauauc

SEQ ID NO: 4155346 - RNA, 80 nt, Human
gguuuaaauauacaaguaauuaguaagcagagccuuuccagagccgaaggguuucugaagggauuacuugguuuugaacc

SEQ ID NO: 4155347 - RNA, 68 nt, Human
gguuuaacugucuccuuuagaaagcuucagaaaacaacugucuaguuucuagcaaggauuguugaauc

SEQ ID NO: 4155348 - RNA, 66 nt, Human
gguuuaauaauugugguguugguuuuuuugcauagcuuucuauguaccaaacccaucauaacuacc

SEQ ID NO: 4155349 - RNA, 97 nt, Human
gguuuaauggcaagugguugugaaggacugaaugaaaaugucuaccuucugggaaaugacuuuggauugggucccucccaccccuucuauucaaauc

SEQ ID NO: 4155350 - RNA, 114 nt, Human
gguuuacaaaucuguaggguauuccuucaugcacccaagguauuaaacuuguuagcuucauggauaugacagugccuggggguaauguaggauuaacucuaccugauuugaacc

SEQ ID NO: 4155351 - RNA, 68 nt, Human
gguuuacuggguuuuacuuuguuuuaacucucccuggguaauuuuaaaguguagccagguuaagaacc

SEQ ID NO: 4155352 - RNA, 63 nt, Human
gguuuauaaacagguuacaagacauuugcugaaguaacuagcucaugucaucuguuuaaaacc

SEQ ID NO: 4155353 - RNA, 74 nt, Human
gguuuauagaggucuuuaugcugcaagaauaggcuaacaaccuguuuaagcugaugagguaucgcuacaaaacu

SEQ ID NO: 4155354 - RNA, 66 nt, Human
gguuuauaugucuugcauuuuucaaacuucugucugaauguuugaacugucaacgacauuaggacc

SEQ ID NO: 4155355 - RNA, 59 nt, Human
gguuuauugaaggccaccccacaaccaucacacaacgugggagccucugucgaugaacu

SEQ ID NO: 4155356 - RNA, 57 nt, Human
gguuucaaacacucugagaaugggaucagauauuucacuccagcagugcuugaaauc

SEQ ID NO: 4155357 - RNA, 63 nt, Human
gguuucaaacaucugacuugcuuuuucagggucuagaucuugaagauucagugcuugaauucc

SEQ ID NO: 4155358 - RNA, 62 nt, Human
gguuucaaaucuuuugaguuauuuuaaaucauguaauacauggagcugcaaaagguggaacu

SEQ ID NO: 4155359 - RNA, 90 nt, Human
gguuucacauuugacauugacaguccauuaacuguguuaacagcaguaauugcuuuagagcaguuuaauggaagauguuuauguguggcu

SEQ ID NO: 4155360 - RNA, 64 nt, Human
gguuucagcccugcuguuccuggguggaucccucuuacuuuuccaggugcggugggugggagcc

SEQ ID NO: 4155361 - RNA, 73 nt, Human
gguuuccacauccauggaaugggugacucuagagagccucugaucugacuccauauuccauggguugugagcc

SEQ ID NO: 4155362 - RNA, 118 nt, Human
gguuuccagaugacccucagguucuuccgcguugguuagagagggcuacgcaucuucuacugcucagccacagucuguagccagcuuagagcuuagaagacauugcagucuggaugcc

SEQ ID NO: 4155363 - RNA, 58 nt, Human
gguuuccauauuuuuagugccaaugcgaacauuaauguuuuggucuacuauggaaucc

SEQ ID NO: 4155364 - RNA, 66 nt, Human
gguuucccuaguuauuugaaauggauuggaauccacuuuugaaagcauuucaaagagcuggaaauc

SEQ ID NO: 4155365 - RNA, 69 nt, Human
gguuuccugugggcucucggccuccaggcuccucauagccugggagggaauuugacccagcagugagcc

SEQ ID NO: 4155366 - RNA, 106 nt, Human
gguuucgcucccucgcugagucccuucuccccgccaacaaaaggugaugauuccuagcggacugggcacgccuggacggcggaggguggcugggaggggcgagguc

SEQ ID NO: 4155367 - RNA, 72 nt, Human
gguuucugcaugcaaguuaugacagguaggacugaaaaaacacugccuuuugacuucuagcauuuagcaacc

SEQ ID NO: 4155368 - RNA, 83 nt, Human
gguuucugcugcuuccauuuccagcuuucuaggccuguuguugacucuggacauacaugaggaggcuggaaacaguggagacu

SEQ ID NO: 4155369 - RNA, 59 nt, Human
gguuucugugguucugagaugauugcuaaugagaauaagccagauacaccacugaaacc

SEQ ID NO: 4155370 - RNA, 78 nt, Human
gguuugacagcucagaacaugaaaagucuguugccauaaguacugaaacaauuggggcaacauucauguucuguaacc

SEQ ID NO: 4155371 - RNA, 86 nt, Human
gguuugacauggccagaggccuuguugcguccguucggcuuuggcgccacucgauguaaauggucuuuggcagaagguguggaauc

SEQ ID NO: 4155372 - RNA, 87 nt, Human
gguuugccuuguguauuaguaagaauuauguaagaugauauuuacaagugcucuguauguaguucuugcuuugugaguguucaaacc

SEQ ID NO: 4155373 - RNA, 68 nt, Human
gguuugcuaaaaccugggccaucucucugcaaguguccuuauguuaguucagaggcccagagcaggcc

SEQ ID NO: 4155374 - RNA, 73 nt, Human
gguuuggaugagagggugugguacauugguugcaaacaggacccugauccuucacucccucugcauccacucc

SEQ ID NO: 4155375 - RNA, 78 nt, Human
gguuuggcaugccuuauuccaacaaucuagcacucucaagagaauguauuuuguauuagggaugaaaaaugugaagcc

SEQ ID NO: 4155376 - RNA, 80 nt, Human
gguuugggaggagugguaggcaguguuaggaaacuuuuaguauggguuucaagcucgaugcuaucaugggucccaagacu

SEQ ID NO: 4155377 - RNA, 89 nt, Human
gguuugguuauguucuuccaucuuaaaaugugucauaacucucagaaagggugaggagcucaacuaggacagaagagggugaucagauu

SEQ ID NO: 4155378 - RNA, 82 nt, Human
gguuuguaagaugagucguaugcuagggagacaggcagcugaauguauacugucugugugagcaaaugacuucuuuugaacc

SEQ ID NO: 4155379 - RNA, 63 nt, Human
gguuugugaauguguuuuugcuuugucuuauuugguacugagacagcagcauguuuacaggcc

SEQ ID NO: 4155380 - RNA, 78 nt, Human
gguuuguuuuauccaggaccucaguuauuaugaggauucauaucuucucacacagggcuccuugggcugacacaaauu

SEQ ID NO: 4155381 - RNA, 55 nt, Human
gguuuuauagcaguacuaucaggagaguaacuggcaacaguacugcuauaaaacu

SEQ ID NO: 4155382 - RNA, 88 nt, Human
gguuuuauuagacaugacacaugaagaccuaauuggauuucauucuucauguugauuuaauaauuucaugugcaaguuuaugaugacc

SEQ ID NO: 4155383 - RNA, 76 nt, Human
gguuuuauuugugguacgugagaacugggaaauauggaacucuauuuaacagaugcuaugucuaccuauacaaacu

SEQ ID NO: 4155384 - RNA, 69 nt, Human
gguuuucugauuagcaaaucugagggcagggagauauugugaucaggacuguuugauucuggggaagcc

SEQ ID NO: 4155385 - RNA, 81 nt, Human
gguuuucuuagcauagcuguuugaaguauuuuucuauuucauagcuagaaguggaguacucaagacagcacugggaaaagu

SEQ ID NO: 4155386 - RNA, 105 nt, Human
gguuuugaucuguuuucuccauauuuauagaucuggcauuuauuguaaaauacuggggaaaaagaaugcaaauauauggaucagugggaaaaucugauuaaaacc

SEQ ID NO: 4155387 - RNA, 93 nt, Human
gguuuugcuguguagucugaaaggauuuuucuggaugucacuucacugucucaguuucuuguucaguaaaauuacagaucuacauuuaaaauc

SEQ ID NO: 4155388 - RNA, 72 nt, Human
guauuauuuuguauuuguguaccuacaugccuuuagaaaugaauguuccuaggacagaaugcagaaaaauac

SEQ ID NO: 4155389 - RNA, 74 nt, Human
guauucacuuugcugugauaauucaaugagcuguacaagaagguauacuuuuaugcguguuucaguaugaaugc

SEQ ID NO: 4155390 - RNA, 77 nt, Human
guauucagaaggccuagcuacuuacucuuccuugaucuuccgacugaugauauuuggggugaagguuuucugaaagc

SEQ ID NO: 4155391 - RNA, 66 nt, Human
guauucaggagacugugaauugacugucagaaccccaaagggacucucagcgcaguuucccaaugc

SEQ ID NO: 4155392 - RNA, 102 nt, Human
guauucauuuugaagcuagagucagagaaucauuacagccacaccacuugugaauuaguguauuugaaaugcucuuuggaaucuaguuauauaaaaugaugc

SEQ ID NO: 4155393 - RNA, 59 nt, Human
guauucccacaaucugcguguguaucagaaucaagauacuguacugauugugaggaugc

SEQ ID NO: 4155394 - RNA, 76 nt, Human
guauucccaggauaucaaagcuaguggaaauuuccauauggaaaaccuucuagacuuuauauuuuuggaacaaugc

SEQ ID NO: 4155395 - RNA, 78 nt, Human
guauuccuguaacuaguauuuaaaggcuaugauuuuaaccacaguagugaagucaccuuguuuaugcccagggauuac

SEQ ID NO: 4155396 - RNA, 64 nt, Human
guauuccuucagaagacguuuacuaagcgcuugcuguauugggguugcucuucucgaggaguau

SEQ ID NO: 4155397 - RNA, 72 nt, Human
guauucucaggccuucagaccuggcccggaaucuaugucuuuggcucuccagcucuaaggccuuaacuauac

SEQ ID NO: 4155398 - RNA, 58 nt, Human
guauucuguugcagccaagucgcacagaaauagacagggccuggcugcugugggaugc

SEQ ID NO: 4155399 - RNA, 55 nt, Human
guauucuugguuaucaaaauacucguauagcuuugggauuuugaacugggaauau

SEQ ID NO: 4155400 - RNA, 60 nt, Human
guauugagcugugauuaacucugagacuuuagggucucagaguuuacggggcugaagugc

SEQ ID NO: 4155401 - RNA, 76 nt, Human
guauugauucugaaucuaauuuugguuuccagcguauugaggauaacuaaaucuggcauuuagagcacuccaauac

SEQ ID NO: 4155402 - RNA, 59 nt, Human
gucacauugggauuuauuggccucacagcaacaauggcacugagaccagagucccugac

SEQ ID NO: 4155403 - RNA, 63 nt, Human
gucacccacucccugcugcuguuguuucugcuuauccccacagcuuacagggaggggagugac

SEQ ID NO: 4155404 - RNA, 65 nt, Human
gucacccaggcuggagugcaguggcacgaucuuggcucacugcaagcuccaccucccggguucac

SEQ ID NO: 4155405 - RNA, 65 nt, Human
gucacccaggcuggagugcaguggcgcgaucucggcucacugcaagcuccgccucccggguucac

SEQ ID NO: 4155406 - RNA, 62 nt, Human
gucacccaggcuggagugcgguggcacuaucuuggcucugcagucuccaccuccugggugau

SEQ ID NO: 4155407 - RNA, 71 nt, Human
gucacccuggcuggaggugcaguggcgugaucucagcucacugcagucuugaccucccaggcccaggugac

SEQ ID NO: 4155408 - RNA, 70 nt, Human
gucaccuaauucacaugcaugucugugcacacacacaugcgugcacacacacaaacguugagguggguac

SEQ ID NO: 4155409 - RNA, 93 nt, Human
gucaccuagaagcucugacaacacaggcuuccaguccccagcucagauccucuauaucagcaugggcucuggaaucuguguauggcuggugac

SEQ ID NO: 4155410 - RNA, 72 nt, Human
gucaccugcaacucacgcugcaagcccugaagcaagugcuucuggaagcugcagguggccgucaccaggggc

SEQ ID NO: 4155411 - RNA, 59 nt, Human
gucaccugguuaaaauggcacacaacuuugaagcugccugccauuuuaaccaagugugc

SEQ ID NO: 4155412 - RNA, 130 nt, Human
gucacggcuuggugugauaauguauguguugguuugcugcuggaugcgcuugaugguugccccuuuggggcccaccaccagccccaccacgcgguagggcacccgcacacggauggucaccuggccgggc

SEQ ID NO: 4155413 - RNA, 75 nt, Human
gucacguauuguacauaaaauguaugucuuugucucacaagucaagggcaagagaaauuuugauguauuugugau

SEQ ID NO: 4155414 - RNA, 69 nt, Human
gucacuaaggagacagguaaauuucccagugcuggaaucagauuggugaggaagaccugcuccugaggc

SEQ ID NO: 4155415 - RNA, 68 nt, Human
gucacucaggcuggaguucaguggcaaucacagcucacugcagccucgaacuccuagccucaagugau

SEQ ID NO: 4155416 - RNA, 59 nt, Human
gucacucuuuuucagcuagcucaggcuaaagauaagcccaagugggcaaggaagaugac

SEQ ID NO: 4155417 - RNA, 90 nt, Human
gucacugaaaacuuuuucuaaaauagauuuuauggugcaaucuuuaaguuauuuugcauuaggaagguuaucuguuuuaguucaggugac

SEQ ID NO: 4155418 - RNA, 77 nt, Human
gucacugauuuuuuggauggcuguacauuaauuaacauacauuuauugagugcauacccuucuaaaaaguccugugc

SEQ ID NO: 4155419 - RNA, 73 nt, Human
gucacugcacuccagccugggugauagagccagaacugucugaaaaacaacgcuaagggcugggugcgguggc

SEQ ID NO: 4155420 - RNA, 80 nt, Human
gucacugucugccgugcagagcccuuccucccacgggggccuaccucaccugugccaagggcuugucuguggucagugac

SEQ ID NO: 4155421 - RNA, 55 nt, Human
gucacuguuucacuguucauuaacaccuccaggagagggugagcugagucaggac

SEQ ID NO: 4155422 - RNA, 66 nt, Human
gucacuuacacaucucugucaguagugaugcuucugggcauagcaaaauguggauguaguugugac

SEQ ID NO: 4155423 - RNA, 97 nt, Human
gucacuugcuuccccuucugcuuugguuccauggauggccaucggcccuggcucugcagccucuguggugacugggagcagacggggaacaucugau

SEQ ID NO: 4155424 - RNA, 73 nt, Human
gucacuuucccagccuccuuugcagcuaagacauaagcagguggcugaggagcugcugggaugauaaggugac

SEQ ID NO: 4155425 - RNA, 74 nt, Human
gucagaagcaccaugggggaaggcugguccaggcuucagaauggaacucaggccagguuucucccacagcagac

SEQ ID NO: 4155426 - RNA, 76 nt, Human
gucagaauugcagggagggcaggacacccuggcaaaaguagaaaaaugccagcuugcuguccgcuacauuucugau

SEQ ID NO: 4155427 - RNA, 56 nt, Human
gucagaguggaaggccaguggcucugugaaagugccugcuggucaccuaaucugcc

SEQ ID NO: 4155428 - RNA, 67 nt, Human
gucagaguguggcaagcauuaggucucugcuccaccucagugccaauucugccauggggacucuggc

SEQ ID NO: 4155429 - RNA, 125 nt, Human
gucagauauaaaucaacguuacagcacucuuuccaagaauguguuagaaugugcauguguuuggggagcagacaugguauuucuauuauaauuuuguuuguuaggugugaucugaauuguuuggc

SEQ ID NO: 4155430 - RNA, 79 nt, Human
gucagcaggauucauucuggaggcuugagcaaagaaucuaucuucuuagcuuuuccagcuucuagaggccaccugcaac

SEQ ID NO: 4155431 - RNA, 56 nt, Human
gucagcaguggcagcucccggggaccugcagcccccccucggcccugccagcugac

SEQ ID NO: 4155432 - RNA, 100 nt, Human
gucagcaugcugguuuggcagaauguguggcugauugccagaguauuuuugagcaaagcagccauucauuucaccugcaaaaucgaaaguucacuuugac

SEQ ID NO: 4155433 - RNA, 65 nt, Human
gucagccacucucagacagucccacccuauggccugaaagggugguggccagguaggugguugac

SEQ ID NO: 4155434 - RNA, 82 nt, Human
gucagccagcugcccuucucuugcccuuggccacugcagcagaccuuaggccaagggaaggcuaagggcaacagcaccugac

SEQ ID NO: 4155435 - RNA, 72 nt, Human
gucagccugucggcuccuucauucuggccacacaucacaacaguccaugaaugcagcagugacagggcuggc

SEQ ID NO: 4155436 - RNA, 61 nt, Human
gucagccuugggaagaaacauguccaucauuguuuauguggcauuucuucccagugcagac

SEQ ID NO: 4155437 - RNA, 94 nt, Human
gucagcgugcacagcucccagcuccugagcucucagggacagacuaugugagugagcauucuguuaccagagccaguggaaacuguacaccuac

SEQ ID NO: 4155438 - RNA, 61 nt, Human
gucagcuaauaggguguguguccauggcgugcucagccccucacaggccuugugagcagac

SEQ ID NO: 4155439 - RNA, 84 nt, Human
gucagcucugcccugggaggcuuuccuguuuggcacgaggaugacucuaggcaggugaccuggccucccagggaccuggcuggc

SEQ ID NO: 4155440 - RNA, 114 nt, Human
gucagcugcugugggugaguugggggacacgggggacacuguggggagugagcacuggacauagagcucagaggccaagugcccgcccugcccauacuuagccauggccuugac

SEQ ID NO: 4155441 - RNA, 73 nt, Human
gucacacacauuucuuuggugcuaaaggcacaugauucugucaaccggcaacagcacugcagacuguuguggc

SEQ ID NO: 4155442 - RNA, 62 nt, Human
gucacacagguugaaaugcaguggcacaaucauggcucacugcagcuuugaccuucaguggc

SEQ ID NO: 4155443 - RNA, 78 nt, Human
gucacacaguuggggcaguggccagaguggaagcagcauagcagcucuuuccagucucagcccuguaacuauggugau

SEQ ID NO: 4155444 - RNA, 61 nt, Human
gucacacucaaaagcuaggaugggcccaacugagaggcugcccuaguuuucugagcgugac

SEQ ID NO: 4155445 - RNA, 89 nt, Human
gucacacuguggagagccuuaaaggccacuugaaggauuuuucauguuauuuugugagauaaagaugguuuuuagggguucugagugac

SEQ ID NO: 4155446 - RNA, 62 nt, Human
gucacauagcacucagaagcugggucuaguauucugcucucucaaagacuggggcugugugc

SEQ ID NO: 4155447 - RNA, 66 nt, Human
gucacauagucuggaguguccaguucuacucugaaaagauggcucuccccaccuaagaaaugugac

SEQ ID NO: 4155448 - RNA, 74 nt, Human
gucacaugugagcuuuaccuuagguucuguuuucuagagaaaccaaacuaaaauaaggcauuauacucugugac

SEQ ID NO: 4155449 - RNA, 55 nt, Human
gucaccaaccagccugccucuggggccuauuucagaaauaaacugguuuguagau

SEQ ID NO: 4155450 - RNA, 65 nt, Human
gucacccaggcuggagugcaguggcacaaucuuggcucacugcaaguuccaccucccggguucac

SEQ ID NO: 4155451 - RNA, 61 nt, Human
gucacccaggcuggagugcaguggcgccaucucggcucacugcaagcucagccucccggau

SEQ ID NO: 4155452 - RNA, 65 nt, Human
gucacccccaagugugucaguccccagaacaacagccagauuggacucaggcaccaggggauggc

SEQ ID NO: 4155453 - RNA, 72 nt, Human
gucaccguagugccucugagcucugcuacagaugaaauuaauuccuccagagcugagggagccugagcaggc

SEQ ID NO: 4155454 - RNA, 64 nt, Human
gucaccuagcucaugguggaauugccaacuauaaaauagcauuuccacagcccaagcugguggc

SEQ ID NO: 4155455 - RNA, 58 nt, Human
gucaccucgcugucuuccugaguucaauuaaagaaaacaguaacagcaagaggcugac

SEQ ID NO: 4155456 - RNA, 81 nt, Human
gucaccucuuuauaauucuggcauaggcuguugggccugagcuggccucauggucuuuucccuggauuauaggaggguggc

SEQ ID NO: 4155457 - RNA, 59 nt, Human
gucaccugaggggaggugacaggaacugaacccacugucacucuguguuucccugggac

SEQ ID NO: 4155458 - RNA, 94 nt, Human
gucaccugggugggagcuuguuauaaaugcagaauggcaggccaaucucagaccugcuaaucaauauucauuuuaacaagaucccccaggugau

SEQ ID NO: 4155459 - RNA, 65 nt, Human
gucacgccuguaugguuaauuuuccugagugagcgccuggcuugguaaggaccagcaggcgugau

SEQ ID NO: 4155460 - RNA, 83 nt, Human
gucacugaaguccuugauuccucaguuucuuuucccuaguauuagagaggggaaaacaggaauuaacagguucuuuaugucac

SEQ ID NO: 4155461 - RNA, 61 nt, Human
gucacugaggcuggagugcaguggugcaaucguggcuuacugcaaccucugccuccuggac

SEQ ID NO: 4155462 - RNA, 56 nt, Human
gucacugcgcugacugcuacgaucauugggcaggcgugcacaggcaguguaguggc

SEQ ID NO: 4155463 - RNA, 58 nt, Human
gucacuggucggguguggcuguuaggccuuggcugcugcagcgcccucugaccuugau

SEQ ID NO: 4155464 - RNA, 123 nt, Human
gucacuuagcuaauuaauuccagggcuggaacaugggcuaucuguaaauuugagguucuugcuuuaaugcaaaagaauuaugcaucaggugugcaccauguugguugaggaaaaagaaguggc

SEQ ID NO: 4155465 - RNA, 61 nt, Human
gucacuuauaagcagguuugugucucccuuuucauaagcgucucgcccugcuauaaaugac

SEQ ID NO: 4155466 - RNA, 125 nt, Human
gucacuuauuucacaaauaauagcuccauaacaaagugcugucauuguguggacauggagaagaggagcuccucuucuguguucugugcaaugagcacaaagcauugggugugaaucuuccuggc

SEQ ID NO: 4155467 - RNA, 73 nt, Human
gucacuuguacauagagaagaagccuuccauuacuccuauacuagguuagguuccucuccugugcacugucac

SEQ ID NO: 4155468 - RNA, 58 nt, Human
gucacuuucacacuuuauugcugcacacacaaaccagcuggauguuuuuggaagugac

SEQ ID NO: 4155469 - RNA, 126 nt, Human
gucacuuuuggauggaagcuuuuuugccagugagauagucuuacuuuucucugcuacauugcauguaauugguagagaugguggguacuuuagcagcuuggcugacagcuacguugaacuuguggc

SEQ ID NO: 4155470 - RNA, 77 nt, Human
gucagaaaugagcuuauucauaaaagugcaguauggugaagucaaucuguaauuuuauguauaagcuagucucugau

SEQ ID NO: 4155471 - RNA, 90 nt, Human
gucagacaacucgggaaggugcuaaaggucauggagcccuauuguugguucauugcagauuuguagcuuuucagucugucagugucugac

SEQ ID NO: 4155472 - RNA, 62 nt, Human
gucagagaagguaggggguguggcuaagggacaccucguugcagccccacccuuguccuggc

SEQ ID NO: 4155473 - RNA, 73 nt, Human
gucagagccucaggagcaugcugaugccagaaggcaccacuugguggugauuagcagcauccauuggccucac

SEQ ID NO: 4155474 - RNA, 71 nt, Human
gucagagcucugcagccagggagagaagaaaaugccucauuguucggcucccugagcuggagagacugcac

SEQ ID NO: 4155475 - RNA, 93 nt, Human
gucagaggaugggaguucugggggcgaccagggacugcuggguauagcagcagucaguauggguaucgcccaucgguaugacuucucccuggc

SEQ ID NO: 4155476 - RNA, 62 nt, Human
gucggggcacggagccaaggagggagcuagggcaggcuaaggcugggcucgguggcccuggc

SEQ ID NO: 4155477 - RNA, 55 nt, Human
gucgguacuaguacugguguugcgaggauauggcaccgucaguacuaguauugac

SEQ ID NO: 4155478 - RNA, 78 nt, Human
gucguaggagaagauguugcaguugaugcgggagccgaggccaauguagaagcugcacaucuggcccagguccacggc

SEQ ID NO: 4155479 - RNA, 62 nt, Human
gucgucaucuuccucuuccuccauugguucugaagauggggucuccuaauggaggaugacac

SEQ ID NO: 4155480 - RNA, 68 nt, Human
gucgugaggguugggagggcccaaaucuuacuaaauccagcauacauugggcucuuuaacccaggcac

SEQ ID NO: 4155481 - RNA, 76 nt, Human
gucguggagcccagucgggguguagguggagcgggcuguuugcagugugaaagcuucucuggcuggucugccacgc

SEQ ID NO: 4155482 - RNA, 61 nt, Human
gucuaaaacccuagaggaugaaugacauccuuuaugauaucugucaccuguaggguaggau

SEQ ID NO: 4155483 - RNA, 72 nt, Human
gucuaaaugugguugauaucucuguuuaagagcucaucuugcuuuaggaaaaugagccucagcuacauugau

SEQ ID NO: 4155484 - RNA, 63 nt, Human
gucuaauguaucauggcucucagcucucauugaugagaaagcaggggaagggguacuuaguac

SEQ ID NO: 4155485 - RNA, 56 nt, Human
gucuacaaugagcagucauggccuggacuuggcaugcaaagugcugucauguagac

SEQ ID NO: 4155486 - RNA, 59 nt, Human
gucuacagcacuuaauuauuaguucugaauuaaggggcuaaauaauaaguugcugagau

SEQ ID NO: 4155487 - RNA, 63 nt, Human
gucuaccacugccucccuguccaagaaaugacuguugggaggggaaguggcagugagugaggc

SEQ ID NO: 4155488 - RNA, 59 nt, Human
gucuacugugaggcuccuggauggugagcuauuccagagaaaucuagucuuacagagau

SEQ ID NO: 4155489 - RNA, 69 nt, Human
gucuacuugcugugauggagaauucuggaagguucucccauccgaggaugccuuaucgcacugagggac

SEQ ID NO: 4155490 - RNA, 66 nt, Human
gucuagaauaacugcuaucuuucuggccuaaggaacuggguggaagguaaugcagcuuacugagau

SEQ ID NO: 4155491 - RNA, 57 nt, Human
gucuagagccugaugaggaugaacgucauggaaacccauucucacauggcuccgggc

SEQ ID NO: 4155492 - RNA, 56 nt, Human
gucuagagugcuuccuagucaucugguacugggugguugaggugucauucucagac

SEQ ID NO: 4155493 - RNA, 67 nt, Human
gucuagcuggggagcuagaccucagcacaggcgauacuguccugacacugucucuccccagcugugc

SEQ ID NO: 4155494 - RNA, 66 nt, Human
gucuagcuucuuccuucuccccacuggaagauguccuguagcugcccagauaggaggaggcugggu

SEQ ID NO: 4155495 - RNA, 56 nt, Human
gucuagggcuccucagugacaagcagggcugccuccgccguacuguggagcaaggc

SEQ ID NO: 4155496 - RNA, 58 nt, Human
gucuagggucuguagugcaugucugcaauccaucagaucucaugagcugccccuagac

SEQ ID NO: 4155497 - RNA, 59 nt, Human
gucuauacuacuauacagauguaaaugaaauacauguuuacuaagccagugguauagau

SEQ ID NO: 4155498 - RNA, 83 nt, Human
gucuauaguauagaugauucuguugcuuuuagauucuguugcuuuuggaauagaauuacagcuuuuagaauaguauaauggac

SEQ ID NO: 4155499 - RNA, 56 nt, Human
gucuauccuuuaguccuacaacucgaucuucucgguucacuugggcuaggauaugc

SEQ ID NO: 4155500 - RNA, 75 nt, Human
gucuauguaaaguuguugcauaaaguaggaaauauauaaaccguaugucuaauauauucaacagcuuauaugagc

SEQ ID NO: 4155501 - RNA, 107 nt, Human
gucuauuaccucacuccuccuuguucucugccuuucccaggcuacugugguuaugauuuguggcagaaguugggaaggcagaaaaggagagaaggagggaaaaggac

SEQ ID NO: 4155502 - RNA, 86 nt, Human
gucuauuagguagcuuggcagcccuuucacugggacaacugcucacugaagacugggcucuaaaaauuacauugcugcuuugagac

SEQ ID NO: 4155503 - RNA, 76 nt, Human
gucuauuguggcugcucacugaaggacccugucacauucuagagcaggguuuguugguguagcccgaguuacggac

SEQ ID NO: 4155504 - RNA, 96 nt, Human
gucucaaaucaagaaaaauauauuugauaucaguguuuccacaggauagaugaaaaacauagauaauagauagaugauguuguuguugaugaagau

SEQ ID NO: 4155505 - RNA, 81 nt, Human
gucucaacagauuugaguuuucuauccuugugucaucaccgaagcacagaagcaugggugugaagcaggaaacuuaaagac

SEQ ID NO: 4155506 - RNA, 87 nt, Human
gucucaacaucauguaguguacacuaaaugaauacaaacuagcuuuuauguuaguuugauugagguguauauuuauaugugaaagac

SEQ ID NO: 4155507 - RNA, 56 nt, Human
gucucaagggggaacucacuguagugcaguccacacuccagugcuccccuuggggc

SEQ ID NO: 4155508 - RNA, 56 nt, Human
gucucaccccacuaccccuuggugucgugcgggcaggggaguuugguggugaagac

SEQ ID NO: 4155509 - RNA, 73 nt, Human
gucucagccucagggaggccucuguggcuucugugcguagaggccacagccaucaccucccugggucucugau

SEQ ID NO: 4155510 - RNA, 68 nt, Human
gucucagguguucuccacucaguuucauguuagaucuaccagcaaagcuuguggaaaauaccaaggac

SEQ ID NO: 4155511 - RNA, 79 nt, Human
gucucauucagguagcgcaauuuccugggacuggggccucccuuaggcccagguagguguguuacuuuccucaugagac

SEQ ID NO: 4155512 - RNA, 67 nt, Human
gucucauugguucugccagagucaggagucaguccugcacugaacacuguggccggaacagugggac

SEQ ID NO: 4155513 - RNA, 82 nt, Human
gucuccaaccauuggugucugugucauuacuaauagagucuuguaaacacucguuaaucacggaaggccgccggccuggggc

SEQ ID NO: 4155514 - RNA, 74 nt, Human
gucuccaggaaugugugugggcuagugcugaaccuggacagguuucugugcuuccuacaaauauuccuggcugc

SEQ ID NO: 4155515 - RNA, 70 nt, Human
gucucccgagcagcccugaguuagcccacggaccagucaccggucuccggcuccccagggauuguuagau

SEQ ID NO: 4155516 - RNA, 76 nt, Human
gucucccucuaaagauguuuauugacauacaugaugaugaauauguugacuuuaugaacucuucuuuuuggggagc

SEQ ID NO: 4155517 - RNA, 55 nt, Human
gucuccugccacacucagucccacucaggaguguccgugaagguggggaggggac

SEQ ID NO: 4155518 - RNA, 55 nt, Human
gucuccugcuagcaagcaccacguaggaaugaacccaggguuguaagcaggagau

SEQ ID NO: 4155519 - RNA, 130 nt, Human
gucuccugucagcagcuuccacucacccacgcggauggcagccugcacggcgguguuccagaugccaaagccgcccuccagggagccaugcugggcaugguuguagagugggucaauguugugcaggauc

SEQ ID NO: 4155520 - RNA, 70 nt, Human
gucuccuuguuccagccuugcagggggagauccugaucccucccugguguccacuggaggaagacgggac

SEQ ID NO: 4155521 - RNA, 78 nt, Human
gucucuaaaacauguugacuuccauuaaaauaacaccaaaggauguauugcuugggguacaagguauuuauuagggau

SEQ ID NO: 4155522 - RNA, 94 nt, Human
gucucuacaggccuaaagaaagguaaaucagauguauuaaaagugccuuuucaacuuaugagaaucugcaguaugcuuaguucuuugcugggac

SEQ ID NO: 4155523 - RNA, 62 nt, Human
gucucuagauugggagagagaauccugccaagcuuuuuccuucauuucccacuucaggagac

SEQ ID NO: 4155524 - RNA, 84 nt, Human
gucucuagggugcuaauaacagcucuguguauugucaucuggagcagugguucucaaccagagcuuguguuacccccaggggac

SEQ ID NO: 4155525 - RNA, 62 nt, Human
gucucuaugcaggacauucuccuggagcacacagucuguuggggugagacccugcauagggc

SEQ ID NO: 4155526 - RNA, 67 nt, Human
gucucuauguagaggacauuugaaucccagcccugccagcacuagguguguguccuuugcaagaaac

SEQ ID NO: 4155527 - RNA, 58 nt, Human
guccuguuacugaaaugcaccgugccucuucccucugacgcacgcguuuccgugagac

SEQ ID NO: 4155528 - RNA, 62 nt, Human
guccuguuggugaauggcucuuuuacauaauugcaggagcuauuucaaagccagccaagggc

SEQ ID NO: 4155529 - RNA, 73 nt, Human
guccuuaauagagaccuucucugacuuagccagccaugggaaggaagaugaaaguacugcuaacaaaggggac

SEQ ID NO: 4155530 - RNA, 55 nt, Human
guccuuagcaacaggcaggagacagcaaaguucccagugcacugugcugaguggc

SEQ ID NO: 4155531 - RNA, 81 nt, Human
guccuuaguaaacugagguauugaaguaucuucuuuuucuuucagaaaauauuugucaagcaccuucuguguucuaagaac

SEQ ID NO: 4155532 - RNA, 58 nt, Human
guccuuccaacggcaauccaaaugccagauauaagggcauaaaaggauguggaaggau

SEQ ID NO: 4155533 - RNA, 58 nt, Human
guccuucgcggcugaggccauugccaugaaccggcagcuggcccagcacgacgaggac

SEQ ID NO: 4155534 - RNA, 80 nt, Human
guccuugcaguuaaaaaucauuaguuucaguugcaauacaaauuuaggcaagggcugaugauauuugcacuguaauggau

SEQ ID NO: 4155535 - RNA, 60 nt, Human
guccuugcuugagacaggcaguacuagaaguaucagaacauguggugcugaagcaggcac

SEQ ID NO: 4155536 - RNA, 58 nt, Human
guccuuggcauucugagucuugcugucucugcuuacaccagcucucaggcuaaaggau

SEQ ID NO: 4155537 - RNA, 112 nt, Human
guccuuuagucucuauuuuugcuccuaauuguuccugcagguaguagguuaacauguaacguacuuacagaaggaagcaauugaacauggcauagauacugaaagaaagggc

SEQ ID NO: 4155538 - RNA, 92 nt, Human
guccuuuucaggccaaggaggcagagagcauaguuugaguuugcaguucuuauaguaaagcaggcaucucucuccucugccuguaaagugac

SEQ ID NO: 4155539 - RNA, 90 nt, Human
gucgacauuuugaaauaccucugaaguucaucaacucugaccaaaauauuuugauagaauuugggguguguuauuucauugcguguugau

SEQ ID NO: 4155540 - RNA, 81 nt, Human
gucgacuucacaacagcauuacucuccuguuuugcagaguauuuaaggcaugcagggauuaaaugacugccuugaggugau

SEQ ID NO: 4155541 - RNA, 65 nt, Human
gucgauucucaggcuugugcaccuguacugagcuccaggugaacagcagcuuccugggaauugau

SEQ ID NO: 4155542 - RNA, 85 nt, Human
gucgauuuguguauacugaacucagaaaggagacaucugaauagucagauucucaguucacuaguuucuuaugccaaaaguuaac

SEQ ID NO: 4155543 - RNA, 56 nt, Human
gucgcaaacuugcugccugugagugcaauccagcccacagguucauucugugugac

SEQ ID NO: 4155544 - RNA, 61 nt, Human
gucgcaaaggccaugcauuuagaagggccccuugucugguuaaaugcugugcuguugccau

SEQ ID NO: 4155545 - RNA, 60 nt, Human
gucgcaagguccugaccaccauguggauuccuccacguguagguggacaggaucuuugac

SEQ ID NO: 4155546 - RNA, 70 nt, Human
gucgcccaagcuggacugcaguggcaugaucucggcucacugcaaccuccacuucccagguucaagcgau

SEQ ID NO: 4155547 - RNA, 65 nt, Human
gucgcccaggcuggagugcaguggcgccaucucggcucacugcaagcucagccucccggguucac

SEQ ID NO: 4155548 - RNA, 65 nt, Human
gucgcucacauagcccauggacuggucagcugccucggacugacuggaugugcuacugcagcggc

SEQ ID NO: 4155549 - RNA, 109 nt, Human
gucgcucuugguaaagcaauuucucaucuccaccugcccuccagggucucauuuguagaaugaggggggcucuggugaggguaggagauggaaggggcuggaaggugac

SEQ ID NO: 4155550 - RNA, 70 nt, Human
gucgcugugucauugccaugaaaaggcaggggguaucuuccagguguugccauggcaaugauaaacugac

SEQ ID NO: 4155551 - RNA, 67 nt, Human
gucggaggagcaggaggaguauggagggaagacuccuggguggcaugaagcucuugcaccucuaggc

SEQ ID NO: 4155552 - RNA, 77 nt, Human
gucggaugcacagcuccggggucguucagacuaguuagagagauaauaguuucugccucggaagcugaaaauuugac

SEQ ID NO: 4155553 - RNA, 64 nt, Human
gucagcaccucuuuggggagcugcuuccaaaaguucuggaugaggcucaccggggguguggggc

SEQ ID NO: 4155554 - RNA, 69 nt, Human
gucagcacuugucagcgguggcggggcaggacgaggagccugcucaggccagccggacagagagagggc

SEQ ID NO: 4155555 - RNA, 128 nt, Human
gucagcacuuuaggccucuuuaccuccugucguuccugagugacucuagaaaguuucuugagagcacugggcgagaggcugggaagucacaggaaagaagcagagaggaggcuggccugcaggcugau

SEQ ID NO: 4155556 - RNA, 72 nt, Human
gucagccaguccccucggacagccagaggccaugaagucaaggggcucuggucagugaggggccuugcuuac

SEQ ID NO: 4155557 - RNA, 59 nt, Human
gucagcucauccaucccgguggagcagaucuuucuccaccaucaguacuggaugcugac

SEQ ID NO: 4155558 - RNA, 71 nt, Human
gucagcucggcuccgucuugccagggcuggggggacccucauccucacccgcuuccggagcugcaguggau

SEQ ID NO: 4155559 - RNA, 66 nt, Human
gucagcugcuagacagugaucuguugauacugaaaugcccacuaauauuaauaugucuaagcugau

SEQ ID NO: 4155560 - RNA, 60 nt, Human
gucagcuguugugcugggcaguuaccuuauauuaacccacaauccccacaacagccaggc

SEQ ID NO: 4155561 - RNA, 114 nt, Human
gucaggagacuggguaauaugacuuuuuuauaucaacugaagucuugauuauuaaaguugggguguaaggguugaaauggaggucucaucaauuuuuccacccaguuuacugac

SEQ ID NO: 4155562 - RNA, 80 nt, Human
gucaggcagcucugcuucuaagaaccugcagcuuuuggaagaaaggcacccugugguuucagaagcccaagagucccugc

SEQ ID NO: 4155563 - RNA, 91 nt, Human
gucaggcaugguggcuuacgccuguaaucccagcacuuugggaggccgaggugggcggaucacgaggucaggagcuugagaccagccugac

SEQ ID NO: 4155564 - RNA, 56 nt, Human
gucaggggcagaaccaagggcacacuccaucccagcuuguccuguccugcucugac

SEQ ID NO: 4155565 - RNA, 130 nt, Human
gucaggggggccaguacacagggauaaguauacaauggaugagauuuuggcuuugaauccaagagagaugggaagcuaugggggaguuucaaccauaaucuuauuugccuguuaacuggcuuacucuggc

SEQ ID NO: 4155566 - RNA, 85 nt, Human
gucaggucuugauuuaauuguucucuuauuucuacccaagggacauguuucccucaguguuaggauaagagaaagucagguuggc

SEQ ID NO: 4155567 - RNA, 102 nt, Human
gucaggugaguaugagggagaugggcugauucgauggggguagagaggcgggccacgugagcucugcccuggggucagccuccauucaucacuuucucugac

SEQ ID NO: 4155568 - RNA, 77 nt, Human
gucaggugugucauugcuuuacaaaaauugauggugacaugugugucauuauuuguaagagccagugaauaucuuac

SEQ ID NO: 4155569 - RNA, 59 nt, Human
gucaguacccagugcaacuggagucucugcaacagggaacccgcacgcugggugcaaac

SEQ ID NO: 4155570 - RNA, 76 nt, Human
gucagucaagucuggagcagaugggguccuugugccauugacagcuaccaugguuuguuccagucucaaucucggc

SEQ ID NO: 4155571 - RNA, 70 nt, Human
gucagugaaccuucaccaaaccccacgugcauuuuauccucagugaauuguugguggaggugcaccugac

SEQ ID NO: 4155572 - RNA, 66 nt, Human
gucaguggagccaaggccaguucucagggcccagcucuuggugaauaugaucuugguuugaucgac

SEQ ID NO: 4155573 - RNA, 59 nt, Human
gucaguggcagguguuucguggugcuaccggacaggcagaaugaccgaccucgccgggc

SEQ ID NO: 4155574 - RNA, 72 nt, Human
gucagugguagggcuaguucaggggcugcaguagugcuggugcccacagguggaaccuucuccugcccugau

SEQ ID NO: 4155575 - RNA, 70 nt, Human
gucaguggucccagguggucacagccuacagcuucccuugcugugcuguucccauguggggcucagagac

SEQ ID NO: 4155576 - RNA, 59 nt, Human
gucagugugaguugauuccauaagcugagaaaagucaguagugaauuccuaacacuggc

SEQ ID NO: 4155577 - RNA, 88 nt, Human
gucaguguuuuuaaagcaauauaaagcagcugagauuuucuauuauuuacuuacugcaauaagcuguaaugcauuaaauaauauuggc

SEQ ID NO: 4155578 - RNA, 84 nt, Human
gucaguuaugcagaagaaugagcuuggaguugguccagagacuagaaacucuuguauguucaauucuuggcauuuucuuuugac

SEQ ID NO: 4155579 - RNA, 116 nt, Human
gucaguuuucuugcauggugcagagcuagcuuagccugugagguauaaaaucuuaaugccuuuuauccaugggcaaguuugaaguuccccuaaaagcauagugcaauacugcuggc

SEQ ID NO: 4155580 - RNA, 77 nt, Human
gucauaaagucaucuguccuaggcucuacaauguagcauuuucaaauuggaagagccuucagagauuauuuuauuac

SEQ ID NO: 4155581 - RNA, 108 nt, Human
gucauacugaucaacaaccagcugaguucucggauggucagcaucaacuaucagcccuaugagugagccaucuuagaucuccgucucagugugaagcccucagaugac

SEQ ID NO: 4155582 - RNA, 109 nt, Human
gucauagaaagauugugcuuuuugacuuuuaucaaggaagugaucuuugcuauaaaaucaaauuaaccuuaugauagaacuguacgagcuguuuaauuuuucagauuac

SEQ ID NO: 4155583 - RNA, 62 nt, Human
gucauagccucccuuccuuaggauccauguguugaugcugaggccuguguuggggcagugac

SEQ ID NO: 4155584 - RNA, 73 nt, Human
gucauagugaggaaccauauuucaaaugacuucuuuugguaagugauuauuuaaugcgguuuuacauaaugac

SEQ ID NO: 4155585 - RNA, 59 nt, Human
gucuccuggccuccaguuucucugcuugaagcgcccuugaaacugauggccaggaugau

SEQ ID NO: 4155586 - RNA, 63 nt, Human
gucuccuggcucauagagcagcuccaacaacacgugcuuggaugccaagugugccauggagac

SEQ ID NO: 4155587 - RNA, 93 nt, Human
gucuccuugucuccuguuacuucuuaggcauuaguaccuugaaaguuugccauaaaaucucaguuagggccucagaagacagacacaugagau

SEQ ID NO: 4155588 - RNA, 63 nt, Human
gucuccuuuaagauuuccucaggcuuucuuugucuuuauggcacugacauuuuugaaugagac

SEQ ID NO: 4155589 - RNA, 94 nt, Human
gucuccuuuggcuucuucugaugcuccucuucucccacugaaugcaggaaaacucaccuccaucagagugaggaggguaaggauugccugagau

SEQ ID NO: 4155590 - RNA, 63 nt, Human
gucucuaaggacaaaauucaauucgcuaaauacuagcaagcagaauucuguccucuagaagau

SEQ ID NO: 4155591 - RNA, 124 nt, Human
gucucuaccaugggggaaauagagggacagggugugggacugggacagccccaggcaggaaggagccugcauuguggcucaucuucagcuccccccaucugagcagagcccccgugggucugac

SEQ ID NO: 4155592 - RNA, 102 nt, Human
gucucuauccuggcccuuugcaacugccugccucugauucugcacaccacagugcugcaguaucuaugggcaugccauauguauaagauguuauuuagggac

SEQ ID NO: 4155593 - RNA, 59 nt, Human
gucucucuugcucuacuggagucuucugcccuggucuucagagaucuucaggaugggac

SEQ ID NO: 4155594 - RNA, 55 nt, Human
gucucugucacaacuacucaucucuguaacucugcuguuguggugugaaagggac

SEQ ID NO: 4155595 - RNA, 84 nt, Human
gucucugucauuaaacagcugucauuguuuuaaaauguacacauuauuuaauuuaauuguauggcugaguagagacaugaagau

SEQ ID NO: 4155596 - RNA, 67 nt, Human
gucucuuccaccuggcugguguuccugaggccagggggccuuccagagccugcagguuggaugggau

SEQ ID NO: 4155597 - RNA, 98 nt, Human
gucucuugcccuggucuccuaauucagguucgagucuguuaaucguauuucuccuccauugacaacagccacugauacugaauagccaaaucagagac

SEQ ID NO: 4155598 - RNA, 62 nt, Human
gucucuuggcuuuugcucccagaucaucagaaagaugacucaaugagccagagcucuuugau

SEQ ID NO: 4155599 - RNA, 97 nt, Human
gucucuugugaucuugcuguaacuucacuggacucagcagcucuuaaaacagaguacgcuuguaagguggggugggauggacagagauccaggagau

SEQ ID NO: 4155600 - RNA, 57 nt, Human
gucugaacaguuaagaguuugaacuagauaauuucuauguucaaacacugauucagc

SEQ ID NO: 4155601 - RNA, 56 nt, Human
gucugaauagcucugugaauaccagugggcugcaggggcacagagguuauacagac

SEQ ID NO: 4155602 - RNA, 96 nt, Human
gucugaggaaggaagaagguuggugacuauauaagguucaaagcuuuccaaaaggaagaacuuacauuauagagcuguacucuuucuccuucagau

SEQ ID NO: 4155603 - RNA, 82 nt, Human
gucugauaguucuguggccagauggugccaguucacuuccagcugaacugguacagccugaccacacuccaugcugacagau

SEQ ID NO: 4155604 - RNA, 75 nt, Human
gucugauaugaguuugauggcucuuuauggcauauaaaauguauguuaaggagacacaugaaaaauuaacaguac

SEQ ID NO: 4155605 - RNA, 79 nt, Human
gucugauaugugcagugacucacaggaaggaggccaguauuagccuccuucagcugaaucccugcuccaacauauuugc

SEQ ID NO: 4155606 - RNA, 56 nt, Human
gucugauuuacuggaaaaaaggagagcagccuuucuuuucucccagaugauuagac

SEQ ID NO: 4155607 - RNA, 83 nt, Human
gucugcacaguguuucucaggcugccuaucagacugugaaacgcuuuuacgggagagggcgccugagugaagagcucgcaggc

SEQ ID NO: 4155608 - RNA, 96 nt, Human
gucugcacaucagcacggacuucaucucucagcaaggggucucugcccuucagugcgugagaaugaggcccgucaacugcuaaggcuguggcaaac

SEQ ID NO: 4155609 - RNA, 66 nt, Human
gucugcacgugccagggaggggucacaggaugaaugcuauaucccuccuuuuugggaccgugcagc

SEQ ID NO: 4155610 - RNA, 80 nt, Human
gucugccaaacagaguacagacaaaggucagaugacuuaacaguuucucaucuguacccugaugcuuugucaagguuugc

SEQ ID NO: 4155611 - RNA, 83 nt, Human
gucugccauauagucaugcuuuguuaauguggcacaucuugccaugauggugcccucaugaaacgaaggaugcugaagcagau

SEQ ID NO: 4155612 - RNA, 69 nt, Human
gucugccuccuuguuucuguccugugggaauuuugcuuguuacacagcagaauagcaagaaaaacaggc

SEQ ID NO: 4155613 - RNA, 67 nt, Human
gucugccuuuugaucuauaacuguguaugaguuuugucaaaacauagggagucagggggaaucaggc

SEQ ID NO: 4155614 - RNA, 65 nt, Human
gucugcugugccuuggggaaaagagacaaugaaaaauaaccauuguuccucaggggcucacagac

SEQ ID NO: 4155615 - RNA, 106 nt, Human
gucugcuuguuuuguaguugaggaaccagagguugagcaacuagaggccacacaggucaucaguguccucaggcuuuguuccuuagguggcacgaggugaucagac

SEQ ID NO: 4155616 - RNA, 57 nt, Human
gucuggaagggagugcauuuucacauaaugauguugguugauguaauguuucuaggc

SEQ ID NO: 4155617 - RNA, 75 nt, Human
gucuggaagggcggaagggcacagcuucuuagaucuuagggauggagagcuggccagcuucaguauguuucagac

SEQ ID NO: 4155618 - RNA, 61 nt, Human
gucuggacccugggcugugauuuuuggccaggaggacacagccacuuaggguaccugucac

SEQ ID NO: 4155619 - RNA, 63 nt, Human
gucuggagccugggucccugcucccauaccuugaauuccugagauggccuugaggcuccacac

SEQ ID NO: 4155620 - RNA, 64 nt, Human
gucuggaguguccuagcaagccgguccuuugcacagaaggcuggauuuauggggacuucauggc

SEQ ID NO: 4155621 - RNA, 69 nt, Human
gucuggcaucagccuguagaauacaguaaaucauauuuauaauuugcaugggucugcagcaggccaggc

SEQ ID NO: 4155622 - RNA, 77 nt, Human
gucuggcaugcaguaggugcuggauaaagaaugguacugggauagaccuuccgcuuuccacacuguugcccccagac

SEQ ID NO: 4155623 - RNA, 67 nt, Human
gucuggccagcccagugguccucucuagcacauuacagagauuggccuuuggagcugaaagcuggac

SEQ ID NO: 4155624 - RNA, 61 nt, Human
gucuggcguucagcaagugguuuucaaauuauuuaaugaacacuugcaugaacagcuacac

SEQ ID NO: 4155625 - RNA, 89 nt, Human
gucuggcuaaauuggcagauucugaacaaagccuggcccugacaagucuucagaaaaaccgguuuucaccuccagaaugugccccaggc

SEQ ID NO: 4155626 - RNA, 67 nt, Human
ggugaggguaaacuaaaacaucuucagacaaacagaaagagaagguaguuaucagcagauccucacu

SEQ ID NO: 4155627 - RNA, 69 nt, Human
ggugagggugggacagaggguauggucagggcagccagucccugcugucccucaguccugccucucgcc

SEQ ID NO: 4155628 - RNA, 66 nt, Human
ggugagguaaagauggcggcagagccuccggaagcuaggagagaggcaugcaacagauuauuuccc

SEQ ID NO: 4155629 - RNA, 109 nt, Human
ggugaggugccugggucagugcugauagggcagucaggccgccacugaccugagcauccugcagggggaggaggcggccaggcgcucuacaucgauggggaccugaacc

SEQ ID NO: 4155630 - RNA, 59 nt, Human
ggugagguugguaucacuggccgcaaguccucucaguggcccugugcaugcugcuuccc

SEQ ID NO: 4155631 - RNA, 69 nt, Human
ggugaguaaucgaggucucugagugccugggguugaagguugagggaguucaaagacuugaugcugacc

SEQ ID NO: 4155632 - RNA, 106 nt, Human
ggugaguagggggaugaaggaggaacaccaacacaguuuggaggcaggguugaugauggucaguggagucacaacucacagccaccgguguuggcccugcaccacc

SEQ ID NO: 4155633 - RNA, 124 nt, Human
ggugagucauauauguaucauguccuaacuuugucaucuucccuuucugaaucagaacauggauugucaaagguaagacugauuagaagaaugaagggcuaagauugcugacuaaagacucacu

SEQ ID NO: 4155634 - RNA, 76 nt, Human
ggugauaguguuagagccaguauguuccuaagagauacagugucaucagaacaaacuggcacugaaacauuucucc

SEQ ID NO: 4155635 - RNA, 76 nt, Human
ggugaucagucacauuucgacauaacuagaugucaaaagaaguuuaaguuguaugacgaacugugaugcagucacu

SEQ ID NO: 4155636 - RNA, 62 nt, Human
ggugaucgaguuguuuguucuggggauaugaauccuguggagcuuucagcagcucggccauc

SEQ ID NO: 4155637 - RNA, 59 nt, Human
ggugaucggugaucuggcuuauuuguuccuuuguggggguaagggcugggcaccucacu

SEQ ID NO: 4155638 - RNA, 55 nt, Human
ggugaucugcccgccucggccucccaaagugcugagauuacgggcaugagccacc

SEQ ID NO: 4155639 - RNA, 76 nt, Human
gugaagaugcuggcaggguaugauuaccucugaggccuuuagcuugcagauagcgucauucuugcugccucuucac

SEQ ID NO: 4155640 - RNA, 76 nt, Human
gugaagcagaguguggaagcaauaaaacccuauuaagaucaguuuaggccuuuaaaaauuccaugauuccuuucac

SEQ ID NO: 4155641 - RNA, 66 nt, Human
gugaagccucaagaagagggagaccuacagccucaggaauuguaggcccuuuuccuuguccuuugc

SEQ ID NO: 4155642 - RNA, 123 nt, Human
gugaagcguuuagaugagcagaauuugauaucugcagcuuacuuucacaugauucagcaaaauauuaaucaucggugaauccagcugcuagguauuuagguguucauuguacuaaucuuucac

SEQ ID NO: 4155643 - RNA, 81 nt, Human
gugaagcugaaauauuuuaaucucaggauaaacccauuauuuaaguuaagguacucuugagaacaaauaugauuacuucau

SEQ ID NO: 4155644 - RNA, 57 nt, Human
gugaaggaaguaaauucugucuggcaacuuucaggauaaagucuuuauuucuuucau

SEQ ID NO: 4155645 - RNA, 81 nt, Human
gugaaggcuauugcaaguaguccagccuuugggaauuugacuguaaguggacccacugcauggaagcuugcaagcuugcac

SEQ ID NO: 4155646 - RNA, 79 nt, Human
gugaagggauauuguuugcuuacccaccuguaaucauuuagaguuaugauuaauugagccagaaaguaucugcuuuuau

SEQ ID NO: 4155647 - RNA, 61 nt, Human
gugaagguggggagccucaguucugugaauaucagcauugccgagccuacuccaucuccac

SEQ ID NO: 4155648 - RNA, 58 nt, Human
gugaagguugucaugaaguacaaaggacaauuccuuuccuggcagguacaacuuuuac

SEQ ID NO: 4155649 - RNA, 77 nt, Human
gugaaguauauuuagcugagcuugugcauaugacuucaguucauaaaaaguuuacaagugcagcuggaaugcuuagc

SEQ ID NO: 4155650 - RNA, 72 nt, Human
gugaagucaccucuuguuucccagguugcugccccaccugcagcugccacagagccuggccagaggucucac

SEQ ID NO: 4155651 - RNA, 66 nt, Human
gugaauaaaacaccugccaagacgugguaggauuuaaaagugauuuggggcggguguuuuauucac

SEQ ID NO: 4155652 - RNA, 77 nt, Human
gugaauaagucucaugagagcugaugacuuuacaaggggcuuccccuuucacucagcucucauugucucuugucugc

SEQ ID NO: 4155653 - RNA, 81 nt, Human
gugaauagccaacuugaaaaccucaugaauuguacaguucagauaccuguacaaauuguuuugguuuauaaaagcuaucau

SEQ ID NO: 4155654 - RNA, 76 nt, Human
gugaauagugcugcuaggaacauuuauauacaaauacuuguuugaaugcuuguuucuaguucuuuugauuauacac

SEQ ID NO: 4155655 - RNA, 72 nt, Human
gugaaucacaaagcuauauggagucuauggggaaauucaguuuuauauuuuuauccauaagcuuguguucau

SEQ ID NO: 4155656 - RNA, 93 nt, Human
gugaaucaucucuucuggaguugugcaguggaccuggcaugaccaaguuuaugcaucuuagggucccucacaucugcaguugagauaccucac

SEQ ID NO: 4155657 - RNA, 79 nt, Human
gugaaugcucaaucaaugguuuccaaauuuuggauaucacagacugguaaaauuugagaacuauuuuugggucaaucac

SEQ ID NO: 4155658 - RNA, 91 nt, Human
gugaaugggccuggcugccuggcccagggaugggccuggauuugcucaggcucagagguugaggccggcacuuccgucaaaggcccuucgc

SEQ ID NO: 4155659 - RNA, 58 nt, Human
gugaaugucuucuguucccagcugccuccugugaauagucugaggagaaggagaacac

SEQ ID NO: 4155660 - RNA, 118 nt, Human
gugaauuaaagauaaauaaacauugugauacaacuuaacuguggggaaauuuguuuucucauucacuucauuuuaccuugaguuugcaacaccacaguguuuugucacauuaguucac

SEQ ID NO: 4155661 - RNA, 74 nt, Human
gugaauuacuguuagggaaaauauaucaguagcagagauacugauucuguaauuuuuccuaaauaggcacuuac

SEQ ID NO: 4155662 - RNA, 62 nt, Human
gugaauuagcuuuaccuaggauuguuuugggaaaauucuugcaggaaccugguaagcuucac

SEQ ID NO: 4155663 - RNA, 113 nt, Human
gugaauucaaagcugcagacuccugggaggaaauucugcuguuugcuuaugcccaaggugccauuucagagcaaaaguguagcuuucuuuccauccaucagugaacuuuucac

SEQ ID NO: 4155664 - RNA, 57 nt, Human
gugaauugugugaagugugaugcauuuucagcagguggacacauuugcacaauccac

SEQ ID NO: 4155665 - RNA, 66 nt, Human
gugacaaaugaagucacugaccuuguauaagucauuuuaggaagggucaacauuucauugauucau

SEQ ID NO: 4155666 - RNA, 60 nt, Human
gugacaaggaaaauaaauucuaagguuuauaucaaguagaauuccaguuucuuaugucac

SEQ ID NO: 4155667 - RNA, 84 nt, Human
gugacaagucccaugacuuuguuuuccucguuuggaaaaaccuccaguuggugguuccagagcugagcagucauucuacuucac

SEQ ID NO: 4155668 - RNA, 69 nt, Human
gugacaaugucucugcugugguuagcuuuggugccuucuccaagguaaauucagcagugacauuaacac

SEQ ID NO: 4155669 - RNA, 82 nt, Human
gugacacgcugcagaggagcuggaaggcuggacagccucggggaggcucagcuaauuccagggcuacaccuugggguguuau

SEQ ID NO: 4155670 - RNA, 61 nt, Human
gugacagaaacagggcuagaaugcaggucucucgucccuacucugccacuuuuucugucac

SEQ ID NO: 4155671 - RNA, 62 nt, Human
gugacagagaaggagcucaaauauggcuuuucugaagcuacaucuggacucuuuaugugcac

SEQ ID NO: 4155672 - RNA, 83 nt, Human
gugacagagacagauugaagcuuaaauuagcucaucauaggcuaugauuuuaucuaacuuuaggcuuacuuguaccaugucau

SEQ ID NO: 4155673 - RNA, 74 nt, Human
gugacaggcuucuggaauccaguuucuccuacugaauaaaaggagagaguaggacuucagaauccuuaaguuac

SEQ ID NO: 4155674 - RNA, 67 nt, Human
gugacagggacagagaaaugucacuaugagcccucagugucgguggcaguucugugucucuuguucc

SEQ ID NO: 4155675 - RNA, 76 nt, Human
gugacagggauuugaaauggccuuauuaaguguuugggcauuauucuagaaaugagguuuuuuaaagccagagagc

SEQ ID NO: 4155676 - RNA, 85 nt, Human
gugacaugugucuguagcuucuugagaggccaagucaggaggaucacuugagccugaguucaaggcugcaguaagcuaugaucgc

SEQ ID NO: 4155677 - RNA, 69 nt, Human
gugacauuuaaagcuggcguuacaguuuguagguuuuacaaaucauggcucuagcuuacaaauguacac

SEQ ID NO: 4155678 - RNA, 100 nt, Human
gugacccaagguggaaagaacaaggcagaggugacagugucuuuuauaagccagccuuggaagugacguagcaucauuucugccuuauuccauuggucac

SEQ ID NO: 4155679 - RNA, 72 nt, Human
gugacccacagcccacccauaccaggcccccagcucuggccagugggccuccggggugagcuguggggucau

SEQ ID NO: 4155680 - RNA, 55 nt, Human
gugacccaggacacuguguaucccauaggcccugauuuuuaguggacuggcucau

SEQ ID NO: 4155681 - RNA, 65 nt, Human
gugacccuggauagcuacuggccaggcgucccgccacgccucccagccauguucuccgguggcac

SEQ ID NO: 4155682 - RNA, 65 nt, Human
gugaccuaucaacgcugacugguugggcacuccaguaacaaacaccaaagcgagugauaugucau

SEQ ID NO: 4155683 - RNA, 57 nt, Human
gugaccuuauuuggagauggucuuugcagaugauuaaauuaauuaagaugaggucac

SEQ ID NO: 4155684 - RNA, 56 nt, Human
gugaccuuauuuggaguuaggaucuuuacagaguaaucaaguuaaaaugaggucau

SEQ ID NO: 4155685 - RNA, 85 nt, Human
gugacggagcucuguucucguccugcuggagugcccugccauucacgccgcgugccagcgguggggaggaaagaugcuaagugac

SEQ ID NO: 4155686 - RNA, 68 nt, Human
gugacgugcagagucuuggcauucaugcguuccuggagacagggacaucaccguggcuuuggaugcgc

SEQ ID NO: 4155687 - RNA, 61 nt, Human
gugacguugcugcccgaggcccuacuuaaaucaaguguagcuguuggggccagcaggucau

SEQ ID NO: 4155688 - RNA, 83 nt, Human
gugacuaucugaggcaggaagcuaucaguuguguaaauaacccuuugcaccugauugauuucacugcuccagauauaggucac

SEQ ID NO: 4155689 - RNA, 69 nt, Human
gugacuauugccagggucaggaugagaucugcccgucagccgacuuuauuacuaacccugugaaguugc

SEQ ID NO: 4155690 - RNA, 58 nt, Human
gugacucaguuagacaguauuugggucacaauaugugauuuacuguuuaauugauuac

SEQ ID NO: 4155691 - RNA, 78 nt, Human
gugacucgaacucggggaaauuguuccuguaauggaguucucaauuuauuggucaauuucaccuugauuuugugucac

SEQ ID NO: 4155692 - RNA, 77 nt, Human
gugacucguagagcuggccuuuugguaugggugugaggcugcccugcaagguccaccugcuacauaaacugaguuac

SEQ ID NO: 4155693 - RNA, 128 nt, Human
gugacucuguuucuuguggauauaauuucggugggugcaaauggugauggcaaauaauugcccucagggagauaauugcuguuacaauuauuuacccauccaaguuagcucuguuaaaaauuuaacac

SEQ ID NO: 4155694 - RNA, 58 nt, Human
gugacugaagaagccacauuggauguugaucuuccagccuccagcuguuuugagucac

SEQ ID NO: 4155695 - RNA, 117 nt, Human
gugacugcugagggagagucccuugcuuugacuguugcugccauucuggaaagcauugaucucuuaccagaggggcuucagaggcaagagcagcuuccgggggcuccuuagcaucac

SEQ ID NO: 4155696 - RNA, 73 nt, Human
gugacugguacaggaaggagggaguuucagaguccugauaauguucuauuucuugaucuagcaugccaguuac

SEQ ID NO: 4155697 - RNA, 129 nt, Human
gugacuguugcaauggacuuuagcgccuggcaggaagugccuggcucaccuccgcuccagcaacuguggcugccacugcugauggaggaaugagagacacaacccacggccagguuucagcacaggcuc

SEQ ID NO: 4155698 - RNA, 64 nt, Human
gugacuguuuuuaggaggaguagguuuuuuaaaauaagggcuuucuuuuuaauaaaacugucau

SEQ ID NO: 4155699 - RNA, 85 nt, Human
gugcagguucacuugaaucacacucguaagugaguuggaagggacuccagcuaacucuuagcuguaauucaggccaaucucccac

SEQ ID NO: 4155700 - RNA, 64 nt, Human
gugcagguuguugacugcauauaggcacccaccuagccugugcuucacucaacaagccguguac

SEQ ID NO: 4155701 - RNA, 71 nt, Human
gugcagucucuccagcucagggagccgaacaaugaggcauuuucuucucucccuggcugcagagcucugac

SEQ ID NO: 4155702 - RNA, 58 nt, Human
gugcaguucaagguuguacagcucaauccaccgagacuggauagcuuuggacuugugu

SEQ ID NO: 4155703 - RNA, 70 nt, Human
gugcauacaugugugugcauacaugugugugcacguguguguacacgugugugugcacguguguaugcac

SEQ ID NO: 4155704 - RNA, 68 nt, Human
gugcauauguauguacuuauguguguguauuuuugcauuuguguuaacauguguacauauauaugugc

SEQ ID NO: 4155705 - RNA, 102 nt, Human
gugcauauuaaaguuugagaagcccagcuguccuuggaagcucagauaaacuggaggcuacaguagauaaggacggucggggcacuugcuucugaguggcac

SEQ ID NO: 4155706 - RNA, 63 nt, Human
gugcauccugggcugacuuacuucugccagaugugguggaggucccagucugugaugacucac

SEQ ID NO: 4155707 - RNA, 63 nt, Human
gugcaucugggccagauccauggcaauaaccuucagguugaggcuagagggcuucagaugggc

SEQ ID NO: 4155708 - RNA, 73 nt, Human
gugcauguauacuuccuuacugacccauuuccugcagcccauggaagauuucaucaaaggaaguacgugucac

SEQ ID NO: 4155709 - RNA, 115 nt, Human
gugcauguguguguguguaucuucauuuauagguauagguguauauauaucuauaugucuguagauauguuuguauauauuuguauauguguaguacacacacccauaagggcac

SEQ ID NO: 4155710 - RNA, 106 nt, Human
gugcauuaggcagacacagccucagugcagcggcagcagcucuugggaagcaagagcccagggcuuugaacacugcauuacaacaggggaugcguccuaaugucac

SEQ ID NO: 4155711 - RNA, 64 nt, Human
gugcauucuuugaaugcuucuaaugacugacaggauuaggaaucugguauucagagaauggaac

SEQ ID NO: 4155712 - RNA, 60 nt, Human
gugcauuuauauuugccuuugguauggaucguauaacugccuaaggcaguaugauugcac

SEQ ID NO: 4155713 - RNA, 59 nt, Human
gugcauuucaagagcucugcuguuaguuucucuaaugagagccaggguucuggaugcac

SEQ ID NO: 4155714 - RNA, 57 nt, Human
gugccaagcacagaggggccacugugugcagcuacagaggcccagcuggccuggcac

SEQ ID NO: 4155715 - RNA, 78 nt, Human
gugccaaggugucaccaugccagcuucugccuguugaaagggaugcuggcggaagucaugguggcugaguccuggcac

SEQ ID NO: 4155716 - RNA, 66 nt, Human
gugccacaguuugcugacccuugccuuagauggaugaagcaugggcugaaagaguaagcugugaac

SEQ ID NO: 4155717 - RNA, 61 nt, Human
gugccacuggugucauauaaggggcucuguuaucuacagaggauucccuagugaccugcac

SEQ ID NO: 4155718 - RNA, 90 nt, Human
gugccagaacuaagacuagaaaacaggucaucggauucuucucugcaaucugcccuaggaauucuauggccaaguguugguuuggggcac

SEQ ID NO: 4155719 - RNA, 66 nt, Human
gugccagacuuuccuuagguaucucaagagcucuguuucuaggaaacucaaagggaagugggaaac

SEQ ID NO: 4155720 - RNA, 83 nt, Human
gugccagcaagggccaacaacugugcaaaggccuuauguuuuugaggaagacagaggcuagugucacuggcccaggguagcau

SEQ ID NO: 4155721 - RNA, 74 nt, Human
gugccagcauucacacugguuccuucagucccaaauccuaaaaaguaaggcagagggccaagugaugcuugcac

SEQ ID NO: 4155722 - RNA, 63 nt, Human
gugccaggugaugaggagacauacugucugggcucuucagacaggcuucuuucucccuggaac

SEQ ID NO: 4155723 - RNA, 63 nt, Human
gugccauccagaaggguuugaaagaagcauaaaauugauccaaacuucacacuucuggagcau

SEQ ID NO: 4155724 - RNA, 66 nt, Human
gugccaucuguuucuuccagggugcccgagugauacaaagcugauucaccuuacagaaacaggcau

SEQ ID NO: 4155725 - RNA, 57 nt, Human
gugccaugucuguugaggucauugccaguccccugcaccguccccaggacuuggcac

SEQ ID NO: 4155726 - RNA, 65 nt, Human
gucgacauggugacgaauccauagcaucgagcccccgggcugcgggcguucguuaccacuuuggc

SEQ ID NO: 4155727 - RNA, 74 nt, Human
gucgagauagggucucacuauguugcccacgcuggucuugaauuccuggugucaagugauccucccaucuuggc

SEQ ID NO: 4155728 - RNA, 60 nt, Human
gucgagcuuggacagcuauauugaaacugaggagagguucaguauagcuucuaaacuaac

SEQ ID NO: 4155729 - RNA, 59 nt, Human
gucgaggcaggcaggcggaggauaggaaggccccacugucuugcgguuucugccucagc

SEQ ID NO: 4155730 - RNA, 64 nt, Human
gucgauaagauggaagaauggcagcugugcuggagcagacagugguguuuuccauugcauaggc

SEQ ID NO: 4155731 - RNA, 76 nt, Human
gucgccaggcuggaggcuggagugcagugguguaaucucagcucacugcaaccuccgccucccagguucaagcgau

SEQ ID NO: 4155732 - RNA, 71 nt, Human
gucgcccaggcuggagugcaagcagcaagaucauagcucauugcagccuugaccuccagugcucaagugau

SEQ ID NO: 4155733 - RNA, 78 nt, Human
gucgcggagccagggacucccaggguagcuccguccacuaagggcggcuggaggcuggggagucccggcgacggcggc

SEQ ID NO: 4155734 - RNA, 65 nt, Human
gucgcucaggcuggagugcaguggcgcgaucucggcucacugcaagcucagccucccggguucac

SEQ ID NO: 4155735 - RNA, 87 nt, Human
gucggaugaagaucugcagccucaggaugaagaucugcagccucaggaugaagaucugcagccucaggcgacgcucuucagugcgac

SEQ ID NO: 4155736 - RNA, 129 nt, Human
gucgggaaccaagagcagugcaaggcggaaaugaaacuggguaaaggaauuggguuuccuggcuucccaagauguguccauucuuugcuccuccucguuuucuuccuucuugacuucuuuuucuauuuc

SEQ ID NO: 4155737 - RNA, 69 nt, Human
gucggggccugaggagguugacggcacugugaauaauucauccgccuguaaugauuuucuagcccuugc

SEQ ID NO: 4155738 - RNA, 91 nt, Human
gucgucaagccaaagagagaggucucaggagaaaccaugcuugcuggcacuggcaccuugaucuugaacuucuagccucuggaacugugac

SEQ ID NO: 4155739 - RNA, 59 nt, Human
gucuaaacuuuacagagucaaggcuguguggaaaaguaagcuauucuguaagguuggau

SEQ ID NO: 4155740 - RNA, 108 nt, Human
gucuaacugguacgauguaauuuacuuuggauuuucaauaucuuuugcuuacuucaucuccuaaaaggauaacuuugaaaguaaauugcaaaagcgaccauauuagac

SEQ ID NO: 4155741 - RNA, 69 nt, Human
gucuaagaggcuccuccuuacauuuaccuguugucacucaggaaaaguagcagggggaucuucuugcgc

SEQ ID NO: 4155742 - RNA, 58 nt, Human
gucuaagccaaucauggugguuucauuauucuugucaucacacuugauuggcuuagac

SEQ ID NO: 4155743 - RNA, 63 nt, Human
gucuaaggcagugagaagaaacaggugcaguugcaauuuguucucuuuuccuugcuccaugac

SEQ ID NO: 4155744 - RNA, 116 nt, Human
gucuaagggcaguggcagaggcaggaguugcauugaucccagcuugggccauggagagcucaccagcccagguagugcuauuaaggagcaccugcuuugagccaacagugcuagac

SEQ ID NO: 4155745 - RNA, 95 nt, Human
gucuaaguccugcaggcaggugggggagcuaguccagcugaggccagugguccagcuggccuggccucuccugcccgaagcugugggaucuggau

SEQ ID NO: 4155746 - RNA, 63 nt, Human
gucuaaguggguggcacugacaaaguugacauuagcugguuuugaaggggccaucacaaaggc

SEQ ID NO: 4155747 - RNA, 85 nt, Human
gucuaaguucugauaagcugcucauuaagccauaacaguuuguuauggcuuaggagaguuuaacuguacauucagguucuuaggc

SEQ ID NO: 4155748 - RNA, 112 nt, Human
gucuaauucuuguaccuuuccuucacuguuucauccuacuucuaugcucacugauaaaaaugggcauguuggaagcucggugcagagggugaaggacugauuaaaauuagau

SEQ ID NO: 4155749 - RNA, 62 nt, Human
gucuacaaagcauauaaaagaggaaguugagcuuauucuaauuuuauguauguuuugcagau

SEQ ID NO: 4155750 - RNA, 86 nt, Human
gucuacuucauccaagcagggcuaggcuagggcugcaaagaugagugagucugcaaagaagccacagucccagggugaaguuaggc

SEQ ID NO: 4155751 - RNA, 76 nt, Human
gucuagaaacacauacauuaauuguauugaaauguuauaucaauacaucauuuaugauguguguguggucccagac

SEQ ID NO: 4155752 - RNA, 87 nt, Human
gucuagaggcauuaguuagcuguucagagaagaccacucugucuuacucuuuaguguggccuuuuagaauaaacucuuccucugagc

SEQ ID NO: 4155753 - RNA, 68 nt, Human
gucuagcuguccgugcaucuuuucccccauuauggaaaugauauggaaggaagauguacacagcugau

SEQ ID NO: 4155754 - RNA, 76 nt, Human
gucuaggagcacugguuuugcugauaaggcaaacucuauggggcugacuuauugguuaacuagucauugucuagau

SEQ ID NO: 4155755 - RNA, 72 nt, Human
gucuaggguaugugaccuauggaucagcagcagucuuuuagaaaugcaagagucccaggcuccacccuagac

SEQ ID NO: 4155756 - RNA, 60 nt, Human
gucuagguagaagccaagaaacaccugcucacaaggggcuuucuuaggcucuaaaaugac

SEQ ID NO: 4155757 - RNA, 61 nt, Human
gucuaguaugaaucucuuuauucugcugcagagcagauuuguugacuucaugaaucuggau

SEQ ID NO: 4155758 - RNA, 59 nt, Human
gucuagucacauuucaagugcucaaaagccauguguggcugauggcuaguguacuggac

SEQ ID NO: 4155759 - RNA, 59 nt, Human
gucuagucagccucaggacaugcuugcagaugcugccugcaggcacagguugucuggac

SEQ ID NO: 4155760 - RNA, 62 nt, Human
gucuaguuccacguaaagccccagaagugaccuucugggucuuuacccauggaauuccagac

SEQ ID NO: 4155761 - RNA, 80 nt, Human
gucuauaaaacauuuaaacaccaggaagaaucgguaggaaagauaaauacgucugccuguugcuagaaugucauguggac

SEQ ID NO: 4155762 - RNA, 97 nt, Human
gucuauaaauaaauuaacaccuggucuuucuuugauaguggagaacuagaaaguacuguaggucuaauauugucaaagugagaccuugucugugggc

SEQ ID NO: 4155763 - RNA, 76 nt, Human
gucuauacucugaugagaauaaugaucugcugugggaaauacagcagaucaauugauuguucacucauauguagau

SEQ ID NO: 4155764 - RNA, 84 nt, Human
gucuaucauuccagaacucaagaaaugcccuucguuugguggagcacaggggcucugagcucugggaauuauaacugauuagau

SEQ ID NO: 4155765 - RNA, 100 nt, Human
gucuaucuuguguaccaggaguagucacaaggcagauuuucagugugguguagcacaggucugaaucacugugccuaucccagguggcacaguaauagac

SEQ ID NO: 4155766 - RNA, 76 nt, Human
gucuaugagaaaacugaggccaagugaggaaagaugaaauuagaaacauuaucuccugaugcccagauucauagac

SEQ ID NO: 4155767 - RNA, 66 nt, Human
gucuaugcagaugggugccaaagucuggacaguuguguugagacuuuggcacccaucuacaauggc

SEQ ID NO: 4155768 - RNA, 71 nt, Human
gucuauguccuaaucucugaaaccugugccaauguucuauuacauggcagaggagaauuaagauuacagau

SEQ ID NO: 4155769 - RNA, 58 nt, Human
gucuauuuugcaugcagagcaauaugagaaauacauagaagaagcauguguaauaggc

SEQ ID NO: 4155770 - RNA, 66 nt, Human
gucuauuuuugaaagccccucuuaagugcaaagcccagcaccaaggauggguggcaauagaaagac

SEQ ID NO: 4155771 - RNA, 57 nt, Human
gucucaaaucucacucugcauuucucuuauagggacaccugugaguggauuuagggc

SEQ ID NO: 4155772 - RNA, 58 nt, Human
gucucaaggucagcgugaaguucugucagaugaaacuaggauguugcuggccuaagau

SEQ ID NO: 4155773 - RNA, 80 nt, Human
gucucaaguuuauuugaaugauuaucuuucggcauucucuggaauugcuuguugagguguuauuuaauuuuuuuugagac

SEQ ID NO: 4155774 - RNA, 70 nt, Human
guggagaaggggcagggucuccaaggggcauggcugcaugggcacuuuggacccugcacaccagcucuac

SEQ ID NO: 4155775 - RNA, 87 nt, Human
guggagagauuuagaguaagcagaaaaagugggaguuauuaaagaacuaaaugacuuacaggaauuucuccuuucaagacuuuccac

SEQ ID NO: 4155776 - RNA, 77 nt, Human
guggagaguaagguaauaaaagcagguuuugcaauggacaugaaugagcacugauuuuguugcacuuaaauaaccac

SEQ ID NO: 4155777 - RNA, 62 nt, Human
guggagaugucuggaggucagguccugggguccugccccaggucccgccccagcucuaccac

SEQ ID NO: 4155778 - RNA, 106 nt, Human
guggagcagauguguuuuugcaucguugucugagaaaguuuauguuuauuucugcauccuugguucaguagauugcuuuucagacaaugaggcauauccgcuccgc

SEQ ID NO: 4155779 - RNA, 57 nt, Human
guggagcccugccuugcucauguuuuguuauggaggugaagcuagugguugcuccau

SEQ ID NO: 4155780 - RNA, 61 nt, Human
guggagccuuaaauguuugauuugagcauuuaauaagauguuccucacuauuuuggcccau

SEQ ID NO: 4155781 - RNA, 82 nt, Human
gucucccuucucucccucaucccaucgccuaggguguccgggccccuaggagagguaaugaaguucagaaaggccaagggac

SEQ ID NO: 4155782 - RNA, 70 nt, Human
gucuccuaaacauuaaaccacaggaauaugcaagggcaugguuuauugcuuuaaugaaauguagguaggc

SEQ ID NO: 4155783 - RNA, 58 nt, Human
gucuccuauagcugcacugaaucauucuuaacacugagaguugcagcaaaugggggac

SEQ ID NO: 4155784 - RNA, 123 nt, Human
gucuccucaguaaggcauggcuuugauugacagaagacuacugugcguauaugaguucuauugagagcuuuagcccguuggcaguaguugucagaaugucauucacaugcagacaggagagac

SEQ ID NO: 4155785 - RNA, 113 nt, Human
gucuccugguguguaagucucucuccugguucccagcaggaguguaggaaugagugcuuguccuggacucugggcugggaacuagcaccuaguggggacuggacuaggaugac

SEQ ID NO: 4155786 - RNA, 85 nt, Human
gucuccuuagcaucauuagucacuucuuccuucaucacuucccaguggauaggagguuaguaaguggcuuaaccgcuaccgagau

SEQ ID NO: 4155787 - RNA, 88 nt, Human
gucuccuuuagggcuucaucugugccgaaccguacaaacauuuuugugaaggcagagccagugaaaacccugcgaauaaaagugggac

SEQ ID NO: 4155788 - RNA, 75 nt, Human
gucucuaaugcuaaggauuuguuaaggaaucacuaaacacgguuagugcuuaauagauguccagcaucaugggac

SEQ ID NO: 4155789 - RNA, 66 nt, Human
gucucuagccaaagcacaauccauugaauauuauuuauuguuuauuagagauauuugguuagggac

SEQ ID NO: 4155790 - RNA, 72 nt, Human
gucucucagucucugagaggugagaagcagcagugcccaggucuugccuugcuuuggcggaggcuguguggc

SEQ ID NO: 4155791 - RNA, 104 nt, Human
gucucuccuauuucuguguauguuauaaauagagacacuggcugcauuuauucuuaauuguuuuuucaacguauuuauauagcagagccauggaagcuagagac

SEQ ID NO: 4155792 - RNA, 55 nt, Human
gucucucucccaagauuggcuaguguauaguuacuggaccagcugucugaggggc

SEQ ID NO: 4155793 - RNA, 99 nt, Human
gucucucuguuguucuguuucuaguuuaggauccaaucuaagaucccacguuuaguuuuuauaucucuagucuccuuuaaccugaaacaguuucucagc

SEQ ID NO: 4155794 - RNA, 60 nt, Human
gucucugagcucugagcuggcuggggucagccugagcagcgguggaaggagcacagagac

SEQ ID NO: 4155795 - RNA, 73 nt, Human
gucucuggaaggaugucugauugcuugacuucgcagcagccuggucagagccguuagcauucagucugaggac

SEQ ID NO: 4155796 - RNA, 113 nt, Human
gucucugucaacucugcugcugcagcaggaggcuccugcagaugcugggugaaugaaggcgcauggcugugcugcagugagcccuuguugcagaaacaggccccacacaggac

SEQ ID NO: 4155797 - RNA, 57 nt, Human
gucucuguggcaacuacuuagcucugcaguuggagcacaaaagcagccacagaugau

SEQ ID NO: 4155798 - RNA, 76 nt, Human
gucucuguuggugcuuuuccuggcugucaugcccuaguaaccuacugaggucucagguggggaagccacaguuggc

SEQ ID NO: 4155799 - RNA, 74 nt, Human
gucucuucuucucuguaugggauucccuugugaaauauuugggaacucuaucauggaaagcaucgagaagagac

SEQ ID NO: 4155800 - RNA, 106 nt, Human
gucucuuucauucccugauuuagugaggcagauuugaugagguggaaaaacaucuuuagcauguuuaaguacucacagguucugcagcucacagguugagagagac

SEQ ID NO: 4155801 - RNA, 70 nt, Human
gucugaaaauggccugaagaagcaauccuuugaaagcuucuaaucauugauugcugggaccuuuuucaac

SEQ ID NO: 4155802 - RNA, 84 nt, Human
gucugaacacaagagguagcucuuuauggguaaaugccaauuguccacacuugguguccauagugagcacuggugaucucaagc

SEQ ID NO: 4155803 - RNA, 64 nt, Human
gucugaagaguuaauuaugaggugcccuuuacugaagagcaauuauuaugugacuuuuacagau

SEQ ID NO: 4155804 - RNA, 55 nt, Human
gucugacaccuagaguccaggaucagugaacugaucuugguuccguguguuugau

SEQ ID NO: 4155805 - RNA, 57 nt, Human
gucugagccaaaauaaacagcauuugccacuacaaagcuuguuggagauggccagau

SEQ ID NO: 4155806 - RNA, 61 nt, Human
gucugaggcuuguccucucagcuucuuggguuccucugaaggcuaaagaauaagcccagac

SEQ ID NO: 4155807 - RNA, 60 nt, Human
gucugaugagucggcugccaccaggauaggcauccuguugucagugucacucacacaggc

SEQ ID NO: 4155808 - RNA, 77 nt, Human
gucugauggguuuauagggaggcuaacucugaaacacauaccagacugagacugccccuguaacaauuccaauagac

SEQ ID NO: 4155809 - RNA, 62 nt, Human
gucugaugucucugggauuagcuucaaaauaaaauggugagguugggaugagggauacagau

SEQ ID NO: 4155810 - RNA, 79 nt, Human
gucugauuaugagaauaaucugguaaauacuugguuuauauaugugcuaguguuuuuauauguuauucuuauggcagac

SEQ ID NO: 4155811 - RNA, 85 nt, Human
gucugauuucaauguccaaaccucacggcggcuguacgucugagaauaggcugugcgggcagccgugggaggaaggagagcagac

SEQ ID NO: 4155812 - RNA, 98 nt, Human
gucugauuuuuaaugggccaaagcuauuuaaacuguacaugcauuaacaauuuucuuaguggcauguauacuugaguaggagguuauaaagaguagac

SEQ ID NO: 4155813 - RNA, 104 nt, Human
gucugcacaccuagccccagccuuggggguuucugcccuccucucucagucuugugaaaguagggagaccggaggccgccugcaaggggcugggcagccagggc

SEQ ID NO: 4155814 - RNA, 72 nt, Human
gucugccaggcacgugcagcaucaggaaacucauaaaaucuuuucuggcugcuuuuuaacugcuggccaggc

SEQ ID NO: 4155815 - RNA, 75 nt, Human
gucugcccacaauugugaguaugaagugaugagacaauuuaucuuucucugcacuauacaauguuuugggcagau

SEQ ID NO: 4155816 - RNA, 68 nt, Human
gucugccugcuucuucauagucuaugugcucgcucccagugguuuaaaagaaugagggaguagggagc

SEQ ID NO: 4155817 - RNA, 58 nt, Human
gucugccugggacgcugggagugugugagcagauuuggugccagaggcccgggcaggc

SEQ ID NO: 4155818 - RNA, 99 nt, Human
gucugcucagugauguggcaguaguggaucaaaaauaucuguuuggaggucagacaggccuagauucacugcugugcaauuuugaguaaguuccuugac

SEQ ID NO: 4155819 - RNA, 58 nt, Human
gucugcugacagagcauggaccucaguuuuagguucuaccuacccucugcauacagac

SEQ ID NO: 4155820 - RNA, 62 nt, Human
gucugcuuuagugugguguuagagaaggccuugcuucccuagugucaugcuaaaguacaggc

SEQ ID NO: 4155821 - RNA, 64 nt, Human
gucugcuuuuguuuuacugguacuaggucgggaaagaaaugcucagugaaacagaaguccaggc

SEQ ID NO: 4155822 - RNA, 77 nt, Human
gucuggaccccuccccacgaguagguaacccaggccuccugccucucuggggccuccaggccuacucagggccagac

SEQ ID NO: 4155823 - RNA, 60 nt, Human
gucuggaccuuggacuccuuaaugguacuuacuagaagggagcucuuuggucuugccgac

SEQ ID NO: 4155824 - RNA, 67 nt, Human
gucuggagggugggccagauaugaggggcuaggcaugcugggugcccucgucugguuucccuuuggc

SEQ ID NO: 4155825 - RNA, 56 nt, Human
gucuggcagccccuccaccuggcuacugaagccagucaggugugggggcugcagac

SEQ ID NO: 4155826 - RNA, 85 nt, Human
gucuggcauagaauuuagaauuuuagccugacucugagaggcacacuuucauggaggcuuuggaaucagaguucuguccugagac

SEQ ID NO: 4155827 - RNA, 57 nt, Human
gucuggcauucuuccuggagaauaaacucuucacugggaaaauagaguguccuugac

SEQ ID NO: 4155828 - RNA, 57 nt, Human
gucuggcccucugcaagauucuggacacuauggugugcaagaaagguggggccaggc

SEQ ID NO: 4155829 - RNA, 55 nt, Human
gucuggcuuugcucagaugcugcuugagcagcaucuugaaggguaaaccaaggac

SEQ ID NO: 4155830 - RNA, 64 nt, Human
gucugggcagcagcauuucuuauccagcaucacugggcaggcucucagaugugcaggcucaggc

SEQ ID NO: 4155831 - RNA, 55 nt, Human
gucugggguaucugccacaacucugcaaugcguagaguggcaccuuaccugagac

SEQ ID NO: 4155832 - RNA, 65 nt, Human
gucuggguccuggcuuugucaggguuucugaaugaugaaaucugugggcucucaggaucacagac

SEQ ID NO: 4155833 - RNA, 86 nt, Human
gucugguaggggcugcucucugcuucugggaugguggcuugcugcuacaugcuccugaggagaagagugcuagguucucacaugac

SEQ ID NO: 4155834 - RNA, 110 nt, Human
gucuguaauuauuuauucauuuauuuuugcacuugucaaauauuauaguacaccuacuaugugcuagguaacaugcaaguuucuggagauaagugaugaaccaggcagac

SEQ ID NO: 4155835 - RNA, 83 nt, Human
gucuguccagcccuccugggaucacaguaagaagcccccagcuccuauucugaggcccaagagauggcccuugaggcaaugac

SEQ ID NO: 4155836 - RNA, 74 nt, Human
gucugucuuccagucuucccagcugcugcgaugccacugagcuggcugggucccagcugggaggaggagcagac

SEQ ID NO: 4155837 - RNA, 107 nt, Human
gucugugagcucuggguguuccauccugacuugauaccccucccaaaggacccuaaaaagcagggaggugugcaggaugaaccccucagcccccucacuguagagac

SEQ ID NO: 4155838 - RNA, 71 nt, Human
gucugugaucagggaacauguguuguguccuauuauccccagaacauuguacaaaugccugacacacagau

SEQ ID NO: 4155839 - RNA, 56 nt, Human
gucuguggucccugcuggggacagauugugucacgugagccucacagggaccagac

SEQ ID NO: 4155840 - RNA, 65 nt, Human
gucuguguccucccugucccccagagcagacacccucucugugucuggaccggggaggagcagac

SEQ ID NO: 4155841 - RNA, 66 nt, Human
gucuguucagggacccgcacagguagcaugccugguagcacaccuuuaggugggucccauggugac

SEQ ID NO: 4155842 - RNA, 120 nt, Human
gucuguucuaacuugugcagagaaaaugaguuuuuaauuacuucugccaaccucggaacugccggucuuggaggcauuuguguggcggaaggauuccaccuguaggagugggugauaggc

SEQ ID NO: 4155843 - RNA, 100 nt, Human
gucuguugcuaguuggacagucgguauggccuggaggagaagggcuguuuguauuuccaugcauccuccuuuguccucuugcccugggugaagcaaugac

SEQ ID NO: 4155844 - RNA, 55 nt, Human
gucuguugggcaucggcucauggcuuagggcaggcuacugggcaagcccacagac

SEQ ID NO: 4155845 - RNA, 56 nt, Human
gucuguuuauauguuuuucagaccugagauauuauggucgaaaaagauaaacaggc

SEQ ID NO: 4155846 - RNA, 61 nt, Human
gucuguuuccaguucuguguccucagagccauccuccucaacacagcugccggagacggau

SEQ ID NO: 4155847 - RNA, 58 nt, Human
gucuguuuugguggucacuguuucuuuagcaccuagcaagcaguccaaaagggcagac

SEQ ID NO: 4155848 - RNA, 80 nt, Human
gugggggcguccgcuggcugggugcuccaggggugcucggaggagcagcuucuguuucuagccccugugaacguguccac

SEQ ID NO: 4155849 - RNA, 130 nt, Human
gugggggcugagcggcacacagcuuuccauguguguugugcgugucacugaguggcccgugaaguccaguuauugugugcguuagccuaugugggccguguaucuaaauguguguguuguguguguuuac

SEQ ID NO: 4155850 - RNA, 65 nt, Human
gugggggguguuggccuuaaucuggaauggcaacuguauuucucaucaagugccaacucugacau

SEQ ID NO: 4155851 - RNA, 82 nt, Human
guggggguggcuguccugugcauuguaggguauugaguggcaccccuggccucuacacacuagaugccaauagcacccccac

SEQ ID NO: 4155852 - RNA, 115 nt, Human
gugggguccaagggcuuccuggggaagcggaugagcuuguagcaguacuccuucaacuggaguugcuggcauuucaggacucacccgacuuguucuaaugucuccuuggauccac

SEQ ID NO: 4155853 - RNA, 74 nt, Human
guggggugguacaggugggcaccgugcugcaugucacaggaugucaggcagcaucccggccuccacugucccgc

SEQ ID NO: 4155854 - RNA, 63 nt, Human
guggguccuuugaaaggggugugucagugggggagaacuugacaccccauggggaggggcaac

SEQ ID NO: 4155855 - RNA, 64 nt, Human
gugggucuaggaagauaccugagauacugcacuucuaacacacuuucaggauucuagaccacac

SEQ ID NO: 4155856 - RNA, 62 nt, Human
gugggugaaagggcgugggggugggagccuggcauccuccucucugggccauuuucuuccac

SEQ ID NO: 4155857 - RNA, 84 nt, Human
gugggugcucgaugagcaauuguuaaacuuaccaaaauuaagccuaucuaacuuugacaaaauuaugcuaauauugauccccau

SEQ ID NO: 4155858 - RNA, 97 nt, Human
guggguggagcagucuaggaagggcucacaggagggagagacacccaggacugagagcccuacucucccuccuuccccuggaagcugggccaccugc

SEQ ID NO: 4155859 - RNA, 88 nt, Human
gugggugucacauagggcguucucugcaugaugcuguugucgcugggccugagaagcagccucccagggagcagccuguggaccccac

SEQ ID NO: 4155860 - RNA, 75 nt, Human
gugggugugauaagaccaagggcuucaaaagcauauguacaaugggcuugucccuuguguuucuauuauggccac

SEQ ID NO: 4155861 - RNA, 56 nt, Human
guacucauugauuccuuuacucaguaaacaguauugagugcaaggcacugagauac

SEQ ID NO: 4155862 - RNA, 100 nt, Human
guacucggguguggugucuuagcuguauuccugcacuguauagagguuuugagggugacuucuuaauuugugcagugucugagaugccgugucugggugc

SEQ ID NO: 4155863 - RNA, 73 nt, Human
guacugcugcgguaccugcuacuaccgcuucugcugcaagaagcgccacgagaagcuggaccagcgccagugc

SEQ ID NO: 4155864 - RNA, 82 nt, Human
guacuggcuuugagggaauagcuacagaacaaaugggcagaauuucacuaaucacuaguauuuccuguaagcuauaggguac

SEQ ID NO: 4155865 - RNA, 58 nt, Human
guacugggaauggagccugggccucggcaccaugcccagggccgccacuuuccagugc

SEQ ID NO: 4155866 - RNA, 71 nt, Human
guacugggcagcugugcaaacaauauuaaaacagaaaaaauauuuugugccaugcacugccuugauuguac

SEQ ID NO: 4155867 - RNA, 83 nt, Human
guacugguagugcacugagcugauuucaggugccgcaacuuaaagagaaugugaggaaauuggagugguucagggaccaguau

SEQ ID NO: 4155868 - RNA, 129 nt, Human
guacuugguugcuacagcccuuggacaauguccaccgugaugauggaaugugaagauaaauaagacacaauuccugucaucacaguggccacaaucuagaaggcacagcuguggacauuuuuaaauuac

SEQ ID NO: 4155869 - RNA, 86 nt, Human
guacuuuaauuaaauugguugaaaugaaagguggugauugucaagccugacaaacuaaaauucuuuauugaaucuaauuagggugc

SEQ ID NO: 4155870 - RNA, 69 nt, Human
guacuuuauaagguaugaaaaguaaaugggauuugcaaucaccauuucugcaauguaccuuugggcugc

SEQ ID NO: 4155871 - RNA, 55 nt, Human
guacuuuguuaccauagcuccaggaaacuaauggggaacaggacugacacagugc

SEQ ID NO: 4155872 - RNA, 100 nt, Human
guacuuuucaaaaacauaaaauguucacccuuuagaaggcaucucaguuuuuaaaaaacuggcagccacaacuggcaggggagauuuuaguaauagguac

SEQ ID NO: 4155873 - RNA, 55 nt, Human
guagaaaaagcaguaagucucagucaucugguauuuggacuauugcucuuuuugc

SEQ ID NO: 4155874 - RNA, 73 nt, Human
guagaaaauaauaucccaggugggcaccucgaggaagugucuuucucuggcgcccuccuggaauugugacuac

SEQ ID NO: 4155875 - RNA, 69 nt, Human
guagaaagaaauucagauuggcugccuuaucagcucucacuaugaucaaguagccugguuccuuucugc

SEQ ID NO: 4155876 - RNA, 65 nt, Human
guagaaaugguguguuucuucucugacuaaauguaaugcccagagaauggacucagaguuuuuau

SEQ ID NO: 4155877 - RNA, 72 nt, Human
guagaaccaugugauguugcugauauuauguuguuuuugacccagaggaacagcaauuucauuugguuuaac

SEQ ID NO: 4155878 - RNA, 81 nt, Human
guagaacgagaaaagcgaaggaccuggagugccuucagcaaugcacugagucucuuuccucgcuuucauuuugguuucuac

SEQ ID NO: 4155879 - RNA, 57 nt, Human
guagaacucucgcuggaucagacuuccucauagagaggucucuggggggaguauugc

SEQ ID NO: 4155880 - RNA, 84 nt, Human
guagaaggcagagcugauagagagaaacagauuugcgauaauagcauuucuaccuugucuuuucuacuguaagcauauuuuuac

SEQ ID NO: 4155881 - RNA, 76 nt, Human
guagacaguugauauaugggucuggaguuaagggcaagaucaagacuggagauaaaaccaugagucaucugaguau

SEQ ID NO: 4155882 - RNA, 79 nt, Human
guagaccugaguucuaaggcuuuccuugucaucuuugacucuucaaaguuuagggaagggaagccuuauaucacacuac

SEQ ID NO: 4155883 - RNA, 64 nt, Human
guagaccuuggugugagggaagcugcaaagaacuccucugugugcccaccugacaccuggcugc

SEQ ID NO: 4155884 - RNA, 80 nt, Human
guagacuaucaaaaguucuauguaauguuuuuuguauugcuauaaacaaauagugcaugggaauuuauaugacagccugc

SEQ ID NO: 4155885 - RNA, 75 nt, Human
guagacugcacagauuaaguuagauuuagagaaaaauuuuuguuccuuaauaugaauauaagcugugcaguuuau

SEQ ID NO: 4155886 - RNA, 74 nt, Human
guagagacgggguuacucuguguuggucaggcuggucucgaaguccugaccucaggugauccaaccaccucugc

SEQ ID NO: 4155887 - RNA, 99 nt, Human
guagagacugaaauguccucucuucuaauuuucccgaguauuugaguuaacuacacaguuauacaucuggaugaauaggagagugauuguaguguucac

SEQ ID NO: 4155888 - RNA, 83 nt, Human
guagagaggaaugaaguagggugggcaguucuuggggaagaaggauuggcuuccuuuggcuggucaccuucaaagcuuucuau

SEQ ID NO: 4155889 - RNA, 61 nt, Human
guagagauagcugaauucaggcacuuaaacgauguuaggauccuuuuucugcuguuuguau

SEQ ID NO: 4155890 - RNA, 72 nt, Human
guagagauggguucaccauguuggucaggcuggucuugaacuccugaucucaagugauccacccaucucggc

SEQ ID NO: 4155891 - RNA, 58 nt, Human
guagagcagagacuaagacagagacugugcauuccccucugucucuccacugcccugc

SEQ ID NO: 4155892 - RNA, 69 nt, Human
guagagggagaggucuggguuuccauccagguuccaugccucuuagaucuaauuucuccaaaucucuac

SEQ ID NO: 4155893 - RNA, 58 nt, Human
guagaggggugauucugugagacugauaggccugacuauucucaauucuccccacugc

SEQ ID NO: 4155894 - RNA, 80 nt, Human
guagagggugcuggagagacauugcagaaggaaagaguuuugccuucucauuccaguguccucuccuagcagccuccuac

SEQ ID NO: 4155895 - RNA, 82 nt, Human
guagauaaccaauccugugcaaugacugcaucucgcugggaaaaucaggaaggagcacuugcuguaaggauggauauuggac

SEQ ID NO: 4155896 - RNA, 72 nt, Human
guagauaggauuugcauuuuuacaaguagccaguuggugcugcuggaacugcuuugaaaaucacuggucuac

SEQ ID NO: 4155897 - RNA, 91 nt, Human
guagauaguagcucagcaaacuauuguucacaagacaagcuggccugccaccuaguuuugaaaauaaaguuuuauuuggauauaaucaugc

SEQ ID NO: 4155898 - RNA, 60 nt, Human
guagauauguguugggcacucaaaaacugagucaguuuaguauaccaguacaucuucuau

SEQ ID NO: 4155899 - RNA, 68 nt, Human
guagaucucagacuuugaaauuuauaaugaaacucaucucauuuucuguuuuuaggucuuggguuuac

SEQ ID NO: 4155900 - RNA, 101 nt, Human
guagaugacuccagaggggagacaggauuuaaccaaagcuaacuagcagaacuaguuggagcucuuaguuugguguucuuucugcuacucacagucaauac

SEQ ID NO: 4155901 - RNA, 71 nt, Human
guagauggaaguucaggaacauguuggaaagaaaucaagauaacuagauuuucuuguuuuaacuucccuac

SEQ ID NO: 4155902 - RNA, 100 nt, Human
guagauguauguggaguuaagucguggaugauucuucgguuuaaauuauuuucuuguuucugugggaucccaugacuuuccagacaucacucaccucuau

SEQ ID NO: 4155903 - RNA, 85 nt, Human
guagauuaauuuuaugucaucugugucaguuaggcuuucuaccuuaugagcuaugcagaauuuagugacuuaaaacaauaucuau

SEQ ID NO: 4155904 - RNA, 57 nt, Human
guagauucuuggaauucaagucauaucacugaauuagaguagagccuaagaaucugc

SEQ ID NO: 4155905 - RNA, 74 nt, Human
guagauuguaaugguguggugugggaagcaggguaauaauuccuuucuuuuauccaccagccagacaagcuuau

SEQ ID NO: 4155906 - RNA, 78 nt, Human
guagauuucugauucuuuggccuuuauugacagaagaaaacacauuuugucagcaugucagccaaagauagcauuuac

SEQ ID NO: 4155907 - RNA, 74 nt, Human
guagauuuuuacccaggggcugagcagagguucugcuucugguuguacuucuguuucugcuucugguuguguac

SEQ ID NO: 4155908 - RNA, 129 nt, Human
guagcaguuugucuauuucuucuuuuuaggucuucagcaaaaagaacagcuggucucaaucuuuucuaugucaguuuuucacaugcuuggggacuuaaaauggugagcuaggucaugccugucaauuac

SEQ ID NO: 4155909 - RNA, 85 nt, Human
guagccaguaagugguagaguugagauuuaaucccaggacugacugauugcagaaccucaacucuuaaccacuauacuacccugc

SEQ ID NO: 4155910 - RNA, 86 nt, Human
guagccaguugacuuugcaaaugugaguuuagacugcauuccaaaugcaguuuaguguugcauuuggaguuacauaguuugguuau

SEQ ID NO: 4155911 - RNA, 80 nt, Human
guagccccauucuauguuaauauuucagaguggugccaucuucuugcacagaacuucaaacaauuaacagagaaugcuau

SEQ ID NO: 4155912 - RNA, 84 nt, Human
guagccguggaaaauucucagucaguuuggacuguguacauucuggcccuuucauauacacagacuaauuggugacauggcuau

SEQ ID NO: 4155913 - RNA, 73 nt, Human
guagccuagaggucacgucuucauguuccauauuggaugccaaagaguuuaguggaauuuccuucuggguuau

SEQ ID NO: 4155914 - RNA, 76 nt, Human
guagcuaaagagaaccuugagauuuacuuggcuuagcacacucuccauggcaugccauuucuucucuuuaugcuac

SEQ ID NO: 4155915 - RNA, 93 nt, Human
guagcuaacaguuauugaguaguuaccaugugccaggagcuaucuuuaguuuuugacauggaauaacucauuugaugacuauaaacaugcuac

SEQ ID NO: 4155916 - RNA, 62 nt, Human
guagcuguguuccucgcuggguguccacagcuacuauugggcagcccaucucccacagcuac

SEQ ID NO: 4155917 - RNA, 73 nt, Human
guagcuuauuguauaaggugauuuaugauacauaaaacaucacugugcauuuguuaccuuauugcagacuuac

SEQ ID NO: 4155918 - RNA, 74 nt, Human
guagcuuuucuuagcacagauucugggaacaugacuuugacgaugaugacaguggucugggcuaaaugagguac

SEQ ID NO: 4155919 - RNA, 92 nt, Human
guaggaaaaugaugcuaaagcugagacacuugagagacuauucaguguggugcuguggacuuuuuugugucuccuuuauaccugcauccugc

SEQ ID NO: 4155920 - RNA, 75 nt, Human
gugauuucaucaacccauguuggaagcuuaucagacacugcugguauggggcaaaaacuggggagaugaaaccau

SEQ ID NO: 4155921 - RNA, 72 nt, Human
gugauuugcaugccccuguugucuuaaaauggccuaaugucacagcagauccagggguugugucuuugucac

SEQ ID NO: 4155922 - RNA, 77 nt, Human
gugauuuugaugaaugucuguccccuagcccugauugacaccagcaggcuguggaggaugacaaauugucagacaac

SEQ ID NO: 4155923 - RNA, 74 nt, Human
gugauuuuuuuuaagaaacuauggagaagaacugguaugaaacuagaguucuucccuuuucuauggagaaucac

SEQ ID NO: 4155924 - RNA, 63 nt, Human
gugcaaacuuucagggacuuagugucaguuucuauuagaaacugaaaaugguguccugugcgc

SEQ ID NO: 4155925 - RNA, 78 nt, Human
gugcaaaggcacacaguuagauagagcauccuguugguuaugugucucuccucaaacucauaucagugugccuugcac

SEQ ID NO: 4155926 - RNA, 85 nt, Human
gugcaaaguacuggucagugcuugaagggcagagagauggaauuucacuuacuuuaaagaacugauuauuugaauguuuuuguac

SEQ ID NO: 4155927 - RNA, 128 nt, Human
gugcaagagugcguuuggguggguguaguguauuugugugcaugugugugcauguucauguuuacaugguucguguaugugccugcauucacauguacgucugugugcauguguacuugcuuuugugu

SEQ ID NO: 4155928 - RNA, 83 nt, Human
gugcaaggagaccacagagacagagcccagggugccucuuguacaagaacccaggcugcuucucaguggcgcucccuccccac

SEQ ID NO: 4155929 - RNA, 56 nt, Human
gugcacacauguauguauaugugugugugaaugcauaugcacauacgugugugugc

SEQ ID NO: 4155930 - RNA, 66 nt, Human
gugcacagaucuuugagaugauucuauuguguuuagacuaauaacuucaucuucaggauaggugac

SEQ ID NO: 4155931 - RNA, 67 nt, Human
gugcaccaggcacaguuccaagcauuuuauauauauucuauagacuuacauauugucccuggggcau

SEQ ID NO: 4155932 - RNA, 76 nt, Human
gugcaccgugcgcaggagcucugccaggagauggaaaacaagcuccuucacgcaggcugccauguccgugguccac

SEQ ID NO: 4155933 - RNA, 71 nt, Human
gugcaccucugagucucacuguaaccuuuuuugucauugaaaggugcuaauugaucuuaggguacugacac

SEQ ID NO: 4155934 - RNA, 67 nt, Human
gugcaccugaauggaacuuugaaccuccaggccagccugcacagguguucagagcuauucuguggac

SEQ ID NO: 4155935 - RNA, 77 nt, Human
gugcacugacaccaacacaguguuuuuccuggugacaggcaccagggcagcuuccuuuguuaggucagucagugcac

SEQ ID NO: 4155936 - RNA, 88 nt, Human
gugcacuggcuggcaaguuacuggcaagggcugcaguuuuggcugauagcaguuguuuucagugagugguuauuacugcaggguguac

SEQ ID NO: 4155937 - RNA, 62 nt, Human
gugcacuuugggagucucagugguacccaguggcgggggccguggggcuuggccaaggugac

SEQ ID NO: 4155938 - RNA, 58 nt, Human
gugcagaacgugcagguuuguuacauaaguauacacaugccaugguuguuugcugcac

SEQ ID NO: 4155939 - RNA, 87 nt, Human
gugcagaagacagauggaucuuggagaaugacaguggauuauguaagcuuaaccagguggugacuccaauuccugcugcugcuguac

SEQ ID NO: 4155940 - RNA, 55 nt, Human
gugcagaccuuaguucaagccaucagguuagacuuggcuuagacugaguucucac

SEQ ID NO: 4155941 - RNA, 62 nt, Human
gugcagagccauccaggugccuguugauuuucauuacagcagcaaggccuggaacucuccau

SEQ ID NO: 4155942 - RNA, 90 nt, Human
gugcagauaaguaauugaguuuggaagaauuuggucuguuuucauuuuguaaacauucacuauguccaaacucugugcuacguacuguac

SEQ ID NO: 4155943 - RNA, 77 nt, Human
gugcagauggcagagaauaaaucuugacuuugcaaggaagauaaagcaagguggagguguuuucaucgcaaucgcac

SEQ ID NO: 4155944 - RNA, 71 nt, Human
gugcagcaagacaauggagcauaaacguggacaaagaagauaaguuuguguuugucugcaugucucgccac

SEQ ID NO: 4155945 - RNA, 56 nt, Human
gugcagccaccauacagcagaagcuaguagccaagcauuugaaauguggcugaugc

SEQ ID NO: 4155946 - RNA, 74 nt, Human
gugcagccacuuguucauauacccucuggaucagguccccuggacaugggaugagaugaagcauaugguagcac

SEQ ID NO: 4155947 - RNA, 69 nt, Human
gugcagcuuuggagguggaacucuauuuucacacuuuucuauggagccuuccgagucccagguuuucac

SEQ ID NO: 4155948 - RNA, 69 nt, Human
gugcagcuuuuaauuguuuucaauguuaaugaugguauuuaugguaauuaacauacaaaacagcuguac

SEQ ID NO: 4155949 - RNA, 99 nt, Human
gugcaggaugcccaggggccauguggagaggagacggugcagcccugggaaucuggggcaggugaccucuuguccuggccugugaggccgguccugugu

SEQ ID NO: 4155950 - RNA, 65 nt, Human
gugcaggcacuggcuguggccacggcugcucugacggcacagcugccuggccggagccacuggac

SEQ ID NO: 4155951 - RNA, 58 nt, Human
gugcaggcauugggcuagccaugccuauggcguuagugcauggcccagugcuuugcac

SEQ ID NO: 4155952 - RNA, 73 nt, Human
gugcaggcucuggaguaggaucacuggggaucuaaucacagucccacacugaccagcugugagaccugagcac

SEQ ID NO: 4155953 - RNA, 58 nt, Human
gugcagggcagguguccuuccagguccaagggaggccagggcagggccguugccucac

SEQ ID NO: 4155954 - RNA, 57 nt, Human
gugcagggguuccaggcuguagugcaccaggaucucaccugugaauagccacugcac

SEQ ID NO: 4155955 - RNA, 95 nt, Human
gugcaguaaaggaaaaauuauaggcugagcuuguagaucguaacaagcuaaugauaggacuaucagccaguucagaguauucccuaaaacuguac

SEQ ID NO: 4155956 - RNA, 61 nt, Human
gugcagucagguuaaggccuucccaggccucuggccugagaguugcccuacuuguuugugc

SEQ ID NO: 4155957 - RNA, 55 nt, Human
gugcagucccuccucccaaggcacaaagagagucuuggaaagaguggauuugcau

SEQ ID NO: 4155958 - RNA, 78 nt, Human
gugcagucuuuucuaugucuuuuucucacuauaguacaggacuaugggauaagagaaaggcaaagcuaaugacaguac

SEQ ID NO: 4155959 - RNA, 89 nt, Human
gugcaguggcucaaucucagcucugccuccuggguucaagcgauucucuugccuuggccuacuuaguagcugggauuacaagcaugcac

SEQ ID NO: 4155960 - RNA, 61 nt, Human
gugcaguucuaaguagacaagucccugugaggaaggggagugaguacuggaguagcugugu

SEQ ID NO: 4155961 - RNA, 73 nt, Human
gugcauaagggaagaagacaagaaaaugauauugucguuuaauaguucacuuuagaucuucaucucuuaucac

SEQ ID NO: 4155962 - RNA, 66 nt, Human
gugcauacagaaguguguguguaggaaugcacauggcguguauguguguagacacuucuguagcac

SEQ ID NO: 4155963 - RNA, 60 nt, Human
gugcauauaugcacauaugugugugugcaugcauuugcuuuuaugugugcauuugugcau

SEQ ID NO: 4155964 - RNA, 56 nt, Human
gugcauccacugcgcauccccaguguccaggcagggccugcacacaguaggugcac

SEQ ID NO: 4155965 - RNA, 61 nt, Human
gugcauguaaggagcccucagaggaaggaugcccauuugaacuaccucuccuuagcagcac

SEQ ID NO: 4155966 - RNA, 97 nt, Human
gugcauguguauguuuagaaacaggaggccuuccaguccagauucuggucuugguauuuggaaggaccaggccuugauuuugagcagaaauaaccac

SEQ ID NO: 4155967 - RNA, 57 nt, Human
gugcauuaacaacccagaacucuagccauauauuugaguuuggcuuguuuauuguac

SEQ ID NO: 4155968 - RNA, 65 nt, Human
gugcauuaguuuccuauugcugcugugacaaauuaccacaagcuuaguggcuuaaaacaaugcau

SEQ ID NO: 4155969 - RNA, 81 nt, Human
gugcauuggccuggggaccuggccaccuucccacuucugccccucaggucgcagaugaagguggcccggguugaccugcau

SEQ ID NO: 4155970 - RNA, 57 nt, Human
gugcauuggugcgccacuucacccugugcucccuaacagcccugugcaucagugcau

SEQ ID NO: 4155971 - RNA, 55 nt, Human
gugcauuugacgaauacucacugggguaauucacuguguaauuggccaaaugcac

SEQ ID NO: 4155972 - RNA, 77 nt, Human
gugcauuugcccuggagucaggauacauggauucuugucuucuuuuugccccaucugugugauuucagggaagucac

SEQ ID NO: 4155973 - RNA, 76 nt, Human
gugccaacaggacugucgucucccugacaccuuggcucacaugccacggaugucucuggcugcagccuguucucau

SEQ ID NO: 4155974 - RNA, 56 nt, Human
gugccaagaccauuuaauggagaaagaauaaucuuuucaacaagugguguuggaac

SEQ ID NO: 4155975 - RNA, 72 nt, Human
gugccaauggccucagaacggaaaugguuuuggccacgggaaagccaguugcuuccgucucugagacaucac

SEQ ID NO: 4155976 - RNA, 67 nt, Human
gugccacaugguccauguaucaaggggccagcaccagucucugguuucagauacaggauaugggcac

SEQ ID NO: 4155977 - RNA, 60 nt, Human
gugccaccucugccccagaggguauauuuaaaaucauuccucaugucacagaucagguac

SEQ ID NO: 4155978 - RNA, 67 nt, Human
gugccagaccacuguguuugagacuauuuuaaccagcugaugggauacuuuagacauugucugguau

SEQ ID NO: 4155979 - RNA, 55 nt, Human
gugccagagauuccuaaacuuucuguguucagggugccauuaguugucuugguac

SEQ ID NO: 4155980 - RNA, 66 nt, Human
gugccaggacaaggaccacaugguauucaacauugcuuccucagugccugguacuaugucuggcac

SEQ ID NO: 4155981 - RNA, 73 nt, Human
gugccaggaguggagacaggacagucgauacaagaggggccccugucaugucagcugcugaguccccuggggc

SEQ ID NO: 4155982 - RNA, 69 nt, Human
gugccaggcaagggggcgccaccuuccgcgguguggcgcgggggccgggggucccuuugggcugggcac

SEQ ID NO: 4155983 - RNA, 64 nt, Human
gugccaggcacaggaagcagcccccgagacacguuuucgcuggagguuucucugggcuuggcau

SEQ ID NO: 4155984 - RNA, 59 nt, Human
gugccaggcauggugcugggcuaugaccuacaguaucucauucucccgugccauggggc

SEQ ID NO: 4155985 - RNA, 101 nt, Human
gugccauagagugauugagggucagagcuaggagcuggaguuccuggguucaaaucccagcucugccacuuccuagcuaugugaugucaucucucuaugcc

SEQ ID NO: 4155986 - RNA, 112 nt, Human
gugccauauaaaaggcuugauaagagaugagcugucuagcuguuggaaucaagcauucugacagcuucaguaguuuuuaucuuguuuuauuugccucauuucuguuuggcac

SEQ ID NO: 4155987 - RNA, 68 nt, Human
gugccaucuuaggugaugauugaugugaaguaauauaucugucaauuauucacauaggccuggggcau

SEQ ID NO: 4155988 - RNA, 76 nt, Human
gugccauucugcagccucacuaguuucaguauaauuuuuuaaaucacaugccauuauugaggguguagauuggugu

SEQ ID NO: 4155989 - RNA, 71 nt, Human
gugcccaaaccuggcuguugauaauuaauaauaguuaacaguaucaacaauagccaguguuuauugagcac

SEQ ID NO: 4155990 - RNA, 71 nt, Human
gugcccaccuggggccucugagucuccccagccagguggcccugaggcuccccaugaggccccagcugcau

SEQ ID NO: 4155991 - RNA, 100 nt, Human
gugucaaacaaaucaauaaugcaggcagccuucucgucucacaguucagcuccaucuucaccagguggguauggagaccaagaaugugcugcuuugacac

SEQ ID NO: 4155992 - RNA, 55 nt, Human
gugucaacagccgaagauaaauacgauuuuaucagcucggaaucuguugaaacac

SEQ ID NO: 4155993 - RNA, 56 nt, Human
gugucaaugagguuuauuuuugucuuucacaucuugagacugaaccucauuugcac

SEQ ID NO: 4155994 - RNA, 59 nt, Human
gugucacaagagcccaggaaacacuuuggcccccaaagaaucuuuucucucuuggauuc

SEQ ID NO: 4155995 - RNA, 84 nt, Human
gugucacacucuucucaugaaauguagggagccuagacauugauauuuucauggcaucuuugggcugcauggaaggggugacac

SEQ ID NO: 4155996 - RNA, 72 nt, Human
gugucacuuuggcuaguucauuacauaugcuuuuugauugcaguuagagccuuuggagcugcuauuaggcac

SEQ ID NO: 4155997 - RNA, 74 nt, Human
guuauggugcaaccccagauuguaucuccaaggaaauugacaggagaagcaccugcaguugacaaaaauaugac

SEQ ID NO: 4155998 - RNA, 64 nt, Human
guuauguaaguuucugaaaaaacugggcaauggauuugucuuacuuuuucugggcuuccauagc

SEQ ID NO: 4155999 - RNA, 59 nt, Human
guuauguacaaucuaucacaagaagcauagcugugcauucaugagcugauuguauuaac

SEQ ID NO: 4156000 - RNA, 129 nt, Human
guuauguagaauuuuagugaacuuucagggaauuccagaugaagaucauagaauaguauccuuauuaggauagacaauacucaugcucuuuuucuaauucagaaaguugauacuaauauuuauaauaau

SEQ ID NO: 4156001 - RNA, 68 nt, Human
guuaugucugcagcaagagguuucuguugaccacuggugguucacagggauccuuguugaaaaauaau

SEQ ID NO: 4156002 - RNA, 56 nt, Human
guuauuaguaagacucgcacauugcccaaaccaauguguagguuucuuuaguauac

SEQ ID NO: 4156003 - RNA, 80 nt, Human
guuauuccuccuugcuucagaguuuagcugguguuugccuucaacaacaggaaauacuuaugagguaggaaggcuauggc

SEQ ID NO: 4156004 - RNA, 63 nt, Human
guuauucguguuuuguaaaauguguuaaaugcuuguuaaacacauuuuguuaaacccugugac

SEQ ID NO: 4156005 - RNA, 55 nt, Human
guuauugacauguauuaagcacagaauucccaaaugcuaaaugcauguuaauaac

SEQ ID NO: 4156006 - RNA, 56 nt, Human
guuauugcaguauagaggucuaagcaccaauucuuagaucauauacuugccaugac

SEQ ID NO: 4156007 - RNA, 64 nt, Human
guuauugcuaugaugauguguaguuauugauaugauaauauauuguuguuagcaaacagguaac

SEQ ID NO: 4156008 - RNA, 101 nt, Human
guuauuguucugaguuuauuauccuauuuugauuuuaauaggcuucuccuucuugcugagaagccuuugccuaaaacauuaaauaggugagaugcaaugac

SEQ ID NO: 4156009 - RNA, 82 nt, Human
guuauuuagcgugaaccuggagcuaguaguuucaugaguuugaucccaacauggcuaaauuagcuuuacucuguucuaugac

SEQ ID NO: 4156010 - RNA, 67 nt, Human
guuauuuauaagguguaacuccucacuguagcagauguugcuuguguuaguuucaguuuuaggugac

SEQ ID NO: 4156011 - RNA, 130 nt, Human
guuauuugcauacauuuugggcauguaggcagaauggcucaaagacaaaaaucugagguucagccuuguuuggccuccugguguuugaucuugaccgggcuaccugcuucucugacuggcaugcaaaugc

SEQ ID NO: 4156012 - RNA, 64 nt, Human
guuauuuguguugaguauauaguaggucuacagaacugaaauaaauguacuccccacaagcaac

SEQ ID NO: 4156013 - RNA, 83 nt, Human
guuauuuugcagagucaauuuucuguuacauaaucacauagacuuguaucuaaugcaacagaaaauugccuggguggaauaac

SEQ ID NO: 4156014 - RNA, 77 nt, Human
guuauuuugcuuggugcuuaaucuuguuaaauaaggaagaaauuuccacaagguuugguaccacauccaaaaccaac

SEQ ID NO: 4156015 - RNA, 81 nt, Human
guucaaauguuuauuucagauucgagaggaaguggagugguuccuuuccauuuccucgucucuggaaucugcgaguuguau

SEQ ID NO: 4156016 - RNA, 104 nt, Human
guucaacuccaagcugaugaccagugucgaccgccagucauucugaacauuugaccaguugagcuuucaaaugauggcaguccuggcugacauuuugggugaac

SEQ ID NO: 4156017 - RNA, 55 nt, Human
guucaaggagcagcuugcuacaguuuccguuucugcuggugcgcuguuccugagc

SEQ ID NO: 4156018 - RNA, 75 nt, Human
guucaagggauaaauugaguucaggcaugguuugauccaggagcuccuagaaugucaauaacuuuaucccucagc

SEQ ID NO: 4156019 - RNA, 67 nt, Human
guucaagucuggggcugccaguaaagagauaccccaguaucugaucuuggcugccugagauuagaau

SEQ ID NO: 4156020 - RNA, 80 nt, Human
guucaaguuaacucuccuuguacuguucauccugauucuccucuuuccagauuuucaguguaaggaguauaggcuugagc

SEQ ID NO: 4156021 - RNA, 77 nt, Human
guucaaugucauuuaaagaguucuguuugagcugaaaggggagaauccuuguuuagggggcagagguggcauuaggc

SEQ ID NO: 4156022 - RNA, 96 nt, Human
guucaauuuugaaaaaucauuuauuugacuuuggagugaucauuuaauauauacauguccuauguugaaggcaaagaaugaucuuuaauuuugaac

SEQ ID NO: 4156023 - RNA, 72 nt, Human
guucacaaggucguguggggguugcugcuguaggaguagaugagcucacaugaccuuguacguugcaagaac

SEQ ID NO: 4156024 - RNA, 56 nt, Human
guucacagaugccugauguguggcuggcuuacaugugacaacauccgucugggaac

SEQ ID NO: 4156025 - RNA, 67 nt, Human
guucacagcuuguguuuucucuaugugcaaccauuuauuuuuggagaugguacaaggagcugugagc

SEQ ID NO: 4156026 - RNA, 88 nt, Human
guucacucaagauacacagcgaugagaggaggcgccaaaauucaaacccagguuuagccuucuccaacgucuguguccuuagaggaac

SEQ ID NO: 4156027 - RNA, 78 nt, Human
guucagaacaggcucacaucugcgcucugccucauaugagcugugugacuuagggcaggugagauggccucucugaac

SEQ ID NO: 4156028 - RNA, 78 nt, Human
guucagacuccaucuggcaaaaccagcauuaugcauggacuucuauacaauaagguaaggguauugucagauuugaac

SEQ ID NO: 4156029 - RNA, 90 nt, Human
guucagagccacccuuggagagaggcugcucaggcucagcucccugugcugggcuuucuagaucuagcucuguucgggggaguucuuagc

SEQ ID NO: 4156030 - RNA, 80 nt, Human
guucagagggugauccagaggugucuugagccugggaugugaggagguaggggguacuggcuggagccccacauuugaac

SEQ ID NO: 4156031 - RNA, 64 nt, Human
guucagauacagcuagcuccguggcuuggcucucccggccuugagcccgcuguggucugugagc

SEQ ID NO: 4156032 - RNA, 70 nt, Human
guucagauaguggguuuuuuggaggcuacuuuggacaugggugauggcuccaaggcccaacugucuaggc

SEQ ID NO: 4156033 - RNA, 65 nt, Human
guucagauggagaaggaaaacuuuggguuaugcauuuuuuccccucuuuuccuucuccucuuaau

SEQ ID NO: 4156034 - RNA, 55 nt, Human
guucaggaagguccuauagcagagcuuacuaacuuuguuauccaucuuucugugc

SEQ ID NO: 4156035 - RNA, 59 nt, Human
guucagggagggacagaugaagggcguaaaucaugaucugggaagucuggucccugaac

SEQ ID NO: 4156036 - RNA, 76 nt, Human
guucagggucucuuccucaguauugcaugaccaaauccugauuuuguuuguaugcugagaagaauugccucuggau

SEQ ID NO: 4156037 - RNA, 91 nt, Human
guucaggguuauggucagacagaaagaugaguauggcaagaucauuuccuuauuauccuuuuguuuacuuuaucuauaaaugccacugaac

SEQ ID NO: 4156038 - RNA, 63 nt, Human
guucagguccugaggccaagcagcucugccucaaaucccagcugugugaccuuggacuugagc

SEQ ID NO: 4156039 - RNA, 66 nt, Human
guucagugauucucgguguucaugacuguagcucugcagggaguuuugaaucugggaagucugaac

SEQ ID NO: 4156040 - RNA, 58 nt, Human
guucagugguguauccccagugccuaaaacauugccuggcaauacacauuuauugaac

SEQ ID NO: 4156041 - RNA, 71 nt, Human
guucaucaagcuggcauauguaguucuuaacaaacacauuaaggaaacauucggaaugucacuugcagagc

SEQ ID NO: 4156042 - RNA, 110 nt, Human
guucaucagacuugaacagcgaacuugaaccacaugguggggcucuaaagauuccaggaagcuccagcggauggucuuauauuugaugucucagaucaugucuggaaaac

SEQ ID NO: 4156043 - RNA, 98 nt, Human
guucaucucuuuuuccaagcugaaauuuuacugaguauaagacaguaacccaauuauccuaaugguauacucauuaauauuucaucaaaggagagaau

SEQ ID NO: 4156044 - RNA, 59 nt, Human
guucaugcucugggcuucuggggaaccaaaugauuucacccugcaggccagggcugagc

SEQ ID NO: 4156045 - RNA, 65 nt, Human
guucauggcaguuguaugggcuguaugugcacauagacagccucaaagauaaucaugcauagaac

SEQ ID NO: 4156046 - RNA, 89 nt, Human
guucauggccaauauuucccaagugucuuggaccaggggcuugcuuuuggcacuccugguccaaaauauuugggaaauacaggccgagc

SEQ ID NO: 4156047 - RNA, 74 nt, Human
guucauuaacauagagacaggaagugcuuuguaguucaguacaucaaagcacacuuggcucuguguacuguaac

SEQ ID NO: 4156048 - RNA, 59 nt, Human
guucauuauauugcugcaaacaugaauaauccacauguaauuguagcuuuguaaucagc

SEQ ID NO: 4156049 - RNA, 96 nt, Human
guucauugaugccuacucuguuccaggcuccauuccaggagcuagauguugcaaauacauuauauuucaaaggguggggccaggaaggcagugaac

SEQ ID NO: 4156050 - RNA, 77 nt, Human
guuccaaagagagggguuugccauccuaugagucacugauugcuggugcauagccuggaagcccucuccccuggaac

SEQ ID NO: 4156051 - RNA, 59 nt, Human
guuccaaaguuagaguguauuguagggcauuaacuaauuaugccucuaauuuugcaaac

SEQ ID NO: 4156052 - RNA, 61 nt, Human
guuccaaggagagcucgaccucaaagguguuagugcuuuggggucaaggcugccuuggggu

SEQ ID NO: 4156053 - RNA, 130 nt, Human
guuccacaauaucaaaauccaguaauacaaaauugcuuccuucaauuucacucucccugccacuuaccaaugagguggugcuaguagagggugggcaagggagugaauuggagaaaugggauaaaugaac

SEQ ID NO: 4156054 - RNA, 78 nt, Human
guuccagaagccucaccccagcccccuugcuggauccuagggaccaguuucugggggagguuggggagggcggggagc

SEQ ID NO: 4156055 - RNA, 56 nt, Human
guuccagacuugccaguggaagggacuugcacaagauuaaagggaagugcugggac

SEQ ID NO: 4156056 - RNA, 75 nt, Human
guuccagccauaugcuugguuccuacuucuggcccuuuucuggggccauggcccauaccaggugcaugcugaaac

SEQ ID NO: 4156057 - RNA, 76 nt, Human
guuccagcucuaugucuugaucuuuaccaaagauucucaacacaacuggcagauuuugaagacagagaggaagaac

SEQ ID NO: 4156058 - RNA, 67 nt, Human
guuccaggcaagugggauaggacgugcuaugauacggaggcacagauagguccgcuaugucuggaac

SEQ ID NO: 4156059 - RNA, 65 nt, Human
guuccaggccucuagcccucucuucgcugcucccagccaggaagaguccgagaggcgacuggagc

SEQ ID NO: 4156060 - RNA, 63 nt, Human
guuccaggcuaauuuugcauuguuuuaccuccagacccagaauaaguaauuuugccauggaau

SEQ ID NO: 4156061 - RNA, 60 nt, Human
guuccaggcugcuuuauuacucuguuuuggccuacagggaaacauuugggagcuuaggac

SEQ ID NO: 4156062 - RNA, 71 nt, Human
guuccaggucugguuggacagguugaggcugacacaccugagagaauccggaaugccagagagccuggagc

SEQ ID NO: 4156063 - RNA, 60 nt, Human
guuccaguugcaacagguguguuuugguguagcauauacacagacgucugugccugggac

SEQ ID NO: 4156064 - RNA, 130 nt, Human
guuccauacccugggggacaugcaggugagaugcucagggacuuggauccuggcccuacacacaccuccuuguggccuugggcgagucccucagucacccugagccuucauuuccuccucggucaugcac

SEQ ID NO: 4156065 - RNA, 75 nt, Human
guuccauugccauugccauuggcccagcccugcugguugggaccuggagggcuggacuaaggaaagcaaggggac

SEQ ID NO: 4156066 - RNA, 65 nt, Human
guucccacgccuccucuccagcgugacuaguggcugaggaugcggaggagaggaggcugaggagc

SEQ ID NO: 4156067 - RNA, 76 nt, Human
guucccacucaggccccaucgcccaucugcagaugguggccccuccacaggugggcaaugaggccugaguguagac

SEQ ID NO: 4156068 - RNA, 64 nt, Human
guucccagcugagguugaagaaagagaugcucugucuucuuguuuuagcccucauacuguaaac

SEQ ID NO: 4156069 - RNA, 80 nt, Human
guuccccuaaaucuggagagucaucucugacacguuaaauguagacagucaggccaauacucuccagcaccuaggagagc

SEQ ID NO: 4156070 - RNA, 60 nt, Human
guucccuagccugccacucuuucacuacccacauaacagaaagcuggguaggagaggagc

SEQ ID NO: 4156071 - RNA, 96 nt, Human
gugggcaacgucuguccaucccuggccuccuggccuucucauuuccucuugcaguggccgugacaguggaaggagggccgaggacagcuugcucac

SEQ ID NO: 4156072 - RNA, 84 nt, Human
gugggcagagcuugaaagucucugcauguaggaaaaggggaaauccacaguugcucagcacagaccaggccaggaucugcccac

SEQ ID NO: 4156073 - RNA, 63 nt, Human
gugggcaggaugcguugauucuuccccaggucuaugagggagagccugcuccaugcugcuugc

SEQ ID NO: 4156074 - RNA, 58 nt, Human
gugggcaguuggugauucucguguuucucacacacacaugagggucccgcguguccac

SEQ ID NO: 4156075 - RNA, 56 nt, Human
gugggcaucaccagggccuccagauccuccuggggcagaagcugggcgauguucac

SEQ ID NO: 4156076 - RNA, 87 nt, Human
gugggccgcgcccggggcgcggagggcggcggccgggcccggguuccggucgcgcugccucucuggggcccugggggcaucgcuugc

SEQ ID NO: 4156077 - RNA, 77 nt, Human
gugggccgugucaucugcggguggcacugcccucggugggcgggugggccgugucaucugcggguggcacugcccgc

SEQ ID NO: 4156078 - RNA, 64 nt, Human
gugggcgggguuccgugccccagagucgagggagccgugggcuugggguccggaucgcggccgc

SEQ ID NO: 4156079 - RNA, 97 nt, Human
gugggcuccaugacuuuaugaauauucuucauucagguucuaaacugcuagugcacuuucuaggacccugcgugagaacguagagcucagugcucac

SEQ ID NO: 4156080 - RNA, 129 nt, Human
gugggcugccuccaggcggguggcccgaaaguggacagcuguggccagggugugggcgucggcacgugggcucccggccggcgugugcccuucuguccugccacccgcucuggccccagguucaccugc

SEQ ID NO: 4156081 - RNA, 66 nt, Human
gugggcuggguuugacuccuggcuucuccacugacugggaugcugggagugaagccccuggcacac

SEQ ID NO: 4156082 - RNA, 92 nt, Human
guggggaagaaggccgcuuaugcucuauuaucuuuuuuuacugaaaaaaaggaagggcggauaguauaaguuaacagaagccucuuucucac

SEQ ID NO: 4156083 - RNA, 56 nt, Human
guggggagcugggaccaugcugggaaauccaucgcuucaaaucucagacuccugau

SEQ ID NO: 4156084 - RNA, 81 nt, Human
guggggagggggagaaaggccagggggcacugacuccauugcaucgugggaggagcagccuggucucucgccaauacccac

SEQ ID NO: 4156085 - RNA, 56 nt, Human
guggggagguaagauuuguuaaacuggaauuaaaagaagacaguaaacuuccccau

SEQ ID NO: 4156086 - RNA, 81 nt, Human
guggggaggugaaacuggcauuuaguggauggaggccagggugcugcuaaacaucuugcaaugcacaggacaaccucccac

SEQ ID NO: 4156087 - RNA, 94 nt, Human
guggggaguguccaccccccugugauauuguucauaauauccaguccccccucaauauuacacacgguaucacggggaaguguacacacccuac

SEQ ID NO: 4156088 - RNA, 58 nt, Human
guggggcaugcacgcugcuccugaugccacuccgucagagcagcguggauggccccau

SEQ ID NO: 4156089 - RNA, 84 nt, Human
guggggccaugcuggggccucugugagguuaaccugacuccucacuuugacccugagaggugccugcaaugauccuugccucac

SEQ ID NO: 4156090 - RNA, 63 nt, Human
guggggcccuaguacugggaaagagggcuggcuaggccacgucugccugucugggguccccac

SEQ ID NO: 4156091 - RNA, 78 nt, Human
guggggccucugcagcugugagugcuggaugccuccgagcaggacacugggaccuauagcugucagggcucaccccau

SEQ ID NO: 4156092 - RNA, 70 nt, Human
guggggcucagggcugcugucagggcuccagccuccagcugggcccugacuucaagcauccaggccucac

SEQ ID NO: 4156093 - RNA, 124 nt, Human
gugggggcagcucugauaugugggggagcccugggugugggggcagcucugauaugugggggaguccugggugugggggcagcucugauaugggggagccgugggugugagggcugugccucac

SEQ ID NO: 4156094 - RNA, 59 nt, Human
gugggggcgggugcaggcgggcagcucggggagccccagccugugacagccguccucac

SEQ ID NO: 4156095 - RNA, 81 nt, Human
guggggggaggaguuaagagugugaaaauguuaguuagcuauagaguuuguuagcaucaaguaccucgacuucauccuuac

SEQ ID NO: 4156096 - RNA, 75 nt, Human
guggggguagggagugggagagucggagagguagaagaaagccgcuagauccaggccucuagccccuaucucuac

SEQ ID NO: 4156097 - RNA, 82 nt, Human
gugggggugaaaagcauuuauagauaagaauuugaaauucaaaugaaggaacaaguagucugucuaaaaugcuggccuccgc

SEQ ID NO: 4156098 - RNA, 74 nt, Human
gugggggugcucacugacuccaggguucagccacugucugcaugcuaaugagcuaaggagucccacaccuccac

SEQ ID NO: 4156099 - RNA, 84 nt, Human
guggggguggugagcagagcagaaugugaagguggggugaagcccccucgccggccaccccugcucuugcccucccauccccgc

SEQ ID NO: 4156100 - RNA, 86 nt, Human
guggggucugagguuacaguggugggcucacagcgaggcucauccugcguguggcgagaacauuggaccaucagucaccaccccac

SEQ ID NO: 4156101 - RNA, 69 nt, Human
gugggguggugucuuugcauuauggugcuaggauaaauguacagguggagcauaacacacuagccuugc

SEQ ID NO: 4156102 - RNA, 97 nt, Human
gugggguguuguuuuuuuuuuuuuuuugagauggagucuugcucugccacugaggcuggacugcagcggcaccaucucggcucacugcaaccuccgc

SEQ ID NO: 4156103 - RNA, 110 nt, Human
gugggguuaauguucuuugcccugcggccuuccaggguugugggcuucagcagaagugauauuccugcgaaagcuuugaacucuaaaguauguuucggguauaaccuugc

SEQ ID NO: 4156104 - RNA, 66 nt, Human
guggguaaccaggaguaacagugagugguagaacuccuauuucaaccccuugauuccuggaccugu

SEQ ID NO: 4156105 - RNA, 97 nt, Human
gugggucacacagcaucaugggggaugagcuggggcuggagucggcuguaucugacaccagacccuccauucaagcucccuugaugacaacgcccac

SEQ ID NO: 4156106 - RNA, 90 nt, Human
gugggugaacgaaugcaugacugaguggguuucugcuugucaagucuuccucuuuggaagcauacccccuuagcacacauuagagcucac

SEQ ID NO: 4156107 - RNA, 90 nt, Human
gugggugacagaaagauugaaaucacuggaagcuuucagccaugaaggaguuguacauugugaacauucaaaucaagaucuuucauccac

SEQ ID NO: 4156108 - RNA, 61 nt, Human
gugggugcagcacugggcuucgaacccaggccgcugggacucugggcccaugcugccucac

SEQ ID NO: 4156109 - RNA, 83 nt, Human
guggguggggcagugggaagugugccuggggggguccguggacgauuccuccuucgggacugcuugaccacugccuuccccgc

SEQ ID NO: 4156110 - RNA, 58 nt, Human
guggguguuggugauguggcuggcaugaaguuucugucaggagccaccagcacuccgc

SEQ ID NO: 4156111 - RNA, 67 nt, Human
guggguugaccuaugcuaggugcucaaugagcgcaugcacauucagcaugcaauuagguaaucacac

SEQ ID NO: 4156112 - RNA, 77 nt, Human
guggguuggagucugugaugcucugggucuggugacuagaacuuuuaccacaguugccauaagaaccaagugccuau

SEQ ID NO: 4156113 - RNA, 129 nt, Human
guggguuuuguguguauguauguauuuuauuuuucacaagguuauugcuggauagauacaucaugacuuaauguugauauuccagaauaauguagaaaaugauacaaugucuaaauacguguuacugac

SEQ ID NO: 4156114 - RNA, 98 nt, Human
guggguuuuucggccaggcgugguggcucacgccuguaaucccagcacuuugggaggccgaggcagguggaucaccacgucaggaguucaagaccagc

SEQ ID NO: 4156115 - RNA, 66 nt, Human
gugguaaagaagauaacaagcuugagaaaagugcacuuuuuucuagucucgaucucuuaaugccac

SEQ ID NO: 4156116 - RNA, 116 nt, Human
gugguaaauaaaagcaauuucaagaugguguguaugagugugacuaaacuuuuuggcuauuagaugccugagguagucauuuucuacucuuugaagaugcugaauacaaauuucac

SEQ ID NO: 4156117 - RNA, 60 nt, Human
gugguaacaugacugugccuccagcacuggccuuugccaggcuccuuguucaucauccau

SEQ ID NO: 4156118 - RNA, 74 nt, Human
gugguaaggagcugacuuguaaagcauugugcaauucacuccucuuuugaugcagcagccagcuucugaaccac

SEQ ID NO: 4156119 - RNA, 86 nt, Human
gugguagcaaauauaaaaguuaaagguauaaaacaagcacauuuuugucgauuuuauauguuuguacaauuaaguuugccacucac

SEQ ID NO: 4156120 - RNA, 55 nt, Human
gugguagcaugucuggcuuuuuggaggaaucgcaaggaggccaguacugcugaac

SEQ ID NO: 4156121 - RNA, 74 nt, Human
gugguaugucucuugagccacuaauagauugucauguaauaugcaguuuucaaaaguuuacaggauaaugccau

SEQ ID NO: 4156122 - RNA, 66 nt, Human
guggucaggagguaggacauacugguuaguuucauccaccaguauccacucaagccccaggacuau

SEQ ID NO: 4156123 - RNA, 57 nt, Human
guggucagguuaucagaucauauggaaggcccugcuggucuuaugaggccuguccau

SEQ ID NO: 4156124 - RNA, 60 nt, Human
guggucagugccuccuguguuggccgcaaugcugugcuccucacagcuggcgcugaccgc

SEQ ID NO: 4156125 - RNA, 63 nt, Human
guggucaguugcaucagagaagucugcucugaaaugcgaacacuuucucuugcagcuggcagc

SEQ ID NO: 4156126 - RNA, 70 nt, Human
guggucaugugguuucacuguaauaguuaggugcugauguacaccuuccucagcacaaagccaagaucau

SEQ ID NO: 4156127 - RNA, 89 nt, Human
gucagacaugggauuuagaggcaggaggguuuuaccuaagaacauagacugugugcccagacugccucagugaaaaucucagcccuggc

SEQ ID NO: 4156128 - RNA, 82 nt, Human
gucagagagagucaaaucuuugcugcucaaaaucagugcuuuaggcauugauaacacaaguaagcauuuguuucucuuaggc

SEQ ID NO: 4156129 - RNA, 67 nt, Human
gucagagccccacaugggcguaauguccaugguuggaaccguggcucccugccuauuguggcucugc

SEQ ID NO: 4156130 - RNA, 63 nt, Human
gucagagcccuucccugauuuuuuucaaacuguaacuaagagaagagggauggcgcucuagac

SEQ ID NO: 4156131 - RNA, 57 nt, Human
gucagaggggacaagacacagauggcaaaaacaucuggccugucugccucuauugac

SEQ ID NO: 4156132 - RNA, 60 nt, Human
gucagaggggcagcugccaggcucacaccccaccccgucaccccucagcugccccuggac

SEQ ID NO: 4156133 - RNA, 67 nt, Human
gucagaucaugucugggagcagacuccaguuggaauucugugucugcccuuaguacaucuuucugau

SEQ ID NO: 4156134 - RNA, 59 nt, Human
gucagaucuucuauguaaugaagugucuuuacaguuuaagagacuuucuaggagcugac

SEQ ID NO: 4156135 - RNA, 84 nt, Human
gucagcauggaacgucagacucuuagaacgccacagugcagccgacguauguguggcagcugggagugugaggcuauuucugac

SEQ ID NO: 4156136 - RNA, 86 nt, Human
gucagccuugguucuggcaaugagcaggugcucuggaagaagucccaggcaagcucugcugugccccuuaucugaaccgagcugau

SEQ ID NO: 4156137 - RNA, 63 nt, Human
gucagcucagcaggugggagugugccuuggcccugaggaagcaccugccugcuagagccugac

SEQ ID NO: 4156138 - RNA, 112 nt, Human
gucagcucuggucuaggucuguuacagcgggaauggauuuacacaguguuuguauaaauuuaaauuccugcugccuaagcagucuggaugcugugccaugagccuucuugac

SEQ ID NO: 4156139 - RNA, 58 nt, Human
gucagcuggugaacuaguuuuucaugcuccaugagauuucugcaauuaccaagcuuac

SEQ ID NO: 4156140 - RNA, 80 nt, Human
gucagcuguagggcuuagugcuuagugcccaggguccucgcugguggugguguccucacuauagcaagucugcaggugac

SEQ ID NO: 4156141 - RNA, 92 nt, Human
gucagcugugcaauuacuuuguuuuggcaggacacuuuggagucaagaaaacauuggcuggaguucaaggccaagauuuuggaucagcugcc

SEQ ID NO: 4156142 - RNA, 69 nt, Human
gucaggaaggacccacgaagucacuggaugcagcccgggcucuguggcuucugcuugggccucucagac

SEQ ID NO: 4156143 - RNA, 67 nt, Human
gucaggaaugguuucucaagcaagagaaaccugaguuaugucuugaaaugagaagccaugguuugau

SEQ ID NO: 4156144 - RNA, 79 nt, Human
guguucauuuacauauugucugugacugcuuugcacacuacaagagcaaaugugaguuauagcaauagaggcagaaugc

SEQ ID NO: 4156145 - RNA, 86 nt, Human
guguucuccuuguggcugcagcagccgcacuaagacacuggccacaccugguuucuccacagccgcugcagccacgaggagaaggc

SEQ ID NO: 4156146 - RNA, 75 nt, Human
guccgccccgcccgcucuagcucugagagccacucgcccagugcuuccagcaccagcagaggggaguggcaggau

SEQ ID NO: 4156147 - RNA, 128 nt, Human
guccgggucguccugguuuggcuuccuuaggacugugccgcuuucacucgagcuccugcagcggcagcccgccgccuuguggccaggguggaaaacggcacccggcggacagggcaggagaccacggc

SEQ ID NO: 4156148 - RNA, 85 nt, Human
guccggucuuuggcaagguuaacaccacagcugggacaaauucgagguuugugccuguugguguagacauagcuacaagagggau

SEQ ID NO: 4156149 - RNA, 61 nt, Human
guccguaguggcugaugcuuugagcccauggcugcucuggaggcaugagcccugcauggac

SEQ ID NO: 4156150 - RNA, 95 nt, Human
guccuaaaguacaccuaccuucucacuacauuugaacuguguugggcaggauacaugcaguggcaaugggaguggagacagggaggaaacuggau

SEQ ID NO: 4156151 - RNA, 61 nt, Human
guccuacaccggagccuggaagguaucaaauccugguaccaccauuugccugcuguaugac

SEQ ID NO: 4156152 - RNA, 79 nt, Human
guccuagcuuugcgcaugcguagugggcggagaaaaaagguccggucccaggauugguugcgcaggcgcagggaaggau

SEQ ID NO: 4156153 - RNA, 103 nt, Human
guccuauggggccaaucauuaacuuuguauuuuaugguacauucuaaauaccucccauggguauguacauaacaugaaaugcaggguaaugggcagaugggac

SEQ ID NO: 4156154 - RNA, 77 nt, Human
guccuauggguagagauggggguuagggaggcugccuugaauugaaacauacccugguugcaacucuaccuuaggac

SEQ ID NO: 4156155 - RNA, 76 nt, Human
guccucaccccuugugaaugcugcucuggaaggcaagcugguccugcuggauggcauucaccgggugaaugcgggc

SEQ ID NO: 4156156 - RNA, 60 nt, Human
guccucauaauaaacauuugcugagucuagguaagaaaucagcagaccuguuauuuggau

SEQ ID NO: 4156157 - RNA, 70 nt, Human
guccucauugucacuggcccgcagacaggaaaggaaaaguaaauccccgcugaggcaggggcagugggau

SEQ ID NO: 4156158 - RNA, 61 nt, Human
guccuccaaguuugacucaggacacuaccuaugucagugguuuccaaacuugucugaggau

SEQ ID NO: 4156159 - RNA, 69 nt, Human
guccuccucagguaagauuauccuccaagcucuugcuucagugagcagaggcauauaauugcuggggac

SEQ ID NO: 4156160 - RNA, 63 nt, Human
guccucugagacaucagguugagcaguauuguggcugucaucaugaaccuugucaucagggac

SEQ ID NO: 4156161 - RNA, 69 nt, Human
guccugaaagaagacagacauuucuuucuuagggauugccgauagagauccccuguuuuccccugggac

SEQ ID NO: 4156162 - RNA, 55 nt, Human
guccugagaauacuaggcacaacaaaagguucuguuuaagcuuguuauccaggac

SEQ ID NO: 4156163 - RNA, 58 nt, Human
guccugagggcccaggcauucuggauuccaagccuagccuugucuggggccucgggau

SEQ ID NO: 4156164 - RNA, 64 nt, Human
guccugauacaugggcugugacaagaagugagagauagugacagugugacaauugugucagaac

SEQ ID NO: 4156165 - RNA, 55 nt, Human
guccugauagcccaacacugccuaaaaacagcagagagcaguaggcgcgcaggac

SEQ ID NO: 4156166 - RNA, 59 nt, Human
guccugccuaggaacugguugugggugucuccuaccucacccagucaccuagguggcac

SEQ ID NO: 4156167 - RNA, 71 nt, Human
guccugcugcuguccagccugaagagugggggccacaggcucccagaaccaaggcuggggaggcaggaggc

SEQ ID NO: 4156168 - RNA, 80 nt, Human
guccugcugucucugcugcaccuucuggguccugcuaucccccaggagacccaagauggugaguagggaaagcaaaggau

SEQ ID NO: 4156169 - RNA, 78 nt, Human
guccuggaggaguaauuaguguccagcuucugcuuaucaaagcuuugccaggaggcuugguccacaugauuccaggau

SEQ ID NO: 4156170 - RNA, 68 nt, Human
guccuggaugggucugagcagagagguggcgugauggucaucucauuguagaaagacugauuuggaac

SEQ ID NO: 4156171 - RNA, 63 nt, Human
guccugggcaugcagggcuuucucuuucacuggaugggugacagcauggugucuguucagggc

SEQ ID NO: 4156172 - RNA, 62 nt, Human
guccugguagcuggcuuggucaggugucaacucacccuauccauuggcuaggugcuugguac

SEQ ID NO: 4156173 - RNA, 68 nt, Human
guccugguuaguagcacagaugcugaauccagucuuccuguguucacaucucagcacugccucuggac

SEQ ID NO: 4156174 - RNA, 67 nt, Human
guccugucccccaaggcuguggcuguccaucaguccugccuguugcagccauguggggauuuagggc

SEQ ID NO: 4156175 - RNA, 59 nt, Human
guccugugcguuucuuucccagcuucguggagccacgcaggggaggaagguacaccugc

SEQ ID NO: 4156176 - RNA, 78 nt, Human
guccugugcuaagcacuuuauaugcauuaccucauuuaaccaaaugagcauacauauguaaagugcuuggcaaagugc

SEQ ID NO: 4156177 - RNA, 64 nt, Human
guccuguguaaguacuugcucagcaugcucagagauucccaugccagcuuauuuacugcaggac

SEQ ID NO: 4156178 - RNA, 78 nt, Human
guccuguugugguugcugacucuuuucaugccuccugauugagagaaucaagguggagaucagggacuaaggcaggac

SEQ ID NO: 4156179 - RNA, 56 nt, Human
guccuuaaagagagcaucauucgugccaaauggcagguuugcuuggcucuuuggac

SEQ ID NO: 4156180 - RNA, 126 nt, Human
guccuuagcauuugugaaccagguugggaaugagagucagcccaggaggggccgguggcucauuuacuucagggcaugaucuggcuguucccaaagugccucuuggguucagggacugugaaggac

SEQ ID NO: 4156181 - RNA, 87 nt, Human
guccuucccagagcugcuccagugagcuggccauccucagaggagaaagggaggagccagagcacuggggagcccuggcagaggcac

SEQ ID NO: 4156182 - RNA, 56 nt, Human
guccuuccccagccagcucugggccaucuccuuggcccggaguguuggagggaggc

SEQ ID NO: 4156183 - RNA, 130 nt, Human
guccuucgaugccuuaucacagcaagucacgugacccugaaguguauaauccugcaaagggagcuuuucaggcuuccucaugugcaaugcaagcagggcauauguacucaagacuccacccaucccaggc

SEQ ID NO: 4156184 - RNA, 60 nt, Human
guccuucucaaauccuguguuuuaagccacaaagauaggucaggaaaugagaaaggggac

SEQ ID NO: 4156185 - RNA, 58 nt, Human
guccuuggcaucaugauuuggugucuaacuccaccauugucaaacagcugccugggau

SEQ ID NO: 4156186 - RNA, 61 nt, Human
guccuuggcuucuuguugacuguuguccagggguugcugucagcaguaagaggccaauugc

SEQ ID NO: 4156187 - RNA, 80 nt, Human
guccuugguggcuguggggaucucuggugguggucacccccaaaggauaaugaccaguuuccccacuguccugcucgguc

SEQ ID NO: 4156188 - RNA, 96 nt, Human
guccuuucuuuccaagcaaagagauaaccuuuugggacaggggcguaacacaccagcuguacugugaggauuaaaucuuugcgcuaggagagugau

SEQ ID NO: 4156189 - RNA, 87 nt, Human
guccuuuucaggaagugaccagauucaggucacucaggucaagccuaguggccugagugaccugaggucuagucacuacuacauggc

SEQ ID NO: 4156190 - RNA, 75 nt, Human
guccuuuuggccugggaggcugagguugcagugagcugugaucaugccacugcacuucagccugggugaaagagc

SEQ ID NO: 4156191 - RNA, 70 nt, Human
guccuuuuugacccucugauugggaacacacucagugaccuugggaguguuuuacucaaagaaagaggac

SEQ ID NO: 4156192 - RNA, 89 nt, Human
gucgacagugcauuuccagucugggcaggaauggccauuggcaacagguguuucuccacugggcguuucuguccaaucucauucuugac

SEQ ID NO: 4156193 - RNA, 76 nt, Human
gucgacugcacucucuccuuagcugcagaccaugcacagugccuggggcggaaggaggagagguguugcgguuugc

SEQ ID NO: 4156194 - RNA, 82 nt, Human
gucgaggauaccaguugccugaaauuuuccucuggauccuucucuagaucauuuucagagguaugcugcuuaucuuccugac

SEQ ID NO: 4156195 - RNA, 96 nt, Human
gucgcaaccuagaaugugggcuggagagcgcugucccagugguggccccgaggccacagguucugucccagauguucucagcaccauuuuagcgac

SEQ ID NO: 4156196 - RNA, 66 nt, Human
gucgcacucagccaggccaggcauucacacucagggugagugggaaccaggacuggcugaggcagc

SEQ ID NO: 4156197 - RNA, 64 nt, Human
gucgccaauggaggcuggucugcggcaagcaaguggaaagcaaacaguccugccccuuggggac

SEQ ID NO: 4156198 - RNA, 70 nt, Human
gucgccuagccuggagugcaguggcgccaucucggcucacuguagccucugccucccagguucaagcgau

SEQ ID NO: 4156199 - RNA, 130 nt, Human
gucgccuuugugcccggcggcgggguggggaggucagcgccgggccgggccgcggccgccggggaggggcuggaggaccggccucggacaaagcggcggccccgccccgccaugccccggggguuggaac

SEQ ID NO: 4156200 - RNA, 87 nt, Human
gucgcuguuuuuacacuuuucaauguagucuguaaucgauguauacaaccucaaaaacagcagcgugaaguguguuaugacagcgau

SEQ ID NO: 4156201 - RNA, 69 nt, Human
gucgcuugaacccaggaggcagagguugcagugagccgagaucgcgccacugaacuccggccuggcgac

SEQ ID NO: 4156202 - RNA, 82 nt, Human
gucggcucagaccuggcaguagcugacacacuugcugucuagacaaggcuaagagcuggugugccacuguuggggagugggc

SEQ ID NO: 4156203 - RNA, 64 nt, Human
gucgggcugcucgcugcggaacucguucaggaugucgaagaagcucugcucgggcaugcccugc

SEQ ID NO: 4156204 - RNA, 72 nt, Human
gucguaggccuccugguacuccuuguggggcuugaccauuaucacacagguggggcacuuggagccugcggc

SEQ ID NO: 4156205 - RNA, 56 nt, Human
gucguaggggaaaagcuuaggcuugauaaaggagaccugggccaaauucccuggac

SEQ ID NO: 4156206 - RNA, 66 nt, Human
gucguaugcaaaugaaauguuugaggacacuguaauaugcuuacucacucauuuccagcaucugau

SEQ ID NO: 4156207 - RNA, 63 nt, Human
gucguguuuuccuccugggccaaucacagaggcaauagugggaguccuggggaggggcauggc

SEQ ID NO: 4156208 - RNA, 70 nt, Human
gucuaacaugcuccucuauuccccacauuuuugauaaauugaaaguggggucuagagggccugauaagau

SEQ ID NO: 4156209 - RNA, 94 nt, Human
gucuaagaguguggcugaugagcugcuguuauucaucagaacugggaaacagugaauauccauucugugcuaacugcaggccaggcuccgagac

SEQ ID NO: 4156210 - RNA, 72 nt, Human
gucuaagggaagagaacugguccuagccuaggggacuuggacugaggugagagguccaguucugucuuggac

SEQ ID NO: 4156211 - RNA, 109 nt, Human
gucuacaagguauuagauuggugcaaaaguaauugcgguuuuggccaucacuuuuaugguaaaaaccacaauuccuuuuacgucaaccuaauacuuaauuuuuguggac

SEQ ID NO: 4156212 - RNA, 74 nt, Human
gucuacaguacacagguaccaagcugccuuuugucuuucuaauucagaaaaagccugaugccugugcuguaagc

SEQ ID NO: 4156213 - RNA, 69 nt, Human
gucuaggcccuuuugccuuucucugaggcccugaggcuuccugaagaggaugguugaggaagaccugau

SEQ ID NO: 4156214 - RNA, 58 nt, Human
gucuaggcuggagugcaguggcgcgauuucggcucacugcaaccucugcuucccaggc

SEQ ID NO: 4156215 - RNA, 72 nt, Human
gucuagggcaggcuugagagaucagauggcgugaaaggcuugugaucuguucgucucaggcucccccuaaac

SEQ ID NO: 4156216 - RNA, 64 nt, Human
gucuagucugaagcacugcaaugcuuuauugaucuggauagagaagaaagugcucagaggagac

SEQ ID NO: 4156217 - RNA, 68 nt, Human
gucuaguugccacaguagcaaaagguucucauuguaagaacauuuuacuccugaggcagaccacugac

SEQ ID NO: 4156218 - RNA, 74 nt, Human
guuucuccuauuuggcacacuggguucucgugucauuuaaagucagauaauccuguguggccaaagucagauac

SEQ ID NO: 4156219 - RNA, 57 nt, Human
guuucucgaaaguugagaaaaucaguuuccucuucugaggaacucacuuagagaaac

SEQ ID NO: 4156220 - RNA, 81 nt, Human
guuucucucagagaguggcaggcucaguagggagggggcaggaggcucaccucucagccggacugucaggcucgaugaagc

SEQ ID NO: 4156221 - RNA, 61 nt, Human
guuucucucguggcuccaaguacaugaaaauuuuuucauguuaucuuggcucugggaaaac

SEQ ID NO: 4156222 - RNA, 60 nt, Human
guuucucuguuccucagugaucagauuugacucugauuugauuucaaaugcagagaacac

SEQ ID NO: 4156223 - RNA, 57 nt, Human
guuucugaaugcugauuaguaugagaaauuaugcuacgaaugagagcauauagaaac

SEQ ID NO: 4156224 - RNA, 92 nt, Human
guuucugauaugguuuggcuguguguccccacucaaugccagcccgugaaagcagcugggagggaggcuauacccugcaaagccacaggggc

SEQ ID NO: 4156225 - RNA, 56 nt, Human
guuucugcauuuacaaaaugaggguuaguaggagccuucaagacaaugcagcaagc

SEQ ID NO: 4156226 - RNA, 84 nt, Human
guuucugcucugagaaccaggaacacaggagugaauaaaguggaccaaacucccugcccucucauuuucuuaugagacagagac

SEQ ID NO: 4156227 - RNA, 56 nt, Human
guuucugcucuucaggggcuaccagacuucuccugucccuccugggcugcagaugc

SEQ ID NO: 4156228 - RNA, 77 nt, Human
guuucuggcauacaguagcuacucaauaacuauuucuggaauaaauaagugaauguuggcuacugaacacuagagac

SEQ ID NO: 4156229 - RNA, 76 nt, Human
guuucugggcgggaucuggcggggagaggaaggaagaaugacuuuuucucugugcuggguccugaggcuugggggc

SEQ ID NO: 4156230 - RNA, 92 nt, Human
guuucuguaucuugugugggcaauuuggucauuuguauugcaaaaaugcaaugcuaaauugacaaauucaccaucauaagguaauuuuuaac

SEQ ID NO: 4156231 - RNA, 59 nt, Human
guuucugugcuuccuagaugugauuagacacaauagucaacaucuguaaggacagaaac

SEQ ID NO: 4156232 - RNA, 86 nt, Human
guuucuuaacacaggcaggacuaauuguuauuguuucauuauuaagcaaugaccagugaucuuguauacuguaugaauuaagauau

SEQ ID NO: 4156233 - RNA, 96 nt, Human
guuucuuccaaugagaggugggaugcugauaauucaugagaagccauggcaucacaauuuaauuacaguaucacuuaugguugauugugaagaaau

SEQ ID NO: 4156234 - RNA, 58 nt, Human
guuucuuccucuguaaaaggugaccauagcauggauaugguucaugugaggaaggaac

SEQ ID NO: 4156235 - RNA, 75 nt, Human
guuucuucuguuucaugcucauggaacacagcacaaucuuuggggcucaguuuacugaguaugagacagcaggac

SEQ ID NO: 4156236 - RNA, 62 nt, Human
guuucuucuuucccucuggcugcaaggugccccacacuccuguggucuggaaggaauggagc

SEQ ID NO: 4156237 - RNA, 73 nt, Human
guuucuuucaggaacuuguaguaucuugcugcucuaguaucugucugaaauacugcagguucucugaugcuac

SEQ ID NO: 4156238 - RNA, 103 nt, Human
guuucuuugaauauaugguuuccucacagaacaccaaagaaccuuccucaacaggaaaccucaguggcuuguucccucugugugaggauguguugaaaagaac

SEQ ID NO: 4156239 - RNA, 67 nt, Human
guuucuuuugugaucaccaaccugccaauuccuggaggguuaauagaaguggugaaauuagaggagc

SEQ ID NO: 4156240 - RNA, 100 nt, Human
guuucuuuuguguuaacuugacuucccugaaugaccuaguuggugaauuagucacuaguaauuuggucacuaggaaaaucaagccuucaagaaaggaagc

SEQ ID NO: 4156241 - RNA, 112 nt, Human
guuucuuuuuuaauucuuaagugugugcaagagaaccagaggaaaacauuuaucuguaggaaaauaaguaaaugagauuuguucuuuuguucaccuuauguaaaaagguaac

SEQ ID NO: 4156242 - RNA, 129 nt, Human
guuugaaauggagaguuuaaagguuuuauaaaaaggcaguaaagagcagugcugaagaguagggguucagaagcaacagaccucaagucugaguacuggcucugcugcuugcaugaccuugaaacuugc

SEQ ID NO: 4156243 - RNA, 81 nt, Human
guuugaagcaauuacucacucccauuagaaauuugugauuuccaauuuuauaaauuauuaaacagugggaugcuagcagau

SEQ ID NO: 4156244 - RNA, 64 nt, Human
guuugaagcaccaaaggagaaaaugacuugguagauugugcauuuuccacuggguguuuggaac

SEQ ID NO: 4156245 - RNA, 78 nt, Human
guuugaaguugcacacuuucguuaauaaggaugagagaagcagggaucuuuauuauuaauaaaguggcauagccaggc

SEQ ID NO: 4156246 - RNA, 73 nt, Human
guuugacuacauagcgucuucuagguauaguucuuccaaacuccagcuugggauaugcugauguaaacaaaac

SEQ ID NO: 4156247 - RNA, 56 nt, Human
guuugacugcaggcaaaucacuaaaauuaaggauaaugccagcccugcaguuaagc

SEQ ID NO: 4156248 - RNA, 80 nt, Human
guuugagagaucaguuggacaugauuagcagggagagcauuuguguuuuuaugagaguuaugccgagauagguaacagau

SEQ ID NO: 4156249 - RNA, 129 nt, Human
guuugagaggaugaacccugcaggccauguccacaguucugagaggccaccugcuuuugccuuuguugacuggugguagaacuccaguucuguggcaaggggcagccacaccauuucucucucauugac

SEQ ID NO: 4156250 - RNA, 75 nt, Human
guuugagauaagauauacuauuaaguaccaugguaaaguacuaugcaaguuuguggugguauuucaguuucuaau

SEQ ID NO: 4156251 - RNA, 76 nt, Human
guuugagcagucuacacauuucucuuagagacaccauaggauggguuuuugagauagagaguuaggauuuuuaaac

SEQ ID NO: 4156252 - RNA, 95 nt, Human
guuugaggcugcagugaguuaugauggcaccacugcacuccaaucuggggagcugcagugcaauggugccaucauagcucacugcagccucgaac

SEQ ID NO: 4156253 - RNA, 91 nt, Human
guuugaguguaagaucugaagaguuauuuucugauguggcugaaaaguuguguacgaugaaagacuuaaggguuuaacuuacaguucagac

SEQ ID NO: 4156254 - RNA, 65 nt, Human
guuugauaaauugguuggacuagagauguucugaacaucaucaugaacaacuaauccuaucaaac

SEQ ID NO: 4156255 - RNA, 73 nt, Human
guuugauauguaacuacuccuuauaugccauuuuauuuugugcauacaugugauuguaguauacauauuaggu

SEQ ID NO: 4156256 - RNA, 130 nt, Human
guuugauuacaucaacaauugcauguugauguuugauuacaucaacaauugcauguugauguuugauuacaucaacaauugcauguugauguuugauuacaucaacaauugcauguugauguuugauuac

SEQ ID NO: 4156257 - RNA, 129 nt, Human
guuugauuauauuuuauugccuggcuuauguagcaggcucgcaauaaaauguuucuuaaagcaaugaauaaaagacugcauuuuauaaagaguuauuugcugcagaggcauuugaaaauaugagcauuc

SEQ ID NO: 4156258 - RNA, 59 nt, Human
guuugauuucuaauaguguugacuaggaauuccaagucuuuaacauuuggagauugaau

SEQ ID NO: 4156259 - RNA, 55 nt, Human
guuugcaguuuugauagagacgggcuucuggaagucuguucaaggaacuacggau

SEQ ID NO: 4156260 - RNA, 82 nt, Human
guuugcaugggaggugagaaggcaaccuguguguuuuuaucauuacacuguccccugugcuuucacuugcuuccaugcaaac

SEQ ID NO: 4156261 - RNA, 71 nt, Human
guuugcauggguugauuaguacugaauguaguuuucuuuaacuaccauuugaugacucaacucauaaugac

SEQ ID NO: 4156262 - RNA, 61 nt, Human
guuugcauuccaauuuaggggacacaaaaaucccuguccucaucaccauugcaauguaaac

SEQ ID NO: 4156263 - RNA, 87 nt, Human
guuugcugcucuccaaggagcuccugugccggccgcauuggacaagcaucucugcccugcggcgcagagucuccaggaccagcagau

SEQ ID NO: 4156264 - RNA, 67 nt, Human
guuugcuggaaaauuuuuuucugaauaaacaguaauaauacugugucuggaacaaauacuagcaaac

SEQ ID NO: 4156265 - RNA, 63 nt, Human
guuugcugugacacaggaauccucagagauucaucauuacccaggauuucugucauuucagau

SEQ ID NO: 4156266 - RNA, 97 nt, Human
guuugcuuaugcaaucauucauucauucauuuugagaucccauggaaagcacugugcaaaucuuugaaucaaugaaucagugagugaguuagugaac

SEQ ID NO: 4156267 - RNA, 63 nt, Human
guguugaaggcaggccuugaggacuuugcauuuagaaaaguaacaaauagcugccuuuaaagc

SEQ ID NO: 4156268 - RNA, 62 nt, Human
guguugacugaaugaaugaaugaaguggacuggacauucagagauuguuauucagacaacau

SEQ ID NO: 4156269 - RNA, 69 nt, Human
guguugaguguccuuuuugcugacgcauaucuuuuaauaguccguucagugucuagggacaguaaucac

SEQ ID NO: 4156270 - RNA, 78 nt, Human
guguugauuguuggauugguucacuuggagucuguacuuggguuacagagcaguaagaacacagcugacuuucagcac

SEQ ID NO: 4156271 - RNA, 82 nt, Human
guguugcuauaugagcucggguuuuuucuggagggccacagccuaacaagguaagccuggccaugaaaugauggaacaauac

SEQ ID NO: 4156272 - RNA, 59 nt, Human
guguugggccugucucuugucuuccaguccacugguaagauaagagccaggccugccau

SEQ ID NO: 4156273 - RNA, 76 nt, Human
guguuguaagacuucccagaagaaucccauuugguggaguuuguuuauuggaaggagucuuuggggaugacaaggc

SEQ ID NO: 4156274 - RNA, 87 nt, Human
guguugucagaccuuguccuggcugcucaggggcuuaauucugccuuuugaugcaguauuccugagcaccagacacugcacaggcgc

SEQ ID NO: 4156275 - RNA, 65 nt, Human
guguugucuccacaauucauguguuggaaacuuaaucccaaugcaacaggguugggaggcggagc

SEQ ID NO: 4156276 - RNA, 104 nt, Human
guguugugcuuuauucucugaacucuaauucacagaaccauggugcucuccuguccaggcugaacacuaaugcucuugagagucacauugaagaaagccaacau

SEQ ID NO: 4156277 - RNA, 125 nt, Human
guguuguuucugggccauucagaggucuucuuguacccuuuaaaguuuuaccagcagauuguuuaagcauccucuguaugaagcucuuagaauuucaaauggacucuuauuuuuagaagcagcau

SEQ ID NO: 4156278 - RNA, 98 nt, Human
guguuuaaccagacgcaugggcaccuuguggcccagucagguugauacauaaaauuaaccaucacaagugggucacaaccagcguuuucuaaaaauau

SEQ ID NO: 4156279 - RNA, 61 nt, Human
guguuuaaguaaaugaauguguggcuagagcucagacacacauuaggcagugcuuaaauau

SEQ ID NO: 4156280 - RNA, 76 nt, Human
guguuuaagugagguuuccuguuaggacaaggguaaauuguuuaguuauccuagucacaggaaaauuucaaaauac

SEQ ID NO: 4156281 - RNA, 65 nt, Human
guguuuaaguucugcuccuuauuuuguucaccuacagaguaggaaguucuaacuagaaaagacac

SEQ ID NO: 4156282 - RNA, 58 nt, Human
guguuuacagauaaagugagcuggacauugggaaguccacuggcaacuucugaaauac

SEQ ID NO: 4156283 - RNA, 74 nt, Human
guguuuacaucagaaggaaacagcgugcucacgugucuacccgcacacgcuucgccuccuucuccgugcagcac

SEQ ID NO: 4156284 - RNA, 92 nt, Human
guguuuagaauacugaaauuaaauuugaaauccagcugagcucucaccaugucaugcuauuucgaauguaauaugucacguauauuaaacac

SEQ ID NO: 4156285 - RNA, 71 nt, Human
guguuuaugugcaugcugacuugaggagacguuagcacacaucuccauguuaucuguauguccauaagugc

SEQ ID NO: 4156286 - RNA, 76 nt, Human
guguuucacagaugcagaggccauggggcauuuuucagagucugagucuauccccagucuuucauugucagaauac

SEQ ID NO: 4156287 - RNA, 81 nt, Human
guguuucuauguuuaaaaugaggauauucugucuugaacaucagugaaugaugaauaaucuguugacuaacuugggagcau

SEQ ID NO: 4156288 - RNA, 75 nt, Human
guguuucugggaugagcuauauagaaaguuuaguugacugcuggaccuuggauauucuuacucgguucaaaauac

SEQ ID NO: 4156289 - RNA, 57 nt, Human
guguuucuguuagcugcaaccgaaacuaccugguaugucugagucaugcagagauau

SEQ ID NO: 4156290 - RNA, 84 nt, Human
gugaaggcuucauguucaugcuuaggaaaauaauuauuguaaccauaauuuuccuuuaaaaugaaacaugauguuaacauucac

SEQ ID NO: 4156291 - RNA, 60 nt, Human
gugaagggcccggcugugggcagagcacagacagcccugguccccagcccugccugacgc

SEQ ID NO: 4156292 - RNA, 83 nt, Human
gugaagguguuuuaacugauagcauuauuuacaauuaguacagccauuguaugaguacaaauguuucagcugaaggccuucac

SEQ ID NO: 4156293 - RNA, 64 nt, Human
gugaagucagaucagacuccagagcccacaugccauggagccuuggagacagguuugcuuucac

SEQ ID NO: 4156294 - RNA, 92 nt, Human
gugaaguggugugugugugugugugugugcgcgcgcacgugcgcgugcgcucgugugcgugcauaugcacaaggagcaggcuguguguucac

SEQ ID NO: 4156295 - RNA, 69 nt, Human
gugaagugugugcauuuuugauaacuguguacuucuggugacuguacaguuagaaaugcuauuuuuuau

SEQ ID NO: 4156296 - RNA, 106 nt, Human
gugaaguuaaauguuaaaaauguggucuagaaauguucucagggguuugucuguaucaaaucccuaagaacauuccuagauauauuuuauauauauauaauuuugc

SEQ ID NO: 4156297 - RNA, 76 nt, Human
gugaauaugaucuuauuuggaaaaaaggacuuugcagauguaauuguugagaaacuucaggugagaucauguugac

SEQ ID NO: 4156298 - RNA, 68 nt, Human
gugaauauugagaggccacugcggagagagugagcacuuguccucugggaguggccacuucucaucgc

SEQ ID NO: 4156299 - RNA, 81 nt, Human
gugaaucuaacuauuuugcauaauuacugauaugcugauuaucacugguuuuuauuauguaguugugaugguuaauuucau

SEQ ID NO: 4156300 - RNA, 58 nt, Human
gugaaugaaaggaugauucuuuuaucuuaccacaguaaacgaucauuuugccauucac

SEQ ID NO: 4156301 - RNA, 83 nt, Human
gugaaugcaguaucuuccaaauggagaagaugaguucaauccuuugaaaguacauguuuggccauuugcccaggacuggucac

SEQ ID NO: 4156302 - RNA, 92 nt, Human
gugaaugucuuugagaaggcaucuucaaaauugccaaaucguccccuuaggauaaauuucuagcagugaacuugcuugcucaaagauuacac

SEQ ID NO: 4156303 - RNA, 56 nt, Human
gugaauugccucuuauaugaccaugcugaucaugaguagaugagagaguaguguac

SEQ ID NO: 4156304 - RNA, 115 nt, Human
gugaauuuccaaguauuuacuuggcuaaaaguagcucgagaacagauuuuucugcugucacuuaggugcacacaggggaguucucagaaacucuggcgaggcauggaaauggcac

SEQ ID NO: 4156305 - RNA, 103 nt, Human
gugaauuucuacuuccucucuguguaugaccugggagaggcugucagugacgauucucugcucucacauacagaaaagaggcagauacauaauagagaagcac

SEQ ID NO: 4156306 - RNA, 70 nt, Human
gugaauuucugacuaaaagugccaggcaagccuuuucaugcugcagaacauuuacagugagaguuuuuac

SEQ ID NO: 4156307 - RNA, 88 nt, Human
gugacaacguuacuccucuguggaccgggcuuuggccacugcuagguggcccauugcucaugguguauuauuagaggguuuguugcac

SEQ ID NO: 4156308 - RNA, 65 nt, Human
gugacaaguucccaggugaugcugauguugguagcccaaggcucacauuuugggaaugauugcac

SEQ ID NO: 4156309 - RNA, 73 nt, Human
gugacaauuuauagaaugugacuggguggcuacuuuacauuaacuagucauaaaaucugaagaaguuggucac

SEQ ID NO: 4156310 - RNA, 108 nt, Human
gugacacauaggagguguuuagaaaacauauaaugaauaaacuaugauguuauuuucacuguuuguucaauauguguuuguccuuuaaauauuuaaaaguuuugucau

SEQ ID NO: 4156311 - RNA, 106 nt, Human
gugacacauccugggcacauuccaucuugucuucauccuuucucuaauuacagcucuccaugauugcagggauaaaacaagugaaugugugugcguaggucguuau

SEQ ID NO: 4156312 - RNA, 62 nt, Human
gugacaccaugcugcuggugagcaagauuccuucuuauuugcuggagaugagcgugggucac

SEQ ID NO: 4156313 - RNA, 64 nt, Human
gugacacgcauguacacacaacugaaacaaagguuuugugcagcuucuguuuauugugugccac

SEQ ID NO: 4156314 - RNA, 80 nt, Human
gugacacuguccucugaguuugguuaaucauaaagaaauauucuucauuuaaugaauaauucaaaucugagucuugucgc

SEQ ID NO: 4156315 - RNA, 65 nt, Human
gugacagacugcguaguccccaaagccuaaaauguuuaguuauggguuaaauugcagccucucac

SEQ ID NO: 4156316 - RNA, 61 nt, Human
gugacagagcugggauuugaagccagguguguccagcuuuagaguccuugcucuuauucac

SEQ ID NO: 4156317 - RNA, 68 nt, Human
gugacagagucugugugucccccuggguggugagucccaccuugucugugcaccugggcucuggccau

SEQ ID NO: 4156318 - RNA, 85 nt, Human
gugacagagugcuuauuuggaaaagggaagggacauuaucaugaucugcugucuucuauaucauuuccagaugcuggucuguuau

SEQ ID NO: 4156319 - RNA, 56 nt, Human
gugacaggcccuucacccaaauccugccauggggacaggggcguggggauuguuac

SEQ ID NO: 4156320 - RNA, 70 nt, Human
gugacagggugauuaugagagcuaagcuggcucucucaggccaaauguggguuuucauuauuauuguuac

SEQ ID NO: 4156321 - RNA, 97 nt, Human
gugacagguagaguggagauacuugaagaaauggagacaggauaugggauuauuauauuuuucuucaauuuuuaggagacugcuuuacacaugucau

SEQ ID NO: 4156322 - RNA, 87 nt, Human
gugacagucaguuucuucuggguaacaaggcaagaauaguugauauuauugaagcaugaagaacuuaagaugaaacugacugaucau

SEQ ID NO: 4156323 - RNA, 60 nt, Human
gugacagugaaucuagacagacagccuggaaaggaaguugcuuuauugauuuauuuucau

SEQ ID NO: 4156324 - RNA, 79 nt, Human
gugacaugagcuguaagguggcuuccuacacacugaagucagaguccagaggaaguucauauaguagacgcccugucac

SEQ ID NO: 4156325 - RNA, 57 nt, Human
guuacuucuguuagcucugagaguucaguuuagauacucuuuggcuaaagaagucac

SEQ ID NO: 4156326 - RNA, 84 nt, Human
guuagaaaugcaaauucuaggccccucuccagaccuacugaaucaggaacucuggagguggugcccagcaauuuguguucuaac

SEQ ID NO: 4156327 - RNA, 116 nt, Human
guuagaaccucagacugcuuugucagacauuuucugaaaggagagcugcaaggauucucuuugaauucuuacuuguucucuuugcagucaggcaaucaguaaggaggacaucuaau

SEQ ID NO: 4156328 - RNA, 56 nt, Human
guuagaaggagccaaaucagaaccuucaggugagggccuaaugauuuccuacuaac

SEQ ID NO: 4156329 - RNA, 81 nt, Human
guuagaauggugagagucuuguggucccagguugcccaggacuaaaggguuggcugcuacacagggcuuucaguauuaaac

SEQ ID NO: 4156330 - RNA, 61 nt, Human
guuagacuuggagcggaaacucaaguugaaugaaaaugccaucuccaggcuccaggcuaac

SEQ ID NO: 4156331 - RNA, 60 nt, Human
guuagagacaucucugguuucuguucccagccuaacugcacagaaaagagauauucuagc

SEQ ID NO: 4156332 - RNA, 69 nt, Human
guuagauugguuaaguauuacauauaaugauauauaguuauacaguguacuauuuagcagucaucuggc

SEQ ID NO: 4156333 - RNA, 75 nt, Human
guuagcagaccuccagggucuuugcugcccuggugacaaagggcacagcacaguggacccaggagaccugaaaau

SEQ ID NO: 4156334 - RNA, 69 nt, Human
guuagcaguaaagcacgucuauuuaaugaucagccuaagcugauccauggugaugucuuuaaaguuggc

SEQ ID NO: 4156335 - RNA, 63 nt, Human
guuagcaguauggagcgaggcccagauccagacuucugucggccuaauuuuauaucuguggac

SEQ ID NO: 4156336 - RNA, 59 nt, Human
guuagcaguucauugauuaucguccuguuauaaugcagcaggauggugcgggcugcugc

SEQ ID NO: 4156337 - RNA, 58 nt, Human
guuagcauuuguuuaauaucagacauuguuuacuuguuauuuuugagugaaugcuagc

SEQ ID NO: 4156338 - RNA, 56 nt, Human
guuagccaggauggucuugaucuucugaccucgugauccauccaucuuggccuaac

SEQ ID NO: 4156339 - RNA, 85 nt, Human
guuagccugugccugccgcugucuaguacugguuaaugaauauaaaucagauaguuuauaguuagcgagcacggaacaggcuggc

SEQ ID NO: 4156340 - RNA, 71 nt, Human
guuagcuagcacaggucuuguugccauuuuacauuagaauaagguauaaaagacuugguguaauggcugac

SEQ ID NO: 4156341 - RNA, 127 nt, Human
guuaggaaggggguuauaggaagggaggguauaaguuuugguuggccucuucaaacugccagccuccuacaaaacugucaggagaggccaucagcuuuuucucucuuuguauuucucuguuuuuaac

SEQ ID NO: 4156342 - RNA, 64 nt, Human
guuaggauauggugaaauggagaugaugcuuaauaaaggauauaauucagcauuauauucuagc

SEQ ID NO: 4156343 - RNA, 66 nt, Human
guuaggcaauaccucuuacaccaaagugggcacaccuucggaucauguaggcagcgauuguuuagc

SEQ ID NO: 4156344 - RNA, 80 nt, Human
guuaggcugaaccaugaaguugcugaugugcaaaugcauuuguccugcaaaacaggcaauuucaugugguuuaaacuaau

SEQ ID NO: 4156345 - RNA, 83 nt, Human
guuagggaggaccucacuuagaagaugcaguaaagcaaugaagaaguugcccugcggcuaucuagaugaagaguuuuccaggc

SEQ ID NO: 4156346 - RNA, 67 nt, Human
guuaggguuacaccagccuccuggcaugaagauguguuuuucaacucagagcuguccaaacccugac

SEQ ID NO: 4156347 - RNA, 67 nt, Human
guuagucagagagcugagauuugaacccaggcaguugggcuccagaguccauguucuugucuaugac

SEQ ID NO: 4156348 - RNA, 65 nt, Human
guuagugugugugacucaauaaccauucuguacaccaccaggaaagugacuuuuauaccacuaac

SEQ ID NO: 4156349 - RNA, 76 nt, Human
guuaguuagaaggaaaguagacuauaguccuggggaaauccccagcuucugaaagucuguuuuccuacuaacagac

SEQ ID NO: 4156350 - RNA, 88 nt, Human
guuaguucuuuacuguguccaucugugacuucuggcauuuacccgguuaguuucauugcaguggacaugcaugugguuuaggaaaaau

SEQ ID NO: 4156351 - RNA, 60 nt, Human
guuauaagaugcacauuuuuucaugcuuaacaucucugaaauuagggugccucuuauaau

SEQ ID NO: 4156352 - RNA, 60 nt, Human
guuauauaacaaauaccuaguggagccagccuccaauucuaggcaauuuguugucauagc

SEQ ID NO: 4156353 - RNA, 80 nt, Human
guuauauaacucucaucucggaucagaagugaucauugaaauggugucguuuuugggagguggggguucauuuuugugac

SEQ ID NO: 4156354 - RNA, 85 nt, Human
guuauauuccacucacauuaggaaguaauguuguucaugguaugaauaaaaauucacugcuuauuugauguuaaaggaaaguaac

SEQ ID NO: 4156355 - RNA, 66 nt, Human
guuauccaaaggugacacagaauacccauaaugaugacugggcaugcguuuuaccuuugggcagac

SEQ ID NO: 4156356 - RNA, 76 nt, Human
guuaucccaguugcucagucaguuuuugugagagauucagggaucuuaauaaaacugugcugcuacugcuacuaac

SEQ ID NO: 4156357 - RNA, 100 nt, Human
guuaucugaucauaucuggcucaucccauguuguaucauucuguuccuauauuugauagagagugaguuaacugugacaauguuaguauauaaagauaac

SEQ ID NO: 4156358 - RNA, 67 nt, Human
guuaugaacauggguguucaguagauguuacuuuuauguugcuuuagaacaucugugucuuuaugau

SEQ ID NO: 4156359 - RNA, 68 nt, Human
guuaugaauaaugcugcugugaacauuggcauauaaauaucuguucacauaggagcaugguuuuuaac

SEQ ID NO: 4156360 - RNA, 72 nt, Human
guuaugagauuugggucaguuuaguuuucuaaugccaaagcaaagagacaaauugaccgcaagauucauugc

SEQ ID NO: 4156361 - RNA, 69 nt, Human
guuaugcaacuagauccuguuagagaauagaaugaaugaaaaaucaauucuguccucacagagcauaac

SEQ ID NO: 4156362 - RNA, 100 nt, Human
guuaugcaacuguauauguuuucaaaauucauagaacuguacgcugaaauacucuuuucaguguacaguucuaugaauuucacucuguguaaguuauagc

SEQ ID NO: 4156363 - RNA, 76 nt, Human
guuauggaugagcaguuaggaggaugaugaauaaaacuagaugccauguugucaguuugaaagcuacaucuauagc

SEQ ID NO: 4156364 - RNA, 59 nt, Human
guucuucccuuuggggauugugaacaucauguucaaggcaauauccaaauggaaacgac

SEQ ID NO: 4156365 - RNA, 124 nt, Human
guucuuccugggggugcagacaagcgcaugcaguucuggaggugcuucgcuggccacccggccuuggguggccuggcuggcaccaccucacucugcuucauguacccccuggauuucccagaac

SEQ ID NO: 4156366 - RNA, 60 nt, Human
guucuucugaaacauaaucaauagguucaugaggaaguuguagaaguucuucaggagaau

SEQ ID NO: 4156367 - RNA, 71 nt, Human
guucuucuuuaaucauaaccaagaugguaaccuauauucccuuagcucguauugguuuugauuaauaaggc

SEQ ID NO: 4156368 - RNA, 64 nt, Human
guucuuguccaacugccuccaguuucuauaugaaauguuggaaaggacaguugcugauaggaac

SEQ ID NO: 4156369 - RNA, 55 nt, Human
guucuuuucccucugcgcagccuuggcucccuuaaugcacagggugggaagcaac

SEQ ID NO: 4156370 - RNA, 66 nt, Human
guugaaccauauggaauugcuguacagcuucaacagcugaauacuggcaauuucauauggugcaac

SEQ ID NO: 4156371 - RNA, 90 nt, Human
guugaagagaagcacaguucauauuuugaguugaaugaugaugucacuucaauuccaacucugaaaugugaaaugauuauugucuucagc

SEQ ID NO: 4156372 - RNA, 81 nt, Human
guugaagauuaaagucagcuuggaacuucauaaagaauaccaaagugucuuuauguuuacuccagcugagcuauuuuuaac

SEQ ID NO: 4156373 - RNA, 89 nt, Human
guugaagucucauaguuaaaauucuuucccaaauuaucuaacaccuguugggaagauuaucucagaaguuuacauagugagacuugaac

SEQ ID NO: 4156374 - RNA, 83 nt, Human
guugaauccuuaccauucgaguucugaggacuaaagagugacuagcuccaaaucccaaagaacugaauaguaauuguugcagc

SEQ ID NO: 4156375 - RNA, 63 nt, Human
guugaaugagugagcacgacaguacugacauucaguuucugaggagucagcuuacucacuaac

SEQ ID NO: 4156376 - RNA, 97 nt, Human
guugacaaugauaauggcuguauuuauugagcacuuaauuauguuccagacucugugcuauguguuuuacaugcauuaucuuuguaaucaucacaac

SEQ ID NO: 4156377 - RNA, 79 nt, Human
guugaccugggaagcuaugaugacuuuuaaggagauuuuaaaccucuguucaaaaagguuuuauguuuuccacuucaac

SEQ ID NO: 4156378 - RNA, 125 nt, Human
guugacgcuggguggagguuaggcccgacaggagcccaggaugggcggaggagauccucucucccacucucugcacuccugggucuugacccccugcuucccaauuaccaccaccaaaaacauac

SEQ ID NO: 4156379 - RNA, 60 nt, Human
guugacugaaggucacagacuccugucagguggcccugugugucuggauuuuucgguaac

SEQ ID NO: 4156380 - RNA, 84 nt, Human
guugagaucguucaguaugaaguagagcagagaugcccucuccgcagccgggcgguaguucucucucgcuucguugauuuuaac

SEQ ID NO: 4156381 - RNA, 105 nt, Human
guugagauggagucucgcugucucgcugaggcuggagugcaguggugcaaucucggcucacugcaaccucugccucccagguucaagugauucuccugccucagc

SEQ ID NO: 4156382 - RNA, 78 nt, Human
guugagauucuggaggagaaagggugggcgaguacaaaacguaugccuucucuuuccccucuacccuucuguuuuaau

SEQ ID NO: 4156383 - RNA, 57 nt, Human
guugagcagauucagaucagcccaagaaaucugggcugauaaugcauucuguuuaau

SEQ ID NO: 4156384 - RNA, 56 nt, Human
guugagggggagaagauucugcugcuuggaaacaucagaguuucuuauucccugac

SEQ ID NO: 4156385 - RNA, 107 nt, Human
guugaggguagagggcuuaacagcuguuauauaacuuacaaccuguugacauguagaagacaacagauuuauuuuguauagcuuugggggcucuuacuauaaucgau

SEQ ID NO: 4156386 - RNA, 82 nt, Human
guugaguuugagaugccugcuagauauccaggugaaguaggaaacuggauuuauggaucugcaggucaggagcaagauuaau

SEQ ID NO: 4156387 - RNA, 71 nt, Human
guugauaauaaccccugaguaccauaugucuacuuugugggcuuagcacuacaccagguguuauggucaau

SEQ ID NO: 4156388 - RNA, 87 nt, Human
guugauacaugcucuagaguugaacuugaauagcagauccagccuaugaaacauucaggcaaucacugugguauauauguaucauac

SEQ ID NO: 4156389 - RNA, 60 nt, Human
guugauaugugugugugugugugugugugugugugugugcacacaugcauucaugugggc

SEQ ID NO: 4156390 - RNA, 97 nt, Human
guugauccauggaccacacuuugaguagcaaggcuguaagagacauucauccuuggaguucuguuuggcuuaaaaauugugaccccucuguuucaau

SEQ ID NO: 4156391 - RNA, 58 nt, Human
guugauucucauuuacaguaauuauuuucuauacagucacugugaaugcugaauuagc

SEQ ID NO: 4156392 - RNA, 91 nt, Human
guugauucuggguugagauggggggugguugugugaggauuaauggagccauuuugaaaaccguugcuaaucaggcuaaaaugaaucacac

SEQ ID NO: 4156393 - RNA, 91 nt, Human
guugauuucagcuugcugcagcagcacaggaagauggguccgcaucacaggcuccuggcuaaugcugcugauggcgaaaugcuggagaaac

SEQ ID NO: 4156394 - RNA, 57 nt, Human
guugcaaacuccuacuucucauggaaguauguauauagagaaguuagacauugcaau

SEQ ID NO: 4156395 - RNA, 66 nt, Human
guugcaagggguuuaugcagaugagggucccacauguuuucuucaugcuaaagccaccuuugcaau

SEQ ID NO: 4156396 - RNA, 77 nt, Human
guugcagccacuaacauguuaaucaaaagaagcaaauacauguuuuucccuugagaaaacauggauagugguguaac

SEQ ID NO: 4156397 - RNA, 73 nt, Human
guugcaguauuagcauauauagagaacauuuucaucaucacagaaaguucuauuggauagugcuggucucgau

SEQ ID NO: 4156398 - RNA, 74 nt, Human
guugcagugagcagagaucgcgugauugcacuccagucucagugacaagagugaaacucugucucaaaaacaac

SEQ ID NO: 4156399 - RNA, 127 nt, Human
guugcagugauggauucuuuaucccuucauuaacaaugacugcuugacuguacuagguuacaguacuuaauugugagcaguaacuguuggccagagugauguuauuuaagaaaccaacacuaacaac

SEQ ID NO: 4156400 - RNA, 83 nt, Human
guugccacuauguaugccaauguuacggaaugucaaggacuucacagaagucacacuucguaucucuagcauggcaagggaac

SEQ ID NO: 4156401 - RNA, 72 nt, Human
guugccagcuuguuuuaaaacauauuuguacuggauccaauugcuacauguuucuaaaacuugcauggcaau

SEQ ID NO: 4156402 - RNA, 69 nt, Human
guugccagggugcucuguggcgucgcauucucauuggugggcgacggcgaggaucacccccgaggcagc

SEQ ID NO: 4156403 - RNA, 69 nt, Human
guugccaugcuaauacugagccaccagguagggcaguguugcccugguuugggugccagugaguuuaac

SEQ ID NO: 4156404 - RNA, 71 nt, Human
guugcccaggccuggagugcaauggcacagucuuggcucacugcagucuuugccucccagguucaagcgau

SEQ ID NO: 4156405 - RNA, 106 nt, Human
guugcccuacacgugaucacacaugaagaauguacauagcaucaucuaggauagcuuguguccaggauggcccugacacuuucugguauucauguucuuggguaac

SEQ ID NO: 4156406 - RNA, 59 nt, Human
guugcccucacuggcccuuuauugcagcccaggcuggagcugaggacgugaagggcggc

SEQ ID NO: 4156407 - RNA, 79 nt, Human
guugccuaaguguuuaacggugauugagcggggacguugacgguacaaacacugauugaauuuaccacuggagggcaac

SEQ ID NO: 4156408 - RNA, 85 nt, Human
guugccucaccuguaaaauguggaugauacuaguacuucauaggcugugaagauuagacaggauuaugcaugcagagugaaugac

SEQ ID NO: 4156409 - RNA, 62 nt, Human
guugccuuugacggugcagcaguacuuucuucucuuuuguacucugcaauaucacaaggaau

SEQ ID NO: 4156410 - RNA, 78 nt, Human
guugcgaauuuugucugcauauuagauuuguuuuugaaaccaaaugaacaggugaaugucagauuuccaaguuccaac

SEQ ID NO: 4156411 - RNA, 76 nt, Human
guugcuaauauuuuuagaaaucacgagguuucacaugaaaacccugaucucugguuuccccugagaaauuggcaac

SEQ ID NO: 4156412 - RNA, 68 nt, Human
uaaucuuuugauucuagggcuguuucuuacuaccuauuuggcacaguugugagaauucaauaagguua

SEQ ID NO: 4156413 - RNA, 73 nt, Human
uaaugaaauguuuacgaauauaccauuaaugaagcaaguugacauuagguugugcuuuguggacauuuaauua

SEQ ID NO: 4156414 - RNA, 67 nt, Human
uaaugaacucuuuacuuugggacugcuuuccauuguauccuuaagaaacaauagagagugaacauua

SEQ ID NO: 4156415 - RNA, 70 nt, Human
uaaugagaaugucacagauucacgagggcauaacaaaacaaaacucuugguagauaaagcauuuucauua

SEQ ID NO: 4156416 - RNA, 58 nt, Human
uaaugagggggccuggggucuggaugaagcuugagaagccagccuugccuccuuuuua

SEQ ID NO: 4156417 - RNA, 69 nt, Human
uaaugagugaguauaauguuucaacuaugcaaaaugaaugaguucuaaacauucuacuguacugcauug

SEQ ID NO: 4156418 - RNA, 64 nt, Human
uaaugaugguuucaucacuugaacugucuugcauugauggguauguucaaguaaacuauuauua

SEQ ID NO: 4156419 - RNA, 61 nt, Human
uaaugcacguuaacauuugagaagugcuuguuugaaagaugaauuuguuagcugugcauua

SEQ ID NO: 4156420 - RNA, 93 nt, Human
uaaugcucaggggaucacccccuucaguacuuuccaucucacugcagauacuucacauuagggcagguacuggguggugagcuaugagcauug

SEQ ID NO: 4156421 - RNA, 82 nt, Human
uaauggaauaauccuugggaagagaggaauaugaaucuugugcugaugaaaauaauuucucacuuucuauuguuuaucauua

SEQ ID NO: 4156422 - RNA, 122 nt, Human
uaauguaugucucaauaaacuggcaucugauccaauagauauauaugucuugagaaaaagcauucaagaaaauuuucauauaucuucauuaggucgagagaacagcuuuaaacacaauauua

SEQ ID NO: 4156423 - RNA, 63 nt, Human
uaaugucuaugggccagauaauguccauaaauuugacauuuucaguaucuagucuagacauua

SEQ ID NO: 4156424 - RNA, 57 nt, Human
uaaugugugucaucaguagagugggggcaauaaucugcuuugucuauacacacauua

SEQ ID NO: 4156425 - RNA, 94 nt, Human
uaauuaaaauucacuucacagcaaagagacugacauugauguugcuggguauuuucaguucuuaguaaugcagucuuuuggauaguuauaguua

SEQ ID NO: 4156426 - RNA, 59 nt, Human
uaauuagaaaggguuuuggggccagauguuaaacuggucucaaaugccaguuuuauuua

SEQ ID NO: 4156427 - RNA, 83 nt, Human
uaauuagacugagguuaugggguuuuaggaagacuacagugauucaguguccuuuucaucaccccaaaucuauggucuuuuua

SEQ ID NO: 4156428 - RNA, 80 nt, Human
uaauucacuaguauucuuugguugugugcaaaagaaacugacccugacuaacaugaaccaaagaaaacuguggugaguua

SEQ ID NO: 4156429 - RNA, 76 nt, Human
uaauucaguuuguuugacuguuagaguugauccuccaggcauaaaaggauguuuagucaucaaacaaacaggauua

SEQ ID NO: 4156430 - RNA, 63 nt, Human
uaauugcccauauuugagaaugacuuuauuaauuauguuguuucuuucauuuagggcuaguug

SEQ ID NO: 4156431 - RNA, 76 nt, Human
uaauuguauucacaggauguagcuaauuuuuaaaacccaagggguauauuauuaguuauacuacugaauggaguug

SEQ ID NO: 4156432 - RNA, 76 nt, Human
uaauugugagugagauaugucucacuguccuuuguggacaaagaacaaugaaagacauaaacucagggcacaauua

SEQ ID NO: 4156433 - RNA, 74 nt, Human
uaauuugcaauggcuuucagcaaggauagauuacugguaccuugauucuacuuuuuugaggguuauguugauug

SEQ ID NO: 4156434 - RNA, 129 nt, Human
uaauuuguauuuauauguuuguuggggcauaagagaaauaucugucuuaaucacuggauaguaagauuuguaaagguaggacagagauuuguuuuauguacuaucgagcuuccaauaauuggcaaguag

SEQ ID NO: 4156435 - RNA, 55 nt, Human
uacaaagucaccagcuucuugcaguagccaugcuggcauucuguuugauuuugug

SEQ ID NO: 4156436 - RNA, 89 nt, Human
uacaaauaucuguuccagucccugcuuucaguucuuuuggguauucauccagaggagaauugcgggaucauaugguaauucuauuuuua

SEQ ID NO: 4156437 - RNA, 86 nt, Human
uaaguucuaggguacauguacacaacgugcagguuuguuacauauguauacaugugccauguuggugugcugcacccauuaacuug

SEQ ID NO: 4156438 - RNA, 86 nt, Human
uaaguucuaggguguauguguacaacgugcagguuuguuacauauguauacaugugccauguuggugugcugcacccguuaacuug

SEQ ID NO: 4156439 - RNA, 76 nt, Human
uaaguugauuucugauacaggaaaaggagaaucuacuacuuacgcuccuuggcugucuugugugggaaacaauuug

SEQ ID NO: 4156440 - RNA, 97 nt, Human
uaaguuuaaagcucagucauguuaucagacacagaguacuucauucauuuugauacuaugaagugcucugugguagguaugacuaucucacaauuua

SEQ ID NO: 4156441 - RNA, 94 nt, Human
uaaguuuggaugcaucuugcugacuugcauuauuuauaauuacaaacacaagcagcuaugauugagcuuugcagcaaauguuuuccuucucuug

SEQ ID NO: 4156442 - RNA, 72 nt, Human
uaaguuuugucuggucaaaucacuuguagguuucugucuucuaacugaacccugacuaauaagcagaacuug

SEQ ID NO: 4156443 - RNA, 82 nt, Human
uaauaaaugcuaguuuuugauacucaagagggguagauuuuguucagaagauuacuuugguuuuaaaaauuaauauuuauua

SEQ ID NO: 4156444 - RNA, 126 nt, Human
uaauaacucugaucuauaugaaagagcccugaaacucaagaaauuuacagagaagauauaacauacaaaaugucuguaaaacuucuuuguaaauaguaaguggcuauaugcauuggaagguuauua

SEQ ID NO: 4156445 - RNA, 65 nt, Human
uaauaagaggauuaauugucuuaccuagcaagaaucccagagguaaggcaguuucaauuuuguua

SEQ ID NO: 4156446 - RNA, 82 nt, Human
uaauaauugcuuguugaacagauauaugauuguguaaaugaauaauauuugcuucauagaucuguggacauagugguaauua

SEQ ID NO: 4156447 - RNA, 58 nt, Human
uaauacagagcacugaccuaugggggagaaaagccuaaauuuuaguguaucuguuuug

SEQ ID NO: 4156448 - RNA, 72 nt, Human
uaauaccugaugauuucauuucuagcuguaaacucaauugaguuuuagggcugagggaaauuacagagauua

SEQ ID NO: 4156449 - RNA, 128 nt, Human
uaauaccugcaauuacuuggaaggcaaauaauauaccuaauguaccuacagcucuaggagaaacaguuggaaauuuuaguguuaaugguguauauuaggcauugccgacugcauuuggcaagguauua

SEQ ID NO: 4156450 - RNA, 76 nt, Human
uaauagaugaauguauugaacuguuggagagguuuucugagguucgaagaccugcacaguuuaccauuaucaguug

SEQ ID NO: 4156451 - RNA, 83 nt, Human
uaauagguauguaauaauuguugaauagauggauaauucuuuaacccuguaaugaaguguccucauucaacaugcauuuauua

SEQ ID NO: 4156452 - RNA, 73 nt, Human
uaauagucacuuuaugggaagcaaaaauuuagguugauacuuuccaguuuuauugucccagaggugauaguug

SEQ ID NO: 4156453 - RNA, 69 nt, Human
uaauaguuccaucauuuuguauccaaggggaaaggauuuuccucccagagaaaaacugaagagcuguua

SEQ ID NO: 4156454 - RNA, 57 nt, Human
uaauaguugugacuuuguaaagcuuuuaaaucugcuuuccccagagucuagcuuuua

SEQ ID NO: 4156455 - RNA, 96 nt, Human
uaauaugaccuggcacaguguguagcacaugguaagcacacagcuaguuuuagugcugcugcuccugcugcugcugcugcugccauuaucauauug

SEQ ID NO: 4156456 - RNA, 110 nt, Human
uaauaugagagacuuguuagaccuuaaauauaagguggcuuuuuucccgauggauaauuuuugguggaaaaguucaucauauauucaggcauaaauugugucucauauua

SEQ ID NO: 4156457 - RNA, 72 nt, Human
uaauauucacagggggagaaggguauaauacucccgauaucgcaggggguguacacucccccugugaaguug

SEQ ID NO: 4156458 - RNA, 76 nt, Human
uaaucaaggcugcauaagacgagagaauuuuauguaagaauuuccuauccuggucuuaaaaauguagcuuuuuuug

SEQ ID NO: 4156459 - RNA, 74 nt, Human
uaaucacauguuguuugccccaguuguuauugccauaucaggcaacugcaguguuaaacaacugcugcugauua

SEQ ID NO: 4156460 - RNA, 57 nt, Human
uaaucacugaucaugugcacuaggugccacuuaccuuugcuccaucuaaagugauua

SEQ ID NO: 4156461 - RNA, 69 nt, Human
uaaucagauuugaaaacugguuuuuauuucacuaggaaauaggaaaugauuuuaguuuaucauggauug

SEQ ID NO: 4156462 - RNA, 118 nt, Human
uaaucuacauucagaagaugagagaagacuaugauuuucauaugcuugauuucuugcauuugauuugguaggaaacaaugaaauucauucuucacugaauuuucaaacauguugauug

SEQ ID NO: 4156463 - RNA, 85 nt, Human
uaaucuauaaaguuacgauuuguuuacuuauaaauuuauuuuuaauaaaguugugaaaccgaacauguucuguuuuuguggguua

SEQ ID NO: 4156464 - RNA, 92 nt, Human
gugccuagcauguaugauaaccuguuguaguuugauuugggggcagacaggauagacuauaaauuuggguuuucuuuaaaaagcuacugcau

SEQ ID NO: 4156465 - RNA, 129 nt, Human
gugccuagucacuuuccagcugucauuuauuguucuaagagggaguuuuaauggggaaaaaaauuccaggaagauuuauuuuggcuuugaacuuuggcaagaaguguuaauucauaagaggcaguucuc

SEQ ID NO: 4156466 - RNA, 91 nt, Human
gugccuagugcauagugguuguucaguguuuguugaauguauaaauuauuuaugcuauuuuuaucuugaucaaaauuguccaucuggucau

SEQ ID NO: 4156467 - RNA, 79 nt, Human
gugccucaccccaucagaaggccagaggguagcccaagcuagaaggagguugcccaggccuugccugagcccugaccac

SEQ ID NO: 4156468 - RNA, 85 nt, Human
gugccuccuccucuuuguccuagagauggccagagaaaacccuggccccuacauuucucagggcugaggaggagagagaggaaac

SEQ ID NO: 4156469 - RNA, 91 nt, Human
gugccucgugauuggcuucugcauuggaaaccuaagaauaagcaagcacacuugggccagaauucaaagcagagggucaauacagagguau

SEQ ID NO: 4156470 - RNA, 56 nt, Human
gugccucuagcuuaaaauaauccuuaugccacaguggcauauuuuugggcuggcau

SEQ ID NO: 4156471 - RNA, 75 nt, Human
gugccugaggcugugugucccucuggacacaggcaaccugucuuugugcuaugauuggacagaauagcugggcac

SEQ ID NO: 4156472 - RNA, 65 nt, Human
gugccugcccucucggcauagcaggggcugcucagcugcccccaacaggugccaagggggagcac

SEQ ID NO: 4156473 - RNA, 61 nt, Human
gugccugccuguacuagagacccagacguuuaugcucuuggggaggcaggcaggcaggcau

SEQ ID NO: 4156474 - RNA, 71 nt, Human
gugccuguuccauuuagcuggcaaacaauguuagaauuacugauuagccagugaaauggagaaauuggcac

SEQ ID NO: 4156475 - RNA, 90 nt, Human
gugccuuaaaggccuaggugaacauuucuuugguaaacaugggcucugaacugugagcccugagacugaagaacugucccagucaggcac

SEQ ID NO: 4156476 - RNA, 102 nt, Human
gugccuuacacaugguacucuauaauaaaaaauguauugaaguucaauaacugaauaaaugaauaaaucagucauaguuuggagagaauaguguaguggcau

SEQ ID NO: 4156477 - RNA, 71 nt, Human
gugccuucuucaugcugugcuggggcugcuggaggggacugggcugcacaguggacagugaagaugggugc

SEQ ID NO: 4156478 - RNA, 70 nt, Human
gugccuuguaguuucaauugagugauuccauugugugaaaaggaauuacugggucugagauuaauaguau

SEQ ID NO: 4156479 - RNA, 71 nt, Human
gugcgaggagaggggccuuggggaaaagcucagacccacccuaacuugucuccugggucccuuccacccac

SEQ ID NO: 4156480 - RNA, 77 nt, Human
gugcgagggucccaggaggugcuuccuaggagccggcccugagggcucuucugggaagggccccugaggcaugacac

SEQ ID NO: 4156481 - RNA, 63 nt, Human
gugcgaggucuuguugucgccacgcucgauggugagcggcguggcauugacgcugaccugcac

SEQ ID NO: 4156482 - RNA, 61 nt, Human
gugcgcccacuucaggcuaacgggagaacaucucccagagcccaaguuggagagggcgggc

SEQ ID NO: 4156483 - RNA, 85 nt, Human
gugcgcgcgccccucaauugucucuggggacagguaguccagggugccacacauuugucuuccuccucagugagggggcgugcac

SEQ ID NO: 4156484 - RNA, 79 nt, Human
gugcggauggauugcuaauguggggauuuggggggaaaucaaaguguucucaaaugcuguauuguaguaauacuugcac

SEQ ID NO: 4156485 - RNA, 95 nt, Human
gugcggcggcagggcaagguuggccugggccgcccagaggucuucagacccaggggcgaagcuggccacgacccagccccgcggugaagccgcgc

SEQ ID NO: 4156486 - RNA, 73 nt, Human
gugcggcugcguuacaggggccucaguugugaugugucauucugaggucuauuuugaaacugcuaagcugcgc

SEQ ID NO: 4156487 - RNA, 71 nt, Human
gugcggcugucgcugugagucugcaugggagaguggcggcgugcucuccucugcgcggcagugccccgugu

SEQ ID NO: 4156488 - RNA, 60 nt, Human
gugcgggugguugguuaggguccuucccgugcacagcuugacuccggccagcaacugcau

SEQ ID NO: 4156489 - RNA, 108 nt, Human
gugcggucuggagccucuggauggagccauuccugaagacuucaccaccaguggaguuuucauucgugugcuccagguuauucccuuuguugguuaauccagauccac

SEQ ID NO: 4156490 - RNA, 75 nt, Human
gugcguccauuggagguuucccaacuguggggaccccaagcucacaggguuuggaagccuccugaggacagcugc

SEQ ID NO: 4156491 - RNA, 83 nt, Human
gugcguucagugccccacagaggcagauccccuagcuaugcagucauggcugcugggaauaugccagcugucagggccaccac

SEQ ID NO: 4156492 - RNA, 56 nt, Human
gugcguugcaugcugagagccaagcaccgacaaaggcccagagacgugcaauguac

SEQ ID NO: 4156493 - RNA, 77 nt, Human
gugcguuggggacugggagauccuccuggcaucuaguggauagaagccaggggagcugcuagauaucuacagugcac

SEQ ID NO: 4156494 - RNA, 68 nt, Human
gugcuaaagaauuuugcuugaccagaaccagaccacaauauguuugucaagcuuguucuucuagacgc

SEQ ID NO: 4156495 - RNA, 67 nt, Human
gugcuaagauuauaggcuugagccaccgugcccauccggcaccaguguuuaccugugacaaagccac

SEQ ID NO: 4156496 - RNA, 67 nt, Human
gugcuaaugaauuggagugccucucauauacaaauuuaauuugaaggcuuucaauuacuuuuagcau

SEQ ID NO: 4156497 - RNA, 70 nt, Human
gugcuacaguuccaggaucauagggucuucugggguuucccgcguggcccaagaucuggagcugcagggc

SEQ ID NO: 4156498 - RNA, 76 nt, Human
gugcuagacaugcugugagagucccaaagagcucccauucagagagggaccuuuacacagacauucaaaauaguac

SEQ ID NO: 4156499 - RNA, 86 nt, Human
gugcuaggaggcauuuaacaaguuagauuguuaguauaauacauuuuaauugucagugggauuugucaacaugucuccugcuguac

SEQ ID NO: 4156500 - RNA, 78 nt, Human
gugcuaggcauucaguagaaguuagcuauuaucagcuauuggcuuauuaauggccacuucuugcuucaaguuuaacac

SEQ ID NO: 4156501 - RNA, 85 nt, Human
gugcuaucuggagcuacugugauaggaacuguguguaaagaagacugcuuacagcacugugcauagugguucagacuauggacac

SEQ ID NO: 4156502 - RNA, 73 nt, Human
gugcuauguuccuuggugaaauggaaauguuguuauacauacuuccagggcagcaagugaauggaauagacac

SEQ ID NO: 4156503 - RNA, 62 nt, Human
gugcuauucauauuguaaaagaagugaucaaauuauuucuuuuucuuauagugugauuguac

SEQ ID NO: 4156504 - RNA, 66 nt, Human
gugcuauuuuagacauacuuuguauguuugagggacaacuaagagcacaaaguguguggagagcac

SEQ ID NO: 4156505 - RNA, 59 nt, Human
gugcucaggggcaauccugggaaauuucuuuuuggguuggcaugccccugacuggacac

SEQ ID NO: 4156506 - RNA, 84 nt, Human
gugcucauguuuauauauuuguagguaguuuuucauuuuuuaaauugcauauauuauguacaaaauguuuugaaauguguguac

SEQ ID NO: 4156507 - RNA, 56 nt, Human
gugcuccaaaucuuggccaaggaagaaagagagacuggaucugugaucuggggcac

SEQ ID NO: 4156508 - RNA, 56 nt, Human
gugcuccggaucucuaugccucuaguuaaugucagggcaauuaggcuucugaguau

SEQ ID NO: 4156509 - RNA, 55 nt, Human
uaccucagaaucccccaaagauuuguuaucaguggcaccaggcauucuaggggua

SEQ ID NO: 4156510 - RNA, 55 nt, Human
uaccuccuccaacuguuggucucagcugagugagauucccaugucugaggaggug

SEQ ID NO: 4156511 - RNA, 57 nt, Human
uaccuccuuccugggacagagcugggaagaucuccagggcugguagggaagagcgug

SEQ ID NO: 4156512 - RNA, 59 nt, Human
uaccucucggggucuguuugugugaaaacucaaagauaaauaugacucugggugaggug

SEQ ID NO: 4156513 - RNA, 62 nt, Human
uaccugagaagaaacccguguuuucauguucaucucuuuaacauggggcagguccuuaggua

SEQ ID NO: 4156514 - RNA, 89 nt, Human
uaccugagagcuuguuagaaaugcagaauccuaggcccugcuucagaacuuacagaugcggaccugcauuuuaacaagaucuccaggug

SEQ ID NO: 4156515 - RNA, 64 nt, Human
uaccugaucuccugcuguguugggaucauccucugcaaugucccugcacuaagaggagaaggug

SEQ ID NO: 4156516 - RNA, 85 nt, Human
uaccugcugagcccagggaagugggauaggacagagccuugcccgucaggcucugagacuuuucaccucccagcucaagcaggug

SEQ ID NO: 4156517 - RNA, 58 nt, Human
uaccuggggcugggcuuugauucugucaucuucagaaguagugucacucuuccaggua

SEQ ID NO: 4156518 - RNA, 55 nt, Human
uaccugguaucuucccugucacaaggaagcugaacagggcucugacaccaaggua

SEQ ID NO: 4156519 - RNA, 72 nt, Human
uaccuguuaaggaucugggagggaaacuugcccuguguuaaaguguucaauccccagguccugaauucugug

SEQ ID NO: 4156520 - RNA, 75 nt, Human
uaccuuacuuuuguuuaaggaauauauguucugguguguagaauguagaaugauccuuaggauaauaagaaggua

SEQ ID NO: 4156521 - RNA, 56 nt, Human
uaccuuagauagcaagagaaugcauuaauguguuuccauuguccuaucuauaggua

SEQ ID NO: 4156522 - RNA, 85 nt, Human
uaccuucugucuagauguuagaucauuuugaacuaauuuggaaaucuucaugcuuaauuuagaagugauucaucuacagaucgug

SEQ ID NO: 4156523 - RNA, 67 nt, Human
uaccuugggcuauuaucuuugacuuucauuaaauuuugcagaccucaggauauugugugccaaggug

SEQ ID NO: 4156524 - RNA, 58 nt, Human
uaccuugugagcuuucuaacauggugucuuuggaccaaaggggaguucuuuuaaggua

SEQ ID NO: 4156525 - RNA, 84 nt, Human
uacgaauguaauucuuauuauaguaaaacaguacuagggauuauuugaugugcuguuguacuuuagacagaaaaagcagcugua

SEQ ID NO: 4156526 - RNA, 65 nt, Human
uacgagcgcucuugcuggccaacggauacugagucuucugugagugguuugagcuggguguugug

SEQ ID NO: 4156527 - RNA, 67 nt, Human
uacggaauuuucagguagcaauuucauuaaagccccaguuauuuggaagcuaucagaaaauucagua

SEQ ID NO: 4156528 - RNA, 78 nt, Human
uacguuagguucauguuugagaacaaggaguccaacauccagaucagacuucuagaauuucaaaucugaaauaaugua

SEQ ID NO: 4156529 - RNA, 79 nt, Human
uacguugaggagcuucuggaaagugcacauucugacucagcagguauuggagucugcauuucucaugagcacucaggug

SEQ ID NO: 4156530 - RNA, 125 nt, Human
uacuaaaaauaauguaaacuguauauucugccauaauggauaucuugggauuugucaugcagguaguauauuucaagaacuucuauccauaauguguaucaugcuugcuucauuuaaaaucagua

SEQ ID NO: 4156531 - RNA, 80 nt, Human
uacuaaaagccauugaacuguacuuuaaaugggugaauaugaauuuuaucucaauaaagcagugcaaaagcguuuuggug

SEQ ID NO: 4156532 - RNA, 58 nt, Human
uacuaaguuugucucauuugaucuucacaauucugugaaaaagguaggacagauagug

SEQ ID NO: 4156533 - RNA, 82 nt, Human
uacuaauuauugauucaauuucauuaauagauauagaccuauucagaggaucuauuucgcauauaaguuuugguaauuggug

SEQ ID NO: 4156534 - RNA, 56 nt, Human
uacuacaguuuggauccuaugagggcggcgaccugcaugucuuccacacuguagua

SEQ ID NO: 4156535 - RNA, 68 nt, Human
uacuacuaacacaguuuuucagacagagauuuaaugggaucucguuuugagaacuguguuauauagua

SEQ ID NO: 4156536 - RNA, 68 nt, Human
uacuagcugugugguuugggcaaauuacaaaaccucucugugccuuacccucacccauaaaaauagug

SEQ ID NO: 4156537 - RNA, 69 nt, Human
uacuaggccaacugauguggcuggaugauucucugaagaguucacccccuguauuaguagcuaccagug

SEQ ID NO: 4156538 - RNA, 69 nt, Human
uacuauaccauguaagauaugaaggaguucucuucaccuaacucccucaaaugcuaaauggugguggua

SEQ ID NO: 4156539 - RNA, 58 nt, Human
uacuauacucuccauuuuauaguagaggaaacuaaagcuaagaugcgagaauaaagua

SEQ ID NO: 4156540 - RNA, 78 nt, Human
uacuauugugaauagugccgcaauaaacauaugugugcaugugucuuuauagcagcaugauuuacaauccuuucagua

SEQ ID NO: 4156541 - RNA, 65 nt, Human
uacucaaauucucuacuguaugaauuaugcuuuaaguagaauucagugccaaggagaacuuggug

SEQ ID NO: 4156542 - RNA, 65 nt, Human
uacucaaauugccugaguaugucacaugcagaaaugcuuauguccgucacuugguaauauuugua

SEQ ID NO: 4156543 - RNA, 71 nt, Human
uacucaagaccagcuuuuaacacauaaaugaucuugaaaguccugugugauuggaagcugagacuugagua

SEQ ID NO: 4156544 - RNA, 60 nt, Human
uacucaccauaugacuuuacuaacagucugaucauugcagugaggggguaugugugugug

SEQ ID NO: 4156545 - RNA, 76 nt, Human
uacucaccuuuauuguuguuguuagucuguuuucagaguuuauagacaaauuuccugcaaugaaguuuaaggagua

SEQ ID NO: 4156546 - RNA, 67 nt, Human
uacucauuugacacuuuaaacuguuuugucauuuagucucaaaaugguuuggauuuacaaaugagua

SEQ ID NO: 4156547 - RNA, 80 nt, Human
uacucauuugcuaaugaggcaagagucauggcuccauccccucauuuagcauggaguuuugcuucauucugugaguggug

SEQ ID NO: 4156548 - RNA, 55 nt, Human
uacuccaggacuccauuugaaaagaccugguuguucaauguggaguuguggggug

SEQ ID NO: 4156549 - RNA, 70 nt, Human
uacuccugcugaauuugaguuagcugccugucacuuuaaaguuuaagcagcugcagguucaaaggaugua

SEQ ID NO: 4156550 - RNA, 106 nt, Human
uacucucaugaaaacucucuuaacuguuuuauaaaguccaaaagugguuggagaaaagaaauaacuaaugguauugugauauggugagaaagauaaugugagagua

SEQ ID NO: 4156551 - RNA, 55 nt, Human
uacucugccacuaggaguucugccuguaggagggaaaauagaaaauggaagagua

SEQ ID NO: 4156552 - RNA, 129 nt, Human
uacucuugcugcuucaaugauauaaugcuuugcuuuaagguuugcuuaucuucgccugugaaaccacaggugaagaauuauaaacuaaggguuuuagccauguauucaagaagggauuuggcaaacaaa

SEQ ID NO: 4156553 - RNA, 56 nt, Human
gugggcaggagagaagcuaaagaaaguauccuuucuuugauuuccuuaccuuucau

SEQ ID NO: 4156554 - RNA, 78 nt, Human
gugggcccagguacaagcagauuaguguuuauuucacuguggaaacuaaagagguguuuuugcaugggcaauaaccac

SEQ ID NO: 4156555 - RNA, 68 nt, Human
gugggcccuguuuccaguuuuuaaaaaugaacucuugaaaugaaggugggcuggacaugguggcucau

SEQ ID NO: 4156556 - RNA, 61 nt, Human
gugggcucagaacugcucugaaacacgagaaaacccguggacucagggccaugagcgccac

SEQ ID NO: 4156557 - RNA, 57 nt, Human
gugggcuccuggcagucaugcucaucaaccgcauggcagaggcagucaugacccugc

SEQ ID NO: 4156558 - RNA, 58 nt, Human
gugggcugcccuggucccauggcugauuggaaaaauccuguggcuccagggagccggc

SEQ ID NO: 4156559 - RNA, 93 nt, Human
guggggaagacacagccaggccaggaggcuucugcaggccuugggcuucccugagggccucgcggcuucugguggcugcuauaguggccccac

SEQ ID NO: 4156560 - RNA, 57 nt, Human
guggggaccuggacagcggcacagggugugaaguccgugccugcccagguccugcac

SEQ ID NO: 4156561 - RNA, 61 nt, Human
guggggagcuggggaggcuuggccuggcugcagggggccuggcuuccuucccagcccccac

SEQ ID NO: 4156562 - RNA, 122 nt, Human
guggggaucuccuuccucugagaucagccaugcaagacccagaaaucauuagccccacucuuaagggucuggugauuucugggucuugcacggcuauuuuuuggaggaugguggagcuccac

SEQ ID NO: 4156563 - RNA, 73 nt, Human
guggggcccgugcuugagaaucugcuuaagaaucuuacuuuucugugcaccuucuaaugaguacuucauccac

SEQ ID NO: 4156564 - RNA, 78 nt, Human
guggggccuuggcccagugggccucggcaggauuucccuguguucagggagugacucucggggccacuagccccccac

SEQ ID NO: 4156565 - RNA, 130 nt, Human
gugggggcucacugggggcccagcuucuccacccugucaccauccuggccucacuuuccuuucuccugggacuucgguucuuggucaagugaggcuggacaggcccagcuguggccccuggcugagcugc

SEQ ID NO: 4156566 - RNA, 66 nt, Human
gugggggcugcuuuugcuguaagccagagauacaaaccuugaggugagcacaaaggcagagaccac

SEQ ID NO: 4156567 - RNA, 84 nt, Human
guggggggaaccugguggcaacccuguccccacugggcaaccaucugaagacaaaguagggugccugcugcagguucagcccgc

SEQ ID NO: 4156568 - RNA, 111 nt, Human
guggggguaggggaggggacaggccagaggagggcucugaugaggguguuggccccuccagacccugccccuggagacauuaucuguccccaaagccccccauguccucac

SEQ ID NO: 4156569 - RNA, 81 nt, Human
guggggguccugaaggaagcagguggccuguguuacuucugaauguuguaucagguguuuuuguuuguuuccuauccuugc

SEQ ID NO: 4156570 - RNA, 89 nt, Human
gugggggugagugacacugauauuaaacacaauuuaauagauucacccaugaggauuauauugggucugguaucagguucugauuaaac

SEQ ID NO: 4156571 - RNA, 70 nt, Human
gugggguaaauggggagagguuacaguaauaauaauucauguaauugguaaaauucuucccauuuuacau

SEQ ID NO: 4156572 - RNA, 67 nt, Human
gugggguaaggagcaaauaucuuuuuagcuccuagggaaggagcugaaguuuccauuuguaccucac

SEQ ID NO: 4156573 - RNA, 93 nt, Human
gugggguaaugggcuuugcugcaauaugaaaaucuaucaaauggguaaaaucaaugacauuguaucagaguucaugaaaagugccuacugcac

SEQ ID NO: 4156574 - RNA, 77 nt, Human
gugggguaguaaacauuuaaccaaacuguuuaauuagacacagaagacuaauaagcagggucaaaugccuacuccac

SEQ ID NO: 4156575 - RNA, 84 nt, Human
gugggguaguaauaagcacuuugcauauuuguuguaaggauuaaauaaaaucauguguaaaaagugcuuaauauggugcuuggc

SEQ ID NO: 4156576 - RNA, 57 nt, Human
gugggguccugagugcuccacgcugaccagcugcauggccuugaaccaggucuccac

SEQ ID NO: 4156577 - RNA, 87 nt, Human
gugggguuuuccagcagauaaauagacuuggucagacuauuuacuagaaaucagaagaagguauauuuauacuaugggagaagucac

SEQ ID NO: 4156578 - RNA, 57 nt, Human
guggguaaauucaaaaucagaugaaucauuaucuuuuuugucaccugauuugcccac

SEQ ID NO: 4156579 - RNA, 63 nt, Human
gugggugagcagaacagguggcuucucagauucccuuguaggauuccugugacugucauugac

SEQ ID NO: 4156580 - RNA, 82 nt, Human
gugggugauuuaauaugguacuccuuaagcuaacaggccccugucaccauuagcuuaaggaguaccagaucaaaucacccac

SEQ ID NO: 4156581 - RNA, 64 nt, Human
guggguggggagcucucuggaggccacauuguugcuggguucagggcagcagcuucucacccac

SEQ ID NO: 4156582 - RNA, 82 nt, Human
guggguuaggacuccagcauauacuuuuagugggacacaauucaacccauaaaagguggcagugcuugagcacuggauucau

SEQ ID NO: 4156583 - RNA, 72 nt, Human
guggguuauuggggacagucugaucaauccauaaauacuuauugaacaucugugaacuccgaaaauuaccac

SEQ ID NO: 4156584 - RNA, 68 nt, Human
guggguucguggucucgcuggcugcaggagugaagcuguagaccuucccagugagugcuacagcucau

SEQ ID NO: 4156585 - RNA, 79 nt, Human
uaaaggcagccuaggaaguguugauuauucaaguaaaacaguagcucuaaauucuuugacuuuccaggcuuguccuuua

SEQ ID NO: 4156586 - RNA, 61 nt, Human
uaaaggccagggccugagugcuuguguuuuuguguuuugguagccaggccuugagccuuua

SEQ ID NO: 4156587 - RNA, 75 nt, Human
uaaaggcuaagaauauacauaguucugugaaaaguaacagcuguuucuccuccucauuggaacugugugccuuua

SEQ ID NO: 4156588 - RNA, 58 nt, Human
uaaaggcuuuuacaggagugcagggggaaaaaaaucugaucauucuuggcagcuuuug

SEQ ID NO: 4156589 - RNA, 60 nt, Human
uaaagggaagaugacuacagaaaaaagaugccaguuauggcauuggucauuuuaauuuua

SEQ ID NO: 4156590 - RNA, 72 nt, Human
uaaaggggcuuuauuacagaauuuagucaauuuuccugcuauucccacuucauuccaguauaagccucuuug

SEQ ID NO: 4156591 - RNA, 86 nt, Human
uaaaggucauggcauugggcuuuauguaggggaagaagaaaaguuguaucuguuugcucuggaaaaagcccugggucuggaguuug

SEQ ID NO: 4156592 - RNA, 61 nt, Human
uaaaguaaaacuguauuaaugucuucauccacagaguaggcaacugacaguuucugcuuua

SEQ ID NO: 4156593 - RNA, 70 nt, Human
uaaaguagaaugacuucucugcuggacuucaagacucugagauccaggagcuauguacacacuaucuuua

SEQ ID NO: 4156594 - RNA, 69 nt, Human
uaaaguauacugaagguauccagggaacuucacuccaaaauauggcucccugguauaauagguauuuug

SEQ ID NO: 4156595 - RNA, 58 nt, Human
uaaagucaucuuuaaacaugccaugccuuuauguggaguguugaguuuaggugcuuua

SEQ ID NO: 4156596 - RNA, 65 nt, Human
uaaagucuguagcaguauaaauaaucaagagcuguuguucuugacauuguuguuagcaggcucua

SEQ ID NO: 4156597 - RNA, 57 nt, Human
uaaagugugcucuguugaaauguaucauucugugcugccaggagagcaugcacuuug

SEQ ID NO: 4156598 - RNA, 56 nt, Human
uaaaguucagugcaugaaugugggauuuguugucugcaugaguuuauagggcuuug

SEQ ID NO: 4156599 - RNA, 78 nt, Human
uaaaguugaagacuacagaaggagaaauggguaaaugugcuuaguguugcccaccuucuuuucgugccuuuggcuuug

SEQ ID NO: 4156600 - RNA, 93 nt, Human
uaaaguuuaacaauuuaauaucagaaggggagguaaagaaggacucacuuucccucuuuaccuccccuucugauauuaaaugguuaaaucuua

SEQ ID NO: 4156601 - RNA, 85 nt, Human
uaaaguuuguguucugguccagaauuuaugauucuaagucaggaggauggggaguuuguuuugaggccaggaggacauuauuuua

SEQ ID NO: 4156602 - RNA, 92 nt, Human
uaaauaauguuaguaugauuuuucaguauaaaauauaugaguuuauuauaacugauggguuucccucugaaauuauagugcaacauugguua

SEQ ID NO: 4156603 - RNA, 98 nt, Human
uaaauacauaguaagugaauaaauaagucacugaccauuuauaugcauagauagcauuuuggguggcaaccgcugacuuagaacauuugcccuauuua

SEQ ID NO: 4156604 - RNA, 60 nt, Human
uaaauaggccuguaggagaauagaugggagauacuaucauuuugugacaaugccuguuua

SEQ ID NO: 4156605 - RNA, 83 nt, Human
uaaauaggguuuaucaacuguuguguucccauggucuuuagaauaugaauauguagaaaacaaaaguugaaaacuuaaauuua

SEQ ID NO: 4156606 - RNA, 56 nt, Human
uaaauaucaguccagcucuuccuuguugaacuugggcauaauggacugaauguuug

SEQ ID NO: 4156607 - RNA, 67 nt, Human
uaaauauuagguuggugcaaaaguaauugcaaaaacuguaauuacuuuugcaccaaccuaauggaua

SEQ ID NO: 4156608 - RNA, 59 nt, Human
uaaaugcaaggauuuuguuaggccaaucauguuaacguaaaaggcuauuuuugcauuug

SEQ ID NO: 4156609 - RNA, 66 nt, Human
uaaauguuccuuuggauuaaacucaagguggaauuuacccacaaguugcuuuaaaaggagcauuua

SEQ ID NO: 4156610 - RNA, 78 nt, Human
uaaauguuuguggagcaucuuaugccuuuccagaacuacuauuuuuauagcugaagaacgugagauccagaaaguuua

SEQ ID NO: 4156611 - RNA, 91 nt, Human
uaaauucucaucagcaacaaggaaagcugugguucugagaagaaucacugucuccgaucacagguuuucaaucaagcuucugagugauuua

SEQ ID NO: 4156612 - RNA, 77 nt, Human
uaaauugagguaugauuuacaugcaguaaaaugcuuaagucuaggugugcagcucagugaauuuuugcccauguuua

SEQ ID NO: 4156613 - RNA, 73 nt, Human
uagagcaaauggagcuugucuacuaacaugugaaguuuccucauugcaaguagauaccaguucuuugacuuua

SEQ ID NO: 4156614 - RNA, 73 nt, Human
uagagccagagagcuauuccaagaggagucaacauuucucuucaaggaagaaguggcuuugagucagguucug

SEQ ID NO: 4156615 - RNA, 58 nt, Human
uagagcuagcuucaaaaugcgauucaacuggguacucugucacuuuaagcuagcucua

SEQ ID NO: 4156616 - RNA, 59 nt, Human
uagagcuauacacugaguaaaaacagagcuugaaaguuuuugacagguggagagcccua

SEQ ID NO: 4156617 - RNA, 58 nt, Human
uagagcugauuucacuucgcuaguccugggauccaggauucagaguaauucaucuuua

SEQ ID NO: 4156618 - RNA, 97 nt, Human
uagagcugggcuccagggcacagcuugcaaggucaucaugcauuggagucuccauccucuccagccucaucgccugccugucccuacagcuucuuua

SEQ ID NO: 4156619 - RNA, 74 nt, Human
uagaggaggggugggcacauguauagccaggauuuggggacuugacuugguauggaugguguggcuuucuucug

SEQ ID NO: 4156620 - RNA, 60 nt, Human
uagaggccucuuugcaaguaggucuuacuucccaggaccuauaaaaacaaggggccuuug

SEQ ID NO: 4156621 - RNA, 55 nt, Human
uagaggcuccuguguguagguucuuugcacagacuauaccaacuuuuagccucua

SEQ ID NO: 4156622 - RNA, 64 nt, Human
uagaggcugacauugaaaaaguugaggccuuuuaaacaaaggaguaucucagugucagcuccug

SEQ ID NO: 4156623 - RNA, 130 nt, Human
uagaggcugaggcuuccuaguggaugggcaaacugguagcucgccugcccguggccauugguaccaggcuggcugguguucaggcucccuggccaguuggccucuccuagaggagcccucaaauccauua

SEQ ID NO: 4156624 - RNA, 71 nt, Human
uagaggcuuuauaugacaagauggcuaaaauuauucaguuugaagacauauuguuacauaaugacccucug

SEQ ID NO: 4156625 - RNA, 57 nt, Human
uagaggggaagacuucuggacaguggcuugacuuugcucacugggcauuuccuucug

SEQ ID NO: 4156626 - RNA, 91 nt, Human
uagagguccacugugggccuggaaucaugcagggguuacaagacgggggacucccaugaccaagcgugauucuccagcaaggggauuucug

SEQ ID NO: 4156627 - RNA, 85 nt, Human
uagaggugguuuaaaaaggcaucugccuaugaaucuauuaaaaugaucuggaagagguagcauuggcaggugcaaagccuuucua

SEQ ID NO: 4156628 - RNA, 67 nt, Human
uagaguagcagcucuccaggguucacaauguggguuguguaacguccuguugaguuucccugcuuua

SEQ ID NO: 4156629 - RNA, 73 nt, Human
uagaguccguccaucagcaguaacuguucuuacucaaccuugauaaaagcuuugccagaugaguugggcucug

SEQ ID NO: 4156630 - RNA, 72 nt, Human
uagagucuacugguuaaaaauaauuuacuuggcuccaaaaggauggcugugaaacauuuuggcaggacuuua

SEQ ID NO: 4156631 - RNA, 82 nt, Human
uagagucuucugcuuuauuuuguuuuguuguuugcaaaagcaauguaagacuguaugagacaauauaaaccuugaggcucua

SEQ ID NO: 4156632 - RNA, 65 nt, Human
uagaguuugugggaauggaguauugcacagaugcagcugcacaauggucuuccuccaccccucug

SEQ ID NO: 4156633 - RNA, 66 nt, Human
uagauaaugaaugccaugacauuuuccaaauaauucuaugcaaaugaaaaugguguuuauaaucug

SEQ ID NO: 4156634 - RNA, 64 nt, Human
uagauaccugcuggaccucauuugcaacugguaaaaucagaagcugucuuccagcagguguuua

SEQ ID NO: 4156635 - RNA, 73 nt, Human
uagauauucuuauccuuuucucuguagaccagaugggcuagcuggguaaauaguaagagugauggauuaucug

SEQ ID NO: 4156636 - RNA, 66 nt, Human
uagauauuggaaauugagugagaauuggccaagaaggaacucuauacuuaaauuccuugauauuua

SEQ ID NO: 4156637 - RNA, 93 nt, Human
uagaucaaagguugauagagcacuaaguaguguauuccagggcaucuccuagugcagguucuauauauuuaauguuauauaaaguuugaucua

SEQ ID NO: 4156638 - RNA, 84 nt, Human
uagaugagauaggagagcugaacuauugucugcaguguagacuuaaagcaauacaggaauaggaucagcaaaucuacuuauuua

SEQ ID NO: 4156639 - RNA, 66 nt, Human
uagaugaguguaaucugaaaacuugaacauugcauguguucagccucuuccuaauugccugaucua

SEQ ID NO: 4156640 - RNA, 68 nt, Human
uagaugauggacuauuugcauauacuuagagucauugagaucauauguacaaggucuaggcaagucua

SEQ ID NO: 4156641 - RNA, 75 nt, Human
uagaugccugugacagucucugucauauaaauaagaauaugcuacaauuuauaugaacuggacuuuaggaaucug

SEQ ID NO: 4156642 - RNA, 128 nt, Human
uagaugcugaugaagguguggagaaauaggaacacuuuuacgcuguugguggccaugugaguuaguucaaccauuauggaagacaguguggugauuccucaaggaucuagaaccugaaauaccauuug

SEQ ID NO: 4156643 - RNA, 57 nt, Human
uagauggacagcaagcucuguuggcaaaaauuucacaacaggcccuggacccaucug

SEQ ID NO: 4156644 - RNA, 93 nt, Human
uagauggcucugaagauacucuucaggucuugcagacccuccuucaccccugggacauaucucaagaucucaagauggccccagaacccucua

SEQ ID NO: 4156645 - RNA, 61 nt, Human
uagauucccaggaagguauaguguuauuucacuaauacagaauacuaauuccugagaaaua

SEQ ID NO: 4156646 - RNA, 114 nt, Human
uagauuguucagugcuguggaucuguugguuuuuuguaaggagguaaauuaggagaggauuuuacuuuuucccauauagaaagccaacugccccaccucacugauggagaugua

SEQ ID NO: 4156647 - RNA, 94 nt, Human
uagauuucacccauagcguaauacuucaagaugcauaaauucaaggauagaauaaauuaaguagauucaguguuaagggugggaaggaguucua

SEQ ID NO: 4156648 - RNA, 85 nt, Human
uagauuuuacuuaguuagacauuuugcaugcaauagaauuguuaacagugaacuuguugccaaauguaaaauauguaaauauuua

SEQ ID NO: 4156649 - RNA, 88 nt, Human
uagauuuuaguaccagcuguacaguuuacuaggugggcauguugcucaacucuucuacuugcaauaaacuguacuauacuagaagcua

SEQ ID NO: 4156650 - RNA, 57 nt, Human
uagcaaaguuaaauggcuuuuguuucugagagucuucucaaagcauuuaauuugcua

SEQ ID NO: 4156651 - RNA, 72 nt, Human
uagcaaauguauugaacauacauauccacaccuucuucccaagaagggauuuuguuguucauuaucguguua

SEQ ID NO: 4156652 - RNA, 122 nt, Human
uagcaacauucuauuaaguaguucuaaauggaguauauuuugauuguauguguugguguuuuauugagcauugcuguaagguauaucauauuuguaaaucugcucuuaagaauauucugcua

SEQ ID NO: 4156653 - RNA, 68 nt, Human
uagcaaggucccaagcaaugcccuuggcggcuuagccaggacacagugacuuggaauacagcuugcua

SEQ ID NO: 4156654 - RNA, 78 nt, Human
uagcaaugcuguggcaaguuacuuugcaccucuauuuuaugaucucuaaaaugggaguacuaugugauaggauuguua

SEQ ID NO: 4156655 - RNA, 64 nt, Human
uagcacaggcuucuuagauuggcuggaggcuccugaguaccaccagccaacagagccuucacua

SEQ ID NO: 4156656 - RNA, 57 nt, Human
uagcacaguauuucucaacugggggcuauuuuaucucccaggaggaaguuguagcua

SEQ ID NO: 4156657 - RNA, 59 nt, Human
uagcacaguguucacaacagugucuggcaucacaaacauugguguuauuauuguugcug

SEQ ID NO: 4156658 - RNA, 64 nt, Human
uagcacaucuggcgcuuauaggugucaugguucauugucacgacuauaagugacagauggacua

SEQ ID NO: 4156659 - RNA, 65 nt, Human
uagcagaaaaacaaauaugugugcgugugugugugugugcguguguguauguuuugagguugcua

SEQ ID NO: 4156660 - RNA, 92 nt, Human
uagauuugucaucccagcucacauaugguaacucuaucaagaaagaauaucguauuaaugugaaguaauuuagggauaauauuauaaaucua

SEQ ID NO: 4156661 - RNA, 87 nt, Human
uagauuuuugaauuucaaaacaguuuuuuaagucucuagggauacaaaauaucccaagggcaagcucuuuuggcuugcagaagucug

SEQ ID NO: 4156662 - RNA, 67 nt, Human
uagcaaagggaaagaagggccuggagggcauugugugccgaaggaggccaguuuuuccugcuugcug

SEQ ID NO: 4156663 - RNA, 67 nt, Human
uagcaaagguagaguuuugagaaauuuaauguguucccaucacacacuuauaacucuuccuuuguug

SEQ ID NO: 4156664 - RNA, 125 nt, Human
uagcaaaguagggacuuguugauuuugagguuggcauuucuuucccuacuaguuccucaggccugacuucaugccuggcugguagagggggcucaacccacauugaugaaugggccugcaggcua

SEQ ID NO: 4156665 - RNA, 55 nt, Human
uagcaacagguaggggagagcuccaacauguuguguuggugcccccuucuggcug

SEQ ID NO: 4156666 - RNA, 71 nt, Human
uagcaaccaucaguuucuucuuuagauaaaauauauuuuauguuugaucugaugaacagagauaguugcua

SEQ ID NO: 4156667 - RNA, 59 nt, Human
uagcaagaagcugucacaggugugacuuugugacauguguggguggucaguuucuucua

SEQ ID NO: 4156668 - RNA, 79 nt, Human
uagcaagccaaauauuuauucuucugagagcacauguuuaauggcacuauuuucagagaacugaguccuugcucuguua

SEQ ID NO: 4156669 - RNA, 61 nt, Human
uagcaagugagguuucugcuuucagacaugccuuuguguuugaagcucuaccuuuuuucua

SEQ ID NO: 4156670 - RNA, 99 nt, Human
uagcaaucugcuuuuucccugucccucaagguccagucaugggggaguacuuagccagacugcccugaccuuguggccccagcugggaagcagagacua

SEQ ID NO: 4156671 - RNA, 66 nt, Human
gugguggcagcacauugacccgggcuccccuccggggucuuggccuuucagugugucaccaagcac

SEQ ID NO: 4156672 - RNA, 61 nt, Human
guggugugauucggaugaggguccugagaacuggauccguaauuuucauugaagacaguac

SEQ ID NO: 4156673 - RNA, 61 nt, Human
gugguguuuguuaacucccauggugcaaauaccgccaccauggcugauuucaagcuaccac

SEQ ID NO: 4156674 - RNA, 63 nt, Human
gugguuaauuggaugucuacuuuccuccauggauucuuuaugaugggaaggaacgacuaccac

SEQ ID NO: 4156675 - RNA, 67 nt, Human
gugguuacagcugcaggagcugagcacuugcagggaguaggguaaugcgccuggagcuuaaugccac

SEQ ID NO: 4156676 - RNA, 90 nt, Human
gugguuauguucauaucauuuugaaagcugaguggauagauuuaaauagcaagagcuuuguucggaaugauguguggaacccagaaucac

SEQ ID NO: 4156677 - RNA, 69 nt, Human
gugguucaugcaucuguucagagcugucgaucaaaaaauguucagaguucucuguccagaugagaccau

SEQ ID NO: 4156678 - RNA, 76 nt, Human
gugguuccagcucccaccaggcagaccuacccucuaggacccaacuccuucuugguggcugccugguggucuccgc

SEQ ID NO: 4156679 - RNA, 83 nt, Human
gugguugaccucucuggagauaagcagcaaugaaauuccaaugaaguuucaucaucucucaucaccaaaaccauccuaaccac

SEQ ID NO: 4156680 - RNA, 70 nt, Human
gugguugagacagaggcuggcugagucaggccuuggggccuugcugccuucccaggccuuugcuggcuac

SEQ ID NO: 4156681 - RNA, 72 nt, Human
gugguugaggacaugcugaauaacuauaugaaucuauuuucuuuuauauggaauaaguauguuaagugccac

SEQ ID NO: 4156682 - RNA, 58 nt, Human
gugguugccuuuuuucaacgguaguaauauuaagccuaccaagaagaaggaaaacuac

SEQ ID NO: 4156683 - RNA, 94 nt, Human
gugguugcugcggucccgccagggcugcaccggggcuucgcgcagacguucucccgcgaucugcugcagcccaggcgguggcgguggcgguagc

SEQ ID NO: 4156684 - RNA, 61 nt, Human
gugguuggauuccagagagguucuggaggugcuggcaccaccaaaacuuucuggggacugc

SEQ ID NO: 4156685 - RNA, 63 nt, Human
gugguuggguggggauuuaguugcaauuuguccuagauucuucuaggucuuuagccuuaucac

SEQ ID NO: 4156686 - RNA, 71 nt, Human
gugguuuacuguccucugcaaagaauuugucuccauuuaaaauggaggaguggagaggggcaggauaccac

SEQ ID NO: 4156687 - RNA, 76 nt, Human
gugguuugaauuagugagaaagaagaugcaauacugaucuuucaugcuauuucuaucucauuuaaauuuuaauuau

SEQ ID NO: 4156688 - RNA, 71 nt, Human
gugguuuuuaauauccaguggauacaaaugccaggagcguuugauguuuuaccauugugaauuugaacugc

SEQ ID NO: 4156689 - RNA, 91 nt, Human
guguaaacaacaguggucaggaaaagacuccccagaaggugaaauuccaacaaauuuuggcagagucauuucagaaacguuaaaguuacac

SEQ ID NO: 4156690 - RNA, 81 nt, Human
guguaaagacuauuuuuuuguacaccuugaauuaccaggaggguauccaagugaagauauacagaaaauaguuguauacac

SEQ ID NO: 4156691 - RNA, 70 nt, Human
guguaaagugcauuauaacugaauguuguucuuguauuucauggacaccaguugucaugcuaaugugcac

SEQ ID NO: 4156692 - RNA, 79 nt, Human
guguaagaguuuguauuuuuucauguguuuuuauuuaccuuuugaugucuauacauguaagacaugagacucuuuacau

SEQ ID NO: 4156693 - RNA, 84 nt, Human
guguaaguacaaacaucaucagaugggugcuugaacuagauguguucaaaauucauccagcucugagguucuauaaauuuauau

SEQ ID NO: 4156694 - RNA, 125 nt, Human
guguaaguagacaugaacagagcuuggcagagucuaaugaggacuuuauagagagagagaaucaucuuugcuauucugcuccuuauuuccauucuuucaauuauuuaugauauucuaauauauac

SEQ ID NO: 4156695 - RNA, 59 nt, Human
guguaagugccccaagggaagggauggcaucugcugugcuggaacccagggccuaacac

SEQ ID NO: 4156696 - RNA, 86 nt, Human
guguaauccuggguaaguuccuaaggcucauuuucaucauauauaaaaugcagauaauacuagaacuuacuguuuaggauuuucau

SEQ ID NO: 4156697 - RNA, 90 nt, Human
guguaaugagucagaaacagaugaaaaggguaaagaggugaugaaaauggucaucaacacuuuugucuuugucccuggugacuuuuacau

SEQ ID NO: 4156698 - RNA, 60 nt, Human
guguacaaaugguugaauggaugaaugaauacauuuaugaaugcucaacuguguguacau

SEQ ID NO: 4156699 - RNA, 77 nt, Human
guguacacuucugauguuauccucgcucacaugucaccagcuugcaacuuugagugggaugaguuagagguguccau

SEQ ID NO: 4156700 - RNA, 74 nt, Human
guguacagagcaagugacagaaacagggcuagaaugcaggucucucgucccuacucugccacuuuuucugucac

SEQ ID NO: 4156701 - RNA, 108 nt, Human
guguacccuguauugagauaauuuaugaauaucuauuuccacaaccagauacaaacuccuggaaggaaggagccauaucauauccaucuuuguauccagagguaacac

SEQ ID NO: 4156702 - RNA, 98 nt, Human
guguaccuuuccacacuucauuauauuccagcugacaguucaaaaugaaaaacacuuggggacaagugucaucugaacaugcagccugugaguuacac

SEQ ID NO: 4156703 - RNA, 62 nt, Human
guguacgugcaugcacgugugccugugugugaacaugugugggugcgugcaugcauguacau

SEQ ID NO: 4156704 - RNA, 70 nt, Human
guguacuucuaauagcuuuuaugcagucuguaauuuaucuacacuuguguugaaagcuguuagccaccac

SEQ ID NO: 4156705 - RNA, 88 nt, Human
guguagcagaaguacacaaaaagcuagaauagaagccucuguuauguguuucuaacucuguuauguguuucuaacuuacugcuuauau

SEQ ID NO: 4156706 - RNA, 63 nt, Human
guguaggaguggcagagaggguauacuaaggucugaguguaucuauagcuggugcucaaacau

SEQ ID NO: 4156707 - RNA, 78 nt, Human
guguagggagguggcugaaucaaaucaggccucacugucauuuguguggcuuuauuugcagccauuguuucccugugu

SEQ ID NO: 4156708 - RNA, 75 nt, Human
guguagguauguuuguguguguguguguguauguguagguggauauguauuugcaggacauagauauggcuaggc

SEQ ID NO: 4156709 - RNA, 63 nt, Human
guguaguaauaguacauuagaaugggcaucaggagccuaggaauguaaucucuguuaugcaac

SEQ ID NO: 4156710 - RNA, 55 nt, Human
guguaguuuauaguuugagaaggguuuuucuccuuugaaaauuuaagugcuacac

SEQ ID NO: 4156711 - RNA, 73 nt, Human
guguauaacuaucuaucuaguaagcauaaagagauguuaauuuucaguagaauacaagauagagguaauauau

SEQ ID NO: 4156712 - RNA, 73 nt, Human
guguauaaugucucaugcaaaauuuaguuauuuguuucucagcuuaaacuggauuuugaugagcaguuuucac

SEQ ID NO: 4156713 - RNA, 67 nt, Human
guguauacaauaugcugccauguauuauuacaagaugaaaagauaacauacuugcauguguauacac

SEQ ID NO: 4156714 - RNA, 76 nt, Human
guguauacucagcuccuggccgcauucuuggaugugucuuucugaggaccaguaugagagcaucugggguguacac

SEQ ID NO: 4156715 - RNA, 94 nt, Human
guguauaugugcguggaugugcaugcaugugagcaugcauaugagucugucucugugugugcacaugugugccuccuccaagccuuccuaucac

SEQ ID NO: 4156716 - RNA, 130 nt, Human
guguauaugugugcauacauauacgcacuuauauagugucugcauauucaaacuuguguaauauaaaacauacauucagguacaauguaugcagauuuuugugaguguguauguguguauaaauaugcau

SEQ ID NO: 4156717 - RNA, 55 nt, Human
guguaugauauauuguucuaggagcacacauggacuaagacagugucucaagcac

SEQ ID NO: 4156718 - RNA, 63 nt, Human
guguaugcacauauaaccugcacuguagaacuguagggcaggaucuauguaugucacaugcac

SEQ ID NO: 4156719 - RNA, 76 nt, Human
guguaugcaccacagcuuguuuagugacucaccuauccaguuuggguugugaugaauaaagcugcugugugaacau

SEQ ID NO: 4156720 - RNA, 66 nt, Human
guguaugcacgugugugugugugugugugugugcacgcacaugcauacaagcacauguagugucau

SEQ ID NO: 4156721 - RNA, 58 nt, Human
guguaugcauguguguacguguguacauguauguguguacgugugugcauguuuauau

SEQ ID NO: 4156722 - RNA, 72 nt, Human
guguauguguguguguguaauguuucucucuucugugcgagagaagagagaacauuacauaaacuauaacac

SEQ ID NO: 4156723 - RNA, 70 nt, Human
guguauguguucaugagagugugcuuguguauguaugcaugcacauguaacauauauguagcauauauau

SEQ ID NO: 4156724 - RNA, 105 nt, Human
guguauguuuuuuugugucuuggggaagcuuugaaauacuugcugauuuauggagagugaaaagugaaccagacuuucucagaacauuuagaaaaacucagacac

SEQ ID NO: 4156725 - RNA, 97 nt, Human
guguauuagauauuaaaauauaguggcaauuggguuguagagagcacaaauuauuccuaugaaauacaguuacugcauuucuaauaguucuaauuac

SEQ ID NO: 4156726 - RNA, 77 nt, Human
guguauugauucuuucauggaucaugccuuuuguguuuguuccucagaugcauaugaauuggugagagaguauauau

SEQ ID NO: 4156727 - RNA, 56 nt, Human
guguauuuucagaguggcauuucuucaccacggugaagaaggcugaaaugaagcac

SEQ ID NO: 4156728 - RNA, 113 nt, Human
gugucaaucuugaugaaaucaguaaucuugccagucucuaaaucaaucugaaugguaucauucaccuugauaaggggaucaggguagcagauggcgugaguaucaagagucac

SEQ ID NO: 4156729 - RNA, 72 nt, Human
gugucacaaagggagggauagcuggguuuuaauucugauuuugcagcguuucucuuuacuuuugccaggcau

SEQ ID NO: 4156730 - RNA, 116 nt, Human
gugucacguguccaccuuccuuucccuugccucgcaugcccugccucauccaggcacagccuggaagguagaggugagugacaagcacgcaggaagcuuuauggaacauccaacac

SEQ ID NO: 4156731 - RNA, 79 nt, Human
gugucagagccucaguucaguuuccauaguuauaagaaguggagauaaacugugaaaggcuuaacauagcgucugacac

SEQ ID NO: 4156732 - RNA, 88 nt, Human
gugucagcuaccagaugcuuccucuacggccucugagaugcacucaugugacuucagagcuuggagggaggauuccugguucugaggc

SEQ ID NO: 4156733 - RNA, 129 nt, Human
uacugcuuaaguguuuaaagcaagggauaguauaaucagauuugugucaugaaaagguaacucuggcagcuuugucauggacagauuagaugagugaggauccaggggcaggcagagcaguuaaaagug

SEQ ID NO: 4156734 - RNA, 69 nt, Human
uacugguacaauggaccauaaaagcuucaaaaggaaaagaauguuuuguggacuaguuguuucacagua

SEQ ID NO: 4156735 - RNA, 56 nt, Human
uacuggugucuacuacaugguugaaaucgaauagucaauaaggaagacacacagua

SEQ ID NO: 4156736 - RNA, 113 nt, Human
uacugguuuuuuuuggaaguguuucuuaaaccacaaaauucagagauugaaaugaauuguucuuugggaauugauuuggugguauauuagcuaacaaaaccgagaacacagug

SEQ ID NO: 4156737 - RNA, 91 nt, Human
uacuguaauguucuuguggucauaaagcauacuuuguaugacuuuaauucuuuuaaacuuauauuugcuuuaugcuucagaaugucgugua

SEQ ID NO: 4156738 - RNA, 60 nt, Human
uacuguacaaccucugccccuguacggucaugcuaccacaccagagaaguuguuacagug

SEQ ID NO: 4156739 - RNA, 62 nt, Human
uacuguauaugcuuguaucugagucucuugaucaaucucagggaaaaaagcaugcuauagua

SEQ ID NO: 4156740 - RNA, 55 nt, Human
uacugucuauacacuugauuacaagguuguaaagcaaguguggauguggaaggua

SEQ ID NO: 4156741 - RNA, 61 nt, Human
uacugucucugcugcacaaauucaucucugcauuguagugcaaaagcagccagagauggua

SEQ ID NO: 4156742 - RNA, 75 nt, Human
uacugucuuccaggucuggagguuggaaacugaagguucagguaucugcagggcuggaaucuucugagagcggua

SEQ ID NO: 4156743 - RNA, 97 nt, Human
uacuguguagcccucugcccauccccagaaagaccgauguaccucucacuccacaggcuguguccaggugggggugacgcagagaggaacgcuugua

SEQ ID NO: 4156744 - RNA, 71 nt, Human
uacuguuugcaguuugcaguauuaucaucauccccauuaaacagaugagaaaacugaggcuucaagcagug

SEQ ID NO: 4156745 - RNA, 60 nt, Human
uacuuaagaggaaaauguguggauguugccuccagcaugcacaggacggccuuauaagua

SEQ ID NO: 4156746 - RNA, 59 nt, Human
uacuuaagguaggccaaaucuucacacuguuauguaguuggaggugucuuuccugagua

SEQ ID NO: 4156747 - RNA, 84 nt, Human
uacuuaccgcacaguagucucuacucugcacuugaggauuacaguaguauucucagagggaggauuacugccguggguugagua

SEQ ID NO: 4156748 - RNA, 62 nt, Human
uacuuauauaagagauaaaaucugauuuuuaaaaaucagcaagauugugucuuguaaaggug

SEQ ID NO: 4156749 - RNA, 86 nt, Human
uacuuaugugaugugauugauauguuaauuaccuugaguuggguaacauuucacaauguguuugcauauuaaaauauuacauugua

SEQ ID NO: 4156750 - RNA, 99 nt, Human
uacuucaaccagggcagcagcuacucuucuguuuaguuuuauauaaugagguuccauauaagauuauacuuaaagagaaagugccgguuugguuaagua

SEQ ID NO: 4156751 - RNA, 60 nt, Human
uacuuccacuguuuguguagcucugcguauaaaaagaaugcugugcacauaguagaagug

SEQ ID NO: 4156752 - RNA, 65 nt, Human
uacuuccuguuuccaugucuguccuggagcgcuaagaaagggcaugugggagauuucaggaggug

SEQ ID NO: 4156753 - RNA, 62 nt, Human
uacuucugaagcagagauuuggguccaugauaguggauguaauaggaaaauguuuagaagua

SEQ ID NO: 4156754 - RNA, 56 nt, Human
uacuucuguucuuaaaccaagauguuuaucuuccugagguggauugagcagaggug

SEQ ID NO: 4156755 - RNA, 74 nt, Human
uacuucuuuugugugucauuacugaaagauugaagcaagcuucaccuaaguguagugaugcaaaaauaauagua

SEQ ID NO: 4156756 - RNA, 66 nt, Human
uacuugaggccaccaguccucuggcaggguaaaauacacccaacagaauacggauggcugauagug

SEQ ID NO: 4156757 - RNA, 71 nt, Human
uacuugggugguggggagaguucagagaucuuuuaucaccaaauuugaugacucugccaccagccacugua

SEQ ID NO: 4156758 - RNA, 84 nt, Human
uacuugucuuguuagaugaguuaguaaggcugguaaauaauuuauaauaaccaggucuuauuaaaaaucuaaucccuuuaggua

SEQ ID NO: 4156759 - RNA, 67 nt, Human
uacuuguggcacucaccuccguguccccagugcccagcacagcaugacacagaaugggugcucagua

SEQ ID NO: 4156760 - RNA, 67 nt, Human
uacuuuacuuugcaaugggcagaacccagcuccauccaggcugggucuauuuuguagcaaaugagua

SEQ ID NO: 4156761 - RNA, 76 nt, Human
uacuuuccuuugacugucuucaaaugaauauauuucuuguccaaagaauuaugugaggguuagucgacuagaagua

SEQ ID NO: 4156762 - RNA, 60 nt, Human
uacuuucuguccuucuguuaaagcuuaaugggaacugcugcaaaggaggaucagagagua

SEQ ID NO: 4156763 - RNA, 58 nt, Human
uacuuucuucuuaugcauuaaggaacugcuuuuguuucucuuuugccggagggaagug

SEQ ID NO: 4156764 - RNA, 89 nt, Human
uacuuugcagucugagcuuaguguuauaacuguucuaaaaaugucucauuuggaaggaagagcuguagccugcucuuuauugcccagua

SEQ ID NO: 4156765 - RNA, 62 nt, Human
uacuuuggaagaguucauacagugaucccaaaccgugcauugauggaacagcuuugaaagug

SEQ ID NO: 4156766 - RNA, 64 nt, Human
uacuuuggggacaauauggaaucccuuuagggacaauauggaaucucuuguguccaacuaagua

SEQ ID NO: 4156767 - RNA, 70 nt, Human
uacuuuuaaaauucacagguauagcaggcuuugugacugugguguccuguggucuuuacaagcuaaagua

SEQ ID NO: 4156768 - RNA, 66 nt, Human
uacuuuuccccucucagauuggagcagaauagaauggggaaagugugcuccagagagggagaagug

SEQ ID NO: 4156769 - RNA, 64 nt, Human
guguggcuagaauuggguucacaggaggcauuuauuaaaagcccauuuguuccaaaagccacac

SEQ ID NO: 4156770 - RNA, 128 nt, Human
guguggcuaucucugacagguuagacacccuggagguacauguacacacaaagggacaauguagaaggauacauugccuuuaccugagcaugaaugagcccaggguguugugccagcaguccccacac

SEQ ID NO: 4156771 - RNA, 55 nt, Human
guguggcuugccugaggccacucugugcauggagaugccuguggugagcacacau

SEQ ID NO: 4156772 - RNA, 58 nt, Human
gugugggaggaaggugaacagacugguugaucccucaucucuucucucucucucauac

SEQ ID NO: 4156773 - RNA, 70 nt, Human
guguggguggucucugugcucgggcaugggggucaaguuggcugcuggugccccagaggcagccacgugc

SEQ ID NO: 4156774 - RNA, 78 nt, Human
guguggucugaggaccaagagcagaggcaucaucugugagcagguuagaaacccagacucuuaggucccaacccagau

SEQ ID NO: 4156775 - RNA, 129 nt, Human
gugugguggcuggguggaugagggcauaggaaagcagcuggcgacucuccucgaugaaagcauugcucucgauugaguaggccagcacuuucugcaguagccucauguacuccgacuuggccucugugu

SEQ ID NO: 4156776 - RNA, 77 nt, Human
guguggugugugugcauauaacauauacaugguaugcgugugugugcaugcaugugugcacacauuuucugcuacac

SEQ ID NO: 4156777 - RNA, 88 nt, Human
guguguaaaacaacgaggauuucuacauuguaugauuauuguaaaaaaaugauuaaacaauguaaaguucuuguagugcuuggcacac

SEQ ID NO: 4156778 - RNA, 58 nt, Human
guguguacacucagacacacauguagcaaauaucuuuucuauauuugagugugcaugc

SEQ ID NO: 4156779 - RNA, 110 nt, Human
guguguagaaaguuuugucagugcagaucaggacagucucagcuugcugucuaauuacaaguucauggugcuuuccugucucugugaagcugucauaccuucuuacauau

SEQ ID NO: 4156780 - RNA, 55 nt, Human
guguguagaugugagaggacuguaugugugcuauugucaacuuacacuuauaugc

SEQ ID NO: 4156781 - RNA, 78 nt, Human
guguguaguuugggacacucuuggcgaucaaggacagauacauccuuaucacaauggagugucacagccacuccacgc

SEQ ID NO: 4156782 - RNA, 67 nt, Human
guguguauggacacaugucauguugcgauaugugauguauauauaaauaugguauguguaugcacgc

SEQ ID NO: 4156783 - RNA, 78 nt, Human
guguguauguguguacaaauuucauguaaagccucauauuuagaggucuauuuuuacagagaauguacauaaagcuac

SEQ ID NO: 4156784 - RNA, 85 nt, Human
guguguauuguauaaacaagaugaaugaaauuaauuuauuucuugucuucauucuugucuuuguauaguguagcuacuuucacac

SEQ ID NO: 4156785 - RNA, 66 nt, Human
gugugucagaauuuuuguggcaauugaaaugucacaauuuuucuuggaacaacauucuggcaucau

SEQ ID NO: 4156786 - RNA, 65 nt, Human
gugugucagcacuuuuccgaggcagaguuagcuggauucuagcuuugaagaaaagguuguuacac

SEQ ID NO: 4156787 - RNA, 68 nt, Human
guguguccacacucaaauaugugcguguccacacugaccgcccacacuaaauaugagcguguccacac

SEQ ID NO: 4156788 - RNA, 59 nt, Human
gugugucccuccucuccugagugucacugcagccacacucaaggauaccgaggacacau

SEQ ID NO: 4156789 - RNA, 59 nt, Human
guguguccuugggccucugcagaccacggacuguggagcugcgggggcagagguggcac

SEQ ID NO: 4156790 - RNA, 107 nt, Human
gugugugaggacagggaggcugggagauaugaggaucuggauaaaaacuuaucucagcguugagaguaucuuugagcaguguaucccuuuugucuuuaucaaaacac

SEQ ID NO: 4156791 - RNA, 89 nt, Human
gugugugagggugaagaaacaaacugguagguagggucgggucuuggaggacuuuggacgccaugcuguuuggauuuuaacuuauaggc

SEQ ID NO: 4156792 - RNA, 56 nt, Human
gugugugcuuugggaucacauguccccacccuaggacccugguuccaaccauacgc

SEQ ID NO: 4156793 - RNA, 55 nt, Human
guguguggcauguccuauuuuguuuaaagaaugagcuccagggcugcuugcacau

SEQ ID NO: 4156794 - RNA, 90 nt, Human
gugugugggagugacagagcaggaacugaaaaugagacauccaugguauuugucagucucuucuuugccgguccugcccucucccaccau

SEQ ID NO: 4156795 - RNA, 72 nt, Human
gugugugguuuugacagggugaugagguggugagaagacauucugaauuucccugcaagcauuuucacauac

SEQ ID NO: 4156796 - RNA, 66 nt, Human
guguguguauauauacacacacacacagaaacauguuucuguguguguguguguguguguauauau

SEQ ID NO: 4156797 - RNA, 75 nt, Human
guguguguguccugugcccagacccucugugugucuucuccaucucacacagacagucccauaggacucacgugu

SEQ ID NO: 4156798 - RNA, 56 nt, Human
gugugugugugugcgcacacacgcaugugcaugugugugugugcaggcacacacac

SEQ ID NO: 4156799 - RNA, 62 nt, Human
guguguguguguguauccucccauggacauuuauggauauguagguaaacacagacauauau

SEQ ID NO: 4156800 - RNA, 74 nt, Human
gugugugugugugugugagagugugucgcugccgcaguagccgcugcagcaucagguucacugcgugcacgcac

SEQ ID NO: 4156801 - RNA, 75 nt, Human
guguguguguguguguguauguguguguguguguguguguguguacgcauacauagaaacacacagaguacagac

SEQ ID NO: 4156802 - RNA, 101 nt, Human
gugugugugugugugugugaaagugcuaucuaucauaaagcuauguaaaaguuacucuguuuugacagaaaguuauuauuuuuuaaaugcauauauacugc

SEQ ID NO: 4156803 - RNA, 56 nt, Human
gugugugugugugugugugugugagagagaucuacaagugccacccacagaugcau

SEQ ID NO: 4156804 - RNA, 87 nt, Human
gugugugugugugugugugugugugugugcaugcaugugugccugcauuuaugugugcauguauacauuaagucacauuuuuuauau

SEQ ID NO: 4156805 - RNA, 106 nt, Human
guguguguguguguguguguguguguguguaaugcuuauugugcuuauugugugucaggcacuauguuagucauuacacuuacauacgaugcauauauauauguau

SEQ ID NO: 4156806 - RNA, 72 nt, Human
guguguguguguguguguguguguguguguguguaugugcacacaugcauguguguuuacaugcuugcauau

SEQ ID NO: 4156807 - RNA, 74 nt, Human
guguguguguguguguguguguguguguguguguguguguauauguguauguguauacacacaggcaugcagau

SEQ ID NO: 4156808 - RNA, 70 nt, Human
uaucauaugcuuucauucauaugugagagcugaaaaaguugaucucaugaagauagagaguacagugaua

SEQ ID NO: 4156809 - RNA, 81 nt, Human
uaucaucagucuagauucuaguaccaggaccagguuacucagaaguggucacaaaggguggcuggugucaggggggugaug

SEQ ID NO: 4156810 - RNA, 76 nt, Human
uaucauggccuagguuuuuccaaaaagccagacucugggaagaaccuggaguggaggaaaaaaccaggcagaggua

SEQ ID NO: 4156811 - RNA, 58 nt, Human
uaucauuguguuauuucuuccaccagggcgcagcagucuggaaauagaaacaauggug

SEQ ID NO: 4156812 - RNA, 117 nt, Human
uaucauuucuaguugucuaaaguuauguugaagaacugaagacuuuuacuguacaggauaaacaacugacauuaaaugucuuaguugccucugcugaaucacaccuagauaaggaua

SEQ ID NO: 4156813 - RNA, 78 nt, Human
uauccacagaaauuauuaggaugcuugaaccuuucauuuauaguuguuaagggaaagugccugaugaaauuuuggaua

SEQ ID NO: 4156814 - RNA, 72 nt, Human
uauccaucaacaccugcaggucuacucugaaaaaggcuuugcuucaguggaacugucugggugaggaggaug

SEQ ID NO: 4156815 - RNA, 72 nt, Human
uauccauucaaccuugggcaaguuggaaacugaggcuuaguuuccuaacugcaccauagcaauugugagaua

SEQ ID NO: 4156816 - RNA, 66 nt, Human
uauccccaaauuuccuuggaaggguaauugcaaaggauacuuggcuccuaucaaggaguggguuug

SEQ ID NO: 4156817 - RNA, 82 nt, Human
uauccccaacuaaacuccccguguuucuggcuguuugauaagacauuaucauuagauacgcaggcaguuuuaaaggaggaua

SEQ ID NO: 4156818 - RNA, 79 nt, Human
uaucccucgguuagguuccucccgucccugcucccugaggcugauggacaggcaggcgggacagcccgaucgaucgaug

SEQ ID NO: 4156819 - RNA, 72 nt, Human
uauccggagucauuuuuuuaauuauuguugagaagcagaaucuaguuacagagaaaugauuugaugcggaug

SEQ ID NO: 4156820 - RNA, 88 nt, Human
uauccuccaaaaauuugucuugaagcucuaauccccaaagugauaguauuuacagguggaggcuuuaggaggugauuagguuuagaua

SEQ ID NO: 4156821 - RNA, 58 nt, Human
uauccuguguacugucuaguacauuaaauguauguuucuugggcauugcacauagaua

SEQ ID NO: 4156822 - RNA, 126 nt, Human
uauccuugaaaguagaaauagggugagugccagggaguggaggagcuuaaaggaauaagaagacgaaguagacacuuaccaaacaggcacccuuuaacccuacaaucacuuccuacuauugggaua

SEQ ID NO: 4156823 - RNA, 59 nt, Human
uaucgagcuggacgggcuggucugggggaccuccaagcugaugcccgugggcuacggua

SEQ ID NO: 4156824 - RNA, 61 nt, Human
uaucuacaaccccucaaacugugccugguacccaacagguauuucuugaguguaguaggug

SEQ ID NO: 4156825 - RNA, 89 nt, Human
uaucuacagauuauuuaguaagacauugaucugucugugaggaacaucgaucucauccagaaaaaugucuuagccaagaugugugggua

SEQ ID NO: 4156826 - RNA, 64 nt, Human
uaucuacuaccuagcucuugauaacugugcccauuuauaggcauggcagacuagaguauagaug

SEQ ID NO: 4156827 - RNA, 82 nt, Human
guguucuguuuuguuuucagacuucuacugaagucacucaagaagagcuagaggacuucaaaggucaaacaucgcaggucac

SEQ ID NO: 4156828 - RNA, 100 nt, Human
guguucuuaaucugugcgauguuuuaggaaagaggguggcaguaggaccugcacacuccuggauccuagagaugacagauaugugacuuuuaaagaacau

SEQ ID NO: 4156829 - RNA, 68 nt, Human
guguugaugacauuuuagaaacaaaagccaggugcccaugaauagccugaauuaagguggaucagcac

SEQ ID NO: 4156830 - RNA, 86 nt, Human
guguugcagggcagagggugccucaccuggccaagucucuggauagccuggugccaacagagcucccauucuaucucugccagugc

SEQ ID NO: 4156831 - RNA, 99 nt, Human
guguugcauucacauuuuggaaaauaguuauacaggagauuccuuacuugcuuuaaugcaaguagaauuguuuguaagacuuuccaucugauuucucac

SEQ ID NO: 4156832 - RNA, 62 nt, Human
guguugcuagugcaguuucuuguguucaccaucacaguugagauacuaagcauuuccagcac

SEQ ID NO: 4156833 - RNA, 127 nt, Human
guguugcugaggcccauccuggcuccagcuuuuccucucauugcuuaccucuguguuucuggggaagugcaugguggaguggcguggauuauggacccugaaaccaggcugcggcuuuaccacucac

SEQ ID NO: 4156834 - RNA, 81 nt, Human
guguuggagaggauguugaucaaccuaagcucuuauacacugcuggugggaguccaaauugguacaauagcuuuugaagac

SEQ ID NO: 4156835 - RNA, 73 nt, Human
guguuggcugggggugcuauagcugcaucaaacccccacagaaggguagcaccgcuucagcucccuugcccac

SEQ ID NO: 4156836 - RNA, 76 nt, Human
guguuguaggcaguggggucucucuguaccucccacccuugaggagggagguaaagaugagcucaguguccaacac

SEQ ID NO: 4156837 - RNA, 86 nt, Human
guguuguuguuguuuguuugguagaagugagagaauuuuuauacucucaguauagaguuuuauuuuccaauaaacuauaauagaac

SEQ ID NO: 4156838 - RNA, 65 nt, Human
guguuuaaccaccauucuauucugccuugagagagaaugagaaugcaauaaaugguggucagcau

SEQ ID NO: 4156839 - RNA, 63 nt, Human
guguuuaagauacuucacuugccgaaauguauuugaacaauucauuaugugggguaucugcac

SEQ ID NO: 4156840 - RNA, 56 nt, Human
guguuuaauagguagcugaaucugcuuccugaaugguuuaguuaaauauggugcac

SEQ ID NO: 4156841 - RNA, 77 nt, Human
guguuuacugccccaagcuuuauccgccauguaggauuacuuuuccuacuaggaaacguaaaacuucuaguaagcau

SEQ ID NO: 4156842 - RNA, 75 nt, Human
guguuuagaagccaagauuuggguacuagcgccagcuguguuuauuguuaccagaguuuuacugcuucuaagcac

SEQ ID NO: 4156843 - RNA, 85 nt, Human
guguuuaugauaucugucuauguggcuauguaugaauuugguucauugcuucugacugcuacguagauauccaucuucugaauac

SEQ ID NO: 4156844 - RNA, 130 nt, Human
guguuuauucccaaaacaagauuuuguuuugggggauuguauaagucuauuuacaauguacgcuugucuguaaaauuguacauaugauguauguaauauuuccaaggcaaauuauuuuuucaggaaucac

SEQ ID NO: 4156845 - RNA, 57 nt, Human
guguuuccuaguuuaaugaaugacagcaccaucccauucuagaaaccagggaggcau

SEQ ID NO: 4156846 - RNA, 83 nt, Human
guguuuccuucuuauugaacuguagucuucugucuaguccagcuauacagaaauauaauacaagaaaucaaggaaagaaagac

SEQ ID NO: 4156847 - RNA, 82 nt, Human
guguuucuugaggcagguacgcacggacacuguuuuuagagcaagcauuguccuaucucagugccaugugcucaaagagcac

SEQ ID NO: 4156848 - RNA, 69 nt, Human
guguuugaaagaacuuauccuagaauuugguuauaugcuaggugauuuggaaaaggucuuaaggaacac

SEQ ID NO: 4156849 - RNA, 65 nt, Human
guguuugaacauggcaauaaaccuacacaguggcucccacugauguucagccauguucugaacau

SEQ ID NO: 4156850 - RNA, 72 nt, Human
guguuugagaguugccaggugugaguucuggagccaugcguccuggguucauguccuggugcuguuuuuuac

SEQ ID NO: 4156851 - RNA, 60 nt, Human
guguuugcauguguacuuaauugguuaauggggacaggcuaauaauggacauguagauau

SEQ ID NO: 4156852 - RNA, 75 nt, Human
guguuuggaauucugcagcucaugucagcaucucaauaaacaucacugagcagaaguuguaaauuucaucuuuac

SEQ ID NO: 4156853 - RNA, 103 nt, Human
guguuuguauuacugucuuaagaacagcagagggcacuccaagcuaaacuuuggaaugugcuacuguugauuuuuaaagaaguuuuaaauugagaacaagcac

SEQ ID NO: 4156854 - RNA, 64 nt, Human
guguuugucugugugcguguauguugguauuuuauauuuauaacauguuuguacacugaaacac

SEQ ID NO: 4156855 - RNA, 73 nt, Human
guguuuguguauugccuuuuaacuguggaugaccagaaacauuucggcaguuacauuaauaaugcacaugcau

SEQ ID NO: 4156856 - RNA, 84 nt, Human
guguuuuaaaggugcuuguauaguacaaagcacuguauauaguauaauauaaaggauuuuguauaauauaaucauuaagagcac

SEQ ID NO: 4156857 - RNA, 84 nt, Human
guguuuuaaucccaucagguuuaggugggagagucucaagauucaaaucuuuuuuuccugagccuuguggucuaauugaaaggc

SEQ ID NO: 4156858 - RNA, 64 nt, Human
guguuuucaaccucauaccuggagguuacagugagacauggauucuagaagagguugagaauau

SEQ ID NO: 4156859 - RNA, 71 nt, Human
guguuuucaucucuguuguuaauguacuuugccaaaugugcugagugcagaugaacagaagauuaaagcac

SEQ ID NO: 4156860 - RNA, 55 nt, Human
guguuuucuaugugauguugaguagauuugcuccaaagucacagcagagaacugc

SEQ ID NO: 4156861 - RNA, 97 nt, Human
guguuuucugagugaguuaacaggaacuagggcuaugaaauucccaaucaggagagcaagcugcuuauucucugcucuagcucacaaagggagucac

SEQ ID NO: 4156862 - RNA, 85 nt, Human
guguuuuguuuuaaacuguagaagggacacaaaaguccacaauuugggcuucaaacuuauuuuuacagcuguaagaugaaaacac

SEQ ID NO: 4156863 - RNA, 106 nt, Human
guguuuuuguuuguuuguuucaauuuuuuugauaucaaugaagugccuuccaaaggcacuucaguuucccucaacaagauugcauuugacagguugacacugauau

SEQ ID NO: 4156864 - RNA, 77 nt, Human
guuaaaaaugcaguuuccugagacccacucuauuuacuggcucuuuuagauggagcucuggagucugcaauuuuaac

SEQ ID NO: 4156865 - RNA, 89 nt, Human
guuaaaacgguugcauuucaaaagaaauaguugcauuuacuauaugguacuguaauaugguucuuuugaucaccauauugugauuuaac

SEQ ID NO: 4156866 - RNA, 108 nt, Human
guuaaaauauauaugugaguaauuaauugauuuaggcuuguuaugaccaguuuaucaugcuugucaacaguauuaggacauuugaaagaacuuauuuagaaguuuaac

SEQ ID NO: 4156867 - RNA, 66 nt, Human
guuaaaauucaggaggcaguuucagaagucagaaaucuagauuuuuauagaaauccuccaguuagc

SEQ ID NO: 4156868 - RNA, 64 nt, Human
guuaaagaccaugaccugccacuaagcaaggucuuaccuggcuggcaaugguguggucugguau

SEQ ID NO: 4156869 - RNA, 71 nt, Human
guuaaaggaucaagugccaggcaggaaauacagcuccucccagcuccagccugaaaugccucauccugaac

SEQ ID NO: 4156870 - RNA, 68 nt, Human
guuaaauacaugcuuauauggaaaggaagagaaaaaacucucaaucuuuagaccaaggcaugaugaac

SEQ ID NO: 4156871 - RNA, 114 nt, Human
guuaaauauguucacuuuucccccuuucccauagcaaaagcaugugcaauacaccaugauaaagugauuggauaauuauuguuuuagcuagggaaagugaaauuuauguuuuac

SEQ ID NO: 4156872 - RNA, 60 nt, Human
guuaaaugcacuauugaaagcuucacauuucccuggaagauauuuaguggugcauuugac

SEQ ID NO: 4156873 - RNA, 56 nt, Human
guuaaaugcauuuuccaagcacucacagauaggaaguggggcugguggcauuuaac

SEQ ID NO: 4156874 - RNA, 77 nt, Human
guuaaauguucauucuugcguaugccaugguuuauuagaaaugacugucaggaaauguagagaauccuauauuuaac

SEQ ID NO: 4156875 - RNA, 61 nt, Human
guuaaauguucucgccacauacaaaaaaaugguaacuauaugaggugauggacauauuaac

SEQ ID NO: 4156876 - RNA, 93 nt, Human
guuaacaaaaaugcacuuugaguagaguagaugagaaagcaucuguaaugcuucuugcucaaugucuguuuaagguguucaguaaauguuugc

SEQ ID NO: 4156877 - RNA, 64 nt, Human
guuaacaaauguaaagcaauuaaaacagugccaagcacauaguaagugcuuuauacauguuuac

SEQ ID NO: 4156878 - RNA, 60 nt, Human
guuaaccuuuaaugauagucuggggguuuuuugcccccucuacuggcaaaaaagguuaau

SEQ ID NO: 4156879 - RNA, 67 nt, Human
guuaacuuuaugacaugucuugcuuauuaagccacauggugcaagucagggauguaauaugguuaau

SEQ ID NO: 4156880 - RNA, 129 nt, Human
guuaacuuuucugagcuuucauuuccucacuuguaugaagacuucuucuguguucaauuuuauguugauaccaggagagauuuuauugagaagggcguccuggaagagaauuuugaaguugaaucacuc

SEQ ID NO: 4156881 - RNA, 122 nt, Human
uaguuuucguucucaggcacaggagaaccucauaaaggcacacuuguuguuuauccuaauaggcauuuaguaaguguuuauuaugacuuagguccugugcuaaccacuggggauaagagcug

SEQ ID NO: 4156882 - RNA, 75 nt, Human
uaguuuucuccucuauuucuguauguauuuccuuaauauguaguuucagaaguggaauuuauuagagauaaacua

SEQ ID NO: 4156883 - RNA, 66 nt, Human
uacuuuucccugccuuccagcuccaccccuuucccugaucaauggggcuaggaaggggaaaaagug

SEQ ID NO: 4156884 - RNA, 69 nt, Human
uacuuuucucuguaccguauaucuuuguggcaguaauuagcuuuguagaauuguuguuagggaaaagua

SEQ ID NO: 4156885 - RNA, 74 nt, Human
uacuuuuguuaaggucugaauauagaacuuaaguauauuacuuagaaagggauucuagauuuugacuugaugua

SEQ ID NO: 4156886 - RNA, 64 nt, Human
uagaaaacucuacaucuguaugugugcacauauucacacacacacaugcauagagagauuucug

SEQ ID NO: 4156887 - RNA, 66 nt, Human
uagaaacagagagauaugccccucccuucuuuuguuugggaguccaaaugucacucauguucccug

SEQ ID NO: 4156888 - RNA, 109 nt, Human
uagaaacuaaaaaucugagcuuuuacuuuucauuucagccauacuggaugguggacaucucugacucaaugggcugagugaggaaaagguuauaggguagugguaucua

SEQ ID NO: 4156889 - RNA, 67 nt, Human
uagaaagcucuuauguaaacagaaauugcaguagcuaucuuucuguuuagcauaaaguggcuuacua

SEQ ID NO: 4156890 - RNA, 62 nt, Human
uagaaaguaaaucaguuuuauuuacuagauuuccccugggaagaaaacuguauuucuuucua

SEQ ID NO: 4156891 - RNA, 58 nt, Human
uagaaaguagggaagguaggauuuuaaccuaggguggucuuacuuuuuuuccuuuuua

SEQ ID NO: 4156892 - RNA, 72 nt, Human
uagaaaucaaauucaguuauggaaauaaaaagauaauugucuuuuauuuugcaaaccugaguuugaggucua

SEQ ID NO: 4156893 - RNA, 129 nt, Human
uagaaaugcaauauguucuugaucucuauguaugcgauuagaauuuuucccucuacuugguauuuguuucguuaccgaaugaaauuuugagcuuauauuuuuggauauauuucaccucaugcauuucaa

SEQ ID NO: 4156894 - RNA, 73 nt, Human
uagaaauggacagagcugggaucugaacccaggcaucugggcuccagcaccugugcucuuagccauuauucua

SEQ ID NO: 4156895 - RNA, 57 nt, Human
uagaaauggagagagcuggacuuugacccaaucagucuggcucugaauucacuucug

SEQ ID NO: 4156896 - RNA, 60 nt, Human
uagaaauguuagauguauugagggauuugauucugaaucuaucaaagcaagcauguucug

SEQ ID NO: 4156897 - RNA, 80 nt, Human
uagaacauaacuuccuuugaucaaaagcauuugauguaaauuucuauauggaauguggauaagggugucuauauggacua

SEQ ID NO: 4156898 - RNA, 88 nt, Human
uagaacucugacugaccuggaaugaauguauuccaguggaauaaauauggaaugaauguauauucauuccaggucagucagacuucua

SEQ ID NO: 4156899 - RNA, 60 nt, Human
uagaagaaugaugucagaguuuucuuaauauaagaugaaaaccucugcaucaauccuuug

SEQ ID NO: 4156900 - RNA, 59 nt, Human
uagaagacccuugcaugaauuaauucagaauuauuucuggaauugcaggcugucuuuug

SEQ ID NO: 4156901 - RNA, 96 nt, Human
uagaagacuagcaaaaauuuaaguagauguuguuuaaaaacccaucugggucucuuacaagguauccacauuaaauguuuugaauuaguauuuuug

SEQ ID NO: 4156902 - RNA, 71 nt, Human
uagaagagacauagccugugguuauguaaaauuauucaaccuauauugaacuauagacugaguuuguucua

SEQ ID NO: 4156903 - RNA, 62 nt, Human
uagaagcacugacagaguuugacuugaucugaggaaaguucugaaauucugacagucuuuua

SEQ ID NO: 4156904 - RNA, 57 nt, Human
uagaagcucaggaauaggcauagagguaagggauuccucuauuaauccagagcucug

SEQ ID NO: 4156905 - RNA, 56 nt, Human
uagaaggaguauauauauguauacacaaguaaguuuaaauguauaggacccuucua

SEQ ID NO: 4156906 - RNA, 88 nt, Human
uagaaggucguucucuggagucccugggccccgagucacuaagcggguccccaagguaggcuucagaaucaaaggggcagacuauuug

SEQ ID NO: 4156907 - RNA, 61 nt, Human
uagaaguuaaaggaauacagaauuagauguuugcugguuuucugugcuuuuuuggcuccua

SEQ ID NO: 4156908 - RNA, 63 nt, Human
uagaauaguguuuucauuaugggcuaaccugcaaagcuaaccaugauuuaaaauauuauuuug

SEQ ID NO: 4156909 - RNA, 75 nt, Human
uagaaucaauaagugaguuuagcaaguuugcagaauacaaaaaagcacacaugagaaacaucaguugucuuucua

SEQ ID NO: 4156910 - RNA, 118 nt, Human
uagaaucacuggcagagcuuuuaagaaauuuuagugccugggccaguuccagauacauaguugcucugggauggggcccaggcauugauguuuuuaaaaaacucccuaggugauucua

SEQ ID NO: 4156911 - RNA, 87 nt, Human
uagaauugcacuguauuauguauuugguauaguuuggcuaaauuuaccugcuagaauacuugaauacuguaauuacaaacaucucug

SEQ ID NO: 4156912 - RNA, 77 nt, Human
uagaauuggcugucaggucuacaaaaaugcugcugguucuaucucucaucagcuuuguggccuugaccucguuacua

SEQ ID NO: 4156913 - RNA, 72 nt, Human
uagacaaccagaaaggaugccuccuuccggcuucuaaggccaggacuagaggccuucuuucccuacagucug

SEQ ID NO: 4156914 - RNA, 78 nt, Human
uagacaagaggauguggccucuauccuggaagggccuacaguuuaggaaaugaggccaacaugugaacuuugaaacug

SEQ ID NO: 4156915 - RNA, 67 nt, Human
uagacaagcaacuccuaggaggaaaggaaugcagcgcuaucuucccucucuagguagacguagucua

SEQ ID NO: 4156916 - RNA, 67 nt, Human
uagacaaugccaucuugugguucuugugaaaaucauuccuuggaaaauucaagaaggucauuguuua

SEQ ID NO: 4156917 - RNA, 62 nt, Human
uagacacauucccugaaguguaauagauuugaauugcacacaaguuggagaaugaaugucua

SEQ ID NO: 4156918 - RNA, 69 nt, Human
uagacacuuagcagaguugaauguacuguauacauguuauuuuccagauauaguaaaugcuaaggucug

SEQ ID NO: 4156919 - RNA, 55 nt, Human
uagacagauguuuucuggcugugucuucacauggccuucuuccuuugucugucug

SEQ ID NO: 4156920 - RNA, 96 nt, Human
uagaccccucgccuugaauaugagcagaaguuauaaauaagaugagucacuuacucucuugguuagaguacuuuauauggcaaaggugaugggcua

SEQ ID NO: 4156921 - RNA, 57 nt, Human
uagaccuccagcggaggagauugcacaagcucccucagucucccaugccugugucua

SEQ ID NO: 4156922 - RNA, 59 nt, Human
uagacgucauuugccuuuuaaacucacaauggaauuuuccagaggcgaccugaugucua

SEQ ID NO: 4156923 - RNA, 82 nt, Human
uagacuagaauguaagugagaacuaaaccuucuguuguauuaagccacagugcaauuagaacuuauuuauugcugcagucua

SEQ ID NO: 4156924 - RNA, 77 nt, Human
uagacuagccuuguuucucaaacuccugugugcggcagaagcacccagagggcuugcugaacacguggcuggggcug

SEQ ID NO: 4156925 - RNA, 64 nt, Human
uagacuagggaaucauucuuggauugcaaaauucagcccaaaucaaggaaaauuuccuaguuug

SEQ ID NO: 4156926 - RNA, 75 nt, Human
uagacugaaauucuguguuaccagaaagugauaccacauaauauccauggucucuacagaaugcgcuucagucug

SEQ ID NO: 4156927 - RNA, 118 nt, Human
uagacugauagcuccuggagagcaaggaucucgugcuuuuccugcuugucacuuguacuguaaagcacaguggugaaagcaugggucuguucuguucacgcuuuuggcugucagucua

SEQ ID NO: 4156928 - RNA, 65 nt, Human
uagagcacaguggaugacauccuuuugcaaacagcauaguauguauauccacugcccaauaucua

SEQ ID NO: 4156929 - RNA, 60 nt, Human
uagagcagaguucugccaauucugguucgaaugaaacaggcaauuuaggacucuuuucug

SEQ ID NO: 4156930 - RNA, 56 nt, Human
uagagcagggcugguccucaauagccugggcaugaggagccaggaaaccugcucug

SEQ ID NO: 4156931 - RNA, 60 nt, Human
uagagccuggaguuguaacuuaggccacaucuuucucuccagucccaacauucagcucug

SEQ ID NO: 4156932 - RNA, 67 nt, Human
uagagccugggcugcuguccacuaggguuccagaaaaggacucuuggucagaacaauucagguuuug

SEQ ID NO: 4156933 - RNA, 72 nt, Human
uagagcggaaccgcaggaagcccuugcuuaucuuucacuucugaggcucccauuuccugggguuccauugug

SEQ ID NO: 4156934 - RNA, 84 nt, Human
uagagcuacaugugguagggagggcaguggucuauaggaaauccguugagaagauccacucccuaacaccauguuccugcuuug

SEQ ID NO: 4156935 - RNA, 68 nt, Human
uagagcugcuggacuguaacagauauguauuaauuggaaguagaugugacagcuuacagcaguuacua

SEQ ID NO: 4156936 - RNA, 61 nt, Human
uagagcugguuugggagaaucaauucagauaaaucauuucucuaaaugugaaccggcuuua

SEQ ID NO: 4156937 - RNA, 83 nt, Human
uagaggaauuuauggcagccaaggguuuaugguuuugauauggguuuauuaagcacaauuuaggacugaaauagucuccucug

SEQ ID NO: 4156938 - RNA, 129 nt, Human
uagaggacuaaaauguauuacuugaaagcaaauauugcaguguguuuaugugaaucuagaaaauaaaucucuaucuuaaagaaaauacugaauauuuccauaaguauuauuuauaguaguaggccucua

SEQ ID NO: 4156939 - RNA, 58 nt, Human
uagaggagcacaugaggcugagggcauauggacgaugcucuugcugaugucuccuuua

SEQ ID NO: 4156940 - RNA, 60 nt, Human
uagaggagccagacugugcgcgaugggcuugggccaguugaaagaugucuugguucccua

SEQ ID NO: 4156941 - RNA, 81 nt, Human
uagaggaucacauuugugucauaagcaaauccuuuauaaaucaucaagagacugcauagauggccacaaagagauuuugua

SEQ ID NO: 4156942 - RNA, 59 nt, Human
uagaggccagggugucuugagugcuguaacucccaagcacugggcuagccugacuucug

SEQ ID NO: 4156943 - RNA, 129 nt, Human
uagaggcugcaacuuaccagugccuuuguguuuucuucuguagcuuguucacauagcuuuugugaccugaaucucacaggcaugcaaaacaacucagagagauugacaccgcacuucacucaaucucua

SEQ ID NO: 4156944 - RNA, 85 nt, Human
uagagggaguacacuagcuuuuaguacuuaauggcuauggaucauguuauagccagaaacugcaagagcuagcauugguccccug

SEQ ID NO: 4156945 - RNA, 78 nt, Human
uagaggucagaagugcaaaaucaguuucuugggguuaaaccuagguguuggcagagcuuguuccuucuguuuccucug

SEQ ID NO: 4156946 - RNA, 57 nt, Human
uagaggucuuaugcuaagaauauuggacuugaucaucugggcaguucggauccucug

SEQ ID NO: 4156947 - RNA, 57 nt, Human
uagagguggggaaguccugcugagccucucccacagugagccuuccccucaccacug

SEQ ID NO: 4156948 - RNA, 84 nt, Human
uagagguuguguaaaguuuugagaguuaggcggaaucagguagccucugauuaaguugcauuuuaauauuucauacaauuuuug

SEQ ID NO: 4156949 - RNA, 90 nt, Human
uagaguacaaaaauggggagggacacaaagaguucccuguguagacacggggaccacacuuaguguuccucagcacccuucugccuucua

SEQ ID NO: 4156950 - RNA, 55 nt, Human
uagagucuuggugccauauugaaagaaacuuuucacagugcugcaccuggcuuua

SEQ ID NO: 4156951 - RNA, 104 nt, Human
uagagugaaaguagggaaauguaauagcuaguaaugaagaccuagauggggacauacagaauucacuacaguuuccagauuucauauuccuguugcaaacucug

SEQ ID NO: 4156952 - RNA, 78 nt, Human
uagagugaacuaugagaaauugcugauauuugaccauuuuugaccuaaauaaauggcaauuuuguaugguucaaacua

SEQ ID NO: 4156953 - RNA, 58 nt, Human
uaguuuuucuguuccaccccacucugcaaggaguguuacuugccauacagaaaaagua

SEQ ID NO: 4156954 - RNA, 62 nt, Human
uaguuuuugagguugugcuggauaucuucaauuugcccucucccugcacaaaucaauuacua

SEQ ID NO: 4156955 - RNA, 71 nt, Human
uaguuuuugggauaaucaguaaaugcauagggaaucagaacuauccacuuggcugguuguucuaaacucug

SEQ ID NO: 4156956 - RNA, 82 nt, Human
uagguugguacaaaaguaacugugguuuuuaauauaucuaaaauuauauuguaauugccuauuuauuuguuugugccuccua

SEQ ID NO: 4156957 - RNA, 76 nt, Human
uagguuggugcaaaaguaauugcgguuugggcauuaaagguaauggccaaaccgcaauuauuuuugcaccaaccua

SEQ ID NO: 4156958 - RNA, 77 nt, Human
uagguuggugcaaaaguaauugugguuucugucacuaaaaguaaugacaaaacugcaauuacuuuugcaccaaccua

SEQ ID NO: 4156959 - RNA, 64 nt, Human
uagguugguuuuuaaacuccaagucugaugaugaguggguagaggauuuuaaaaacugcaccug

SEQ ID NO: 4156960 - RNA, 55 nt, Human
uagguuuucagaguaaguuuguucucuucuaacuuauuugcaucugaauaacuua

SEQ ID NO: 4156961 - RNA, 55 nt, Human
uaguaacaacaacuagcauuuuggggguguuuucuaaaugccaguuccuguucua

SEQ ID NO: 4156962 - RNA, 64 nt, Human
uaguaagcuuucucuccccuugcauuuuacacccaaagguuugcaacaaugaggaaagcuacug

SEQ ID NO: 4156963 - RNA, 110 nt, Human
uaguaaguuguuccugcagccucaacaucuuagagaauuccaaaugacuacaccaaaugaguuacauggacauucucucccugaguuacaggaaaauauuuaaauuacua

SEQ ID NO: 4156964 - RNA, 69 nt, Human
uaguacccuuuaaguccuggaacaaaguucucucagggggcuugaaauccagauuucagagggaaacug

SEQ ID NO: 4156965 - RNA, 57 nt, Human
uaguacuagaaccugguuguuucagcauuuuucuagaagucagucaguucuauacua

SEQ ID NO: 4156966 - RNA, 59 nt, Human
uaguacuccagaaucgagaucucauauccuugauuuugagucuugagcuuuggauucug

SEQ ID NO: 4156967 - RNA, 78 nt, Human
uaguagaaagacuggcucuaucuccuuggcguuggaggacagagcucuaaggaauaagggcagagucgaucucuacua

SEQ ID NO: 4156968 - RNA, 129 nt, Human
uaguagauuugcauaggaauuaaaaacaauugguguucuuuccauuugcucccugauggcaauuuuauccuuggucauaauuguacagaugagguaagugagaauccaaauaucccuaugauccuguua

SEQ ID NO: 4156969 - RNA, 94 nt, Human
uaguagcauuguuguuucacuaagcagaaauauaccaagguguuaaaaaugcuguuuuguucaucuguuagugaaacuaaaaaacauauuacua

SEQ ID NO: 4156970 - RNA, 78 nt, Human
uaguaguagcuugucauucaacugcacauuaggucauuugcugggauaucuuucugcagugaaugauaagcauagcua

SEQ ID NO: 4156971 - RNA, 74 nt, Human
uaguaguauagagcaguggcugcaaguaaacccuguaauaacguuaaauuuacccaguaacugcuuggcuucug

SEQ ID NO: 4156972 - RNA, 55 nt, Human
uaguagugguggagccagcaacuugugaggcagaaugugcuggcaacuacuauug

SEQ ID NO: 4156973 - RNA, 72 nt, Human
uaguagugugcaucuuucuuccuucuucugcuugcuggagcuuagauacaaggcagagaugugcacucgcug

SEQ ID NO: 4156974 - RNA, 129 nt, Human
uaguauaauggaauauaugaaauuaaaaauaacuacacuggacacugggcucugcauacaguaaauauucagccguugucugcagacuugccuaaguguguacgcaguaguuauucuaggcaggugcug

SEQ ID NO: 4156975 - RNA, 72 nt, Human
uauucccugacagaugagggaguauucucaggcagaccucuagaaucacuguuuccaucuaggcagggugua

SEQ ID NO: 4156976 - RNA, 72 nt, Human
uauuccucagcucagcgagagagaacuaguccaucugguuaaucuaagacuuuccuggaguugacaagaaua

SEQ ID NO: 4156977 - RNA, 107 nt, Human
uauuccucuacagcagugauuuuaaacuauggaugauuucugcccccagggggcaucuagcaauauccggagacuuuuuaaauugucauaagugaggugggggaaua

SEQ ID NO: 4156978 - RNA, 64 nt, Human
uauuccuggcucggcuuggggacuucugcggcugccggggcuccaaggaggccagccuggaaug

SEQ ID NO: 4156979 - RNA, 87 nt, Human
uauucuaauaacaaacagcguucggacagaaauauuagcuuuuggagaucaaugagguaauacuuucaguccuuuguuaauaugaua

SEQ ID NO: 4156980 - RNA, 55 nt, Human
uauucuauucucccucucaguacagaaucugucaggacagggcagcaauaggaua

SEQ ID NO: 4156981 - RNA, 76 nt, Human
uauucuccagaacauguagacuuuccucccuccaucacccucaaggauaaggauucuaguccaugaauggaggaug

SEQ ID NO: 4156982 - RNA, 90 nt, Human
uauucugcccaguuuuguaaagucuguucugaguuguuauuauaaauacauuuagucaucuugaaauacuuucuagaauaaggugggaua

SEQ ID NO: 4156983 - RNA, 61 nt, Human
uauucugcuucccguggcacaagcaggaggcauaaccuuccuaaccaagggggauagagug

SEQ ID NO: 4156984 - RNA, 77 nt, Human
uauucuuacucucgacugcauuauaaagcaccauauguaccagcuuguuuuuguguauuuugaaccgaguaagaaua

SEQ ID NO: 4156985 - RNA, 93 nt, Human
uauucuuucaguggaccacaguuugaugauaucugcagucccaaguguaaaucuaaaaucauagcaugugagucuauuccaguugaaauagua

SEQ ID NO: 4156986 - RNA, 69 nt, Human
uauugagcuacgugugguuauugaguuacauuuaugacuucuguguuuuacuauauguauuucucaaua

SEQ ID NO: 4156987 - RNA, 79 nt, Human
uauugauguagguuuaucuauuguaacaaauguaccacucugguaggggauguggauaauggaggaagcuauguggaua

SEQ ID NO: 4156988 - RNA, 65 nt, Human
uauugccuucuugucuaaggaacacaucauuaaagcugaaagaugguuccuuagaggaggcggug

SEQ ID NO: 4156989 - RNA, 57 nt, Human
uauugcugccaggacccuaucccagaaagcuggagugacuugguuuugguagcggug

SEQ ID NO: 4156990 - RNA, 63 nt, Human
uauugcuugauaugugcuaaccuucccuuugcagggccugcaauugaaagccaugcagcagug

SEQ ID NO: 4156991 - RNA, 57 nt, Human
uauugcuuuugauucaaggcagauuucuguuaucucucuuuggagaaagaugcaaua

SEQ ID NO: 4156992 - RNA, 129 nt, Human
uauuggaagggaaaugacaaguuaaugaagguuugugguuaaccgcacauuuuugugccuacaaauaaacaaggggugcaaguuaaucagcauauacuccauuaacuuggauucuuacccuucuguuua

SEQ ID NO: 4156993 - RNA, 109 nt, Human
uauuggacaagggagaggcuggugauucugaggcagcugcuugcuaauccuggaagcagaggggaacaagauuuagcucccuuaucucucugccuucuccuuuccgaug

SEQ ID NO: 4156994 - RNA, 67 nt, Human
uauuggagauuuaguuucagcuucucuuacaguuaggugcugguauaugacugaguuuugaccaaug

SEQ ID NO: 4156995 - RNA, 66 nt, Human
uauuggauauugagcagcuucucugccaucugcacaccagaugccaguagcacugcuuucccagua

SEQ ID NO: 4156996 - RNA, 130 nt, Human
uauuguauuuuaauuguauguuauccuuccuuugcaucauuucuagaaaguuaauuuuaaugauacuaaugacugaagcugaguuugugcauagaggaagaaucagauaaaauagaaaucucauauaaua

SEQ ID NO: 4156997 - RNA, 61 nt, Human
uauuguguguguguguguguguguguguguguguacagacauacauaagcaccacauuuug

SEQ ID NO: 4156998 - RNA, 77 nt, Human
uauuguuagguucuauacuaagaugagaaagcuagaaucuuuauugcuguguauauaaggucaggaauuugacaaua

SEQ ID NO: 4156999 - RNA, 98 nt, Human
uauuguuuaggauauauuuugaguuggaauuuucaggaaaagaaaagcauaacugagagaucugugcuuacuacaaggugcauccuugaaaaauaaua

SEQ ID NO: 4157000 - RNA, 87 nt, Human
uauuuaaaauauggaacucuuggcaguaaaagaaaaugcuuaggaaccuaaguuucugauauuguuaaagcuacaugugaaauaaua

SEQ ID NO: 4157001 - RNA, 66 nt, Human
uauuuaaauugacaaaucauacuuguauaccuuuauggaguacagugugauauugucauguaggua

SEQ ID NO: 4157002 - RNA, 97 nt, Human
uauuuacauacaugugugcacauacauauuagugucacagaugugcaugcauucauguguauacgaguaugaauaugugugcauauguaugccagug

SEQ ID NO: 4157003 - RNA, 88 nt, Human
uauuuacaucuguccuuuucuuacugcuuagccaccaugacacacucaaauggucaggagcuugguagugugauuagggauguggaua

SEQ ID NO: 4157004 - RNA, 95 nt, Human
uauuuacuacauuccagguacuguggggauauugauuguaaugacaugauccuuuauugucaauaugcuuacaguccacuagggggagccaaaua

SEQ ID NO: 4157005 - RNA, 55 nt, Human
uauuuaggugcagaaagaggggcguguucacuguaaucucucuguacauuagaua

SEQ ID NO: 4157006 - RNA, 112 nt, Human
uauuuauaccuuuaugccuauaccuaaaucucuaccuauuuguuucugugucaucugaaugaauacacagcuagauggauagauagaugauagauagauagauagauagaua

SEQ ID NO: 4157007 - RNA, 71 nt, Human
uauuuauagaguggcaucuaaguuuuagaaagugacaguauuuuuuaaagugagauuucauuucuuagaua

SEQ ID NO: 4157008 - RNA, 60 nt, Human
uauuuauucuuuguacugccuuguaugaaaaccgucuaagaaggcuugcaaagauaagua

SEQ ID NO: 4157009 - RNA, 56 nt, Human
uauuuauugaaguucaagcuguagaaaucugacagcuuugaggacuuuaaaagaua

SEQ ID NO: 4157010 - RNA, 79 nt, Human
uauuuauuuaaugacucuaagaauucuagauguccucaguggagcugcguuuggcauuagaguuauuuguuaauaagug

SEQ ID NO: 4157011 - RNA, 62 nt, Human
uauuucacaagaugcugaugcuucccuaaccugcaaaacucucucagugucuugguaaaaua

SEQ ID NO: 4157012 - RNA, 65 nt, Human
uauuucacaugcagcagggaagugaggagaaaucugagaguuuuacuugggcugacauugagaug

SEQ ID NO: 4157013 - RNA, 64 nt, Human
uauuucacauucucacaagaggaaaauuuuauaagcuuuucuaaucugugggcaugugucugua

SEQ ID NO: 4157014 - RNA, 64 nt, Human
uauuucaucaaaggauaagaauaguaugauuauaugagcauugacuugauucuuugaugaggua

SEQ ID NO: 4157015 - RNA, 63 nt, Human
uauuucccagggagcaacaagccaggcaauagcuggcugaugccacagcuucccuggaaaaug

SEQ ID NO: 4157016 - RNA, 129 nt, Human
uauuuccuaaagagugugucaaagugauaaaagaggugaggaauggacucauaaacagagugauuuugaaauuacuguugguguauccauagcacguguucuucuaaacuuuggcuuuuaaggauuuca

SEQ ID NO: 4157017 - RNA, 58 nt, Human
uauuucugucagccagauauggggcagccauucuucccauuucaugauuauagaaaug

SEQ ID NO: 4157018 - RNA, 61 nt, Human
uauuucuuuucgugacuuauugcaguggcuaagaccugcaguacaauguggaaaaggagug

SEQ ID NO: 4157019 - RNA, 78 nt, Human
uauuugaagguaaucagccuuuccacaauuauuucauggucauggauuuuguguugaugcugguuaauuagccaaaua

SEQ ID NO: 4157020 - RNA, 89 nt, Human
uauuugaucaaguaaguuuauagauaaaugccuaucuaauauauuaaaucagaagauggggauaaugaaguauagcuugcuuuuaaaua

SEQ ID NO: 4157021 - RNA, 96 nt, Human
uauuugcuagaacauagacacaguguugacaucaaauagauaucuuuuuuccaagagguuaagagaaugaugaucacugguuuaucccuucaaaua

SEQ ID NO: 4157022 - RNA, 66 nt, Human
uauuugcuauuguucucucagugcccaguauagugcccucuacugagcagggaccaaaagcauuug

SEQ ID NO: 4157023 - RNA, 59 nt, Human
uauuugcuuggaaaccuaauccuaaauccacugucuuggaauaggacacuaagcaaaua

SEQ ID NO: 4157024 - RNA, 64 nt, Human
uauuugcuuugcuuuauagagauugaccauuggccuuauuugguuacucuguucaaagcaagua

SEQ ID NO: 4157025 - RNA, 58 nt, Human
uauuuggaaacaauucacaugcuuuuucugucuuuguaggcaugugaauguucaaaua

SEQ ID NO: 4157026 - RNA, 59 nt, Human
uauuuggcccuaaucugcaguacuuguuucaucaccuggcaugcagcaagugcuaaaua

SEQ ID NO: 4157027 - RNA, 58 nt, Human
uauuugucuucugagagaauuaucccauugagagugggauaaggcaggaggauaagua

SEQ ID NO: 4157028 - RNA, 61 nt, Human
uauuuguguguuuguauguguccagacuugggaggggaacacauauauucagauacagaug

SEQ ID NO: 4157029 - RNA, 74 nt, Human
uauuuguuauagaagcccaagcugacuaaggcaagaaauuggugcuaagaagugagaugcugcuguaacaaaua

SEQ ID NO: 4157030 - RNA, 70 nt, Human
uauuuguuucuuaugugcagagugaguacagacuuaacagcagguguucauuuuaauauaagaacaaaug

SEQ ID NO: 4157031 - RNA, 67 nt, Human
uauuuuaaucuucacagccaggccguggguuaggaaccacagcuuaugguacagaggaggugaagug

SEQ ID NO: 4157032 - RNA, 78 nt, Human
uauuuuauuuuccagacagcuuaggaaguuucuauuauucaagguuauuggaaaauaugguuucuggaaaauacugua

SEQ ID NO: 4157033 - RNA, 91 nt, Human
uauuuucuuuauugauugaggagugcuaucuucuuuuuagguaaugcugaaccuauaagaugagaucagcuuucuguuuuaaagauugaua

SEQ ID NO: 4157034 - RNA, 59 nt, Human
uauuuucuuucuuaaacauguugugcuuguuaagcuaaaguguguguggaaugagaaua

SEQ ID NO: 4157035 - RNA, 84 nt, Human
uauuuugaaaccuauuuauaacuucuagauaaggguacagccaucccucccuaggacaugguuuuaaguagaguugaaugaaua

SEQ ID NO: 4157036 - RNA, 68 nt, Human
uauuuugucaucuguguuuugcuggaguuugacucaguuauauuucagaagucacaguugacugugua

SEQ ID NO: 4157037 - RNA, 55 nt, Human
uauuuuguuucuuggcucaggcccuaaggaaaagccuguaucagguuacaaagua

SEQ ID NO: 4157038 - RNA, 58 nt, Human
uauuuuuacuguuugaugauucccugcuuaggaggguuucagugggaaagugagagug

SEQ ID NO: 4157039 - RNA, 113 nt, Human
uauuuuuaucugcagggccguuacucucauguuuccugucacagaaucuaaacaucacagaucugcagaggacaggcgaggaugcugagugaugccaagcaguucugaaagua

SEQ ID NO: 4157040 - RNA, 63 nt, Human
uauuuuuccaucuuuguaacucuaguaacauauugcuaacagagggugcaacauggggaucua

SEQ ID NO: 4157041 - RNA, 56 nt, Human
uauuuuucccccuuccacugucuauuucaaaggggugguggcagggaggaaauaua

SEQ ID NO: 4157042 - RNA, 72 nt, Human
uauuuuucggugugauuuggauuggaaaagaggugaaacauuuuucuacuuuggaaugcacugauaagaaua

SEQ ID NO: 4157043 - RNA, 73 nt, Human
uauuuuuggucauccuggaucuuggaaauuagaaacaaaucaugagcacugagauccaggaugucccaaaaua

SEQ ID NO: 4157044 - RNA, 94 nt, Human
guugaaguccuaaaccccaguaccccaggauaugauuguauuugaaaguaaggccuuuauauugguaauugagguuacaugaggucacuucaac

SEQ ID NO: 4157045 - RNA, 73 nt, Human
guugaauagaauugaacuugaucuuuagcuagaaaucuuccuucuagcucgauugguuucauuuguguuucac

SEQ ID NO: 4157046 - RNA, 63 nt, Human
guugaaugacuccuucgucuggguagcugcacaaggcagacagaccuggcagucauccucaac

SEQ ID NO: 4157047 - RNA, 81 nt, Human
guugaaugguaguaaagaucagucugaagcaacauuuaacaaaaguugcuuucuagggcuagauuucuuguacuauaaaac

SEQ ID NO: 4157048 - RNA, 55 nt, Human
guugacaaacuacagccugcaggccacaucuucccugcugccuguuuuugugaau

SEQ ID NO: 4157049 - RNA, 83 nt, Human
guugacuccaucucccaauaggccucuucuggaaauucccuccccauguuagaucuggcagagccacugggagacagagcagc

SEQ ID NO: 4157050 - RNA, 83 nt, Human
guugacuucuuaccaugugcucagcaauggaacaagaggguccgggggcuuccucugugauuucugagccaaugaggauuaac

SEQ ID NO: 4157051 - RNA, 58 nt, Human
guugagaaugaugagauucuuccuucuaggugaggaauauuuucucuuuauuuucuac

SEQ ID NO: 4157052 - RNA, 60 nt, Human
guugagacuccugguguagaauaauuaaauagauugcucuagcucauaggacucaucaac

SEQ ID NO: 4157053 - RNA, 71 nt, Human
guugagagcucuggguguguugucaguuggaaagaaaucugacuguuucggcucagaagcaaaugcucaac

SEQ ID NO: 4157054 - RNA, 105 nt, Human
guugagauggagucucgcucugucauccaggcuggagugcaguggugugaucucggcucacugcaaccuccaccucccggguucaagugauucuccugccucagc

SEQ ID NO: 4157055 - RNA, 121 nt, Human
guugagcaauaaacagguuuuuaauuuuuuccccuuccgucucuugagugucugucucugauggaugaugugacagaggaaggcggcuccauaaauucugaauucugaauacuaaaucagc

SEQ ID NO: 4157056 - RNA, 65 nt, Human
guugagcccaugguguacucuguggcccagggcacggcagggcccgagguauuccaggcugcagc

SEQ ID NO: 4157057 - RNA, 58 nt, Human
guugagcucuccagcuucauuuccagaaggcugcuggcugugcaguucagaguucaau

SEQ ID NO: 4157058 - RNA, 84 nt, Human
guugaggaaaagaaaugcaagcucaguuccaagguuuuucccuugcuaaaacucuuaaaauuuuggcuugcuuauuuccuuaac

SEQ ID NO: 4157059 - RNA, 81 nt, Human
guugaggaggacuaucggacuuaguguuuugcuguagacacaguacugaguacugaguuggauuaagagugcugccccaac

SEQ ID NO: 4157060 - RNA, 82 nt, Human
guugagggccauuuaggcagauuccauauuuuggcuauugugaauagugcugauuaacaugaauguguagauguccuucaau

SEQ ID NO: 4157061 - RNA, 76 nt, Human
guugaguauguggaaagggggugaaaaagcagcuaaacccaagauguaggucacagucccuaucccuacucucaac

SEQ ID NO: 4157062 - RNA, 62 nt, Human
guugaguauuccuuaucugaaaugcuugggacuagaaguguuucagauuugggaguuucggc

SEQ ID NO: 4157063 - RNA, 63 nt, Human
guugaguggguuaggaugcugacauaucuuuugagggccacuaacuauucaacccacuacaac

SEQ ID NO: 4157064 - RNA, 105 nt, Human
guugaucauauaaaugcuaagauagauugaugaguauauaugaacuauuuaauuguuauauuuguucaaacaauucaguguaguuauuaucuuugccugaucaac

SEQ ID NO: 4157065 - RNA, 73 nt, Human
guugaucaucuccauacggucucgcagcggcucggggaugguguccgugacguuggccgugcagaugaacagc

SEQ ID NO: 4157066 - RNA, 87 nt, Human
guugaucuaggagaagagaugggaaggcagacuucaagagccacuaacauuucgugaauguuuucugauuuugauuuuuggggugac

SEQ ID NO: 4157067 - RNA, 68 nt, Human
guugaucuaggauggaugguuugguaggcugaauaacaaccuccaaauauauucacguccuaguagac

SEQ ID NO: 4157068 - RNA, 56 nt, Human
guugaugcauugccgacuuacugggaucuucaguggagguucccaaugcagacaac

SEQ ID NO: 4157069 - RNA, 76 nt, Human
guugauggaggagauggcagggugcaccaugaacuuaagcagcugcuccaaggcugccuugcccucuucccauagc

SEQ ID NO: 4157070 - RNA, 104 nt, Human
guugauggccucaccaaguuuagucauagauacccaaggucagggagggccauuacccugugaaacuuuggggaucuacggcuggaccacguggggccaugagc

SEQ ID NO: 4157071 - RNA, 127 nt, Human
guugauguagggaaaguaaaagaugccacucuucuaaccugaaaguaguaaaagcuggaauggacauuuuagcacuaguuugagguggcaauaaaagagaggaacugugacagaauccuauuagaac

SEQ ID NO: 4157072 - RNA, 116 nt, Human
guugauuccacccaaugcacagaccuauguggaaaccuugaagccauaguuuucucuauaacuuuaaugugcuucauucuacaugacauugaaggccugugucaauuaugaaaaac

SEQ ID NO: 4157073 - RNA, 67 nt, Human
guugcaaagcgucuucaauauguguuuaauauuguacaggcaaucaaaggaugugaggacuugcagc

SEQ ID NO: 4157074 - RNA, 84 nt, Human
guugcacguaauagucucaaacuccuggacucaagccaucugcccccauuggccuuccaaaguguugggauuauaggcaugaac

SEQ ID NO: 4157075 - RNA, 70 nt, Human
guugcagagccuuccuagcagacucugguuucacagucccaaggcagcagcugcagggagggucugcagc

SEQ ID NO: 4157076 - RNA, 57 nt, Human
guugcaggaggauggcugcauaacggcgaaccggggagguugccuccugccugccac

SEQ ID NO: 4157077 - RNA, 93 nt, Human
guugcaggcucauucucuuuuaccaaguuguuagauguugggaugguucaaaaaacaggcauucuuuucugcagcugguauuuauguugcaac

SEQ ID NO: 4157078 - RNA, 59 nt, Human
guugcagggcacuuaagcuugguggagaccgucagugccuccuugccugucccugcagc

SEQ ID NO: 4157079 - RNA, 84 nt, Human
guugcaguaaguugacgauugaauauacccugagcauauggcaaaggaugaauagggaugggagauucucaaacguggcugagc

SEQ ID NO: 4157080 - RNA, 67 nt, Human
guugcaguucuugcagacaaauguguuccaguccuuugcuacacagagugguuuguagaauagcagc

SEQ ID NO: 4157081 - RNA, 86 nt, Human
guugcaugggcuauugguagauggagagagacauguuaauaaaauaaccaacaauguuuuucaagcauuuauuaaugcuaggcaac

SEQ ID NO: 4157082 - RNA, 97 nt, Human
guugccaaaauguugauaauuacugaacugggaugauggacauacagggaguucaauauugauccuauuucaguguauguuuaaaaauuuccguaac

SEQ ID NO: 4157083 - RNA, 73 nt, Human
guugcccauuucuuaugcugagaaugaaagaaugugacauuauuuuuuaaaagcucugcauguugugggccac

SEQ ID NO: 4157084 - RNA, 70 nt, Human
guugcccccuccuugcuuuuucccuuccacagagcuaagugggaaugaguggcugaguaagaggggagac

SEQ ID NO: 4157085 - RNA, 86 nt, Human
guugcccugcaccaaguucuauacuucccuguuuuuuccugagagcuucuuuucacaauccaggaagcaacuuggugggggacagc

SEQ ID NO: 4157086 - RNA, 82 nt, Human
guugccugcggucuccgugggugagggaaaaggcacagggaggugcagaagcguuccuggcgccacggagccggucagugac

SEQ ID NO: 4157087 - RNA, 74 nt, Human
guugccuguaucuaagguauaugaggaaucauugcaaagaacggucuucagaaacuuuagaacuuacccgcagc

SEQ ID NO: 4157088 - RNA, 67 nt, Human
guugccuucaaucaggauggucucaucccagcaguucaucugaugugacugucucauuugaagugau

SEQ ID NO: 4157089 - RNA, 72 nt, Human
guugcugcaaaaguaauugcagguuuugccaucgaaaguaauggcaaaaaccgcaaucacuuuugcaccaac

SEQ ID NO: 4157090 - RNA, 85 nt, Human
guugcuggggaagugacaacagccaucacuuuuagguuuuguuugcaagguuugcauguguaagguuguuuauuuccuuucagau

SEQ ID NO: 4157091 - RNA, 83 nt, Human
guugcuuaguaaguguuuauuuauaacgaucucuuauaacaagaauuauggagacagguguucaguaaaccuuggugaauagc

SEQ ID NO: 4157092 - RNA, 65 nt, Human
guugcuucuuggcuuuuccaacccucugccaugcuugaacaucuuugugaaaguccaggaacaac

SEQ ID NO: 4157093 - RNA, 68 nt, Human
guugcuuuccuggaagcacaacgcauuuauuugacaagaguauuugauacagucuucuaggaggcggc

SEQ ID NO: 4157094 - RNA, 102 nt, Human
guugcuuuucauagugcagcugcuugccugguuaggaagacagauuggugacccgcagucauacacauugauuaggugacagccuguauucugaacaguagc

SEQ ID NO: 4157095 - RNA, 57 nt, Human
guugcuuuuuugauagguggaaauuuuauauacaauuucauuuagaaaaaaagcaau

SEQ ID NO: 4157096 - RNA, 78 nt, Human
guuggaagcuuguaacagguacuaaauaacugccaacaauucuuauuuuaaggcacuuuauuuccuauugcauccagc

SEQ ID NO: 4157097 - RNA, 68 nt, Human
guuggaauaauuaaaaauucuggugcaguggugguauaccaaucuuuagaauucuuaaguauucuaau

SEQ ID NO: 4157098 - RNA, 81 nt, Human
guuggaaucuaagcuuuagguuuugccugagaucugaguuuuaagcucagaauucagggaucuagacuguggguucugagc

SEQ ID NO: 4157099 - RNA, 59 nt, Human
guuggacuuuuuacaugguggcuuaagacuccaaaagccaaugcguaaaaagaucuaau

SEQ ID NO: 4157100 - RNA, 66 nt, Human
guuggaggauggaguuagcaucuuugaugauaaugaauggcucuggauugcaauuccucuucaggc

SEQ ID NO: 4157101 - RNA, 74 nt, Human
guuggaggguuuagcuuuuauguaaauuucuucuugcuuuucugcauuuaaauuaaguucugaucccuaucaac

SEQ ID NO: 4157102 - RNA, 67 nt, Human
uaguauucuucaaagagugucaaaguucaugcaugaugaagaaagacugaggcauugaaggaaacua

SEQ ID NO: 4157103 - RNA, 104 nt, Human
uaguauuuuguuccuugaggagguuguguggauaauauuacuugagcuucauuuugggugauuuauauucaccaguuugucuccuccugggugaacacugucua

SEQ ID NO: 4157104 - RNA, 104 nt, Human
uagucaaagccauacagguucuaggacuccauguguccuggagaugggaauuaucaucccagugagcacagguagugccaauccugauuucugagcugugacua

SEQ ID NO: 4157105 - RNA, 81 nt, Human
uagucaauuauuuuguagcucugaucuuuucccccugcacccgacaggacagaaagguggugguuagggaauaugugagua

SEQ ID NO: 4157106 - RNA, 72 nt, Human
uagucacaaucgauaucauuugaagauacuuuucuuucuugaaauuugccaucuuugggauauuugugauua

SEQ ID NO: 4157107 - RNA, 67 nt, Human
uagucauaauuuugauguuugucaguuuacuauuuucuuucuuacugaaagcauuuacuugugauug

SEQ ID NO: 4157108 - RNA, 82 nt, Human
uagucauauuccacaagaccauaaauuaggggaccucuaacaauaaaucuagcuaagcugugugcuugauggaaaaagauua

SEQ ID NO: 4157109 - RNA, 60 nt, Human
uagucauuaauuaguaggaaggugagggacagcaucauaucuaacuaucuguuauggcug

SEQ ID NO: 4157110 - RNA, 62 nt, Human
uaguccccaggcucugacauagaugggagcacagaguugcuugugugagggccugggagcug

SEQ ID NO: 4157111 - RNA, 80 nt, Human
uagucccgucuauggcugcuacacuacaggagauuuagaaauuuguauaccuguuguuuagcacuuagaacaaggcacug

SEQ ID NO: 4157112 - RNA, 88 nt, Human
uaguccuuuauggugugauugcccagcaccauuguucguucaaaagaucugagagcaagggucuugggcuuacguuauuaaggcgcug

SEQ ID NO: 4157113 - RNA, 57 nt, Human
uagucucugcuuugcccuuggcuagcuagguggugugccaaguggggagagaagcua

SEQ ID NO: 4157114 - RNA, 83 nt, Human
uagucuguccaggauuuuaguuguaguuggugaggaggacagagcuuucuccauauuaacuaaaacuagaacccuggcagcua

SEQ ID NO: 4157115 - RNA, 91 nt, Human
uagucuucuuguauaaacacuuaaugagcacaagaugcccauuuauaaaugaagggcaucuugcuguuauguuuauguauuaaaagggcua

SEQ ID NO: 4157116 - RNA, 65 nt, Human
uagugaaauaggcagugauucauauuugugcaaacucccacugaugccugcugucugcuucccua

SEQ ID NO: 4157117 - RNA, 67 nt, Human
uagugaacuccacugaaggcagggacuucauucacugcuccaucccuaaugcuuacaggaguuccug

SEQ ID NO: 4157118 - RNA, 62 nt, Human
uagugacuaaugaacauauaauggucguagcuuucuuuacaacuaugucauuuaagucacug

SEQ ID NO: 4157119 - RNA, 68 nt, Human
uagugagaagaaguugcuuuccggcgggcagggggggcacccucuccaaaaauggcagcuuuucauua

SEQ ID NO: 4157120 - RNA, 86 nt, Human
uagugagagccgguugauguuuacuacucuucagaacaucuuauguucuagaaauccguaagugaaugcugcugcugcucuugcug

SEQ ID NO: 4157121 - RNA, 63 nt, Human
uagugcaaugugaggcaguacccuuaaugguaagagaaaggggaggguuggaauauugcauua

SEQ ID NO: 4157122 - RNA, 56 nt, Human
uagugcagguuaauaggacuuccugggaugauggaaauauucuauaaucugcccug

SEQ ID NO: 4157123 - RNA, 57 nt, Human
uagugccucggagacaagcagcuucugggugagcgcuaggcaguccugacgguacua

SEQ ID NO: 4157124 - RNA, 63 nt, Human
uagugcuaaugugcaauauagagguagcaauugugucuuagcucuguauuacauaucagucug

SEQ ID NO: 4157125 - RNA, 72 nt, Human
uagugcugaaauacagaaagaccucucgggaaaaguuugaguuucucuuaaugucucugugcuucagugcua

SEQ ID NO: 4157126 - RNA, 81 nt, Human
uagugcuuucauucuuuaguuuuaacugaaagcuaucugggcaagaguggacuuaaggaagcagauauaugaaggcggcug

SEQ ID NO: 4157127 - RNA, 82 nt, Human
uaguggaaugcaauuaggaagccuaaauuaagugguaauggagaaccagcucuugaaacugggguuuccacggcaaccacug

SEQ ID NO: 4157128 - RNA, 57 nt, Human
uaguggagguggucugugaacuacguuuugaaaaacacuaauagccccaccucacug

SEQ ID NO: 4157129 - RNA, 84 nt, Human
uagugggccucaguguuggagaccuucagggagagggagaaaggcagccauagcccugaaguguuaccagcauggagccuguua

SEQ ID NO: 4157130 - RNA, 69 nt, Human
uagugggugauuugaugaggaauaugauauuuccauagccugaaguacuuucucauaaaauacucauua

SEQ ID NO: 4157131 - RNA, 63 nt, Human
uaguggguguggaacugugagaccugaauucgaauccugguuucauauuuucauagcuuguug

SEQ ID NO: 4157132 - RNA, 67 nt, Human
uaguggguucuuggaccagcagcauugacauuaccugggauguuagaaaugcacccaagaccuacug

SEQ ID NO: 4157133 - RNA, 102 nt, Human
uaguggugugcaccuguagucuuagcuacucaggaggcugaugugggaggaucaauugagccugggaggcugaggcugcagugagcugugaucaugccacua

SEQ ID NO: 4157134 - RNA, 116 nt, Human
uagugguuaaaagcauggauucuaaaguuagacuguguucaaauucuccaaccuaccaucuaugugacuuuggacaaaugucugacuuucuuuugaccucaguuuucucaccacua

SEQ ID NO: 4157135 - RNA, 64 nt, Human
uagugguuucauagaaggcaaugguggacucuuagucaacugaagcuuggguggaacuuagcug

SEQ ID NO: 4157136 - RNA, 79 nt, Human
uaguguacagucucugaguuguaaaaaauagucauuccuuucugcuugaaagacuguauuagcuacucagggaauacua

SEQ ID NO: 4157137 - RNA, 70 nt, Human
uaguguacaguucugcaagauauuuuuuuaggcugaagaguaacaaggaagcaggguagagcugauacua

SEQ ID NO: 4157138 - RNA, 56 nt, Human
uagugucaaacagggauuagaaagcuaaugcuuuccauucucaugaauggcagcua

SEQ ID NO: 4157139 - RNA, 67 nt, Human
uagugucucggggcccaggauuccuggcacagggcuggcccagucuuuccugggcuuugguuuacug

SEQ ID NO: 4157140 - RNA, 56 nt, Human
uagugucuucaggagauaugagaaagcacuccccaugucucaaucagaagucauua

SEQ ID NO: 4157141 - RNA, 72 nt, Human
uagugugauaacagugaccucucagcaccgucaccgggcagggugcuccuguggucacuguuuucagaucug

SEQ ID NO: 4157142 - RNA, 55 nt, Human
uagugugggaggccuuagccuguucuuagaucaaacucugaggccaacuacacug

SEQ ID NO: 4157143 - RNA, 55 nt, Human
uagugugggaggggcauggagaugaauugcucacugcccaccaagcuccacacug

SEQ ID NO: 4157144 - RNA, 55 nt, Human
uaguguguuaucugccuuagcucgucagauacaugagaaaucagaccacacacua

SEQ ID NO: 4157145 - RNA, 68 nt, Human
uaguguuaccauaggucagaacguuauugcaacaaauguacaaaacuaugaugacuauggugagauug

SEQ ID NO: 4157146 - RNA, 73 nt, Human
uaguguuguuacaaggaagaauguagguaauucccaacuugcugaaaaccuacucauuuccuuuuaaaaacug

SEQ ID NO: 4157147 - RNA, 75 nt, Human
uaguuacacuugugguuuuagagaguauuugcugcucauuuggagucucaaaugcaaaauauaacccuguagcua

SEQ ID NO: 4157148 - RNA, 114 nt, Human
uaguuacagaaacuaguucuaggagcuuaaaaaaauuccauucugugccuuucaaaauauaagacagguuugguaauuuucuuguuguuccuugguuguucuagaaggugauua

SEQ ID NO: 4157149 - RNA, 79 nt, Human
uaguuacuuuugcucugaguccaaauucuccugcaggugucaccccucagcagagaaucucaggcacccagaagaacua

SEQ ID NO: 4157150 - RNA, 121 nt, Human
uaguuauugaaacgaggaugaauauuauguguauauguguuuauguaugcauuaugcuguauuagccacuguauacauagaugaugaacaagaaugaaguaguccuugcccucauuaauug

SEQ ID NO: 4157151 - RNA, 93 nt, Human
uaguucaaggaaaucaaaguggggaggcucagguggagggaugguagccuaaaguuaaggguuccugcuuugugccucacacuuagagaauua

SEQ ID NO: 4157152 - RNA, 80 nt, Human
uaguucccauguguggccuugggagaggucugagcuggacgguuagacccgcaggcucccacaggccaccguggcugcug

SEQ ID NO: 4157153 - RNA, 86 nt, Human
uaguucccucaucugcaugauuggggucaugauagcaucugugaagaguuguuauaaagacuaaauauguugagauaugggaauug

SEQ ID NO: 4157154 - RNA, 77 nt, Human
uaguugacuucucuaucccagcuccugguuuaauaauuagacauuccgggaauaacugcuuuggcagaagucagcua

SEQ ID NO: 4157155 - RNA, 71 nt, Human
uaguugguagaaagaguauagcuuuaggauugaaaucuuaguuuugaccuaguuuuauauaucacuaacua

SEQ ID NO: 4157156 - RNA, 129 nt, Human
uaguuggugcuguuugagugcaguaaugguggucagacugauuugcuauaggaagauaauguaauuauccauaguuuauagaucaagaaucugaggcacaaggaaguuacuuguaaaacagcucaccua

SEQ ID NO: 4157157 - RNA, 57 nt, Human
uaguugguuaccuuuucacaaggacuccuagaugggaggcaagagguaacuguacua

SEQ ID NO: 4157158 - RNA, 90 nt, Human
uaguuuagcaaaugcaauuuuaguuuuagcauccaugcuucauaguaaaggaauggauacucaaagguagaugguacagauguugagcua

SEQ ID NO: 4157159 - RNA, 58 nt, Human
uaguuuaggucguacaagcaaaggaagggagcuguauccuugcagaugagcugaacua

SEQ ID NO: 4157160 - RNA, 130 nt, Human
uaguuuauuuuuauauuuuacuucaguaguaaugacuauuaacuaugugcuagacgguguucuaaaagcauuacauagauucauuuaguuaauuuuuaugaaacucuuaugaaguagagaagauucuuug

SEQ ID NO: 4157161 - RNA, 77 nt, Human
uaguuuccugguucucagguuccagcccacugcugcuguagcaugugccugggcagaaugugggauccagagaagug

SEQ ID NO: 4157162 - RNA, 58 nt, Human
uaguuucucagggaggaaagaagaugagaauaacaucucucucucuccagggagauua

SEQ ID NO: 4157163 - RNA, 70 nt, Human
uaguuugauuccagauaauaguacugagugugaauggcuaaggaauauuuaguaucuggaaaucacauua

SEQ ID NO: 4157164 - RNA, 120 nt, Human
uaguuuuaacauauauaagcaguuuaagcuuuuuauaaacauuggacuagguuucauaccaaaaagcuauuucaaaguuugagacacuauagguuuggguugugacacaaauggagacug

SEQ ID NO: 4157165 - RNA, 77 nt, Human
uaguuuuaagaagucuauauuggagcuuauuuaccguaauauauuguaaaugaguaauauagcuguuugccaaacua

SEQ ID NO: 4157166 - RNA, 56 nt, Human
uaguuuuaagcugacauuguuccauaugugauaggaacaacuuaguugagagacua

SEQ ID NO: 4157167 - RNA, 62 nt, Human
uaguuuucugucccagugauccugagugcuccccagaugucaucacaggacugggagaacug

SEQ ID NO: 4157168 - RNA, 60 nt, Human
uauaaacagguccuugcaauaaucucaaaugguucaggccaguuuugcaaggcguuuaua

SEQ ID NO: 4157169 - RNA, 76 nt, Human
uauaaagaauccagaagagacacguacagaaaugacccuucagaacuguuuauggcugugucuuccuuucuuuaug

SEQ ID NO: 4157170 - RNA, 65 nt, Human
ucaagaugccuggugaguggucagauggugauugggcucccccuguacagucucuguggcacuga

SEQ ID NO: 4157171 - RNA, 78 nt, Human
ucaagcaccuaccguguguaugguggaacugcuuugcauacguuagcucugaucuuuacaacaaaguaggugguauga

SEQ ID NO: 4157172 - RNA, 69 nt, Human
ucaagcaggguagcaagcuggugcuggauacuguacacgcccuacccaaauucccuucucccuguuuga

SEQ ID NO: 4157173 - RNA, 94 nt, Human
ucaagcaucaggaauggaaauggagugugcuugcuuuguuugaucuuucaagaaccagcacccaauauguccauucugccauuuccugucuugg

SEQ ID NO: 4157174 - RNA, 68 nt, Human
ucaagcaugcaugucugccaguugcuuagguagcugaucuaaauggguuggaggcagcaaagcuguga

SEQ ID NO: 4157175 - RNA, 91 nt, Human
ucaagccaaaugugcugggauuuugucaaauuccaaauguuggaacacauuucaggauguuugacugaguuuggcagaaucaguaccuuga

SEQ ID NO: 4157176 - RNA, 63 nt, Human
ucagcccuagccucaguccagggcaccacacccaagggccccacacugaugcuggugguguga

SEQ ID NO: 4157177 - RNA, 81 nt, Human
ucagcccugcucucccuaccuccucucugcucuugggugguggcaguccuauuggcaggaaccgaggaggggcagggccga

SEQ ID NO: 4157178 - RNA, 60 nt, Human
ucagcccugugugcuuguguuccuuagagcucuccuucaaagagcgccgggcagggcuga

SEQ ID NO: 4157179 - RNA, 68 nt, Human
ucagccuaagucaguacucugccaugccguuaguaagauggcccuggaaagagcuugaguuauucuga

SEQ ID NO: 4157180 - RNA, 91 nt, Human
ucagccucuaugaucuguauuuuguauuguuguauucauuaucacaggaguugaaaccucaggccagugggaaauagggauauggaacuga

SEQ ID NO: 4157181 - RNA, 57 nt, Human
ucagcuaggcacuucucacugagagucaugcaguguggucggauagugcugggcugg

SEQ ID NO: 4157182 - RNA, 130 nt, Human
ucagcuaugggaaaguaauuacaccaaagaaacuggcaaaugcuacauacugggccucuuucccucccacucccagagagccaguuguuaagcacuuaccaacaccacuuuuccugaucucucccacuga

SEQ ID NO: 4157183 - RNA, 57 nt, Human
ucagcuauuuugccuaucaugguaguucacauugauuauuauguuguaaaauguuga

SEQ ID NO: 4157184 - RNA, 68 nt, Human
ucagcuccuuagugccucugcacgagacagagaaauuacuucacuccuccaguagguucuaagacuga

SEQ ID NO: 4157185 - RNA, 84 nt, Human
ucagcucgguucagauaaggggcacagcagagcuugccugggacuucuuccagagcaccugcucauugccagaaccaaggcuga

SEQ ID NO: 4157186 - RNA, 55 nt, Human
ucagcugaugaagaugagcucuuuuaagugaauuuugaaagauuucauuagcuga

SEQ ID NO: 4157187 - RNA, 80 nt, Human
ucagcugcauccauguugcugcaaaggacaugaugucauuccuuuuuauggcuuuguaguauugcauggugaugugcuga

SEQ ID NO: 4157188 - RNA, 62 nt, Human
ucagcuguccgcagcccacuuccuaaucagaucgagagcugggugggaacgcggacagaugg

SEQ ID NO: 4157189 - RNA, 78 nt, Human
ucagcuguuggccaucugccucaaugugugcuuuugaagcccagcagauugcacauucuguguagguggauagcuuga

SEQ ID NO: 4157190 - RNA, 74 nt, Human
ucagcuuaguugauagccaaaauuuaucgcucuguucuuaaugagcgacuauuggcuucucagguuuuugcuga

SEQ ID NO: 4157191 - RNA, 61 nt, Human
ucagcuucuuucacuuaacaugaugcuugugagauucauccauguugguguggguagcuga

SEQ ID NO: 4157192 - RNA, 71 nt, Human
uauugcuacuuugccuuccaaagucuugccuucuacagcuacauaacuccaggaaaucagaagugguaaug

SEQ ID NO: 4157193 - RNA, 111 nt, Human
uauugcucuucagggauuugugaacacgaaccaagacaguaaauucuaugaaaacaaugguacaauauuugcuucuggaacuuucuguucacccacucaagaaaugcagua

SEQ ID NO: 4157194 - RNA, 71 nt, Human
uauugcugaugguauuaugcuaguaguuuuucuuuaaccuuaagaaaacuaaauaaugccaucugguggug

SEQ ID NO: 4157195 - RNA, 62 nt, Human
uauugcugcuggaaccaggaauuugaaguauugcagcuuagaaauaaugguuucaguuaaua

SEQ ID NO: 4157196 - RNA, 60 nt, Human
uauugcuggugcuguucugaaucaccaccaagugggcuuucucaacagcaaccgguagug

SEQ ID NO: 4157197 - RNA, 66 nt, Human
uauugcuuuccacaagugauaucuagcugguuuaacaaaccagucccuguuguuugggagacaaua

SEQ ID NO: 4157198 - RNA, 67 nt, Human
uauuggaauaguuauuagagaagcugguauaaagggauaccacguuuuucuagaauuuaacuuaaua

SEQ ID NO: 4157199 - RNA, 68 nt, Human
uauuggacaagacagaacagaauaauuguuggaugaaucuacgguucugugguucuguucguuuagua

SEQ ID NO: 4157200 - RNA, 129 nt, Human
uauuggcaccaccuggggaguuuugauaacaacugaugccuggguucccaccccaaagauuauaauuuaauuggucuugggugugaccuuggcauugggagugcuacaaauugccaggugguuccuaug

SEQ ID NO: 4157201 - RNA, 88 nt, Human
uauuggggcugaguguauaauauuuaguaguuuauuauugaaacaguaauagagauuuuaauguccagugcauaauagguccucagua

SEQ ID NO: 4157202 - RNA, 82 nt, Human
uauuggguucgugcaagagugauugcaguuuuuguaaugaaaauauggcaagaaccucaauuauuuuugcaccauccuaaua

SEQ ID NO: 4157203 - RNA, 130 nt, Human
uauuguagaaggguuacaguggccacugugagugauaagccugcacaugugugcgccuguauguauaucugcuacaugugcugugugugcacacucucucacacuggugucuguguuggugucugcuaug

SEQ ID NO: 4157204 - RNA, 73 nt, Human
uauuguauuuaagaagcuucugcuaaugccuagcccaaugauaggcauuaaggaugagcuucucuugcugaua

SEQ ID NO: 4157205 - RNA, 56 nt, Human
uauugugcauguugaauaacuaauuagcaaguuugguugaauaaauauguauaaua

SEQ ID NO: 4157206 - RNA, 59 nt, Human
uauugugccagguaauguguuccuuuacuccaggagcaaaaaucacaucugguacaaua

SEQ ID NO: 4157207 - RNA, 87 nt, Human
uauuuaaacaacaguuuagguauuuguagcauguagcugugauaaaaaucaugacagugguuacaaauagcuggauuuugauaaaua

SEQ ID NO: 4157208 - RNA, 83 nt, Human
uauuuaaauccacuuaagagaacagcuauagaagaaugacuguuuaggacuguggcucuguuuucuuguuugucauuuagaua

SEQ ID NO: 4157209 - RNA, 124 nt, Human
uauuuaauaauaguugacauuagauugaagagauauuucaguuccacacuuaggauauuggucuuuauuugguaggaaauuggaaacucuucacugcuauggaugacagaaguuuuaauaaaua

SEQ ID NO: 4157210 - RNA, 97 nt, Human
uauuuaauguauguguaaagcauggugauuguuucuucuuuggacagugauguucuaaagacaaaugacauuacggcuuugcaagcugcagaaagua

SEQ ID NO: 4157211 - RNA, 98 nt, Human
uauuuaccucaucagggagagcuuuguuugauugucagaaaauagaacauguacauuugucugucauaaacacacacaagcucuccagagcauaaaua

SEQ ID NO: 4157212 - RNA, 98 nt, Human
uauuuaccugggucuuccccgagcucagcugagcuccagcucauagugaaucacauguugggaaucagcugagagcuggcccugaagaucccugaaua

SEQ ID NO: 4157213 - RNA, 111 nt, Human
uauuuacuauaaaaauguuugaaaugccuuuaucaucugcugaaaaguaaucauagaauugacauuauugcagauggugugagagauuuuuaagauuaaugauaguagaua

SEQ ID NO: 4157214 - RNA, 56 nt, Human
uauuuaguuuaggaaaaguagguaacugcuugcuuaugagacucuuaggcuaaaua

SEQ ID NO: 4157215 - RNA, 73 nt, Human
uauuuauagaguagauuauuaaccgcaguggugcucauuccagggcccugccggguauuuugugcuauggaug

SEQ ID NO: 4157216 - RNA, 61 nt, Human
uauuucagugcacaaugacgguggcuuucagcucaugaaaggcuuccucgugccuuagaua

SEQ ID NO: 4157217 - RNA, 55 nt, Human
uauuucaguugcguuucccgaguagccccagcaacaggagaagcaucuagaaaua

SEQ ID NO: 4157218 - RNA, 55 nt, Human
uauuucauggacaucuuuggaggccuagugguuuuagguuucacuccauaaaaua

SEQ ID NO: 4157219 - RNA, 68 nt, Human
uauuuccacaccuuuugaaucugggcuggccuugugacuugccuggacucuugaagguggugggagug

SEQ ID NO: 4157220 - RNA, 68 nt, Human
uauuuccagaggaguauagaaggaauagcaauaucuuugauucucaggucugauacuuuuuugaaaua

SEQ ID NO: 4157221 - RNA, 58 nt, Human
uauuucugauugcucaugaggcagaauuggaaagggaaaaaugcagcaaucagaaaua

SEQ ID NO: 4157222 - RNA, 55 nt, Human
uauuucugggaguucagaaauuuuaggccauuuuuggcuaaacuccuaggcaaua

SEQ ID NO: 4157223 - RNA, 67 nt, Human
uauuucuuauauugggucauggauacuugaguauuuauucucuauaucuuuuucaauguuggaaaua

SEQ ID NO: 4157224 - RNA, 69 nt, Human
uauuugagagugugaaugguauaaguugaggguaugaauguuggaaaugaacauauucaccucuaaaua

SEQ ID NO: 4157225 - RNA, 67 nt, Human
uauuugaguaggcuuccuuucacuacccucaguccguguggccugggguggggcaagccaccaugug

SEQ ID NO: 4157226 - RNA, 58 nt, Human
uauuugcaagcaugcacaaaagcagucacacaaaccugcucaugaagcucugcaaaua

SEQ ID NO: 4157227 - RNA, 77 nt, Human
uauuugcugagagaacucuuuaucuguggaaugugcuuaguaggauauagcugguuaaggguugcuuacaguaaaua

SEQ ID NO: 4157228 - RNA, 59 nt, Human
uauuugcuuuccugaaucaugaacuuguuucuacaagcauuggaagaggaagggaaaua

SEQ ID NO: 4157229 - RNA, 70 nt, Human
uauuuggagugcaacacaugccaccuuagaccauuagugcucccaguggccugugcugucuccccaaaua

SEQ ID NO: 4157230 - RNA, 116 nt, Human
uauuuggaguuaaaauguuagucuacauagauggaugauuguaacuuuacugccauuaaaaagauuucagauugcauucaugcuucuguguacacauaaugaaaaauggacaaaua

SEQ ID NO: 4157231 - RNA, 57 nt, Human
uauuugggaacgcugaaaaaggcauguguaucacucucauaucaguguuccagaaua

SEQ ID NO: 4157232 - RNA, 84 nt, Human
uauuuguauggaauguugucucuuuauaucccauuucaaaauggcaggagauugaaacaggaaguaaacagacaauaauaaaug

SEQ ID NO: 4157233 - RNA, 81 nt, Human
uauuuguuaagagaguuggaggugucaggauuuagguauacuguauguggucugacuugcuuuggacagcucugccaagua

SEQ ID NO: 4157234 - RNA, 95 nt, Human
uauuuuccugaguaggcaauugggcaagaggguucuucagcccaacugcgacugguugaaugcucacaugccuaggucacccuacaagggaagug

SEQ ID NO: 4157235 - RNA, 91 nt, Human
uauuuucucuguuuuggaguauuuaacuggaaacacaaugauguaauuacaugauuaauuuuuccaguagguaaauaauaacaaggaaaua

SEQ ID NO: 4157236 - RNA, 76 nt, Human
uauuuucugauuauuuugauuuucccaguggaauaugaaguuaggucgucagcugagaaucaagauggagagggua

SEQ ID NO: 4157237 - RNA, 79 nt, Human
uauuuugcagaugaagagacuggggcuccaggaauugacuuucccagaaucccauugucacuucagggcucucaagaug

SEQ ID NO: 4157238 - RNA, 103 nt, Human
uauuuuggccucaaugaaagugcaaagagaauuuccauaauuuacaaucuacuuaggugugaaauugagaaacuuucaccuaauguucaauugggacagauua

SEQ ID NO: 4157239 - RNA, 64 nt, Human
uauuuugugaccuagagcaauuuauucagguucucugagccacaguuuucugaguuauaaaaua

SEQ ID NO: 4157240 - RNA, 74 nt, Human
uauuuugugugaggaacaggacuagagcacuaauuuacuuagucuuuuauguauuguuucuuaaaacaacaaug

SEQ ID NO: 4157241 - RNA, 56 nt, Human
uauuuuguuguuuauuuuguuuucuuucucuggauaauaauuauggcagcaaagug

SEQ ID NO: 4157242 - RNA, 85 nt, Human
uauuuuuaaagaugcuucuggcagcccuaaaaagacgaaauauaagaaguuagagacgggaugccagagaguaucauggagagua

SEQ ID NO: 4157243 - RNA, 122 nt, Human
uauuuuucaaagauguuuauuuucuguauuucuggcaguguuuugcuuagaaaagcugcugacacgcucucucagugguggcauuccagaccccugcagaaaccccuuacaugagaaaaaua

SEQ ID NO: 4157244 - RNA, 96 nt, Human
uauuuuucccccaacccuaucucauuucacucauucauguuacuuucauggcccauguagguaugugggugagaggaggagguuguuggaagaaug

SEQ ID NO: 4157245 - RNA, 62 nt, Human
uauuuuucuaauauuauuguugaaaaauggaugcccaugaaaaaaugguaauuagagaaaug

SEQ ID NO: 4157246 - RNA, 63 nt, Human
uauuuuugagcuuguagcauugcuauuggaccuaaggauauagcaaugaucaagacagacaua

SEQ ID NO: 4157247 - RNA, 69 nt, Human
uauuuuugauauuuugcauguacauguuugcuguucuaggcagcacuucagcauucagauuugggaaua

SEQ ID NO: 4157248 - RNA, 75 nt, Human
uauuuuugucugaacugcauuugcuccuuaaaugaagaucacccugaaggaggcaacugagauuuagaaaaaaua

SEQ ID NO: 4157249 - RNA, 99 nt, Human
ucaaaaauuugcaugcauuguaauagaugccagacauuaacgacuaugccagacauaugcauuucuuccuggauggcuguuacaauauagcaaggauga

SEQ ID NO: 4157250 - RNA, 82 nt, Human
ucaaaagauugcuuggugaguauggacacagagaaauuagaaugagcugugugaucuuuauguugauuuccucaggcauuga

SEQ ID NO: 4157251 - RNA, 89 nt, Human
ucaaaaguaaucucuuaccuuaaauggcauagaggugaagguaagaaaaucucuuaccuuaaaugccauagaggugaaggauuugguga

SEQ ID NO: 4157252 - RNA, 109 nt, Human
ucaaaauauauuuguguuuaugcuaauauguucuauucugauuauuauagugcaaggacuagaaauuaguugaacaaguuaaguaaaauggccagcuuauguuaaguga

SEQ ID NO: 4157253 - RNA, 64 nt, Human
ucaaaaugcuucugcucauauuucauuccucugugacuauuggagugagcagcagaugccuugg

SEQ ID NO: 4157254 - RNA, 78 nt, Human
ucaaaauucauguaaaugaggugaaauugcauuaaagcggccaacauaacaguuucacacaacauuugcaugauuuga

SEQ ID NO: 4157255 - RNA, 66 nt, Human
ucaaacagaaauuguucaugcugucauggagaagguauuauccggaugaacguguuucuguguuga

SEQ ID NO: 4157256 - RNA, 58 nt, Human
ucaaacaggacuacauucucauauaauuucccaagaaagaguaaguagucuugugugg

SEQ ID NO: 4157257 - RNA, 58 nt, Human
ucaaacauguuagcagucuguguguacuuauuauacaugcaguaguguucauguuuga

SEQ ID NO: 4157258 - RNA, 68 nt, Human
ucaaacauugcuaccagagguuuauuugccagagagcagguaaacuuccugcaguagucgaaguuuga

SEQ ID NO: 4157259 - RNA, 92 nt, Human
ucaaacuauagguugauuugcuugcugucaauccuuggaauaagaauauggauaggcugagcuaagagagcuuauacaauggaaugguuuga

SEQ ID NO: 4157260 - RNA, 81 nt, Human
ucaaagaucagauaguuguagauauguggcauuauuucugagggcucuguucuguuccauuggucuauaucucuguuuugg

SEQ ID NO: 4157261 - RNA, 56 nt, Human
ucaaagauuuccauuucuagcucauuggccauucccaugugcagggaaaucuguga

SEQ ID NO: 4157262 - RNA, 69 nt, Human
ucaaaggaucguagaagcuacaaggagacagguugcaaaagauaaguguccuucucuaugauugucuga

SEQ ID NO: 4157263 - RNA, 60 nt, Human
ucaaaggcaagguucaccgugcuaugaagcuuaucacagggcuuagaacuuggccucuga

SEQ ID NO: 4157264 - RNA, 62 nt, Human
ucaaagguuaacucuguuguuccauuucaaaagaaaauaucaacaggaaaguugaaguuuga

SEQ ID NO: 4157265 - RNA, 55 nt, Human
ucaaaguaccagagugaacugaccucuugagcuccaucaacucugugugccuugg

SEQ ID NO: 4157266 - RNA, 62 nt, Human
ucaaagucacaacucucuaauuaaugaacugcgagcuucaguuuggacaaguugugguuuga

SEQ ID NO: 4157267 - RNA, 61 nt, Human
ucaaagucagccagcuaguaggucagggagcaguuuccuaccugggugugccugacuucga

SEQ ID NO: 4157268 - RNA, 79 nt, Human
ucaaagugaucuucuggcaucugcuguuuuucagguguuuuuagcuuaaacaguuaacaugccagaauaucauauuuga

SEQ ID NO: 4157269 - RNA, 85 nt, Human
ucaaagugcaagcccagcugaaagcauuuuuuuaguaauugugacggaaugagugugaaguuagcucagugugugugcacuuuga

SEQ ID NO: 4157270 - RNA, 74 nt, Human
ucaaauacuauuuguaaagugccugguguagugccuggcacauuuuaagcgcuauauaaguuugucaaguuuga

SEQ ID NO: 4157271 - RNA, 59 nt, Human
ucaaauaggcuuguagugacuggacuggcaacccaaucauuaccguaauguuuauuuga

SEQ ID NO: 4157272 - RNA, 88 nt, Human
ucaaaucuuauauaaucggccauaaauggucagauauugguaauuucuuguggcugaacuaaugugcuguuugguauaagaacuuuga

SEQ ID NO: 4157273 - RNA, 66 nt, Human
ucaaaucuuucacguauggucaugucugccacauucaaacagacaagaaccaaagaaggauauuga

SEQ ID NO: 4157274 - RNA, 62 nt, Human
ucaaaugagaggcagggcagcucuggcuucagguggcagaaauggcuugcccucucguuugg

SEQ ID NO: 4157275 - RNA, 56 nt, Human
ucaaauuauuuaggauagugcuugcaaaaggguaguguaauuucuagguaauuuga

SEQ ID NO: 4157276 - RNA, 99 nt, Human
ucaaauugcaauuuucuguagaugaaauucaguuucaaucauuguagucuugucugucagcuaucgugguugaaaugaaacucaaugcgugugauuuga

SEQ ID NO: 4157277 - RNA, 56 nt, Human
ucaacaauaggauauagcaggugucagucuuuggccugcaaacaaauuauuguugg

SEQ ID NO: 4157278 - RNA, 76 nt, Human
ucaacaaugguaucaccucacagaauuauuuucaggaaugaaacagugccuggcaugggguguuacuuguuguuga

SEQ ID NO: 4157279 - RNA, 65 nt, Human
ucaacacugcaguagcacauaguaaauguucaguaaaugccaucgauuguugcugcugcuguuga

SEQ ID NO: 4157280 - RNA, 129 nt, Human
ucaacagaaaucccauauuaaaugugccuguugccuaggcagagugaagcauuucuuucuauugcucaucaucgauaaagagaaaacugcuacgcuuucuguagcaggcaggacugugagggaauugga

SEQ ID NO: 4157281 - RNA, 69 nt, Human
ucaacagauuuuuucgcucaauggcugcuugaaguucuacucacacaguacauucgaaaaauucuguga

SEQ ID NO: 4157282 - RNA, 73 nt, Human
ucaacagcuccauggagagcagccuagagccuggagauugaaauccuggcucugcugccuccuagcuguguga

SEQ ID NO: 4157283 - RNA, 57 nt, Human
ucaacaggaacgggaggauuaucuacuucuaaaauaguucauucacguagcuguuga

SEQ ID NO: 4157284 - RNA, 128 nt, Human
ucaacaggcaggcacugaguauucaguauaaauuuuugagcagggaauccaccagaagaacuaugcaucuggaggauuaaucuggaaagauuguguagaauguuaugcagugaaagagucugagauga

SEQ ID NO: 4157285 - RNA, 57 nt, Human
ucaacagguucaagccuugcagcagccaggcugcuggagucucuugacccuggguga

SEQ ID NO: 4157286 - RNA, 57 nt, Human
ucaacugcagaguuguuauuuuguuuccaugauauggauaugcaacuuugggguuga

SEQ ID NO: 4157287 - RNA, 65 nt, Human
ucaacugcuauuuuauaacagaagacauacugcuaaaaaugucucuaagauaggaauacaguuga

SEQ ID NO: 4157288 - RNA, 72 nt, Human
ucaacugcuucugugcugucucagauaagcauuguaagcaauauugucuuucagaugcacagaucauaauga

SEQ ID NO: 4157289 - RNA, 61 nt, Human
ucaacugguucuugaauguauauaggguuuaucaggauauacagaaagaauucaagucuga

SEQ ID NO: 4157290 - RNA, 75 nt, Human
ucaacuuacugguuucauacagauuauucaugggaaggcaacauguuccgucaguuaucugagaggcaaaguuga

SEQ ID NO: 4157291 - RNA, 78 nt, Human
ucaacuuguacaaaguccugcuucauacucggaaggcauuuauuugcuuaugaaggaucagguacuuggacagguaga

SEQ ID NO: 4157292 - RNA, 55 nt, Human
ucaagaaagggcuucaccaggaugaucaaugcaaauggauauggagcuuucuugg

SEQ ID NO: 4157293 - RNA, 110 nt, Human
ucaagaagccaucuggagggcuuccccuuggaaucauccuggucugcaaaaccagucaacuguucuggagauaagagguagagcccaaaguucucuagucagcaucuaga

SEQ ID NO: 4157294 - RNA, 129 nt, Human
ucaagacaucucuggaccuaccacuuuggguaggcauggagggaaaggcuggcguuuuacaggugccaaagauagcuucaggcuuugggaaugccacuuguagaccaaggugguggcagaauguccaga

SEQ ID NO: 4157295 - RNA, 88 nt, Human
ucaagacgucagucauggcuguagucaucugaaggcuugccugggucugaagggugguucucggauggcucacccacauggcucuugg

SEQ ID NO: 4157296 - RNA, 89 nt, Human
ucaagagauuuugaaaauccugaauacuguauuccucuuuugggguuucccaaugaacauuauuguauuaaggauucaaguacuccuga

SEQ ID NO: 4157297 - RNA, 60 nt, Human
ucaagaguuuccaugcucugugcuaauucccugaauuguuaugcgggcuggagcuuuuga

SEQ ID NO: 4157298 - RNA, 57 nt, Human
ucaagaugcauggguggcauaaauguauuucauaggcguucucacccauguaugugg

SEQ ID NO: 4157299 - RNA, 129 nt, Human
ucaagcacuguauguaauguaauggcagaagcacaaauuuaguuaggggaaaaacgacagggguccucugacucuuuucuucuaauuguucugccucuagcauuaccauuaucaguauaauuagcuuaa

SEQ ID NO: 4157300 - RNA, 56 nt, Human
ucaagcaugguauucuguuagcucugugauuuagauguaaacuuuaccagcucuga

SEQ ID NO: 4157301 - RNA, 62 nt, Human
ucaagccaguggugagaagauagcaaggaacuagaaaagcuacauagaaaccacugguuugg

SEQ ID NO: 4157302 - RNA, 109 nt, Human
ucaagcccauuauuaacacuacagauauguuuaaugccucaguauuugcacguuugcaaaagcuguguccuagagguguaaaugguagugcuaaauuacauuggcuuga

SEQ ID NO: 4157303 - RNA, 67 nt, Human
ucaagcgcugcugauggggugauuugcuugcaaugggaugacacagcaagcccauuaccaugcuugg

SEQ ID NO: 4157304 - RNA, 64 nt, Human
ucaaggaacuaaauaguucuggaaugacuucagggaaagugguuggacuucaguuaggccuuga

SEQ ID NO: 4157305 - RNA, 82 nt, Human
ucaaggccuugaaagccuugagauccuauaguuguuuggacacaguuaaaacucagacucaaggccaaguucaugcucuuga

SEQ ID NO: 4157306 - RNA, 72 nt, Human
ucaagguccacaacugguaaauggcaaaacugggauuugaauccaggcuucagugucuaguuguggaauuga

SEQ ID NO: 4157307 - RNA, 82 nt, Human
ucaagguuuguaucauucauuuugugugugugugugcugagguaugucaaguaaugauuauguacagaaugugcagagcuga

SEQ ID NO: 4157308 - RNA, 90 nt, Human
ucaaguaacugauucacaauagcuauguaaccugaagaggcagcauuguguagcgucuaaggacauuggcuuuggagucaggcugccuga

SEQ ID NO: 4157309 - RNA, 104 nt, Human
ucaaguacgucuuguguucauuugagauguaagguaugcuuacuugaggaagaggauucucuuuccuaguucuuaugucuguacaucuccacaagauagucuga

SEQ ID NO: 4157310 - RNA, 84 nt, Human
ucaaguauuuuaguugagauugucacauuuuaagauaagcuuugacaaauaagcaaaauguugaggauaucagaaaauauuuga

SEQ ID NO: 4157311 - RNA, 57 nt, Human
ucaagucuggagaucuggaacuucuuccugaagcuccauguuuagccagauaauuga

SEQ ID NO: 4157312 - RNA, 75 nt, Human
ucaaguggugugagggcaacacagcaaacuuacccuuuuuaggccguuuccuuuuucugcccucaaucucuguga

SEQ ID NO: 4157313 - RNA, 63 nt, Human
ucaaguuuuucacauugcuguuguacuuuuuucauagauaauaacuccuguugaagaacuuga

SEQ ID NO: 4157314 - RNA, 82 nt, Human
ucaauaguauuccuuuaguguugcuuaccaaccaugguuucacuguggaaaccagaagugaucuaaagaauauugaaguuga

SEQ ID NO: 4157315 - RNA, 69 nt, Human
ucaauauaguuucgucaauuguaacaaauguaccacuguggugaagauguuaaaauugggggauguuga

SEQ ID NO: 4157316 - RNA, 69 nt, Human
ucaauaugaaauucugccugaaugaagcccuaaaaucuuuagggacaaauuugcagaaccagauauuga

SEQ ID NO: 4157317 - RNA, 70 nt, Human
ucaauauuauauuuaagauggagauuucaaauauaaguuugaaggaggcuccuuuuuaaaauaguacuga

SEQ ID NO: 4157318 - RNA, 114 nt, Human
ucaauccuacuaaacauuuuauuucaguucacauucuucucuuucuaccagaaauguucuucucuauguggggagaagcaauagacucuagcaauggauuggcuguaggguuga

SEQ ID NO: 4157319 - RNA, 81 nt, Human
ucaauccuuaaccucuuagugcaucucauuaguuugguaauuuauucaucaaaaaugcacuccaagauguggugggauuga

SEQ ID NO: 4157320 - RNA, 58 nt, Human
ucaaugagcacucuggggauacaacauggcaguccuaugauuucaagagguuuauugg

SEQ ID NO: 4157321 - RNA, 86 nt, Human
ucaaugaguuaugucucccagaagucaugcccuugagaaaucacaaccuacauugacucugggguugaccagaugacuugcuuuga

SEQ ID NO: 4157322 - RNA, 75 nt, Human
ucaaugcugucucugcuauccaaagguagucagucaacccugaaacucuuucuuuggaaguaaagucagcaggga

SEQ ID NO: 4157323 - RNA, 70 nt, Human
guuuuagaggcuguugucuguucuaggcuuaauauaugggguagaacuucuuacagcuaaguuuugaaac

SEQ ID NO: 4157324 - RNA, 85 nt, Human
guuuuagauugggguggugagggcgcaggggcccgguaggauucucuaacagggcagcagccacucauuuagcaacaggagaggc

SEQ ID NO: 4157325 - RNA, 107 nt, Human
guuuuagcauccaucaagcucccucugagcccucuuuugcagccccaccagccugggguuuguugagagagaggcuccccuugccgccugaguggguccucuggaau

SEQ ID NO: 4157326 - RNA, 71 nt, Human
guuuuagcuuuagaaauauucucagagguuuucugaacugaaucuuugauggaugcuucugaagcuuaugc

SEQ ID NO: 4157327 - RNA, 61 nt, Human
guuuuaggagucaugguuauuuaauaugcuuauauuaggcauucaugcagcuccugugugc

SEQ ID NO: 4157328 - RNA, 76 nt, Human
guuuuagggcagcagcucucaaaguggucuggauucuccugugagucccaagauccucucaggcgcugcauaaggc

SEQ ID NO: 4157329 - RNA, 82 nt, Human
guuuuaggggaucuugggaguugugauuuggacugggugccucuauuucucaggguccaggucccaugugguccuuuagaac

SEQ ID NO: 4157330 - RNA, 86 nt, Human
guuuuauauguuuuggaauaacuuucacaucacacugacuaaaguaugguagcuucuaguugugaaaucuagucaauguguaaaac

SEQ ID NO: 4157331 - RNA, 78 nt, Human
guuuuauauuuuaucaguagugauuucugagaccuauucauucuaucucugaaaucuacgauuagugaaaaugaaaac

SEQ ID NO: 4157332 - RNA, 75 nt, Human
guuuuauuugacuucuugcuaugcuugcauucuaccaagacugugccuucagcuuaccgaugagucagaaaggac

SEQ ID NO: 4157333 - RNA, 87 nt, Human
guuuucagcccaggaguuugaggcuacagugagcuaugaucauaccacugcacuucauaccacugcacuucagccugggcgacaagc

SEQ ID NO: 4157334 - RNA, 74 nt, Human
guuuucagggacuugguuauacuccaggaaccagugaugauauuggcuccugauauccaggaagcuuugaaggc

SEQ ID NO: 4157335 - RNA, 77 nt, Human
guuuucaggucuaggugugauggguauggugacaagucugcuguugcugugcugcuagaccuggauuccugaacaac

SEQ ID NO: 4157336 - RNA, 129 nt, Human
guuuucaugaaacagagcauagcaggcuacuuggagagcaggaagcugcccaagacugaagcaucuacuuucuggaucucucaggagccuccugcucucugauucucccugcacaccugccucauuuuc

SEQ ID NO: 4157337 - RNA, 56 nt, Human
guuuucaugcccucuuguagguuaucugugucauuccuacuuuaggcacugagaau

SEQ ID NO: 4157338 - RNA, 70 nt, Human
guuuucauguucuguggaaauaagguagauacuguuaucucaccuguauuaauacagaacucuguauaac

SEQ ID NO: 4157339 - RNA, 77 nt, Human
guuuuccccuguucuguagugaguuugagcuuaacucugucugccauaacauuugucaucacagagcuggauaggac

SEQ ID NO: 4157340 - RNA, 55 nt, Human
guuuuccugagcccagagaugcaugaaaaauggggaaaaugaggcuuagggaggc

SEQ ID NO: 4157341 - RNA, 77 nt, Human
guuuuccugggcucuuaaugaaugcugcuguauuucuccuugaagagguucaguaaauguuaguugauuaggauaau

SEQ ID NO: 4157342 - RNA, 123 nt, Human
guuuucggucagucucuuccuuugggguggaggaggcaguuguugcugagcagcugagaaagcacugccacauacgcugccccuccacaccuagagcggugcaggagagcacugaguguuggc

SEQ ID NO: 4157343 - RNA, 80 nt, Human
guuuucuauggugcuauuguuucuaugcucugaggccucuccaggugucagugucuaugaagaauuuauuuauggaaaac

SEQ ID NO: 4157344 - RNA, 55 nt, Human
guuuucuggcaguuauuccuuauuucaguagggaacaaauucacugucagaaugc

SEQ ID NO: 4157345 - RNA, 75 nt, Human
guuuucuguauugccugcuaggcccugcugggugauuaagccacucacucagagucuuacaggccacucgaggac

SEQ ID NO: 4157346 - RNA, 62 nt, Human
guuuucuuugaaugcuucuagaaccacaaaauaucagggcagaaaggcaucucagagaaaac

SEQ ID NO: 4157347 - RNA, 86 nt, Human
guuuugacuaaauagugcaacaucuacguagaaaacauaccccaaacuugaguuuuccuggguugugcauuguacauugucaaagc

SEQ ID NO: 4157348 - RNA, 86 nt, Human
guuuugacuggcucuaucaggauaaauugacccuugcuucccaugguauuuauggcauuuauccuugggguagagccaguaccgac

SEQ ID NO: 4157349 - RNA, 76 nt, Human
guuuugagcuuuaugcuuccuacaagcuuguaccaggugauuacaccuauagagcguagaagguaaaguauaaaac

SEQ ID NO: 4157350 - RNA, 67 nt, Human
guuuugauucacaggacauuagucuuguugggaugacuucuuacagcaacucuccugugcucaaaau

SEQ ID NO: 4157351 - RNA, 74 nt, Human
guuuugcagcucuucagugacugcucugggacagguaggcuguuagagggaggucuuugaggggcuuagggagc

SEQ ID NO: 4157352 - RNA, 86 nt, Human
guuuugcaugauccagaguagcuauuugugccaaauuauuucuaagccccugcuuuuuaacauauagguuacaggaucgugaaaac

SEQ ID NO: 4157353 - RNA, 116 nt, Human
guuuugccuacauccaccugcauucccaguuaugagaggucaacuccuaugagcuuuguaugguucaguggauauuucuguggcuggaaggugaugcauggugaugaaaguaaaac

SEQ ID NO: 4157354 - RNA, 114 nt, Human
guuuugcuaugucuuaauguauucaauguuuucaacugacaaguaaaauuuguauguauuuauuguguacuauauguugcauggaaauauguauacauuauggaauggcuagau

SEQ ID NO: 4157355 - RNA, 112 nt, Human
guuuugcuuaauaaauaaauuacacagccaauguauuauacauaauuuguguccucguggauuugagugauauauaaugcaugguccaagucauuuauuuauuaagacuaac

SEQ ID NO: 4157356 - RNA, 57 nt, Human
guuuugcuucucauguuaagugccaacauugcaucucuuauguuggagaggcagggc

SEQ ID NO: 4157357 - RNA, 96 nt, Human
guuuugcuuuagguauuauaaaauaguguauuuuucaaaauuauagccauaaaguuguagauuugcaaugaaaauacucucuuugccaggcuagac

SEQ ID NO: 4157358 - RNA, 70 nt, Human
guuuugcuuuccaucugauuuuugugucugaauuucucaguugguucugaccacagacuggaaagagggc

SEQ ID NO: 4157359 - RNA, 70 nt, Human
guuuuggacacaguuuuucucacgguggucguuccaguuauacccacugugacucggggcuguucagaau

SEQ ID NO: 4157360 - RNA, 62 nt, Human
guuuuggagaaaagagacugauuuccuucagugcuggaaaucauuguugucguuccuagaac

SEQ ID NO: 4157361 - RNA, 83 nt, Human
guuuuggguacuuggagacauugaucuuuugcaaaucugagaagccagcacagcccgugucuccuuuaagugaauccuacgau

SEQ ID NO: 4157362 - RNA, 129 nt, Human
guuuugguuuccucacaggguuuucugauuugcuguucccuccuccccacugggugucuguucuggaggccagggugagagguggaggaggauggccacgcagaucagcacucggggcagccaguguac

SEQ ID NO: 4157363 - RNA, 100 nt, Human
guuuuguaccugcugguuaaguaugguccugaggcuccguauuucacauacuagagaucagagguaaggagucccaaccauccgagccaugguacagaau

SEQ ID NO: 4157364 - RNA, 67 nt, Human
guuuugugaauucuuggaagauugguauuuaaggccuuuuuauccauuucugggagauuuauaaaau

SEQ ID NO: 4157365 - RNA, 65 nt, Human
guuuugugauuauaucaccaacuauaagaguuauaaauugaggucugugauaaaagucaugagac

SEQ ID NO: 4157366 - RNA, 78 nt, Human
guuuuguuuguguccacugcagugauaauuaugaagguaauuuagacccauggaaaauuguguggaaaaaaguagaau

SEQ ID NO: 4157367 - RNA, 70 nt, Human
guuuuuacagcagcaaaauacugcagaggcaaaguugauauugugguagauuugcuguggguguaagaau

SEQ ID NO: 4157368 - RNA, 92 nt, Human
guuuuuacauuugugugaauacauaugaucuauuuuauguucuggaagaaaacuugcuccagugcaauggcucauucauguaagguggaaau

SEQ ID NO: 4157369 - RNA, 130 nt, Human
guuuuuacugcccaguuuauaugugaauaaaauuuuaguaaaaauaugcuuguggcuaaaauugaauuuaauuugguugaauaagauaguuuuauguaauuauuaaaguguauaaaccagcaguaaaagc

SEQ ID NO: 4157370 - RNA, 124 nt, Human
guuuuuaucagaucccugccuauggauuauagaguacugccucaguuaugaauaaaguggcauuuguuucucauuuagguaguguuuuccuguucauagcuguugggacccugugaguagagau

SEQ ID NO: 4157371 - RNA, 101 nt, Human
guuuuucauaaauucucauaaauugagauuauuaggguaauuuaaaucuggaguccggguuuuaccuaaaauagcucaauuuagggcaauuuaauaaaaac

SEQ ID NO: 4157372 - RNA, 111 nt, Human
guuuuuccaaagcucucagcccaauuuuguuuguuuguuuguuuuuaauuucuaacagcuguugaaacagacaaguaaaugucuuggaugcuaagcucugcuggauaaaau

SEQ ID NO: 4157373 - RNA, 88 nt, Human
guuuuuccaucucagagcucuuuaaucccagcaauaacugccugacacagcagaugaugacagugauuagacugggagagggaggaac

SEQ ID NO: 4157374 - RNA, 76 nt, Human
guuuuucccgguuuuuauaggacucauuaaggcagagauaauuuguuguaaucauuuuaugaaaacauggaggaau

SEQ ID NO: 4157375 - RNA, 92 nt, Human
guuuuucugaaguauacaguuaguugaggaguguuugucagucucucaacuucaaaucucugcuacuagcuaugcaauacugagaaggccac

SEQ ID NO: 4157376 - RNA, 62 nt, Human
guuuuucugucauuuuagaaauuuuccuuuucaguggccuuauucuaauuugauggaguagc

SEQ ID NO: 4157377 - RNA, 88 nt, Human
guuuuugacuucccuguucuuuucaguuuaaugccgaguguuuaguagguacucagugacuggguauuaaaucagaggaagcagaaac

SEQ ID NO: 4157378 - RNA, 72 nt, Human
guuuuugaggcaggaguuaaugugcucagcaugaagagcugggucugcacagaaaacugcugcuucuugagc

SEQ ID NO: 4157379 - RNA, 82 nt, Human
guuuuuggcuggacacuuaacuucugagaauaaagauguuuuccaacuuuuucuagcagcuaggugugucuuggccaauaac

SEQ ID NO: 4157380 - RNA, 117 nt, Human
guuuuuguaaaaugagcuguauuugugaauauuuaauuuucugaacuuugaucuauaauaggcacuuacauguuuacggauacacuuuaaauuuuaauaaggcucaauugcaaaaac

SEQ ID NO: 4157381 - RNA, 80 nt, Human
guuuuuguaauuucuaauucauuuucagugaagaaaccaugagaguagaugaacugaaaaugaauuagaaacagcaaugc

SEQ ID NO: 4157382 - RNA, 57 nt, Human
ucacugucugaaagaaauggccagagacacauaucuacauaauuucaugggcaguga

SEQ ID NO: 4157383 - RNA, 70 nt, Human
ucacuguggcuaggaagcugugggacucaggaggccaggccuggucacaugcucaccuaagccacaggga

SEQ ID NO: 4157384 - RNA, 85 nt, Human
ucacuguugagcuccauuccugucccuucauuguugagcugcguuccagccaugacucggacagugagcuauggacccccaguga

SEQ ID NO: 4157385 - RNA, 56 nt, Human
ucacuguuuuaucucaagaguucaaugcaauugcuugagcugagauaaaugcauga

SEQ ID NO: 4157386 - RNA, 63 nt, Human
ucacuguuuuucagaagguaagggauaaauaauguuuguccuuuuuauaguuagagaaacuga

SEQ ID NO: 4157387 - RNA, 59 nt, Human
ucacuuacccuguaagguugcuaggaaggacucaaacuuuaagcaagacagugguguga

SEQ ID NO: 4157388 - RNA, 68 nt, Human
ucacuuacuagguguugaccuugggcgcuuucacuggguaagccucagugucaccaucuaccaagugg

SEQ ID NO: 4157389 - RNA, 78 nt, Human
ucacuuagcuuuagcguuggggauaaaggaagacuucuauacuucuauauuucugaagguugagaagggcugagcuga

SEQ ID NO: 4157390 - RNA, 58 nt, Human
ucacuuaggcuucaguuucuucaucuguuaaaugaggccauggaacuagcuugggugg

SEQ ID NO: 4157391 - RNA, 59 nt, Human
ucacuucucuuuagaaauagaaguguaaugcuacgacuucuuuucuuggcaggaguaga

SEQ ID NO: 4157392 - RNA, 59 nt, Human
ucacuucugugacuccucagagauuuugcaccagugaacucuggcuagcauagaauaga

SEQ ID NO: 4157393 - RNA, 79 nt, Human
ucauaauuugacugcaagucaaaucugcaaaaauguaauaugcuauauuuugggugaauuugccaguuagucucuguga

SEQ ID NO: 4157394 - RNA, 86 nt, Human
ucauacagaguacagagguggucacauuagauuuggcacucuaggacugucuaucugaggaggugacauuuuaguucucuaaguga

SEQ ID NO: 4157395 - RNA, 96 nt, Human
ucauagaaaaaauucccaaguuucaguguugacagaugguguuacucugcaauauaagcagcaauguccucacgagacuauugauuuuguuuguga

SEQ ID NO: 4157396 - RNA, 108 nt, Human
ucauagaaauucugacucuuuuuuguucuuucacaguuaaugcaauauaaauuuuguucauuguacuuuaagagaugccaagggguuugguuugcaauauaucuauga

SEQ ID NO: 4157397 - RNA, 80 nt, Human
ucauagaauguacuuacacagcuguagaagguauagcguacuugcacuugcaggcugugugguagaaccuacugcuguga

SEQ ID NO: 4157398 - RNA, 65 nt, Human
ucauagcaaauauuagcacauaugucuuaugaggcaaugacuuuuaaaagcugguacuugcauga

SEQ ID NO: 4157399 - RNA, 83 nt, Human
ucauagcacaaagccuucauaaucuugggcuuuccucuugaugaaaugggaagccacagagauugugggggaggugguacuga

SEQ ID NO: 4157400 - RNA, 60 nt, Human
ucauaggaguagcagugagaggacagugucacagcaagggccucucugcaugcucccuga

SEQ ID NO: 4157401 - RNA, 67 nt, Human
ucauaguauggaucacauaauuuggaaacagcuagccuagcugucugucucugugacuuaacuguga

SEQ ID NO: 4157402 - RNA, 59 nt, Human
ucauagugcaggauugcggcuuccguaaauggaccugaagcggcagacccugcauuuga

SEQ ID NO: 4157403 - RNA, 93 nt, Human
ucauaguuugugucuuugguugugcauguaccuuauucuggacacucuucucagaacuuuauauguaucauccaugcuuacaacaccuuauga

SEQ ID NO: 4157404 - RNA, 61 nt, Human
ucauaguuuuacuuaguggugugcuagacccagcucuuacccacugauggaaacaaaauga

SEQ ID NO: 4157405 - RNA, 75 nt, Human
ucauaguuuugaagaagaccuugaaaccuuuggagguuuuacgauuuggucuuugcccagaaaauacugcuauga

SEQ ID NO: 4157406 - RNA, 73 nt, Human
ucauauauaaugacagcagcgggccacagaugucacgugcuuagugcucaccgccucugcugucuuauuguga

SEQ ID NO: 4157407 - RNA, 59 nt, Human
ucauaugcuggcuuugcgagaugcauugcuucuguaaucaaguacaaagcaguauauga

SEQ ID NO: 4157408 - RNA, 71 nt, Human
ucauauuauuuauggcacuguuggugguagccagauaucauaaaugcagugucauaaauacuuuuguauga

SEQ ID NO: 4157409 - RNA, 76 nt, Human
ucauauucuuuucucugaaagcagacuguauauugauuauuuuuauauggcaauuuucucagggaagagaauauga

SEQ ID NO: 4157410 - RNA, 61 nt, Human
ucaucaaaagccuucuggguuauauuaaggaauuugaacuagauccugaaggcugugaugg

SEQ ID NO: 4157411 - RNA, 81 nt, Human
ucaucaaguuagagaguaucagagcgaggauuagauccaagacaugguucaauuucuggcucgauucucugaccgggcuga

SEQ ID NO: 4157412 - RNA, 74 nt, Human
ucaucaaugaaaacuuuagccucauuaguauggauaucuuaaugcauuuuaaugguaugaaguccuucaaguga

SEQ ID NO: 4157413 - RNA, 83 nt, Human
ucaucaccaccaucaucgucauuauuggcucagccccuuugauuaaauguaaugccuccaguaaaugaugauagugccuuuga

SEQ ID NO: 4157414 - RNA, 65 nt, Human
ucaucacugugaugucugcuguaaugaaugacauacuuccaguuauaagaagcaucacaggaaga

SEQ ID NO: 4157415 - RNA, 78 nt, Human
ucaucagaggagcucccagcccuaagccacagaagaaagcugcacuuacuggcauucugggagcuagcucugagcuga

SEQ ID NO: 4157416 - RNA, 55 nt, Human
ucaucaggauagaaaugagacacaucaauguguuccuucaaacugucauugguga

SEQ ID NO: 4157417 - RNA, 55 nt, Human
ucaucagguauccauugugagaagacucgccucuucuuaacaauggcucugauga

SEQ ID NO: 4157418 - RNA, 67 nt, Human
ucaucauccacuuguuaauuacagugugaaauaucucaaucacuuuguuuuuagagguggcaugaga

SEQ ID NO: 4157419 - RNA, 70 nt, Human
ucauccagcaaguuuuagcaaguggaaaggguagcaauuggcccucacuacuagcuaugauugguaguga

SEQ ID NO: 4157420 - RNA, 66 nt, Human
ucauccagcgguugucagcuauccaggcucauguggugccugugaugguguuacacuguuggaaga

SEQ ID NO: 4157421 - RNA, 86 nt, Human
ucauccuccucagccagguaauguggagaugguccagaauuauccuugguaaugucuccuguacauuaacucugggagaagcuuga

SEQ ID NO: 4157422 - RNA, 69 nt, Human
ucauccugaacuugccagauacaccaaaaaguacaccacguggcuuuacugucuggaaaguuugguuga

SEQ ID NO: 4157423 - RNA, 77 nt, Human
ucauccugccagcuggagccaagguggacucuccccauagacugggaugagugcccuggcccagcuggaccuggugg

SEQ ID NO: 4157424 - RNA, 76 nt, Human
ucauccuggaugcaccgggcacaggucacacacaugaagcaggagggguggaaggccuggcccagggcccugauga

SEQ ID NO: 4157425 - RNA, 80 nt, Human
ucaucuaacaauggcccugugauggauguauuagguugaacuguaugaaacugccauucuuauagguccaggauagcuga

SEQ ID NO: 4157426 - RNA, 84 nt, Human
ucaucuacagaugccccagauguuuggaugguuuuugguguguagaaaguauucaaaaauauuuggucgaauuauuguaaauga

SEQ ID NO: 4157427 - RNA, 56 nt, Human
ucaucucucagggccaaaggagguacagcccugccuguggcaaguagaugagauga

SEQ ID NO: 4157428 - RNA, 61 nt, Human
ucaucucuguuaguaggauauaaacaguuuaaguuguuagauauucauuaauaggagaaga

SEQ ID NO: 4157429 - RNA, 69 nt, Human
ucaucucuugccagucagaauggugauuauuaaaaaguccagaaacuauagaugcuggcgaggcugugg

SEQ ID NO: 4157430 - RNA, 122 nt, Human
ucaucugaaaacuggguauaacaauauguacuuuucaggauuguugcagggcuucguugaggggauguuuauaaagcucuuaguagcagccuaguaucuaaaaaauguucaguuaaugguga

SEQ ID NO: 4157431 - RNA, 120 nt, Human
ucaucugcaaauaaggauaauucugucuuuacauuuucauuauucguauguccuaacuaggacuuccaagagaacaugacguaauaguggugguaauagacauucuucaugcugccuuga

SEQ ID NO: 4157432 - RNA, 73 nt, Human
ucaucugcacccaugcucuugucucaggacugcguccaaagaagccugagucaagauguaugguaaaggguga

SEQ ID NO: 4157433 - RNA, 129 nt, Human
ucaucuggagaucuuguuaaaggcagcuucugauuagcagcgccugcauuucuaacaagcucucaggcggggcugaugcugcugauccaaggacuguacacacuuugagaaucucuguucuaagcugca

SEQ ID NO: 4157434 - RNA, 63 nt, Human
ucaucuggggaucauaaauugauggaguggcuuauucugacuucauuaggaguucccaggaga

SEQ ID NO: 4157435 - RNA, 101 nt, Human
ucaucuguaggaccccaaaaaaugccaccuccucuagugaaacuuccgcaguuuccuuagacagagguggucauucauuagggucuuccacauccugauga

SEQ ID NO: 4157436 - RNA, 56 nt, Human
ucaucugucauggaaccagaaucuaaauccaaauaggcuguugccaguacagaugg

SEQ ID NO: 4157437 - RNA, 59 nt, Human
ucaucugucccaggcuuuuuucccucaacauacaguaagagaugccuggagauaaauga

SEQ ID NO: 4157438 - RNA, 55 nt, Human
ucaucuguggcugcuuuugugcuccaacugcagagcuaaguaguugccacagaga

SEQ ID NO: 4157439 - RNA, 58 nt, Human
ucaucuguuuuuaaauuacucuagaggucaaagacaaucagaguggaagacaguuuga

SEQ ID NO: 4157440 - RNA, 83 nt, Human
ucaucuuaaccacaucugcagucccuucuguauguaaggucacauuucacagguucuugggauugggaugugguuauauuuga

SEQ ID NO: 4157441 - RNA, 73 nt, Human
ucaucuucccccuaguuccaaagucaguaacuggagauccagaccucugacugugagagcaggaaugggauga

SEQ ID NO: 4157442 - RNA, 77 nt, Human
ucacugauguggcagugccguuugguucaggacacuguccuuugucuccaggaccauugcaacugccccuucacuga

SEQ ID NO: 4157443 - RNA, 56 nt, Human
ucacugauuugcccuuauccugccuacccucugguggugguauucaguaacaguga

SEQ ID NO: 4157444 - RNA, 59 nt, Human
ucacugcucagaguagaguuuagcccagcacggauucagacuuccacuuugugcacuga

SEQ ID NO: 4157445 - RNA, 57 nt, Human
ucacugcucucugcaaguagaugggcuuacucuccauggcuuacagauggagcaugg

SEQ ID NO: 4157446 - RNA, 56 nt, Human
ucacuggcucuucagugcuugguuccuaugcuuuaggagaaugguggggccacuga

SEQ ID NO: 4157447 - RNA, 56 nt, Human
ucacuguaccuuccauuucauuugcaaacccaaauguuggcuggggaaggcaguga

SEQ ID NO: 4157448 - RNA, 61 nt, Human
ucacuguccuccgagggccgaauaucuacacgcaauugcagguaagguuuggaggcagugg

SEQ ID NO: 4157449 - RNA, 76 nt, Human
ucacuuaaacccaggagauggagguuguggugagccaagauugcaccacugcacuccagccugggcaauagaguga

SEQ ID NO: 4157450 - RNA, 91 nt, Human
ucacuuaacuauuuaccuaaugacuuucagugguucaguuuucaaauaaccucugagcuggcuauacuugaaaagucaaaauguuaaauga

SEQ ID NO: 4157451 - RNA, 64 nt, Human
ucacuuaccacagugcaugacuucugaaagcaguuauucagggguuaucagcacugggucauga

SEQ ID NO: 4157452 - RNA, 109 nt, Human
ucacuuaucagcauauguguguggaggauguguguguguguguguguguguguguauguaaaaucacuacauugcaauaauaauucucuucagauuguagauuggguga

SEQ ID NO: 4157453 - RNA, 57 nt, Human
ucacuuaucucauuuaaucaccacaggcuccuccaagguggagaucagagauaagga

SEQ ID NO: 4157454 - RNA, 60 nt, Human
ucacuuccuugcagcuguagaauucauggggacugugucuuuaaggccagcaggagguga

SEQ ID NO: 4157455 - RNA, 61 nt, Human
ucacuucuggucagucugcaaaguggucuuaccugaggccugagaauguaccagaucuuga

SEQ ID NO: 4157456 - RNA, 77 nt, Human
ucacuugaacccaggagacggaguuuguggugagccgagaucacaccauugcacuccagccugggcaacaacaguga

SEQ ID NO: 4157457 - RNA, 76 nt, Human
ucacuugaacccgugaggcggagguuacagugagcaaagauuuugucacugcacuccagucugggugacagaguga

SEQ ID NO: 4157458 - RNA, 76 nt, Human
ucacuugagcccaggaguucaaagcugcagugagcuaugaucgcaccacugcacuccagcccgggcaacagaguga

SEQ ID NO: 4157459 - RNA, 76 nt, Human
ucacuugagccugaaaagcagagguugcagugagcugagaucaugccacugcacuucagcuugggggacagaguga

SEQ ID NO: 4157460 - RNA, 76 nt, Human
ucacuugagccugggagguugaggcugcagugagcaaagaugcugccacugcacuucagccugggugacaaaguga

SEQ ID NO: 4157461 - RNA, 62 nt, Human
ucacuugcaaaaauuauuguauauucugaaauaguggauguaaaauacgcagugcaguguga

SEQ ID NO: 4157462 - RNA, 67 nt, Human
ucacuugcuaacagauauugaggaugagcuugccuuuggugaucaugaacagugcuguuaacaguga

SEQ ID NO: 4157463 - RNA, 58 nt, Human
ucacuuggcaggucaggggauauugcagaggguguagauuaaacugggcugucaagga

SEQ ID NO: 4157464 - RNA, 65 nt, Human
ucacuugggcuuuccgagcacagccacuuauuuugucaggccugcaaggagaguccccagaguga

SEQ ID NO: 4157465 - RNA, 63 nt, Human
ucacuugucacugcccacucucaaaugguauuacacugccugagcugcggggcagugcucuga

SEQ ID NO: 4157466 - RNA, 70 nt, Human
ucacuuuaacucauuuaaacauuuacugaagauaugcucuaagaauuguguugaauagagugggagguga

SEQ ID NO: 4157467 - RNA, 74 nt, Human
ucacuuuucaccaagagaagacucagaguuuaucauauucacucucauuugauucuuagcuggugauaauauga

SEQ ID NO: 4157468 - RNA, 61 nt, Human
ucagaaagacgaaacagaugggacaucaaaggcggucauccuguaauuuugucuuuucuga

SEQ ID NO: 4157469 - RNA, 89 nt, Human
uaauuuuggggggugaguuuguaauuguauuuaguuguuaugggaauaacaguauauuuaccaaaccuuucaccuucuaauuagaguua

SEQ ID NO: 4157470 - RNA, 112 nt, Human
uaauuuuuacuaauauguagauauaaaagguuaagguguucaagaaaugauguuuagcauuguuuuacauugaauccuugaucaucauaauuauauauuucagggaaaauua

SEQ ID NO: 4157471 - RNA, 68 nt, Human
ucaggcagguguuaacccucugagccccucagagccucuggggcucagcaacaugcaccuggcucuga

SEQ ID NO: 4157472 - RNA, 56 nt, Human
ucaggcauacccggguuugauccagcuuugcuguuuucuaacugggugggccuuga

SEQ ID NO: 4157473 - RNA, 70 nt, Human
ucaggccacacaugcauaaggauaauuacuggaaaacaucuaugauuauuuuuacaguaugaauuucugg

SEQ ID NO: 4157474 - RNA, 72 nt, Human
ucaggccucagcagcccacagguaaaaguguuguuucaucaagauuaauagugggcuuuugacagugccugg

SEQ ID NO: 4157475 - RNA, 64 nt, Human
ucaggcgcuccaggcgagcuggaccagagcuuuguucugauuggcugaggccuggauugccuga

SEQ ID NO: 4157476 - RNA, 57 nt, Human
ucaggcuaagggagaggcgcucauccauugacaggugccaggcuguccugggccugg

SEQ ID NO: 4157477 - RNA, 68 nt, Human
ucaggcuaauacagaaguguauuaaaauggccggaugccaauuuaguucaucuuuugugaaauccuga

SEQ ID NO: 4157478 - RNA, 61 nt, Human
ucaggcuauauccagguauccaagaacuugcagggauaaagaacacagggaauagcacuga

SEQ ID NO: 4157479 - RNA, 91 nt, Human
ucaggcuauguauucaagugaagcucaggcucugcagggacuaaggaugccuuuagcccucagcuuggagcgugggaaugcugaugucuga

SEQ ID NO: 4157480 - RNA, 61 nt, Human
ucaggcucaggugccucauucacaccaaugcuccuccacagggugugugcaccugccuuga

SEQ ID NO: 4157481 - RNA, 60 nt, Human
ucaggcugcagcugucagcagcaggaacuucugcugcuuucauuugagacggagcacuga

SEQ ID NO: 4157482 - RNA, 56 nt, Human
ucaggcuggggaggaugcuacgaccugcagagaauugcugucccucccagguauga

SEQ ID NO: 4157483 - RNA, 65 nt, Human
ucaggcuguugcucugaacaggucuugccaaaauagcgagugcccaucggagacaacuuguuuga

SEQ ID NO: 4157484 - RNA, 65 nt, Human
ucaggcuuugaagucuagcugggaaggcacagugcaugacccagggaaggggcucucaaacuuga

SEQ ID NO: 4157485 - RNA, 115 nt, Human
ucagggaaauauccuguauaucuugcuuuguguggugauugcauggguauauguauuccacuaacauggguauauguaaccaccacacaaagcaagaugcaggacauugcacuga

SEQ ID NO: 4157486 - RNA, 60 nt, Human
ucagggaagaugucucaucuuaggcuucuuuaucauccaagugccuggcauuguuccuga

SEQ ID NO: 4157487 - RNA, 65 nt, Human
ucagggcccgaccaggcuguugggcccaguguuaugcacagggggucccauggccuggacccuga

SEQ ID NO: 4157488 - RNA, 64 nt, Human
ucagggccggggcuguggcgagcagagggaugugccagguggucgucguggccucauguccugg

SEQ ID NO: 4157489 - RNA, 81 nt, Human
ucagggccgugccagccuggugcgccugggggacccacagcagagguccugcaugcacuuggcuggcacguguaguucuga

SEQ ID NO: 4157490 - RNA, 89 nt, Human
ucagggcuaguaagugagaaagccauauuuugaacccagaucuugcugacucaaaaccuaggcucucugcuuccucacaaagccuuuga

SEQ ID NO: 4157491 - RNA, 90 nt, Human
ucagggcugcaaguuuaagcagauugcugugguguauacacaugauuuuagcaugauaacacuucuguuuaauguccuuaguuguucugg

SEQ ID NO: 4157492 - RNA, 57 nt, Human
ucagggggaggagacugccagugccgugacucaaaauagcugucucuucccugcuga

SEQ ID NO: 4157493 - RNA, 75 nt, Human
ucaggguauuuaauuucuaagaguauucaagguuuuguugaagaucuaaacagugcuuagaaauuuuuacccugg

SEQ ID NO: 4157494 - RNA, 69 nt, Human
ucaggucuccacuaaaaacuuucacgugcuaaggguuuuauuguuuguggaggaaggguggggauaugg

SEQ ID NO: 4157495 - RNA, 107 nt, Human
ucaggucugcccuccuucuccucccagguagugagaaauggaggucaugcuaugauucuugcuuuuuucacugcuauggucuguggagcuaaaaggcaggcaucuga

SEQ ID NO: 4157496 - RNA, 64 nt, Human
ucaggucuuuugucuccuagaaauaaauaguuuuuaaaaaucaauaaaggggacagaaaucuga

SEQ ID NO: 4157497 - RNA, 66 nt, Human
ucaggugacuucagcucccuguguguuugcagguauaagcgagagcagcaaggaugaagcacuugg

SEQ ID NO: 4157498 - RNA, 59 nt, Human
ucaggugccugcucccagcuugggcaucuucucuugccuaccuggagacagcacucugg

SEQ ID NO: 4157499 - RNA, 77 nt, Human
ucaggugcgcagcuagagaggaagaggcgggcucuucaauauggcaaggccuucgucuccuagcuucuaggcucuga

SEQ ID NO: 4157500 - RNA, 55 nt, Human
ucagguggagaccuccuuggccucccuagcagccaagguuagagucuuccccugg

SEQ ID NO: 4157501 - RNA, 69 nt, Human
ucaggugggaccugcuaggacagguauaacuuuggccaccugcauugcauaaacgucccuuuugcuuga

SEQ ID NO: 4157502 - RNA, 55 nt, Human
ucagguuuaagcuacuggaaucauuccuacaugauuacuggcagcagaaaccuga

SEQ ID NO: 4157503 - RNA, 55 nt, Human
ucagguuuaagugacuggaaucauuucuacaugauuccuggaggcagaaacguga

SEQ ID NO: 4157504 - RNA, 100 nt, Human
ucagguuuacauguuuauuugugaagcuuguauuuaaauaaguuuucuaugcaagugagauacacuuuaagagauacaugccucguaaaaacaugccuga

SEQ ID NO: 4157505 - RNA, 58 nt, Human
ucaguaaaauaaaacaugggaccccacagacuuucagggucuuaugaaaauuuuuuga

SEQ ID NO: 4157506 - RNA, 94 nt, Human
ucaguaaguguuugaauggaauuggaaguaaaaaagcaaauucauucauacaacagguuuucuuaauuugaguuccacuaauaauacuugaaga

SEQ ID NO: 4157507 - RNA, 72 nt, Human
ucaguaaucuugccagucuccaaaucaaucugaaugauaucauucaccuugauaaggggaucaggauagugg

SEQ ID NO: 4157508 - RNA, 68 nt, Human
ucaguaaugugucgcaggugccuagaaguguuccuggcagauaguaggcacugaguacauauugguga

SEQ ID NO: 4157509 - RNA, 62 nt, Human
ucaguagauauucuggugaaaccuuuggaaaguucucuaaaugguacaggauaucucuuuga

SEQ ID NO: 4157510 - RNA, 85 nt, Human
ucaguaucuuccauuagacugucacacuggccaggagcaggagcauuucauguuuacauucccagugugcagcaugguuuacuga

SEQ ID NO: 4157511 - RNA, 122 nt, Human
ucaguaugcaugauauaucaaauuguggacaaggugagucaguuaauguugcuaagaggaauuuccacuuugcauaucaugacuucuaucuuaauauuguauugauauuccaugaucuuuga

SEQ ID NO: 4157512 - RNA, 70 nt, Human
ucagucacccccuccaucacccauaugucauuuuaccuuguguguauuugaugagaggagggucaacuga

SEQ ID NO: 4157513 - RNA, 116 nt, Human
ucaguccaauuugauuuggauuucugucacuugcaaucaagaguugucacuacuacacagucucauuugauggcaggaggauauaauucauguauuauuuuaaagggggaaacuga

SEQ ID NO: 4157514 - RNA, 56 nt, Human
ucaguccacacagccugcugcuguggcacuguuccacagcagagcaaaguggcuga

SEQ ID NO: 4157515 - RNA, 59 nt, Human
ucaguccucacuugguucuaagguuugaccaucaaacuuugagcuugcaugagccuuga

SEQ ID NO: 4157516 - RNA, 55 nt, Human
ucaguccuccacacaggcaccccagggaggaggcugccuugggcagaggaacuga

SEQ ID NO: 4157517 - RNA, 75 nt, Human
ucaguccucccucauuuuuucucuugacacugucucuagaguggcaugggguguauguggcacggaggaagcugg

SEQ ID NO: 4157518 - RNA, 98 nt, Human
ucagucuucauaauuacauugucugauuuagagugugauuacauuaaugcuagaucauguugcucaaaauuaaacaaguggguaauuuccaagauuga

SEQ ID NO: 4157519 - RNA, 118 nt, Human
ucagugaaaugaauagacaucuuguuucaccuguuucaccucccugaacuguaggagaaagagcccaguccuggacuuggagucagggaaaccuauguaagaacgcuagguuugcuga

SEQ ID NO: 4157520 - RNA, 109 nt, Human
ucagugauucuguaaggaugaaggugauguagaguaguagauggcagcucuacucuggaaguccagaauacugcucugauucacaccugcaagccuuauuggucaauga

SEQ ID NO: 4157521 - RNA, 71 nt, Human
ucagugcaggugaagauuuaagcaucucaauuguagauuagcacguauugagaaauuaaucugcccacuga

SEQ ID NO: 4157522 - RNA, 60 nt, Human
ucagugcauuaauaauaucagucuuuuaaaagaagagggcugaccuuugagaugcacugg

SEQ ID NO: 4157523 - RNA, 67 nt, Human
ucagugccaaggagaaggacagccuuguguauuuaauuacuuuagcuuauuuuguccucuggcauga

SEQ ID NO: 4157524 - RNA, 80 nt, Human
ucagugccccaccuacagagaacucagcugcccucagacuuacuuaggaacaagccagauucuguaaggaggggauuuga

SEQ ID NO: 4157525 - RNA, 92 nt, Human
ucagugcuuugcuguccagagccacugucugccaggcaccaugugagcacuauuuuauugcugaauaagacguggcuuguggggcacacuga

SEQ ID NO: 4157526 - RNA, 77 nt, Human
ucaguggaacacuaaaggucaguuagaagauaaucaguugaagugcuuuuaaucuaauuuuuauauugauucauugg

SEQ ID NO: 4157527 - RNA, 66 nt, Human
ucaguggagauugcaugcaagaaguuuguacacuuuaaacugauucaaguuaugcaucuucaauga

SEQ ID NO: 4157528 - RNA, 108 nt, Human
ucaguggccagaggcuucaaggcauucagggcucugggggcucuuauuauaaugguaaugaaaauuggacccuagaacuuuggaccuccccagccuuaaauccacuga

SEQ ID NO: 4157529 - RNA, 90 nt, Human
ucaguggcucauuugauugucaccuaccuugcacaaaaccucccagccccgagcacugucugguggguugacaggcagucagagugcuga

SEQ ID NO: 4157530 - RNA, 66 nt, Human
ucagugggaacagcaaaagugggcucuccaguaaaugcuuuauaguucacugagguugaccacugg

SEQ ID NO: 4157531 - RNA, 89 nt, Human
ucaguguauacaacaaucauuuuuccccuucaguucugcugcuuuauacaacagugugauugacagaaaauuggauggcaugugccugg

SEQ ID NO: 4157532 - RNA, 62 nt, Human
ucagugugcacucugugacccagggucccccagcauguaaggggucacugggaggccacuga

SEQ ID NO: 4157533 - RNA, 56 nt, Human
ucaguguggaauucaacagcaaaauaugucuagacaugugaaaccuuccacgcuga

SEQ ID NO: 4157534 - RNA, 63 nt, Human
ucaguguucgcucagggacuccuuaggcaucaacugucagguuccccuggauggcgaaacuga

SEQ ID NO: 4157535 - RNA, 74 nt, Human
ucaguuaauauggguaaagcauuuaguacuucugucauauucgacaccauguauguguuuuuuucaauaacuga

SEQ ID NO: 4157536 - RNA, 113 nt, Human
ucaguuacauccacggaauaugaaaguucaagcugugguacuugauucacaauuaaacagauuugaaggagcuacagcuuccaacauucuugaauucuuaaagugauaauuga

SEQ ID NO: 4157537 - RNA, 76 nt, Human
ucaguuacuuaaaguuugaaugauauauuaguuugcuagggcugcuauaacaaaauaucacagacugggugacuga

SEQ ID NO: 4157538 - RNA, 70 nt, Human
ucaguuauuuauuuuauuguguguuugugcaugucgguagagcacaguauuuaguagaaugaguuauugg

SEQ ID NO: 4157539 - RNA, 75 nt, Human
ucaguucaucuaguucugaaggguuacucagugucaucuugaucagcccaccaucuucauaacaagauuuacuga

SEQ ID NO: 4157540 - RNA, 63 nt, Human
ucaguucuuaauaccaugugguugccagcuauguagggaaacucagacauguauaaagacuga

SEQ ID NO: 4157541 - RNA, 78 nt, Human
uccagccgcucuuggaggucucucacacucacagggcguccccccaacgccuagggugcucagggacgagcgacugga

SEQ ID NO: 4157542 - RNA, 73 nt, Human
uccagccgguuaaugagggggaugggaaaguguuuguacacgacgucuuucucuucaaugacaaucaggcgga

SEQ ID NO: 4157543 - RNA, 78 nt, Human
ucauuaagcuuucacuuguagcucacugugcagucuuggauauuagcacccugaguuauugagaaauaacugcaauga

SEQ ID NO: 4157544 - RNA, 120 nt, Human
ucauuacuauaagccaagguaaauucuucuaaagccuguccuaucagaaugaauguauucagugaaugagauaacuuuagauuuuuggaaaauuacccugaauauguggauagaaauaga

SEQ ID NO: 4157545 - RNA, 77 nt, Human
ucauuagaaagagcaucuaguuuuauaaaaagucucaccagugacgcagagauggaaagagauguuguuucugaaga

SEQ ID NO: 4157546 - RNA, 104 nt, Human
ucauuagaauuuacuuugaaagauucuaagcauaacgaagauacuauauuuuacugucagugacagaguaugcaucuauuguaccugcuagucaguucuaauga

SEQ ID NO: 4157547 - RNA, 69 nt, Human
ucauuagaucacggguguucuggcaaggaguuaagaacuucucagaggccagaagcuaugugaaaguga

SEQ ID NO: 4157548 - RNA, 81 nt, Human
ucauuagcaccacaggagagaguuguaguagccuuugauuaaucuauaaucuaccacuauugcaauauucuuuguuaaugg

SEQ ID NO: 4157549 - RNA, 104 nt, Human
ucauuaguuuaagaagcuuggaugggcacccaggaaagccgugaggaggaugcacuuacacacuggcuugauggguaaugccuccaagacauugaacgugcuga

SEQ ID NO: 4157550 - RNA, 87 nt, Human
ucauuauagaagaacuuugcuugggucaaacucagaaaaugaaaggaauaaauuuagguuggcuccaaggcaaaggaaauuauagga

SEQ ID NO: 4157551 - RNA, 72 nt, Human
ucauuauuucucaaccaggucaaaaaggcagaaacaguucugcagaauuuuuuaggugguuggaaauguuga

SEQ ID NO: 4157552 - RNA, 73 nt, Human
ucauucagagcauugggaagaagaaauuugggauaguaguaaauucaaagcaauuucaccagugccuguacga

SEQ ID NO: 4157553 - RNA, 60 nt, Human
ucauucagauaggucuuauaggugauuuuuuauuccuuugcuuauaaccuguuuugaugg

SEQ ID NO: 4157554 - RNA, 57 nt, Human
ucauucagcacuguuauggauuugcuccuguuagggcauuuaaauauguguuggaga

SEQ ID NO: 4157555 - RNA, 55 nt, Human
ucauucagcuuguaaauugugaaucugggauuuagaaccacaacuggcugauuga

SEQ ID NO: 4157556 - RNA, 57 nt, Human
ucauucaucaguugguagagauuuggacuguucccacuuuuuggcuguuaugaauga

SEQ ID NO: 4157557 - RNA, 93 nt, Human
ucauucccaugggggaugggcaagggacaggccuggcuuucuugggaccuuagacccaggccaggcaugucugcccugcccuugaggguuugg

SEQ ID NO: 4157558 - RNA, 87 nt, Human
ucauuccgugcuuggccucuacagacuguuggccuacugagcaauauaugcucuguucaucaguuuguugggagaguuuggcaguga

SEQ ID NO: 4157559 - RNA, 125 nt, Human
ucauuccucuggggccuggguuccgucuccaccugggcacugagaacuuggggacagagguugccagugaccucccaccguaucucaguggcaugggguuagggacauggguucuggaacaguga

SEQ ID NO: 4157560 - RNA, 68 nt, Human
ucauucguguaacaaacgguuccaagaugccugcuauaugccaggcauuacguuaguucuagggauga

SEQ ID NO: 4157561 - RNA, 75 nt, Human
ucauucucucucgggccuuggaguccuccacuggaugucgaauucagccagcagcccaaggaugagagcaaguga

SEQ ID NO: 4157562 - RNA, 85 nt, Human
ucauucugucuggaaccugcuguucuugguccccugcuguggcucccacuggcaguagagggagcgcauugccagauaugaagga

SEQ ID NO: 4157563 - RNA, 61 nt, Human
ucauugaacacacuuuucuaguuggcccuuuguccaagcugacugguggacuguucauuga

SEQ ID NO: 4157564 - RNA, 95 nt, Human
ucauugaccuuacaacacuugcugauuuugccuacugauccaccugcagguggggaguaaagaagaaucagggaaagucuguuaaggagagaugg

SEQ ID NO: 4157565 - RNA, 84 nt, Human
ucauugaguauggaaagugagacauauuuauagccaggagaacaugguuaugaagcugauaaucacugauaauccaugccagga

SEQ ID NO: 4157566 - RNA, 56 nt, Human
ucauugauggcuucuuucuugcuguuaggaaggccaagccagagaagcuaaaauga

SEQ ID NO: 4157567 - RNA, 56 nt, Human
ucauugcuguaguccagaugaggcauggugagagucugaaauggcagcgggaauga

SEQ ID NO: 4157568 - RNA, 77 nt, Human
ucauugcuuuaagauacauuuucuucagagaaaguauuuuuuccuuacugugaaauuguauaaugagaugcuaauga

SEQ ID NO: 4157569 - RNA, 88 nt, Human
ucauugucauccaauguccuauuaagacuugggguuuugagggccuugagaauauaauugauagguuuugauguuggagugagaauga

SEQ ID NO: 4157570 - RNA, 119 nt, Human
ucauuuaaaccauguacuuuuuagaauaugcaucauuuguucacuugauuccaagaagauuuugugaaucauaaucagguaauuagguuagcagagaacuaaugugcauggaaaaauga

SEQ ID NO: 4157571 - RNA, 124 nt, Human
ucauuuaaauguugaaguagcuacaagcucaaaguuaucaacugcaacauuauucagaauugcaaauaugaagagugaaaguagagaaaaugcuugagaaaauugugauacagcaacugaauga

SEQ ID NO: 4157572 - RNA, 87 nt, Human
ucauuuaauagucaaugcuuucuuauaaccacugcgaaauucacuauccguaaauguuagaggaaaguguagaaauaaaguuagaga

SEQ ID NO: 4157573 - RNA, 66 nt, Human
ucauuuacauguagugucucauugcucaucaaaauaacuugauugugcaaauauuaucuguaguga

SEQ ID NO: 4157574 - RNA, 56 nt, Human
ucauuuacuggauccauaagcacuuguaaacauugcuaauggaguuugcuaaauga

SEQ ID NO: 4157575 - RNA, 69 nt, Human
ucauuuacuugguuuuaaucuuuaccuuucuuugucaggaacauuguuggauuagaacacagguguuga

SEQ ID NO: 4157576 - RNA, 92 nt, Human
ucauuuauaauuuuuuuaaaagcagcugauagucucaucucauaaaaaucugagggugagauaauuuaguuccuggaaagaaauuagaauga

SEQ ID NO: 4157577 - RNA, 61 nt, Human
ucauuucaugucucaggcacuguaaaaugcugagucacaguacaccugagcgcugcaguga

SEQ ID NO: 4157578 - RNA, 128 nt, Human
ucauuucauuguauaauaaauguuguuuuccuccccuggacucagguccuugguaacagaguuucuuuaaaucuguagucacaguacaugauucagugguagcacauucuguauucauuguagaauga

SEQ ID NO: 4157579 - RNA, 65 nt, Human
ucauuucuaucuaugcagcuucucucugcaccgaugcagaaacugugccugccagauaguaauga

SEQ ID NO: 4157580 - RNA, 64 nt, Human
ucauuucucuguuuuccccucgaugucuggcaaagugcuagauacaggauaagaagagaaaaga

SEQ ID NO: 4157581 - RNA, 126 nt, Human
ucauuucuuugggaaaauuaccucugcuucucaagcucucaguuuccucaacuguaaaaugaucacacacuuuuauaaugagaaacugagaguagugacgugaaggaaggauacaaagagcuguga

SEQ ID NO: 4157582 - RNA, 87 nt, Human
ucauuugaagcuuccauuccaaggccaagucuaagauguucuuuaaagaaaucuuaagcuauugcauuuggagggcacacagauuga

SEQ ID NO: 4157583 - RNA, 91 nt, Human
ucauuugacaugucuuuuaaagucuaauaaucauguauaaaaaagauaacgguucgcugcaucuguuaccuuuaggaguauguacaagugg

SEQ ID NO: 4157584 - RNA, 60 nt, Human
ucauuugagguaagacugccauguggagaugggucuccaucugguggcuuccuuuuguga

SEQ ID NO: 4157585 - RNA, 96 nt, Human
ucauuugggggaccugucuugucugugagggcauuggaguuugugaccccugcuccauguguaaggcucacaggcaggucuuaagucuguaagugg

SEQ ID NO: 4157586 - RNA, 78 nt, Human
ucauuugucagcaagugauggaaaucagagcuggccguguuacgauuuccuccuccaggucuccaacacuugcaauga

SEQ ID NO: 4157587 - RNA, 103 nt, Human
ucauuuguuuauacaugugugguacuguuaauguuuugucauacuuguauguuuauauaacacacaguaguguggaaaaacaugcuauauuuuugaaacuuga

SEQ ID NO: 4157588 - RNA, 71 nt, Human
ucauuuguuucagagaaagcccaaagacuguaaccugcagucauuugucauuuuuuugaggucucaaauga

SEQ ID NO: 4157589 - RNA, 65 nt, Human
ucauuuuaggaaaaugaaauuaccuguccuaauauaaaggaagguuuuuaugauuccuauuuuga

SEQ ID NO: 4157590 - RNA, 98 nt, Human
ucauuuucaguucaaaccugguuauaguaacacucugucauacuuaauauacacagggcaacaugcagugugcuagauuuggacucacuggaaaaaga

SEQ ID NO: 4157591 - RNA, 89 nt, Human
ucauuuugugugugguuugugcaccagcagcaucagcaucaccugggagcugguuggaagugcagacucucaggccccacccagaauga

SEQ ID NO: 4157592 - RNA, 77 nt, Human
ucauuuuucuccauugucuaugaaauauuugaaguggaaauggcuuauuucaacaccagagaccaugcgggaaauga

SEQ ID NO: 4157593 - RNA, 91 nt, Human
ucauuuuuuuaaaguaauugaagcuuguggcuuuacaacuuaguguuuuuugcuauccagauaacaaguuucauuguuuagaacccaguga

SEQ ID NO: 4157594 - RNA, 59 nt, Human
uccaaaaagggauauugacauucuagcucccaguuccugugaauauuuccuucuuugga

SEQ ID NO: 4157595 - RNA, 60 nt, Human
uccaaaacagcuagcaguuugguucuugaaagaucccugaauuguaugcaguuacuugga

SEQ ID NO: 4157596 - RNA, 63 nt, Human
uacauguacacauaucauuugugggaauguguauuuucuacuucuuagguguguguauaugua

SEQ ID NO: 4157597 - RNA, 57 nt, Human
uacauguaccuguuuguuuggggaggauagguuugcucuccagggcaggaacaugua

SEQ ID NO: 4157598 - RNA, 69 nt, Human
uacaugucccagugcugcuaaagagguagaguguauuuccucuccuccugacguugcaauggccaugug

SEQ ID NO: 4157599 - RNA, 70 nt, Human
uacauguucugagccagaguaaaccagagaccauguauaaaguaauauaauauuuauucuggcauaugug

SEQ ID NO: 4157600 - RNA, 67 nt, Human
uacauuaaggauauggacaugauucccaguagaagguggaacauauguuaccauguccuggaaugug

SEQ ID NO: 4157601 - RNA, 69 nt, Human
uacauuagcucaucuauuuauuaauaggagaaggaaaguaauucuuugccaguagguggugcuuuugua

SEQ ID NO: 4157602 - RNA, 56 nt, Human
uacauuaucucauuugagccucacagugacucugugugacucagagaggguaagua

SEQ ID NO: 4157603 - RNA, 85 nt, Human
uacauucauauuugcaguauaccuggagcagugccuggcauguagcaagcacuauagaaagguuuauuaaguaaauagagcugug

SEQ ID NO: 4157604 - RNA, 56 nt, Human
uacauucugguggagaaaguaaacagaagaugguuauuuguucaacuaagaaugua

SEQ ID NO: 4157605 - RNA, 71 nt, Human
uacauuguaacauuuguguugaacugccccacacagcauacuaauguagggguguaacacacauacuugua

SEQ ID NO: 4157606 - RNA, 85 nt, Human
uacauuuaaaacucuuguaaauaucauguuuuagaagggugcauacauauccaaaaagcugaugucuacuagagaaggaaaugug

SEQ ID NO: 4157607 - RNA, 102 nt, Human
uacauuuaucugaucuuuucucacaauuuccauugagcagcaguugcuacaaccaccugagcaucaaaugggcaauuaauuggaacagauuuaauaaaugua

SEQ ID NO: 4157608 - RNA, 96 nt, Human
uacauuuggcuucaguuguuuuccucuuuugucaguaggucaucaggaauuuaccaugaggccaugggaagagguggagagcauguugucagugug

SEQ ID NO: 4157609 - RNA, 79 nt, Human
uacauuuucuacuuuuauuaucacucccguguauauuccagaugcaagagguaaaaugaaaggagaaagcacacaugua

SEQ ID NO: 4157610 - RNA, 73 nt, Human
uacauuuuuaaaccuaucuaagaaauagcccugauauugaaauggcuucuguggaauagguuugacagaugua

SEQ ID NO: 4157611 - RNA, 58 nt, Human
uaccaagaugccagugcauuugaaggaugauguccccaaagcagaagguucuguggua

SEQ ID NO: 4157612 - RNA, 87 nt, Human
uaccacacuuuuaucacucugccauuuuuucacccucagaaccuaaggguggccaccaaguaugucagagucaguauugugugugug

SEQ ID NO: 4157613 - RNA, 67 nt, Human
uaccaccuuccucuguguuccuauauauauuuaagugucuuuauuucagcacaugggauagguugug

SEQ ID NO: 4157614 - RNA, 97 nt, Human
uccaauuaaccagugaguugaacauugauaaugaugauaguaauaugaauaaucauuaacaauuguuuaugcugugccccgcacuguguaccuugga

SEQ ID NO: 4157615 - RNA, 64 nt, Human
uccaauugucccggauuucacacuacaagccagauugguugugccuggaucucugugacaaggg

SEQ ID NO: 4157616 - RNA, 66 nt, Human
uccacaagaugauaaagagagggcagaagauguaaaauguuuaucucucuucaguuaccuugugga

SEQ ID NO: 4157617 - RNA, 118 nt, Human
uccacaccggcacuccagaguguuggcacaucuccagcaauggggagcucuuuccaccuggagcggccccugcccuuggaggacagugccaacucuuguaaacuucccccuuugugga

SEQ ID NO: 4157618 - RNA, 73 nt, Human
uccacaccugcugagcugcuggggguugggggugagguguuguccuggguucuagcagccagccagggauggg

SEQ ID NO: 4157619 - RNA, 63 nt, Human
uccacaccugcuucaaggagguuguuagaacacacguaaacaauguucucugaguugugugga

SEQ ID NO: 4157620 - RNA, 80 nt, Human
uccacagcauucagcuuguuaccgagggaggguacuuggugugggacagguauuacuccuuuucuagcaggugcugugga

SEQ ID NO: 4157621 - RNA, 108 nt, Human
uccacagugggaacagugccaagaggaauuggaaggaagaaccgcgguagcugcccugcaguuaacagcuguugcuucucuucuuccuaaaagucacagcacuuugga

SEQ ID NO: 4157622 - RNA, 81 nt, Human
uccacauccaccgagggggcgggaggcggcaggaccagcaggggcagcccguucucuucgcuggcccucggggaggucggg

SEQ ID NO: 4157623 - RNA, 56 nt, Human
uccacaucuuguguucauaugugagaguuucccuggcauauauaccuagaagugga

SEQ ID NO: 4157624 - RNA, 70 nt, Human
uccaccacccugccucuauucacugaggcagucacaaagacuguccauauucaagggguaggggacugga

SEQ ID NO: 4157625 - RNA, 69 nt, Human
uccacccacccuggccugguucaugugaugucaaacacucaccaggagcuaggacaggcaugggaagga

SEQ ID NO: 4157626 - RNA, 56 nt, Human
uccacccuaagcauuacagauggcuuauagcuguccacgggguugguagagguggg

SEQ ID NO: 4157627 - RNA, 74 nt, Human
uccaccugaaccauguacuuuauucuguuuuacacaucaguugaaacuguaaauacuaguaaguguaggguggg

SEQ ID NO: 4157628 - RNA, 65 nt, Human
uccaccuugggauaucaccuuucagaacccagcugccacguucugaggagaccaagccaagugga

SEQ ID NO: 4157629 - RNA, 64 nt, Human
uccacucaacccuugguuccuguugaagaugauggcagguccugggccacagggugcuggugga

SEQ ID NO: 4157630 - RNA, 62 nt, Human
uccacucagcagguaccacaugaucuuugggaaaaauuuguguuauaccugcuccugguggg

SEQ ID NO: 4157631 - RNA, 86 nt, Human
uccacucagguuugauuaauagaaaguggaucccuuuauacugcauuuuagucagaggccuuucuguugagugaagccauuguggg

SEQ ID NO: 4157632 - RNA, 116 nt, Human
uccacucugcuuaccuucuggagcugccuggauucgcucugcccccuauaggggacuugucuuugagaaugguaaguggaucggcagagaaaggccaauaggaagcaacaguugga

SEQ ID NO: 4157633 - RNA, 126 nt, Human
uccacugccaguuaaccagaggagcauaacaugugggagcugcuggguaacauuuccaaaauacuuagcauuagucagauauguuuuuagaauuauguauccauuuuggcugaaggaaaaugugga

SEQ ID NO: 4157634 - RNA, 56 nt, Human
uccacuggaacaacucugaggcuguuuugcacagucucccagaggaucccagugga

SEQ ID NO: 4157635 - RNA, 56 nt, Human
uccacuggaaguucauucucagaaggucuguuuccuuuugauaaagaacccaggga

SEQ ID NO: 4157636 - RNA, 58 nt, Human
uccacuggccugggagcuacugaaggaaugugccucuccccaucccaggccaggugga

SEQ ID NO: 4157637 - RNA, 80 nt, Human
uccacuuauaauuccugcuguuuggugagugagaaauaaagauauaauuuacuggcuaagccaguccuauaauaagugga

SEQ ID NO: 4157638 - RNA, 55 nt, Human
uccacuuuucuuccaucaucauugguaaaaacgaugaaaaagauguggaaaggga

SEQ ID NO: 4157639 - RNA, 72 nt, Human
uccagaaggcugccgugcccauauuguggguggggaucucuacccgugaagugagcguggggcuuuaacgga

SEQ ID NO: 4157640 - RNA, 61 nt, Human
uccagaauacucugaaaucauugugggugcccaguaagcacuucuuggucagagucugaga

SEQ ID NO: 4157641 - RNA, 78 nt, Human
uccagacuguuccaugcagaggagcugguggcagguccacaucccuagcuccccgcuaauuugcagugugacccugga

SEQ ID NO: 4157642 - RNA, 130 nt, Human
uccagagacaauaagauguuguagcuaguuaauacuuuuaagauccuuuugcugaagucauauugaugcuagcagugccaggauuuugcugaaggauugaaguucuguggaguuuuguuuuuuuuuugga

SEQ ID NO: 4157643 - RNA, 60 nt, Human
uccagagccucagaauccuguggagagaguugagaccaggcgccucccugagguuuugga

SEQ ID NO: 4157644 - RNA, 62 nt, Human
uccagagccugggguuuguaacauugaagaaaaagaauacaaauccccucaggcucccugga

SEQ ID NO: 4157645 - RNA, 56 nt, Human
uccagagccuuucugcuugacauccuuccucucuggguacagagcaggguucuggg

SEQ ID NO: 4157646 - RNA, 59 nt, Human
uccagaggcagcugcggucaggggcagggacugccgccagaugugccugccuuucuggg

SEQ ID NO: 4157647 - RNA, 80 nt, Human
uccagaggcugcgcucaucucagggcaagggcugauugcagccuggcaggggccugggagugggcccagccgccacugga

SEQ ID NO: 4157648 - RNA, 100 nt, Human
uccagaguucuugguucagcaggucuggguuggguuccuggaauuugcauuuccaacaaguccccaggggaugcccacgcugcuggccugagaacuugga

SEQ ID NO: 4157649 - RNA, 128 nt, Human
uccagaucuuuuucuuaagaaaaaaauuucaguauugcaccugaugucuuaguguuagcugucagucaucuugacaaguggagauauuuaaggucaaauauugaaaauggaaugugggagagggugga

SEQ ID NO: 4157650 - RNA, 91 nt, Human
uccagauguuuugucugcuugaugccaagcauccugauuuuucaacuauccagauguuuggcaucaggcagaccaauauccaaaaucugga

SEQ ID NO: 4157651 - RNA, 86 nt, Human
uccagauuaugauuggccuuguacaucauauuaagagauuuaaucuuguagaugaucaagagcuagaggagaauuauaaguaggga

SEQ ID NO: 4157652 - RNA, 64 nt, Human
uccagauuuaagacucagcacuuucuaagaaauuauguaccuugaaagucuguuuaucucugga

SEQ ID NO: 4157653 - RNA, 85 nt, Human
uccagcaaagggaacagacaucuauccauuuaauuaagcucugcuaagaugcuuugaguuaaauuguguauguuugugugcugga

SEQ ID NO: 4157654 - RNA, 94 nt, Human
uccagcaagaccaugaugggaagcucagggcccauggcagauugcuucucccaacaggugccuuugcuaugacucauucauuggugcuucugga

SEQ ID NO: 4157655 - RNA, 58 nt, Human
uccagcacugaaugugagucauggaggagaaacguggcaugcaauggacagagcugga

SEQ ID NO: 4157656 - RNA, 78 nt, Human
uccagcacugagucaaugucagauguuccugguaauagugucccccagagauuugucaaugauuuccagagugcuuga

SEQ ID NO: 4157657 - RNA, 68 nt, Human
uccagcagagggucuuggccauuuacagcugaaggaaugugcuaguggcaaugcugcccucuuuugga

SEQ ID NO: 4157658 - RNA, 63 nt, Human
uccagcagccagaggggccagagucggaagcugggggucggacucuuggcaucuucuggugga

SEQ ID NO: 4157659 - RNA, 71 nt, Human
uccagcaggucuggagugggaucugagagucuaaaauuaaauugcucaccagugauucagaugcugcuggg

SEQ ID NO: 4157660 - RNA, 79 nt, Human
uccagccugaccccagagcagaaccggaacaccagguuggggcccuggugcugccaccuccucugcuggucgggcuggg

SEQ ID NO: 4157661 - RNA, 60 nt, Human
uccagcuuuuauuggaugaggauuugacuucucugagucuuucuuaauugguaaaaugga

SEQ ID NO: 4157662 - RNA, 55 nt, Human
uccaggacagaguagaagcagcuaggcacuuggugacucucucagauguucugga

SEQ ID NO: 4157663 - RNA, 55 nt, Human
uccaggacuugccuguccucccugaguuuggaugggagagacacaagggccugga

SEQ ID NO: 4157664 - RNA, 73 nt, Human
uccaggagcccugacugagccucccuagcccccaacucuacuggagaccugggcugugcuccggguuccugga

SEQ ID NO: 4157665 - RNA, 106 nt, Human
uccaggaguguagccaccaagagaaagggguggcuggagaacuuggggaucuccugcgagggaacccagaaguccagcugcccauuccugguggaaacgcccugga

SEQ ID NO: 4157666 - RNA, 55 nt, Human
uccaggcacgaggcccugugcagagaaagcacuuaguaggagccuuugcacugga

SEQ ID NO: 4157667 - RNA, 113 nt, Human
uccaggcagcaugaggaaugggaagagugauggauguguggggcuuuccggggaguacuuugaggagcccuccaucugugcucaggcugcccugguucucugcaugcacuggg

SEQ ID NO: 4157668 - RNA, 55 nt, Human
uccaggcccgagaugggcuggagguccucauuuugccuucagaaaggggccuggg

SEQ ID NO: 4157669 - RNA, 56 nt, Human
uccaggcuggagugcaguggcgcgaugucggcucacugcaaccuccaccucccggg

SEQ ID NO: 4157670 - RNA, 58 nt, Human
uccagggacagcgcuggagcuagaggaaccuccagagccuuccugccgcugcccuggg

SEQ ID NO: 4157671 - RNA, 71 nt, Human
uccagggauguccuguagcacuaaccuagguaguuuuauuauuuucacaggcaauacaaggcaucucugga

SEQ ID NO: 4157672 - RNA, 92 nt, Human
uccagggcagaggcgagggcaggguaggucgcggccccaguggaaacaaggccugagggacugcauacccagcuuugaaggucugcccugga

SEQ ID NO: 4157673 - RNA, 64 nt, Human
uccagggccgcccgccugacgagcgaccggggcucuccugugacguuccugcuggcgaccugga

SEQ ID NO: 4157674 - RNA, 55 nt, Human
uccagggcuggguuggcucagcucuaccucguguuaucucucauccuccccugga

SEQ ID NO: 4157675 - RNA, 55 nt, Human
uccaggggagugcuacgcacagcaggaggguggcugggcagugcaaagccccgga

SEQ ID NO: 4157676 - RNA, 63 nt, Human
uccagggucccaggagcugcuuucagaccagaaguuuccaugagagggcuggacccaaaggga

SEQ ID NO: 4157677 - RNA, 56 nt, Human
uccagguaaucucauccagaaaucagugaauaaugguuguggaugugggaucugga

SEQ ID NO: 4157678 - RNA, 55 nt, Human
uccagguauguuugggguccuggaaagauugcaggguucuggaauauaaugugga

SEQ ID NO: 4157679 - RNA, 78 nt, Human
uccaggucccgggagcuuggugucccagaaguacuaacucucaguaccuugggagacgccaggcccucuagcccugga

SEQ ID NO: 4157680 - RNA, 56 nt, Human
uccaguaaaugugauuuuucuuguaaguaauuuccuuaugggaacauugaacugga

SEQ ID NO: 4157681 - RNA, 70 nt, Human
uccaguacaccucacuucccuuuguaagugaaagugaauaugaaaaugcaaagggaugaaguguauuggg

SEQ ID NO: 4157682 - RNA, 81 nt, Human
uccaguagucuaucagugcuaagagagggccugcaccccaugaugggguccccgaggccagcucuaagcccuaccccugga

SEQ ID NO: 4157683 - RNA, 59 nt, Human
uccaguaugacugauguccuuccaaaaaggggaaauuuggacaagacagcaugcaagga

SEQ ID NO: 4157684 - RNA, 64 nt, Human
uccagucaagcuugagaauuucagcagcucuugcuuuugguguagauuuucauuuugacugaga

SEQ ID NO: 4157685 - RNA, 84 nt, Human
uccagugagaguacaguugaaacaagucaacuuguuuagaguacaguuaguacaguugacuuguuucaacuguacucuccugga

SEQ ID NO: 4157686 - RNA, 55 nt, Human
uccagugucuacaggcucuggagagccagacucuucaaacacuguuggcacuggg

SEQ ID NO: 4157687 - RNA, 63 nt, Human
uccaguugccugucucugauuaugguuugguuucuagaagguucuaaucagagacgggcagga

SEQ ID NO: 4157688 - RNA, 86 nt, Human
uccaguuggagccuuuuccacccuugaugggcugcucauuucuuagugguugaguguauaugaagguuguaauuauucccacugga

SEQ ID NO: 4157689 - RNA, 65 nt, Human
uccaguuugcacuguauaauagagacuacagaaaagacauguuuuguuuacaguuagaaucugga

SEQ ID NO: 4157690 - RNA, 71 nt, Human
uccccuuuguacaccuaccuaauacagggcauguaugcccuguauuagccaggugcacaaggaacaaugga

SEQ ID NO: 4157691 - RNA, 124 nt, Human
ucccgaccucaggugauuugcccuccucaaccucccaaagugcuaggauuacaggcgugagccaccacgccuggcaauuuuuuguauuuuuaguagagacgggguucugccauguuggccggga

SEQ ID NO: 4157692 - RNA, 105 nt, Human
ucccgagaacuggcccauggucacacaguggaaaugugggaggggaacuugccucgcuccaagccgagugcuccccacucaccacuggccaaagccuccuuguga

SEQ ID NO: 4157693 - RNA, 127 nt, Human
ucccgccguguccggggcaacuacaccgaaggccgagcggcggcuucacgguaccggccgggcaccgccggaggggcccaagccggagcugggagagccgcggcauccuggagcccggcgggcggga

SEQ ID NO: 4157694 - RNA, 65 nt, Human
ucccgcgccgucccucuacggugugacguacgcgucagggccacgcggaggugacgggaacggga

SEQ ID NO: 4157695 - RNA, 74 nt, Human
ucccggaagcccaggcagcgcccgaguccgcagcugccgucggagcugggacgccgcugccuccagcucuggga

SEQ ID NO: 4157696 - RNA, 56 nt, Human
ucccgggagacagccuucccaagaggcagcccuccugggagaccgccuuccuggga

SEQ ID NO: 4157697 - RNA, 66 nt, Human
ucccgugcuugcugguaggcuuguguuugcaguuagcuggcagacacuucccacugcagcgcgggg

SEQ ID NO: 4157698 - RNA, 99 nt, Human
ucccuaaaguaaauaguuggcauaagguuaauuuaguagaguccagauauguguacaggcaccuuaucagcugcuacauuggccucuuuucaacaggga

SEQ ID NO: 4157699 - RNA, 80 nt, Human
ucccuaauagcauccuaaaacauacuugccuuugccaacaagcaucuggaagaggauaguuuagaauguuauuuuaggga

SEQ ID NO: 4157700 - RNA, 69 nt, Human
ucccuaaucucagugauuuaauaccacaaaaguuucuuucucagguacaauccacuguggguuaggugg

SEQ ID NO: 4157701 - RNA, 58 nt, Human
ucccuaggaggcggcaucgucccugcuuuucuagucucggccaaauuccuccuaggga

SEQ ID NO: 4157702 - RNA, 67 nt, Human
ucccucaaauccuauuuuguugccacagauaccacugaugccuuaggucacaaaggaucaugaggga

SEQ ID NO: 4157703 - RNA, 57 nt, Human
ucccucaaugugggucaagaccagcaacugcaacagguucaugucagcauuaaggga

SEQ ID NO: 4157704 - RNA, 60 nt, Human
ucccucaggagaugucagcuggagguuuacucuuccuuccuccugacacagccugaguga

SEQ ID NO: 4157705 - RNA, 59 nt, Human
ucccucaggugguucuuguuucaauuaaaguccuuuugggaaacaaucuauccggggga

SEQ ID NO: 4157706 - RNA, 67 nt, Human
ucccuccacaccugcugguaccuguaaaaugccaaauggaucugccuugucaggugaugggacagga

SEQ ID NO: 4157707 - RNA, 72 nt, Human
ucccucccucugaggcuuugagccugggguugucauuaacagaagagggagcgaggacuucaggggaacgga

SEQ ID NO: 4157708 - RNA, 69 nt, Human
ucccuccucaggcagaaacaccuaacagcuuggauggcuggcagugggcuccguugccuggggcaggga

SEQ ID NO: 4157709 - RNA, 55 nt, Human
ucccuccugagcauccccagcugcuccacaucagugccagggagaucaggacgga

SEQ ID NO: 4157710 - RNA, 58 nt, Human
ucccuccugcuugcguucugagaacacaguuauuucaggacauguaaauggagaggga

SEQ ID NO: 4157711 - RNA, 74 nt, Human
ucccuccuuuaagagauauggcucucuaauacuuugccuguuguuuaagauacagaccucuuauuaaggaggga

SEQ ID NO: 4157712 - RNA, 67 nt, Human
ucccucuggccugcccgugucugugauugccagcauccugguggggcaauuucaugggaagauggga

SEQ ID NO: 4157713 - RNA, 97 nt, Human
ucccucuucccacacuguggcaaccugugcccaaguccuuuuucucaccugauuggguguccugguuuccauagcucuguguauguggggagaggga

SEQ ID NO: 4157714 - RNA, 56 nt, Human
ucccucuuuuacuugucuuuccuuaucuuugaggauucaguuauucagagaaggga

SEQ ID NO: 4157715 - RNA, 77 nt, Human
ucccugagcugucaagguacagugaaccuggggcuucccgcucccgcugugaggcugcacuaugcauggcucugggg

SEQ ID NO: 4157716 - RNA, 58 nt, Human
ucccugagggcagcucaaguccucacccccaggacccaagacacguguccucagcggg

SEQ ID NO: 4157717 - RNA, 86 nt, Human
ucccugauccuaucagcuaugacauggacagaggccaucauucucauagcuauugaggagugaugguuuccagucacugacaggga

SEQ ID NO: 4157718 - RNA, 79 nt, Human
ucccugcacagaguucaaaucuguaucaauuuguacucugcuuaucugaguacaaauugauacagguuuucugugggga

SEQ ID NO: 4157719 - RNA, 68 nt, Human
ucccugccuccuggcugauggguaggcagcacaugccagcccagagaaggggcccguggaggcaggga

SEQ ID NO: 4157720 - RNA, 84 nt, Human
ucccugcucuuuuaaacucugucuuguuacauggggcuugacaguuuggaagcuacauuaagcagauuuacuagccaguaggga

SEQ ID NO: 4157721 - RNA, 69 nt, Human
ucccuggcagauaaccugcugugcccugcuuggggguagagaggagggugcccagguaucugccacuga

SEQ ID NO: 4157722 - RNA, 87 nt, Human
ucccuggcaggccaggcgucgggugcuggugcucgcuccucuggggccagccuggggaggcagcauggcagcagugccugucaggga

SEQ ID NO: 4157723 - RNA, 65 nt, Human
ucccuggcuucugggauguguugacagaaacgaaauugcaaccugacccagccagcccuugggga

SEQ ID NO: 4157724 - RNA, 113 nt, Human
ucccugggacaguaugguuaaccccaccauugcaggugaugauguagugucgguuauucauuucuuacgauacagcauguccuuagcaaggcuggaacuggaggugucaggga

SEQ ID NO: 4157725 - RNA, 57 nt, Human
ucccugggccuaucuuagcucccaggucaaacuuagaguugcagcaggccacaggga

SEQ ID NO: 4157726 - RNA, 98 nt, Human
ucccugggcucccagccucugggcucacccaacccugacacccucuaugaaguuucaggacuuggggcagagcaacagaggcucauugagccaaugga

SEQ ID NO: 4157727 - RNA, 83 nt, Human
ucccuggggacaggcuggaaguuuccuuccuggucaggugacagccuggcuccagguugaacuuugggcccuauccacaggga

SEQ ID NO: 4157728 - RNA, 56 nt, Human
ucccugugacaagucugaguucaauuuuaccuaauuuuaagacuuguaacaaggga

SEQ ID NO: 4157729 - RNA, 57 nt, Human
ucccuguggauuucaguuuguguccugugucugaggacagcggacugaauacaguga

SEQ ID NO: 4157730 - RNA, 92 nt, Human
ucccuuaucaguagccuuguuagcccuaccacugcuaacaaguuaaacauuucagugacauuaguagggcaacaugggcacuaggaaaugga

SEQ ID NO: 4157731 - RNA, 78 nt, Human
ucccuucacucaaccagccuugaggguucguuaacucacagcagugugaccagcccauagagaggcgaggagaaggga

SEQ ID NO: 4157732 - RNA, 65 nt, Human
ucccuucaggggcacagugugcuuccuuguggaggaggaaccagcagacaggcccaguggaggga

SEQ ID NO: 4157733 - RNA, 78 nt, Human
ucccuuccuccuuucacacuucaguaugauauuauaauugucacuagcaucauuuggggaauuguggacaaguaggga

SEQ ID NO: 4157734 - RNA, 69 nt, Human
ucccuucuagguugcugagggaccggcuccugucacauuaugagcuguuucuuuggcaaacugauugga

SEQ ID NO: 4157735 - RNA, 79 nt, Human
ucccuucucuuuaaucaggcaaagcauaauagauauccaugucuuauuaugaagacagucugcauuuagaaagugggga

SEQ ID NO: 4157736 - RNA, 83 nt, Human
ucccuucuugggucaagcagacaccagugguagcccaauuucaaacugggaucugcuagggucuguuuuccagguguuaggga

SEQ ID NO: 4157737 - RNA, 71 nt, Human
ucccuugaaggccuaagcagaacaaaaagguggagugagagaaaauuuacucucugugucuuuaagcugga

SEQ ID NO: 4157738 - RNA, 123 nt, Human
ucccuugguugcauucuuagggaacaucuucagugugcacaugguagcagucccucacccacauuccuagggaaugucuucaguguauacaugguggcaguucuuuggcugcaugcuuaggga

SEQ ID NO: 4157739 - RNA, 55 nt, Human
ucccuuuaggcaauugcauuaaguagguuggcuaagugaaauugcaucagaggga

SEQ ID NO: 4157740 - RNA, 66 nt, Human
ucccuuuuaggauaaaaauggaguugcuuucucuguuaccagcaacuucuuggcuuccuaauggga

SEQ ID NO: 4157741 - RNA, 75 nt, Human
ucccuuuucaaagguucuggugaaggaucugaaguguauggccacaccagucccagaagagccugggagaaggga

SEQ ID NO: 4157742 - RNA, 74 nt, Human
uccgaagcccaguuucacacugagacucucgagcauaugagauuaugccuguuuccugugggaacucggcugga

SEQ ID NO: 4157743 - RNA, 56 nt, Human
uccgccaggacugagggcccaugugcucucuggagccuccccucacuccugccggg

SEQ ID NO: 4157744 - RNA, 78 nt, Human
uccgcgccgacuucuccgacaaccgacgccggggcuucgaggagcagagguaccggcgaccgcugucggaggcgcgga

SEQ ID NO: 4157745 - RNA, 71 nt, Human
uccggacuguccaagggccuccuggggagccugggaggccaggcucaccuggagccccuggugaacaagga

SEQ ID NO: 4157746 - RNA, 66 nt, Human
uccggauggcuguaaaaggugggaaacaggugugccccacauuccuacuccugcagcucagcugga

SEQ ID NO: 4157747 - RNA, 68 nt, Human
uccgggguccucuuguagcggccacguugaucugcgauacgcguguuugcccagugaguggccccgga

SEQ ID NO: 4157748 - RNA, 67 nt, Human
uccgguauuucuagaaaaugcagauuccugugaccugcccgcgaaaauuaugccuaggaagucugga

SEQ ID NO: 4157749 - RNA, 70 nt, Human
uccggugccugguuuggggaauguucaugggauauguuccaaaggacuuacggaccuaucagguacugga

SEQ ID NO: 4157750 - RNA, 79 nt, Human
uccacuuuguccacauaggcauagucaacccgugagccccucugggagacagaaugacagugcaugugacaaaggagga

SEQ ID NO: 4157751 - RNA, 59 nt, Human
uccagaccauggauggcugcaaucgggcagcaagcagcauugcagccucaaugggagga

SEQ ID NO: 4157752 - RNA, 57 nt, Human
uccagacccaugacccuggggacuguugucacacaagggucugguggugggguuggg

SEQ ID NO: 4157753 - RNA, 91 nt, Human
uccagacuccauacuaucagccacuugugaugcuggggaaguuccucuacacaaguuccccuggugccacgaucugcuucacgagucuggg

SEQ ID NO: 4157754 - RNA, 58 nt, Human
uccagacuggggccaugucugccaagagggucaucagggggcaugaaccugucaugga

SEQ ID NO: 4157755 - RNA, 76 nt, Human
uccagagaccuggcugacuuccuuuccucugcacuaaccugcugagggaacuugggcaagucuucgccucuuugga

SEQ ID NO: 4157756 - RNA, 56 nt, Human
uccagagagggcgccaccuggagcccaaggcgguucaaaugcgcagccccuuuggg

SEQ ID NO: 4157757 - RNA, 57 nt, Human
uccagagcaaaguuugcuaacagaguccacugcuguucaccaagucuuuguguugga

SEQ ID NO: 4157758 - RNA, 76 nt, Human
uccagagcauaagagaaagcugggggcccuggucuagggcucuccuccagaaucagcucccagcuuccucucugga

SEQ ID NO: 4157759 - RNA, 120 nt, Human
uccagagccuguggagcucacuuuagcaggcacacaauaaauguuugcugaugagucauucauuuauucaucuaauaaacauuuacugaggccuacuaaugugccaggcugggcucugga

SEQ ID NO: 4157760 - RNA, 59 nt, Human
uccagauguucccccaaagcugcuauggaucaguguccaggcaagggaggagcauggga

SEQ ID NO: 4157761 - RNA, 68 nt, Human
uccagcaagaacauucgaacuauuuucucaaaaauugagaguucacagaauguuuugcuuugcaagga

SEQ ID NO: 4157762 - RNA, 95 nt, Human
uccagcaagcgcggcugaccuuucucugggugcuuggccggaauccaagcccauucuuccgagcaccucagaggggggucagggccucagcaggg

SEQ ID NO: 4157763 - RNA, 71 nt, Human
uccagcaagcuauguucaaugugucccuguuugaaagggaacacaucuuagacugaaauaugcuugcugga

SEQ ID NO: 4157764 - RNA, 86 nt, Human
uccagcaggcucuccuggcucagaaaccucuggugucucgagaccuuaguguucaggccuagguuucagagccuuagucuguucga

SEQ ID NO: 4157765 - RNA, 55 nt, Human
uaggucuccuggccuagagauugccaaacugcagcauagucaccaaggaggccug

SEQ ID NO: 4157766 - RNA, 60 nt, Human
uaggucugauaggaguuuaacuuugcacaauuguuuggaaaaacugucugucaguaucua

SEQ ID NO: 4157767 - RNA, 69 nt, Human
uaggugauuuucuccuuacgauuugauuuuguuaaaagguuauugacaagaaucaugagcaaucaucua

SEQ ID NO: 4157768 - RNA, 56 nt, Human
uaggugccuggacgcaaauggagccuauagcuguguacacuuggucaagguacuua

SEQ ID NO: 4157769 - RNA, 57 nt, Human
uaggugcugcccacgccugggucuuugcguuuuuaagggaaaggcugcugcuaccug

SEQ ID NO: 4157770 - RNA, 67 nt, Human
uaggugugacauuucaccaagcucgugacucaugucauugucaccaagcuuuucuguuuuauaucua

SEQ ID NO: 4157771 - RNA, 71 nt, Human
uagguguggugguuaauacugugugucaacgugacuggauugaaggauacaaaguauuaauccuggaugug

SEQ ID NO: 4157772 - RNA, 78 nt, Human
uagguguuuaggaguuuagcagaaacuuguuugaugaauuauuuaaacaugagcauuucuguuuaauucuguaaucua

SEQ ID NO: 4157773 - RNA, 78 nt, Human
uagguuaguguaaaaguaauugugguuuuugccauugaaaguaauggcaaaaaccccaauuauuuuugcaccaaccua

SEQ ID NO: 4157774 - RNA, 95 nt, Human
uagguuccauuuuuuuucuacauuauauugggacuucaggacuuuuguagcuacuuaggaaguguccugucagugcuaauagaggguguuaccua

SEQ ID NO: 4157775 - RNA, 55 nt, Human
uagguugaguuagguuuugguuugcuuacaaaggcacuggagccaucucagccua

SEQ ID NO: 4157776 - RNA, 78 nt, Human
uagguuggcacaaaaguaauugugguuuuggccauuacuuugaauggcaaaaauugcaauuacuuuugcaucaaucua

SEQ ID NO: 4157777 - RNA, 78 nt, Human
uagguuggugcaaaaauaauugggguuuuugccauuacuuucaauggcaaaaaccacaauuacuuuuacacuaaccua

SEQ ID NO: 4157778 - RNA, 77 nt, Human
uagguuggugcaaaaguaauugcaguuuuggcauaucaaguaacagcaaaaacugcaauuacuuuugcagcaaccua

SEQ ID NO: 4157779 - RNA, 78 nt, Human
uagguuggugcaaaaguaauugcaguuuuugccauugaaaacaauagcaaaaacugcaguuacuuuugcaccaauuua

SEQ ID NO: 4157780 - RNA, 79 nt, Human
uagguuggugcaaaaguaauuguguuuuuuugucauuacuuuuaaaggcaaaaacagcaaugacuuuuucaccaaccua

SEQ ID NO: 4157781 - RNA, 97 nt, Human
uagguuuggugacaaguucuggaguacaggaaucuucccaagcacuguuuccucuuuggcaaaauucucuuguacuugacuucugguuccauuccua

SEQ ID NO: 4157782 - RNA, 60 nt, Human
uagguuugugcucagaggagggacugcacccaaagcagggccuccacugucacugaccug

SEQ ID NO: 4157783 - RNA, 93 nt, Human
uagguuuuauucaguauaggucagauacagguuuuuguuagaugauagguuauuuggggauccuugugucugggguaacugauguagaacuua

SEQ ID NO: 4157784 - RNA, 88 nt, Human
uaguaaaaugggcuggguaauuccagcacucuggaacuccaaagugcuuuggaauuccaaagugcuggaauuacauggcucacaucug

SEQ ID NO: 4157785 - RNA, 62 nt, Human
uaguaaaucucagaaaaagaucacccauaagcauagcacagggguauucugagguuugacua

SEQ ID NO: 4157786 - RNA, 69 nt, Human
uaguaacugggagagucagaauuggcacccagauugaucugaccccaaacccuguauucuucaauauug

SEQ ID NO: 4157787 - RNA, 80 nt, Human
uaguaaguucucaaaaaauguuaucuggugcuguucuaugauguaucaagauuauggcagauaacaauuugaccuugcua

SEQ ID NO: 4157788 - RNA, 119 nt, Human
uaguaauauugccuauucuugugucuuaauucccacuagacucuuacuaguguucucuuuauguauggacauuucaggagcaguuucaguggcuaaagaugcaguuugcuguaaaacua

SEQ ID NO: 4157789 - RNA, 79 nt, Human
uaguaauccuaucaagggacaagugucuugacucagcccccaucccugauuccuaggcacucuucuccuggggucucug

SEQ ID NO: 4157790 - RNA, 71 nt, Human
uaguaaucucuaguaugucugucuucuagucuuccucuaguauauuagagagagcauauuacugguuauua

SEQ ID NO: 4157791 - RNA, 82 nt, Human
uaguacaacaugauuuuacucucuggucuccuacacuuucauuuugagaugagaaaaggagggugaaaccauguugaugcug

SEQ ID NO: 4157792 - RNA, 60 nt, Human
uaguaccuuucuguaugcuuagcugggacuacuuuaccguuuggcagcuucaggguacua

SEQ ID NO: 4157793 - RNA, 59 nt, Human
uaguacuuacaaaauagguugcuguaggaauacacagagacaauauuuguaaagugcug

SEQ ID NO: 4157794 - RNA, 58 nt, Human
uaguagaaaagacuuggagaaauagauuuguaaacuauuggcuuuaaguuuuuugcua

SEQ ID NO: 4157795 - RNA, 67 nt, Human
uaguagacggauggugccaaaacauuaccaggugcaaacugaacacuaggaggagccgucccuacua

SEQ ID NO: 4157796 - RNA, 95 nt, Human
uaguaggaaguauuuuagguuugguuugacaagacugauaauaauccaagugacaaaaggaugauuagucucagaucuaccuucuucagugacua

SEQ ID NO: 4157797 - RNA, 68 nt, Human
uaguaguuaagagaagaguaucuagaacaaggaugccuagguucagauucuuucucuuucacauacua

SEQ ID NO: 4157798 - RNA, 57 nt, Human
uaguaguuaguguuuguuuuuguuauuuuuuagcauuuauuacaaauacaacugcug

SEQ ID NO: 4157799 - RNA, 65 nt, Human
uaguauaaguacaggugcggguaaccucagauaaaucaagguguuaugcagcugucucuauauua

SEQ ID NO: 4157800 - RNA, 69 nt, Human
uaguaucuuuuuguuggauuucaauuggaguuauauugacuauauagauugauuugaacaaagauauua

SEQ ID NO: 4157801 - RNA, 70 nt, Human
uaguauguagauauucauuuuuugcuuuauauuuaaauauauuauuaaagugaaauggaugcugcuacug

SEQ ID NO: 4157802 - RNA, 76 nt, Human
uagucaagcuccaacugagcuuugcuuugcucuauguuuucccaaagcaaagcaaggcucaguuugaacuuggcua

SEQ ID NO: 4157803 - RNA, 68 nt, Human
uagucacaagaaauaagcugccuuucucuaugaaucgaugauugggagguuuuuugcuuggagggcua

SEQ ID NO: 4157804 - RNA, 97 nt, Human
uagucaccugagaacuuguuagaaauguagacccucagacccuaccccaaaacuagugaaucagaaucugcauuuuuacaagauccccaggugauug

SEQ ID NO: 4157805 - RNA, 55 nt, Human
uagucacuuuuuuaccaugugccagacauauuaggcauuggggagacaguugcua

SEQ ID NO: 4157806 - RNA, 63 nt, Human
uaguccagguuuccaucuccacauucugcaaccacuugcagauagacugaagccaugugacua

SEQ ID NO: 4157807 - RNA, 74 nt, Human
uagucccugcucugcaugccacaugagugaccuagaaguagguagcgguuaugucugcagggaguucuggacua

SEQ ID NO: 4157808 - RNA, 65 nt, Human
uaguccucugcuuucaagcugguacucuuuaauaagacaauucacagcugaggcaccugagguua

SEQ ID NO: 4157809 - RNA, 77 nt, Human
uagucucucaaagugcucuagaaauugucagugguuuacaugaaauggccaucgguguccagagcacccugaagcug

SEQ ID NO: 4157810 - RNA, 64 nt, Human
uagucucugugguccugaggaaggugauuugguuucauccucacauggugagccacacaggcug

SEQ ID NO: 4157811 - RNA, 86 nt, Human
uagucuuuccauugcugacuauacauuuagcauuuguugaaaguaacaacaaaucuagagaacuguggggcagccuggagagacug

SEQ ID NO: 4157812 - RNA, 60 nt, Human
uagugacauuuuuacuuccuauuuguuuagcuuuuaugaaauguggaagugaggacacug

SEQ ID NO: 4157813 - RNA, 119 nt, Human
uagugaggaucagcacugagaucuaaauccacaugguccagguggaaggucugugcucugggccacuauggcugcugccuuccccugcucccaugggguggugcugggcuaccuggcua

SEQ ID NO: 4157814 - RNA, 61 nt, Human
uagugagugucuucaccucucagcucugucuugaaugcuuccugggugcaggcacugacug

SEQ ID NO: 4157815 - RNA, 92 nt, Human
uagugauacugugauuagucaaagguguuaguaauaucccuuuauccaacauauuauuuccauuaucaugacaaauuaaaauguguucauua

SEQ ID NO: 4157816 - RNA, 68 nt, Human
uccgcggacuggcacagaugcuguuucucaccuccucccacuaacagcucuguugccagaucugcuga

SEQ ID NO: 4157817 - RNA, 75 nt, Human
uccggagccaggucuaggagucugaaaguaucuccaaggaacucucaggauuucucagaaaacaacagcuccaga

SEQ ID NO: 4157818 - RNA, 57 nt, Human
uccggaucaucauaccuuggucauuacugucagacaaaguguaugaacagaugcggg

SEQ ID NO: 4157819 - RNA, 58 nt, Human
uccggcugcgacuguacagaauugccccugugaaaacacugcagucauucgugccgga

SEQ ID NO: 4157820 - RNA, 91 nt, Human
uccgggacauccuauguggauccuuccuuuacucaucacucaccugcagugacccagaguaacagauggauucucuaagggaaguuuugga

SEQ ID NO: 4157821 - RNA, 61 nt, Human
uccggguuuuacacucacaucauaaaaaucugucuugaacuugucugugcugagcaccggg

SEQ ID NO: 4157822 - RNA, 70 nt, Human
uccggugccugguuuggggaauguucgugggauauguuccaaaggacugacagaccuaucagguacugga

SEQ ID NO: 4157823 - RNA, 70 nt, Human
uccggugccugguuuggggaauguucgugggauauguuccaaaggacugauggaccuaucagguacugga

SEQ ID NO: 4157824 - RNA, 67 nt, Human
uccgguucuccugggcccuccggaucagguaggggauuaccuccuccaaggagccauagggaaugga

SEQ ID NO: 4157825 - RNA, 86 nt, Human
uccguacuccuggcaggauggccccggggcugugcuccaggacccacgucccgaugccagccugaggccgugccugcuccuccgga

SEQ ID NO: 4157826 - RNA, 112 nt, Human
uccguaguugaagaucuugaaaccugcuagaagcaaaugucugauuacauaagaagaaaucagauucuuaauuuaugggauuuaagauuuauauuuaugagucuuuuaugga

SEQ ID NO: 4157827 - RNA, 81 nt, Human
uccgucucuaccuuaaaagaacguucucgagggagucaggggaggugauggacucagaaguguucuuuuauuuuagauggg

SEQ ID NO: 4157828 - RNA, 59 nt, Human
uccgugccaugggcagccucucagggaacccuuugcugaugcccuuguccaggcaagga

SEQ ID NO: 4157829 - RNA, 61 nt, Human
uccguggggauggagguggacaggaaauagcauuccugucuaucaagacaucuucaauuga

SEQ ID NO: 4157830 - RNA, 95 nt, Human
uccguguucuuuuccucaucuggcuggcuagaauggaaaugucauccaagauguugaaacuggcagagucaugguauaggaagagaaagcaugga

SEQ ID NO: 4157831 - RNA, 87 nt, Human
uccguuggcauauacucacacugauaggcuugacaggcagauaaaccuguauuugaaggucagcaggauuaguuguguggccuugga

SEQ ID NO: 4157832 - RNA, 55 nt, Human
uccuaaaauaccuauuauuggcuuuuuuuccagccaaaaggauaggaaauuaggg

SEQ ID NO: 4157833 - RNA, 56 nt, Human
uccuaaauccugaaaaaaagguuugaugcacaaucuuuacagcagcaggauuugga

SEQ ID NO: 4157834 - RNA, 89 nt, Human
uccuaacagaagcuuggcuguguccacauuuuuauucaucaaagcaggggucuccagugaaguguggacgucaccaaugggcuuuagga

SEQ ID NO: 4157835 - RNA, 63 nt, Human
uccuacaaaauugcugugaggugguaguacaaggacuguuauucccauuucauaggcaaagga

SEQ ID NO: 4157836 - RNA, 99 nt, Human
uccuagacuauuuggggaagauaucagugaaaaguauguguaugaagaagcagauaagcauuucacagguguguuugagagugguuuuaugagaaagga

SEQ ID NO: 4157837 - RNA, 79 nt, Human
uccuagagcccagugggccaguagcuacucgcaagccuguuuuacuaauucuugcugcuacucaggccucggcucagga

SEQ ID NO: 4157838 - RNA, 56 nt, Human
uccuagccuggugagaaacugucacucugugccucaguuuccucaucugcauagga

SEQ ID NO: 4157839 - RNA, 59 nt, Human
uccuaggaauacugccugaaaugacagugcauuugcuguucagguaaaauucuuuagga

SEQ ID NO: 4157840 - RNA, 56 nt, Human
uccuaggccccaccucccaugauucugacucggggagucugagguggggccuagga

SEQ ID NO: 4157841 - RNA, 55 nt, Human
uccugagcuacaguaguaugaucuuccauagcacgucauaacugucuguuuagga

SEQ ID NO: 4157842 - RNA, 55 nt, Human
uccugagguauaugcuuugcaguaauuuuaaugcagguuuauuucaacuucagga

SEQ ID NO: 4157843 - RNA, 87 nt, Human
uccugagugccgggcccugccccguggcucugauggauucucccagcguguccucaccacucuuuggagcaggugccacauucagga

SEQ ID NO: 4157844 - RNA, 55 nt, Human
uccugagugguuguuuucuucccacugaccaaagcuggagagggaucccucagga

SEQ ID NO: 4157845 - RNA, 75 nt, Human
uccugauggaggggucaucuuuguggucacaccccagacacuagacagagagguaggccaguucuuuagccagga

SEQ ID NO: 4157846 - RNA, 79 nt, Human
uccugauggcccugagucuccuggggaggugaaugacaggauuucugcugcgacccaggaguuagcggugagguuagga

SEQ ID NO: 4157847 - RNA, 65 nt, Human
uccugauggugguggggugggucugagcaggaaggggccuggaauccaucccaucuucaccaggg

SEQ ID NO: 4157848 - RNA, 63 nt, Human
uccugauucuguuagcucucaggcuggccuugagaaggaaagagagagccagacagcauagga

SEQ ID NO: 4157849 - RNA, 57 nt, Human
uccugcagaucaaagccuuugaccuagggcagugcuuuucaaaggguggucccagga

SEQ ID NO: 4157850 - RNA, 57 nt, Human
uccugcagccaagggucaucgauaucgguugaggacuuuguccuguggcagcaguga

SEQ ID NO: 4157851 - RNA, 72 nt, Human
uccugcauggcuuacagaggcugcagaggcuguggggcaugcuggagaaauacucugugugucagugaagga

SEQ ID NO: 4157852 - RNA, 74 nt, Human
uccugccacugcacauauacuugcaugaugcauuagucauauaccauuccauagcauaugagcuuguggcaggg

SEQ ID NO: 4157853 - RNA, 67 nt, Human
uccugcccuagagaugacacaauccuggaucuacguaacuagcccauguuggucacuuugagcagga

SEQ ID NO: 4157854 - RNA, 66 nt, Human
uccugccugcuucugagccagaggaaagaggaagaugacacucuucucugcuccagagcagaggga

SEQ ID NO: 4157855 - RNA, 67 nt, Human
uccugccuguuagucuagcaguuagacugugugucugcuuccuccaguugacugaugguaaagaggg

SEQ ID NO: 4157856 - RNA, 70 nt, Human
uccugccuucagcuuccucugaggcuucugagucagcaccuggcugucagcagagagcaugaaggaaggg

SEQ ID NO: 4157857 - RNA, 82 nt, Human
uccugcucuggaugaggguggaaaggguguaccugguauuucccuagguccuugcuuuccaccuucuaaacauccagcagga

SEQ ID NO: 4157858 - RNA, 59 nt, Human
uccugcuggacucugaguacaaagcugcccuuugaaugggcugccucagggcugcugga

SEQ ID NO: 4157859 - RNA, 74 nt, Human
uccugcuggcuagagcucuccuuccucuguggauccuguggagcugaagagaaagggagcucuucccucuaggg

SEQ ID NO: 4157860 - RNA, 66 nt, Human
uccugcuuuguguggucccuccagggaugcagagucccuuucccugaccugacccauaagcaagga

SEQ ID NO: 4157861 - RNA, 56 nt, Human
uccuggcaaagcaaguuaugaacugccucugcaaaaugaccccuguucugccagga

SEQ ID NO: 4157862 - RNA, 78 nt, Human
uccuggcauuuucacauaucaacucuauccucucuguacaacuauggaggaaaauguuaauauggaaaauaacaugga

SEQ ID NO: 4157863 - RNA, 58 nt, Human
uccuggccugucuggaguagcuccuuacuagucuggccacagcuccugcaggucagga

SEQ ID NO: 4157864 - RNA, 76 nt, Human
uccuggcuccccuugcucccagacugaccagagguguguggcaucuggggcuguggggagcuggggugggccagga

SEQ ID NO: 4157865 - RNA, 57 nt, Human
uccugggaacaagaggaccagugagcuaaagcauugaaggacaucuuguuucuagga

SEQ ID NO: 4157866 - RNA, 79 nt, Human
uccugggacaggaaggcugguuccaucccuggugugacugcuuaccaccucagggacgggaucacuuggucucccagga

SEQ ID NO: 4157867 - RNA, 83 nt, Human
uccugggacucugccucaggcucuccuggcuagacacagagcagaagccagguaacucuacagccuaaggaagacccccagga

SEQ ID NO: 4157868 - RNA, 56 nt, Human
uccugggagcauggugccgugagcccagccuggcugcuggccgugagcucucggga

SEQ ID NO: 4157869 - RNA, 57 nt, Human
uccugggaguaaaagcugcccugaagagggaauuuauggcagccucauuucccagga

SEQ ID NO: 4157870 - RNA, 79 nt, Human
uccugggccucauugcuucaguuuguuggggauaauugcuguugcacgucccugccaaugauuggagcaagaaccagga

SEQ ID NO: 4157871 - RNA, 78 nt, Human
uccugggcuugggccccauaggagccaaagaccugggacccccagggcuuuggcccccugcugcagaccugcccaggg

SEQ ID NO: 4157872 - RNA, 58 nt, Human
uccuggggcuucaaugcuucggugggcucugcccgcugugggucagggggccccggga

SEQ ID NO: 4157873 - RNA, 77 nt, Human
uccugggugauuaggauuucaacagagggauuuuagagugauagaaacauucaguugcaguccaucacaccuagaga

SEQ ID NO: 4157874 - RNA, 80 nt, Human
uccuggucucuucaaauccuguguagggcuauagguaugucuauugacaguuagcacuaucuugggauuuggaaacagga

SEQ ID NO: 4157875 - RNA, 83 nt, Human
uccuggugagagguucuagaagccuuguucucacuaauaaaauggugaagccccagaaaagcuucuagucaauuucaccagga

SEQ ID NO: 4157876 - RNA, 79 nt, Human
uccuggugcugggaguucaugagacuuauucucaaaucuucagagaagaaaauuccgugaacaccugggaacaucagga

SEQ ID NO: 4157877 - RNA, 55 nt, Human
uccuggugguuugaaaacugaaauauuuauccucucagcagaaggaccacuaggg

SEQ ID NO: 4157878 - RNA, 55 nt, Human
uagugauucccuaucaacccugaaaauucucacaaaauuugcaaggggaucacua

SEQ ID NO: 4157879 - RNA, 95 nt, Human
uagugcaucucuucauucacuucuuucuuagcaaucuaugguuucuaacauggccauaccacugggaaaggacugaggaacaaggagauguuuua

SEQ ID NO: 4157880 - RNA, 130 nt, Human
uagugcauuggaaucaccuggagagcuuguuaaaugagccugcugggcuccacccucaacuguuuaugauucaaaaggcugagguagggccuaaaacauuacaaguucccaggugaaucugaugcugcug

SEQ ID NO: 4157881 - RNA, 55 nt, Human
uagugccaaagccuggugucauggcuaaacccugcacaccaaagcauugucacug

SEQ ID NO: 4157882 - RNA, 78 nt, Human
uagugccuauguuucauauauaguaacugaaauucauacucuucauggaauuucaaacuaugugucaggcaggugcua

SEQ ID NO: 4157883 - RNA, 71 nt, Human
uagugcuaugaaauggugguuuuccauuuacuguagaaaguauguagaaauaauuucaguuccugguauua

SEQ ID NO: 4157884 - RNA, 69 nt, Human
uagugcuuauauaugcacauaugcauauauauauauaaauauagcaauguguguguauaaauuguacua

SEQ ID NO: 4157885 - RNA, 65 nt, Human
uagugcuuuaggccugagugucaguucaaacaucuucgaugauaacuaaaugcuuagagcaacua

SEQ ID NO: 4157886 - RNA, 56 nt, Human
uagugcuuugugccuuuuuuaagcccuugacaagaguuugagaacaccaaguacug

SEQ ID NO: 4157887 - RNA, 86 nt, Human
uagugguaacaguggaugggcugcucucaggcuggggagcacacacuuuguucccuguguccugggggcaccucccugauaugcua

SEQ ID NO: 4157888 - RNA, 64 nt, Human
uagugguagaggggagcaugaucuagauuggccauccaguucucuuugucacccccucccacua

SEQ ID NO: 4157889 - RNA, 59 nt, Human
uaguggugagagcagaccuucuuuucucuuuuuugaaaacguucaggcuuucaccauua

SEQ ID NO: 4157890 - RNA, 62 nt, Human
uaguggugaggauggguuugguaaaagggucuucucccuuucuucauucaccuucaccccua

SEQ ID NO: 4157891 - RNA, 76 nt, Human
uagugguguccuuuuugaauagagaccuuauguuuugacguagucaaauccauucuguuuuaaaaguuuaucucua

SEQ ID NO: 4157892 - RNA, 119 nt, Human
uaguguauuuuaccaccauguauaaaaguauuuguguuuauauguaaaauggaguucaccucuagguucgggcacuuacaaaugguuuuguacccacaugaauuugugguggaacauua

SEQ ID NO: 4157893 - RNA, 55 nt, Human
uagugucaucguugcagcugaguccuuaaauucuccuaguggaaggaagacacua

SEQ ID NO: 4157894 - RNA, 59 nt, Human
uagugucugaaugcaccuguuuaagucagcuucuuguucucccagguauuuaggcauug

SEQ ID NO: 4157895 - RNA, 69 nt, Human
uagugugcugacuuuuauaugcauagcauauguaguauauuuauaugauacauuuagaaguacauauua

SEQ ID NO: 4157896 - RNA, 92 nt, Human
uagugugcuuaucuccaucaggauucaguaucuccagcuaucagacaagcuuggaagagcacaguccucauaggagagugcagcaagcauua

SEQ ID NO: 4157897 - RNA, 63 nt, Human
uagugugcuuuccugccaacgcagcaugacuucuugucaagucagcacuccaggaagccacua

SEQ ID NO: 4157898 - RNA, 62 nt, Human
uaguguguaugguaaugaugaaugcuggugggguauguguguguccuuaacuguauauacua

SEQ ID NO: 4157899 - RNA, 67 nt, Human
uaguuaagagcagaggcuguaggagcagacuauuaugacuugaauucuugccucuguugcuugccug

SEQ ID NO: 4157900 - RNA, 75 nt, Human
uaguuacagucacaauuuguaccuuuuucuccacuccaaacugagacuaagagggaaauuguuggcugcuaacug

SEQ ID NO: 4157901 - RNA, 99 nt, Human
uaguuagaguaucuugagggcaucuguuuugugaauugauauauauucucaauugaaaaagaaguagugugcuccagcggugaguuuguaaucuaauug

SEQ ID NO: 4157902 - RNA, 92 nt, Human
uaguuagccggaguguuggugauugggaugccggcugauaagagucgacucuaauuuuggcauuuuaaccuacauucugagcugucacacua

SEQ ID NO: 4157903 - RNA, 63 nt, Human
uaguuaggaauagcagcgacucuuccgcaagggcucagcguuguuuucuguuuugccugucug

SEQ ID NO: 4157904 - RNA, 74 nt, Human
uaguuagguacuaguauagaauauaccagugcauaaguuaguugacugguucauuagguauuaguggcuuucug

SEQ ID NO: 4157905 - RNA, 79 nt, Human
uaguuaguuuuucugagauggagucuuuuucugucacccaggcucuggagugcaguggcgccaucucagcucauagcua

SEQ ID NO: 4157906 - RNA, 59 nt, Human
uaguuaucuaaauauuauuugaguaaaauacucggucuaaaguaauauuuguguaacug

SEQ ID NO: 4157907 - RNA, 76 nt, Human
uaguuauuaugauuauguacuaaaaacucaguuuuugacuugaacuagagggaaauguauauaaccauagugacua

SEQ ID NO: 4157908 - RNA, 62 nt, Human
uaguucaccccucuuuauuuucccaauaaggaaauuaagacccagagagguuggcugaauug

SEQ ID NO: 4157909 - RNA, 86 nt, Human
uaguucagacccuccaagauugcuuagaagaugccuuucauccaggaaggcagcaagaauuccagguuaucuguggggcuaaauua

SEQ ID NO: 4157910 - RNA, 60 nt, Human
uaguucgaguauucuaaucuguggaaccucaagccacaguaauauugaugcucgucauua

SEQ ID NO: 4157911 - RNA, 57 nt, Human
uaguucuguuuauauuugguguccacguauauuaagaaauucaaauguacagaacua

SEQ ID NO: 4157912 - RNA, 65 nt, Human
uaguucuuggagggcguguuuggcuggacacauccaugcuccauaguuaaaccuuuagagaacua

SEQ ID NO: 4157913 - RNA, 105 nt, Human
uaguugaagacuucucuuugcuauaacuacuugaagaguucagcagaaaaauuuuacugaagaaucccugauccuccuuuaaguagcuguagagaauauucacua

SEQ ID NO: 4157914 - RNA, 92 nt, Human
uaguuuacaauaccauuagcaggaugaguacaagguaacuuaucuaggacuuguaauuaacguucuuguuagauauggucuuugugcaacua

SEQ ID NO: 4157915 - RNA, 77 nt, Human
uaguuuacugagaaugaugauuuccaauuucauccaugucccuacaaaggaaaugaacucaucauuuuuuauggcug

SEQ ID NO: 4157916 - RNA, 58 nt, Human
uaguuuagcacuaagaaaaacaagaguccggggacagguuguuggaggugcugaauua

SEQ ID NO: 4157917 - RNA, 80 nt, Human
uaguuuaugaaauauucuuugguaagaagaaauaaauuccaugccuuuuucuuuaccagugaaauguuauaugaaagcua

SEQ ID NO: 4157918 - RNA, 62 nt, Human
ucccagagacagagccuccucccaccagcagacgggagcuggaggcagggcuguccugagga

SEQ ID NO: 4157919 - RNA, 67 nt, Human
ucccagagcaggguuucucagccucggcacuacugacauuggggauggaugaaucuuugcugugggg

SEQ ID NO: 4157920 - RNA, 58 nt, Human
ucccagagcugauaagccuuuaucuguaaaauagaaagaacaggcuggcucacaggga

SEQ ID NO: 4157921 - RNA, 60 nt, Human
ucccagaguauuagcaauugcuaaugcagcaucaucugcaguuguuuuagugcuguggga

SEQ ID NO: 4157922 - RNA, 56 nt, Human
ucccagagucuucuccuguaauacaaaccacuguauguauaggcauccaucugggg

SEQ ID NO: 4157923 - RNA, 72 nt, Human
ucccagaucuuuguuucuccugucauuucugaucacucgagauuaaaaacagcaauggagaagccaggagga

SEQ ID NO: 4157924 - RNA, 55 nt, Human
ucccagcaccugaugaaguaggacugcaacuauccccacuucccagaugagggga

SEQ ID NO: 4157925 - RNA, 70 nt, Human
ucccagcagggccgaccagccuaccauacaggugccacugaggggcaaugguggguccuguucccuggga

SEQ ID NO: 4157926 - RNA, 79 nt, Human
ucccagcccaguccacccuuacuccccaacuaaagggaagauaguucuuucuccuggggccgugaugugaggccuggga

SEQ ID NO: 4157927 - RNA, 66 nt, Human
ucccagccuguggcagaggucuaauguuaacagaagcguuaaaaucuauacacgagguggguggga

SEQ ID NO: 4157928 - RNA, 57 nt, Human
ucccagccuuaucuccccuggcuccucaacaggaacccaguccuagugaagcuggga

SEQ ID NO: 4157929 - RNA, 86 nt, Human
ucccagcuugugagacguuaaucacucacuggacucugcuuuuuagaggcagaagugaaugugauaaaccauuugaauagcgaaga

SEQ ID NO: 4157930 - RNA, 87 nt, Human
ucccaggaucagguuuuuaacucugugguucaggauucuguuugcuaaggaccuggcauaagggcuugaguccagcuugcccuggga

SEQ ID NO: 4157931 - RNA, 85 nt, Human
ucccaggauucugcuggagggagcugauagugauacuugucccuucuguacauugcuucauguagccuucucagcaucccuagga

SEQ ID NO: 4157932 - RNA, 59 nt, Human
ucccaggccuaggcaugagggagaaguguaccugcaucuccuucccccuuggccuggga

SEQ ID NO: 4157933 - RNA, 80 nt, Human
ucccaggcuccaugcaaaggcuguuuggaagcuccauggauagaaagggccgagggcaggcugcaugggggaagcuggga

SEQ ID NO: 4157934 - RNA, 66 nt, Human
ucccagggacagcuagguggggcuugagguaguuauagcuucuagauuuguccccugucccuggga

SEQ ID NO: 4157935 - RNA, 55 nt, Human
ucccagggacccagccugauacccucauaucuggcacauagcagggucucugggg

SEQ ID NO: 4157936 - RNA, 55 nt, Human
ucccagggccgcaaacgaguuugggcggaagccagggcuuuggggcuuccuggga

SEQ ID NO: 4157937 - RNA, 108 nt, Human
ucccaggugcugcaggugaaugggccugugucacucuucgugggcacugaugucaggcaugggccuggaagaggacagagaaaguguguucugcaagcagccuuggga

SEQ ID NO: 4157938 - RNA, 74 nt, Human
ucccagugagaugaaacagguaacucaguuggaaaugcagaaaucacccgcuuucugugucaaucucacuggga

SEQ ID NO: 4157939 - RNA, 63 nt, Human
ucccagugggaagcagcacgcucccuaugaugguugguagugagaugcagugacccacugggg

SEQ ID NO: 4157940 - RNA, 82 nt, Human
ucccaguugaauuuguguaccuguggaugggagagucacuagagauuucucuuauugaugaaggugcuaaauugccucggga

SEQ ID NO: 4157941 - RNA, 61 nt, Human
ucccaguuuucuuucaucuaucagcaaugagaacacugcuucaggauggaagaggguggga

SEQ ID NO: 4157942 - RNA, 77 nt, Human
ucccaucagcuaaacuuagugaaauaaagggcaaaaaaaucccuguugauuucguucauaaguucagucuccuggga

SEQ ID NO: 4157943 - RNA, 89 nt, Human
ucccauccaauacuagaugguugggugugugaaacagacucugcguuuaccugcacagccagccauguggaugacgguuggaacuggga

SEQ ID NO: 4157944 - RNA, 81 nt, Human
uccucugugcaugaagcaggcagcuccuggcuguugauaaagugccguggacaccuucugcuucgugcagaugcacgauga

SEQ ID NO: 4157945 - RNA, 74 nt, Human
uccucuuagaucuuaauugagccuugaguauauuuaucucaugauguagcgaaugagaaucugaauacagagga

SEQ ID NO: 4157946 - RNA, 95 nt, Human
uccucuuauaaucagacuuucuggaagcuaaaaacacagcaguuugguuuuauugguucuucuacuugaaagugacauuucugagacauagagga

SEQ ID NO: 4157947 - RNA, 64 nt, Human
uccucuucaaaaggauuuccuuucucccuauuaaucaaggucagguaucuuuuguuggggagga

SEQ ID NO: 4157948 - RNA, 61 nt, Human
uccucuucaaaauagcucugaaaaauaugauuggaauuucuggagucuauuuugaaaagga

SEQ ID NO: 4157949 - RNA, 65 nt, Human
uccucuucucuagagccggaauccccuaggagcauuuccuuguuuuccuccucuggagaagaaga

SEQ ID NO: 4157950 - RNA, 107 nt, Human
uccucuucuguucuguuuacagugucuuugggcagcaauucuucagaaucaugaaaugaacugagcuuaauugcugauuuuccccaaaguuauggaggggaagagga

SEQ ID NO: 4157951 - RNA, 90 nt, Human
uccugaacuuagugggaauaucucuaguacuuccucacucacacuaaaacugccuuugugacaaaagagauauuauuuaccaaguuagga

SEQ ID NO: 4157952 - RNA, 85 nt, Human
uccugaagcccaaauaagauuugugcucugacagggugagcauuuacuuuaucagaaaacacauuagggugggcaugucucagga

SEQ ID NO: 4157953 - RNA, 108 nt, Human
uccugacacagaguaauuugucaggaccugcccuggcuugagaaaggugaagaagcugccucacugcucugaaaguacaggguagguacacugugagcuguggaaggg

SEQ ID NO: 4157954 - RNA, 80 nt, Human
uccugacacucaguuuccuuguuuaccuacuggaguauauacuaccuauuuuagauaggugauuaggaaaagccucauga

SEQ ID NO: 4157955 - RNA, 85 nt, Human
uccugagacaccaaaugcaauuuuuccagugcuacuguggugcuguaacaugggcaguguauuggaaggaauauguguauuagga

SEQ ID NO: 4157956 - RNA, 63 nt, Human
uccugagaggugugaggugcagggauacccaccucugccuugacggccgcgcaccccuuagga

SEQ ID NO: 4157957 - RNA, 63 nt, Human
uccugagagguuuauaacgcagaucagauaacaccagcuucuccugucuuuugccucuuuggg

SEQ ID NO: 4157958 - RNA, 84 nt, Human
uccugagauuguuugaagcacaggugaaacagucagguggauaauuucaccacugaacagcaccgugacugugacaauucagga

SEQ ID NO: 4157959 - RNA, 84 nt, Human
uccugagccacugugcuggguccuucuuuugaguuucugauuagucuuucgaaggaggcacucagacaugcaucuaugucaggg

SEQ ID NO: 4157960 - RNA, 63 nt, Human
uccugagcuucaaaacacuuugcuauaaauuuccuuugcuauagagaguucuugggcucagga

SEQ ID NO: 4157961 - RNA, 56 nt, Human
uccugagggacugguuccucgcugggaggaggaggauguagccagaaccucuggga

SEQ ID NO: 4157962 - RNA, 72 nt, Human
uccugagucacugggauuacaggcacgugcuaccacacccagcuaauuuuuguauuuuuaguagagacaggg

SEQ ID NO: 4157963 - RNA, 61 nt, Human
uccugagugucagauguccagggcagcauugcugauguuccccaggacucugaccucaggg

SEQ ID NO: 4157964 - RNA, 67 nt, Human
uccugauccccuucccaguaagccuuuggggcagcagguauugaggcugcuugggaagaggauagga

SEQ ID NO: 4157965 - RNA, 66 nt, Human
uccugaugcacuugccccuccucagaccggccugaugggcgucugugggacucaggagcgucaggg

SEQ ID NO: 4157966 - RNA, 78 nt, Human
uccugauguauaucauguuuccuaaacuagacuggaaacuuccccuggacggggaauaugacuuauuuuuuacagugg

SEQ ID NO: 4157967 - RNA, 60 nt, Human
uccugcagcauccgucgucuguaucauaugaugguccucgauaccaggauguugcagaga

SEQ ID NO: 4157968 - RNA, 58 nt, Human
uccugcagccugaaaaacaacagccuuaagcuguagguuaacauuucuaggugcaggg

SEQ ID NO: 4157969 - RNA, 61 nt, Human
uccugcaguuacaucccagccagggcccguggaggaggggcugggauggagacugcaguga

SEQ ID NO: 4157970 - RNA, 62 nt, Human
uccugcaugucacucugcugucccugaggugcacacacugggggugcuguggucaugcagga

SEQ ID NO: 4157971 - RNA, 66 nt, Human
uccugcauguuuucuggcaggcuuauaaccaugcaaagcaguuauaccuuccacaaaacagcuuga

SEQ ID NO: 4157972 - RNA, 90 nt, Human
uccugcauuguaugguuauaaauagcacccuagugagugcugucguccagucucucuugggugugguuugaaugaucucgggaugcauga

SEQ ID NO: 4157973 - RNA, 68 nt, Human
uccugccuccgagacucgaguguccucagcuccuccagcucugggcucacgagucuggacaugcagga

SEQ ID NO: 4157974 - RNA, 55 nt, Human
uccugccucuuuucuuauuccagauuucucacuuucuggggaauuagcuguagga

SEQ ID NO: 4157975 - RNA, 66 nt, Human
uccugccuguuccaagucagaggcucccuaauauucccgagugucugaaagggaugcugggcagga

SEQ ID NO: 4157976 - RNA, 56 nt, Human
uccugccuugccugggacaucaggagcugagggucuauauaggucaggacccagga

SEQ ID NO: 4157977 - RNA, 56 nt, Human
uccugcucugauggguucuccucugugcuuggugagaauucuccuucagggcagga

SEQ ID NO: 4157978 - RNA, 69 nt, Human
uccugcucuguuuuaugagccauauaaccuugugaugcaauuauggcuaacguacagacucaggcagga

SEQ ID NO: 4157979 - RNA, 67 nt, Human
uccugcugaagcuagguucaugaggucggaaauccccaccacauuugccuagacuuugggcacagga

SEQ ID NO: 4157980 - RNA, 111 nt, Human
uccugcuuccagccuuuccaugagggacacuggaugcugccauuggcucccugcauugccuuauuucagcaccuguggcucaugcucguggagcuggggcugguugugggg

SEQ ID NO: 4157981 - RNA, 57 nt, Human
uccugcuucuucgagcuucugguagccccagguauuccuuagcuuggagcagcauga

SEQ ID NO: 4157982 - RNA, 76 nt, Human
uccugcuuuuguuaauuccacuccagauguauauggucuaguagaacacugguguacaggagguaaaaggagagga

SEQ ID NO: 4157983 - RNA, 80 nt, Human
uccuggaaaguguuucugaugaaguuuauaugaacuuacuggcccaaauaucaaacugaauuaaacacuuguuccaagga

SEQ ID NO: 4157984 - RNA, 59 nt, Human
uccuggagccucauucaaacacaauaaacauucaguugacuuguuaugagacucuagga

SEQ ID NO: 4157985 - RNA, 89 nt, Human
uccuggaggccuuugugucugggacuuugagggagcugcaaggaagagggaacuugucagcccaaagccccaggcuagagagaccagga

SEQ ID NO: 4157986 - RNA, 58 nt, Human
uccuggagggcucacaggcggcacccgcagugcacguguugccacuggucuucaagga

SEQ ID NO: 4157987 - RNA, 84 nt, Human
uccuggauaucaaacaaacauuucagugcucuucaaucuuagauguuugugauuugauguagcuauuuccuuaacaagucagga

SEQ ID NO: 4157988 - RNA, 84 nt, Human
uccuggaugaaauuguuuugauacuuuaaaggauaaaccuuaaacugucuuuaaaaagguuacucagaauaacuuccucuugga

SEQ ID NO: 4157989 - RNA, 61 nt, Human
uccuggcaggcagugugggagcuggggcacauuccccacgcaucccuaugcccugcgggga

SEQ ID NO: 4157990 - RNA, 57 nt, Human
uccuggcccggccgggccugcucacaaaccgaaacgcaggcggcugcggcgccggga

SEQ ID NO: 4157991 - RNA, 64 nt, Human
uccugggacaccccaauaugaggucagggagaugacaaggaacuucauggguggaaugucagga

SEQ ID NO: 4157992 - RNA, 64 nt, Human
uccugggcuccaguuuccccuuggggcccugaagaaaggggcugggggucccuggugccuggga

SEQ ID NO: 4157993 - RNA, 90 nt, Human
uccuggggagcuuuaaaaacugcccugcucugguuuagucagucugggcugggucccaggugucuagaguuuuaguuuuguuucccagga

SEQ ID NO: 4157994 - RNA, 56 nt, Human
uccugggggcuccaacagguuguggguauucucauccugcugauggcccuccagga

SEQ ID NO: 4157995 - RNA, 107 nt, Human
uccuccucuuguuccaucucugugggcuuuugucagccuaggcauuuuucaaaaucacaugccacauccuucagaaagcuuuugggggugggaauaucagaggaggg

SEQ ID NO: 4157996 - RNA, 57 nt, Human
uccuccuuguauucuauuucacuucugcagacaagaagugugaagcccucaggagga

SEQ ID NO: 4157997 - RNA, 67 nt, Human
uccuccuuuggcagucagucuuggugcuuccauaaggagugugcuguagaagggcuugcguggggga

SEQ ID NO: 4157998 - RNA, 76 nt, Human
uccucggaauauugcuucauguacaguuauuggagaugaguaacuuacauucucuuaauuguaaugguuccuugga

SEQ ID NO: 4157999 - RNA, 70 nt, Human
uccucggccgcucugcugcucaguggcggccucugccuugccugcuggagcagggcucuucagccgagga

SEQ ID NO: 4158000 - RNA, 85 nt, Human
uccucgugggacccuccuggaaggugacugucuugaaugcuuuauucauggccaugguaccuuuuugaggagguuucguagagga

SEQ ID NO: 4158001 - RNA, 80 nt, Human
uccucuacgucuucguuggcagagauuuccaagaaaaguuuuuccagucuuugacuucugcccuggcgagggcguuugga

SEQ ID NO: 4158002 - RNA, 63 nt, Human
uccucucagcagccagauccagagcucuccuggggggcgaggguuggggguugcugcacugga

SEQ ID NO: 4158003 - RNA, 89 nt, Human
uccucucccccauccuuucuccagagguggcuagaguugaaaaaacauuugucucucagcugaucaucugggacugaggagaaagagga

SEQ ID NO: 4158004 - RNA, 55 nt, Human
uccucugaaauguguguucggcuuuacuaaaucugaacacauuuucuucaguaga

SEQ ID NO: 4158005 - RNA, 87 nt, Human
uccucugacuggaaugaucuuuccucuuguuugucugaaaaaaaauugguuucaacauucagcugaugggucauauucucaguagga

SEQ ID NO: 4158006 - RNA, 57 nt, Human
uccucugacuucugguugaguuggucaauggggagcaccagcaggagaucagaagga

SEQ ID NO: 4158007 - RNA, 64 nt, Human
uccucugagcauauugucuacauuucagaauaagcauaaugaauaaacaagguugcucugagga

SEQ ID NO: 4158008 - RNA, 56 nt, Human
uccucugagguggcuuccccgagccugcgggcagggcgugcagcccccucagagga

SEQ ID NO: 4158009 - RNA, 59 nt, Human
uccucugcuccuguggcucuggaaggagaugcacuguucucccacccagggggagagga

SEQ ID NO: 4158010 - RNA, 57 nt, Human
uccucugcuuguccccaaacugucugacuacaccagcaaauagacauggcuagagga

SEQ ID NO: 4158011 - RNA, 58 nt, Human
uccucuggcucuuucccuaggaaguguuauagcuucccaaguacuaaagugccaagga

SEQ ID NO: 4158012 - RNA, 61 nt, Human
uccucuguaaaacauugcuaaauaaugcugcagcuucucuggcagccagugguacggugga

SEQ ID NO: 4158013 - RNA, 66 nt, Human
uccucuguaguaagagaacauauggcaaacaaaggccucucuaaauaugcauucauacuuagugga

SEQ ID NO: 4158014 - RNA, 61 nt, Human
uccucuucugcccaucagaggcgcgguggucucccaucgaucguugugggccggagcaggg

SEQ ID NO: 4158015 - RNA, 99 nt, Human
uccucuugaaguuacucuaaaauguugacagaugugaaagugagcauuaucgaaugcuuaguuuuacauuugcauucagaucuguuguuucaaugggga

SEQ ID NO: 4158016 - RNA, 70 nt, Human
uccucuugcuauuuguuuucaaugugucauucaguggugggcugaaauguuaaacaaguggcucugaggg

SEQ ID NO: 4158017 - RNA, 70 nt, Human
uccucuuguauuggaguuaguggggaguguguguuucuccuccacuggccugucaguauauuuagaguga

SEQ ID NO: 4158018 - RNA, 103 nt, Human
uccucuuucccugggaugcucugagguccucagagggaaagguucgggaucccccgugccucucccugcagggcccagggcagcugaucccacucaucgagga

SEQ ID NO: 4158019 - RNA, 85 nt, Human
uccugaaaauuggaccaauauugacagcuuuugcuuaauccagaacagcucauugagaaaggggucaauaucucucccacuagga

SEQ ID NO: 4158020 - RNA, 66 nt, Human
uccugaaauucuuuggaguuuucuuaaaaggaauuucugacagaaacucuggaagaacuuuuagga

SEQ ID NO: 4158021 - RNA, 68 nt, Human
uccugaaguucaagagugacauauuaggcuuauauuaggcuuauuuguaauguuugaauuauacagga

SEQ ID NO: 4158022 - RNA, 58 nt, Human
uccugaauuccucuuugcauccauauucagggaugcaaagagaccugggaaauuagga

SEQ ID NO: 4158023 - RNA, 75 nt, Human
uccugacaguuaaauagauuucuaacagugugcuuguaaugaucaaauggcaagugaacuuagaggucuuaagga

SEQ ID NO: 4158024 - RNA, 69 nt, Human
uccugacccaagauaccugucaguuccuccgucaccaaauaucaggugcguacuucagguguggucuga

SEQ ID NO: 4158025 - RNA, 57 nt, Human
uccugacccauuauagugaccugugguuugaaacacaggguccuacagggcucagga

SEQ ID NO: 4158026 - RNA, 70 nt, Human
uccugacuccaaggccagcuaucuuuccacaucugcugcaaaugucaugaggcuagcccccaaguuggga

SEQ ID NO: 4158027 - RNA, 56 nt, Human
uccugacuuaacuacucucuggagcuacugccuacuagagaagagguuaagcauga

SEQ ID NO: 4158028 - RNA, 101 nt, Human
uccugacuuuucuuaagcauuaaagucucuuuggguacuuuauuuuacuagcugagaauaauaaaaagagcauuuuaaauguuaggcagugaaaaucagga

SEQ ID NO: 4158029 - RNA, 58 nt, Human
uccugagaaggaguuuccauggccuugcuuuaguauuuaacaaacuucauucucagga

SEQ ID NO: 4158030 - RNA, 59 nt, Human
uccugagagggguggguuucccaugaagcuuaagucucagggcuccucucucucaaggg

SEQ ID NO: 4158031 - RNA, 78 nt, Human
uccugagauucaaaagaccaugcagacucuuuugcaccauauuucugugcggagaucuuucuggcuuggauuugggga

SEQ ID NO: 4158032 - RNA, 61 nt, Human
uccugagcaacacagcuaaguggcauuccccaccccugcucuuagcaaaaguuccucagga

SEQ ID NO: 4158033 - RNA, 57 nt, Human
uccugagcccuguaggacccuguguuucaaaccacaggucacuauaaugggucagga

SEQ ID NO: 4158034 - RNA, 90 nt, Human
ucgcagagcaccucgaugggcguggcgcguuugguguccccgaucuucugguaccgcuccuugagcgugucggccugcgggggucugugg

SEQ ID NO: 4158035 - RNA, 61 nt, Human
ucgcaugcagaaaaugaacaacgaagugguggacaagguugguguuuuauucugccuggga

SEQ ID NO: 4158036 - RNA, 63 nt, Human
ucgcauugaccaaaauugaagggaugggggaacaguucaccuuuggauaauuugaguuugcgg

SEQ ID NO: 4158037 - RNA, 58 nt, Human
ucgccgaggcuggagugcaguggcgcgaucuuggcucacugcaagcuccgccucccgg

SEQ ID NO: 4158038 - RNA, 76 nt, Human
ucgccugagccccagagguugagucugcagugagcugugaacaugccacugcacuucagccugggugacagagcga

SEQ ID NO: 4158039 - RNA, 57 nt, Human
ucgccugcugugcagucuauuucgggacucagucucaguugcugcugcugcagguga

SEQ ID NO: 4158040 - RNA, 89 nt, Human
ucgccuuucaaaaaagggaguggcaggaggaacagcgagucagacuugaaaugaaacuucuccacccacucuuuuguugccagagguga

SEQ ID NO: 4158041 - RNA, 78 nt, Human
ucgcgaauugguuuugcugcugguuuugcuguguguggcuugcuggaccagcuguuaucuguaguaucuaaagcgugg

SEQ ID NO: 4158042 - RNA, 76 nt, Human
ucgcucugacacccaggcuggcgugcaguggugugaucucggcucacugcaaacuccgcuuccuggguucaagugg

SEQ ID NO: 4158043 - RNA, 76 nt, Human
ucgcucugucacccaggcuggagugcaguggggcgaucuuggcucaccgcaaccuccgccuccugaguuuaagcga

SEQ ID NO: 4158044 - RNA, 77 nt, Human
ucgcucuuguggcccaggcuggagugcgguggugugaccucggcucacugcauccuccgccucccggguucaaguga

SEQ ID NO: 4158045 - RNA, 86 nt, Human
ucgcugggauuacaagugucagguacuggcaccuggaaagccuggugccagcgccugacacuuguaaccuccuucccuuaugguga

SEQ ID NO: 4158046 - RNA, 60 nt, Human
ucgcugugaaaaccuuggacaaaucccuucccugcggacuccuggguuguacuacaguga

SEQ ID NO: 4158047 - RNA, 77 nt, Human
ucgcuugaacccaggaaguggagguuacagugagcugagaucacuccacugcacuacagccugggcgacaagagcga

SEQ ID NO: 4158048 - RNA, 77 nt, Human
ucgcuugaacccaggaaguggagguugcaaugagcugagaucucaccauuacacuccagccugggcaacaagaguga

SEQ ID NO: 4158049 - RNA, 76 nt, Human
ucgcuugaacccaggagauggagauugcaguaggccaagaugaugccacugcacuccagccugggcuacagagcga

SEQ ID NO: 4158050 - RNA, 77 nt, Human
ucgcuugaacccaggaggcagauguuguggugagcugagauugcgccauugcacuccagccugggugacaaaaguga

SEQ ID NO: 4158051 - RNA, 75 nt, Human
ucgcuugaaccuaggagguggagguugcagugggccaggaucgcaccacugcacuccagccugccaacagagcga

SEQ ID NO: 4158052 - RNA, 77 nt, Human
ucgcuugaauccagguggcggagguuguggugagccaagauugcaccauugcacuccagccugggcaacaagaucga

SEQ ID NO: 4158053 - RNA, 76 nt, Human
ucgcuugagccccugaggcugagguugcagugagccaagauggcgccaccgcacuucagcuugggcuaccgaguga

SEQ ID NO: 4158054 - RNA, 60 nt, Human
ucgcuuugaugcuggagaacuaaucacccagagagaacuggucuccaggcaggugagcga

SEQ ID NO: 4158055 - RNA, 55 nt, Human
ucgcuuuguaucuaaauaucuugaaaugaggcuuacaggguauagguacagauga

SEQ ID NO: 4158056 - RNA, 64 nt, Human
ucggaaauucacugucagcuugcaugggguagaagccccaucagagcugaaggcgguuugcuga

SEQ ID NO: 4158057 - RNA, 65 nt, Human
ucggacacccagcuucggcaagcucucuccaagggugagugggccagugggaccugggucuccgg

SEQ ID NO: 4158058 - RNA, 129 nt, Human
ucggacaucaugccuucaccugugcgcuucugagccucaagggcuuguggcauguuuugaugcuguguuuaugccaugcacacguacccuacaaggcacgccaguguacauauggcaugcauaauugga

SEQ ID NO: 4158059 - RNA, 77 nt, Human
ucggaccccgggaguuuccucuuccgagggggaggcgaggccgcgccagcuagcggggaggaaaugccggagucugg

SEQ ID NO: 4158060 - RNA, 78 nt, Human
ucggacgccugagaagaggaacugggggcugaguccuguccuggccuggccgcuccccauuccucccucugccucuga

SEQ ID NO: 4158061 - RNA, 64 nt, Human
ucggauggggugggcaugcgcuguccuucccguuuauuuaggaaggaggggucuuucccacuga

SEQ ID NO: 4158062 - RNA, 72 nt, Human
ucggccaauucuggcucaauuuguacugcugugggagcuacccacagagacugggagcaagaggcaggcgga

SEQ ID NO: 4158063 - RNA, 71 nt, Human
ucggccauuuaucaggacagggaugccaaccaacaguguccagugucuagcagaugacaggugugugccga

SEQ ID NO: 4158064 - RNA, 129 nt, Human
ucggccucccaaagugcugagauuacaggcaugagacaccauguccggccgcaauggguaguuuagaaaggucauuuugaggcagggcaugguggcccacaccuuaaccccaguacuuugggaggcaga

SEQ ID NO: 4158065 - RNA, 55 nt, Human
ucggccugugggcacugagcauacaguaggugcucaguaaaugcuugcaggccga

SEQ ID NO: 4158066 - RNA, 56 nt, Human
ucggcuauauggcuccagugguaaugaucuucugccacauagcuauagaaagucga

SEQ ID NO: 4158067 - RNA, 59 nt, Human
ucggcugcugguggggcuaucugggccugucugggaaguggaagccaucggcagucuga

SEQ ID NO: 4158068 - RNA, 63 nt, Human
ucgggaacuuugcugagaccucuuaaaauauuuagggagucaacacaguaauguuaacccuga

SEQ ID NO: 4158069 - RNA, 89 nt, Human
ucgggagguucuacuccacgcccagcugaaaucuccaggcucucaacagcuggaggagaauagcagggcuuugggaagaacuuaauaga

SEQ ID NO: 4158070 - RNA, 77 nt, Human
ucgggccuguuggaauuugcucauccauuucaucgugggccagugugaaauggugagggaauugaacagcgucacga

SEQ ID NO: 4158071 - RNA, 57 nt, Human
ucgggcuccugcacuuggagaccagccucugugaaacacagguguagugagucauga

SEQ ID NO: 4158072 - RNA, 129 nt, Human
uauuugucauuuggauggcuaguauugugacucaaguauucuagacaagcugugauuaaauauuucaacagaagaccucaaagaauuacugauuuauaauuacccacguuaccuaugcuacaauaauua

SEQ ID NO: 4158073 - RNA, 66 nt, Human
uauuuguccagguaaauuucagauauuauucucucuuaaauuaucugaaaucugaugggacaaaug

SEQ ID NO: 4158074 - RNA, 60 nt, Human
uauuuguuguauucuuucuauauuuguggcacugcauuauaugcuggaguacaggaaaua

SEQ ID NO: 4158075 - RNA, 84 nt, Human
uauuuguuucuggaaagguauauuucucugguuguuagcucauuugcagaaccauuuugacagauauacugaggccaaugaaua

SEQ ID NO: 4158076 - RNA, 59 nt, Human
uauuuguuuugugugugcugcacuaggccuggggaauacagcagcaaacaaaacaggua

SEQ ID NO: 4158077 - RNA, 71 nt, Human
uauuuuaaauuauugucucauguuuacagcaacugaugcuggauuugcauuuaugauaguaauaugaaaug

SEQ ID NO: 4158078 - RNA, 101 nt, Human
uauuuuaauauaccaccuauuuuauauugaacuuucuuuguauagauucugaguuggagaauugcaaacagaaaguuuauuguggaauguucuuugagaua

SEQ ID NO: 4158079 - RNA, 73 nt, Human
uauuuuacagacuacuuuagaugcuaguaauuuuccugcuggugcauaaauauuuggagugguuuguauuaug

SEQ ID NO: 4158080 - RNA, 61 nt, Human
uauuuuaccuucuuuuaacuacagugcuaauuuuauacacugaguaagacagggugauaua

SEQ ID NO: 4158081 - RNA, 60 nt, Human
uauuuuagagaaccucuugaaaguggccaccucggccuuuugcaauaagucacuggaaua

SEQ ID NO: 4158082 - RNA, 64 nt, Human
uauuuuauaauuauuaauucuuuauguggaacaccgcaaaagagugacugauaaguauaaugug

SEQ ID NO: 4158083 - RNA, 73 nt, Human
uauuuuauaauucagaucccauguucaagugagugauguugugcugcauuugcuggggaugugauuggaaaua

SEQ ID NO: 4158084 - RNA, 79 nt, Human
uauuuuauaugcuucugaagaucuugcauagcuuuccuuguuaaucauuugcaguguuuuucagggcauauugcaaaua

SEQ ID NO: 4158085 - RNA, 114 nt, Human
uauuuuaucagaagccuguaccucaucgaguuccuucuauucagcuccaagaagcuuuaaggaucugggagagggaaagaagacuuacugaggacaggauaacugucuuaaaua

SEQ ID NO: 4158086 - RNA, 68 nt, Human
uauuuuaugaccauaagauuacuguuaacuuuuuuaugugugauaauaguauugugguuaugucuaua

SEQ ID NO: 4158087 - RNA, 67 nt, Human
uauuuuauuaaauuuugggaaugaaacagugccacagugugguccauguacagaguuugauaaagug

SEQ ID NO: 4158088 - RNA, 130 nt, Human
uauuuuauuuauguuuuuugagagucucgcucugucacccaggcuggagugcaguggcacaaucucggcucacugcacuccagccugggagacagacgagacuccgucucaauaaauaaauaaauaaaua

SEQ ID NO: 4158089 - RNA, 55 nt, Human
uauuuucuccuucuccucaagcuccugcuauuggggcacagagaugagcaaagua

SEQ ID NO: 4158090 - RNA, 65 nt, Human
uauuuucucuaccuuuugauuaagccauugaaaaucccuggcggaaugcaaauguaggaagaaua

SEQ ID NO: 4158091 - RNA, 75 nt, Human
uauuuucuuuccguuuaaaauguuuuaacaugagugauuacaucaguucuaacaguuuagaacaaagggaaagug

SEQ ID NO: 4158092 - RNA, 87 nt, Human
uauuuugaaagguacagaaauuaacaaggaaggaguuaacaccuccacucucauaauccuacuggugacuucuguauagcuaaaaua

SEQ ID NO: 4158093 - RNA, 82 nt, Human
uauuuugaacugaaggcaacugagaaaaagcagauacaagaaaaauuuucugccuucuuccuauuugccuaaagacaaaaua

SEQ ID NO: 4158094 - RNA, 77 nt, Human
uauuuuguggcacagugcuggauggugcuggcucccacaggugacacagucaucaccaguacagugugcaggagaua

SEQ ID NO: 4158095 - RNA, 78 nt, Human
uauuuuuauaugaauaugauguauggguccagcuuuggaauauuuggacacaauaacagaugcuucagcauaaaaaua

SEQ ID NO: 4158096 - RNA, 130 nt, Human
uauuuuucuuauuuuuaguguagauuccaagaaauagaauuuaaggaccaagcauuuugauuccaaguccagaguucuuugagaccuuaaauuagguuauucagaauauuaacuaaaacagagagaagua

SEQ ID NO: 4158097 - RNA, 86 nt, Human
uauuuuuuacuuggcauuuucuuggaaacuucaaacaugugcaaaacacauguaucaugcaggguccaugaauuagcuggaaaaua

SEQ ID NO: 4158098 - RNA, 57 nt, Human
ucuccagguggggucaccuuuuuccuccauuccauaagagguggucuaggcuggaga

SEQ ID NO: 4158099 - RNA, 71 nt, Human
ucuccauagccaagcacagaggucaucuuguugccaagcacagagucgccuuguagcuggcacaaugggga

SEQ ID NO: 4158100 - RNA, 78 nt, Human
ucuccauaucccacuguaauuaucugaacgugcagauaccacucugcaucuuggaagauugcacaaauggguguggga

SEQ ID NO: 4158101 - RNA, 63 nt, Human
ucuccaucugucauucuuguccauggcaaauguggacaugucauucggaauguagcauggagg

SEQ ID NO: 4158102 - RNA, 70 nt, Human
ucuccauguuguuguaguugucccuggauugucuucaugucgcagcugaccuuuuacaaaacauguggga

SEQ ID NO: 4158103 - RNA, 71 nt, Human
ucuccauuagaaguucauuuuaagaacuucacagaauacuuuuggaagaggaaaaugagccuagagggaga

SEQ ID NO: 4158104 - RNA, 89 nt, Human
ucuccauuggugaauguuguagcagggcugaccagaagguuaccuauaucucauuugucugccuugcuggacuguaaacucgguggaga

SEQ ID NO: 4158105 - RNA, 55 nt, Human
ucucccacuggccuuguaugaucugagagcuggcaguggacaagcuaaugggaga

SEQ ID NO: 4158106 - RNA, 67 nt, Human
ucuccccauugaaguucacaagacgggaggccauuucuccucauucuuggugcaucaaauccggagg

SEQ ID NO: 4158107 - RNA, 75 nt, Human
ucucccccggaugcagcugagucacccagccaugccugcuaggcaggugggcaccaggcuuguggugggggugga

SEQ ID NO: 4158108 - RNA, 58 nt, Human
ucuccccuggucucgcgcgcugucugaaccccgggcggcagcguccggcuacgggagg

SEQ ID NO: 4158109 - RNA, 57 nt, Human
ucucccuacugacuccaggaccguaaccaaagcaaagguucuucagccaagaggaga

SEQ ID NO: 4158110 - RNA, 121 nt, Human
ucucccucaucugugcugucucugcuucuccaucacaaccagugcuuccugcuggagcuggaucccucagcuccccagggaagggacuggagugaaucaggugcacaggucaugagggaga

SEQ ID NO: 4158111 - RNA, 68 nt, Human
ucucccucauuccugcuuccauagguaccucauauuaccaauuucugaguuuaggggauagagggaga

SEQ ID NO: 4158112 - RNA, 91 nt, Human
ucucccugacaagacuauacacuuuuugaaaauagagacacuguauuuugugucuucuguacuccuugaguagugcuagucccaagggaga

SEQ ID NO: 4158113 - RNA, 86 nt, Human
ucucccuugggcucagcaagaaucagacaaccucaguguuucauuuuuggcugagcuggaaucuucuugacugugccuaugggaga

SEQ ID NO: 4158114 - RNA, 105 nt, Human
ucuccuaaggcacauuaaagaacccaaauuccauuuugugacuauucugagcaguuuuuggagagcauacuauaauggagguggggugauuuaaucacuuugaga

SEQ ID NO: 4158115 - RNA, 77 nt, Human
ucuccuaggacaguggagauaaccagaaaacuucaaaagucuuuucaaucuccagcuguuuuaugauucuaaggaga

SEQ ID NO: 4158116 - RNA, 55 nt, Human
ucuccuagucuaauacgccaggugucuuccugaaauauguggcaggggugggaga

SEQ ID NO: 4158117 - RNA, 65 nt, Human
ucuccuaugcauucaauggaaugcauaguuucaucuccuaugcauucagcggaaugcuuaggaga

SEQ ID NO: 4158118 - RNA, 69 nt, Human
ucuccuauuucucucacgguugccuggguaguagggcaugccacuggcaaauggagagaauguuagaga

SEQ ID NO: 4158119 - RNA, 82 nt, Human
ucuccucagaacacacugccaccugcaugcccugauuggucaggagugcaucuggagggggucaguuauaaggcugaggaga

SEQ ID NO: 4158120 - RNA, 63 nt, Human
ucuccuccaggaagccuuccuugucugcuccuuucucaacuggagcccuguuuccuggagaga

SEQ ID NO: 4158121 - RNA, 64 nt, Human
ucuccucugugacauagggcaaauaaugugucugcuugccuuuugaagccucacagguaggaga

SEQ ID NO: 4158122 - RNA, 78 nt, Human
ucuccugacaauuuccugccugacucuagucucuugagcaugaggagcucuuagauagggcaggaaccugucagggga

SEQ ID NO: 4158123 - RNA, 60 nt, Human
ucuccugccuuugcauccugggccagcaucucccuggucucagccugugaagagcagagg

SEQ ID NO: 4158124 - RNA, 56 nt, Human
ucuccugggaggacaaggaaggggcucugagacccaagccuggucuugucaggaga

SEQ ID NO: 4158125 - RNA, 109 nt, Human
ucuccuguggcugcaccccugacagccaggucugaugacccagauggcaaccacugcaacuggaguggugugggcucugcugucgggcacacacugagucacagugaga

SEQ ID NO: 4158126 - RNA, 85 nt, Human
ucuccuguuuggcccagggccaagccccuuuggcuguagcaacagaucuacugcgggcuguggcccugggucgccucucagugga

SEQ ID NO: 4158127 - RNA, 77 nt, Human
ucuccuucuccccucugcagggugugccucccaacaggaacaggaaaccaucacccuggaucuuagggggauggagg

SEQ ID NO: 4158128 - RNA, 107 nt, Human
ucuccuucugucucacaccaaacacacuacggucuucuugagucuugugcaaugauuacaugauuacacugagcaggaagaagugggggugaagacagagcaggagg

SEQ ID NO: 4158129 - RNA, 101 nt, Human
ucuccuuggacuuccuuuugggaaacuguuuaaggaacucacauacaauacauuuaaacagcuaauggccaggaauagaaguucaauacauaaacaggaga

SEQ ID NO: 4158130 - RNA, 79 nt, Human
ucuccuuuuucugggacccccacugcguagcucggcauggguccaagucuucagggggggcucagcaaagacuugguga

SEQ ID NO: 4158131 - RNA, 102 nt, Human
ucuccuuuuugaaauuccuuuucuuuuaugguuacuuuaauucuguucacuuuugugagcaaugacuuugaaaucaugacucggaaaggucagagaaagaga

SEQ ID NO: 4158132 - RNA, 71 nt, Human
ucucuaaaccuuuccaaaaugaaucuaaugcaggauuguccugcauggaucuuucuggaagaaaauggaga

SEQ ID NO: 4158133 - RNA, 57 nt, Human
ucucuaaaguagaaaagaccccagaauuaagcuugggucuuugcucugauuuagaga

SEQ ID NO: 4158134 - RNA, 60 nt, Human
ucucuaacaaugugaagugcuguucagcccaggauugccugccuggacuuuuauaagaga

SEQ ID NO: 4158135 - RNA, 59 nt, Human
ucucuagggaucuguuuuaauuuccugauucuuccaagacuuagaacauccucuaggga

SEQ ID NO: 4158136 - RNA, 61 nt, Human
ucucuagucacacaguaaggacgggcuaagccagcucugaauccaguugugugacuccaga

SEQ ID NO: 4158137 - RNA, 123 nt, Human
ucucuaucgaugaaacugcuuucucaaauacgucagcaaugggauucaggcuuugcuuacaaugugaaggaaguucuuagucucauuugcacaaagaaggaaggagggcuaaagauaaaaaga

SEQ ID NO: 4158138 - RNA, 58 nt, Human
ucucuaugacaagguuugguugcauaucuacaccugcaaccaaucacugucaaggaga

SEQ ID NO: 4158139 - RNA, 57 nt, Human
ucucuaugacuuuucucuccaugugaagaaaauguauggauggaaaaguugaggaga

SEQ ID NO: 4158140 - RNA, 56 nt, Human
ucucucaaaguaagguguauacauuauccuguuaguguugcaguuguuuuugagga

SEQ ID NO: 4158141 - RNA, 64 nt, Human
ucucucaauuuggguuugacugaugcuuucucaugaaaacaucagaauauccauguugggaaga

SEQ ID NO: 4158142 - RNA, 63 nt, Human
ucucucagcaccuccacaccacccaugccacaccccuguggcacugcaggaggacugagcaga

SEQ ID NO: 4158143 - RNA, 65 nt, Human
ucucucaggguuuccugggggcugcugaugggaaagaggcagcauucgcaggggcccugcagaga

SEQ ID NO: 4158144 - RNA, 129 nt, Human
ucucucaguggcugcaaucucuguugagccucuuguuuugucuuuggaaauuuaauguuuaauuauuuuuaauaugucaaaauauuaguuucucaagagagaggcugugcaguaacaggcauuuggaga

SEQ ID NO: 4158145 - RNA, 80 nt, Human
uccuggggcccucugagagugcuucauggggccagcaaguggugcguggggacccacgugcagcacucgaggccucagga

SEQ ID NO: 4158146 - RNA, 58 nt, Human
uccuggggguuuaaugagcaaccagauaaucuccugcuccagugccugccccacagga

SEQ ID NO: 4158147 - RNA, 76 nt, Human
uccugggugaugaaaugauugaaaucuuuacuguaucuuugggaagagaaaacaaugauuucuaagcaaccuagga

SEQ ID NO: 4158148 - RNA, 89 nt, Human
uccugguauucuuucuguagaucauuuuggugcuccacaaaauuaaccuccaauguuaugucugggaagggguauaucuaaaggcagga

SEQ ID NO: 4158149 - RNA, 67 nt, Human
uccuggucccagaauugguuagcacaagacaugggaauucuauugguuucaauucuugggacuggga

SEQ ID NO: 4158150 - RNA, 61 nt, Human
uccuggucccugauacaggcugucauccagcuccacuggcucagccucagcaggcccagga

SEQ ID NO: 4158151 - RNA, 75 nt, Human
uccuggugaggcuggaacugcuccagacuucagaaggggcuggaaaggauauuuuagguagaccuacaucaagga

SEQ ID NO: 4158152 - RNA, 59 nt, Human
uccuggugaucaaaauucauuuccgaguuauuuccugaaaugguauuuugacaccuggg

SEQ ID NO: 4158153 - RNA, 59 nt, Human
uccuggugcuuguauuugaaguccaagaagaggauuuugauuauuuguuacuuguggga

SEQ ID NO: 4158154 - RNA, 73 nt, Human
uccugguuauacuguaguuucugcagcuguggagccaaguccacuuucugagggaacagcagccaacugagga

SEQ ID NO: 4158155 - RNA, 60 nt, Human
uccugguuuauagcuuagggaaaguuacagcuuaguuauauguaugcuuauaaaccagga

SEQ ID NO: 4158156 - RNA, 55 nt, Human
uccuguacauucucgcuccucucagcuaacagcuggacucaggggaugugaagga

SEQ ID NO: 4158157 - RNA, 71 nt, Human
uccuguagcugucacugggggccccaccuccgacggaauccccggagccaccccggagauaggaacuagga

SEQ ID NO: 4158158 - RNA, 79 nt, Human
uccugucuuugggaaggguuaguuggauuauuuauacuuuauaaauuuucuugcuguacuuaguguuaaagaugaugga

SEQ ID NO: 4158159 - RNA, 66 nt, Human
uccugugccacucggcaaauauuugaagaaaaagaaugcuugcugggccaauggcaauuucaagga

SEQ ID NO: 4158160 - RNA, 68 nt, Human
uccuguggaagacaguguugggguccugccuauauccccugggcacuuaacauuuucuuaugcaugga

SEQ ID NO: 4158161 - RNA, 64 nt, Human
uccuguggcugugugagggauggauuguguuauaaaagacggcagucagggacaccagcuagga

SEQ ID NO: 4158162 - RNA, 67 nt, Human
uccugugguaguaaauuucagcuccauuguagguuucuccugcucauugcugauuuacaugucagga

SEQ ID NO: 4158163 - RNA, 97 nt, Human
uccugugucaaaaccauuacauauguuggcaacauuuaucaucaggaaaagcgucccaggaaguugaauucuaauguaugugugguguuacaaugga

SEQ ID NO: 4158164 - RNA, 81 nt, Human
ucuaaucaacucugcuguuccuuauucucagcucaaaaugggaacauagaguuugauagagaggaaccgggagaagagaga

SEQ ID NO: 4158165 - RNA, 65 nt, Human
ucuaauguauuuucugaggagcauuaggaaaauuauuuugcauuaaucucccaggaaaugaaaga

SEQ ID NO: 4158166 - RNA, 82 nt, Human
ucuaauucuacaaaagucuacaagcuucaacaagguuguuaugacuuuguuuugagcccuggacuugcugagcugaaacaga

SEQ ID NO: 4158167 - RNA, 64 nt, Human
ucuaauugcaauucucagagaugucuauggaaguguucagcagucucuggaguuagcagagaga

SEQ ID NO: 4158168 - RNA, 74 nt, Human
ucuacaagaacuggagcuguucaagguaguggauaucucacuacagugaagacuagcuauaguagaauugagga

SEQ ID NO: 4158169 - RNA, 70 nt, Human
ucuacaaggaguuagcaccagugcucauaacacuauuauaaugguggugguggugcuaacuccuguuuga

SEQ ID NO: 4158170 - RNA, 65 nt, Human
ucuacaauguugguaaaguaucauggacauauuuuaugcaauaaauacuuuccagcuguuggcga

SEQ ID NO: 4158171 - RNA, 73 nt, Human
ucuacacucaggccucauugcccaccuguggaggggccaccaucugcagaugggcgauggggccugaguggga

SEQ ID NO: 4158172 - RNA, 60 nt, Human
ucuacagacuccuauguaacacauuaaccaaacaaggaccugaaaacauagagucugaga

SEQ ID NO: 4158173 - RNA, 87 nt, Human
ucuacaggccagauugcuucuggaaagcaguuuuagaaaucacaugaaaauaguuguuuggaucaauaaaaacacuggcauguuaga

SEQ ID NO: 4158174 - RNA, 59 nt, Human
ucuacaguagaaagaucccaguaaccaaauuuguaauaugggaucucaucugucuuaga

SEQ ID NO: 4158175 - RNA, 63 nt, Human
ucuacauaaaaauucagaaggcacauccguguuugcccauagacuucuggauuauugugugga

SEQ ID NO: 4158176 - RNA, 59 nt, Human
ucuacauagaauuagguaauuuggaugacuuguuuccaaacuuugcuuaacugugugga

SEQ ID NO: 4158177 - RNA, 62 nt, Human
ucuaccagaaugugauaauggcuuccaugagggcggaagccaugugucuuuauucuguuaga

SEQ ID NO: 4158178 - RNA, 66 nt, Human
ucuacccugcagcuuuugcauagucagugacacacuugacaauuggcacagcugugcuggggaaga

SEQ ID NO: 4158179 - RNA, 109 nt, Human
ucuacccuuuaaaaaguuagcucacggucuugaaguuaaggucaacuauaaacauaagcuauggacaagaauuacaagauaugugagaacuagcacaaugaaagggaga

SEQ ID NO: 4158180 - RNA, 60 nt, Human
ucuaccggaacaaccaguuuagccaagaggagcugguuauuguggagaaguuccggaaga

SEQ ID NO: 4158181 - RNA, 84 nt, Human
ucuaccuguuuuccuucugggacucugcuuccuucuccuugguggacagggaggaguccucaaagucauaggagaagaggugga

SEQ ID NO: 4158182 - RNA, 81 nt, Human
ucuacuacagaagcucggguaagcuccauuuugucaugcugcagacuggaugaccucuugaguuucugugcaucucguaga

SEQ ID NO: 4158183 - RNA, 82 nt, Human
ucuacuaugucuaucucuuagcaauguuuuuuaacagaaagccaccauauaucucuguaauuauguuguuagaguauguaga

SEQ ID NO: 4158184 - RNA, 56 nt, Human
ucuacuauguuucuuaaauagaauguauaaguguucugaaauaggagccauguaga

SEQ ID NO: 4158185 - RNA, 55 nt, Human
ucuacucugguggggaccugccaucuugguuggcaagaagcccuuccugggugga

SEQ ID NO: 4158186 - RNA, 55 nt, Human
ucuacucugugccaugaagaccccucccagcuggaggggcugcaugcagagaaga

SEQ ID NO: 4158187 - RNA, 55 nt, Human
ucuacuguugguacuuaaucugcucugccuucuugguguagcagccagcacugga

SEQ ID NO: 4158188 - RNA, 65 nt, Human
ucuacuugucagucuucaaaucagagaaaaucaggaucaauaucugcuuugggaaagacaggaga

SEQ ID NO: 4158189 - RNA, 66 nt, Human
ucuacuuguuucuggaguccaccugacuacaguauguagauucucagaauuuuagaaacuuaugga

SEQ ID NO: 4158190 - RNA, 75 nt, Human
ucuacuuucugccuuaaaaguacuuuuacuuaaaacauccaguuagaaggguauuuuuuggcauugcuaguuagg

SEQ ID NO: 4158191 - RNA, 70 nt, Human
ucuagaagaauccuguccucuuuaggagugagagugagcccuggaauagacagggaucuuuccacauaga

SEQ ID NO: 4158192 - RNA, 60 nt, Human
ucuagaagauaccugcugccaacacaaauuagauuaguuggcauaaaaaucugcucugga

SEQ ID NO: 4158193 - RNA, 59 nt, Human
ucuagaauagauucugcugaucaccauauaacuuacugguuuagagagcuguuacugga

SEQ ID NO: 4158194 - RNA, 64 nt, Human
ucuagacaacuggagauagucugacuugauccaaagugaucaucucaggucauguuguauuaga

SEQ ID NO: 4158195 - RNA, 80 nt, Human
ucuagacaucaaagggguaggaaauccagagguggcuccucuauuuggagaacuggauauuuugcugccaggagucugga

SEQ ID NO: 4158196 - RNA, 74 nt, Human
ucuagacuacucuuggaugugucgccuucacacaacugaaaaugacaaaugcaacauguaagagaguuucaaga

SEQ ID NO: 4158197 - RNA, 61 nt, Human
ucuagagacuauaauguguccuugaagaauaaucuguaggacuauaucagaguuuccugga

SEQ ID NO: 4158198 - RNA, 83 nt, Human
ucuagauuccaagacaauauuucuggugcuucucacucaaggaaagaggaggagaauuuaaaaauacagguuggguuucuaga

SEQ ID NO: 4158199 - RNA, 85 nt, Human
ucuagcagaugaagguguaugcugugggucagggacauugaagcagaaacuuggcccuucuccagucaccucucccugugcuaga

SEQ ID NO: 4158200 - RNA, 59 nt, Human
ucuagcaucuaauuauggaaucuuuguuuuaguuagcaacaauuuaugaagaugcugga

SEQ ID NO: 4158201 - RNA, 64 nt, Human
ucuagcugaauuuugcuuucuaauuacagaaucagaauguaaggagaaaauguuuucagcugga

SEQ ID NO: 4158202 - RNA, 55 nt, Human
ucuagcugaggguaggagaccuggaauucacauggugcuaccuuacacagccaga

SEQ ID NO: 4158203 - RNA, 55 nt, Human
ucuaggaauguucuuagggauuugauacagacaaaccccugagaacauuucuaga

SEQ ID NO: 4158204 - RNA, 73 nt, Human
ucuaggcagguggucacucauccccagcucagaaguggguuguggguaaacaauuaguagaucagccugaaga

SEQ ID NO: 4158205 - RNA, 62 nt, Human
ucuaggccguaggauacagagcacagaaucaguguguguguguuuguaugcuaugaccugga

SEQ ID NO: 4158206 - RNA, 68 nt, Human
ucuaggccuucaggucuugagccaucaggauaugcagucaagucuaccugggcaaggccugugccaga

SEQ ID NO: 4158207 - RNA, 55 nt, Human
ucuaggcugugugugggcaggggcagauacucugcuccuccuugcagagcccaga

SEQ ID NO: 4158208 - RNA, 57 nt, Human
ucuagggaacaugggucaagcuuucucagugguccugcuugagccugucucccuuga

SEQ ID NO: 4158209 - RNA, 97 nt, Human
ucuagggcuaugugguauuuaaggggcuccagaaauuuuagggcagcugagaucuaaauccuucccuuccuggaguacccucugucuaacuccuaga

SEQ ID NO: 4158210 - RNA, 66 nt, Human
ucuagguggaugaggaacauagaagucagaaaaagaagaaacuguggaggccacaucccacccaga

SEQ ID NO: 4158211 - RNA, 66 nt, Human
ucuaggugguuugcaaaauuacaaacgugguaguaaaaccaaaguaaugaugggaauuuacuuaga

SEQ ID NO: 4158212 - RNA, 57 nt, Human
ucuaguaucaucuaagggaguuacugaaacacacuacuaaugccucaugauacuaga

SEQ ID NO: 4158213 - RNA, 58 nt, Human
ucuagucauucaugcuaugauuauugagcuccugcucugugucaggcaugaaucuggg

SEQ ID NO: 4158214 - RNA, 69 nt, Human
ucuaguuagugguugauacuguguguucaugauaaauucuguuuaggccagguacaaacaucaacugga

SEQ ID NO: 4158215 - RNA, 94 nt, Human
ucuaguucucugcuucucucucagacugcaagccuuagaaauuagacuggcuuucuccauccuaagcagagggaguagagguuugagaauuuga

SEQ ID NO: 4158216 - RNA, 110 nt, Human
ucuauaacagagcccaaaaaauauaaaggauguggguuuugcaucuuaaacugaucauguucaugagaaagccauaucuauucuauucuguggccuuuguacauuguaga

SEQ ID NO: 4158217 - RNA, 94 nt, Human
ucuauaaguaacagauaagaaaccugaagaugagggacagcuaaucacguauuuggccauauuuccauuuuuugguuuuugugaugcuggaaga

SEQ ID NO: 4158218 - RNA, 66 nt, Human
ucuauacaaggucgauaacucacacuggacuucagaagucucuugcuagaaucagccauguguaga

SEQ ID NO: 4158219 - RNA, 77 nt, Human
ucuauaguuuuauagucaauacucaacucucugcacauuuaguauauggcagagcauaauugacaugagguaguaga

SEQ ID NO: 4158220 - RNA, 71 nt, Human
ucuaucaaagauggcccaugaucucuuggaggccugacucuaaucaucaggauuaucccauuagggauaga

SEQ ID NO: 4158221 - RNA, 81 nt, Human
ucuaucagaugcccacauauguauaucaaauaugacugaucuauccaguuagucagcauugcagauauauggccugguaga

SEQ ID NO: 4158222 - RNA, 59 nt, Human
ucuauccagcaugcaaucauuuagcauuuaugugugcucagugcuguggcugaauaaga

SEQ ID NO: 4158223 - RNA, 68 nt, Human
ucugaaaguccuguuugaaggaccugccuagaacuugcaggugagggucuggacacagggcugucaga

SEQ ID NO: 4158224 - RNA, 63 nt, Human
ucugaaauaaguggacacauacuccaccauccccagguaguguacagugugugcccuuucagg

SEQ ID NO: 4158225 - RNA, 74 nt, Human
ucugaaaugaccagggcugcucauuggcugguuuagguuuccaccaccagggaauggggagcuugagacacaga

SEQ ID NO: 4158226 - RNA, 86 nt, Human
ucugaaaugcuucuguuuaucccuuuggucagcaccuccugccaggaccaugcuggagcugcuaagaaggaagacaggugcacaga

SEQ ID NO: 4158227 - RNA, 69 nt, Human
ucugaaauggaugagagcagagguuaaauugaaagaaugagggaugagaucuuuagccauccaaucaga

SEQ ID NO: 4158228 - RNA, 128 nt, Human
ucugaacauugagaaaauauuaauggaaugccuguuuuauuucaaguguugagcucauaaugcauauuucaaguuguuuaugaaacauuuaaaucuagguguuccaucuagaaccuaguauguucaga

SEQ ID NO: 4158229 - RNA, 85 nt, Human
ucugaagacaucugucauuucaaugauacuacuaaguccuagaggaagauuuggugguaucauugaaauaacagauguuuccaga

SEQ ID NO: 4158230 - RNA, 59 nt, Human
ucugaagaggacuggguuggaggcagcacaagacugucucuaggauuuucugcuucagg

SEQ ID NO: 4158231 - RNA, 55 nt, Human
ucugaagaggcucuugauaagaucugggggaugaggucugaggagugguuucagg

SEQ ID NO: 4158232 - RNA, 62 nt, Human
ucugaagagucaucuuugggugaccaaugucaagaacagagaauuugaucaaaaucuucagg

SEQ ID NO: 4158233 - RNA, 55 nt, Human
ucugaagcagaaaauggggauacugcauauuuguuuucucuauauuuguuucuga

SEQ ID NO: 4158234 - RNA, 77 nt, Human
ucugaagcaguaaccucacacccuaccagugcuacaagugcuuccuuggauauuggucaaguugaggacccuucagg

SEQ ID NO: 4158235 - RNA, 65 nt, Human
ucugaagcagugaaagagugggacuuggcugauuuuucaugcuucagugcuaccuucaaaucaga

SEQ ID NO: 4158236 - RNA, 67 nt, Human
ucugaagcauaucaugccaaguuuuuguauuuggguucugauuuaacuugaguaaugauaugaagga

SEQ ID NO: 4158237 - RNA, 61 nt, Human
ucugaauagaguugaggauguagaccugcacagacagugagggauccucuagcuucucaga

SEQ ID NO: 4158238 - RNA, 60 nt, Human
ucugaauuaaucaugccucuuuaaucaaugagaaggaagagucucaaagauuaauucaga

SEQ ID NO: 4158239 - RNA, 76 nt, Human
ucugaauuacagcaguggauuagaggauggcuagagguagucauucuuuuuaaaacauuuuaaacugugguuuaga

SEQ ID NO: 4158240 - RNA, 80 nt, Human
ucugaauuuuuagauaguuuaacugcacuuuaggggguauuguauucuccaguguacuugagaauugacuaauuugcaga

SEQ ID NO: 4158241 - RNA, 110 nt, Human
ucugacacucaguuugaagauccuucaagugucuuucugauccugacaggcaguuuuuaaaauguuuguggcauuccaagacgcuuaauaauuuaaagcuguauuuuaga

SEQ ID NO: 4158242 - RNA, 71 nt, Human
ucugacaucaaagugguuuucugugcuuuaaaugagucaguguggagauaggauuauuauuuuguguugga

SEQ ID NO: 4158243 - RNA, 95 nt, Human
ucugaccagcuguauaggcagcucuguggccucccagcccuggaagauagacagcguccuggugagacucagggaugcuuuacauuaaacucaga

SEQ ID NO: 4158244 - RNA, 67 nt, Human
ucugacccuggcugaaagccuggccugccagucccuagggcugagaucauauucagucaggaauaga

SEQ ID NO: 4158245 - RNA, 78 nt, Human
ucugaccuaauaaacugcuacgcuuaguuaucaucaacugagaugaaaaagcugaggggggcagguuuggaaggaaga

SEQ ID NO: 4158246 - RNA, 89 nt, Human
ucugacuagcccuuucucugccuuguuugagcuuugacagaauuugcaaggguggcguuaaggcugagcaggacacuggaaaggccaga

SEQ ID NO: 4158247 - RNA, 57 nt, Human
ucugacuaguucuugcugaaauaauuaaaugucuuuucagcaaauggacuguucagg

SEQ ID NO: 4158248 - RNA, 79 nt, Human
ucugacuguuucguuuccauauuuggucuuugggagcagaaguucuuaauauaaaucaauggaacuaaaggaacacagg

SEQ ID NO: 4158249 - RNA, 85 nt, Human
ucugagaaacaacgaagaggccauugcagcucagggugaugacugcccuaaugcaagucgacauucagggugcagugggagcagg

SEQ ID NO: 4158250 - RNA, 74 nt, Human
ucugagacugugauuucucugccaccuuuacuccugauuagggaggguggcucaaagagagcacagaguucagg

SEQ ID NO: 4158251 - RNA, 65 nt, Human
ucugagagcaucacugggguacagagagaggcaugccaauucauagguacccuugaugcucuaga

SEQ ID NO: 4158252 - RNA, 62 nt, Human
ucugagaggcaucugcacuucugaguuguaacgcagguuaggaagaggcaauuucucuuaga

SEQ ID NO: 4158253 - RNA, 69 nt, Human
ucugagagucucugaggcagaugacccagccaaaccacaccuggauuuugacccacagaaacucugaga

SEQ ID NO: 4158254 - RNA, 63 nt, Human
ucugagaucaacuguguggguuugaaccccagacacuuuccuuaccaccagugugaucuaaga

SEQ ID NO: 4158255 - RNA, 91 nt, Human
ucugagaucucgcuguggaccaggugcugagacaacaggaaacaaggccccaugcagcccucaaauugcucagcgucuaguggguuucaga

SEQ ID NO: 4158256 - RNA, 58 nt, Human
ucugagauugaucuuuggcuaucuuccaggcucuuugguaguuauugaucuauucagg

SEQ ID NO: 4158257 - RNA, 63 nt, Human
ucuacaccacaagcaucaucucugucuacagaacccuguagaaacugauagucuugugcuagg

SEQ ID NO: 4158258 - RNA, 69 nt, Human
ucuacagcuucagugugccccagugcugcccucucugccagcaggaccugggcucgaggaagcuggagg

SEQ ID NO: 4158259 - RNA, 80 nt, Human
ucuaccaucaaugggcaaugccuggcccaacucagagccacagguccucuggucaugccagguuugcugcagagaggaga

SEQ ID NO: 4158260 - RNA, 75 nt, Human
ucuaccucucaggcaggagucucccuuagucaucuuuuagauaaagagguaaugacugcuugaguaaauuguaga

SEQ ID NO: 4158261 - RNA, 60 nt, Human
ucuaccugcaucuucauauacuucuauccaauucuuaacagugugugauaggcaggaaga

SEQ ID NO: 4158262 - RNA, 74 nt, Human
ucuacuagguauaucuuauaugugcagguacuaaugacaacacagggcccaacacauaguaggcauuuggugga

SEQ ID NO: 4158263 - RNA, 129 nt, Human
ucuacuauuggcuccauacuaauguuccuugugauuuaaugcgucucugaguuuugcaugucuaagguuauuuacagcuuaaaagaugcauuuauauuaugauuagucaccggugagcuaugaaguaga

SEQ ID NO: 4158264 - RNA, 90 nt, Human
ucuacuccugcagaacaaaacauauucagaugccaaguccagcaauggcugggaaggagguggcuugaagugagucucuugggaguaaga

SEQ ID NO: 4158265 - RNA, 68 nt, Human
ucuacuggucagcuucagaguguuccaugaaucacauccaugucacuuggagaagcugaucccacaga

SEQ ID NO: 4158266 - RNA, 72 nt, Human
ucuacuuccugcagaacuagcucuccagcacagcagcaggucucugugccauuucuauucugcagcaggaga

SEQ ID NO: 4158267 - RNA, 61 nt, Human
ucuacuuugaguguggucaagugauuuuaaaagucaaagucuggacuugaaucagaguaga

SEQ ID NO: 4158268 - RNA, 73 nt, Human
ucuagacgacuggacuaaggagugauuuaugggccuuacauuaugauuaucucucaaagaccaaaaguguaga

SEQ ID NO: 4158269 - RNA, 63 nt, Human
ucuagagacaaaggaaggagggcucuggacaggagauacagccucuuccuucuuugucguaga

SEQ ID NO: 4158270 - RNA, 72 nt, Human
ucuagagcaguguucuaaauugggugugauuuuguccccaccccaacccuggggauauugucaauuucugga

SEQ ID NO: 4158271 - RNA, 62 nt, Human
ucuagaugcggcugugggggaaugggagcggccggaccucccagccugacagugcaucaaga

SEQ ID NO: 4158272 - RNA, 63 nt, Human
ucuagaugcguguucagcaucugacauguuucuuaauagcaaaggccuuggacacgcuguaga

SEQ ID NO: 4158273 - RNA, 60 nt, Human
ucuagcauuucuuuccugaggaaaauauugcuccccaggggaacuuuggaaauguuuaga

SEQ ID NO: 4158274 - RNA, 69 nt, Human
ucuagccaccucccuaacccuuuuggcucccuaggaucaggggccugggaaucuaggcgaguggccuga

SEQ ID NO: 4158275 - RNA, 67 nt, Human
ucuagccacugggaugggcauaagacccuauuagagccaacgggucuugaugagccuagugcuuaga

SEQ ID NO: 4158276 - RNA, 64 nt, Human
ucuagccuugcagaggagauuaucgggcaaauugaugcuggaaagaauuuucuguuagauuggg

SEQ ID NO: 4158277 - RNA, 67 nt, Human
ucuagcuuuccugcagcaccacaguucuuuaaauagggauccuguggggcggcugcaggggacgggg

SEQ ID NO: 4158278 - RNA, 78 nt, Human
ucuaggaaacaccaggcuuugguacccauggagucaggugucacccuggggaccgagcaagcucuggaacauucugga

SEQ ID NO: 4158279 - RNA, 77 nt, Human
ucuaggaaguucuuuaguuuucaucaaaucuauuccuccuuuauacaagugagaaaacugaagaucagcaagcuaga

SEQ ID NO: 4158280 - RNA, 56 nt, Human
ucuaggacaccauccacaagugugcuauaaagcacaacuucaccaggguuccuaga

SEQ ID NO: 4158281 - RNA, 74 nt, Human
ucuaggcagccaagaagccaacagggcaggagagaauaaagacauuuuuagcugccugguuuccggcugccagg

SEQ ID NO: 4158282 - RNA, 67 nt, Human
ucuaggccacaaagagggcuuugauucucaguucccuaggagcgggaaggagcucucuggucggagg

SEQ ID NO: 4158283 - RNA, 60 nt, Human
ucuaggcucugaugauagagcaguaaguaagacagccauguuccuguuauggagcuuagg

SEQ ID NO: 4158284 - RNA, 55 nt, Human
ucuagggaaccuauccuaugaugugacagaagagucaauuaaggaauucuuuaga

SEQ ID NO: 4158285 - RNA, 81 nt, Human
ucuagggcagccuugucccauggauaccaggcuaugaugcauguugcagacguaucuccauggccaaggugcagcacuggg

SEQ ID NO: 4158286 - RNA, 83 nt, Human
ucuaggggauuaauggccagcugggagaguugauggcccagaggagggacucauuaaccucagcgggccauuaauuccuuagg

SEQ ID NO: 4158287 - RNA, 64 nt, Human
ucuagguuagaauggcacaaaauaaggcauaguucuugucuucaaagugcuuuuaaccuuuaga

SEQ ID NO: 4158288 - RNA, 71 nt, Human
ucuaguauacauagugcuuccucuugguagauuuuuaccuacugugagaaggaaugauuuugauacucaga

SEQ ID NO: 4158289 - RNA, 83 nt, Human
ucuagucaguguuaguguaugucuaacauacacuagucuagucuaguuaguguaugucaaguauauacacuaacuuuggauga

SEQ ID NO: 4158290 - RNA, 61 nt, Human
ucuagucauauuuuuucaguauuuucaaggaugaauaaaaccugaagguguaugugcuggg

SEQ ID NO: 4158291 - RNA, 72 nt, Human
ucuagugccaagcuaaugccagaauuaauuauuagcaauuauuguucuuucuuucaauagcuggcauaugga

SEQ ID NO: 4158292 - RNA, 92 nt, Human
ucuaguuggcccaaagcaguagugucaguacagcaaauugugguaugcucuauugucguuugcugugcuuacauauguauugaagucagaga

SEQ ID NO: 4158293 - RNA, 62 nt, Human
ucuaguuuuccccagguagauagauaauccaguagacaaaucugcauacuucgggaaccaga

SEQ ID NO: 4158294 - RNA, 129 nt, Human
ucuauaaccugguuaucucuacgaugauuuuggcaagaacgugcagaugcauacacauauacacaaaaugcugcacaucuuucagcaucauacaaauuuuguagaagaauggccaaucccuaaauuaga

SEQ ID NO: 4158295 - RNA, 94 nt, Human
ucuauaggacuccgccucucugccggcuucuguaggccaaucacugaggccuuagaauaacagaaggcggggacaaggcggggcucucacgaga

SEQ ID NO: 4158296 - RNA, 67 nt, Human
ucuauaggucacucagugagucaacgacugagcuaugauuaacguugacagcuggugagcugcuagg

SEQ ID NO: 4158297 - RNA, 68 nt, Human
ucuauauucuccucccaauugccaagugcugcucugucagugaccugggagugggagggaguauugga

SEQ ID NO: 4158298 - RNA, 57 nt, Human
ucuauauucuggguggccaagaagccagguagagcucaaaggcucccugacuaugga

SEQ ID NO: 4158299 - RNA, 55 nt, Human
ucagauaaauaaaccugccagagagacaaagcuucuugugguuuagauuaucuga

SEQ ID NO: 4158300 - RNA, 73 nt, Human
ucagauauuacgaauguuagauugcaucucaguguuaaaucuucacugauagauguacguauguaaaucauga

SEQ ID NO: 4158301 - RNA, 95 nt, Human
ucagaucuagaacagaucuaguaggagcuggguuauuaggaugcuagucagcccuaggaacccccaggcuucugaguucucuggccuggaaauga

SEQ ID NO: 4158302 - RNA, 104 nt, Human
ucagaugaaacagcuguuuuaacaguuggguuuuuccaaaauuaaaauauucuauuccugacaguggcuagcaacucaacuguuaaaacagcugcucaugcuga

SEQ ID NO: 4158303 - RNA, 62 nt, Human
ucagaugagcaugggcacaagcauauguaaggacacagacauguguuucuccuuguuucuga

SEQ ID NO: 4158304 - RNA, 74 nt, Human
ucagaugaggucaggacauuuuugcuuugugacagauuugggacgcagagaaaagaguucaggcuuuguacuga

SEQ ID NO: 4158305 - RNA, 78 nt, Human
ucagaugauucucauuugcuggcuauaugauguccugcucuggaaaagcauguagcuuagaaaugagacugcauguga

SEQ ID NO: 4158306 - RNA, 56 nt, Human
ucagaugcuaaguuaucagcaggcucagucaugucccucuugauuuuuagcucugg

SEQ ID NO: 4158307 - RNA, 70 nt, Human
ucagaugucucuguuaucucaagucacaagaguguugacuuucuuugcuugcauuagguaacauauuuga

SEQ ID NO: 4158308 - RNA, 87 nt, Human
ucagauguggcuuaacauuugcucuauaacaagcauuuguaugucuugauguacaaauuucauaggcaaauuuuaaaggaacuuuga

SEQ ID NO: 4158309 - RNA, 77 nt, Human
ucagauugucaauuguuuauuguuucuguuugauaccauugagguauuuguuccagagauaaaaauauguaugcuga

SEQ ID NO: 4158310 - RNA, 89 nt, Human
ucagauuuaucucccaagucuggcagaauuaaacaguguguaauacuaacugcuucauuacugacagucugugacuagguauucucuga

SEQ ID NO: 4158311 - RNA, 58 nt, Human
ucagauuugaggcauguguuagauaucucauaggagauauugcauaccaugaaucuga

SEQ ID NO: 4158312 - RNA, 58 nt, Human
ucagcaaaauguggcuagugcugguggugcaugauuacaccaagcacuuuuuuguuga

SEQ ID NO: 4158313 - RNA, 58 nt, Human
ucagcaaccaggggcacaguccaaaagaagcccagacucucacugcucuuggggcuga

SEQ ID NO: 4158314 - RNA, 55 nt, Human
ucagcaagagacuguucucuaaguccacugggugugcugggugcugucucacuga

SEQ ID NO: 4158315 - RNA, 81 nt, Human
ucagcaccgagaaaugucaggguuuuaagcugccacagagaacauuuagcuugaaaauaagaaagacuuucuggaugguga

SEQ ID NO: 4158316 - RNA, 70 nt, Human
ucagcaggcagugggucacaauuaacugaaucaucucaccacugguugauugugaugaggugccaauuga

SEQ ID NO: 4158317 - RNA, 59 nt, Human
ucagcagggagaggagaaugcagaguugccaaacuucacacucucccaauccuugcuga

SEQ ID NO: 4158318 - RNA, 61 nt, Human
ucagcaggucugaggcggggccugacauucugcacggcuggccugcuccgggcgcugcuga

SEQ ID NO: 4158319 - RNA, 66 nt, Human
ucagcaguccuccaggaucaagaaacuacucauccuaaaagcucgagaucacugggaacugcguga

SEQ ID NO: 4158320 - RNA, 58 nt, Human
ucagcaguggcucucaugcagucaauaggauuggagggcgaggagaggccaguguuga

SEQ ID NO: 4158321 - RNA, 126 nt, Human
ucagcaucaucuggacuccuguuagaaacacacauuguugggcccaacaccagaucuuuacugaaacagaaacucuggauuggaguccagcaaucuguguuuaacaaacucugcaggugauucuga

SEQ ID NO: 4158322 - RNA, 56 nt, Human
ucuggugauuuucugucagucuuuggcauuccuuggcuuauagaaacaucaccaga

SEQ ID NO: 4158323 - RNA, 69 nt, Human
ucuggugcaccuuugugcuugcauagcuugcgucuaaagcagcagcaggacauggaggaguaaacugga

SEQ ID NO: 4158324 - RNA, 126 nt, Human
ucuggugccaagcaugugcuggaaaagccaacaggaaaugaaagcuagcuaauuuguaaaauuuucucaugacuuuuauuucucaauguaugcuuucaucgaucucgcagaguucuuggggcugga

SEQ ID NO: 4158325 - RNA, 101 nt, Human
ucugguguugcacaaggcgauuguuaucgcugaaagucuccuugcauucagcacagcuauagggcuuuucugcggugugaauggccugaugucgcaucaga

SEQ ID NO: 4158326 - RNA, 62 nt, Human
ucugguuaggcuugugagguccccguagcuguggcugcugcagaggccucagccuggccgga

SEQ ID NO: 4158327 - RNA, 76 nt, Human
ucugguucccaggagauaagcugaguuuauaauuuuaaggaagggagugaauguagcuugucuuccuggcaccaga

SEQ ID NO: 4158328 - RNA, 86 nt, Human
ucuguaaagcaguguucaggaucugaggccagggaguuugacuuugaccagagauacuguuugggagccuagcacaucuuugugga

SEQ ID NO: 4158329 - RNA, 84 nt, Human
ucuguaauuuuuuuauguugaccaugaaucaugagcuguuuccauagaaacagcuucaucacauggcauagccaguuucacaga

SEQ ID NO: 4158330 - RNA, 107 nt, Human
ucuguacuauuuguugacggacauuuagcuguuuugcauuuuuaucuauugugaauaaugcuagaaugaauagucuuauaaaugacuccuaagacaaauaggcaaga

SEQ ID NO: 4158331 - RNA, 59 nt, Human
ucuguagagaaggggaaaggcagagaccaacucucugagcugccccuuuacuuuguaga

SEQ ID NO: 4158332 - RNA, 61 nt, Human
ucuguagcaguguuccagcauugugccaccagcacagugggagacaggagauaguuauaga

SEQ ID NO: 4158333 - RNA, 59 nt, Human
ucuguagcauucaccagcccugcugcccaccccuuccagagcuggggaauggauauuga

SEQ ID NO: 4158334 - RNA, 98 nt, Human
ucuguagcugccucagccccugaauggagagagaugcuauauguggcuuucuccagcauuuccggggccugaaauggcuaaucuguaagagcuagagg

SEQ ID NO: 4158335 - RNA, 66 nt, Human
ucuguagcuucuauccuaccaugucuugacuuguaaacaguccaggcauaacugauauaagccaga

SEQ ID NO: 4158336 - RNA, 68 nt, Human
ucuguaggaagauauaaaauaucuggaggcgcuuuugcaucuguauguauccccuaucauuuuacaga

SEQ ID NO: 4158337 - RNA, 78 nt, Human
ucuguauacucauuuauccagcuccucuaguuguagacauuuauuuuaaagagagaauuggauaaauugguaaacaga

SEQ ID NO: 4158338 - RNA, 117 nt, Human
ucuguaugaacagauucauucucauuggggaagcugaggcagcuuaucagaguaauuacuacuuuucuugguauaagcugugucagagcccucagugagaacaaauccacuuacaga

SEQ ID NO: 4158339 - RNA, 63 nt, Human
ucuguaugcaucgacucaagucugaagauaagcaagugcuucagaagcgaaagauggagcaga

SEQ ID NO: 4158340 - RNA, 113 nt, Human
ucuguauuuuaaauuuuuaggcaguuucuucuaaggugaacaaugguauuuaccuuuuggguagaacaugacuuauuuuuggaaguauugcuugaguaauauuaagaauuagg

SEQ ID NO: 4158341 - RNA, 130 nt, Human
ucuguauuuugucugguguuauuuccccuuuaaaugcaucuggaagcccagaaaccuaguuucacuauguccucuggagguuuuuaggugauaagaguuuuggagaccuauacagacuuccaauacagga

SEQ ID NO: 4158342 - RNA, 83 nt, Human
ucugucagggcagccuucuguggggagaguaagcccaauugccacauaaucaggcucugccaccuagauuaaugccuuacaga

SEQ ID NO: 4158343 - RNA, 81 nt, Human
ucuguccagugaggugggcugggcucuaugccaggcacaagucaucuguccuccguccccacucccagcuccugaggcagg

SEQ ID NO: 4158344 - RNA, 72 nt, Human
ucuguccaugcauguugucugcugaguucucucaaacauagccagcagucuuucacauagcauuacgauuga

SEQ ID NO: 4158345 - RNA, 130 nt, Human
ucugucccauuccucugcaccucuccgcugcacgugucacacuaaccacgucugcagcuacaacuuaagaagccuaaagauacggucaguguacacaugugcaggggagagugcaaaggaaugggaugga

SEQ ID NO: 4158346 - RNA, 84 nt, Human
ucuguccugauaaagcauucugauagccaggugugguggcucaggccugcauuccuggcauuaugggaggcugaggcggaugga

SEQ ID NO: 4158347 - RNA, 80 nt, Human
ucuguccuugcuuccagcccacacuccagguaguugggacuucagccauguuggggaaggugggcuagaguuuggaaaga

SEQ ID NO: 4158348 - RNA, 75 nt, Human
ucuguccuuguugagcuagggaggaggcuugcucuucaggagagaagccaaacuacugagcaagacaaggagaga

SEQ ID NO: 4158349 - RNA, 122 nt, Human
ucugucgugaccucuggaguuauccucauucagacaguuuucagauucauucacguagacaugauauguguaugucuugaggauaauaaucaagagcuucccccuuuaucaugaauuacaga

SEQ ID NO: 4158350 - RNA, 58 nt, Human
ucugucucaugucaaggcaugcuauuuaaaucuggugacuuuugaaguaugagacagg

SEQ ID NO: 4158351 - RNA, 71 nt, Human
ucugucuccgagagcuguaccaggaugcuugcccacuguauagggcaccuuucugcaaguucugggacuga

SEQ ID NO: 4158352 - RNA, 65 nt, Human
ucugucugacuaccaugaggcaacccugaagauagaagccaugugccuguggguggcagaauaga

SEQ ID NO: 4158353 - RNA, 58 nt, Human
ucugucuucaacaaguguuuacucucaugggggagagagugcugaaugcgagaacaga

SEQ ID NO: 4158354 - RNA, 74 nt, Human
ucugucuuuuuacuauguucaaucuauauaguauauauuuauguaaagaagagaugagaguaaaaaaaggcagg

SEQ ID NO: 4158355 - RNA, 70 nt, Human
ucugugaaagauacuaggcagaggcaagauccuuucucacaagacuuccucuguucccugucaucacuga

SEQ ID NO: 4158356 - RNA, 77 nt, Human
ucugugaaaugagaaucaucuuauucccuaccucacagcaguauugugaggcucacgaacagaagacucaacacaga

SEQ ID NO: 4158357 - RNA, 57 nt, Human
ucugugaccugcugcauuacucuucucaagggcugucccagaggcaccagguauaga

SEQ ID NO: 4158358 - RNA, 55 nt, Human
ucugugaugguauggaaccacuagguggggaacuagcgucaauaucgucaacagg

SEQ ID NO: 4158359 - RNA, 75 nt, Human
ucugugauuuuguauucuuccuuagcaguacaguuggaacagugugcaugaggauaggaauaacuaaaacauuga

SEQ ID NO: 4158360 - RNA, 55 nt, Human
ucugugcagaaucaaggagcuuuacauaacguagcccugugagucaugcggcaga

SEQ ID NO: 4158361 - RNA, 67 nt, Human
ucugugcuccagcagggccacaauuauugcuaucugaaucugaguuguggcaggcaagauguacaga

SEQ ID NO: 4158362 - RNA, 57 nt, Human
ucuguggaguugaggaagguuguaauacuuuacaucuacaacuuaagauuucacaga

SEQ ID NO: 4158363 - RNA, 69 nt, Human
ucugugggaggagguggguuaaguuguaaaguauuauuauacaaagugagcaaccucuuuucccagaga

SEQ ID NO: 4158364 - RNA, 73 nt, Human
ucuguggguagcaaaaaaacuggcaucucccaguaugguccuuggggaucucaguacuuuuggugucuaaagg

SEQ ID NO: 4158365 - RNA, 87 nt, Human
ucugugucaaaaagugucugcaaaaugacagagccaccuugucacaguggcucuuucauuuugcagacacuuuuugccuucuacaga

SEQ ID NO: 4158366 - RNA, 83 nt, Human
ucuguguccagcuuuuaccaaaugagcauuauucaacaaagauaacugccuagacaauugguacaggcuuggaaaacuucaga

SEQ ID NO: 4158367 - RNA, 67 nt, Human
ucugugucucuuccuuucaaguggggaaacagcccauuauccucacugagaccuuggcgacguaaga

SEQ ID NO: 4158368 - RNA, 84 nt, Human
ucugugucuggacugcaaaauaaggaucuuucuauuacacuuucuguccuauuuuucuugcaguccuuuucagcuggacgugga

SEQ ID NO: 4158369 - RNA, 55 nt, Human
ucuguguggccuugggaaaguugcuuaacuucauacuucccaggaccuacucaga

SEQ ID NO: 4158370 - RNA, 65 nt, Human
ucuguguucuuucucuugauucagauaauuuucuucaugaucugaauuacagauggaauuacaga

SEQ ID NO: 4158371 - RNA, 65 nt, Human
ucuguuagucuuuugcaggagaguaaaaagguaauuuacaacuccaguacucaaaugacagcaga

SEQ ID NO: 4158372 - RNA, 65 nt, Human
ucuguuauagacagcaauguguguguuuuucucaacuuaagugagccaauaccaugcuguucaga

SEQ ID NO: 4158373 - RNA, 70 nt, Human
ucuccagagcugcagauugaaggcauauuuucaucugacuuuggugauuauguuuccaaucucucuggga

SEQ ID NO: 4158374 - RNA, 73 nt, Human
ucuccaggaagugcagcugggacuguaggguccccagggacuugcaggauccucugccugauaaucguggaga

SEQ ID NO: 4158375 - RNA, 68 nt, Human
ucuccagggcuccccaacauccaguccagugccugcugcuccaucugaggcuggggggucccuggaga

SEQ ID NO: 4158376 - RNA, 92 nt, Human
ucuccagggcugccuuuucuauucuggaucuguggcaggggcccagccugccuccuggugcaggcaggcaugugacugaggcagcccgggga

SEQ ID NO: 4158377 - RNA, 88 nt, Human
ucuccagucuucucuuaauugcuuaguugcaacuaugcccugauuuggaggggauaaguguacugguaaccuagaggacacugagagg

SEQ ID NO: 4158378 - RNA, 107 nt, Human
ucuccauccaugaggucauuccaaaugaagauuuggauuccaugucacaguccaagggcucagugagcaugccguccaagucacuuggaagccucuccugguggaga

SEQ ID NO: 4158379 - RNA, 78 nt, Human
ucuccaucuccaugaguucaauuguuucagucauuagucccacaaaugagugagaacaugugaagucugucauguaga

SEQ ID NO: 4158380 - RNA, 121 nt, Human
ucuguuugcaaauaucaaucacuuuccaaacuauuauauaagugaucucuuacaauuuaaauacaguuguaagagaucacuuauguaauaguuuggaaggugauugauauuugcaaacaga

SEQ ID NO: 4158381 - RNA, 77 nt, Human
ucuguuugcucauuuuuaggaaggagacucuauuuucuucuuggagauauaguaauauuccugaacucagccacaga

SEQ ID NO: 4158382 - RNA, 60 nt, Human
ucuguuuggaauagcaguaaacauuccaggcauaggagugaauuugcucuuccaggcaga

SEQ ID NO: 4158383 - RNA, 70 nt, Human
ucuguuuuguaaacaucagccacucuauuucucucucagaaguggacuuugaugucuuauaaauugcaga

SEQ ID NO: 4158384 - RNA, 57 nt, Human
ucuguuuugugcuuuguuuucuuuugcuucuuugugccugacaaaaguacagacaga

SEQ ID NO: 4158385 - RNA, 82 nt, Human
ucuguuuuguguccauucuauuuccaaagacaagcuuaaggguuaagcugugguaaaggguagagggaaugccaaaagcaga

SEQ ID NO: 4158386 - RNA, 59 nt, Human
ucuguuuugugucucucugguguuuggugacauaacauaauaagauggcaggaggcaga

SEQ ID NO: 4158387 - RNA, 88 nt, Human
ucuguuuuuaauggauuuacaagauaaccugaugcugugcgguuuguuuacuguagcggcuuuaugguguuuuguaccaguaaacggg

SEQ ID NO: 4158388 - RNA, 85 nt, Human
ucuuaaaagcaugaaggagggaaggagucaggggagccuccucagcuccucagacuuuccuuguccguggucuuucuguguaaga

SEQ ID NO: 4158389 - RNA, 93 nt, Human
ucuuaaacaaauuugguuaacaagcauuucauucugacugaucaguggguauugaucaguggggacgagaaguuuagcuaaccauuuauaagg

SEQ ID NO: 4158390 - RNA, 73 nt, Human
ucuuaaagccacuucauucuagucuauaugagugacauaggggagacacaauggaaugaagggcagacagaga

SEQ ID NO: 4158391 - RNA, 83 nt, Human
ucuuaaccccuacaaaggacugaaacuggcugucagcucuggggcuugccacagucauagcagccuuuguuaacaaguuaaga

SEQ ID NO: 4158392 - RNA, 55 nt, Human
ucuuaacuugaugucucucugcuguacacuacaugcacaggccaugaaguugaga

SEQ ID NO: 4158393 - RNA, 70 nt, Human
ucuuaagagccucucaugagcauuccuaagggaaagauuuuucucuuggaaccucucaugaguccuuaga

SEQ ID NO: 4158394 - RNA, 57 nt, Human
ucuuaagcauuuggcucugucuuccuucaauagaaaagagcugggacuugccugaga

SEQ ID NO: 4158395 - RNA, 60 nt, Human
ucuuaaggcagguaggugccuguagcuuucacuacgcuguaucuacuggugucuuucaga

SEQ ID NO: 4158396 - RNA, 97 nt, Human
ucuuaaguaggagggcagccauugagggauucuaaguaggcgaguaccauaaacaaaaggagagugucuugggauggcugcccuccauccuucaaga

SEQ ID NO: 4158397 - RNA, 116 nt, Human
ucuuaaguguuucuuuuuggaaugggacagacauuuccugauccaauuuguaaacgaagauuaucuguuggcuugaguaaugucugcaucuuucucccaagaagaaggucuuagga

SEQ ID NO: 4158398 - RNA, 84 nt, Human
ucuuaauagauauuccuaaggccaaaaguaucacugagaaguuggagccaaaaucucagggcuuuucuuuugaauucuauaaga

SEQ ID NO: 4158399 - RNA, 77 nt, Human
ucuuaaucauuggcugccuguggaucgcauuguuuagccugagagugcccauggguccagaggugcuaauuuuuaga

SEQ ID NO: 4158400 - RNA, 69 nt, Human
ucuuaaucuccaggcauuucaagagacugaccugagucuugaguaugaaauccugcagaaaaaguaaga

SEQ ID NO: 4158401 - RNA, 64 nt, Human
ucuuaaugaaugugugcuaacguuccuucuggcauaggaauguguaguaaauacacuucaaggg

SEQ ID NO: 4158402 - RNA, 64 nt, Human
ucuuaaugcacuaaacugccuccuuguuacacacagguuccagggcuguaaauuagugcugaga

SEQ ID NO: 4158403 - RNA, 66 nt, Human
ucuuaauguacaauuuuugcuuaggggguuuauuuucucucccaugguuaaaauaauacauuuugg

SEQ ID NO: 4158404 - RNA, 56 nt, Human
ucuuaauuucccuuggguguguaaucuaacauagugacaaguucuggagauuaggg

SEQ ID NO: 4158405 - RNA, 76 nt, Human
ucuuaauuuuuucacuuccaauuuugaaauuucaaguuauaggaaaguuguuaagaauggaaugaggaauuuagga

SEQ ID NO: 4158406 - RNA, 89 nt, Human
ucuuacagaaguucaguagcauaggucaguauagauggaagcacaucuuuucuguuugcuaugucuuugaggaacuucuagucucagga

SEQ ID NO: 4158407 - RNA, 103 nt, Human
ucuuacuguuucaugugauaccuuguucagauuucaaaauaguuguagacuuauccugguuuaacagaugugaaauuuucaagagauuacugacauuccuaga

SEQ ID NO: 4158408 - RNA, 89 nt, Human
ucuuacuugaaaaauuuaaacauuuuucuggaaccugucaugguaacauugaaaggauuaaauaaaugugcuguguuuuuuaaguauga

SEQ ID NO: 4158409 - RNA, 81 nt, Human
ucuuacuugaauauguguauuugguuagccuacuuguuauaagauagaguugacauuuaaguauacaauuaaaaguuagga

SEQ ID NO: 4158410 - RNA, 91 nt, Human
ucuuagaauuugaagugggugaguggagggcauucuacuuugggaagaaugguuggaguuaagccugaaccauuuacucaccauuucuaga

SEQ ID NO: 4158411 - RNA, 74 nt, Human
ucuuagcagaaugaugacuggggaugaagagaccuuuuaugggaaaauucagccagucaucagucuuguaggga

SEQ ID NO: 4158412 - RNA, 130 nt, Human
ucuuagcauccccuaggaacuugcacacccaggucucucgacuucuggaccugcuucuuaccaugccgucuuaagcagucaggagucgcugccuggguucgaguccuaguuaaauuacuuagugcugaga

SEQ ID NO: 4158413 - RNA, 67 nt, Human
ucuuagguucacacacacaaaaagauaagauguagugcaugaucugguugcugugugugaaugagga

SEQ ID NO: 4158414 - RNA, 88 nt, Human
ucuuaguaagggggcccagcacuaaguuggcgcguaaucaauguuugucuaauacaauggaguugggccccguuuuuuacagauaaga

SEQ ID NO: 4158415 - RNA, 91 nt, Human
ucuuaguaggucaaugauuauuuggggugaacauaugcugauuccuauugcuaauguauucaacuucuuaaaaauugcugacuauacuuga

SEQ ID NO: 4158416 - RNA, 74 nt, Human
ucuuagucacuuuggguugucccagcaacaggagacuuaacucugaccauagguaaggagcccagaggacagga

SEQ ID NO: 4158417 - RNA, 111 nt, Human
ucuuagucuuuggaguuaaacugccuggguaagcacuaauauugaucaauuuaacagaauuaaccucauuuguugcuguuaccugaggggaggagagugacaagacaaaga

SEQ ID NO: 4158418 - RNA, 81 nt, Human
ucuuagugggggccugacgcagaagaccucuaguucucccacagugucuucuggggccaggcccgcuguuucucacugagg

SEQ ID NO: 4158419 - RNA, 127 nt, Human
ucuuauauauaacuauaaacuuuccugaggaaugggugauaaauucaaacauagaguuucaagauccaauucaaauguaaauucuuuugaagcccccucagggaaagcuauuaguuugaucuuggga

SEQ ID NO: 4158420 - RNA, 63 nt, Human
ucuuaucuuauaccuaacagccucauuauuacaauagacacuggcugguagguguaaaggaga

SEQ ID NO: 4158421 - RNA, 66 nt, Human
ucuuaugugcaggggcaggagcucagaccuagucuuguggauggugcugccccauugcaaaggagg

SEQ ID NO: 4158422 - RNA, 73 nt, Human
ucuuauguggccauggucagaauauugguauaaauauggugguaaaggcaguucugauuaggucucagaugga

SEQ ID NO: 4158423 - RNA, 78 nt, Human
ucuuauguuauuauaaaacuaugauuugcaaaugugucuguugaaacagucuugcuguauggucagguggcaauaaga

SEQ ID NO: 4158424 - RNA, 71 nt, Human
ucuuauucuucccauuuuaccgauuauaugauuugccuaaggcuauaugcuugggaaaugguagaacuaga

SEQ ID NO: 4158425 - RNA, 59 nt, Human
ucuuauuguucuugugaauaauagucauauguauggcuuuauacuuaagcacaauagga

SEQ ID NO: 4158426 - RNA, 77 nt, Human
ucuuauuuaaauuccugaugaauccgagguuuaaguguaaagagacaagccuuagaggaaaacauuaguuaauaaga

SEQ ID NO: 4158427 - RNA, 58 nt, Human
ucuucaaacccugguuuugugauaggcccgcaaaggauucaugauccaggguugagga

SEQ ID NO: 4158428 - RNA, 79 nt, Human
ucuucaaagucugguugcuaagauagaggcugguuuccuuaaaugccacuuuggaucugauguaaucagcuguggcaga

SEQ ID NO: 4158429 - RNA, 73 nt, Human
ucuucaagcucccaugguuuaugguaagggaagaucuaucuucauuggcuuccauagaugcauaugaugaaga

SEQ ID NO: 4158430 - RNA, 68 nt, Human
ucuucagacuguuguucuuuuggagccacaguccaauggucccagccacagaaacaacauucuggaga

SEQ ID NO: 4158431 - RNA, 57 nt, Human
ucuucagagcauuucugagguagagaguucucugcuuuucacauccugcccugagga

SEQ ID NO: 4158432 - RNA, 70 nt, Human
ucuucagggacagggaucauuugcuucuacaauguaaagguuuauggacauaucucugguccuuuaaaga

SEQ ID NO: 4158433 - RNA, 101 nt, Human
ucuucauccugagcccauugcuagaucagcagaaguauagaggccauuuauuaaaagggccagucguguauuacuguuucuuauggggcaaagagacaaga

SEQ ID NO: 4158434 - RNA, 67 nt, Human
ucuucaugucauucuucagucuucuuuggaagccuuuagccagaacugucacgagugacaaagagga

SEQ ID NO: 4158435 - RNA, 67 nt, Human
ucuucauuacccacagccucucuucaaaauauuaucaauauuuguggguaugcugggaguaagagga

SEQ ID NO: 4158436 - RNA, 58 nt, Human
ucuucauuuccgcuucucuacucucagcagcuagggcuaagaagcugugaaaugaagg

SEQ ID NO: 4158437 - RNA, 59 nt, Human
ucuuccagaugcagaugcuucuuccugaguuuaggagcuuacugucccauuugagaagg

SEQ ID NO: 4158438 - RNA, 72 nt, Human
ucuuccagcuacucuucuggcuggcuuccaguauguucugccaauggaaggcacugggagaagacuggaaga

SEQ ID NO: 4158439 - RNA, 78 nt, Human
ucuuccaggccauugacugcauccucacugcacauacuggauggcuaaaaaggguaugcagucuauggccuggaaaga

SEQ ID NO: 4158440 - RNA, 110 nt, Human
ucuuccaggcccucuugcucaaaauuaccaugugaucaaaacaaauccuaucguugucccagcaggguucauuggucuuaugaauuuggggacagacagugccuggggga

SEQ ID NO: 4158441 - RNA, 59 nt, Human
ucuuccauuucuugcccugucuccauggaccaaacucaacuggcagcaagaagggaggg

SEQ ID NO: 4158442 - RNA, 66 nt, Human
ucuucccagaggaggugccagcuggauauuggaggaugaguaggugguaccugaaugaagggagga

SEQ ID NO: 4158443 - RNA, 65 nt, Human
ucuucccagauuggagggcagggguguaccaugucaccccuaugcgucuuucccaucugggcaga

SEQ ID NO: 4158444 - RNA, 83 nt, Human
ucuuccccacagugcuuuuagcugacugugugauuuggccguucuuuacugcucaaucaugucacuagggacuuuaggaaaga

SEQ ID NO: 4158445 - RNA, 69 nt, Human
ucuuugucuucacugauuaaccaaaugccaauggcccagcagcuuucuuuaacaguugaagaacaagga

SEQ ID NO: 4158446 - RNA, 71 nt, Human
ucuuuguuuauauuucuccucgaacgucuuccugagggcugaagaaguccagagaggcauauuuacaagga

SEQ ID NO: 4158447 - RNA, 129 nt, Human
ucuuuuauccuguucuucuauucuucuaacaugaaauaccauauaaauauccuuguuuggaguuuguuuuuccaggaaggagggcagauauuaaguuuguauguuagacucaagaggggaaaaaguuaa

SEQ ID NO: 4158448 - RNA, 82 nt, Human
ucuuuuaucuagcaaguaacaugcugacuuauguggguagaaucccccagcacagugcaaaauguuucuccuguuagaaaga

SEQ ID NO: 4158449 - RNA, 63 nt, Human
ucuuuuaucuguuguguaacaaucaugcuacugaauguuagauauuacaugacauaugaagga

SEQ ID NO: 4158450 - RNA, 69 nt, Human
ucuuuucaggaauggcucuaguccuauuccuagggauugauuuuaccucagggccagaucuugcaggga

SEQ ID NO: 4158451 - RNA, 94 nt, Human
ucuuuucagucuuggguaugggcagcagcugccauucauuuaaaaacaauguaggaaggagguagagguuaguugcuggccuaagaauuuagga

SEQ ID NO: 4158452 - RNA, 76 nt, Human
ucuuuucauuuucacauucucagcaucuauacaguuuucaucacuuaguagauucugaguauguguuugcuggaga

SEQ ID NO: 4158453 - RNA, 71 nt, Human
ucuuuuccuaucuagaaacagaguuuuacuaaaauaacauuuggaaaauucuuugguuuggucagaaaaga

SEQ ID NO: 4158454 - RNA, 57 nt, Human
ucuuuucuagcuuugaagaagcaagaugcugugacuccuucagcugcuaggaaauga

SEQ ID NO: 4158455 - RNA, 61 nt, Human
ucuuuucuuauaaaaggcaguuugaggauuuuacuuuauuugucuuucuuauaagaauuga

SEQ ID NO: 4158456 - RNA, 104 nt, Human
ucuuuugaaaacaaccuucaggccucucagaggcccaggagucacugggcuggcccagagacucagagaucccuggagguccugagaagggguugguuggagga

SEQ ID NO: 4158457 - RNA, 76 nt, Human
ucuuuugaaaucuuuaguaggaaaauccccuagaggaguccaacuggggcuugcucugcaaaaguguucauaaaga

SEQ ID NO: 4158458 - RNA, 115 nt, Human
ucuuuugauuauauucugaacccaaacaaagcuacucuggccugcagauccaugcuccagugagcuguguagggaaucagagaaaggcaugauugguugaagugaaucacaagga

SEQ ID NO: 4158459 - RNA, 78 nt, Human
ucuuuugcagaagaauacacacugcauucaugacagucaguacaaggaagggaggccguguguauacucuguaauaga

SEQ ID NO: 4158460 - RNA, 61 nt, Human
ucuuuugcagaguguaucuguguaagcauauguaugugugacuugaugcacucugauuaga

SEQ ID NO: 4158461 - RNA, 70 nt, Human
ucuuuugucaucccuuguacaugcacuaccaauguuuaccaucugucucaggggcuuaagugacagaagg

SEQ ID NO: 4158462 - RNA, 65 nt, Human
ucuuuugucucagugucaccuccagcugcaaucauugccagaagguuagugcugggauucuaaga

SEQ ID NO: 4158463 - RNA, 63 nt, Human
ucuuuugugacucuugggucugugaccauugcuggcuacacaauguugccccaggacaaagga

SEQ ID NO: 4158464 - RNA, 68 nt, Human
ucuuuuuauuucuuauguacuucuaucaguuugacuugaaagaaacagguauauugggaaggggaaga

SEQ ID NO: 4158465 - RNA, 60 nt, Human
ucuuuuucaugggugaugaguggguacauagauggcugcacacaguucucaggaaagaga

SEQ ID NO: 4158466 - RNA, 61 nt, Human
ucuuuuuccgaagaacaugugcagccuagaaacagaaagggcaaauguucaggaaaaaaga

SEQ ID NO: 4158467 - RNA, 66 nt, Human
ucuuuuucuuggaaaguuacgggaguaggaggaaaauccugacucugcuguuuacucucuauaaga

SEQ ID NO: 4158468 - RNA, 76 nt, Human
ucuuuuugucuacugagaagcuaugcaaggaggauagcaguuuauuguagucuagcuacuagauagacauggaaga

SEQ ID NO: 4158469 - RNA, 111 nt, Human
ucuuuuuguuggguugauuucccaaguacccugaaguacacagaauucuacuuguugucaaucaauugaguacuuucugagugccagacugagguccccacugcaaggaga

SEQ ID NO: 4158470 - RNA, 58 nt, Human
ugaaaaacacuaauuggaaagcaauacuauuuucugguuuccaauuuguauguuuuca

SEQ ID NO: 4158471 - RNA, 90 nt, Human
ugaaaaaucugcaauacaaagcaugcaguaguagaaaaccguguuccucugaagcacagguauaacgugcauguuguaauggauuuauca

SEQ ID NO: 4158472 - RNA, 88 nt, Human
ugaaaacagacauuuauacucaaauuccugaaucauuucugaucacuacccugagugacaggaugaugagcagggggaaugcuuuuca

SEQ ID NO: 4158473 - RNA, 61 nt, Human
ucuguuggcuugagauuuaauuugcuaagagaaaagcaacugaaguuacuaagguaauaga

SEQ ID NO: 4158474 - RNA, 127 nt, Human
ucuguugggauacuuggauaguauugauucauuuccuauuguggaaacaucuggaauucaguuucuuuaauauaaaggaaugaauucaauggcaucuaaauuuuuuucuauuccuaaccuacuagga

SEQ ID NO: 4158475 - RNA, 55 nt, Human
ucuguugucugaacucccuaaggucaacgcucaagggcuccgggcaggcgaugga

SEQ ID NO: 4158476 - RNA, 71 nt, Human
ucuguugugucuaagcuaguuucaucuuugaagaaaugcaagggaaaaaagcuggcugggagcagaaggga

SEQ ID NO: 4158477 - RNA, 92 nt, Human
ucuguuguuuuaagccacgcaguuuguggacauuuuuuaugcagucuuggaagcuaaaacgauguuuaaaagcucuggcugaaauaggcaga

SEQ ID NO: 4158478 - RNA, 57 nt, Human
ucuguuuaaugggaaugauacuaacuacuucauaggcugucgugagaauuaaacaga

SEQ ID NO: 4158479 - RNA, 58 nt, Human
ucuguuuagauuuccacuguuguugccguaguguauucagcagugugucugagcuaga

SEQ ID NO: 4158480 - RNA, 67 nt, Human
ucuguuuauucacuuugggagagccauucugagaauugaugaauguguuuuaugagagaauauaaga

SEQ ID NO: 4158481 - RNA, 76 nt, Human
ucuguuuccagcauccaaucaucucucucucucugaaguuucccgaaacuuaaggaguaguggugauggcaacaga

SEQ ID NO: 4158482 - RNA, 79 nt, Human
ucuguuucccuaauauguucuaguuccugagaugugccagaaaguuucaccacacaggaaaauuggaauuaaaagcaga

SEQ ID NO: 4158483 - RNA, 56 nt, Human
ucuguuuccucuuguguaaagugaacguaauuccuccuccauaggauggagauaga

SEQ ID NO: 4158484 - RNA, 56 nt, Human
ucuguuuccugcaucuaucucugguaucauccaagucaaguacuacaggaaacaga

SEQ ID NO: 4158485 - RNA, 80 nt, Human
ucuguuucuugaaaagucuugucaagguucccagucugaagacaaauaugugguccucugaaggcuuuucacuuaauaga

SEQ ID NO: 4158486 - RNA, 64 nt, Human
ucuguuugucuggauugcuguguccaacagaaguuuacaacuggccagcaguguggcaagcaga

SEQ ID NO: 4158487 - RNA, 100 nt, Human
ucuuaaaaucaagcugugacauuugauuuacuugguaggcaacggaaaaacacugaauuuuuuuagcacuaagugauaugcuuaaaguuuauuuuacaga

SEQ ID NO: 4158488 - RNA, 87 nt, Human
ucuuaaaccuugcauggagauagccgaaaaauguucacaauugaacugugaccagcugccuggucuaucugcagcagugguucuaga

SEQ ID NO: 4158489 - RNA, 72 nt, Human
ucuuaaacuuugcuguaauucucuaugacaugccuuuuaagaaggauaugagaauagggcaagguccugaga

SEQ ID NO: 4158490 - RNA, 98 nt, Human
ucuuaaagggagaacauuaaugcgagguauuacugacacucagauauuuacuuuuaaauugagaacauguucucuuccuucagaauacaucuuugaga

SEQ ID NO: 4158491 - RNA, 77 nt, Human
ucuuaaaucacauggcuucugucuuggaaauuuuaccuuuaaaagauuauuuaagacaggaaccaggaggcuuggga

SEQ ID NO: 4158492 - RNA, 80 nt, Human
ucuuaaauucauguguuuguugucaagggcaacaauuggguguuugggagcacugaacaacaaauagugaaugaaugaga

SEQ ID NO: 4158493 - RNA, 103 nt, Human
ucuuaacaccaaaaauacuuucagaggaauaguuugaggauuucaguucaaauaucaucaucaaaauccuggaagaucucugugagauuuggaggacuugaga

SEQ ID NO: 4158494 - RNA, 128 nt, Human
ucuuaacugguauaaagaaagccauuuaacugaucaguguuuauuuacagaugguuugacaguccuagaguuuaagcugaaucugaaauagaauuguuggucugggcugcauuuaauuugguggaaga

SEQ ID NO: 4158495 - RNA, 60 nt, Human
ucuuaaguaccuccuuuaucacagauggcucaaaaccugcagggaaggagaugcuuuaga

SEQ ID NO: 4158496 - RNA, 77 nt, Human
ucuuaauauguagcaugcaaaagcugaaggaauaaaauaaacuuucacugacaguucugguuugcagauauauaaga

SEQ ID NO: 4158497 - RNA, 76 nt, Human
ucuuaaugcguucuccugcacuggagggagaagcugcuaaugcaagcucagcccuccugugcagcucguaaugagg

SEQ ID NO: 4158498 - RNA, 57 nt, Human
ucuuaauggagucaguguuucacaaaggagguucccugaaacacucuuuccaugaga

SEQ ID NO: 4158499 - RNA, 86 nt, Human
ucuuaauucagggagguuguaguuggagguuguauagcagaugcaugugacagcaauaacuacuuaagcauacccugagaaugaga

SEQ ID NO: 4158500 - RNA, 92 nt, Human
ucuuaauuucaugcugaagagugugcuuagagagcugcauuaauuuccuucuaauguuguuuuuucauaaaguaugagcaggaaauguguga

SEQ ID NO: 4158501 - RNA, 71 nt, Human
ucuuacaguuuuguaaaccucuccugagugucucccauagucaggagcugugaauacaaagguaaguaaga

SEQ ID NO: 4158502 - RNA, 84 nt, Human
ucuuaccuuuaccuaccuagguccaaucuaaaguuuccgacuuugaggagguaugacuagguacuguaugggaaaaggauagga

SEQ ID NO: 4158503 - RNA, 57 nt, Human
ucuuacucagggauguaggcuugaaccgugguaaauaucaaggacucccugggaaga

SEQ ID NO: 4158504 - RNA, 85 nt, Human
ucuuacuuaaaaccuagucagcacugcugugauuuaagccccacuauaccagguuccccuccagcccugcugguuuugggcaagg

SEQ ID NO: 4158505 - RNA, 60 nt, Human
ucuuagaaacuguaucgauuaggguuggauucccuugugaucauuuuacuguuucaaaga

SEQ ID NO: 4158506 - RNA, 64 nt, Human
ucuuagaaauccagggaccuacucuacuuauccaggaccggauuuuagaaccuggauuucagga

SEQ ID NO: 4158507 - RNA, 79 nt, Human
ucuuagaguggcucugcugggcacagaaggagggcucugaaacucucccgaauugugcucccagcugggcucuccugga

SEQ ID NO: 4158508 - RNA, 57 nt, Human
ucuuagaugaauaaaaaguuauguuuaaaugccuguaagggugacuauucacugaga

SEQ ID NO: 4158509 - RNA, 62 nt, Human
ucuuagcaauaagagggaauauaguaauacuuucacuccuauagcccccuuuuauucuaaga

SEQ ID NO: 4158510 - RNA, 84 nt, Human
ucuuagcaucguaucuuguuaucugaaccaaaauuauauuaaaaugguauaucucaagguaguaguagcuagcgaauguuaaga

SEQ ID NO: 4158511 - RNA, 62 nt, Human
ucuuaggcagccuucuguuauagcacaucaucuccaccgcuacagaggcauacagcuuaagg

SEQ ID NO: 4158512 - RNA, 63 nt, Human
ucuuaggccugaggcaggacagagaggagcaggguuccuugacacugucacucaggccagaga

SEQ ID NO: 4158513 - RNA, 81 nt, Human
ucuuaggguugggguaaggaaauauggcuucucaggauuauucaagcucagaagcccugucacccugacuucaagcucaga

SEQ ID NO: 4158514 - RNA, 77 nt, Human
ucuuaguauuuucacauaugguuguugauugcagagcaacaugcuggccucagccuacaguguagagcagacuaaga

SEQ ID NO: 4158515 - RNA, 86 nt, Human
ucuuaguuauuauuucucuccuugcuaaauggaggcaauauuuuaaaaaccucaauagcaccacuggugggaaaaacuaacuggga

SEQ ID NO: 4158516 - RNA, 100 nt, Human
ucuuaguuauugggaauaaaguuggagugaacaugagauugucgaugucuguuugauguaccaauuuucaauuccuucagauauauacccaaaacugaga

SEQ ID NO: 4158517 - RNA, 57 nt, Human
ucuuaguuuugccccuuugaagccacaggaguggcuucccaaggagccaggauguga

SEQ ID NO: 4158518 - RNA, 77 nt, Human
ucuuauagccuauuugccucuuuuucuagauugccuuacuuaauucucuggcgggaaugaggcagauagauaaaaga

SEQ ID NO: 4158519 - RNA, 89 nt, Human
uccaaauagccauccuguggauguuggcuucuuucccaagcuacccugugggagagugcucaaugugcaaaguggcuauggcaucagga

SEQ ID NO: 4158520 - RNA, 72 nt, Human
uccaaaucuuugagugacauagugaaaaaucagauuuacauuugaguuucaguucugucauuuauagcugga

SEQ ID NO: 4158521 - RNA, 120 nt, Human
uccaacagaacccuggaggcaggaagguuuggaaccaagguucuauagcaaaaucuguggggguuucaaauggauguguuauagaggcuugcauuacuucuggugucucccgggguugga

SEQ ID NO: 4158522 - RNA, 55 nt, Human
uccaacauuugagcaucuacuaaguguaaagauauacuaaaugccagauguaggg

SEQ ID NO: 4158523 - RNA, 71 nt, Human
uccaacccagcuagcuucccugcagugcuggggcugcugagcaucaaacgagaaguuugcuugguguuggg

SEQ ID NO: 4158524 - RNA, 72 nt, Human
uccaaccuaaguuaguucagccuaguucugacuauaacaaacuugguucaaagggauucaauuuagguuaga

SEQ ID NO: 4158525 - RNA, 87 nt, Human
uccaacugauuuuaauuuagagaauuagaacaguacucaguuugacagauugauguauuuauuuucuaaaugacccaucuguuguga

SEQ ID NO: 4158526 - RNA, 57 nt, Human
uccaacuucugcaaucaguuugaaucuauauucugaaucagaaaagcaggacuugga

SEQ ID NO: 4158527 - RNA, 63 nt, Human
uccaagaacaugaaccucuucuaacuccuuccagcauggcaagaguugagucuucaucuuggg

SEQ ID NO: 4158528 - RNA, 67 nt, Human
uccaagaagcucagcaaacaucagcuuuuccuagcucuguguccuccucugcuuggggcaucuuggg

SEQ ID NO: 4158529 - RNA, 61 nt, Human
uccaagaucaaggugucagcagguuugauuucuccugaggacugacucuccuuggcuugga

SEQ ID NO: 4158530 - RNA, 57 nt, Human
uccaagcuuuccaugcccucacccugacaugugcagggguggcauagagggugugga

SEQ ID NO: 4158531 - RNA, 68 nt, Human
uccaaggacgcuggaccccugcuguaacaagacacagaucacacgggagggguucucagccuuaagga

SEQ ID NO: 4158532 - RNA, 62 nt, Human
uccaagggcagcagccauagcccaccuccaccccaugagggccuggugccuguuguccugga

SEQ ID NO: 4158533 - RNA, 55 nt, Human
uccaaguaucugccucuguuggauuauuuucccccaaaagagacugauucuugga

SEQ ID NO: 4158534 - RNA, 86 nt, Human
uccaagucuuugcuauugugaauagugccgcaauaaacauacgugugcaugugucuuuauagcagcaugauuuauaguccuuuggg

SEQ ID NO: 4158535 - RNA, 64 nt, Human
uccaaguggccaagaaaauagaugcauugguacuuuuccaguucuuucacuugagucacucaga

SEQ ID NO: 4158536 - RNA, 78 nt, Human
uccaaguggcuucccaaugugcuaguuucugggcugacagucaauuccaggcccuaggacuuuggggggaaauuagga

SEQ ID NO: 4158537 - RNA, 124 nt, Human
ucuggauaugucuugaauaauuuugacugagauuaggggaaggauacauagaucucugaagauuuucuuuggucauuguucuuuucugugauucuaaaugcacuuuauuuuccugguguccaga

SEQ ID NO: 4158538 - RNA, 100 nt, Human
ucuggaucagggugcuucgcuuacaucugcacuccaggacaggguuaugaauccuuccuguccuguggaccugaggacguugaaggacccucuuuucaga

SEQ ID NO: 4158539 - RNA, 57 nt, Human
ucuggauccaaagcucuuucauggggacguccucuuccccucuuggcuugguccaga

SEQ ID NO: 4158540 - RNA, 66 nt, Human
ucuggaugacagaauggucauauuauugcuugauuugaagaagagcaccauugacuaucugccgga

SEQ ID NO: 4158541 - RNA, 69 nt, Human
ucuggaugaggcucucaacaccuugaggaaccaaagguaccagacaggcaggugagagcuccauuuaga

SEQ ID NO: 4158542 - RNA, 61 nt, Human
ucuggaugggaugaggcaacaaaucggugacuuuccgccacuccguccccauccaucuaga

SEQ ID NO: 4158543 - RNA, 111 nt, Human
ucuggcaagaaugugcggccacaggauucacagggcagcagcugagccugggcacucugaaaugcagccucguuaguugccugaagacuguaggacccacugcugcugaga

SEQ ID NO: 4158544 - RNA, 78 nt, Human
ucuggcagagauauccaucccagagccuuccccuguccuuguaccguggcucacauaugauguugugucucuguuaga

SEQ ID NO: 4158545 - RNA, 60 nt, Human
ucuggcaguugccgcuucagucuuggccuuagccucaucuugaaguggguagcuggcggg

SEQ ID NO: 4158546 - RNA, 75 nt, Human
ucuggcauguaucuggcucucaacaaauauuuauugaauuagcaaguaaaugaauagagaucagauucugcuuga

SEQ ID NO: 4158547 - RNA, 62 nt, Human
ucuggcauuacaugugcaaaagagaggaguagcuucucaugugguacagugguaagcuauga

SEQ ID NO: 4158548 - RNA, 72 nt, Human
ucuggccaacccucaaguuguauggaccacuauaccuuucacccuauacaguugagggagauugguuccagg

SEQ ID NO: 4158549 - RNA, 81 nt, Human
ucuggccacauggucaugcugagcuacaaaggagacugggcaauacagccuuuguucuuaguaucugugugcuuagcugga

SEQ ID NO: 4158550 - RNA, 60 nt, Human
ucuggcccaaguuuucggugaggacuugacuuggguuaaaaucauccacuuggguccgga

SEQ ID NO: 4158551 - RNA, 65 nt, Human
ucuggccuugccugcugcucugcugggaagagcccaaagcgacagaaaccaaggacaaggccagg

SEQ ID NO: 4158552 - RNA, 89 nt, Human
ucuggcuagggcguggccugggaggugacuggcgccguagguaugguggcaccugggugccuuccugccagccgcaacccuggacugga

SEQ ID NO: 4158553 - RNA, 73 nt, Human
ucuggcucacuucaggcuucacgcaguucaagccugagagcuguuagagaaagugaggccuaacugggcuaga

SEQ ID NO: 4158554 - RNA, 70 nt, Human
ucugggaaagcagggaguauggugggacuuugaauccaaagucccuguacuuuccacugcccuaccuaga

SEQ ID NO: 4158555 - RNA, 57 nt, Human
ucugggaacgaaggcuaauauggcucaaaucccaaacaguccuacauuguuccuagg

SEQ ID NO: 4158556 - RNA, 81 nt, Human
ucugggaagacuuccuggcguagcugacauuuggccauuugagccgaguaggaggugaauaugucgggauggcauccuagg

SEQ ID NO: 4158557 - RNA, 64 nt, Human
ucugggaagggauguaaacaugaauaagaaauggucguugcacauguuuuuaucucaaaccaga

SEQ ID NO: 4158558 - RNA, 75 nt, Human
ucugggaaucuucaggaugauuaaagucccucucuagccaguugcaaugacucuaaguccuagaugauucacaga

SEQ ID NO: 4158559 - RNA, 75 nt, Human
ucugggagaccuucuggugcagaccaugucuuggcuauaacuucaagauccagucaaaauuaguaagguccaaga

SEQ ID NO: 4158560 - RNA, 58 nt, Human
ucugggagacuguguugaccaacuucuuggcaaaguaaacuaccacuguuucaccaga

SEQ ID NO: 4158561 - RNA, 81 nt, Human
ucugggagggguagcugaauugugggagaccuagguggacuugacuuggcuuuccugcuacucugcgucuccuucucaaga

SEQ ID NO: 4158562 - RNA, 73 nt, Human
ucugggaucagaggggagagaccagacccaagugggugcacaggugucuaauucucacccccugcauugcagg

SEQ ID NO: 4158563 - RNA, 79 nt, Human
ucugggauuggucagggccagggcuccauuuccuuuaaaauguaaauugugcagcucugcucuuauucucaucaccagg

SEQ ID NO: 4158564 - RNA, 56 nt, Human
ucugggcaacaacuugcaaaugguuuaauguuuuccaaaugcagggcugcugcgga

SEQ ID NO: 4158565 - RNA, 127 nt, Human
ucugggcagggcagaccuggcugcaagguggggccuggggcuggguuggugcugggguuuccccuucucugccaaaccauccaucuccaggcugcuugugacuggagugaguccuucccugcccagg

SEQ ID NO: 4158566 - RNA, 73 nt, Human
ucugggcagugggggccagagggagguguaguguuaacgccccaguacuucuagccugccccuugugcucaga

SEQ ID NO: 4158567 - RNA, 73 nt, Human
ucugggccccucccugccuccgcagccccacccuucccaccccuggguggcccggaaaggacuagggcucaga

SEQ ID NO: 4158568 - RNA, 63 nt, Human
ucugggccgcugcguuccaugagaacuguuuuauugagagggaugguauguaguggauugaga

SEQ ID NO: 4158569 - RNA, 78 nt, Human
ucugggccuccuuuccauucagagagcgcuuggucaagcaauuauaguccaagauccuuccgauggagugagcccaga

SEQ ID NO: 4158570 - RNA, 66 nt, Human
ucuggggagugccuaaguggaagugcuuauucuccugcugccgcugcucacaggcaucuccccaga

SEQ ID NO: 4158571 - RNA, 62 nt, Human
ucugggggugguaggcacaggcugggguaauucucagaggugcccuggcaucuuucccaaga

SEQ ID NO: 4158572 - RNA, 87 nt, Human
ucuggggugcacagcacaugaauugaugccaagugcucucagauguacuaggaggaggugcuuggcuccauuuuuggugcccucaga

SEQ ID NO: 4158573 - RNA, 83 nt, Human
ucuggguacacaauggcuagcauguaaaauaucacaguaaauuuauuacuagauaauuauaggcuaagccacuugaccucaga

SEQ ID NO: 4158574 - RNA, 66 nt, Human
ucuggguacuugcaagauuuucuccuuaucuuugguuuuuaggaauuuaauuaugaugugccuaga

SEQ ID NO: 4158575 - RNA, 61 nt, Human
ucugggugguucuaacuguugaugcgacaacggaucagagaaaagagagaucacugccaga

SEQ ID NO: 4158576 - RNA, 89 nt, Human
ucuggguucaaguagagaugggucucccuuagcaccuuugccuucuucacacaagggcuaaucugccacccaugucuaucgaccucaga

SEQ ID NO: 4158577 - RNA, 109 nt, Human
ucuggguuccagccacaggggccagcccaggcagggcucaaggaaccugcuuucugggugugcaagguccuuggguccuggccaucugaacccccucugagagccuaga

SEQ ID NO: 4158578 - RNA, 76 nt, Human
ucuggguuguuggagaggaggacuagcccuaggccagguggcugaggcucaauccccuucugacagucacuccaga

SEQ ID NO: 4158579 - RNA, 66 nt, Human
ucuggucagcucucuuauccaugaggugaaaaaaaugcaccuuauaucauaggaguguuggaaaga

SEQ ID NO: 4158580 - RNA, 69 nt, Human
ucuggucaugacaguuuugaaauguagucuauuuuuuuaaauacuuugcauggaaaauggucauacaga

SEQ ID NO: 4158581 - RNA, 65 nt, Human
ucuggucauuaauucuuaccuuuaagcuuacugaaaagauaaaggccuaguaaguugagacugga

SEQ ID NO: 4158582 - RNA, 101 nt, Human
ucugguccauuaguccuuucagauuuuguuaauacccacaccagaggcugagugggaaaaagagagguguuaacaaagauugaaaugacuaauggacgaga

SEQ ID NO: 4158583 - RNA, 65 nt, Human
ucuggucccagcccugggucccugcccuggccccuccucgccagcguggccaaggguggagcagg

SEQ ID NO: 4158584 - RNA, 60 nt, Human
ucuggucuccaggaguggugguagaaugugguuccuaagcaugcagauucuggagccaga

SEQ ID NO: 4158585 - RNA, 59 nt, Human
ucuggucuuuauccuaaaagcaaaaagaagccugaaaaguuuuaagcauagaggccaga

SEQ ID NO: 4158586 - RNA, 62 nt, Human
ucuggugacauuaucauuagaauagugcaucuauaacuuaacuuuuugguaagguuaccaga

SEQ ID NO: 4158587 - RNA, 66 nt, Human
ucugguggagaagccuaggauuucaacuuuuugucagaggauuccuguugggacagcuuuaccaga

SEQ ID NO: 4158588 - RNA, 75 nt, Human
ucugguucaucuucauuuuauagcaucuguguucuguuuggaaguacagaguauucuauugauggaaugaaaaga

SEQ ID NO: 4158589 - RNA, 68 nt, Human
ucugguugucuucaccuaagucacaggaugcagagccaucacuggucaggaagguggggacagacaga

SEQ ID NO: 4158590 - RNA, 65 nt, Human
ucuguaaauuaggacauuaaaaaucaugucaggagaauugacagaaauaguucuuaauuuaugga

SEQ ID NO: 4158591 - RNA, 81 nt, Human
ucuguaacugcauuugguggaucgugcugaaauacaucgcauaggcuuguaaacucaguauguuuuacuuccaucuacaga

SEQ ID NO: 4158592 - RNA, 89 nt, Human
ucuguaaguuguagaaguuucccaggugcugcauauuaguccuggacuccacauugccauuugggaauuauuugccuaauuuuaacaga

SEQ ID NO: 4158593 - RNA, 60 nt, Human
ucuguacaagaaggaaaacuagcaauuuccauuuggcugaggauugcccuuguuuacaga

SEQ ID NO: 4158594 - RNA, 72 nt, Human
ucuuagcagcaucuggauucuuuggucccuggcuaaccuugccagagaggagacuuauccagauugguaaga

SEQ ID NO: 4158595 - RNA, 58 nt, Human
ucuuagcauuucauaacaacugugaccaauuuuuauuauguaguuggaaguguuaaga

SEQ ID NO: 4158596 - RNA, 55 nt, Human
ucuuagcccugggggaaggaggaagccuccaaaccaccccucccucagcuaaaga

SEQ ID NO: 4158597 - RNA, 91 nt, Human
ucuugugaacuuugcuuaguuaggaaacaaaguuguucauguaugcguagaauaaauaguauguccugguauuugaguuugaguuacgaga

SEQ ID NO: 4158598 - RNA, 121 nt, Human
ucuugugagucugauuuaugcuuucaggaaaucauagugugcuaagaugaagacuugugucccaaaucaacaggaauuauaguaguauuugucuuuucaagaggcaucauucaaccaagga

SEQ ID NO: 4158599 - RNA, 83 nt, Human
ucuuguguaguauuucucaacugcggcaaugaaaauaaaacuugcaaccguguggcgcaggcuuuagaaucugcuacaauaga

SEQ ID NO: 4158600 - RNA, 112 nt, Human
ucuuguguuggaggcccggaacaucuggagcacuuccagaccugggcucaccaugccuuggaucugaguccuggcagggucuaggucuaggcuccugggacucccagcagga

SEQ ID NO: 4158601 - RNA, 71 nt, Human
ucuuguguuuuauugcuggccaccuguagccaggcacugugcaggaugaugggauccagcaauguacaaga

SEQ ID NO: 4158602 - RNA, 69 nt, Human
ucuuguuaaagguuaaaggugaaagugaauuuuaaugacuguaguuuugauuugaaaccuuuggcaaga

SEQ ID NO: 4158603 - RNA, 62 nt, Human
ucuuguucauuucugugucuucggugucuagaacaggccuggcacaugauagaugcucaaga

SEQ ID NO: 4158604 - RNA, 73 nt, Human
ucuuguuuccaguuugagguuucaagauguggauaccacauuuuaaagugagaccugaaaccaucagucagga

SEQ ID NO: 4158605 - RNA, 65 nt, Human
ucuuguuuuucccauaguguugcagccuucucugagccacacugcuguaucacugcugaacaaga

SEQ ID NO: 4158606 - RNA, 102 nt, Human
ucuuuaaaucaauagagcuuugucucuuuuucucuuguucagaugaauuuccaauuggaaaugucauuuaaagacaaagaaagagcucugaugacuuaagga

SEQ ID NO: 4158607 - RNA, 71 nt, Human
ucuuuaagguaaagcauuucacacaaaaagugaacauugauuuccacugagugaagacuuugccuuuaaga

SEQ ID NO: 4158608 - RNA, 72 nt, Human
ucuuuaagguaagggcuguagacaagauugcuggacucgaacagcaaacuaauugcaguucuggauugagga

SEQ ID NO: 4158609 - RNA, 79 nt, Human
ucuuuaaguaaagugugcauggucaaauauauuuucgaaauauguagcuaaaacugugcacgacuacucagcuuaaaga

SEQ ID NO: 4158610 - RNA, 59 nt, Human
ucuuuacagaaggaacacuacucaguuuucauugaauggagggguuuuucugucaagga

SEQ ID NO: 4158611 - RNA, 80 nt, Human
ucuuuacagagguaaucaaguuaaaaugaggucguuagaaugggccccaauucagugugacugauggcuuuaugagaaga

SEQ ID NO: 4158612 - RNA, 55 nt, Human
ucuuuacaucacaauuguauggaacagagaccacccauauaauggauggaagaga

SEQ ID NO: 4158613 - RNA, 70 nt, Human
ucuuuacugugguuuggccaaugacugcuguuuuuaacaugccaguuccuaugggcaaaacacaaaaaga

SEQ ID NO: 4158614 - RNA, 78 nt, Human
ucuuuacuuuucacaauccuguaagagucaggcacagauacuuugcuucagaccugaaaggaaaaagagaagcaaaga

SEQ ID NO: 4158615 - RNA, 67 nt, Human
ucuuuagaguugguccccugugagccaugcaaggcuggcuuuucacaggaggauaagcccuuccaga

SEQ ID NO: 4158616 - RNA, 120 nt, Human
ucuuuagguuuaggaggagauacuaagauacuggauguuuauccuaucuuaguuugguuggaguaauaagagagaagaagaggguggacuuuggcuuuucaguguuuuuuccccuaaaga

SEQ ID NO: 4158617 - RNA, 71 nt, Human
ucuuuaguuuuccuuugggacuuucaggauuaguugauccagaaggcaaacaaaaggauuucgauagaaga

SEQ ID NO: 4158618 - RNA, 77 nt, Human
ucuuuccaaaccucaaauaauuaauuuauacacaucucagaagaaggugaugauuaucuguuuuauaggugggaaga

SEQ ID NO: 4158619 - RNA, 59 nt, Human
ucuuuccaaggacucuguagcagcccagccuaucuaggugcuaagugcuccugggaaga

SEQ ID NO: 4158620 - RNA, 76 nt, Human
ucuuuccauauuguacucuuuggaggaaagucacacauaugugcagcccacucuuaaggaaugcagaaugggaaga

SEQ ID NO: 4158621 - RNA, 59 nt, Human
ucuuucccagugauuaaggcagugguguugggcauuggaugcugggcauuggaggagga

SEQ ID NO: 4158622 - RNA, 93 nt, Human
ucuuuccuacccccuagcuccacuccuuaugccagacgguuccaaaacuaaggccagcugacugaguggggauguggagcugaugaagaaaga

SEQ ID NO: 4158623 - RNA, 65 nt, Human
ucuuuccucucaggcuugggucguggcauggcuauuuaugccuuucugaucuugaaguggaauga

SEQ ID NO: 4158624 - RNA, 109 nt, Human
ucuuuccuuggugcaggaaggcagucuuuguuacauacagcagaacauagguuaauguggagauguguucugcuuuguguuaauagcuuuaagcauuguggaggaaagg

SEQ ID NO: 4158625 - RNA, 70 nt, Human
ucuuucggcauuuguauagagauuggugcugucccccauuagcagccagagaugugaaaaugccggagga

SEQ ID NO: 4158626 - RNA, 85 nt, Human
ucuuucuaaucuucaguguccucauuugugagauggggacaguuccaauacauaguacagagggcuacugguugauuaaaugaga

SEQ ID NO: 4158627 - RNA, 57 nt, Human
ucuuucuaaugguucuugaccuuuaaagucaaggaagguuauuuuugcuuagaaaga

SEQ ID NO: 4158628 - RNA, 107 nt, Human
ucuuucuagcuuugcauauaggaauguaauucaaauuucagaaaggcuggggcugaauggcucuuuguucugcauuuaaaauauuacuacaguguucacuggaaaga

SEQ ID NO: 4158629 - RNA, 69 nt, Human
ucuuucuaguaaaccacacuaucuuccuauccuggcccuagggcuaaaugaaguauagugggagaaaga

SEQ ID NO: 4158630 - RNA, 93 nt, Human
ucuuucucguguuucccuucauugcuauuucauguuccuauggccggguucuccuugcugucuaccacaugaaaucugcagaagggaggaaga

SEQ ID NO: 4158631 - RNA, 60 nt, Human
ucuuucugaagucuucuaacagaugauuguucuaagucaucauugacuugugcagagaga

SEQ ID NO: 4158632 - RNA, 78 nt, Human
ucuuucugagcuuuuuuagguaagacccaggcaauagccuaggcuauggugggguuccuggagagucuguaagaaaga

SEQ ID NO: 4158633 - RNA, 105 nt, Human
ucuuucugcaaaaucgaagcuaucuuugaugacuaaugcuuugaaacuaucucuguguugguuauaaagcucuaguguuuuggauaauuuuagucaaaagaaaga

SEQ ID NO: 4158634 - RNA, 77 nt, Human
ucuuucuucuggaacaaguggccuugcaagacacuucacucccuguuuuggcaaacacacuuguucugugagagcga

SEQ ID NO: 4158635 - RNA, 55 nt, Human
ucuuugacugccguucucgaccacguaaagugccagucaucgccggcagcaaaga

SEQ ID NO: 4158636 - RNA, 76 nt, Human
ucuuugaggacuaacuuggcagacgcagccaggugugaacagcgcuuauguggcugccgcggugcuuccuggaaga

SEQ ID NO: 4158637 - RNA, 112 nt, Human
ucuuugaggaguaguucaggugacuaccucaugauuaauggcuugccuuuucuguggaaugucaaggcaagcagucagucuaugaggacuucaguuguuuauucuguaaaga

SEQ ID NO: 4158638 - RNA, 66 nt, Human
ucuuugaggauguagaugugagcuucacccaggaggagugggcuuugcuggauccuucccagaaga

SEQ ID NO: 4158639 - RNA, 56 nt, Human
ucuuugaugggagaucugagaggcaugguggcauggcuccaugucugccacaaaga

SEQ ID NO: 4158640 - RNA, 99 nt, Human
ucuuugcagguggaagguggacauuuguccaggauugcgggcugaggacccuggaggagccuccccgaaguccucacucuccaccuucccacccaggga

SEQ ID NO: 4158641 - RNA, 113 nt, Human
ucuuugccauugcugugcuagaaacugguggugaaugcagaguauggugcaccucaguguguguuuaugcagcguuucaccacccacuguuccuugucaguaauugaaagaga

SEQ ID NO: 4158642 - RNA, 61 nt, Human
ucuuugcuaauuagaauugaaccagcaacaucauuugcacaaucacuucuguuagcaugga

SEQ ID NO: 4158643 - RNA, 89 nt, Human
ucuuugcuauugugaauagugccgcaauaaacuuacgggugcaugugucuuuguagcagcaugauuuauaauccuuuaaaaagucagga

SEQ ID NO: 4158644 - RNA, 61 nt, Human
ucuuugcuccacacucuagagacgaggaagggcucacucuuggauuuuaauggaucaaaga

SEQ ID NO: 4158645 - RNA, 69 nt, Human
ucuuugcugguggcauugugggcuuuggugccauauaaccccagagaggcugugcccaccaggcaagga

SEQ ID NO: 4158646 - RNA, 70 nt, Human
ucuuuggcaugcauauccugaauuggguuauugaauauaaaucuagccuuguacaauggaugccagauga

SEQ ID NO: 4158647 - RNA, 80 nt, Human
ucuuugggcuuaaggccagugugcuuuuaaggaacaaugcauuccaacagagagccugcaucuagccucagagcccuaga

SEQ ID NO: 4158648 - RNA, 71 nt, Human
ucuuuggggagacuuggauauagcuaugaaguuauguucauuuagcuguuucuaaguguuguuuccaugga

SEQ ID NO: 4158649 - RNA, 68 nt, Human
ucuuuggggcaugauuagauuaugaggguggagcccucaugaauaggcuuaaugcccuuauaaaaaga

SEQ ID NO: 4158650 - RNA, 91 nt, Human
ucuuuggucuucucccagggcugugguguucugggaagagcuacaccugcugucucaccucugccagaagccagggucuggagaagaaaga

SEQ ID NO: 4158651 - RNA, 62 nt, Human
ucuuuguacuuucuggcuguccuaacuccggcauccaucguuccaaaagaagugugcaggga

SEQ ID NO: 4158652 - RNA, 71 nt, Human
ucuuuguccuguaacauuaggggccgugguuuuaaucuaaggaauuacaguaaaugcuacaggcacaagga

SEQ ID NO: 4158653 - RNA, 78 nt, Human
ucuuugugaaaucuucuagguauggcauucuuuuugcuggggacaggaggagcucuugaugcuugagggagucuugga

SEQ ID NO: 4158654 - RNA, 55 nt, Human
ucuuugugauaguacuagaaucuaaaucaguuugauucuagcauacuuacaagga

SEQ ID NO: 4158655 - RNA, 62 nt, Human
ucuuuguggcgggcuuaaauacugauccuacaaaaggagcuaaaauuaggcugucauaugga

SEQ ID NO: 4158656 - RNA, 55 nt, Human
ucuuugugucacuggcauuguuuuggugccccagcaaaggcuagagacacaggga

SEQ ID NO: 4158657 - RNA, 81 nt, Human
ucuuuguuggcuuucucuguaucugaaugagcucagagccucuuaccaucucauuuaagaugcuagaaggguccauacuga

SEQ ID NO: 4158658 - RNA, 91 nt, Human
ucuuuguuuugggaaauaucuugcacaugcuauuuauguuuuugaaaaaaaucaaugcaacaaauugugugcaauaugcuccuuagcuaga

SEQ ID NO: 4158659 - RNA, 109 nt, Human
ucuuuuaaguaaucauuuacaacuguuggagucuaugcaacuuuuagugggagugauuaguaaaugcacuuacacuuuaaauccagcuuguuuccuaagauuuaaagga

SEQ ID NO: 4158660 - RNA, 70 nt, Human
ucuuuuaauacgaauccuguggaugaaugucugagcccuuuaagauuaucagacaaccuaggguaaaaga

SEQ ID NO: 4158661 - RNA, 90 nt, Human
ucuuuuacaauuacuuacaguagugaagagcuugcagugauaugggguaaucagugaacacagaucuuuauacuguaauaaugaaugaga

SEQ ID NO: 4158662 - RNA, 80 nt, Human
ucuuuuacacagccuguaaugaugacuucagcugugguuucugaaguuaacucauugaugauuacaguguuuggggagga

SEQ ID NO: 4158663 - RNA, 128 nt, Human
ucuuuuagcacuguuaagguuuauuauuaacgcugcacuuauuaaggagacaguugguccauaaauauuucaccuuacuaagcuguguacaagucguugguuuuaaacucagauaggguuuaacaaga

SEQ ID NO: 4158664 - RNA, 72 nt, Human
uccaauaacuauuggcugauugauuuccuauguaucugaagaugcauuuuaaagggucagcugaguuaugga

SEQ ID NO: 4158665 - RNA, 66 nt, Human
uccaauauccuguccauccucccacuggcugaaccugccagaggccaguggacaagggcccgugga

SEQ ID NO: 4158666 - RNA, 64 nt, Human
uccaaugucaccaguuuccaaauuugacucugacaugggacagaggagacuggugacagauggg

SEQ ID NO: 4158667 - RNA, 69 nt, Human
ugaaguuuuuccagacaagucccaucuaacaauauucuagacaggucgggcuucucucagaaacuauca

SEQ ID NO: 4158668 - RNA, 90 nt, Human
ugaauaaaucuugucuuucacucgccucugccuuugcguagaggauaccugcugugcaaaggugaugugagaaagucaggucuaaauuca

SEQ ID NO: 4158669 - RNA, 65 nt, Human
ugaauaauuaugggaguccuaaaagcccacaguugggcggacuagacggcugcuaugauuaagca

SEQ ID NO: 4158670 - RNA, 72 nt, Human
ugaauaugauacuuuggagacuugaguauauuauuuugcuuaaguaaugcaaaugugugcauuuauuauuca

SEQ ID NO: 4158671 - RNA, 62 nt, Human
ugaauaugugcagguguuaguacuucugcuaguuggaguuguaacaagucugcauacauuca

SEQ ID NO: 4158672 - RNA, 91 nt, Human
ugaauauuagguuggugcaaaaguaauugugguuuuugcuguuaucugcaauggcaaaaaaugcauuacuuuugcaccaaccugaaauuua

SEQ ID NO: 4158673 - RNA, 94 nt, Human
ugaauauuagugaacauuagugaacaucagauuacaugagagcaaaucuucucgagagcucuaauaguccgugauguacugguucauccauuca

SEQ ID NO: 4158674 - RNA, 68 nt, Human
ugaaucaauugucuuaagacaugaaguagaucccaaacugcauuuugucuuucugaaaauugaauuca

SEQ ID NO: 4158675 - RNA, 56 nt, Human
ugaaucacgguguuauuaaagcucgaccaucugguucagcagcaacuguugauuca

SEQ ID NO: 4158676 - RNA, 129 nt, Human
ugaaucagguugaacuugggguugacguguaugucuagguguccauauauguguguaaauguauguguguguguguauauauauauauaugaaucuauacaauggggucuccuguacuaaucuaacaua

SEQ ID NO: 4158677 - RNA, 66 nt, Human
ugaaucaucuugaaagucuauguuuuggguuguuuuuuccagcagccugaugaucuggguuguuca

SEQ ID NO: 4158678 - RNA, 78 nt, Human
ugaauccagauaaauagauagauaaacucuauguccagaaccaaggagucuauuuugguugucuauugucuggaucca

SEQ ID NO: 4158679 - RNA, 119 nt, Human
ugaaucggcucaaagccaaauuuagguuaaugucaaaugagaggggagaacaaugaacgcaucauucuuuaugcuucuguuuaggcuucugaucuaaagaccaauuguugaguuauuua

SEQ ID NO: 4158680 - RNA, 83 nt, Human
ugaaugaauuugccaggcuuguuucuaggcuuugaagauauaacugcugacaguuuagacaaagucuugcauuuucuaguuca

SEQ ID NO: 4158681 - RNA, 67 nt, Human
ugaaugauuuggcacacaggaggggcuuguuaaacauuagcugugaugaucuccuuccaaaucuuca

SEQ ID NO: 4158682 - RNA, 77 nt, Human
ucccuccccuccaccagccaguagcuuugccaggagagcagcaaaugagaagccuggaggcucugggagggcaggga

SEQ ID NO: 4158683 - RNA, 85 nt, Human
ucccuccuucucuucucauacacuggcucacaguauggccucucaaagaaaauggagccagaugugagaaagaacacuguaggga

SEQ ID NO: 4158684 - RNA, 56 nt, Human
ucccucuccaugguaagaugcaggacaucuauuccugcugccauagaccugaggga

SEQ ID NO: 4158685 - RNA, 56 nt, Human
ucccucuccuuuuuucuugaaaugaucuacauucccuucugaaagcagcagaggga

SEQ ID NO: 4158686 - RNA, 60 nt, Human
ucccucucguggcagaagccugaccugaacaucuggccccaucugcccacaagaaaggga

SEQ ID NO: 4158687 - RNA, 65 nt, Human
ucccucugggcuggagcaggguccagcuggcacugccccagagcccugcuccuggcugggaggga

SEQ ID NO: 4158688 - RNA, 55 nt, Human
ucccucuguucuguuccaaguguguuuuugauugcucgugguacaggcugaggga

SEQ ID NO: 4158689 - RNA, 101 nt, Human
ucccugaacaccacaguuagagaagcugagcugaggcauguuguuucuucccuaacaucacuguccaaaguucaguuaucacuguacugcggacacuggga

SEQ ID NO: 4158690 - RNA, 72 nt, Human
ucccugagaaagcccaggagguaacugcccagcagggaccaggcagcaucuuccugagguuugcucacagga

SEQ ID NO: 4158691 - RNA, 70 nt, Human
ucccugagcugagcucaacagccuaaggacauggaucaaaagaguccucugcuggcuaaggcucagguga

SEQ ID NO: 4158692 - RNA, 56 nt, Human
ucccugcacccuugcugggcccuggaucuccuagggaaacagccagauggaggaga

SEQ ID NO: 4158693 - RNA, 62 nt, Human
ucccugcagaagcuuguguguagugcacauccugcagcacuguacacagugguucugaggga

SEQ ID NO: 4158694 - RNA, 64 nt, Human
ucccugcagaguugaugcaaguacugagcugccuuugaagucagcuugcaucaucuuugaugga

SEQ ID NO: 4158695 - RNA, 72 nt, Human
ucccugcagcgccaucacccacccguggcugggaggugaccucccagggucaguggugaggccgcccaggga

SEQ ID NO: 4158696 - RNA, 58 nt, Human
ucccugcaggcauguacucugagccccugaggcaguuuagggacagcucuguagguga

SEQ ID NO: 4158697 - RNA, 61 nt, Human
ucccugcauuucccauuguguggcuccaggauucguuuggguggccggggaggugggggga

SEQ ID NO: 4158698 - RNA, 69 nt, Human
ucccugccccaggcaacggagcccacugccagccauccaagcuguuagguguuucugccugaggaggga

SEQ ID NO: 4158699 - RNA, 78 nt, Human
ucccugccuuuccugccccaucugcccagucugccuugcagaugagggcuggaggugagcaggacaggauauaaggga

SEQ ID NO: 4158700 - RNA, 84 nt, Human
ucccugcggucuaggaccucagugugucaggaagaaaauacacagaccugcaaugcccugggagugcuguaccacagauaugga

SEQ ID NO: 4158701 - RNA, 61 nt, Human
ucccugcugcccacugcagugacucuugcuuagugccuugugugugggcagcccucaggga

SEQ ID NO: 4158702 - RNA, 72 nt, Human
ucccuggaagguagguuaaccugcaggagcuuuauuagggagggcucuugggauacacugccauagaaggga

SEQ ID NO: 4158703 - RNA, 87 nt, Human
ucccuggagauguacgagagcauuaagccaucaucauucacccaugauacauuuaccuauggucuugaucggcucucccaucuugga

SEQ ID NO: 4158704 - RNA, 59 nt, Human
ucccuggaggucacuggucagcacuuuugcccuggggucuggaccugucucuuuaggga

SEQ ID NO: 4158705 - RNA, 64 nt, Human
ucccugggaacugaaugucucgguauaaaacccgauuguacauuuguucaguucugagaaagga

SEQ ID NO: 4158706 - RNA, 63 nt, Human
ucccugggagcucagcccuggggugugcccuguaacgcccgaggccuugaugcuucugcggga

SEQ ID NO: 4158707 - RNA, 98 nt, Human
ucccugggggcuaagaguuaggaaaggccuugggccugcuuuccuuggcccccugccacugaggccugggcccagggaacuaaucuuugcuccuggga

SEQ ID NO: 4158708 - RNA, 63 nt, Human
ucccugggucauucucuggcacaaccuaaaaguggaagugcagaaaucucaaugucccgagga

SEQ ID NO: 4158709 - RNA, 88 nt, Human
ucccugggucuuguucuaucaccuuccuuuguccuuuucuguguggcagggauugagacaguggagggcugauguuaaagcucuggga

SEQ ID NO: 4158710 - RNA, 58 nt, Human
ucccuguacuuacacagcguccuuacccucugacaggccagaucuaugugagcaggga

SEQ ID NO: 4158711 - RNA, 63 nt, Human
ucccuguuaccaggaguuacaggcagcaggcaguccuccugucaauaggcuccuggcagguga

SEQ ID NO: 4158712 - RNA, 57 nt, Human
ucccuuaaaacucauguguuguuuacaaauauacuaaugauaugagagugggaggga

SEQ ID NO: 4158713 - RNA, 66 nt, Human
ucccuuagcaacacuuagcaacugccugcuuucagaaaguaguucaguuaagguuguuuaaaggga

SEQ ID NO: 4158714 - RNA, 77 nt, Human
ucccuuagcccaucucugguuacucucaggguaacuugcauuugagauucaugggucuaaccaguguggcuagugga

SEQ ID NO: 4158715 - RNA, 88 nt, Human
ucccuucugaugucuuggucacaggcuugugugcugggguagcaugucucuaggcagcuuaagcccuggcccaggcccucagauugga

SEQ ID NO: 4158716 - RNA, 75 nt, Human
ucccuugaacccaggaggcaaagguugcagugagccaagaucaugccauuguacuccagccugggugacaagaga

SEQ ID NO: 4158717 - RNA, 69 nt, Human
ucccuugagccagguuggaggcugcagugagcuaugaucgugcuacugcacuccaaccugggcaaugga

SEQ ID NO: 4158718 - RNA, 55 nt, Human
ucccuugccagggacacuuauuggccaugcccagugagaugcuagaaggcaggga

SEQ ID NO: 4158719 - RNA, 85 nt, Human
ucccuuggccugcagaggcuguggggcccaagccuucuuuugggucugaagugccccugccccaccgccuuugcugccuguggga

SEQ ID NO: 4158720 - RNA, 56 nt, Human
ucccuuguccucuucgucacugaagaaccagucugacugcagagaagacaaaagga

SEQ ID NO: 4158721 - RNA, 73 nt, Human
ucccuuuagcaauuggaaaauguauuucuagaagccagucucuuggcaauuggugcauuauccauuaaagaga

SEQ ID NO: 4158722 - RNA, 82 nt, Human
ucccuuuccuuuuauguucuuauguuuuuauuguguuuaccugucagugaauccaaacauugagaaacauugggauaaggga

SEQ ID NO: 4158723 - RNA, 84 nt, Human
uccgacgcaggcugccaaggcuggggaggacaagguucccucuugaguucuuuaaaagcugggccauuggugaguucugaagga

SEQ ID NO: 4158724 - RNA, 84 nt, Human
uccgacugcaacggacuggcuaucuccauguucuccuuguuccggacagagagaagcaaucaguggccacccacugcagcugga

SEQ ID NO: 4158725 - RNA, 127 nt, Human
uccgagcaucugagccucuccaugguacucggggagagguuacccgagcaacuuugcaucuggacgacgaauguugcucggugaaccccuuuucgguaucaaauuccaccagggaggccgucuugga

SEQ ID NO: 4158726 - RNA, 55 nt, Human
uccgaggccaaagcugugaauagggugaccccuucugggcuguggaagccucggg

SEQ ID NO: 4158727 - RNA, 65 nt, Human
uccgauuaaaagugcacaaguuguaauuuagaaauacauggaugccuguggauuuuaaaauugga

SEQ ID NO: 4158728 - RNA, 70 nt, Human
uccgcaucaggaggagaugaagaaaaccuauuguauuaaguuguuuucuucaccuuuccuggguugugga

SEQ ID NO: 4158729 - RNA, 109 nt, Human
uccgccuccucccaguugggcgaguagcccuggcugcugcacagggugccucccguaugccaggcacucugcuggcugcagggcagcuuaaccugcagggcggucagga

SEQ ID NO: 4158730 - RNA, 95 nt, Human
uccgcggccccgggaagcgcggggcggggccucgcgaacggccucgggguuccgcaggcccgccccggccucaccugcgcgcaccuggacgcaga

SEQ ID NO: 4158731 - RNA, 76 nt, Human
uccgcuuguggagccuuuuacccacaggagcugccuuugauggacuuuucugggaggaggguuauucccgaaugga

SEQ ID NO: 4158732 - RNA, 71 nt, Human
uccggcagaaaguccugaugcaugcuguagggaaugucugaacagagaacugcagggaucuuucugccuga

SEQ ID NO: 4158733 - RNA, 65 nt, Human
uccggccaggcacaguggcccacguggacuuguaggggaggcugaggcaggauggccuggcuggg

SEQ ID NO: 4158734 - RNA, 88 nt, Human
uccggcuuguuucacggguguguggccuccucuuccgaagucauuucauucuucggggucuuugacacgcucuggcaacaagcgcgga

SEQ ID NO: 4158735 - RNA, 80 nt, Human
uccgggcugcuuggaggaggcgcucauauuacaaaccuacaaggauggggcgcgggggugccugccucaggcagugugga

SEQ ID NO: 4158736 - RNA, 85 nt, Human
uccggggcaguaaaucacacacaggcuuguuaaaauagauguccacaguguaugggcagauggagccuguguuucugcccaggga

SEQ ID NO: 4158737 - RNA, 70 nt, Human
uccggggcuuccccgcagugcccuccuccgccaccaacagcagcugggcccgggcgggagaagccuuggg

SEQ ID NO: 4158738 - RNA, 65 nt, Human
uccgggggauuucuuagcuaccugagugacugcccaggucugcaggcuggaguccacugccugga

SEQ ID NO: 4158739 - RNA, 70 nt, Human
uccggugccugguuuggggaguguucaugggauauguuccaaaggacugacggaccuaucagguacugga

SEQ ID NO: 4158740 - RNA, 58 nt, Human
uccguugacacugcauggagauuauuucugugacagcagucuucaccaguguuaagga

SEQ ID NO: 4158741 - RNA, 60 nt, Human
uccguuugccuguuucgcugaugugcauucaacucauucucagcaaaauaagcaaaugga

SEQ ID NO: 4158742 - RNA, 83 nt, Human
ugagauucacgugccagaagauucucuaucagaugagggccugcugccugguucauagacaccaucuucucauuguaaccuca

SEQ ID NO: 4158743 - RNA, 89 nt, Human
ugagauugacaaucucacgugugucuuuguuccagguacgagagucaacacuuuguauguugggucaaaguacaugagucccaaucuca

SEQ ID NO: 4158744 - RNA, 71 nt, Human
ugagauuguccagaucacauuagcaaggccuauagcggccacgugugcucagugagucugugacaggauca

SEQ ID NO: 4158745 - RNA, 63 nt, Human
ugagauuugggaggggccagggacugaaugauaugguuugucugugucuccacccaaaucuca

SEQ ID NO: 4158746 - RNA, 64 nt, Human
ugagauuugggaggggcuggggugaaauaauaugguuuggcucugugucuccacccaaaucuca

SEQ ID NO: 4158747 - RNA, 55 nt, Human
ugagcaagacccggccucugccccauggagcuccgagucuagccagguuugcuca

SEQ ID NO: 4158748 - RNA, 86 nt, Human
ugaaugcucugaucuggagagaucuucacaaaaacccacaggcaccugcuguucuuugugaagaccucuccagaucagagcauuca

SEQ ID NO: 4158749 - RNA, 58 nt, Human
ugaauggaaggguucaugugugaaggauugaagugccugcacaugcaacuuuuauuua

SEQ ID NO: 4158750 - RNA, 121 nt, Human
ugaauggaguucaaggcagcucccuuuugucucuggcuuuaugcugguuuuacuuuucauuccaguaagcuguuagggggcagagaugaaacacaguuguuuacaggacuuggaacguuua

SEQ ID NO: 4158751 - RNA, 78 nt, Human
ugaaugggcagagaugggccagugacgcaacacaguaaaguguauuuugguuauaggcaucgucucuaaacuuaugua

SEQ ID NO: 4158752 - RNA, 63 nt, Human
ugaauggugauuggugcuucuccaaagacuugaagauugagaggcaaauagauaguccauaca

SEQ ID NO: 4158753 - RNA, 62 nt, Human
ugaauguaauuuaugucuuuacuguaguucccuaaaaaggagccaggaguagauuacauuua

SEQ ID NO: 4158754 - RNA, 60 nt, Human
ugaauucaggggcuauuauauuuucccucuuccagagagaaauauaauucucugaauuua

SEQ ID NO: 4158755 - RNA, 125 nt, Human
ugaauucuugcugaucaaccaaagaguuugucaccagggagcuuguccucugaaugagcuggauuuauauugcaccugccagaacacagcacccuggugccauggggaugccagacauggauuca

SEQ ID NO: 4158756 - RNA, 94 nt, Human
ugaauugauguaucucacauaacugggagauccaaggguggaugugguuuuaaccagaacucgaucugaggguuugugggaaauauucaaauua

SEQ ID NO: 4158757 - RNA, 81 nt, Human
ugaauugccuaaauuagugauaggaagccagauugaguccaugcacucugcuucuggaaccugugcuguuaggcauuuuca

SEQ ID NO: 4158758 - RNA, 85 nt, Human
ugaauugccuuucauagagaugaauucugcagucuuagugggugcaacaggauugcuuuuuauuugcuuugaauugcuuuguuca

SEQ ID NO: 4158759 - RNA, 81 nt, Human
ugaauuggaaaauguuauaaaguuucgaaagauguaucaaccagauacagugugugugaacuuuauuuuaauccugauuca

SEQ ID NO: 4158760 - RNA, 82 nt, Human
ugaauuuaaaacaaccaggaugugaagccuguguccuuaucccaagaggugccaaaagcuauaauuuggugagaagaauuca

SEQ ID NO: 4158761 - RNA, 70 nt, Human
ugaauuucacugacaguauacuuacgcuucuuauucaaaaggaagcacagcauaaaguuacugguauuca

SEQ ID NO: 4158762 - RNA, 129 nt, Human
ugaauuucucugccuccaguuggcgaauaggagaagaaagaguggagaagguauacccgcuucucacccaccuuggcucagaggagaccuucaccacuuccacuccauuccuuuggugagaaaugauca

SEQ ID NO: 4158763 - RNA, 70 nt, Human
ugaauuugacauacaugaaaccagauuguauguuauuauccugugucuuguuucuguagcucaguauuca

SEQ ID NO: 4158764 - RNA, 105 nt, Human
ugaauuugaccuugucaaaucauuuaccugcagcuguuaugagguguacaugcaaauacuugugauugccuaacacuuaggacuuuggugcugacggcaaauuua

SEQ ID NO: 4158765 - RNA, 60 nt, Human
ugaauuuuuccugugcuuaacaaauauucuguagugauauggagcagcaggagagaugca

SEQ ID NO: 4158766 - RNA, 69 nt, Human
ugacaacuccuggugcugaugaagagaugggucaaugagcacucucacacacgccuagaagucaaguca

SEQ ID NO: 4158767 - RNA, 56 nt, Human
ugacaaugaggcccuccacaaacuugauggcgugggugcggaugccgucauuguca

SEQ ID NO: 4158768 - RNA, 67 nt, Human
ugacaauucucugaagagcucagacuaguuuuccuugcagauaacuuugaguccuuuaggcuuguca

SEQ ID NO: 4158769 - RNA, 58 nt, Human
ugacaauugcagacacagaaguaguucaguuucuaugcauucugguuggcaaugguua

SEQ ID NO: 4158770 - RNA, 55 nt, Human
ugacaauuucagaacuaucugggagugaugauguuuacugucaucugagagguca

SEQ ID NO: 4158771 - RNA, 55 nt, Human
ugacacaguugucgacucuacagaagagucuuuagagcuucagcgaaugugcuca

SEQ ID NO: 4158772 - RNA, 125 nt, Human
ugacacaucucugagguuagggcuuccuggcuguuguguucaagaggguauaaauuaucagugacacuagugacacuuuguugaagaauauguuaggggauucugugcugauagagaagagugca

SEQ ID NO: 4158773 - RNA, 78 nt, Human
ugacacauuaaauuagcaaucacgcagucauuuagcuaucugaaggcaaacaugcuugcauugcuaaacauuugguca

SEQ ID NO: 4158774 - RNA, 98 nt, Human
ugacacauuugcuaguuuacacaguagcagggauuauuuuagguaagguacucauauauuuuaaaaaauccuguauuagauugcaagaguaaguguca

SEQ ID NO: 4158775 - RNA, 94 nt, Human
ugacacauuugcuaguuuacacaguagcagggauuauuuuagguaagguacuuauauauuuuaaaaaauccuguauuagauugcaagaguguca

SEQ ID NO: 4158776 - RNA, 113 nt, Human
ugacacugccucuuuaaucuguagcauccgcaugcaagugcugucccagugcaguacaccugggcuaggacucacagaugguauguuaugcacagagcagagagugccuguca

SEQ ID NO: 4158777 - RNA, 73 nt, Human
ugacagacacagagauaggccuguguuuuccugcuuccacugcucucggcagggcuugucucugugauguaca

SEQ ID NO: 4158778 - RNA, 72 nt, Human
ugacagagaggaaaacaguuauaaacagagucacaucacagugacuguguguauguauuguugaaucugcca

SEQ ID NO: 4158779 - RNA, 65 nt, Human
ugacagagucucauuccagcccuguucacaugcucggugguuguggaaauacagacuccaaguca

SEQ ID NO: 4158780 - RNA, 81 nt, Human
ugacagagucugagcugcagaguggggugguugccuagcaacaacaccuguagcacauuaagcagccagucagcuuuguca

SEQ ID NO: 4158781 - RNA, 59 nt, Human
ugacauaaugcuuugaaguugccauuugcuguuuggcaguaacaggaagcauuauuuua

SEQ ID NO: 4158782 - RNA, 56 nt, Human
ugacauaucaucccauuuucagagaaugaaaauucauuuucucuggaugaugguca

SEQ ID NO: 4158783 - RNA, 80 nt, Human
ugacaucaaccccucuggcucugagcuuuucuucuccagaaggaagcacagaaaaggagcauggagugggcuuugaguca

SEQ ID NO: 4158784 - RNA, 60 nt, Human
ugacauucagccaauuacuuucugcuaauagauauugcaguuauguagagugggauguca

SEQ ID NO: 4158785 - RNA, 56 nt, Human
ugacauuuccuagugcuuugugagcaauccaaauuucacuuaaaagagagguguca

SEQ ID NO: 4158786 - RNA, 81 nt, Human
ugacauuuuggcuaaaggcaugccuccauuucuauguacauaauaauauuuaaggaaugugugugccaaugcaaagaugca

SEQ ID NO: 4158787 - RNA, 73 nt, Human
ugaccacuauaaaacuuggguaugaucccuaauuaauauuagguaagcauccuuaaguguuauucuuugguca

SEQ ID NO: 4158788 - RNA, 129 nt, Human
ugaccagccccucgaaggccgccuccgagauguauuccagccgcuugagcucgcccagguccaggcgccgcagcgagggcacgcgguugaaggcguaggaggggaugcucucgaugggguuguuccgca

SEQ ID NO: 4158789 - RNA, 65 nt, Human
ugaccaucaagcacgucuccccauaccugaggauguggggcggcagaugcucccugugaugguua

SEQ ID NO: 4158790 - RNA, 56 nt, Human
ugaccccgccuuuugacucauaaacaucuaaucaggugagugauggaggcggguca

SEQ ID NO: 4158791 - RNA, 56 nt, Human
ugacccggacagcaaacacccaggaaacgaagugcugggccugauucccaggguca

SEQ ID NO: 4158792 - RNA, 78 nt, Human
ugacccugcagucaucucugagauagaagcuuauaguaaacuugccagcuuacugacagagaaccuggaacugcauca

SEQ ID NO: 4158793 - RNA, 82 nt, Human
ugacccuggcuuuguauaguucccugaacugaaauugaccacauucauccguccuuucagagcuaacucggcaaggaaguca

SEQ ID NO: 4158794 - RNA, 57 nt, Human
ugaccuccaagggaaaauguaagugagcagaaacacucaaauuucgcuuggaguuca

SEQ ID NO: 4158795 - RNA, 64 nt, Human
ugaccuguccuugcuggccagguaugggcauaguucuguggucuggccauucagggacucauca

SEQ ID NO: 4158796 - RNA, 113 nt, Human
ugaccuugaacuugagcacuguugaaaucucaugaugccuaugcaggguuguggucaucaggauuggcaagauagcauaugaggaacucagcaaagcagcugguucacuguca

SEQ ID NO: 4158797 - RNA, 62 nt, Human
ugaccuugcacuguagccugggaucuggcauuuucuugccagcccuggagaugugggaggca

SEQ ID NO: 4158798 - RNA, 84 nt, Human
ugacgcuuccuuggccuccaucuccuccaguacuccaguccagcgccaugggugcaggacuccuggaggaagguaccaagcuca

SEQ ID NO: 4158799 - RNA, 68 nt, Human
ugacuaauccauggugcuuuguuuaaacccaguuuuuacuggguuaauagaaucauuaacugagguca

SEQ ID NO: 4158800 - RNA, 76 nt, Human
ugacuaccucuuaauauugcaccuucucuuuuccagaggacagaacuuuuagaagguuaaaguuaagggaugauca

SEQ ID NO: 4158801 - RNA, 68 nt, Human
ugacuagacugggccagucaaauucucucuccagagaauuuagauuugggauccaaaagugcugguua

SEQ ID NO: 4158802 - RNA, 65 nt, Human
ugacuaguucuagccagugaaauguaagugaaauugaugcaucucauuucuggcugaagcuuuua

SEQ ID NO: 4158803 - RNA, 127 nt, Human
ugacuauauuguguacuggaacauugcuaacagaguagauuuugaguauucucaccacaaaaguaggugagguaauguguacguuaauuaguuuaauuuagccauuccacaauguauacauauguca

SEQ ID NO: 4158804 - RNA, 58 nt, Human
ugacucaacucaauaggggcuuauuguuuacauagacuaagaaguccagaguugagca

SEQ ID NO: 4158805 - RNA, 101 nt, Human
ugacucuaaauaaucuuguauuuccuaaaguaauacuagcccucaaaaccuaacaaucuagaaacuuggaggagauugcaaagaccacuugcagaauguca

SEQ ID NO: 4158806 - RNA, 59 nt, Human
ugacucucccucuccugaggcuuccagacaacuggucucagagauucagggagaaguua

SEQ ID NO: 4158807 - RNA, 88 nt, Human
ugacucuucuuugguccuguaagcaccuacucuagaauguaaggaaguguuagagcaggaguugacagauuuuucaugugaaggguca

SEQ ID NO: 4158808 - RNA, 82 nt, Human
ugacugaacaacucaaaccgcgagaggguaacaggaauaaauccuagugucugcugccaccuuguggugagaaguuccauca

SEQ ID NO: 4158809 - RNA, 83 nt, Human
ugacugcauaauguuagaacaguauaggcuaaacauuaauagucugaugugagguuaaccuacuguuagaaugugugugauca

SEQ ID NO: 4158810 - RNA, 55 nt, Human
ugacuggcuguggcuauuaugcuuuauacgaaggcucuaugucgaaagccaguua

SEQ ID NO: 4158811 - RNA, 110 nt, Human
ugacugucaaaauuccaagaagauaaaauaaagaucaaauuagaguugaaggugcuuucccuaauuuaaugaaugagucuuaaauuuguuuuucuggaaauuuuacagca

SEQ ID NO: 4158812 - RNA, 62 nt, Human
ugacugucaugugcuaacuguccacaaaaugucugcuggcauagaaaaguacaugauuuuca

SEQ ID NO: 4158813 - RNA, 60 nt, Human
ugacugugccugguuaaaggcuaccauuuaagagaauaaauggccaaaaccaggugguua

SEQ ID NO: 4158814 - RNA, 61 nt, Human
ugacuguguuggaggacggucuggauuuuuuuaugacuuuguuguuuuccagcgaaaguca

SEQ ID NO: 4158815 - RNA, 74 nt, Human
uccuaguuaagguggauggguaugaagugguagauaacugaaauacuuuucuucauguucccuccuucugguga

SEQ ID NO: 4158816 - RNA, 103 nt, Human
uccuauaaucaagcuguccaucuaaagaagagcaaauuuguuguauauuagcaagaaaauauaucagcugccuucauuagauuagagacagaaauggucaggg

SEQ ID NO: 4158817 - RNA, 124 nt, Human
uccuauagaccauguguugaaaucuugugauaauguguguguguauguuuacuuuuccuuguuguauuuacagggaauugugcuugauacauacuagguacuucauaaauacuuguugaaugga

SEQ ID NO: 4158818 - RNA, 89 nt, Human
uccuaucaccuccccaccaccucaaucauugacauaucuggugcugacagaccacaggaaaggugugucaugaugggaggcauguagga

SEQ ID NO: 4158819 - RNA, 63 nt, Human
uccuaugcugucuggcucucucuuuccuucucaaggccagccugagagcuaacagaaucagga

SEQ ID NO: 4158820 - RNA, 78 nt, Human
uccuauuucacagagagaacucaaaccauuggcuagaaacuucuucaaaaucuggucugauuuuucaucuguugggga

SEQ ID NO: 4158821 - RNA, 62 nt, Human
uccucaaaagucauacauggugcuuacuacagaguugcugaguaaaugucugauuuccagga

SEQ ID NO: 4158822 - RNA, 95 nt, Human
uccucaaaauuuucuaagaauguucucuagggaguucuuucugggagugauucucccagauucauagaaacucauagauucaaaaaauuguagga

SEQ ID NO: 4158823 - RNA, 65 nt, Human
uccucaacuuucuagcagcagguauaaauugccugaauaauacagacuagcuucaaggaugaggg

SEQ ID NO: 4158824 - RNA, 64 nt, Human
uccucaagugccuaaccccuuguaugaagaaguuacucucucugcugggguuggcaccccaggg

SEQ ID NO: 4158825 - RNA, 76 nt, Human
uccucacagcauggcuucugaucaaggaacucacuucacagaaaaagaagagugucaaugggccaugcucauggga

SEQ ID NO: 4158826 - RNA, 63 nt, Human
uccucaccucccagaacccugccucucucaggaagggaaacugaggcagcugggaaaugaggg

SEQ ID NO: 4158827 - RNA, 81 nt, Human
uccucaccucuccucaugggcggguucugccccacuuccauucuuuggcauggagaggacuggcccugaggggaggcagga

SEQ ID NO: 4158828 - RNA, 78 nt, Human
uccucagacaaggccggaggcccgauuguguuuuucucgacucgccagcauccagucagggccuggccugcugaagga

SEQ ID NO: 4158829 - RNA, 56 nt, Human
uccucagauauaaaugagggugcauaauagcacccaauucauggcagauuugaaga

SEQ ID NO: 4158830 - RNA, 68 nt, Human
uccucagccagugcauuccuggggaagaagcaugugaucugugcucaagaccccucugugacugagga

SEQ ID NO: 4158831 - RNA, 60 nt, Human
uccucagcuccuaucucuguauggccuggcuuuuccuagguuaugauuauagagcgagga

SEQ ID NO: 4158832 - RNA, 79 nt, Human
uccucagcucuaacaugagggcuugagucaaaucagagugcgugucuuaugugacuagcccuucaugaccaagucagga

SEQ ID NO: 4158833 - RNA, 59 nt, Human
uccucaggauguggaguagaaucugguugugguuuugcuuuguacuuuccugauaagga

SEQ ID NO: 4158834 - RNA, 73 nt, Human
uccucagggcauacaagcuccuuauucagcuggggcuagugcuccaagcugauaggagcuuggagucggagga

SEQ ID NO: 4158835 - RNA, 113 nt, Human
uccucaugucagcacuugucucagaucaagccuggcaguccucucauuggccuccuggagccagggugucaggagggggauuggggugggguucaaaguaugacagcaaugga

SEQ ID NO: 4158836 - RNA, 79 nt, Human
uccucauuauucaccuuguuguuacuuuaaucuuuguucaguuugacaaaugagaauguagacagaggguuaaagagga

SEQ ID NO: 4158837 - RNA, 60 nt, Human
uccuccagaccacuucugugcggccuuggcaagguucccucagagugugggcuggaagga

SEQ ID NO: 4158838 - RNA, 60 nt, Human
uccuccauggaaugccuuugccuauuaagguuuagacgaggcacuucauggguucaagga

SEQ ID NO: 4158839 - RNA, 81 nt, Human
uccucccacagcaucuaaucuucaugccggagucacauucucaggcuccggacagaccccaggugcugugcagccugagga

SEQ ID NO: 4158840 - RNA, 64 nt, Human
uccucccagcugccugugaggcagaauuaauauucccauucugcagacaggaagcugaggcuga

SEQ ID NO: 4158841 - RNA, 93 nt, Human
uccucccaggauuucuuucuugugggugcccuuuuugcagcguaaaaaccccaggggaagagguagcagucacaaaagaaauccuagggagga

SEQ ID NO: 4158842 - RNA, 57 nt, Human
uccuccccuggaccuugguugaucugcuuuaugccugccagccaaggaggaggagga

SEQ ID NO: 4158843 - RNA, 104 nt, Human
uccuccccuuccuuccccaaccccgacuguguggaauccaaauauuuccaccucaacagcaaacaggaguggggugcuggggagauggaggagaugggggaggg

SEQ ID NO: 4158844 - RNA, 82 nt, Human
uccucccucuuaaaaacuugauauauuuuaaaacauucuaauaaagugccuaagaaaucguucagguuugaaguagggaggg

SEQ ID NO: 4158845 - RNA, 84 nt, Human
uccuccgcaccccacugccucugcgucccacagagucuaggcucauuucggcucgguggccagccugaggcccuggggagggga

SEQ ID NO: 4158846 - RNA, 63 nt, Human
uccuccuacacauagaugcuuucaguuaucaagcaauauuugauuagcuugguguggugggga

SEQ ID NO: 4158847 - RNA, 85 nt, Human
uccuccuaucuugaaguucauguuauagugacuuuaaugaaaucauagaacacuguuucuucgugaacaaugacgagggagagga

SEQ ID NO: 4158848 - RNA, 85 nt, Human
uccuccugcaggcuuacaacuuguaugugauuguugggacaaccaaaagaugacacaaucuugcuguugaagccaugugcuggga

SEQ ID NO: 4158849 - RNA, 58 nt, Human
uccuccugucuaccaguuccuguuucaggaacuugggaugaccuugugaaggguagga

SEQ ID NO: 4158850 - RNA, 95 nt, Human
uccuccuucccuccuucuuaagugucauaauuuccaagaucugccuuauucuuuacuaucuuuauggaacggugaacuuuggcaggggaggggga

SEQ ID NO: 4158851 - RNA, 72 nt, Human
uccuccuugccccuucuuuagcuagcaaggaauacauuucaggccuggcugagguggggaggcaguucagga

SEQ ID NO: 4158852 - RNA, 55 nt, Human
uccuccuuuccccgcuggagcccuggauagagggcucucuggccugggaggagga

SEQ ID NO: 4158853 - RNA, 68 nt, Human
uccuccuuucugccguucccugcucuguggcggaugcgcagggaucaguagggacggcagcaguaggg

SEQ ID NO: 4158854 - RNA, 65 nt, Human
uccucuaagacagggucuauucuuagucccauuuuguggcugaggaaaccaaugcucagagagga

SEQ ID NO: 4158855 - RNA, 56 nt, Human
uccucuacucgcuugcccuuugaaaaugcacagagcuagccaugccuuguagagga

SEQ ID NO: 4158856 - RNA, 65 nt, Human
uccucuagaaaguagccacuuacagagggaaauuccacuuuuuaaauucuguuauuuucaaagga

SEQ ID NO: 4158857 - RNA, 56 nt, Human
uccucuagcuucuguggugugcuagcaauuuuuggcauuccucggcucauagagga

SEQ ID NO: 4158858 - RNA, 129 nt, Human
uccucuagggcugccaguuugcaugagggccucaugucucuccacuggcaggggcuggugagcauccaguccaucuguaggagggacacacgguggcugucuucugcagugugggcaggccuggaguga

SEQ ID NO: 4158859 - RNA, 63 nt, Human
uccucucacagauccuguguuacucagagcuacuaagccuagaaaacauggaacuggagaggg

SEQ ID NO: 4158860 - RNA, 59 nt, Human
uccucuccauauuuucugauuuguuuccuauuuuggcaaagagugaagauggcagagga

SEQ ID NO: 4158861 - RNA, 88 nt, Human
uccucuccccaucaucauuuguacuaacaugucucagggccucuuagggcugagaugucguuagauaucuccugauggaggcaaguga

SEQ ID NO: 4158862 - RNA, 62 nt, Human
uccucucuccaccaagccacccaaauauuaagcaauggguaggcucuguagguagagauggg

SEQ ID NO: 4158863 - RNA, 70 nt, Human
uccucugaagaugcauggaaaucucauuacaaguguucaacaccuguuuucuaaaagguauccagaagga

SEQ ID NO: 4158864 - RNA, 74 nt, Human
uccucugacccugggucucuuacaggcugugcccaaagaguuggacugcaaagucucaagacccaaguggagga

SEQ ID NO: 4158865 - RNA, 76 nt, Human
uccucugccaaagggaguugccuugccuaaguuuauaccuccucccuaggcuaggggcagccucuguggaagggga

SEQ ID NO: 4158866 - RNA, 56 nt, Human
uccucugccagcuagcuccuaguugaauuggauuaauguaaggcacuggcaguggg

SEQ ID NO: 4158867 - RNA, 59 nt, Human
uccucugcuggugaguccugccugcccucaagcaguccagagcccaccagaggaaugga

SEQ ID NO: 4158868 - RNA, 55 nt, Human
uccucugcuguucugguucuuuaggaaacuccgccuuagacaugauggcaggggg

SEQ ID NO: 4158869 - RNA, 59 nt, Human
uccucugcuuggaacuggacagaaguuccaauaagcuacugucuucuauuaaguaagga

SEQ ID NO: 4158870 - RNA, 69 nt, Human
uccucuggggugugcucagagcagggggccugaagaaugcuucuucuguuuacaacacacccaauagga

SEQ ID NO: 4158871 - RNA, 81 nt, Human
uccucuguuauauucucauucauuaaucugguacuauaguuuauaaacaacaagugacagggaaaaugacacugcugagga

SEQ ID NO: 4158872 - RNA, 80 nt, Human
uccucuuagcauagaagaaagcugggaaauaaauauuaaguaagaaacuacuaauacauucuacaguuuucaaaagaggg

SEQ ID NO: 4158873 - RNA, 58 nt, Human
uccucuucacauauuccuugagcuagaaagacuucuauguggcaugggugggagugga

SEQ ID NO: 4158874 - RNA, 93 nt, Human
uccucuucauucuuucucacugacugggacucagcugguagguccgcagaucaguccuccugggaauuuaguugugagugaaugugaagggga

SEQ ID NO: 4158875 - RNA, 59 nt, Human
uccucuuccuucuguccaaaugagcuuaaguuguuuuauggaccagaugagaaagagga

SEQ ID NO: 4158876 - RNA, 82 nt, Human
uccucuugcugcauuucuuaucugaggucuacaugaaugcuccaguuagagugugcuuuagguuaagauaaguaaaagauga

SEQ ID NO: 4158877 - RNA, 66 nt, Human
ugaagucuuucacugucaauuaauguaauucuaaaucaacauucugucaacagugagcagauuuua

SEQ ID NO: 4158878 - RNA, 77 nt, Human
ugaagugugauuaaucaccauggauguaugauugagucaauugacuguuacuuuuucaugaugauuaaucagcuaca

SEQ ID NO: 4158879 - RNA, 84 nt, Human
ugaaguuaucaggcagagcaguauuuguucccuaucaauguguaucuaacaaaacauuacacagaauacuuucugccugcuuua

SEQ ID NO: 4158880 - RNA, 81 nt, Human
ugaaguuauccugccaggaggaggugggacagacaaggugacuuaucuucuuucucuccucuuucugccucuggguuguca

SEQ ID NO: 4158881 - RNA, 60 nt, Human
ugaaguuugguggaaauuuccugcaauauuaccugagccugaaauuuuuaugugacuuca

SEQ ID NO: 4158882 - RNA, 67 nt, Human
ugaauaaaggcuaugagauagaagauaagaacccucuugucuuuagaccucucuggccucagaauca

SEQ ID NO: 4158883 - RNA, 71 nt, Human
ugaauaaguauggcagaguccuaagccuuuaugggacaguucuuguggcuucauucuccugugaauaauca

SEQ ID NO: 4158884 - RNA, 64 nt, Human
ugaauacaugaacccuccugugguucacugaauaaaugaaaccacaggaggguucauuuauuca

SEQ ID NO: 4158885 - RNA, 66 nt, Human
ugaauaccauccauauuucacuccauuuguucuugacaaauggugaagcuucauggguguuuuuua

SEQ ID NO: 4158886 - RNA, 128 nt, Human
ugaauagaugucauuguuaagccgauuaaauguguaacauauguaaaagcaccugcacagugaugggccuagaguaggugcucaauauaugugugcuaaauuugaaucuacaaucauucauucauuca

SEQ ID NO: 4158887 - RNA, 59 nt, Human
ugaauagcuugacaauuauuuuuguuucuugagaagcaugauuacucccaaguuguuca

SEQ ID NO: 4158888 - RNA, 55 nt, Human
ugaauaguccuuggaauaacugcuucuaucuugguguguuaccuuggacaauuca

SEQ ID NO: 4158889 - RNA, 69 nt, Human
ugaauaucaauguuuugauaauaaguguaaugcagcccuuuugcagaguauucaguccauugauguuua

SEQ ID NO: 4158890 - RNA, 81 nt, Human
ugacuaaaaccuagguuuccucauucagagguugaguuucuuuuagucacacuccugaguuaugagacaggguaugaguca

SEQ ID NO: 4158891 - RNA, 65 nt, Human
ugacuaaggaggacagcuaguuagauagaaaguguuccauuguuaaacagcugucuucuucagca

SEQ ID NO: 4158892 - RNA, 71 nt, Human
ugacuagaauuguauuuaguguauauaugagcuauugugauaugaaaaguuuaaauaccugguuuuaguca

SEQ ID NO: 4158893 - RNA, 58 nt, Human
ugacuaguuuaugcucagaugucuuccauuaggaaaccuaaaagucuugaacuaguua

SEQ ID NO: 4158894 - RNA, 69 nt, Human
ugacuauugggugauuuguuauacagcaguagacaacugaaacaguagauauaaaucucucuuuaguca

SEQ ID NO: 4158895 - RNA, 82 nt, Human
ugacucaccaaggacacugauguucauccuguagauaggaggcuaccauuaaaggguuaaaaucaggucauugacaagguca

SEQ ID NO: 4158896 - RNA, 83 nt, Human
ugacucauacagggauaaagcccacuguuuggaccucacuuuacaacccaccaaccccugcucaguuauccgugugugacuca

SEQ ID NO: 4158897 - RNA, 57 nt, Human
ugacucugcugugaaagcauuuauggacuuuagaggcuguaagcacagcagggauca

SEQ ID NO: 4158898 - RNA, 70 nt, Human
ugacucuggcugaaauuagaagguucaauggaaauggaacuacaggaucugcuauuuacagucacaguua

SEQ ID NO: 4158899 - RNA, 93 nt, Human
ugacucugucugagggcuuuaucaggccuugggagccugccugacccauguaggguaggccagaagggccuggaaguaaacaccccuggagca

SEQ ID NO: 4158900 - RNA, 88 nt, Human
ugacucuuacaugaaucuagcaagaggugaagguuucauuggcagaacucucaaguaccucccaucacccuuguuuuuucugagguua

SEQ ID NO: 4158901 - RNA, 62 nt, Human
ugacugaaaaugugucaucccuacugugacuuagucauacuggauuugaaacauuucauuca

SEQ ID NO: 4158902 - RNA, 66 nt, Human
ugacugcuggaccuucagcuggguuuugguuauuuacaaaacaauguugcugggugcgguggcuca

SEQ ID NO: 4158903 - RNA, 130 nt, Human
ugacuggaggcuagauucaccagcugggagagcccaugguuacuuuucuggcuuuguccucacccagcaugacaaagcaccagcaacuaugggcugccccagagggcacuggaggcaucugaccuuuuca

SEQ ID NO: 4158904 - RNA, 81 nt, Human
ugacuggaguuauuuauguuugacaaugaucuggagauugcgaguaaaccugauuauuguaaauauauuugcucuuauuca

SEQ ID NO: 4158905 - RNA, 62 nt, Human
ugacugggaagucagagagaggcuaccugugaugucaggagccugcccucccuucucaguca

SEQ ID NO: 4158906 - RNA, 55 nt, Human
ugacuggucacacaucccugcagagccuggaaccaaggcagggcuggacaaguca

SEQ ID NO: 4158907 - RNA, 72 nt, Human
ugacuguaaacuauucuuucaggagcuuaaacacuaagggaaaguuagaguugcugggaaagauuucaguua

SEQ ID NO: 4158908 - RNA, 74 nt, Human
ugacugucccuagcuucaagaaagaugggcaaaccacauauuuuauuuuccagccucugugcugggaggcagca

SEQ ID NO: 4158909 - RNA, 86 nt, Human
ugacuguuuuugcauuuuuaguggcucacucaugcuauuguacagaaacuagaguggagccaggguagaagcagaggagacaguca

SEQ ID NO: 4158910 - RNA, 64 nt, Human
ugacuuagaaguucugggugcccaaacaaaaccuccaagugcauucaagauuaauucuauguca

SEQ ID NO: 4158911 - RNA, 69 nt, Human
ugacuucuuacagugaucaacacaaagauuauccaguagucuuugguugaauuuauugucuugacuuca

SEQ ID NO: 4158912 - RNA, 67 nt, Human
ugacuugguuaucauucacccugcucaacugaaacuacaguccccagggugaccaauguggccauca

SEQ ID NO: 4158913 - RNA, 77 nt, Human
ugacuuuucacaguggaaggcugcagggcucucacagggggagauuccauuugucugagccugcagagugugaguca

SEQ ID NO: 4158914 - RNA, 58 nt, Human
ugacuuuuuaacuuuugccuacagaaauguccgugcuggcuuuaagguuaaaguguca

SEQ ID NO: 4158915 - RNA, 60 nt, Human
ugagaaaccuucgguccuaagccagggcaucagcugacugguugcacagaggguguuuca

SEQ ID NO: 4158916 - RNA, 60 nt, Human
ugagaaagacgauuggacaucugacagcuucauugauagcugacacaaauugcuuucuca

SEQ ID NO: 4158917 - RNA, 84 nt, Human
ugagaaagccagacagaaagccagagagaaagggcucacuuuguugccuccugaguccauaauucuggucuuuccuggguccca

SEQ ID NO: 4158918 - RNA, 66 nt, Human
ugagaaaugcuuuagaaaaccagcuuugaucaauuuaauuaggaguaguuuugaaagcaauucuua

SEQ ID NO: 4158919 - RNA, 96 nt, Human
ugagaaauuucacuucagacaguaagaaagagguuaaugagucagaccuuucugcuuuucccaacugcuauuuuaucucugacggugacguucuca

SEQ ID NO: 4158920 - RNA, 63 nt, Human
ugagaacaagcaacaaccuucagcugugggcggacgcugacucacagacuguguugcuacuca

SEQ ID NO: 4158921 - RNA, 57 nt, Human
ugagaacaguuggaagcagucauuucauuugaaaguuagcuuuauccaacuuuuuca

SEQ ID NO: 4158922 - RNA, 87 nt, Human
ugagaaccuguaaauggggcuuaaauugcucaaagccuaaagacaaugaaaaguggcagaaugugaagacccgguuuguugguuuca

SEQ ID NO: 4158923 - RNA, 66 nt, Human
ugagaacuugugcuauugcacaacauuccacaugccaucaacauugugcaauucucacaagucuua

SEQ ID NO: 4158924 - RNA, 75 nt, Human
ugagaagcauagaauaugacuuuuagauccaagaacuuaccuacuugucucuuguuaucauuucugaguugcuca

SEQ ID NO: 4158925 - RNA, 102 nt, Human
ugagaagccuuggugcaugcaccugcagagagaagaagagguaauagaccucuucucuggcagaugugugucccucuacuaccaaauauugcuguugucuca

SEQ ID NO: 4158926 - RNA, 101 nt, Human
ugagaaggaagcagggguagagauugcugguguaagggacuuuuucuucccuucugucuucucucccacuguuuugucuucugcucuugcucucucucuca

SEQ ID NO: 4158927 - RNA, 79 nt, Human
ugagaagguaaauaacuugccaaaggucacuuaguuuuaaaaugauggagcugagacacacuuuggcaauacuggcuca

SEQ ID NO: 4158928 - RNA, 55 nt, Human
ugagaauaggcauagaaccugggccuccuguguccuggcccugugcucauucuca

SEQ ID NO: 4158929 - RNA, 82 nt, Human
ugagaaugagcugcagacugggaggcaggugucccagcaugggcucaccaagcuccuacccucucccgguccagcuuucuca

SEQ ID NO: 4158930 - RNA, 55 nt, Human
ugagaaugggagagaacacaaagucccuuuauucaggggaguggauuccaucuca

SEQ ID NO: 4158931 - RNA, 61 nt, Human
ugagacaauaaggcugagaagcugagaauuugugaagcauuaauuuuaguuuauugucuca

SEQ ID NO: 4158932 - RNA, 101 nt, Human
ugagacagagucuugcuccaucacccaggcuggagugcaguagugcgaucucagcucacugcaacccccaccucccggguucaagcgauucuccugucuca

SEQ ID NO: 4158933 - RNA, 106 nt, Human
ugagacagagugucgcucugucacccaggcuggaguguagcagugcagugcgaucucggcucacugcaacuucugccuuccggguucaagcgauucuccugccuca

SEQ ID NO: 4158934 - RNA, 59 nt, Human
ugagacagaguuucacucuuguugcccaggcuggagugcaauggcgugaucucugcuca

SEQ ID NO: 4158935 - RNA, 102 nt, Human
ugagacagaguuucgcucuuguugcccaggcuggagugcaguggugucaucucggcucacugcaaccuccaccuuccggguucaagugauucuccugccuca

SEQ ID NO: 4158936 - RNA, 63 nt, Human
ugagacaggagaggccccuccuaguuggcaugguuuuaagggggagguaaucuugaggucuua

SEQ ID NO: 4158937 - RNA, 58 nt, Human
ugagacaggaucucccuuugucacucaggcuggaaugcagaggcaugaucacugcuca

SEQ ID NO: 4158938 - RNA, 58 nt, Human
ugagacagggucuugcucuguugcccaggcuggagugcaguggcaggaucuuggcuca

SEQ ID NO: 4158939 - RNA, 63 nt, Human
ugagacaguuuuucuauuuccagccuguugcugggaagauguauuaggaaaguugaugucuca

SEQ ID NO: 4158940 - RNA, 67 nt, Human
ugagacauauaauuugcccacaaaaggaaauguaacauuuuagucugggacagauuauaagucugca

SEQ ID NO: 4158941 - RNA, 83 nt, Human
ugagacaugaugugcuccagaagcuucaaggagauucuagacucaagucuagaccccucccugcuucucaccaucaccucuca

SEQ ID NO: 4158942 - RNA, 109 nt, Human
ugagcaauaauagugauaaaaguuuuuaaguuaauugcauguuaaugacuaaguuaaacucaaaauggcaaucagcagaagcuaggaaacauuugucuuguuuaaauca

SEQ ID NO: 4158943 - RNA, 76 nt, Human
ugagcacaugcaccagaaaucaacauaagaauaaguccuuuugaguguucaaaacugguguauuauuugugacuca

SEQ ID NO: 4158944 - RNA, 59 nt, Human
ugagcaccaucuguuugugugccaaguucugugcacacugcuuuaaacagauggucuca

SEQ ID NO: 4158945 - RNA, 72 nt, Human
ugagcagaacacgggauccauggggcauccuuguguagguccuccguggcuuggaucccugugcacugcuca

SEQ ID NO: 4158946 - RNA, 67 nt, Human
ugagcagagcaauaggacucuccuuuguguugacuguuuuuacaacauagucuuguggcuuugugca

SEQ ID NO: 4158947 - RNA, 57 nt, Human
ugagcagggacuuuggagucuggugacccaggguucaaauguugucccugauucuca

SEQ ID NO: 4158948 - RNA, 57 nt, Human
ugagcauagcccuucuaguguuguagcauagugcacagccuguugguuuacugcuca

SEQ ID NO: 4158949 - RNA, 60 nt, Human
ugagccaaaucccauaauaaauccucucauauaacaggauuuauuaugggauuuggcaca

SEQ ID NO: 4158950 - RNA, 58 nt, Human
ugagccaagaucgcaccacugcacuccagccugggugacagagcaagacuuggucuca

SEQ ID NO: 4158951 - RNA, 82 nt, Human
ugagccagauauaaauggaugugguagaaacuguacaauaauaaaaguuaguauuacuaaaagacaucuauucauaugcuca

SEQ ID NO: 4158952 - RNA, 87 nt, Human
ugagccagaugugcgggaucuugguggcacugacaucagacaccaggcggugcuugacguguagccgccccggcaccaucaugguca

SEQ ID NO: 4158953 - RNA, 65 nt, Human
ugagccagcugcaucuccugggcugcacggagacacauccucagacuucaggaugcacugauuca

SEQ ID NO: 4158954 - RNA, 96 nt, Human
ugagccaggauuugaacccaggaaguuugacuggaaaguuuaugcaaauaaacaacauuucagacagauucuucucaguauaaaaacaauggcuua

SEQ ID NO: 4158955 - RNA, 92 nt, Human
ugagccaggugggcugggcauggugaaucaugccuguaaucccagcacucagggaggcugaggcaggcagaucacuugagcucacgaguuca

SEQ ID NO: 4158956 - RNA, 68 nt, Human
ugagccauaugaaaguguuaauauuuggucauuucugaccugccaaaaugacaguuucauaugguuca

SEQ ID NO: 4158957 - RNA, 65 nt, Human
ugagcccaggaauuggaggcugcagugagcugugauuguaccacugcacuccagccugggcuaca

SEQ ID NO: 4158958 - RNA, 68 nt, Human
ugagccccccaggcagcccuucugacgcacacaugcgccaugugcuccaggccgccuggggcugcuua

SEQ ID NO: 4158959 - RNA, 73 nt, Human
ugagcccuagcaggacagagcccagacugugugcucccugcagcacagugccccuaugccagcuaggagcuca

SEQ ID NO: 4158960 - RNA, 72 nt, Human
ugagcccuugcucccugugccccacuguacucugaaaguacaaugagcugagccagaggcagcaugggcuca

SEQ ID NO: 4158961 - RNA, 58 nt, Human
ugagccugguugcagugucuggucccagcauuccuggauucagagcccggcuagguca

SEQ ID NO: 4158962 - RNA, 55 nt, Human
ugagccuucccaagaacccgcacaaaccuaccggcaagguccugggccuggcuca

SEQ ID NO: 4158963 - RNA, 84 nt, Human
ugagcuacaguacuaagacuccaccuagccauuuaagacaauauuacaaaaugaagcuggguauaauuuucaguaguguaguca

SEQ ID NO: 4158964 - RNA, 62 nt, Human
ugagcucacacagcuccaaauacaauggaaaccacuggguuauuugucagcuguugaguuca

SEQ ID NO: 4158965 - RNA, 66 nt, Human
ugagcucuguuagggcuggaaccaaacauguuuguauguguaucuuugggguuuaacaugggcuua

SEQ ID NO: 4158966 - RNA, 58 nt, Human
ugcauagaggauccagugugguucugccacuguggcaaucauucugauucuuuguaca

SEQ ID NO: 4158967 - RNA, 64 nt, Human
ugcauagagucauaauuacauauauuuugcuugaggcgaaucaaugucuguucugauuggugcg

SEQ ID NO: 4158968 - RNA, 62 nt, Human
ugcauauaagggaaacucaguaaauaauuauguugaauugauuagaguugccauuauaugua

SEQ ID NO: 4158969 - RNA, 66 nt, Human
ugcauauauuugagauuauggcuuuucaguuuucugccaucaccaauaaguuuugaaauauaugcg

SEQ ID NO: 4158970 - RNA, 127 nt, Human
ugcauauguugggcuuugggcuagauacugaguucucagacauguaaucucuaccaauuccaagagagaagguaucugauuuuauucugugugucaguuaauuuaucucaaauguuuaauuagagca

SEQ ID NO: 4158971 - RNA, 106 nt, Human
ugcauauuaaaaagagauuuacugaaguucuuaugaaaacuugagcugauauuucauuucaaugugguuauaauaacuaguauauuuuucuugagcaaauaaugca

SEQ ID NO: 4158972 - RNA, 58 nt, Human
ugcaucacaucauggagaauuaugggaacccuaucgguuuuguuagagugauguggca

SEQ ID NO: 4158973 - RNA, 100 nt, Human
ugcaucacuguagaagacugcauuugacagagaaaagugugacuuauaaauuucugaaaguugucaucuuuucuguugaugguauuuauucacaaaugca

SEQ ID NO: 4158974 - RNA, 63 nt, Human
ugcaucaggacuugcaggaccagagaaagaaggagaauaaauauauccugcagcuucuaugua

SEQ ID NO: 4158975 - RNA, 55 nt, Human
ugcauccgcacgcuugugagaaucugucuaccaaagagucugaggugaggaugca

SEQ ID NO: 4158976 - RNA, 56 nt, Human
ugcaucuaaguggcuaacaacccaugagugccuggguugccuuugcaguuggauca

SEQ ID NO: 4158977 - RNA, 78 nt, Human
ugcaucucuugaggccucaguuugucaucuguaaagugagagcauuguacuagaugaucucugaggccuuucccugua

SEQ ID NO: 4158978 - RNA, 71 nt, Human
ugcaucugcaaaucccuacugggcacaaaugcaaaacaguugccaauguccuuuuugggauuuguagggca

SEQ ID NO: 4158979 - RNA, 59 nt, Human
ugcaucuuuuauucauuaugcaaauguuuauucaacauugaagggaaugcaaagaugca

SEQ ID NO: 4158980 - RNA, 67 nt, Human
ugcaugauggaugugcacuucgcuggguuauaacguguccaguuaagaaacccacgccguacgugua

SEQ ID NO: 4158981 - RNA, 80 nt, Human
ugcaugcacagcccauggccccgccgacacaggauagacgcuccaugaaaggccaccaugccagggacuagugcggugca

SEQ ID NO: 4158982 - RNA, 65 nt, Human
ugcaugcacccagccggguauucagcuugguguggucagugugccugugugcugggcugcaagca

SEQ ID NO: 4158983 - RNA, 61 nt, Human
ugcaugcucaaguuaguugugagauguggcucucagcauuuuauacuaaaaugaaguauca

SEQ ID NO: 4158984 - RNA, 76 nt, Human
ugcaugcucucuguccugcucagagccaguaccuggauggaggcuguguguucuggguggacugggggagaaugca

SEQ ID NO: 4158985 - RNA, 105 nt, Human
ugcauggcucugugcacuuuuagugccaagaagcaugagaagauuuuauaacgagaguaauuguaauaggauuuaaucauggugucggcagcaaaagggccagca

SEQ ID NO: 4158986 - RNA, 75 nt, Human
ugcauggcuuggagcagcauuucucaaagggugguucaaaacuauuuccuucaggugcucuucgaggaccuugua

SEQ ID NO: 4158987 - RNA, 104 nt, Human
ugcauguguugguggucacugagacuuggguggccugauucuguauugugcaugauuugcuuuucuggccacuaauaggucucacggugaagacagcagaacca

SEQ ID NO: 4158988 - RNA, 96 nt, Human
ugcauuauguauuuuauauuguuuauuuuugucugcaugaaagauuggaauaguaaccguguaugauaaauguuaauaauaauaaagugaaaugua

SEQ ID NO: 4158989 - RNA, 66 nt, Human
ugcauucaggauccuaugcuucagggagaguucuuuuguauaccauugcugaaggauccaggugua

SEQ ID NO: 4158990 - RNA, 69 nt, Human
ugcauucaguuggucagcuuuuauugaguacuauacuccucagagugaggcuaaggccaauggaaugua

SEQ ID NO: 4158991 - RNA, 61 nt, Human
ugcauuccagcucccuucuggcccgaggaggcggugggcugcgggaaggugcuggagugca

SEQ ID NO: 4158992 - RNA, 85 nt, Human
ugcauuccuuuccagcccuuucuuccugugugugagucuccagggccuggcugcugcacacacggagauaggcuuuggcugugca

SEQ ID NO: 4158993 - RNA, 100 nt, Human
ugcauucuaguaaaauuggccacuaguauaauugcccuaaccuucugagugucugcucacggguguuaagcauuugucuguaccauuuuugauuagugca

SEQ ID NO: 4158994 - RNA, 97 nt, Human
ugcauugaucugagagcuagaugugucuuccuugacaguucaggcaacccugauucuaauucuuuggagacaaucuguuauuaaauugaucugugua

SEQ ID NO: 4158995 - RNA, 127 nt, Human
ugcauuggaagauuucuccuuucuuacaggucguguccugcaacugaaaggcccugggagagagagccgugagggcauggcagugaggauggcagugugguggaaagggggaguuuucaaucagaca

SEQ ID NO: 4158996 - RNA, 89 nt, Human
ugcauuuaauuaaucauggugaauucaucggaaaguaaauagauauuuuagugaguuuuuccguggcuacgauaaguuaauuuaaugca

SEQ ID NO: 4158997 - RNA, 77 nt, Human
ugcauuucaaacaguuacagcugcaaggauuacucauaguaauagcagugacagacaacuguuugagcuuuagugua

SEQ ID NO: 4158998 - RNA, 109 nt, Human
ugcauuucuccaaggccauucuccuagccuguuuggaaucuguuuaauuucuuuguuugaauuaaugguuccaaaaggccagaauagcaguucauucuugagucuugca

SEQ ID NO: 4158999 - RNA, 75 nt, Human
ugcauuugcaaauuuuaauuucaugguucauggcaaugaccucaaggcauugauucugaagugaaaugcaaauca

SEQ ID NO: 4159000 - RNA, 65 nt, Human
ugcauuuuuaugcggcagugcaauagaauuugaauuuuaugcacaauuagucuuauauugaugua

SEQ ID NO: 4159001 - RNA, 78 nt, Human
ugccaaaaaguucugaaguccuucagaccuucgagucuauuugcaauucugagucuggaaacuuugacaaaaagggca

SEQ ID NO: 4159002 - RNA, 56 nt, Human
ugccaaaggacaugucaauaucaggccuucagaagagggagguagcaguucuggca

SEQ ID NO: 4159003 - RNA, 69 nt, Human
ugccaagcccaaacauguggaacuaaaucuuaaaaccccuaagaaucuugacaguuugggaaaugagca

SEQ ID NO: 4159004 - RNA, 64 nt, Human
ugccaaggagcuggaucagggcagucuuugcacaucauucguggggacccugcaguaccuggua

SEQ ID NO: 4159005 - RNA, 67 nt, Human
ugccaaucuuguagcugacuaucuuguuccagucgauuuuggugcagguaacuggaagcugccggca

SEQ ID NO: 4159006 - RNA, 113 nt, Human
ugccaaugcuccuggaucagaggagagacuccugcccacgugcuacuucugagagccagcggcuaccacagaggcagugggcuggagcccucugcaaggccgaggggaaggca

SEQ ID NO: 4159007 - RNA, 77 nt, Human
ugccacagagcuauuucuuaaaagcuguacuuacacucaggauacaguuuuccuugguauagaacucuuccauggca

SEQ ID NO: 4159008 - RNA, 77 nt, Human
ugccacaggcuuaggagggaggucugaacaaaaaugcaagaaaaaggaacuucuguccuccaagccacgucguggua

SEQ ID NO: 4159009 - RNA, 85 nt, Human
ugccacauuuuguguacuuucucaagcugaauugugucuaaugaugucaaauuauguaaugggaagagaaaaauaaauucaggca

SEQ ID NO: 4159010 - RNA, 55 nt, Human
ugccaccuugugcagcaggagguccuuccauuuccugagcuguccagggugagca

SEQ ID NO: 4159011 - RNA, 66 nt, Human
ugccagaaaguggacucgaacugaggucuucugacccuagacacaguguccuucuacuugccugca

SEQ ID NO: 4159012 - RNA, 62 nt, Human
ugccagaaggagggagcagggauccuaugagccugacaucacugcuuccucucuucauggca

SEQ ID NO: 4159013 - RNA, 92 nt, Human
ugccagaagggaagauacaaaaaugugaccacaggguguuggacuuccuucucaugcauucuguagagcauuuauuacccaaauucuggaca

SEQ ID NO: 4159014 - RNA, 79 nt, Human
ugccagacuccguuguucuuaacccccagugcagauagccaauguguguaccuggccugagcacagcggcugcuuggca

SEQ ID NO: 4159015 - RNA, 59 nt, Human
ugccagauuguggcauggcacucaacuccucaaagaagccauugaguuccagucaggca

SEQ ID NO: 4159016 - RNA, 67 nt, Human
ugccagcacuugggggagauuccgggucauaugcuaauggcucaggauaauuuucccaaagcaggca

SEQ ID NO: 4159017 - RNA, 80 nt, Human
ugccagccuuauucagaccuuggauucuuuucagaagugaaaaagggaacacucaaggucuauugaaucggagcguggca

SEQ ID NO: 4159018 - RNA, 62 nt, Human
ugccaggaggaucauccuguuuucucuaguaagaggcaggucagauaaucuucuuuauggua

SEQ ID NO: 4159019 - RNA, 62 nt, Human
ugccaggcuccggaacgacaguugauaacuagcuggcuguguucuaagagaggaggcugaca

SEQ ID NO: 4159020 - RNA, 61 nt, Human
ugccaggcucuggccuacuggaguccaugauacuuuugugucaugcaggcagaguuuggua

SEQ ID NO: 4159021 - RNA, 58 nt, Human
ugccagggcagucucccccagaccuggggcuccccagggacagagacugcaccuugca

SEQ ID NO: 4159022 - RNA, 114 nt, Human
ugccaggugggaccacccgucccaaagacucacggcugugagccccuagcagcuuacgguugcagugggugaugaguccuggggagagggaugggaguggagacccuaacagca

SEQ ID NO: 4159023 - RNA, 55 nt, Human
ugccagguugaaggaugacggggugcccagauucccaccuucaaauuuccuggca

SEQ ID NO: 4159024 - RNA, 60 nt, Human
ugccaguugggaaaacagacauuuuuagugugugucugcaguucagaucuaauuguggca

SEQ ID NO: 4159025 - RNA, 57 nt, Human
ugccaucugcacccaccugcccauugcucuucacagugguagcugcugcaguuggua

SEQ ID NO: 4159026 - RNA, 61 nt, Human
ugccaucuuugcagcacuguucccagaccacugcuuguguugguuggaauggugcuuggca

SEQ ID NO: 4159027 - RNA, 62 nt, Human
ugccaugaagagaggaagcagugaugucaggcucauaggaucccugcucccuccuucuggca

SEQ ID NO: 4159028 - RNA, 70 nt, Human
ugccauguggcuucugaauggaggaggcugcagaacuuccuucagucuucugagccauaauaaauuggca

SEQ ID NO: 4159029 - RNA, 118 nt, Human
ugcaaauaucccucagaccaaagagaugcuuccgugcuugcacuacgcauaguuuaugucauuuaacauucauuuguaacucuguuaggguggcugcaucuccugaguauaaauugua

SEQ ID NO: 4159030 - RNA, 64 nt, Human
ugcaacaguggggcaugcugaagccuuacagaggagccccucucuagccugcccacacaguuca

SEQ ID NO: 4159031 - RNA, 58 nt, Human
ugcaaccugaacuuucugauucugccaggcccuuuuggaaucagcaagguaggaugug

SEQ ID NO: 4159032 - RNA, 90 nt, Human
ugcaaccuggggacucagcuccaguuuccugacugagccuggccagguuggccgccacccauaaacuggagaccagagugcccagguuca

SEQ ID NO: 4159033 - RNA, 58 nt, Human
ugcaacuuagaaggcaugaaauuaguacuuuuuuuaacaucaugcauuucuaagugca

SEQ ID NO: 4159034 - RNA, 66 nt, Human
ugcaacuuggguuaaagcaaguacuggacuucacuuuuggcucaaagcaguuuuaaucaaguagcg

SEQ ID NO: 4159035 - RNA, 83 nt, Human
ugcaagaauaaaauacauguugaugacagugaugaccgaaagcauaagaaugucucugccaucagcuuauuuccuucugugua

SEQ ID NO: 4159036 - RNA, 70 nt, Human
ugcaagaggguguucaguuugugcaaaucaaccaagcuguauauuuauaauugggcacuuucuucuugca

SEQ ID NO: 4159037 - RNA, 68 nt, Human
ugcaagcaaaaagucuccaaauaauguccucauguguuuggcggacuuguauuuacuucuugauugca

SEQ ID NO: 4159038 - RNA, 63 nt, Human
ugcaagcacucaaugcaaacagucauuguagauuaacacaacaaugcacuugagauguuugua

SEQ ID NO: 4159039 - RNA, 68 nt, Human
ugcaaggcccagacaagagcuccacuucuuaaacaauauguguguggaggcugucaaaggguauugca

SEQ ID NO: 4159040 - RNA, 58 nt, Human
ugcaaggguguuugagcugcccauuaaucuacaggaaaguuuagaccaagccuuucca

SEQ ID NO: 4159041 - RNA, 87 nt, Human
ugaggagcaagugagaaugagacuaugcgagugugauaacaguucuauauccauaacacuuucaucucagaguacacuugugcuuca

SEQ ID NO: 4159042 - RNA, 99 nt, Human
ugaggagcuggaauagcuacuaaaaguaaaacucacaaaaggauggggccucccaugacccuguccugugcuuuuuacugucagacuuuuccaaccuua

SEQ ID NO: 4159043 - RNA, 80 nt, Human
ugaggagcuuguuaaaaugcaaauucugauucauuaagucugaguggaacucaaaagucugcauucuucacaagcuucca

SEQ ID NO: 4159044 - RNA, 94 nt, Human
ugaggaguggccucgaccugccugugacucgucuugggccaguaggggacgcccuggccucaccagacgagcgcagccaugggcgaccgccuca

SEQ ID NO: 4159045 - RNA, 70 nt, Human
ugaggaguuagggugauucaguguuauuagacugucagggcuauauauacuauauuaccuucucaacuua

SEQ ID NO: 4159046 - RNA, 118 nt, Human
ugaggaucgguuaaaagcuuugccacauuuuucacauuuguaggguuucucuccaguaugaauaaucuuauguguagaaaggguugaggacaguuuaaaagcuuugccacauucuuca

SEQ ID NO: 4159047 - RNA, 70 nt, Human
ugaggaucucauggcucuaaagacauagauuucugaauuucaaggaccuauuguccagagccaggccuug

SEQ ID NO: 4159048 - RNA, 116 nt, Human
ugaggaugaggagcaggagcgacugcggucugagauuuuuaauaggcagggcuguaaaauguuggccaggccuaagucacagaugcaccacagagcucuuucaagcccuuauucca

SEQ ID NO: 4159049 - RNA, 56 nt, Human
ugaggauggaaugcugugcaagucucuaauaggcaaauugccagcuucuaauccca

SEQ ID NO: 4159050 - RNA, 69 nt, Human
ugaggauguugaggcagacguugcccucgauuucaauguuggggugauagaccauugucucacacuuca

SEQ ID NO: 4159051 - RNA, 94 nt, Human
ugaggauuauauggauuaaugcauguuaagcucuuaaaauaguguguagcacauggaaagugcucaacauguauuugucacuguaaucagcuca

SEQ ID NO: 4159052 - RNA, 101 nt, Human
ugaggcaagggaaucgcuugaacccaggagguggagauugcagugagccgagaucccgccacugcacuccagccugggcgacagagugaggcuccaucuca

SEQ ID NO: 4159053 - RNA, 100 nt, Human
ugaggcagagaauugcuugaagccagggguuggagguugcagugagccaagaucgugccacugcacuccagccugggcgacagagcgagauuccgucuca

SEQ ID NO: 4159054 - RNA, 101 nt, Human
ugaggcagagucuugcucugucacccaggcuggagugcagugucgcuaucuugguucacugcaaccuccgccucccggauucaagcgauuuuccugccuca

SEQ ID NO: 4159055 - RNA, 102 nt, Human
ugaggcagaguuucacucuuguugcccaggcuggagugcaauagcgagaucucggcucacugcaaccuccaccucccagguucaagugauucuccugccuca

SEQ ID NO: 4159056 - RNA, 55 nt, Human
ugaggcaggacugagcgggaugaagguguaauuucauuccucagccccagccuca

SEQ ID NO: 4159057 - RNA, 101 nt, Human
ugaggcaggagaaucacuugaacccgggagguggagguugcagugagccgagaucucaccacugcacuccauccugggcaacagagcgagauucugucuca

SEQ ID NO: 4159058 - RNA, 104 nt, Human
ugaggcaggagaaucacuugaacccgggagguggagguugcagugagcugccgagaucgcaccacugcacuccagccugggucacagagugagacccggucuca

SEQ ID NO: 4159059 - RNA, 101 nt, Human
ugaggcaggagaaucauuugaacccaggagguagagguugcagugagcugagauugcaucgcugcaccccagccuggguaacaaaaugagacucugucuca

SEQ ID NO: 4159060 - RNA, 101 nt, Human
ugaggcaggagaaucgcucgaaccugugagguggagguugcagugagcugagaucgugucacugcacuccagccugggcaacagagugagacccugucuca

SEQ ID NO: 4159061 - RNA, 103 nt, Human
ugaggcaggagaaucgcuugaaccccagaggcggagguuugcagugagccgagaccgugucauugcacuccagccugggcaacaagagcgaaacuccgucuca

SEQ ID NO: 4159062 - RNA, 103 nt, Human
ugaggcaggagaaucgcuugaaccccggaggcagagguugcagugagcugagaucacacgccacugcacuccagccugggcaacagagcgagacuccgucuca

SEQ ID NO: 4159063 - RNA, 101 nt, Human
ugaggcaggagaaucgcuugaaccugggaggcagagguuguagugagcugagaucaugccacugcgcucuagccugggcaguagagcgagacucagucuca

SEQ ID NO: 4159064 - RNA, 102 nt, Human
ugaggcaggagaaucgcuugaauccgggaggcagagguugcagugagccaagaucaggccacugcacuccagccucggggucaagagcgaaacucugucuca

SEQ ID NO: 4159065 - RNA, 101 nt, Human
ugaggcaggagaauggcaugaacccaugagguggagguugcagugagccgagaucgugccacugcacuccagccugggugacagagcgagacuccaucuca

SEQ ID NO: 4159066 - RNA, 100 nt, Human
ugaggcaggagaauggcgugaacccggaggcggagccugcagugagccgagaucgcaccacuguacuccagccugggagacagagccagacucugucuca

SEQ ID NO: 4159067 - RNA, 105 nt, Human
ugaggcaggagaauggugugaaccugggaggcggagcuugcagugagccuagauugcaccacugcacuccagccugccugggugacagagugagacuccgucuca

SEQ ID NO: 4159068 - RNA, 101 nt, Human
ugaggcaggagaauugcuugaaaccgugagguggauguugcagugagccaggauuguaccacugcacuccagccugggcggcgaagcaagacucugucuca

SEQ ID NO: 4159069 - RNA, 100 nt, Human
ugaggcaggagaauugcuugaaccuggaaggcugaggucagugagccgagaucuugccacugcacuccagcuugggcaacaagagcaaaacuccuuuuca

SEQ ID NO: 4159070 - RNA, 100 nt, Human
ugaggcaggaggaucccuugagccugugagguugaggcuguagugagccgugauggcaucacugcacuccagccugggugacagagugagaccugucuca

SEQ ID NO: 4159071 - RNA, 59 nt, Human
ugaggcaggguuuugcccuuguuguccaggcuggaguacaauggcgagaucuuggcuca

SEQ ID NO: 4159072 - RNA, 64 nt, Human
ugaggcagguaagcaaguuuugucaucuggaaaaugaggguaauacuugccuaugccuaccuca

SEQ ID NO: 4159073 - RNA, 101 nt, Human
ugaggcaugagaauuguuugaacccgggaggcagagguuguggugagccaagauugcaccacugcacuccagccugggugacaaagcaagacucugucuca

SEQ ID NO: 4159074 - RNA, 64 nt, Human
ugaggcaugucuggccugucccaguggagacuuuaaggcccugggcccugccaggcuugccuca

SEQ ID NO: 4159075 - RNA, 56 nt, Human
ugaggccugacagaccaagccuguggugguuuagacaaagguucuuggaggucuca

SEQ ID NO: 4159076 - RNA, 101 nt, Human
ugaggcgggagaaucgcuugaacccaggaggcagagguugcaguggaccaagaucacgccacugcacuccagccugggugacagagugagacuccgucuca

SEQ ID NO: 4159077 - RNA, 59 nt, Human
ugaggcggggaaggaggggacggggaagaggucggaucacguccagccuuugggucuua

SEQ ID NO: 4159078 - RNA, 82 nt, Human
ugaggcuagaccaguucugacacaagcacaguugcccugaucuccgguggcugagugagguccagagcuuggcagggccuca

SEQ ID NO: 4159079 - RNA, 80 nt, Human
ugaggcuagcacuggccacguggagcauccugagccguuuuguggcucucaggcuguggccuaguuuguuauaugucuca

SEQ ID NO: 4159080 - RNA, 83 nt, Human
ugaggcucagaaaaguaacuugcuggaauuugaacuacauccaaaggguuuuaaaaucuaaagcaguugucuuuuuuaccuca

SEQ ID NO: 4159081 - RNA, 74 nt, Human
ugaggcuuaaagcaaugcccguucauuaucuuacaauucuguaagaaugccugguuuaucugcucgaggucuca

SEQ ID NO: 4159082 - RNA, 88 nt, Human
ugaggcuucuggcuacucaucaucagagaagggauauggcuucuugacuuugguugagucaggucccaucucagagagcugguccuua

SEQ ID NO: 4159083 - RNA, 79 nt, Human
ugaggcuugagagugccaagcauccuccgagcuguuugucaucgagccccaaggagcccuuggcaccuaguaggcguca

SEQ ID NO: 4159084 - RNA, 89 nt, Human
ugagggaccugaugugggccagcuuuucuccugggugugugacugaauccuucuucccagagcaugugcugccuuuguuaggucuguca

SEQ ID NO: 4159085 - RNA, 57 nt, Human
ugagggaggccuccaucugccaucuguguugcugagggugggugggggucccccucg

SEQ ID NO: 4159086 - RNA, 60 nt, Human
ugagggcaaaguggugcugagggcccaucuagguguugauagcauacauuuugcaucuua

SEQ ID NO: 4159087 - RNA, 87 nt, Human
ugagggcaggcugcuugauggaaggggacgcuccacaauaagaaagaacaaaggcuuugguuuguccucauccuccagucuguccca

SEQ ID NO: 4159088 - RNA, 57 nt, Human
ugccauguugucaaaauucagucuucauguuacauuacaucuuggcagcaucuggca

SEQ ID NO: 4159089 - RNA, 64 nt, Human
ugcccaaggccauaugauauaaguucucuuaccuucuacacuugugucaugguugacuuuggca

SEQ ID NO: 4159090 - RNA, 73 nt, Human
ugcccacacguccuucccacagaugcuguccagaguauuguacacugauuguagucugugguggcgguuggca

SEQ ID NO: 4159091 - RNA, 57 nt, Human
ugcccacccuagggagccugagagcaguggagcacacugcuuggcacucugggggca

SEQ ID NO: 4159092 - RNA, 62 nt, Human
ugcccaggacccuucaauggcucccacugcugucagggacaauuuauggguccuggugugca

SEQ ID NO: 4159093 - RNA, 61 nt, Human
ugcccauuugcucugugucaguggcacaaaagugccacugggcaugcagaugucccaggca

SEQ ID NO: 4159094 - RNA, 55 nt, Human
ugccccagaaguuugcacaagagacacaagagucugaaaaaugagaccuggggca

SEQ ID NO: 4159095 - RNA, 79 nt, Human
ugccccagguugccugucccaggugcacugggcccaggccagguuucuuucugggauagggggcuugaggaagagggua

SEQ ID NO: 4159096 - RNA, 70 nt, Human
ugcccgcuggcugggcuccagcuuccacuucuugaccuugaaauaggggcuggccccauccaggcuggca

SEQ ID NO: 4159097 - RNA, 63 nt, Human
ugcccucaugguacuuacuguagcugucuaugcagcuacgacugggaaccauaagagaaugca

SEQ ID NO: 4159098 - RNA, 74 nt, Human
ugcccucggcagcgcccgcuccgaugucucuggggguucgguugcuaccuagcagagcgggugcgaggcgggca

SEQ ID NO: 4159099 - RNA, 72 nt, Human
ugcccucuccuuuauuuauccaaaucuuggaaaauucacuugauucaagguucagggagaaauugagaggca

SEQ ID NO: 4159100 - RNA, 63 nt, Human
ugcccucuguugauauccacucacugacauaccacagugugugcccuuguucagcagagugca

SEQ ID NO: 4159101 - RNA, 56 nt, Human
ugcccucuuucuguacagcuccucccccucaauggugccacauuacagaaagggca

SEQ ID NO: 4159102 - RNA, 93 nt, Human
ugcccugacuuucccuacccagugccacccucugagggcugcccaucggggcgguuguuauugucgcugcacugggauuggggcagaggggcg

SEQ ID NO: 4159103 - RNA, 89 nt, Human
ugcccuggaaguuaaauaccugaaacuguauggccauggcauccuugcuugggcaagcagcauucagaagcagauuggcuuucagagca

SEQ ID NO: 4159104 - RNA, 58 nt, Human
ugcccuggaggggcuuacaguccagcagacacauggcucugugagccacuugggggca

SEQ ID NO: 4159105 - RNA, 66 nt, Human
ugcccugggacaugcagcggagugacgaccagucuagacaccuccaggcugcaaggccacagggca

SEQ ID NO: 4159106 - RNA, 56 nt, Human
ugcccugugagccugggacaguuguuuguccacuugcucaggcucuugacagagca

SEQ ID NO: 4159107 - RNA, 93 nt, Human
ugcccugugaguucuuugauauucuacugcaaauccugaccaaguguuuugccauguguaucaggccaguagaguuuaggcuuagagucugca

SEQ ID NO: 4159108 - RNA, 66 nt, Human
ugcccuguggccuugcagccuggaggugucuagacuggucgucacuccgcugcaugucccagggca

SEQ ID NO: 4159109 - RNA, 59 nt, Human
ugcccuuccaccugcugucugagcugucucgccucaugcagcccuucaggugaggggca

SEQ ID NO: 4159110 - RNA, 64 nt, Human
ugcccuucucugacauuacugucagcauugcaguacugugcugaguguaaugauggcagaggca

SEQ ID NO: 4159111 - RNA, 101 nt, Human
ugcaucaugguuuccagcuugucauauuuauaaaauguaagauuaaaacuagaugaucuuuaggacauuccagauuugacauucugugauucccucaugca

SEQ ID NO: 4159112 - RNA, 71 nt, Human
ugcaucccgagcccuccauggagccaggcaucuguuuaaaugucaugcaagggagggcuugaagggaagca

SEQ ID NO: 4159113 - RNA, 115 nt, Human
ugcaucucuuacauuuuuaaucuacaguaaaacauuuuuauuaggaaucuauguuuuuaauuaaacagaacauuuaauuaaggugcuuuuuaagugggugaaacaauuaagugca

SEQ ID NO: 4159114 - RNA, 58 nt, Human
ugcaucugagcacuacgguggagccguggacaagcugcuucacagaggacucagguca

SEQ ID NO: 4159115 - RNA, 60 nt, Human
ugcaucuguaguggaaaccuuagcagacaguaacugcucuggggcugucaaauagaugca

SEQ ID NO: 4159116 - RNA, 80 nt, Human
ugcaucuuacagaugaaguuugccuagagcuuuuaauugacuaguuagcucaaguuuucaaauauuauuuguggauugua

SEQ ID NO: 4159117 - RNA, 73 nt, Human
ugcaugaaugcaauuuacuguacauaaauuauauaccucaauaaaguugaugaaaaugaauugcaugcaugca

SEQ ID NO: 4159118 - RNA, 129 nt, Human
ugcaugagaaacgagcaaugucuguuauuuucugaaaagcugccuuccaugugaggaagugacuaauuuuucauuucacacuauaaagggcgugaaaaggcaaaacagaagaaggcuaaggguucugug

SEQ ID NO: 4159119 - RNA, 85 nt, Human
ugcaugagcuguuguuugcagggcaucgcguacuucucugugaucugagaagucuggaauuccugcagguuugcacucaaacgca

SEQ ID NO: 4159120 - RNA, 70 nt, Human
ugcaugccagguacuugguaugcauucacuucccugauucaggguacugauaccagguacuugguaugca

SEQ ID NO: 4159121 - RNA, 96 nt, Human
ugcauggagugucaggaaggggacgcagcacaggagugcuggauuuacagccagccagccccugacuguguccugcucaccccuuccccuccugca

SEQ ID NO: 4159122 - RNA, 84 nt, Human
ugcauggucuagaagggaggcugugguucuggugacauccacucggacccacagauucuucauucuaugggggugaccagagca

SEQ ID NO: 4159123 - RNA, 88 nt, Human
ugcauguaucuacuguaucugcauguaucucucugcauguaucucucuguauguaucucucugcauguaucuacuguaucugcaugua

SEQ ID NO: 4159124 - RNA, 62 nt, Human
ugcauguaugugcucacauguguauacccaugugucuaugcauaggaaugugcauauaugua

SEQ ID NO: 4159125 - RNA, 69 nt, Human
ugcauguauucuuaguuuuaaucagagcuacugacuguggggcucuuauguaaacaaagaauaaauaca

SEQ ID NO: 4159126 - RNA, 56 nt, Human
ugcauguguaugcauucauacauacacauguguguguguauguguaugcaugugua

SEQ ID NO: 4159127 - RNA, 56 nt, Human
ugcauguguauuuuguacuauugggcagaucuuauuguuuaaaaguacacacugug

SEQ ID NO: 4159128 - RNA, 76 nt, Human
ugcauguuuucuuucagauuaucucaacuuuggucuccugggaccacucguugcugacagucagaaaguaagugua

SEQ ID NO: 4159129 - RNA, 65 nt, Human
ugcauuagaaucaccuggagggacaguugaaacacagauuaccaaccuaacuccaugauuuugca

SEQ ID NO: 4159130 - RNA, 63 nt, Human
ugcauuaugcuugugcuguauauacaugugaauaaauauauauggcacaaaauguauaacgua

SEQ ID NO: 4159131 - RNA, 59 nt, Human
ugcauucauguguguuucauguauggaauaguccaucuguuuuuaacacauauaaugua

SEQ ID NO: 4159132 - RNA, 75 nt, Human
ugcauuccugacccaccaagucuguaagcauaauaaaaugauugcuuuacaaaauuugaagugguuuguuaugca

SEQ ID NO: 4159133 - RNA, 74 nt, Human
ugcauucuaguuuucaguccaccaggucacccucugccucugagagguaacccugguugaggacaagguaugca

SEQ ID NO: 4159134 - RNA, 129 nt, Human
ugcauugacuaaaggcacaguaacuaaguauuaaggguuuuuaaaccgccuuuuaggaagaugcugcugccuuccaguauguuaagauggugguucugcccaugcaguacuguaccacaaugcagugca

SEQ ID NO: 4159135 - RNA, 63 nt, Human
ugcauugcaugugugaaaugcacagaaggucuuuauguucuguuauaaaucacacugcaugua

SEQ ID NO: 4159136 - RNA, 121 nt, Human
ugcauuuaguaagcauuuguuaaaugaauggauggggucaagauacaguacugauauuuucaaguuuuugcaauguauuuccucagucauuuaucuaugcauuuauaugcucauuaaguca

SEQ ID NO: 4159137 - RNA, 110 nt, Human
ugcauuuaguagagccagaacuucagcuguaggccaaugcuuuucaauacccucuugguugaaagcauuagucuaagguagagaagacuaguuuugguaggaaugaggca

SEQ ID NO: 4159138 - RNA, 101 nt, Human
ugcauuuauaauuuuuaacaauuuuuggaagaaauucuuucuagaguagcugauuuugucuguuggaugguuuccaaaagauuuuuaagauuauaugugua

SEQ ID NO: 4159139 - RNA, 67 nt, Human
ugcauuuguuacauagguauguuugcuuuguggagauccauugagcuguauaccuaugacuggugca

SEQ ID NO: 4159140 - RNA, 74 nt, Human
ugcauuuugucagccacuuucaaaauugugaugaauugggcaauucugcaagugacugaccuucauuggaugua

SEQ ID NO: 4159141 - RNA, 66 nt, Human
ugccaacaguuccuccauccucucuuucucucucuugggauuguaaggaggggaggcauugaggca

SEQ ID NO: 4159142 - RNA, 68 nt, Human
ugccaacauauuuucaaaguaagggagugaguguuuaugagacugcccuggaaaugagagguguggcg

SEQ ID NO: 4159143 - RNA, 57 nt, Human
ugccaaggagcccuggccucucacuuccuugauacugaccaggccccgggcccugca

SEQ ID NO: 4159144 - RNA, 97 nt, Human
ugccaagucugagggauaucauuucucugagucugauaauuucuagaucaguaaacagucagggcuuacucagggaguuugaaccucauggguggca

SEQ ID NO: 4159145 - RNA, 59 nt, Human
ugccaauaaacuguaaagagggaaaaaaaggccccuguuuucuuugcaguuacagggca

SEQ ID NO: 4159146 - RNA, 82 nt, Human
ugccaaucaucuuguuacaguuuauuacaugcgugacuugauuuucuugcaugugcguuuuagagguaacaacauauuggua

SEQ ID NO: 4159147 - RNA, 60 nt, Human
ugccaaugguguaaagcucaagagcaggagaaauccaguuucagcucaagcacucaggca

SEQ ID NO: 4159148 - RNA, 63 nt, Human
ucuaaggggccaggacuaaguuaacugccuugaacuacauggaaguauccuggccccuaugga

SEQ ID NO: 4159149 - RNA, 66 nt, Human
ucuaaggugggguccugucaucugauuuucacaggacuuucaggugauucugaugcccacccuagg

SEQ ID NO: 4159150 - RNA, 91 nt, Human
ucuaaguuauugucacaccuuguaaagcaucucugucauauaacugauuguaucaguugugcauuacgauugugaugauacucuacuuaga

SEQ ID NO: 4159151 - RNA, 78 nt, Human
ucuaaugaguuauuuuaaccuacaugagaacuuuaaaggaaaaguggcuuugaagauaggaugugggucucaauuaga

SEQ ID NO: 4159152 - RNA, 89 nt, Human
ucuaaugcccaugguggcaagcaguucgcagcccgccuccuuccucagggcagguccggugugucuguuuaccucaggauccaauuaga

SEQ ID NO: 4159153 - RNA, 64 nt, Human
ucuaaugggagcugaaugacugugucguacaaucuagaggcagagcaagcagaauccaucuaga

SEQ ID NO: 4159154 - RNA, 72 nt, Human
ucuaauuaguauucaguuuauaacaccuaaggugcaaacagcagugugugggaaggcuaggaugcuguugga

SEQ ID NO: 4159155 - RNA, 66 nt, Human
ucuaauuguacaguauuugaagaauaugagguuaaauucauuauucaaauaaucuguagaaagagg

SEQ ID NO: 4159156 - RNA, 76 nt, Human
ucuaauuuugcaugucgcuagcugucaccaauugaaucccuuucaguugcaccugcaugguacuuguaagagaaga

SEQ ID NO: 4159157 - RNA, 121 nt, Human
ucuacaaauccuacuacuuaguauccugggcacauuuugacuaguguuuugaauuuagaaauaacuuuaucagcuauguauuaguccugacagcuaaaaauaguauuggaaaauuuauagg

SEQ ID NO: 4159158 - RNA, 69 nt, Human
ucuacaaucagcaggugccucagauucuuucuguauuacugaagucucugguugcuugcauggguugga

SEQ ID NO: 4159159 - RNA, 72 nt, Human
ucuacagaaguuuggaugccaucauaggguugaaaccuuauuuuggauccaccaaacacaauaauucugaga

SEQ ID NO: 4159160 - RNA, 81 nt, Human
ucuacauccccuugugguuuggaaguuugaugaggcuauggauucuaucaguuuuguucacuacuauauucacaguguaga

SEQ ID NO: 4159161 - RNA, 56 nt, Human
ucuacauuccuuuuauaauaucugucuuucaagauuguuguaaggguugaaugaga

SEQ ID NO: 4159162 - RNA, 63 nt, Human
ucuacauuuugauggguggaguagcagccacauggcuaagacacaugcguacaagauaaaaga

SEQ ID NO: 4159163 - RNA, 69 nt, Human
ucuaccacccaagaaucuugcagcuuagacucccucccggugcaguuuauagcccagauucaugguaga

SEQ ID NO: 4159164 - RNA, 56 nt, Human
ucuaccacuuugaccucucugugcagaggcuaaagguacuggucagggguggugga

SEQ ID NO: 4159165 - RNA, 56 nt, Human
ucuaccagcaacagaaggcaggggaccugagacuccuuucacuguggugcuggaga

SEQ ID NO: 4159166 - RNA, 64 nt, Human
ucuaccucugccauugucauugccacuuguccaaggagaaugagacacgugaagcagaugugga

SEQ ID NO: 4159167 - RNA, 64 nt, Human
ucuaccugguacauagaaauguuuagagagcacauuuauuaauauaucccauguacucugugga

SEQ ID NO: 4159168 - RNA, 55 nt, Human
ucuacgaagccaccauggagacgaaagagccaaucgucuacacgggcaguguaga

SEQ ID NO: 4159169 - RNA, 60 nt, Human
ucuacuaaggaauaucauaagaaguagccauaugaaacugguuacucuauucccuguaga

SEQ ID NO: 4159170 - RNA, 69 nt, Human
ucuacugcacuggugucucaucugugaugauucaaauguucuguuuucuucaugauacuguguuguaga

SEQ ID NO: 4159171 - RNA, 76 nt, Human
ucuacuguguuauuccugugcaaaauuacuucauauuacaaaguggagcaguguuuaaucagaggaauuauagaga

SEQ ID NO: 4159172 - RNA, 63 nt, Human
ucuacuucccaguacugccugccacaacuauaucccuuagaauccagaacagcugggaagaga

SEQ ID NO: 4159173 - RNA, 63 nt, Human
ucuacuucuccuucauuucccauccaaaaacauccuaaaggauaagagaugaaggggaggaga

SEQ ID NO: 4159174 - RNA, 80 nt, Human
ucuacuucugucaaagacagaaggaaauggggguagcucuacauuccuauuugccucaagucuucacuggcagaguuaga

SEQ ID NO: 4159175 - RNA, 68 nt, Human
ucuacuuucugucacaauaauugccagcacauguguguuacauggaauguuguguauaggucaguaga

SEQ ID NO: 4159176 - RNA, 76 nt, Human
ucuagaagcugagauguccaacaucaaggcaccagcgauucagugucugaugaggaccuggucucugcuucauaga

SEQ ID NO: 4159177 - RNA, 93 nt, Human
ucuagaaggugaaguaauucagccaaggucacacugcuagagagagaccuaaaucagcucuagacaucuuggcugcaauuaacacucuccuga

SEQ ID NO: 4159178 - RNA, 71 nt, Human
ucuagaaguuucagaaaucaaaaccaggguccaaaacccuguucuguuuuuaguuucuggcacugacauga

SEQ ID NO: 4159179 - RNA, 72 nt, Human
ucuagaauguuucaauuugacccaaaucuuucuuuuacuagcuaaguaaaauaagagaagggucguucuaga

SEQ ID NO: 4159180 - RNA, 77 nt, Human
ucuagacaaagcgcucugagcugaaacaugagcaugcacacauaugcaucucucucggucucaugagauaaucugga

SEQ ID NO: 4159181 - RNA, 57 nt, Human
ucuagacauuggggauacagcaaugaacgaaacacauagcaucucuacugucauaga

SEQ ID NO: 4159182 - RNA, 94 nt, Human
ucuagagagaggaagggagacaauuuaugugccagauuugucucuuacugaucugagauugguuccacaaagauugucucucuaagcuuauaga

SEQ ID NO: 4159183 - RNA, 80 nt, Human
ucuagaggcaugaccaagaaacaacccucuucugagcauuuucacggcuuuaaaggaauugaguuucuugugguuuuaga

SEQ ID NO: 4159184 - RNA, 76 nt, Human
ucuagaggcuggaaaguucaagauaaagcugcugucagauuugguuccuggugagagucugcuuuccggcuguaga

SEQ ID NO: 4159185 - RNA, 99 nt, Human
ucugaaccagccccugggcagaacucacucuuucaauugaaagaugcuuuuaguaucaguuuaguccagaggagaguugcguuauggggcuauaaaggg

SEQ ID NO: 4159186 - RNA, 78 nt, Human
ucugaacccagcugcaccacagcaucccaggucccuauucuuuacagccuguggagcucagaaguagcaguguucaga

SEQ ID NO: 4159187 - RNA, 85 nt, Human
ucugaagacaaucuaaggggaaugguuaaacacaucucauuauaggaauguuauguagcuauucucauacaugauguuuguuaga

SEQ ID NO: 4159188 - RNA, 56 nt, Human
ucugaagcuauaaggaccggugauacuauggagagagcacuggcuuuagcaucaga

SEQ ID NO: 4159189 - RNA, 72 nt, Human
ucugaaguacuaaacaucaccuucugcaguuggccucugugguuaagagagcggaagauguuuauuaccaga

SEQ ID NO: 4159190 - RNA, 74 nt, Human
ucugaagugagaacaguuuguuggagacugugcccuuaaccaguagagucucugcuaacucuguuagugucaga

SEQ ID NO: 4159191 - RNA, 81 nt, Human
ucugaauccaucaugcagaacaauggauuagcaaacacccaacgaaaaugcaaagaacauuucagacaugguggaggcaga

SEQ ID NO: 4159192 - RNA, 81 nt, Human
ucugaaugcucagggucugagcaucucuucaucauaugggacauucaucaccaugagguaucucauuuccugaaauucggg

SEQ ID NO: 4159193 - RNA, 85 nt, Human
ucugaauggcagccccuguggggcugaaagaggcuuuuccuuaaaguccaucucugccccacacaacuggcgucauccucucaga

SEQ ID NO: 4159194 - RNA, 76 nt, Human
ucugaauuuuaguuuacucaucuauaaaauggagauaauacucacauuuaaagguuguggguaaaagaaaaugaga

SEQ ID NO: 4159195 - RNA, 88 nt, Human
ucugaauuuuauuagaguauaugacuuucuuuugcagacacuacuaguagguauuuugcaaagucuugucuuugaggcugauucuaga

SEQ ID NO: 4159196 - RNA, 90 nt, Human
ucugacacacaggucuuccucaggcauuagcuggacuugcuccuuccugcccgucuagcucaaugagccugauuuccucaguguaucgga

SEQ ID NO: 4159197 - RNA, 78 nt, Human
ucugacagcagccccaccuugagagcagaaacagaagaguucuguucugugugcugggagggagucacacugugcaga

SEQ ID NO: 4159198 - RNA, 55 nt, Human
ucugacaguuauauaagcaccagagcuaggcauggucugacuuguagcugugaga

SEQ ID NO: 4159199 - RNA, 79 nt, Human
ucugacauagccuacugaaagaauacauaauuuccccuaagaaaagaggagggacuuagccuuuuagcuguaauccaga

SEQ ID NO: 4159200 - RNA, 78 nt, Human
ucugaccccagggaagggcuaccugaggcugaggggguguugaggggaggccucauguggccccucccugcggacaga

SEQ ID NO: 4159201 - RNA, 79 nt, Human
ucugaccugcaaauucagaagaacugcccuggcaacugucauuccagggcuuucugaaguuguaaacacacauggcaga

SEQ ID NO: 4159202 - RNA, 129 nt, Human
ucugacuuuauuaagauugagcauaaaaagcaagaggcuggauuaaaaaccaccauuaaaauacccaagugaauuuaauucaguauuuauggaacugaguauguuuuacucuaauaaggaacagcuuaa

SEQ ID NO: 4159203 - RNA, 58 nt, Human
ucugagaauaaaaauugcauuucuuggaagucucugagauugcuguuauguucccagg

SEQ ID NO: 4159204 - RNA, 130 nt, Human
ucugagagccuacguuuuauauacauuuauguaguuacggacuaucaauccuucaauuaacugcuccacugcccuaagcaauuguuagucagacacaccuaaauguacauuaaaagggauugcucuuagg

SEQ ID NO: 4159205 - RNA, 97 nt, Human
ucugagcuguaacauuuggcagguuuccuugcuaacauuuggcaauaauuguuuaucaaaugcuaacaaggaaugcugccaaauguaacagcuccga

SEQ ID NO: 4159206 - RNA, 62 nt, Human
ucugaggaggcagcgugcugagaaguguucgaggugaacauucagggcagcugcucuucaga

SEQ ID NO: 4159207 - RNA, 78 nt, Human
ucugaggaguacagagggcuggugccuuggggaaaccagaagccagcuggcccaagggcaucaaguucuacuucugga

SEQ ID NO: 4159208 - RNA, 65 nt, Human
ucugaggagugacccucuugcaccuacauucuagagcauuuagauuugccagagauacucccaga

SEQ ID NO: 4159209 - RNA, 85 nt, Human
ucugaggauauuguuacaaugcagaucuugguucacauggcaggaauuggggccuaagauucuguauuucuaacaauucccaaga

SEQ ID NO: 4159210 - RNA, 55 nt, Human
ucugaggcuaagagacagaggccuggaagaaggcucuguggucucuguucucagg

SEQ ID NO: 4159211 - RNA, 130 nt, Human
ucugaggcuccauggcuuagccaugcaacuugggcaguggcugggccucucugagguuugugguucucaucagcagaacagggagccggccaugcugaccgcugccuuugggcugagcuuggaccgcagg

SEQ ID NO: 4159212 - RNA, 57 nt, Human
ucugaggcugucaggagaaucugccccgggcucccccugacuccuggcagccucagg

SEQ ID NO: 4159213 - RNA, 63 nt, Human
ucugagggcuguacuaugcacggaagaaucagaaaugaguauaguauuuuucuggcccuccga

SEQ ID NO: 4159214 - RNA, 57 nt, Human
ucugagggguuaucaagugaaaguggaauuagauuuguucuucaugauccugucaga

SEQ ID NO: 4159215 - RNA, 55 nt, Human
ucugagguuuucauguuuucugugacagcacaagagauccauggaagcucugggg

SEQ ID NO: 4159216 - RNA, 67 nt, Human
ucugagugguaguacaggagauaccggggaggguucccuggcuuuuguugguaccaccuuauccaga

SEQ ID NO: 4159217 - RNA, 96 nt, Human
ucugaguuuacaagugcuguuuccuugagaaaguacaaggcuguauuuuucuucacauauagcugcauuucagugaaauauuucuuggccuucaga

SEQ ID NO: 4159218 - RNA, 84 nt, Human
ucugauaagaucuuaucccauccuacuugaaaggugaugcacaauuuacuugugagguagguggugaaaaaugacucuaucaga

SEQ ID NO: 4159219 - RNA, 75 nt, Human
ucugauaggugguagaaggaggccccuagugaucuuuaaaauccuuuuaagcuccucuccuucacugccuucaga

SEQ ID NO: 4159220 - RNA, 61 nt, Human
ucugaucucacuguuuauguugcuuuccaaagauguauguugcauaauacaguggaucuga

SEQ ID NO: 4159221 - RNA, 78 nt, Human
ucugaugauucuuugaccaaaaaauugagacauuugggaaaugaugaagugcacauuguuuggucagagcauacuaga

SEQ ID NO: 4159222 - RNA, 73 nt, Human
ucugaugcaugcauguuuuuacccacagucguccaucaccagggauuuuuguguuugaggcauguugcagaga

SEQ ID NO: 4159223 - RNA, 58 nt, Human
ucugauguucuuggagauaaauucuuacagauuucuuuuguaaucuagucacaucaga

SEQ ID NO: 4159224 - RNA, 61 nt, Human
ucugauguuuuauggaacaaaccaagauaaacugcauguugaaauccaugagacaugaaga

SEQ ID NO: 4159225 - RNA, 74 nt, Human
ucugauucuauaggauuguauaccuuugauugccuuugauuaacuaggcugucuuacaguucuguagaaguaga

SEQ ID NO: 4159226 - RNA, 66 nt, Human
ucugauucuugccuugacaugggaaguaggugagccuuuuccuuuccaggcagagcagggauuaga

SEQ ID NO: 4159227 - RNA, 78 nt, Human
ucugauuuauucuccacaguaaucacacaagguagucauuucuugcuccauuuuacagguggagaaguaaggcucaga

SEQ ID NO: 4159228 - RNA, 78 nt, Human
ucugcaaaaguggguuuugggacagccaagcucugagccccuuccagaguuuguaaccuaagauucagguuuugcugg

SEQ ID NO: 4159229 - RNA, 64 nt, Human
ucugcaaacccccaucuaucauucaugcacagccuuugcgugccuuugaauagggguuugcaga

SEQ ID NO: 4159230 - RNA, 66 nt, Human
ucugcaaacuuaaguugaaauagcuugugaccaaccccaaaugauuuugcuaucagcuuuugcaga

SEQ ID NO: 4159231 - RNA, 89 nt, Human
ucugcaaagcuuaacucuacacugcacuuuauuucccaaacuaaagggagggccuggaaugcagugggagcuuaccaaauauuuguuga

SEQ ID NO: 4159232 - RNA, 62 nt, Human
ucugcaacagugcccuguaaauuaacacuuuaguuucuuuaugggagauguaucugugcaga

SEQ ID NO: 4159233 - RNA, 61 nt, Human
ucugcaagcucaguucugacuuacuccugcauugcaccuucagucacauugagcuuuugga

SEQ ID NO: 4159234 - RNA, 107 nt, Human
ucugcaauuucacuuccaugagcuuccugaagaugaaaagagagguuuccccaccaguucagaaauucucugaagucuuucagggcacucaucaccaguguggcaga

SEQ ID NO: 4159235 - RNA, 102 nt, Human
ucugcacaccaggcguggcccuccuguagcacugacaccauaugugucauuacauguggaaagucaaguuccaggauggauuguaagggcagggagugcaga

SEQ ID NO: 4159236 - RNA, 60 nt, Human
ucugcacccacguaccuuggcugaaccacagcggggcaagugauaaggggugggugcaga

SEQ ID NO: 4159237 - RNA, 58 nt, Human
ucugcacccugaccucuguuucuguguuuauaaagggaacaaaaggcaagggugagga

SEQ ID NO: 4159238 - RNA, 66 nt, Human
ucugcaccucugaaauuggucagcacccugaaacuguccugcuggaccaacugcacaggucacaga

SEQ ID NO: 4159239 - RNA, 60 nt, Human
ucugcagaaggaaucagcugaguuuggagacuauuuugauauccugauucccucuuaaga

SEQ ID NO: 4159240 - RNA, 78 nt, Human
ucugcagagcugaacaguuuacuuagccaaugaggauauaaauauuugcauaucugauagacuaaugccagcucuaga

SEQ ID NO: 4159241 - RNA, 62 nt, Human
ucugcagcugccugcaacacaagcuuggaccacccaggccgaaguggaugggcaucuggaga

SEQ ID NO: 4159242 - RNA, 58 nt, Human
ucugcagggaaguuguaauguaauguuagaguagugacaucuaauuauuucccugaga

SEQ ID NO: 4159243 - RNA, 77 nt, Human
ucugcagggagggcuuuccaggcaugccacuggucucacccaggggaaaagcccauggaaaaccuguccucugcaga

SEQ ID NO: 4159244 - RNA, 92 nt, Human
ugcucaagaugaagucaugugccacaugcuuuucccacaauuauaggaaagucuuucucuaaaaaagucuguucacuugguauuuuggugca

SEQ ID NO: 4159245 - RNA, 67 nt, Human
ugcucacuagaagauucagcaguagggugggaugcucuucuucuccugcccuuggacuuccagagca

SEQ ID NO: 4159246 - RNA, 59 nt, Human
ugcucagcuagggaagguuagcuugcuaaaugacugucaaggggccucuccuauuggca

SEQ ID NO: 4159247 - RNA, 84 nt, Human
ugcucaggaaagucacuugucucuuguaccagaccauaagggguuuacauggccugggagagggauagugcagauccuguugua

SEQ ID NO: 4159248 - RNA, 92 nt, Human
ugcucagggacucucugggggaaacaaggcagggcuguacucaaauuggaguuuuccuugggcuccugccgucuuuucugagucccugugca

SEQ ID NO: 4159249 - RNA, 90 nt, Human
ugcucauucgcucauacacucuuugccacuccgugccuggcucccccuuggcaggugugagaucgaggccaguagugugagccaagcgca

SEQ ID NO: 4159250 - RNA, 55 nt, Human
ugcucauuuauguagguauugcuuuuguuucucacugcaguggcauaguugagua

SEQ ID NO: 4159251 - RNA, 56 nt, Human
ugcuccaggaaaauagggaaugagagaaacagcuuuuuuucauuguuccuggagca

SEQ ID NO: 4159252 - RNA, 114 nt, Human
ugcuccagggucauuuggagugaugguugccugguauuugaauaaagagcuccccuaucagaacauucagguucaaaucuuagugccucuguuccuacuguaugaccuugggca

SEQ ID NO: 4159253 - RNA, 84 nt, Human
ugcuccaguggcuucuucuugggagcugcauucuaugacuuuccuggacugcaugcuucccaagggcggggaccacgucaguca

SEQ ID NO: 4159254 - RNA, 60 nt, Human
ugcucccauaugaaugauuguuccguacaucauaugugucaaaccauucaucugguggca

SEQ ID NO: 4159255 - RNA, 69 nt, Human
ugcucccaucaggaacuuggccugcacuaaccucccaggggagguaauaggucccagguuugggcagca

SEQ ID NO: 4159256 - RNA, 58 nt, Human
ugcuccguucuucugcuucuuguagcuauagagccccacagcaggcagaacgugggca

SEQ ID NO: 4159257 - RNA, 56 nt, Human
ugcuccguuuuugaccggcacugaugccacaucacauagcugaguaaaauggagua

SEQ ID NO: 4159258 - RNA, 78 nt, Human
ugcuccucauuuaccucagagggauguuacaggcauucauuuugaaagccuauaaagcuuuuugagcaaggaggagua

SEQ ID NO: 4159259 - RNA, 74 nt, Human
uggaauucccaaguaacuuuuaaaauguaaaauaggugcccuuuaguuuaaugugcaaagguuagggaguucca

SEQ ID NO: 4159260 - RNA, 87 nt, Human
uggaauucuaguacaagucugaaggucugagaaccaggagagccaaugguguaguuccugucuaaagaccugcaggcuugagaccca

SEQ ID NO: 4159261 - RNA, 69 nt, Human
uggaauuggaaucagaugcugauguuccauuaaaaaucaaugcaucaaaguugauauccaauuaugcca

SEQ ID NO: 4159262 - RNA, 75 nt, Human
uggaauuuggcacugggagcugaggcugacgcugcauugcuaaggagugacagggccagcgcccaggcccagcca

SEQ ID NO: 4159263 - RNA, 65 nt, Human
uggacaaaggucuggggaaccugcagaaccgcucugggcugguguucaaacagacuuugugucca

SEQ ID NO: 4159264 - RNA, 101 nt, Human
uggacacuuuuauuuauucauucauccaacacguauuugcuggccgccugcuaugugccagucucugaguuaggacauugcagugaaaaaucaaaguucca

SEQ ID NO: 4159265 - RNA, 70 nt, Human
uggacagcaucccauucacagucacccuucuccauggaguggccauuggaaggugcacugugacagucca

SEQ ID NO: 4159266 - RNA, 73 nt, Human
uggacagggcagccaggccccgugggaagguggcuggagacugggcccaugggcauccugguggcccuguuua

SEQ ID NO: 4159267 - RNA, 65 nt, Human
uggacauaguuagcuaccacacagaaagagcucacccucuaccugugucuaugcagccauaucca

SEQ ID NO: 4159268 - RNA, 56 nt, Human
uggacaugucuucuccaagaaauagguuaaaacuauugcugaagacaaaaugucca

SEQ ID NO: 4159269 - RNA, 129 nt, Human
uggacauguguuuucauuucuuuuggauguauuccuagcauugcaguugcugggucauauguaaauauguaacuuuacauuuaaccuuugaggaacugccagaguauuuccaauggcugcaccagucua

SEQ ID NO: 4159270 - RNA, 85 nt, Human
uggacauguuucuguugaguauauaccuacaaguagaauugcuguuguaagguagggauguauucagcuuuagaagacacuuuca

SEQ ID NO: 4159271 - RNA, 130 nt, Human
uggacccaacacaaaugguucccaguuuuucaugugcccugccaagacucagugguuggauggcaagcauguggucuuuggcauggugaaggcaugaauaucauggaggccauggaacacuuugggucca

SEQ ID NO: 4159272 - RNA, 62 nt, Human
uggacccagaggugcucuuuggaaguggaaggcucuucuccgcuaaguucucugcagguuca

SEQ ID NO: 4159273 - RNA, 68 nt, Human
uggaccugauugcuuuugagcuagaauuuugcccuaggcaguguucuuguuucuaagcaaaugcgcca

SEQ ID NO: 4159274 - RNA, 74 nt, Human
uggaccugguuuggaggacuaguuaagagaccuuuuggaggucucugcagcucccggccccuuauuggagucca

SEQ ID NO: 4159275 - RNA, 58 nt, Human
uggacuagaagggcaagagucccugaagcaaauucaaacuguuggcuuuucugggcca

SEQ ID NO: 4159276 - RNA, 87 nt, Human
uggacuagugugguaguaggaauucauaucaaaauuagacuuugugacugaaaguguaaacaaaugcauucuugcuaagacuagcca

SEQ ID NO: 4159277 - RNA, 74 nt, Human
uggacuccagauggauuuaagaccuaacuaugaaaaguguauuucuacaauugugucuggaaugcguggagcca

SEQ ID NO: 4159278 - RNA, 103 nt, Human
uggacucugaucucauacucuugccuuauagugcucugcauuggcagaacucagcugaaaugcagaaagcaggugagcccaaugaugcagaggucagaguuca

SEQ ID NO: 4159279 - RNA, 72 nt, Human
uggacuguuacaagagagagacaugaucuuccuuaaggcauugauuugucaugagucucuuuguuauagcca

SEQ ID NO: 4159280 - RNA, 109 nt, Human
uggacuuaccucuuuugcaguuaucuuccuauuauuagauaaucuacuugguaaaauugcaugguacaagaggauuauuaauaaauaaucauuaaaaauggcuaguuca

SEQ ID NO: 4159281 - RNA, 90 nt, Human
uggacuuccgagcucauacucuucaccucuagcuugucccaugagaugguuucagucucagaggugggaguggggcuugggaaaauucca

SEQ ID NO: 4159282 - RNA, 117 nt, Human
uggacuugggcacauuauugagucucugagccuccauuucauaguugucacaauaaggagaaacauccuuaagucaugcuguaaaugugaaaggagaugugauauguaaaaggucua

SEQ ID NO: 4159283 - RNA, 68 nt, Human
uggacuuuguugagaaauuuuccuaggaucuuccucagucgaaccaggaagcuuggcaauaagguuug

SEQ ID NO: 4159284 - RNA, 63 nt, Human
uggagaaacucucucagacacccauuuggaaaugcauuaguguuuuucucagugaguccucca

SEQ ID NO: 4159285 - RNA, 67 nt, Human
uggagaacagggcugaguaacaggaauaacacucaggugguugucugaacuccagcccugcucucca

SEQ ID NO: 4159286 - RNA, 83 nt, Human
uggagaagaaggucuaccagggaucuaggagggcaugcaacauaugccaggcauuauuccgaucccuguguauugguucucca

SEQ ID NO: 4159287 - RNA, 87 nt, Human
uggagaagacaagacuggaaugauugaaaaggaaugauuggugcuuuaacuuacauugagccaucacagucauuuauugucucuuca

SEQ ID NO: 4159288 - RNA, 99 nt, Human
uggagaagccagaaauugagugcagccagcccagugccagaacccacccuccucaccucugcacugugcugccuccaccaacagggcucgguuucucca

SEQ ID NO: 4159289 - RNA, 68 nt, Human
uggagaauguaggaaauacuuuucuguuacuguaaugcugaaggccauccugcauccugaccucucca

SEQ ID NO: 4159290 - RNA, 68 nt, Human
uggagacaggcgguccagcccgccagccuggaauugcucuuaggccagggccagauuagccaccucca

SEQ ID NO: 4159291 - RNA, 65 nt, Human
uggagacaggucugugaaccggagguuaguagaugggcucuccagguaugacauggcuguuucca

SEQ ID NO: 4159292 - RNA, 70 nt, Human
uggagaccuggaagggucagagugaugaggcugaggccagcucacaacucaggcucuuucugcugcucca

SEQ ID NO: 4159293 - RNA, 63 nt, Human
uggagagagucgggauaguacaaagcggguuaccccuagcucacaccuucccugcucccucua

SEQ ID NO: 4159294 - RNA, 68 nt, Human
uggagagauaaagagaaacaugggacugaaggacugucuuguaccuuccagccccaucucaucgucca

SEQ ID NO: 4159295 - RNA, 66 nt, Human
uggagagcucuggcuuuaaggaugccacaggcggaaacugacaaagguguugccagagggauucca

SEQ ID NO: 4159296 - RNA, 62 nt, Human
uggagaguuuagccuacuggaaaaugaaaccggaaaaguagguggggugggcugagcuucca

SEQ ID NO: 4159297 - RNA, 57 nt, Human
uggagauaauaauaguaccuaucucaucagauguagguuuuucuguuauuauguuca

SEQ ID NO: 4159298 - RNA, 65 nt, Human
uggagauagguguacauccaugaaaccaucaucacaaucuauggaggaggaacuucuuaucucca

SEQ ID NO: 4159299 - RNA, 57 nt, Human
uggagaugccuggagauuagggacugggucauguagcaucagauaacagguacucca

SEQ ID NO: 4159300 - RNA, 68 nt, Human
uggagcacagccaaaguaagaaggacaaucagggcucuaaagcauggccucauuaucacuguguucua

SEQ ID NO: 4159301 - RNA, 130 nt, Human
uggagcagaggaugcugguacaaggggaaucugguuugagagugugagcuuuuccagggggauaaaggcaacagcuucuuguauaaugagauugacuuuuaaauugaaagugcuagugcuugugcugcgg

SEQ ID NO: 4159302 - RNA, 119 nt, Human
uggagcagggacugagggcgagcauggggccaggugcuguccugcacaugucuacgggggagaggcuggaccacccaggauggcucuugguugcuugaaauccuuaaguucuaguucca

SEQ ID NO: 4159303 - RNA, 62 nt, Human
ucugggacaggggagcagaggggauggguuaccccucagaucucugcagcccugcuuccagg

SEQ ID NO: 4159304 - RNA, 59 nt, Human
ucugggagccugaaagugaauggaagaaaggcagcuucuccucaccuucauuuuccagg

SEQ ID NO: 4159305 - RNA, 85 nt, Human
ucugggagguagaagguggaggcagaugagcagcuguguuuauuuuaaaacauaucauuuaacccucaccuaaaaacaaauugga

SEQ ID NO: 4159306 - RNA, 105 nt, Human
ucugggcagguuaauaugauguguuuccucugcacagucucguggagcuguacagagguguacauaugauaaauauaaguaaaaaauugacagcugagacccaga

SEQ ID NO: 4159307 - RNA, 74 nt, Human
ucugggcaguaccccucuccuauuaucaaagugguggcuaagacauuaaagugagagaagagguaaagucuagg

SEQ ID NO: 4159308 - RNA, 58 nt, Human
ucugggcugggagcguguggacuggauuuauuuguccaaugccacaccccaccccaga

SEQ ID NO: 4159309 - RNA, 69 nt, Human
ucugggcuuugccuccuguguuuggccuuugucaauaccaguggaacaaacagaagaggcggaaccagg

SEQ ID NO: 4159310 - RNA, 57 nt, Human
ucuggggcagcugauguccucugcuuauucuaggcagggcacagacagugccaagga

SEQ ID NO: 4159311 - RNA, 66 nt, Human
ucuggggcucuuucuacucugccacaugccuuuaaguaggcuuauagaguggcaaaguguccaaga

SEQ ID NO: 4159312 - RNA, 129 nt, Human
ucuggggcugguggacgguguuccucucccagugcugcucucuguaagagagaacucuuagauucaauccuuuccuccagagggcccauucgcaagggaacaaaaggucccugccaacuuucccauaga

SEQ ID NO: 4159313 - RNA, 63 nt, Human
ucugggggcuuagcuuaagggaagggagagcacucugcuuauucacauuaauaagucuucaga

SEQ ID NO: 4159314 - RNA, 95 nt, Human
ucugggguaaggacugugagccgaguauaguucauaggcaggcaaaggccuuguaguguuaugaucuauacugguuuuuguccagcauucccgga

SEQ ID NO: 4159315 - RNA, 69 nt, Human
ucugggguauaugagcucuauguaauggcuugucugaucaugcaaggaaccaagcucuaagcccucaga

SEQ ID NO: 4159316 - RNA, 74 nt, Human
ucuggggugauucaguugcugguguuggcugugaaacaguacgguaugcuucagagaacuugaucgcugccagg

SEQ ID NO: 4159317 - RNA, 61 nt, Human
ucugggucucaggaguucugagggguuucccugaccucucuugagcaauccaggcgccaga

SEQ ID NO: 4159318 - RNA, 56 nt, Human
ucugggugaugaaaugcacugucuggagucaguccauucauuuuuuuucaccuaga

SEQ ID NO: 4159319 - RNA, 56 nt, Human
ucugggugucacuccugccugcccugccugcugggugacguagagcacaucccaga

SEQ ID NO: 4159320 - RNA, 63 nt, Human
ucuggguguggaugcuaugagauuaucaacuauuuauuaaucuuucauucauucauacauaga

SEQ ID NO: 4159321 - RNA, 70 nt, Human
ucugguaaaauccugaaccagagaaagaagcuccuaugccugccaaggaguucucuggcuccuuuccaga

SEQ ID NO: 4159322 - RNA, 66 nt, Human
ucugguaacuucucugauucugugccucuuagauuugugaggucagcaugaguagaagguaaaaga

SEQ ID NO: 4159323 - RNA, 100 nt, Human
ucugguauuacuuaacugaguuaguauguucuguaaguauaacuugggucaacacuguaccuacagagacaucacugaagugggaaaguugaagcacaga

SEQ ID NO: 4159324 - RNA, 55 nt, Human
ucugguccaucuuguuagcuguccacucccuuuccagcaaacaggcuccaccaga

SEQ ID NO: 4159325 - RNA, 97 nt, Human
ucuggugaaugcauuugugcaguuaaucuuucccuauuaaauguggcauauguaguagcaaaaauaaggagagaauguuggucaaauguuuucugga

SEQ ID NO: 4159326 - RNA, 80 nt, Human
ucuggugaccaguaaaauggacuguggcagagaugggcuagaugcccacuaauuccaucuccuuuuccuggccacauaga

SEQ ID NO: 4159327 - RNA, 74 nt, Human
ucuggugcaguucuaagaaaaucagguuauucaucucauucaaagaauccuggguuaauuaugauucaccauga

SEQ ID NO: 4159328 - RNA, 62 nt, Human
ucugguggguuguaucuuuuaggccuuaaacacagauaguuugaaaguaucaacucgccuga

SEQ ID NO: 4159329 - RNA, 55 nt, Human
ucugguuaucaccugagagcuuguuagaaaugcagaaucucagggcauacccaga

SEQ ID NO: 4159330 - RNA, 123 nt, Human
ucugguuauuuaguuauuucauccaaugcauuauacucuacuuuguacucuguauauucuggucuaacuccagauuguacacaguagaguauaaugcguuggaugaaauaacuaaaauacaga

SEQ ID NO: 4159331 - RNA, 90 nt, Human
ucugguucuaacuuacaccaggaaguauucaaaggguccagcagaugucaguaugaauucuugagucucuccugguuaaguauuaacaga

SEQ ID NO: 4159332 - RNA, 66 nt, Human
ugcuugauuaagccuuguuugcaaaaucaaauaucuacagaugugggcaagaaacacaaucaagua

SEQ ID NO: 4159333 - RNA, 83 nt, Human
ugcuugauuucuguugucuccucucagauuauucuaggcauccaggagauaaaacaggcaggaaagcagcagacaucacagca

SEQ ID NO: 4159334 - RNA, 62 nt, Human
ugcuugcuuuguaaguugugauguucaguaaugacuaaguacauucauuugcacagccagua

SEQ ID NO: 4159335 - RNA, 80 nt, Human
ugcuuggaaaacauugcuucucguuuguaaguguaggugcauacaugacaaaucagaggggcuuggaaugaaauaaagca

SEQ ID NO: 4159336 - RNA, 80 nt, Human
ugcuuggauacuucucugacagugaaagaguucaagauaacccuuugaagcucaaauuugugagauaaauguucuuagca

SEQ ID NO: 4159337 - RNA, 59 nt, Human
ugcuugguaaaucuucacuaagacugaguaguaaauuugcucugaagaauuagagagca

SEQ ID NO: 4159338 - RNA, 57 nt, Human
ugcuuguauucauaucacagcucgcuugaguaagugguaacgacagaauaauaagca

SEQ ID NO: 4159339 - RNA, 67 nt, Human
ugcuuguauuguuauuugcagaggugguacuucaaguccaccccugggaaugucaauaucaugggca

SEQ ID NO: 4159340 - RNA, 77 nt, Human
ugcuuguuuauugcuaauuguuuucccaaccagagaauuagaaagggaaaacaugaauagauauuaaacaaauagca

SEQ ID NO: 4159341 - RNA, 60 nt, Human
ugcuuucaggacaagguuuaaacuccuuaaauggugggauuauaaaccuuucuuguggca

SEQ ID NO: 4159342 - RNA, 73 nt, Human
ugcuuucaggauugagcaaauggauuauauacacaacuuggauuaucuauccuuacucauccugcacgaagua

SEQ ID NO: 4159343 - RNA, 55 nt, Human
ugcuuucagucucggccucacucagcuccucuguggggcccugggauucagagca

SEQ ID NO: 4159344 - RNA, 58 nt, Human
ugcuuucauuugauaagaaugccauauagcucacuuggcagcuguguaagagaaagca

SEQ ID NO: 4159345 - RNA, 72 nt, Human
ugcuuucauuugguucaugaacagaaaguuaggguuucccuggcuucacaauuucauaacuaaacaaaagca

SEQ ID NO: 4159346 - RNA, 59 nt, Human
ugcuuuccugggccaaaagaaguguucuuugcucaaaggaacugaggccuagggaggua

SEQ ID NO: 4159347 - RNA, 66 nt, Human
ugcuuucuaagcaugaaauaauguccuuguucucaugggaguaacacauguuuaugcuugggggca

SEQ ID NO: 4159348 - RNA, 130 nt, Human
ugcuuucuccuggccuucauggccuaugaccguuaccuggccaucugcagcccacuccgcuaccccuuccucaugcaucgugggcucugugccagguuggugguggucuccuggugcacaggggucagca

SEQ ID NO: 4159349 - RNA, 61 nt, Human
ugcuuugcuuuggagagccagcagucauaagcucacccuggaagagcucuaaagcagccca

SEQ ID NO: 4159350 - RNA, 60 nt, Human
ugcuuuggcccaacauugaugccugucccagaaauacaggaucaagugucuugccaggca

SEQ ID NO: 4159351 - RNA, 66 nt, Human
ugcuuuucuguuuaugaaauuguguuacagacugcgaguaacauagcuuaaaugagaagauaagua

SEQ ID NO: 4159352 - RNA, 55 nt, Human
ugcuuuugcacaggugaguuccuggacccccuccaggcccacuugaccagaggca

SEQ ID NO: 4159353 - RNA, 60 nt, Human
ugcuuuuggaaauccuggaauuggucugagccuagagcuggcacuagcguuuccaaggca

SEQ ID NO: 4159354 - RNA, 85 nt, Human
ugcuuuugucaucuuugguuuucuauaugccacgaggaguucaggcauguagcaaaccaaaggcaacaagaauuuucuuacagca

SEQ ID NO: 4159355 - RNA, 85 nt, Human
ugcuuuuuaacauuauuugggguauuuuuggcaugaguuacaauucauaugccagcuccaaguaagaguuaagaaacuuucugca

SEQ ID NO: 4159356 - RNA, 83 nt, Human
ugcuuuuucucagucacauugcccugcauuuaagugucucaaauacaguauuaauucccugcaagguaaguacuaagaaggca

SEQ ID NO: 4159357 - RNA, 72 nt, Human
ugcuuuuugugcucugccuggggucauggcagggaaggcccagcaggcucccuugcagagcagggcagagca

SEQ ID NO: 4159358 - RNA, 68 nt, Human
uggaaaaggugguucuaucuggguucuuucuccaaaucugggcagagacugauggagcucacucucca

SEQ ID NO: 4159359 - RNA, 106 nt, Human
uggaaaauaaauugauuuaauuaagugccugaauacuaaucugaauuucaauucauucaacaaauauugauugagaauaugauuuaguauaaggcacuauuggcca

SEQ ID NO: 4159360 - RNA, 126 nt, Human
uggaaaauacaaaggaucugaagcuaaacacacuagagugugaauugauuugacugcuuaauaguuugucaauuacagugucaccuuaagucucagguuucuguuuuugauuuguguuguuuucua

SEQ ID NO: 4159361 - RNA, 83 nt, Human
uggaaacgucugcuacaaguagcugccuagcauggcuuuccuucuugggagaagccagcuucagcugcccgugggcgugugcg

SEQ ID NO: 4159362 - RNA, 78 nt, Human
ugcacagaacuagggaaacggcacauagauuccaaauggaaacaggagaacuguguuuguuucuaggucucugugaca

SEQ ID NO: 4159363 - RNA, 80 nt, Human
ugcacagacuguggcagcuggggcauuugggagccucugcagcucagcagcuccccucaugcuccaccccgcaccuggca

SEQ ID NO: 4159364 - RNA, 78 nt, Human
ugcacagaugacaggaauaacuaugauggucuuaggcacaacaggauguaugguuccccuugucagauacccugagca

SEQ ID NO: 4159365 - RNA, 57 nt, Human
ugcacagguaugcaaagcaugugcaaauucuuucaguuguacacuuugauuugugca

SEQ ID NO: 4159366 - RNA, 59 nt, Human
ugcacagguaugcccuuuagaacauaaaaucuucugaagauuuuugguaaucaugugua

SEQ ID NO: 4159367 - RNA, 72 nt, Human
ugcacagugaggauccggucagcuguauaggaguuaacauccuggggugcuggcugagaccaucagggugua

SEQ ID NO: 4159368 - RNA, 72 nt, Human
ugcacauaucaguugccuguacaauccugauaaaagggcuugcuuucuaccacagagcauaaugguguggca

SEQ ID NO: 4159369 - RNA, 59 nt, Human
ugcacaugcucuccgggcacacacccagccugucugccacugcccagaguguaugcgca

SEQ ID NO: 4159370 - RNA, 87 nt, Human
ugcacauucaaaguacaacuuuucuaucauguggaagcuugaagaacauuuuuuaugugaagaggauuuaucauacucugaaaugca

SEQ ID NO: 4159371 - RNA, 66 nt, Human
ugcacauucacuuagguauugucuauagcugcuuugucacaacaaugccagaguugaguaguugca

SEQ ID NO: 4159372 - RNA, 63 nt, Human
ugcacccauguguaugagugugcuucuuuuaaaggaauaggagcuuuuauacaauguggugca

SEQ ID NO: 4159373 - RNA, 78 nt, Human
ugcaccugcuggggcugaugagaugaacccaucuggcauauucugguucacaauucuucccagugccaugcuguagca

SEQ ID NO: 4159374 - RNA, 97 nt, Human
ugcacgacacaacgcccaccacugcuuccugccaucugucccgagugauggaaauagagccagugacagcaagcagugcugggugggccagucugca

SEQ ID NO: 4159375 - RNA, 129 nt, Human
ugcacgauccugcuucccagcuggccccccugcuggccccacuccugggugcauuucugauucuguucugagucuccagccugcccagagugggcaccaguagagcugaugggaagcgaggcauuugca

SEQ ID NO: 4159376 - RNA, 55 nt, Human
ugcacuauuucgccaugguuguuucacuucaggaucacagugguaaaaugaugca

SEQ ID NO: 4159377 - RNA, 71 nt, Human
ugcacucauuuuuucacuguguugucagccauggacaacauuugaguaaagaaauggucauggucagugca

SEQ ID NO: 4159378 - RNA, 61 nt, Human
ugcacuccagcaccuucccgcagcccaccgccuccucgggccagaagggagcuggaaugca

SEQ ID NO: 4159379 - RNA, 55 nt, Human
ugcacucugugucuuaaagcaccucaugaaaauguaugcugacacuagaugugca

SEQ ID NO: 4159380 - RNA, 62 nt, Human
ugcacugcagugacucguuuauguucuuuacaccuaaggaggacagcauucuacuguaggca

SEQ ID NO: 4159381 - RNA, 58 nt, Human
ugcacugcccaggaacugugcuguggagucuggccacguucccuuauuggggcaggca

SEQ ID NO: 4159382 - RNA, 81 nt, Human
ugcagaaaaaaccagacaggugcucgcccaaguccagcaaaacucugugugaccuugggcaaguuccuucucuuuucugua

SEQ ID NO: 4159383 - RNA, 67 nt, Human
ugcagaaaaggaagagcuauguaaccauuagccaugugcuuacaaggggcuauuucugcuucugaca

SEQ ID NO: 4159384 - RNA, 60 nt, Human
ugcagaaacaagccaucauucaucggacaaagucacgugcuaauuggacuugauucugca

SEQ ID NO: 4159385 - RNA, 60 nt, Human
ugcagaacgggucuucuagcaccuuccagguuuucguuaugaagcacuucuuaggcugca

SEQ ID NO: 4159386 - RNA, 67 nt, Human
ugcagacuuuacugaacugcuaguacaggagucgcuauguuuuuagcuagcccauucaguuuuugua

SEQ ID NO: 4159387 - RNA, 75 nt, Human
ugcagagagcugcacaguuaauaugugacagaacuagucaaaccuaguucucaagacaauuaccuguguagugca

SEQ ID NO: 4159388 - RNA, 63 nt, Human
ugcagaggcacagccccagaugaaggaauucuuggcucuuucccaugggcucacugcccugca

SEQ ID NO: 4159389 - RNA, 63 nt, Human
ugcagagggagugacgguucacuaaagagauaaugugauaaguggccuucuucucccuuagca

SEQ ID NO: 4159390 - RNA, 55 nt, Human
ugcagaggugugcauucuuaaggguuuuucucauugagaauggaacuuucugaca

SEQ ID NO: 4159391 - RNA, 83 nt, Human
ugcagagucaaggagacaauuucuaagaugcuuccuuggggaaaacugaagcaaaaaacagaaguuguggauccugagcugca

SEQ ID NO: 4159392 - RNA, 64 nt, Human
ugcagauaucugaaggaugaaccucucagguagaggaaacauccaaagcaaauaucuuaaagca

SEQ ID NO: 4159393 - RNA, 55 nt, Human
ugcagaugagagggaguuuuuaggacccaguuccagcaauuuuuccuccucugca

SEQ ID NO: 4159394 - RNA, 93 nt, Human
ugcagauugauaugaauauuccuuaagcauaacuaaaaaugauuuccgcaaaaugaggagguuaauuuuaguugucucaagggucucucugca

SEQ ID NO: 4159395 - RNA, 68 nt, Human
ugcagcaagcacccaauuuacagcaguuucaauccugaaauuuuuguacuucuggguccuaugcugca

SEQ ID NO: 4159396 - RNA, 79 nt, Human
ugcagcacagcugaggggcugucuuugcacacgggcugugcgagggaggugggcagccuccucaugcuccgugugagca

SEQ ID NO: 4159397 - RNA, 60 nt, Human
ugcagcagguauggcaagcucccuccuagcaccaucagagagagcguagcccugcugacg

SEQ ID NO: 4159398 - RNA, 127 nt, Human
ugcagccacuuaaaguuuucaaagauuacauaacaugaaaaaugcuucugguauaagaaaaaugaggacuucucuuuauuguauaccaggaugcuuuagaauguuuguuuuuauaaauaguguugca

SEQ ID NO: 4159399 - RNA, 73 nt, Human
ugcagcccugagcucagcugggaccaauguguugguggaaauuaauagcagcauugggcucagaaagguugca

SEQ ID NO: 4159400 - RNA, 76 nt, Human
ugcagccucccagagauuccccuaggcagggugauaaacacgcuccaggaguccugggagugauugucaaguugca

SEQ ID NO: 4159401 - RNA, 104 nt, Human
ugcagcgaucccuucaccuuuaguuaaagaauuggacugugcugcucaaaauaaagaucaguuggagguaggauguccaagacugaagguaaaggacuagugca

SEQ ID NO: 4159402 - RNA, 72 nt, Human
ugcagcgccuucacaaggacaguauauguauccuggcaugugcaaauccaaugugaaugcaaaggcuuugca

SEQ ID NO: 4159403 - RNA, 101 nt, Human
ugcagcuccagucugccuugaugaccaaagggggaggcgaggcccagggaaagccacugagaugccugucucuuucaaucugagagcgccuggagugugca

SEQ ID NO: 4159404 - RNA, 123 nt, Human
ugcagcugguugagauguuuguugaggaaaaucugguuuacagcaacagugcagaggugcauccuguguuggccucucccuggccuguugcucaggccuccacagcauguuuuccuugcugca

SEQ ID NO: 4159405 - RNA, 55 nt, Human
ugcagcuuaucucuuuggcaguagauucccuaacaguguaagagaugcaguugca

SEQ ID NO: 4159406 - RNA, 58 nt, Human
ugcaggaacucgaaaacuauagugaaggagguccucucuauaaaaaugguucuuugcg

SEQ ID NO: 4159407 - RNA, 93 nt, Human
ucuugugugaaacaauuaucauauacauugcaaaauagaauauguauaaauguuuccguguauauguguagauggguuuguguguaugugaga

SEQ ID NO: 4159408 - RNA, 65 nt, Human
ucuuguguguucuuuucugauuaaaaaagcaauaugugcuuauuugagagaaaagaaacucugga

SEQ ID NO: 4159409 - RNA, 57 nt, Human
ucuuguguucuguaugugaagucugauggacaauggagcaugugcaugagcacagga

SEQ ID NO: 4159410 - RNA, 78 nt, Human
ucuuguuagcgucucaauggaagugagcauuccgguuugauacaaauggagucacuuccauaugggaacgugacauga

SEQ ID NO: 4159411 - RNA, 130 nt, Human
ucuuguuauuuauucuucaccugaagccaucaucucaguuucugacauuaaaaucuguuaguauggaaacaauuuugguugugucaagagacugaaggauaauaacuccaugguagccuaaguagcagga

SEQ ID NO: 4159412 - RNA, 75 nt, Human
ucuuguucacagauggcuuuuuuguugcuauguucuaacauggcagaagggaauaaggagcuuucuuuuauaggg

SEQ ID NO: 4159413 - RNA, 94 nt, Human
ucuuguuuaccuuuuaaaaauuuuguauuuuguuagucauuuuaagaaacacaugcauugagaagcuugcagauuuuucuaagggaaaauaaga

SEQ ID NO: 4159414 - RNA, 65 nt, Human
ucuuguuuacucuugcaggccaaggcguucuguacagaguuugaaaguggccugcaagaacgaga

SEQ ID NO: 4159415 - RNA, 62 nt, Human
ucuuguuucugagcauauuaggcauauauaaaaaugaaggccaaauacuuagaaacuuaaga

SEQ ID NO: 4159416 - RNA, 72 nt, Human
ucuuuaaagaggaguagaacagauagucaagaaucaccagauucucuggggacugucucuauucaugaaaga

SEQ ID NO: 4159417 - RNA, 94 nt, Human
ucuuuaaauagcaucuccccuagugcauuaaaguguuuauuuauagaucauuaacuacuugaccaagaugcugcagggcagaguagcuuaaaga

SEQ ID NO: 4159418 - RNA, 82 nt, Human
ucuuuaagcaugucacagcucccauuccuccucucacacaagaaacuucugaggaaaaauuaaguuugacaugaacaaaagg

SEQ ID NO: 4159419 - RNA, 70 nt, Human
ucuuuaaggcaaagagacaaugacacuugggagguagcagccucaaggaaacacucucucugccuaggga

SEQ ID NO: 4159420 - RNA, 111 nt, Human
ucuuuaauugaauuacaucccccucagcccaaaaugaugaacugaaaguuagaaaucauguuggcucugacaaaaauggggcauguuuauuuucuuuguuuaauuugaaga

SEQ ID NO: 4159421 - RNA, 123 nt, Human
ucuuuacacaggucuagaggcuggaaguccaagaucaagguggcagcagggcugguuuccccugaggccucucuccuuggcuugcagauggcugccuucucucuguguccaccuguggcauga

SEQ ID NO: 4159422 - RNA, 66 nt, Human
ucuuuacuguucuucugugggaaagggcucugaaaggauugcguuuugacaggaggaagguguuga

SEQ ID NO: 4159423 - RNA, 76 nt, Human
ucuuuagaagggaggcaguuuuauuucuuuaaagucauaauuucuauuaggcaaauaaaauguuuccauaaaaaga

SEQ ID NO: 4159424 - RNA, 99 nt, Human
ucuuuagagacucaccuuaucccauuaauugagauagucugacaaaugugaauaauacauugaacuacuuguaaugagacugguaguuaaucuagaaga

SEQ ID NO: 4159425 - RNA, 90 nt, Human
ucuuuagcaccaaucuuuucuucuacagugauuaauaguaaaauuguugaaugaaaaauuguuaguuaguguggggagauagcauaaaga

SEQ ID NO: 4159426 - RNA, 76 nt, Human
ucuuuagcacuggaaaguuaagaguuuugaucucagaguucaucaacucaagcuuuugcuuuuuauuuguaaaaga

SEQ ID NO: 4159427 - RNA, 66 nt, Human
ucuuuagcuuuucccuuuccacuuccuggggucaccuuugacugcacugaagaaaggagcucuaga

SEQ ID NO: 4159428 - RNA, 91 nt, Human
ucuuuaggauaagguauauuuguuucauuuugauccugcauauacauuacuuuaauuaugagaauuagguucaggaaacaccucuuaagga

SEQ ID NO: 4159429 - RNA, 98 nt, Human
ucuuuauauuaucaguuauugagauuugggggcuagggcugguuuguuauuuggcucaaacuagcacauccuaaaugcuucagaaauugauaugagga

SEQ ID NO: 4159430 - RNA, 72 nt, Human
ucuuuauccaauucaccauugaugggcaccuagguuaauuccaugucuuuguuauugugaauagggugguga

SEQ ID NO: 4159431 - RNA, 66 nt, Human
ucuuuaucugccuuucuacuuugugaugcuuucuaauacaguauuagggccaaaggcaggaagaga

SEQ ID NO: 4159432 - RNA, 127 nt, Human
ucuuuaugcauuuaccaugugucuggagcugugcuagaggugaccaugauguagcuacuguccuuaagaugguggcagcugagugucagguacagacauacccaagucauugcugaguguaaagaga

SEQ ID NO: 4159433 - RNA, 56 nt, Human
ucuuuauguacauauccacaaggaaccaaaauacuggaucuauauggacauagaga

SEQ ID NO: 4159434 - RNA, 69 nt, Human
ucuuuauuaugacagacuuaagagaauggaaguguaacccaccuucacaggcaagucuguuuuuggaga

SEQ ID NO: 4159435 - RNA, 78 nt, Human
ucuuuauuucacuuuuucucugcuugagacuagccagagugggucuggcucuuaagcagagaagaaguugauuaaaga

SEQ ID NO: 4159436 - RNA, 79 nt, Human
ucuuucacacacauacauuuggaaguuucaagggaacaugaacaucucuuugcauuuugaacguguuugucgugaaagg

SEQ ID NO: 4159437 - RNA, 73 nt, Human
ucuuucacagacagaauagguacagucagucacuauaaagccuuggugucugucuguaccuauuuuuucuaga

SEQ ID NO: 4159438 - RNA, 69 nt, Human
ucuuucacauuucucagcacugaugaagucacagaagcuugucucgacagugcaguagaagguagaaga

SEQ ID NO: 4159439 - RNA, 103 nt, Human
ucuuucauaccugguuuuguccacuucaguuaucaaaacucuuuacuuuaacaguuaaguaggacagugguguucuggaguggaccgagguagggugcaaaga

SEQ ID NO: 4159440 - RNA, 76 nt, Human
ucuuucaugggggccucucaucauuaucgcuuuguccaccaggaugguuuccagagagaugccaccucuuggaaga

SEQ ID NO: 4159441 - RNA, 99 nt, Human
ucuuuccaacacucuccuccaucccugaccacaagguguugcuccagcagaugugggagauaauucauuguguucaaggggguggugcugugguagaga

SEQ ID NO: 4159442 - RNA, 70 nt, Human
ucuuuccacuguacuauauugccuaguguuuguggucaaguauggggcugugugugcacauagggaugga

SEQ ID NO: 4159443 - RNA, 58 nt, Human
ucuuuccaggguuuuccguacgcugacuaaugcuuacagcuggcucucucuggagaga

SEQ ID NO: 4159444 - RNA, 78 nt, Human
ucuuuccccuugggcuugggcauagcuuuagggucuucagcacagucuuccaaacagcuaguaccaauccacuaaaga

SEQ ID NO: 4159445 - RNA, 55 nt, Human
ucuuucccgccagagcaugaguguccauggauggcuaguucugaagcggaagaga

SEQ ID NO: 4159446 - RNA, 57 nt, Human
ucuuuccucugagcuccuguagugcuguugccugcaccacuggggcugaaggaaaga

SEQ ID NO: 4159447 - RNA, 68 nt, Human
ucuuucgugccagaagguucccgcugcagcucuccugcuaguuuagcuuagccuucugguuugaggga

SEQ ID NO: 4159448 - RNA, 94 nt, Human
ucuuucugugcacuggucaccagguagcauuguaggccaaaugcugcuugcuugucacccugccugaguggugccauguagcaguacagagaga

SEQ ID NO: 4159449 - RNA, 79 nt, Human
ucuuucuuccguuacuguguuccaagaaauuugaaaauaugcuacauauguuuuuucuggaacaguaauugaagaaaga

SEQ ID NO: 4159450 - RNA, 55 nt, Human
ucuuucuuccuggagcccaacaccucggaggagaaugggaaacccagaagaagga

SEQ ID NO: 4159451 - RNA, 56 nt, Human
ucuuucuuggaacgguuccucaaaaagauuggagaacugucaucuuucaaggaaga

SEQ ID NO: 4159452 - RNA, 88 nt, Human
ucuuucuuuaguaucucauuggcugugugucuccuuuccacucaaaggguuggcugggaagcugcuuagcuaauguagacagggaaga

SEQ ID NO: 4159453 - RNA, 89 nt, Human
ugccuuaaguaagcucugucuuauaugaggucaugauauauuaggguuggguaugaccuuaaaugugacauagucuagcuucucaugca

SEQ ID NO: 4159454 - RNA, 58 nt, Human
ugccuuaauuuuuuauaaucucuguugaccuccaaaagagaccuguaaaguucaggca

SEQ ID NO: 4159455 - RNA, 61 nt, Human
ugccuuauuuucugcuagagaugucacagacuagcuuuaguucuagaaagugaaacaggua

SEQ ID NO: 4159456 - RNA, 64 nt, Human
ugccuucucccuuggacccugagggcuggguuaaacgcuucaggggucucacaggcaggaggca

SEQ ID NO: 4159457 - RNA, 78 nt, Human
ugccuugagcugccaauuaccuauuucugagaauuuggugacucuuauugguaaugauggcauuuacaacauuuggca

SEQ ID NO: 4159458 - RNA, 62 nt, Human
ugccuugaggguagagucgaugacuuauuuccauuuguguauuuccuguaccuaucaaggca

SEQ ID NO: 4159459 - RNA, 62 nt, Human
ugccuugcacauaauauacauucaaucaguguuuguugaaugaauaaaucaaugugugggca

SEQ ID NO: 4159460 - RNA, 83 nt, Human
ugccuugggauaucugucagcagcuuccuguagucuggcugucccaguggcuggagugcuuugaacaccgauucccagggaca

SEQ ID NO: 4159461 - RNA, 70 nt, Human
ugccuuuccauuggauucucuauccuugcuuaugcgagucccaagcagcaaguggaaucauggaaaagua

SEQ ID NO: 4159462 - RNA, 84 nt, Human
ugccuuugggagagccaaggccaguccauuuuggaagaugagaagcuuuugauuuccaagacuccaguucucccagagagggca

SEQ ID NO: 4159463 - RNA, 64 nt, Human
ugccuuuuccaucucaggcagccaagucucugcuucugacuccacugaagagacuggaggggca

SEQ ID NO: 4159464 - RNA, 79 nt, Human
ugccuuuucuacaagcaaaugugcucauaaacaacauuugguauugauuugcacauuuucaaaguuaguauaaauggua

SEQ ID NO: 4159465 - RNA, 66 nt, Human
ugccuuuucuucauugaugucagguggcuuuuucaucggccgcauuuccaaugaggcaaaguggca

SEQ ID NO: 4159466 - RNA, 90 nt, Human
ugccuuuuuuuuacaucuguauuucugcuuucucuaguacuucaacucugcuaagaaguugcugggaaguggcaaauuugauguggggca

SEQ ID NO: 4159467 - RNA, 81 nt, Human
ugcgaauuuggaugauaacucuuuaugaugaagaugcauugucuugcuuauagagaguuucauacccuucuaaaauaagca

SEQ ID NO: 4159468 - RNA, 128 nt, Human
ugcgaggccuuccgagcaggggcugccuuccuuggcagcagacaaaaggccauuucugaguuacagaaaauguguuccuuugcuacagagccgggugagggcugcccgggccgguccugggccaggcg

SEQ ID NO: 4159469 - RNA, 56 nt, Human
ugcgcauccuugacccacuccugggggccaggagcugggcgagccggggaagugca

SEQ ID NO: 4159470 - RNA, 56 nt, Human
ugcgcccagccaagucuggcacuucucuauuaagcaccuggaauguggcuggugca

SEQ ID NO: 4159471 - RNA, 77 nt, Human
ugcgcgaggcugcacuggcuaaaggcugggugccauugucuuucagcaaauagccuugguuugugcaccuggcugca

SEQ ID NO: 4159472 - RNA, 62 nt, Human
ugcgcgucuucccaaggggucuggggaccaaauuccagcucccgccaucgggaggcacggua

SEQ ID NO: 4159473 - RNA, 57 nt, Human
ugcgcugcuccgccuuguccauaugcgcaggcaaguggcaguucaggaagcagagca

SEQ ID NO: 4159474 - RNA, 56 nt, Human
ugcggcuggguucgggguggguaguugcaguuucauucaugagauaaccagcugua

SEQ ID NO: 4159475 - RNA, 61 nt, Human
ugcgggagagcgacuggcuucuagggcccuguccagccugagaaguccccacucugucgca

SEQ ID NO: 4159476 - RNA, 102 nt, Human
ugcgggucagcaauaggcgcgauucaaaggggacaguacuuugcacucugacaaaaaggggauaaggcuaucuuuugaguguguucaugugcaugguuugca

SEQ ID NO: 4159477 - RNA, 55 nt, Human
ugcggugccaguucucaucaucgggccuguuuccuucugagaacuaggcauugca

SEQ ID NO: 4159478 - RNA, 59 nt, Human
ugcguauuugcuucuugcuuccagcaccaauuguggccaauggagugaggcaaagagca

SEQ ID NO: 4159479 - RNA, 130 nt, Human
ugcguccggcggccaccgggcuccaggcgcaggcggcggugguggcggccacuucagcccugggagccgcucuccugcgcccgccgccuccgccgccgccuggaucugccucgggcggccgggcgcguag

SEQ ID NO: 4159480 - RNA, 60 nt, Human
uggccucccuggcccucccucuucugguaaugaaauagaggcugugcagagggagugcca

SEQ ID NO: 4159481 - RNA, 58 nt, Human
uggccucggacacccucugagggcuuuggcuuuucggagcccugcgugucugggggca

SEQ ID NO: 4159482 - RNA, 68 nt, Human
uggccucuggggucuagcaauagcaggaauggugccccugucuuuagcagaggaccucaguguuucca

SEQ ID NO: 4159483 - RNA, 103 nt, Human
uggccugaacuuucuguaguuuuagcagcaaugggaugcuuugaaaccuagaucucucaccaacuacaucuuccauugacuggugaaacacuaguuuaagcca

SEQ ID NO: 4159484 - RNA, 104 nt, Human
uggccugccugguuuccaggcccaacccuggggcagcugcuagggauagggcugccugcccuuagugaggcuccuucaggcugcccuggaaggcagauucccca

SEQ ID NO: 4159485 - RNA, 55 nt, Human
uggccugcucugacuuugggggcucagccaggcauccaggguccagagaguguca

SEQ ID NO: 4159486 - RNA, 56 nt, Human
uggccugcuuucuuagguguucaucaguuaacauguuugaggugacaagcaggcca

SEQ ID NO: 4159487 - RNA, 82 nt, Human
uggccugggcugcccuccaggccuccugugaguggacccugguggucccaggcugcgggcuggugggccuggccgaggcaca

SEQ ID NO: 4159488 - RNA, 77 nt, Human
uggccuguggauaaucugggagaaaacugaugagaugggcucuucuuucaaguuccccagauaugcaauucaggcca

SEQ ID NO: 4159489 - RNA, 80 nt, Human
uggccuguuuaauuuccuuccagguuccuaaggcucaggacuucuagggccauuagacugccaggaagggccuaaagcca

SEQ ID NO: 4159490 - RNA, 58 nt, Human
uggccuucuuugugaaucaaggcaaaguccacauucagccugucugcaauggagguca

SEQ ID NO: 4159491 - RNA, 120 nt, Human
uggcgacaaaauaauacauguuucgggggaagcagauauugugggaguggggaagaugggcaauugggaccacuggcccaagcauacaguauuugcucuccgcaugcugccacuuugcca

SEQ ID NO: 4159492 - RNA, 70 nt, Human
uggcgggauuacaaaacuggugugucugaguccagugcucaugcagcuuccauauuuugcugauucccua

SEQ ID NO: 4159493 - RNA, 68 nt, Human
uggcgugauggccaagaucacagacuucagugcuuaauugccuggguuugaaucuuggcuuucugcug

SEQ ID NO: 4159494 - RNA, 71 nt, Human
uggcguugucuauacauaaaagguagucagaguaaaaagaauucuagcaacauguguuagacaauagacca

SEQ ID NO: 4159495 - RNA, 113 nt, Human
uggcuaaaacuaggggcgcaacaggagcugauccccagggcaggccucccgcagcaggcaaaccugagaucugggaagggccugcccuuccucccugcggcccuggugaguca

SEQ ID NO: 4159496 - RNA, 92 nt, Human
uggcuaacuguagguauagugaaaacaggcacauaguaacauuugacaaauauuuuaaagccuaccuguuuuccacagaccucaccuggcca

SEQ ID NO: 4159497 - RNA, 77 nt, Human
uggcuaaugguucugcaggcuguacaggaagcauagcagcaucugcuucuggugaggccucaggaagcuuccaguca

SEQ ID NO: 4159498 - RNA, 72 nt, Human
uggcuacaguggcauaucaaauuuagcuuaaaguaauaaaagaaacaugaaauuucuuaugcccuauaguua

SEQ ID NO: 4159499 - RNA, 62 nt, Human
uggcuaccauguuaaaaggcuuuuuuuuaaaggcaucaagucuaauauuuaauauggaguua

SEQ ID NO: 4159500 - RNA, 83 nt, Human
uggcucaccccacuucccucccuacccuccagcugaccaaaaccuucccugcugacuggccgucccuagagaugggguugcca

SEQ ID NO: 4159501 - RNA, 60 nt, Human
uggcucacuaaugucuguuccagaccaggacuggaaauagcagccuuuaguuaacagcca

SEQ ID NO: 4159502 - RNA, 58 nt, Human
uggcucagccauucguguugcccguagccaucaacuaccagacaggugggugagacca

SEQ ID NO: 4159503 - RNA, 68 nt, Human
uggcuccaggaauucauaacagcuauguggcaaccaccugucugaaucaugauuuccuguuuaagcca

SEQ ID NO: 4159504 - RNA, 66 nt, Human
uggcuccaucauccaugcaagaucaugcucccugcucugcauucucuugcauggugauggcugcca

SEQ ID NO: 4159505 - RNA, 60 nt, Human
uggcucccccaucccaaggaggucaugugucuacacagagccccucgguggaggggucca

SEQ ID NO: 4159506 - RNA, 59 nt, Human
uggcucccgcagacccugugcugucuaugcugagccaaguaccuccucugugagaguca

SEQ ID NO: 4159507 - RNA, 64 nt, Human
uggcuccugugucuaggcauguuguguguguuuugcucacacaucaaccuagacauuguuccca

SEQ ID NO: 4159508 - RNA, 55 nt, Human
uggcuccuuuccagccugguuuccagagccucugaccugcuguggggaaggacca

SEQ ID NO: 4159509 - RNA, 76 nt, Human
uggcucuagagcaagcuggaggggcucaugaauauucauuaucaauuuguauucagaguugguuuuuuuagaggca

SEQ ID NO: 4159510 - RNA, 70 nt, Human
uggcucugugucucccagcagccugcacugcucaccugcccuguagauauuguggagaaccauagaguua

SEQ ID NO: 4159511 - RNA, 78 nt, Human
uggcugaagugugaucuguuugacaugugagcguguucuccagugaagcacacagcucagagcacucagacucagcca

SEQ ID NO: 4159512 - RNA, 71 nt, Human
uggcugacuuaugauucaaauaggaucuucuuugucccaauuaagcaagccuacuugaacaaagauagcua

SEQ ID NO: 4159513 - RNA, 58 nt, Human
uggcugagagaaaaggcccaggaaucauccuugacuucucucugccaacucacagcca

SEQ ID NO: 4159514 - RNA, 92 nt, Human
uggcugagaguggagagaguuguggcauggcagaagggcacaggaugaaggccccugcaccccugcuuugccaccaagcuaccucugggcua

SEQ ID NO: 4159515 - RNA, 60 nt, Human
uggcugaggggagggagauuuuucuuguuguggacaaggcagucccuacucccugcacca

SEQ ID NO: 4159516 - RNA, 78 nt, Human
uggcugaguugucccaguuggguauugaauucaugguaugauuuauuugcaggauugggacuggauaaaacucaguca

SEQ ID NO: 4159517 - RNA, 55 nt, Human
uggcugaucaggaaguugcugacugacuagagaagucagcagguucucacagcca

SEQ ID NO: 4159518 - RNA, 56 nt, Human
uggcugcagaaccuccucaggagaccuuauucuuuuccuaggauguuuugagucca

SEQ ID NO: 4159519 - RNA, 63 nt, Human
uggcugccuggugauaagcagugaccucaaauuaauauaggaugucacuguuuaccagcucca

SEQ ID NO: 4159520 - RNA, 72 nt, Human
ucuuugagagaggccuggauacagaagugaauauuuuaaaauauuaggguuuaucaaggcacuuuuuaaaga

SEQ ID NO: 4159521 - RNA, 62 nt, Human
ucuuugaggguuggaauacccacuaaacaucuaagcaaauguggacauuuacccuucaggga

SEQ ID NO: 4159522 - RNA, 74 nt, Human
ucuuugcaauggccuccugugugccaggcacuguuacaaagcaggggcuaaggacacagagagaaacugaagga

SEQ ID NO: 4159523 - RNA, 55 nt, Human
ucuuugcagccccaggaaguggaucuugaguagucuacugaccucuggccagaga

SEQ ID NO: 4159524 - RNA, 59 nt, Human
ucuuugcaugugcuucuuggccauaggaguuggauuuuagccuggaggcaaugggaaga

SEQ ID NO: 4159525 - RNA, 62 nt, Human
ucuuugcucacuuguguauuuucagucucuccacuggaauguaaaccucaggugggcaggga

SEQ ID NO: 4159526 - RNA, 68 nt, Human
ucuuugcuuccccuuauauuuucuggucuugcuaaaaugaugauccaggaaauguucuugaagccuga

SEQ ID NO: 4159527 - RNA, 109 nt, Human
ucuuugcuugccaagaacuuuguuuccauauuuguagcagcuaaauaaggauaagcucaggcauacagaaauggaacuauauugcucucauuugugugcuacuuaaaga

SEQ ID NO: 4159528 - RNA, 89 nt, Human
ucuuuggaaaguuuagcuucgugcaucuauagcacagccaaguggaauuguuuguagaaaauuagaugcaugguuuuggaauucagggg

SEQ ID NO: 4159529 - RNA, 59 nt, Human
ucuuuggaaggagcaguuuuugugguuucagaugagccagaggacugccccuccaaaga

SEQ ID NO: 4159530 - RNA, 78 nt, Human
ucuuuggauaguagcucuggcauucuuuccaaaaguuuacuuuuuaaaaaugaaauguuagaaagcuauuguuuugga

SEQ ID NO: 4159531 - RNA, 66 nt, Human
ucuuugggagauguuauuuauauugagagaaguaaauucuaugaguggauaagcaucuuccauagg

SEQ ID NO: 4159532 - RNA, 72 nt, Human
ucuuugucgcauuacauaguaaucugagaugcacuggaugugcuccagggaacagaauguacuuggcagaga

SEQ ID NO: 4159533 - RNA, 96 nt, Human
ucuuuguggauccaucucugaauggcuuguucauugguaccuguaaggaguuacaaugcagagcccaagagcaagccaugaagacauuccugaaga

SEQ ID NO: 4159534 - RNA, 68 nt, Human
ucuuuguuuuugugaggcagcccauggaacaaauguuccauggcaucucaacuuacaaaagucuuaga

SEQ ID NO: 4159535 - RNA, 65 nt, Human
ucuuuuaaaagaccuugaggguccgauucuaaucugaguuguaccauaaugagucucuuaaaaga

SEQ ID NO: 4159536 - RNA, 70 nt, Human
ucuuuuauacaauccagucucucccagaucccugaccugaggcaucgaggagaguugguuuguuuuuaga

SEQ ID NO: 4159537 - RNA, 89 nt, Human
ucuuuucauggccucguagccuuagcacaugcaaauaucaaccaaccaucauugucugagcaccugugcugaaccugggccugagaagg

SEQ ID NO: 4159538 - RNA, 93 nt, Human
ucuuuucuauacagauaaacucaugccaagaaaugauccuggaaauauauuucagacugaugguuucuggucugaguuuaucucaagacuaga

SEQ ID NO: 4159539 - RNA, 85 nt, Human
ucuuuucucaugcacucuguagucugugccauagcugugcuaaagccagcuuguccuccauauggcuaagggugaaagaaaaaga

SEQ ID NO: 4159540 - RNA, 79 nt, Human
ucuuuucuguugaaaucugcuucuugcauaguacaauguaccauuuacaaaggcuuaaagagauuucuuguaguaaaga

SEQ ID NO: 4159541 - RNA, 126 nt, Human
ucuuuucuucucuuuggugcuggacucugccagccaaaauuuaugacccauuuuccuucugcuuaauuguuguuauaaaucugcugugcagaacccaguuguaaauuuaucacagacuggauugga

SEQ ID NO: 4159542 - RNA, 56 nt, Human
ucuuuucuucuuaaugguuaauuaggucacuaaagaagcucuuaagaagaagauga

SEQ ID NO: 4159543 - RNA, 74 nt, Human
ucuuuugaaauuucauuguugggauaaaguuugaaguaaauuauacaguuuauaaaaauaaugaggucaggaga

SEQ ID NO: 4159544 - RNA, 72 nt, Human
ucuuuuguccugaugcuuuggccccaucaugagguaucccaagggaggccaaggcauucagaggauguauga

SEQ ID NO: 4159545 - RNA, 68 nt, Human
ucuuuuguguggcuuaauauuuauagcagauuccaagucuccuuugaaaguuaggacuguccaagaga

SEQ ID NO: 4159546 - RNA, 71 nt, Human
ucuuuuuuaaggacugaauaguauucuguuguauuguuguaccacaguuuaucuauucagcuguugaaaga

SEQ ID NO: 4159547 - RNA, 76 nt, Human
ucuuuuuuaccuccugaugagaguaaaggaccagccucccuacguggccuccauugacacaacaggaggaaagaga

SEQ ID NO: 4159548 - RNA, 74 nt, Human
ucuuuuuuauuaagcuaaauugagcuggguuucugucaugugaaauccuaaaaguuugacuuaauucagaaaga

SEQ ID NO: 4159549 - RNA, 70 nt, Human
ucuuuuuuucucuaaugccuuucuuuugcccaaaucuuaaaucauuuuggaggcaguuagaaggagauga

SEQ ID NO: 4159550 - RNA, 71 nt, Human
ugaaaaaacaucauccuuugaguauuuaggggcaauauccuaaaagaccacaaggugguaauguaauuuca

SEQ ID NO: 4159551 - RNA, 83 nt, Human
ugaaaaagcuccuuauaacuggccacaaagaaggcaucaaugacuuuacuaggugaaaauguggacuaguguuuggauuuuca

SEQ ID NO: 4159552 - RNA, 71 nt, Human
ugaaaaaggccaugguuggaguguuuacaucauaaaaaugagcaagaugcuacaaaucaggucuuccuuua

SEQ ID NO: 4159553 - RNA, 55 nt, Human
ugaaaacacuuuaguuuaggucagucuaggccugaaaaccaggaagauguucuca

SEQ ID NO: 4159554 - RNA, 86 nt, Human
ugaaaacagacaucacacucagauugcaucauucaaggaaguuuaauaaaaugauuguaaagguuugggugugguguuggagacca

SEQ ID NO: 4159555 - RNA, 55 nt, Human
ugaaaacuccaaguuucaucaguuagccuacaucugaugaagauugguaaauuca

SEQ ID NO: 4159556 - RNA, 77 nt, Human
ugaaggccacucagggaguagcacauguggaacuuuuaugugguucuauagagccuuuuauuacccugugggccuca

SEQ ID NO: 4159557 - RNA, 57 nt, Human
ugaaggccuaacuuccagugcuccauacuguggcugaauuuggagauagagucuuua

SEQ ID NO: 4159558 - RNA, 68 nt, Human
ugaaggcugucauuuucuagagauuaagcagaaaaugcugcucugucugagggagugacauuugagca

SEQ ID NO: 4159559 - RNA, 70 nt, Human
ugaaggcuugguggcagccucugagguugaugggaucuuuaggcagaagguggcugccaccuagcuauca

SEQ ID NO: 4159560 - RNA, 61 nt, Human
ugaaggggacuauuuacucaaaugagguuggugauucugccucagcguuguggcccuauca

SEQ ID NO: 4159561 - RNA, 66 nt, Human
ugaagggggugcuggugguagaguggaaucggcuucuaaauuuacuaaguacuuguaucccuuuua

SEQ ID NO: 4159562 - RNA, 85 nt, Human
ugaagguggaagggugguucugcuguguucucuuccuuggaauuucugggaaaaccacgagcgggacuagaacccaaaaucuuca

SEQ ID NO: 4159563 - RNA, 90 nt, Human
ugaagguugggauuguaaauuuguaauuaugacaaauggaagccauuugcauguuguuuaauuucgagugucacauaaacucauccuuca

SEQ ID NO: 4159564 - RNA, 77 nt, Human
ugaaguauauuaguuuacugcuugaucucugcuccccuaaagcagagccaaaucuaaagugaauauugaugacuuua

SEQ ID NO: 4159565 - RNA, 61 nt, Human
ugaaguauccaucuuguucuaggugaugaaagaaaccacagcauggagcucuggaacuuca

SEQ ID NO: 4159566 - RNA, 61 nt, Human
ugaaguaucccaagauuuacagucacaaugggguggcuggagggauguaggguguauuuca

SEQ ID NO: 4159567 - RNA, 73 nt, Human
ugaaguccuaagucuagcucagagacagaugcuugacucuuuccugcugccuagucugcugagcagagcuuca

SEQ ID NO: 4159568 - RNA, 82 nt, Human
ugaagucugcugugcaacauugcaccuauaguuaacaacacaacaguggguguguaaaaaugugcuaacaggauagaucuca

SEQ ID NO: 4159569 - RNA, 62 nt, Human
ugaaguuauagaagauggagaaguuccauaucagaaaaaugucuucuucagccuaugcuuca

SEQ ID NO: 4159570 - RNA, 65 nt, Human
ugaaguuuucugguugauuaagaucuaugccagcaggaggguauaaaaucaccagcaauacuuca

SEQ ID NO: 4159571 - RNA, 64 nt, Human
ugaauaagugcaucacauaaugauguuagcuauuauuauugugguugcauuaucuuuccguuca

SEQ ID NO: 4159572 - RNA, 78 nt, Human
ugaauacagaugaaauacuaagcuagccgaugaaucuuuuagaaaauggaauuagcaacgguaugcaaucugucuuua

SEQ ID NO: 4159573 - RNA, 87 nt, Human
ugaauaccuuccgcacgguggcucacgucuguaaucccagcacuuugggaggccaaggcagauggaucaccugaggucgggaguuca

SEQ ID NO: 4159574 - RNA, 61 nt, Human
ugaauagacuggggcugugaagucauuggcagaaugacauucaaaguuucaaucuguauca

SEQ ID NO: 4159575 - RNA, 81 nt, Human
ugaauagcugaaguaagagugauaauguaccguuuaagacacuaaaugcacauaaauauggucuuaauaacaagcuauuua

SEQ ID NO: 4159576 - RNA, 86 nt, Human
ugaauaggagcuuuuggaguccuguguuagaacaagaacaagaucacauugugacuuugggcaagugacuucuuugagcccguuca

SEQ ID NO: 4159577 - RNA, 82 nt, Human
ugaauaugugcuuuuuugucuugaagaaaugguguaucaauugauucugucaccgucagguuagaaugagcacuuccauuua

SEQ ID NO: 4159578 - RNA, 70 nt, Human
ugaauauucagaugacgugcuuagaauguauucacuaauggcauugucucagaagugaucaggauguuca

SEQ ID NO: 4159579 - RNA, 103 nt, Human
uggcugcucccggggaggagcagaggugagcccaccugggcaguucuaggggaucaucucccccaggaggguggccucugcccugagcccccaaggacagaca

SEQ ID NO: 4159580 - RNA, 72 nt, Human
uggcuggaaaagacaaagcuauuuuauuggucaccagcuaaacuaauuccccuugucuuuuucauaaugcca

SEQ ID NO: 4159581 - RNA, 98 nt, Human
uggcuggagagcaggaaggggcagggggcugccaaggaauguaacagguuuauuuuuguucaggcugcauucuuugcccagccugcacgccccagcca

SEQ ID NO: 4159582 - RNA, 101 nt, Human
uggcuggagcuuuuguggcagugauuauacuagcaguguucuaugaaggacucgauagcccaagagagccugcuguguaagucacaagucagcuuuugcua

SEQ ID NO: 4159583 - RNA, 56 nt, Human
uggcugucucggcuuugcugcugugucaguccaucagagcacaguaaugacugcua

SEQ ID NO: 4159584 - RNA, 70 nt, Human
uggcugugggggguguucaugaccucucacggccccuucuguguuuggucgugcaaaccugacacagcca

SEQ ID NO: 4159585 - RNA, 121 nt, Human
uggcugugucaugacaggccucaugaugcuaacagagauucuucccuucuuuuuuccaaaagcaccaaaaaaaagggcugaaguagucucuguagcaucuccccaaaguguuaaacagcua

SEQ ID NO: 4159586 - RNA, 58 nt, Human
uggcuuaaccuuuccagaagaaagcaauaggacucauucucugguuggaguugugcca

SEQ ID NO: 4159587 - RNA, 75 nt, Human
uggcuuaauauuucauauuuaacugcuuaccccgucuggaauuuguggggcuguggggugugaagugaggaguua

SEQ ID NO: 4159588 - RNA, 59 nt, Human
uggcuuaccacaggccaaauuugagguuaauuaaccaucagucauugucaguggggcca

SEQ ID NO: 4159589 - RNA, 76 nt, Human
uggcuuagacuagcuuucauucucuagcaccuaggaaauuuccugcuccagaaaaacuugagacucuguuaagcua

SEQ ID NO: 4159590 - RNA, 89 nt, Human
uggcuuauaacauaaguauuauguugcaaaugauucaaaauauauuagcacagacugaacacuguaaagugaugcuuaaauuuaggcua

SEQ ID NO: 4159591 - RNA, 55 nt, Human
uggcuucagaucugccccggaggaacccccacucugggaaaacagagcuggacca

SEQ ID NO: 4159592 - RNA, 62 nt, Human
uggcuucaggcagaauuuagacauagaauaacucuaauuugauuauucugcauugagugcua

SEQ ID NO: 4159593 - RNA, 55 nt, Human
uggcuucuggccaggcacaggagcucuaugggcugucccuggacuccaggagcca

SEQ ID NO: 4159594 - RNA, 80 nt, Human
uggcuucuguucucacauccagacaagcucugcaggagcagaacucccagagcccgggaccuggacuugaauggaaguca

SEQ ID NO: 4159595 - RNA, 81 nt, Human
uggcuucuuaaaacugcugggcauauauuucuaggcuuuaauccaggccuacugaaucagaauguccaguaguggaggcua

SEQ ID NO: 4159596 - RNA, 56 nt, Human
uggcuugaauuguguuuugauaagcguguauugcuuuaguaaagccagucaaguca

SEQ ID NO: 4159597 - RNA, 88 nt, Human
uggcuuucaggcucaggguucaggaggacagauaaggauagggcauggcucugcccuuccaaguucuccuggaucccccaggaagcca

SEQ ID NO: 4159598 - RNA, 80 nt, Human
uggcuuucagggaagcgcuuggcugugucuagcggcuccgacaacuaucugggcccgcagcugcugcucugaaacaguua

SEQ ID NO: 4159599 - RNA, 122 nt, Human
uggcuuuccaggugcagccgcagcuccguggccuggguggcuacugccucccugacccucccaggccuagagagggagugccacacaaggcggcccugcaggcagcagaccuccccaggcca

SEQ ID NO: 4159600 - RNA, 129 nt, Human
uggcuuucuucuuguggaaaauaagagggguagaucuugcuucuggguugguguacaguggaaccccuguacagaagcuagagcaaaugaagguaucuugauguuacaucuuucacaggaagaauacaa

SEQ ID NO: 4159601 - RNA, 124 nt, Human
uggcuuugacaauguacuauggucauauaggauauuaucaucggaggaugcugggggaagggaaccugagaacccuuuguccugauuuugcaacuucuugugagucuucgaccguuucagacua

SEQ ID NO: 4159602 - RNA, 84 nt, Human
uggcuuugacagaugaauugcagucagcauuagcaaaauagaucgugcugcuuguugauucuugacugauuauuuguacuucca

SEQ ID NO: 4159603 - RNA, 68 nt, Human
uggcuuugcaaacucauuccacauucauggaaucccggacauuuucaguguggauaguuuuguagcca

SEQ ID NO: 4159604 - RNA, 66 nt, Human
uggcuuuguguauuuucagacugugaauauagcuguuauguuaacagguaacugaggcugcagcca

SEQ ID NO: 4159605 - RNA, 84 nt, Human
uggcuuuuacuuguguuuguuugauuuuaguggcuacuuuaggguuucuaguaacacuguccaauagauacauaaugugagcca

SEQ ID NO: 4159606 - RNA, 55 nt, Human
ugggaacagcaugauugauccucagcuucaucucugagucaucucacugugccca

SEQ ID NO: 4159607 - RNA, 92 nt, Human
ugggaacaguuuucucuuggugauagucuuucuugcucauaaaagacaaagaguagguacaauggcacugcaccaggauuauaauuuuccca

SEQ ID NO: 4159608 - RNA, 114 nt, Human
ugggaacauucgugggugacaccugaggggcacaguaaagggucccccagguccgaaggcggcagggaccacaaggggugcacuccgggcucuccacccaccuccaccguccca

SEQ ID NO: 4159609 - RNA, 74 nt, Human
ugggaacucaguuccaucuucaucuuucccaucaguauggguggggcgggugcagcugggaagcuuagcuccca

SEQ ID NO: 4159610 - RNA, 97 nt, Human
ugggaacuggaguaaaggucacuugugcuaugcuuuagcaacugccaccacucucuuugcaaaagcguagcacaagugaccuuuaccguaguuccca

SEQ ID NO: 4159611 - RNA, 55 nt, Human
ugggaagccuagcagacagcugccugcauacauucaggucugcuggguucuccua

SEQ ID NO: 4159612 - RNA, 63 nt, Human
ugggaaggacagaacauaauugcuuccaaacaaaauuucaagccuguguacauuuccuuccca

SEQ ID NO: 4159613 - RNA, 82 nt, Human
ugggaaggauaagccugguugcaugcuaaugagggagacaaaguagccucacucuuauuugcaacuggcucagaccuuucca

SEQ ID NO: 4159614 - RNA, 85 nt, Human
ugggaagggcugugcgacagucccuggguagcucaguggcucaccacagacacagagcuaccagggccguacuggucucauccca

SEQ ID NO: 4159615 - RNA, 58 nt, Human
ugggaagggucaacagcuggaaauucuuuaugcagaguugcagcacgggcccuuucca

SEQ ID NO: 4159616 - RNA, 72 nt, Human
ugggaauaacacugagaacaauacagaguccacauccucaaggaacucaauagucuacugcagugguucuca

SEQ ID NO: 4159617 - RNA, 70 nt, Human
ugggaaucuggcucucucauuuacaaaaggaaaacuguccuuuaguuuuugcaagauguuagguuuccca

SEQ ID NO: 4159618 - RNA, 55 nt, Human
ugggaaugauagacacagugaacgguccaagacugaaaugaaaucuaucaucuca

SEQ ID NO: 4159619 - RNA, 66 nt, Human
ugggaauuacauggcauaacuugggauaccuguuuuacagcuaaaucauuugugaucugauuucca

SEQ ID NO: 4159620 - RNA, 55 nt, Human
ugggaauuuagacuuguaugagcucuccuaucucguuucaagucagcaauucuca

SEQ ID NO: 4159621 - RNA, 127 nt, Human
ugggaauuuuccugugauagggauuuuacuccuucuugagguagcacauucuuccuuuacacagccaggggaccacuggaauaugccccuuaaguugaggagaagcccucaguccuuauuccaccca

SEQ ID NO: 4159622 - RNA, 74 nt, Human
ugggacaaggucaggaggaaacuggauucacuucauguugugcagaagcaucauucacuuccuucuggcucccg

SEQ ID NO: 4159623 - RNA, 130 nt, Human
ugggacacacaucacaggcugccuuuguauuucacugguucugccacuuuccccuugaggacuguaaacuccccaagggcagaggcagggccccggggauuucacagggcagucuggcucccuucuccca

SEQ ID NO: 4159624 - RNA, 112 nt, Human
ugggacaggcaguucauauuaaggagucugcauuuuucucucagaagggcaaugggaagacuucggagaguuggaaguagcagaaggaccugauaugacuuguguguuacua

SEQ ID NO: 4159625 - RNA, 79 nt, Human
ugggacauuaucacacauuugaaggccugucaaagguaagcacuauuagauuugucuccagagugugggacuuggccca

SEQ ID NO: 4159626 - RNA, 67 nt, Human
ugggaccaagucauuucuuuagaucuuuugcucuugucaggugggguauuaaggagguuggguccca

SEQ ID NO: 4159627 - RNA, 56 nt, Human
ugggaccugcccuggccccaucuuggcuuucacaaaugggagcuggugaggucuca

SEQ ID NO: 4159628 - RNA, 60 nt, Human
ugguucagaauuguggagaaaggggagcuguguuucucugccucacaggucuaagcacca

SEQ ID NO: 4159629 - RNA, 56 nt, Human
ugguucagagaguugcugaccaccuccucuuaccugugguuaagaucuuaggacua

SEQ ID NO: 4159630 - RNA, 78 nt, Human
ugguucauagccucacaggauauucuuaguaaauauuuguuaaaugaaugaguaaauccuguuaggauuauguaucca

SEQ ID NO: 4159631 - RNA, 59 nt, Human
ugguuccaguuuucaauagagcugucaaaauaggcuugagaaggugaaaacuggcauca

SEQ ID NO: 4159632 - RNA, 79 nt, Human
ugguucuaaaaaacuauuuuauuaugcuauucacauuucuagaugugauucaagaaaguaaaauguugagucagggcua

SEQ ID NO: 4159633 - RNA, 71 nt, Human
ugguucucaggccuucagaccuagacaggaaucuauacuacuagaucucugaaucugaagccuucgaacua

SEQ ID NO: 4159634 - RNA, 84 nt, Human
ugguucugcucaaagguccagaggucccgucaccuaggagcaacaucaucagggaugcagcacuugguuaaccagcaugagcca

SEQ ID NO: 4159635 - RNA, 55 nt, Human
ugguucugcuuuugauucugccuaaugucucagggguauuacaggcuuagaacca

SEQ ID NO: 4159636 - RNA, 62 nt, Human
ugguucuugggugcacaagaaaacuaugauauuauaauaguuuguguccuucuaaagggcca

SEQ ID NO: 4159637 - RNA, 64 nt, Human
ugguucuuugauuuuaagggagucauucaguccaucuagacugaauuuggaacucagagaauua

SEQ ID NO: 4159638 - RNA, 101 nt, Human
ugguugaggaaauugaggcucagagaagucgugacauucccgagguccugcggcuaggaagcaccggaaugaugacuucagccucgacaucucuuguacua

SEQ ID NO: 4159639 - RNA, 72 nt, Human
ugguugaugaucaguggacauggcaugugaagaaauaacuccuuagccaugucacauauggucaucgaacca

SEQ ID NO: 4159640 - RNA, 79 nt, Human
ugguugcaagugaaagagaguuuagugguuucaucauuguuguaguaaaaccauugcaucuuucuuaauauuuugacca

SEQ ID NO: 4159641 - RNA, 100 nt, Human
ugguugccaccuugucagcacgccugccugucagucccccuugagggcuucuguugccugcagagggacuggcaggaagaggugcaccuagguggaucua

SEQ ID NO: 4159642 - RNA, 65 nt, Human
ugguugccuaauucauugggauugcuaguuuuaacuucaauacaccauaggaauagugggcacca

SEQ ID NO: 4159643 - RNA, 81 nt, Human
ugguugcugguucacagcauacgcugcauuuuauaggauugcuucccaauucugcaugguggugucucugagcuagugcca

SEQ ID NO: 4159644 - RNA, 74 nt, Human
ugguugcuuuaggauuuaaguggcaggugaaaauuaguacugcuauuugcuauguauauaucuuuaagcagcua

SEQ ID NO: 4159645 - RNA, 73 nt, Human
ugguugggggucccucccuuggucucccucucgguucauugcugccuucuggggaagggagggccuccaguca

SEQ ID NO: 4159646 - RNA, 61 nt, Human
ugguugugcugaguuuagugcaagacuaauguuuuuucuacuugaccggcuuagcaaacca

SEQ ID NO: 4159647 - RNA, 59 nt, Human
ugguugugcugaucugugugugacucugcuucuguagaugauuagauuaaacacggcca

SEQ ID NO: 4159648 - RNA, 74 nt, Human
ugguuuagugugcauggaucuguggaucuaguuguuccucaugcaaacuuucaacuuucuguggcacuaaauca

SEQ ID NO: 4159649 - RNA, 67 nt, Human
ugguuuauaugauucaguuuuggaguuaaaaguaaauuuucucugucagcauugcgucacugagcca

SEQ ID NO: 4159650 - RNA, 67 nt, Human
ugguuuccuauggcagaggaguuauuuucuagcagaaaccauuuauuccuucuuccuuuaguaacca

SEQ ID NO: 4159651 - RNA, 58 nt, Human
ugguuuccugauggacacuugguuggguagauacuggugucccaaagauuagaaauca

SEQ ID NO: 4159652 - RNA, 73 nt, Human
ugguuucuucaacacauuccuguagguguuugguuuuucugagcuccacaugcagagugucacuugaaaacca

SEQ ID NO: 4159653 - RNA, 99 nt, Human
ugguuucuuuuucugucucucacugagcaugucaccggagugcuguguauagaguaaggccuuaauaaauauguguucaguugacaggagcaggagcca

SEQ ID NO: 4159654 - RNA, 67 nt, Human
ugguuuucauuuuuucagguuccuuuaggaugauguccucugguccugcagcagaucuuuggaacca

SEQ ID NO: 4159655 - RNA, 83 nt, Human
ugguuuuucauguuggauucacugugaguucuuaaaaaaaaggaucacccacugauggauucaaaucuaccuuuggaaaauua

SEQ ID NO: 4159656 - RNA, 68 nt, Human
ugguuuuugucuuuaugcacacugacuugggugguuuuuaagucaaauugucuaaagaaauaauuuca

SEQ ID NO: 4159657 - RNA, 84 nt, Human
ugguuuuuguuccuaagugucuacauuugcuaaccagauucucuguuucugguuucugugaagauagcuaccggcacaaagcca

SEQ ID NO: 4159658 - RNA, 77 nt, Human
uguaaaaauuccaagaauaacacuuagguuuugcucuugaggaggggcaguucuauauuauucuugggauucuuaca

SEQ ID NO: 4159659 - RNA, 90 nt, Human
uguaaaaauugaaaccaaagauguccccucacugugcugcccucagaugcagguauuagacagcaggggagucugguuuucaaaacugcg

SEQ ID NO: 4159660 - RNA, 67 nt, Human
uguaaaauaucuuaaucauuuucauauugauuguauguugaaaugagaaugcuuuggauauauugga

SEQ ID NO: 4159661 - RNA, 101 nt, Human
uguaaacuuaaaaaaggcuguuuauuagaaaaaguauugaaauuguguguaugucuagauucacauagcauuuuuuuggcaacagucuaagguaguuuaua

SEQ ID NO: 4159662 - RNA, 130 nt, Human
uguaaagcaacaagaucugugcaguauaauucugucuuuuaauuaacaugaaucuguuuuuugucaauaaaauguuuuugucucugauaaguaguucaguuggaguacaggcuguuuuuagauuaugcug

SEQ ID NO: 4159663 - RNA, 73 nt, Human
uguaaaguaucugugagcucucaggacauuucaacacucccugacuuggaguuauaucucauggauacuuaca

SEQ ID NO: 4159664 - RNA, 78 nt, Human
uguaaauccauuuuccuaagguagugauaauuuuauaacacaagcaugagaaaugaacacaaccuugggagacuugca

SEQ ID NO: 4159665 - RNA, 81 nt, Human
uguaaaugcgaauugaugucaacucaggagaauugaaacucacaucuucugaacuuugacaagucaauugugcagaaaaca

SEQ ID NO: 4159666 - RNA, 102 nt, Human
uguaaauuagaguauaagcauugcaagggcaugugugcguguguaugaaauagagagaaagugcacagucaauguuuuugcaugugaaugacuaaaaccaca

SEQ ID NO: 4159667 - RNA, 63 nt, Human
uguaacacuucagagugccaaaugcuuuuuaaaaaauagcccuggcucugaaagagugcugca

SEQ ID NO: 4159668 - RNA, 75 nt, Human
uguaacaguugcucuagggaggcaauagcaauguucagaugaauggugaauuccuuuccuauugcugcucuaaca

SEQ ID NO: 4159669 - RNA, 61 nt, Human
uguaacaugguucuuacucucaaggaguucacagauacuuacugagugcuuacuauguaca

SEQ ID NO: 4159670 - RNA, 64 nt, Human
uggaagcaguaugcagucuuucugaccaauuacagaugaaaacuugugcaugcuuuuguuucca

SEQ ID NO: 4159671 - RNA, 58 nt, Human
uggaagcugaacuuagcaaggaagcuuaguaguuaucccuccggauguucagcuugca

SEQ ID NO: 4159672 - RNA, 63 nt, Human
uggaagcugccugccacgcuagauagaucuuuuuucuaucuugggguguguagcauguaucua

SEQ ID NO: 4159673 - RNA, 94 nt, Human
uggaaggaaggagggagaaaacagggaaggagguggaaggccagggcuaugcuggggcuucccuaaaccuuuccacuuuccuucuucucuucua

SEQ ID NO: 4159674 - RNA, 99 nt, Human
uggaagggaaccgcuugaugccucuugcuuguuccacucuugggucagagauaucucccuggcuggaaauuaaguaguggccacaguugguagggucca

SEQ ID NO: 4159675 - RNA, 104 nt, Human
uggaagggcgcucagcucagccaggacagggaaacuagugcauaaagguggggcauuugcacaguucccgucuugcacagcuacugccugccagugccucucca

SEQ ID NO: 4159676 - RNA, 61 nt, Human
uggaaggggagccaggggcuuggguggacucgucccacuggcccccuggacuccucaucca

SEQ ID NO: 4159677 - RNA, 55 nt, Human
uggaagguguggcaggucuagugggcaggugagcuggcccuggccacggcugcca

SEQ ID NO: 4159678 - RNA, 70 nt, Human
uggaauacagugagaauaauucuuaguucugagcuagaaauugagcuuagggaugcucuccuguccucua

SEQ ID NO: 4159679 - RNA, 101 nt, Human
uggaauauguucuuuaguuguaucagucaaguuggcuagguuaugcuacaguaaaaagcaacaacaaaacuucacuggcuucaguaacagaauuuuaucua

SEQ ID NO: 4159680 - RNA, 63 nt, Human
uggaaucucaguggaagcaggaaguuuagaaggcaucacagcuaccaucuacuagagauugca

SEQ ID NO: 4159681 - RNA, 81 nt, Human
uggaaugaaggagauggccuuucuacaccaggugcacauucauucucuguuagucaaaaaggguccauagcuaucauuaca

SEQ ID NO: 4159682 - RNA, 83 nt, Human
uggaaugacagaaguuuauuuuacacauccauggagaauagcugucuccauugggaaaagaaaugcaacuaaguacaugccca

SEQ ID NO: 4159683 - RNA, 67 nt, Human
uggaaugcauugccuggauaagcaggucagaguucacaguugaaacugcucaugcaaugcaugucca

SEQ ID NO: 4159684 - RNA, 129 nt, Human
uggaauggaaaagugcaggcaaacuagaaguuuccaggauaugucuacauuagauuuuuguucauuugcaaaguuagacacauccguggaagcuucuuauagucugccuguacuuuuccuuucauucca

SEQ ID NO: 4159685 - RNA, 64 nt, Human
uggaauggauaagucaaagaguaucccauuuaaaguuuaauggguacugucaaauuguccucua

SEQ ID NO: 4159686 - RNA, 113 nt, Human
uggaauuuugagucagaacaggucuugugaauauaaguuccauguguuuacuaccuacagugaaaaauacgugguuacucuauagaguuacaaaaccacugcuuuaaauucua

SEQ ID NO: 4159687 - RNA, 78 nt, Human
uggacaagggcugggucuuuaugggggccaggaucuugauuaauuccugggcacuuguggagauuagagucuuggcua

SEQ ID NO: 4159688 - RNA, 72 nt, Human
uggacaaggggucacucacgccuggaaucccagcaguuugggaggccaggguggguggaucgcuugagccca

SEQ ID NO: 4159689 - RNA, 62 nt, Human
uggacacuguuccacacuaagaagggaagcaagucuccuuacugcgaagggggcaguggcca

SEQ ID NO: 4159690 - RNA, 56 nt, Human
uggacagagaggaaggccauuucacacagaggaaaugaaaccuaaacuuucugcca

SEQ ID NO: 4159691 - RNA, 68 nt, Human
uggacagcagagcaccagggccacuugcagagucaccugugugauguuucuggguucugccuugucca

SEQ ID NO: 4159692 - RNA, 67 nt, Human
uggacagccaaggaauuaggaagggggcagagaggaauagaucaucccuuccucccugggcugugca

SEQ ID NO: 4159693 - RNA, 82 nt, Human
uggacaggggcugccacagggucagccacucugcaugggaacuccuguaagggggaccguguggcccaccuccaccugcuca

SEQ ID NO: 4159694 - RNA, 67 nt, Human
uggacaggugcaaagggcacaugacaccuucaucaaugcagccucguguaaguccauugccugucua

SEQ ID NO: 4159695 - RNA, 78 nt, Human
uggaccaagucauacaucccauuuuuugcauuuauuucucauagaaaucuugaagaguuugggguaugauuguuucua

SEQ ID NO: 4159696 - RNA, 58 nt, Human
uggaccuagagaaaaaugucuggagcaauguuuugccguucaaagacccucaggucca

SEQ ID NO: 4159697 - RNA, 69 nt, Human
uggaccuugccccuugcccuuuggucauucaaguaaccugaaucccucagagaaaaggagcaaggguca

SEQ ID NO: 4159698 - RNA, 61 nt, Human
uggaccuuggcauccucugaagaaaugauauuuuuuauucuagcauugaugccaaggucca

SEQ ID NO: 4159699 - RNA, 68 nt, Human
uggacgaugagauggggcuggaagguacaagacaguccuucagucccauguuucucuuuaucucucca

SEQ ID NO: 4159700 - RNA, 75 nt, Human
uggacuaaccucacagcuugggcaaacggccuuccucuuugaaugagcuucccaagcugugaaauggaggucaca

SEQ ID NO: 4159701 - RNA, 60 nt, Human
uggacuaugugaagugugaauagggcucaguugcauuuguucacaugucauguacaacua

SEQ ID NO: 4159702 - RNA, 105 nt, Human
uguaggaauguuuauggagugacaggcagauguuuuaguuguacuauguaugugcuaagugaaaacuaaaaugaucucuuuuaugauaucauaggcauucuuaca

SEQ ID NO: 4159703 - RNA, 94 nt, Human
uguaggaucauucugacaugagcucauugagaauaagacccaugguugauuaaucuuuugucugucccaauagccaacaggaugcauuucugca

SEQ ID NO: 4159704 - RNA, 88 nt, Human
uguagggcaaaggcuugcgauuccuuguaacaauauuucauaauuuauauauuugauuaaaaaccggaaucugggccagcagccugca

SEQ ID NO: 4159705 - RNA, 63 nt, Human
uguaggucugcagaggagucagcugagggaucuuccacagaggaaugcaucagcagauuugca

SEQ ID NO: 4159706 - RNA, 85 nt, Human
uguagguuuauagucacuuucacauguugggaucaguaaauguaaaaucacagauuugucaguggaagugauucaaacagcuaca

SEQ ID NO: 4159707 - RNA, 57 nt, Human
uguaguaacgggagagugcaucuuuuagcaaccguagcucguuuuuccgggauugca

SEQ ID NO: 4159708 - RNA, 65 nt, Human
uguaguagcaguaacaagguauaucagcccauaacaaggcaaugugccauugaggcugaggcuca

SEQ ID NO: 4159709 - RNA, 59 nt, Human
uguaguccaaaaauggggaaauauuggcuuuaacccuauuuuauccccacuggauuaca

SEQ ID NO: 4159710 - RNA, 62 nt, Human
uguagugaggggaucuugucuggcuuucuaagagaauaugaagcaggugaaccuccaguaca

SEQ ID NO: 4159711 - RNA, 73 nt, Human
uguaguucaaaggccugagagaugaagggcugaugguauagauuucagucugagucuaaaggcuugagaagca

SEQ ID NO: 4159712 - RNA, 74 nt, Human
uguauaaucuuaguuuagauuagcaauucgggaucucuuuuucccugaauucuaaccauuaagccaagcaagca

SEQ ID NO: 4159713 - RNA, 65 nt, Human
uguauaauuggcuugggaaggaagaucuugaauguuuggauauuucccaguuagucauuuuuaca

SEQ ID NO: 4159714 - RNA, 63 nt, Human
uguauaauuuguguacaauuuagcauagugacauuaacuaauuuggaccauacaaguuaugca

SEQ ID NO: 4159715 - RNA, 79 nt, Human
uguauaauuuucaaacucugucaauaacuugcuggguccaaccugcagacccuggcugcgugauggaugaagaaaugca

SEQ ID NO: 4159716 - RNA, 74 nt, Human
uguauacagaauuuuaccuggcugacuuauguccuuuccaccaccagcagcugagaugguaagauucaguaaca

SEQ ID NO: 4159717 - RNA, 73 nt, Human
uguauacuacagguaaggcaauugguaccugacaaauaaccauucuguaaacaauagcauugccugauauaua

SEQ ID NO: 4159718 - RNA, 72 nt, Human
uguauagacacagcuaugauuugagcagugccauuagugucuuaguaccacucggaggaccuguuuuaugca

SEQ ID NO: 4159719 - RNA, 95 nt, Human
uguauaugaaggugagauugcauuuagguaaacacuuuuguuucuuuaggggugaccucaguuaguguuuaguuaagauuucaaaagcuugugca

SEQ ID NO: 4159720 - RNA, 58 nt, Human
uguauaugcacuuuccuuauccugguguugcaggugcugagagggguuguguauuaca

SEQ ID NO: 4159721 - RNA, 83 nt, Human
uguaucaacaaacuuuaauuguguguuaggccgaauuccuaugugaaauugguaacacaggcauuaaaguuuacaagagugca

SEQ ID NO: 4159722 - RNA, 86 nt, Human
uguaucacaaaggucucagagcacauuaaagucacacacacacacauuaaagucacaguaugcucugagaccuuugugcaucuaca

SEQ ID NO: 4159723 - RNA, 90 nt, Human
uguaucacucuucaaaguguuaugaaauuuuuuuugguuagcccagaaacaguuuauaacaugauacuacuugaccauggggaugauaca

SEQ ID NO: 4159724 - RNA, 67 nt, Human
uggagcccaagucugcacucggcggcacccuuauucaucacuccaugcgccugugguuugguuucca

SEQ ID NO: 4159725 - RNA, 80 nt, Human
uggagccccugauguccugcaaaugaaggaggaggauguccuucaguuccuugcagcaggaacccacuuagguggcacca

SEQ ID NO: 4159726 - RNA, 61 nt, Human
uggagccuaagaauuaaugaauacaccagguaauucugcugcagauauuucuuaggccaca

SEQ ID NO: 4159727 - RNA, 91 nt, Human
uggagcgagagugaugucuguagugaagaauuuggcgccaucuugagaaggucaaagugauucuucgauuaaaugccuuacuuaucgccua

SEQ ID NO: 4159728 - RNA, 61 nt, Human
uggagcucaaggaccuugacagaaauuccccaaaacuuuguuaaggucacuucugagccua

SEQ ID NO: 4159729 - RNA, 104 nt, Human
uggagcugggagcugcucggccuggugggaaagggcggacagggcacauuuccaggcccuggaaggcccccagcgcccccaccuguugacaacuccccacccca

SEQ ID NO: 4159730 - RNA, 58 nt, Human
uggagcugggguuugaaucuggaccaucuagucucagggucauuggucuucagcacca

SEQ ID NO: 4159731 - RNA, 83 nt, Human
uggaggaagcauuaagagagacugaacugcaaaaauucuuucccacugagauacuaguucagagauucucugcuuucaaacca

SEQ ID NO: 4159732 - RNA, 59 nt, Human
uggaggaagggaguguacuugcccucaaaacagcaaagggacuaugcuuuucuucucca

SEQ ID NO: 4159733 - RNA, 77 nt, Human
uggaggaauuaugcuaaaugaaucaagucaguuacagaaagauaauacuggaggauuccacuuacaugaggucucua

SEQ ID NO: 4159734 - RNA, 66 nt, Human
uggaggagaccauuccacucagcauugauucugacaugagccugaaugaugggaugcuuuucuuca

SEQ ID NO: 4159735 - RNA, 96 nt, Human
uggaggagcagucaaagacaucuucagguucauggucauauucauuaugguguuuguggccuuuaugauuggaauguucaaccucuacuccuacua

SEQ ID NO: 4159736 - RNA, 79 nt, Human
uggaggauaauggcccucuuaucacagcuccacuagucagugcuccaguggggacacuguguggggggcuacaacccca

SEQ ID NO: 4159737 - RNA, 56 nt, Human
uggaggaugagugugggcucugaugagaauguuaaaucccaauaacuaguccuuca

SEQ ID NO: 4159738 - RNA, 70 nt, Human
uggaggaugccauccaggauacgucauaaaaaaauucauucaauuugaguauucuuuucagaguccuuua

SEQ ID NO: 4159739 - RNA, 79 nt, Human
uggaggaugccuggggaggccuaagggggaggucagagacccagaaagcccccuacacuucccagaugcugcguuccca

SEQ ID NO: 4159740 - RNA, 60 nt, Human
uggaggcacuaaauggccacaaggaaaugacuuccaagaugccaacauuugggccuauca

SEQ ID NO: 4159741 - RNA, 80 nt, Human
uggaggcuggaagccaaagaccaaggugucagcagaguugauuuccccugaggccccucuugugagcauccagcuagcca

SEQ ID NO: 4159742 - RNA, 73 nt, Human
uggaggcuggaaguccaagaucagggaucagucggguucuagccagggcccucuucuagguuucagccugcca

SEQ ID NO: 4159743 - RNA, 63 nt, Human
uggaggcuucuccuuccuaccuuccuccucacucugagcagugaaggaaggggaggggcaacg

SEQ ID NO: 4159744 - RNA, 67 nt, Human
uggagggaaguggcuggcauaggaacagaccauauccauguggcuuuggacuccagucauuccccca

SEQ ID NO: 4159745 - RNA, 75 nt, Human
uggagggcugcacagaucuucaaggguuggcuuguaaauauguaaucagaagagcuggugcugccugagaaucca

SEQ ID NO: 4159746 - RNA, 68 nt, Human
uggagggcuuuguggcagucacuauaugagaugcugagguuauaguugugaauuaaauaaagucccua

SEQ ID NO: 4159747 - RNA, 61 nt, Human
uggagguacaugaggauacacaggacacucucuauuggccugugaauugaaucuaccacua

SEQ ID NO: 4159748 - RNA, 66 nt, Human
uggaggucaaaaugcuuuucaggucuuuaauaucuacauugaguccaaaacuacuuuugaccuuua

SEQ ID NO: 4159749 - RNA, 84 nt, Human
uggagguggcaaaucauucauaguaagaagagccgcaaaugucucauagcacuuccccuccugagcugguauuguccaucucca

SEQ ID NO: 4159750 - RNA, 93 nt, Human
uggagguguccagggcagggauguugcggcagccuggggcucugcacccuccacccuucaccgccacauucugccucuuggccuuuaccucca

SEQ ID NO: 4159751 - RNA, 91 nt, Human
uggaguaaacuuggagcuaaaugaaucauaaaucaauaaguaccucagccugcugccucaugguuuauugauucagaagcuguuuauccca

SEQ ID NO: 4159752 - RNA, 57 nt, Human
uggaguaguguguuucucugcuaucucggcucaguggaugauuuugcacuaacuuca

SEQ ID NO: 4159753 - RNA, 71 nt, Human
uggaguaucaagaguauugacaagaccaauuuacugauugauugguuuauauaucacaucugauugcuuca

SEQ ID NO: 4159754 - RNA, 67 nt, Human
uggagucaaaguuuguggcaauuuauugauccuguaucaugaauaagcugcuaggaacuuaguucca

SEQ ID NO: 4159755 - RNA, 66 nt, Human
uggagugaugcuggggacacagugguggccaagacagcccuaggcccugcccuuagcacacucaca

SEQ ID NO: 4159756 - RNA, 60 nt, Human
uggagugucuuucuugccacuuuagcccuuugguuugguggcagucuuaagagaucuuca

SEQ ID NO: 4159757 - RNA, 67 nt, Human
uggaguucucaggugagggcuuugaccucagagagcuguuggucucauucucgccugugaaauucca

SEQ ID NO: 4159758 - RNA, 73 nt, Human
uggaguucugaaggcauuuuugcugauuucuggguucccagacaucugcacgguugccguuucuagaagucua

SEQ ID NO: 4159759 - RNA, 55 nt, Human
uggaguucuguugagcaaaauuuucaugacaguugcugugauaagcagaauucca

SEQ ID NO: 4159760 - RNA, 72 nt, Human
uggaguuucauuaccaguuuugccauuugcuaguuaauaugacuugcaggugcagcuggugaaauggcucua

SEQ ID NO: 4159761 - RNA, 96 nt, Human
uggaguuucuaauccaguagcucuggacuggggccugagaacugauauuucuaucaauuucucagguagugcugaugcugcugguagggaacugca

SEQ ID NO: 4159762 - RNA, 77 nt, Human
uggauaaaauuuggguaaaauuuaaauacauggcauagaccauguauuuuaagauuugccucaagguuuguaaacca

SEQ ID NO: 4159763 - RNA, 81 nt, Human
uggauacaugagaugguugaccagagagcacacgcuuuauuugugccguuugugaccugguccacuaacccucaguaucua

SEQ ID NO: 4159764 - RNA, 78 nt, Human
uggauacuguugugaggacagugaacagagagguuugcacuaccauuaaauuccuuguucucaaauucucaguguuua

SEQ ID NO: 4159765 - RNA, 65 nt, Human
uggauagugugcugcuuaaacaguuguggaaacuucauccuuguccccuugcagcucauuuucca

SEQ ID NO: 4159766 - RNA, 59 nt, Human
uggauaucuguuucucuguccaugaaucgucccccaggcacagaguagaacauaugcca

SEQ ID NO: 4159767 - RNA, 82 nt, Human
uggauauuccacauuaugacuauuuaacuucacagacaagagaagcagugaaacaaauggaugucauaguuggauauacuca

SEQ ID NO: 4159768 - RNA, 65 nt, Human
uggauauugagaagugagucccuugagguuauguccuuaguaaucuuacaaguuucuaauaacca

SEQ ID NO: 4159769 - RNA, 77 nt, Human
uggauauugaucugaccucuuguuuuuauuucuaaguuuguuuggcacugaaaaaggagagguuuguuaucaaucca

SEQ ID NO: 4159770 - RNA, 56 nt, Human
uggaucuagccagcaacauuucggagauacaacuuuucaugggcagguaagaucca

SEQ ID NO: 4159771 - RNA, 63 nt, Human
uggaucuaucuccagggguccuugagugcacggaagcuggcuuuccccagaggaggggaucca

SEQ ID NO: 4159772 - RNA, 80 nt, Human
uggaucucaguugucccauggcuuuuguuguuguuguuguugucagucagguacuccgagggcauggguaauugauaaca

SEQ ID NO: 4159773 - RNA, 55 nt, Human
uggaugaacaguuuuggagagaucugcaagacuucccagaagagaugaucaucca

SEQ ID NO: 4159774 - RNA, 118 nt, Human
uggaugagauaaaugggaaaaaugaauggguuuauggaugaguggaugagugugccugauggaaaacaguaccuucugaccaguuaucuugaauuccuuccucuuccccuucuguuca

SEQ ID NO: 4159775 - RNA, 77 nt, Human
uggaugaggcaggcuggucugaagagugcacugauaacuagaagcucauuacuuuuuagcacagugugugccaucca

SEQ ID NO: 4159776 - RNA, 104 nt, Human
uggaugaugaggaaagccucuuaagcuuucauucagggagaauuuggacccuagaaaucacagaauuuccuaugagagauuccucuagagauucuuuuaauccg

SEQ ID NO: 4159777 - RNA, 63 nt, Human
uggcccuuugugugcuagcugagccugccuaccugguuugggcuggaagacacugaagggcca

SEQ ID NO: 4159778 - RNA, 95 nt, Human
uggccgggcacggugucucaugccuguaaucccagcacuuugggaagccaaggugggcagaucacaaggucaagagaucgagaccauccuggcca

SEQ ID NO: 4159779 - RNA, 96 nt, Human
uggccgggcaugguggcucacgccuguaaucccagcacuuugggaggcuugaggugggcggaucacaaggucaggagaucaagaccauccuggcua

SEQ ID NO: 4159780 - RNA, 55 nt, Human
uggccucaaccguccuaagcacacgugugcuagaaaaagggagaguuggguguca

SEQ ID NO: 4159781 - RNA, 75 nt, Human
uggccuccagugcccuccuugggggccuguugccucugcccuggcccccagcagaggaggugccccuggcugcca

SEQ ID NO: 4159782 - RNA, 87 nt, Human
uggccugccucccccagcccaguggccauggguauucuagaaacaaaccauucuucccucugcccugggauuggguggaggcugcca

SEQ ID NO: 4159783 - RNA, 55 nt, Human
uggccugcuuucauuugaugcuguuaguuaaucaagcacaucaguuaccaggcca

SEQ ID NO: 4159784 - RNA, 60 nt, Human
ugguuugggcacguuuaaguaaguuguccguggacaaaacuugaauaggugucaaggcca

SEQ ID NO: 4159785 - RNA, 57 nt, Human
ugguuuguuuguucauguaaaacgggauuuccuguuuauacaaggagaacaaugcua

SEQ ID NO: 4159786 - RNA, 123 nt, Human
ugguuuuaguuuaguuuuuguuuuucuguuuguuccuuuguuuagcagagacauuuuccauaagauacagagguuuucuuguuucacaaaaggcaugcagaugggaagaugagcuaagaacca

SEQ ID NO: 4159787 - RNA, 85 nt, Human
ugguuuucacccuugguuuugcagagcuguagaggccugugaaagugccacagcagcccuccagaaaaagggggaaagaggacca

SEQ ID NO: 4159788 - RNA, 57 nt, Human
ugguuuucauugcuaagguuuuauuccuuauacaaagggaguuagaaaugaaggcca

SEQ ID NO: 4159789 - RNA, 76 nt, Human
ugguuuuccaugguagcauguuuacaguacuugaaaaauguugcuuucaagucauguuaacugcuucuuaagacca

SEQ ID NO: 4159790 - RNA, 73 nt, Human
ugguuuuggggaucagggugagugggaagcagcgucaccuucugagcugcucuugcucuuccucccuugacca

SEQ ID NO: 4159791 - RNA, 61 nt, Human
ugguuuuuagcuuuugugucagauaagaaugguguuguucccaucugaaugaguuaaacca

SEQ ID NO: 4159792 - RNA, 61 nt, Human
ugguuuuugaggauuaaaugacauuguagaaaaacuacaaaguuugggguccucaaaacca

SEQ ID NO: 4159793 - RNA, 92 nt, Human
ugguuuuuggggauaguuaagcccaggccuuaagacaguuugauauucaguuuuguuauuuaggucuggguuagggauaccgccagagagca

SEQ ID NO: 4159794 - RNA, 129 nt, Human
uguaaaacuucaaagaugaaugucauuuuuaaaugugagaaaaagagggguaaaugauggcugguuuaaacauacguuaaacagcuucucuuugucuuagagggacagugcgggccugggaagugagca

SEQ ID NO: 4159795 - RNA, 85 nt, Human
uguaaaagugcugccaguacagaauguguaucauuaccauuuuauggauaaauguguauuaccauuuugucuggauaacuguaca

SEQ ID NO: 4159796 - RNA, 63 nt, Human
uguaaaaguuuuuggaacggcauuguccaauagaacuuuuugccguguuagaaauguuuuaca

SEQ ID NO: 4159797 - RNA, 68 nt, Human
uguaaacacuuaggaacuuuggguugcuggauacaccaguuccaggcuacuuggauuccuggucuaca

SEQ ID NO: 4159798 - RNA, 60 nt, Human
uguaaagaaagcuguuguuguauucugcucaauggaauguaugauacaguuuauuuuaca

SEQ ID NO: 4159799 - RNA, 71 nt, Human
uguaaagauagaaagagugguucuuuuuaccuagauaaaauauuguauaagucauucuuucuauuaagaca

SEQ ID NO: 4159800 - RNA, 79 nt, Human
uguaaaguaagcacacauucaccaugacugaaaaccaaaguucuuuacucucacaaaguggauguggguuggcuagaca

SEQ ID NO: 4159801 - RNA, 57 nt, Human
uguaaaugcuuauuagugucacaaaauuacccauuuugugaugagggagcauuaaca

SEQ ID NO: 4159802 - RNA, 66 nt, Human
uguaaauguacugaggcaacaggaguuuaccguuauguauuuucaguuguuggaaguagauguaca

SEQ ID NO: 4159803 - RNA, 82 nt, Human
uguaaauguuguaaguacaucuaagguaugucaggcuaagcuauagacguuugguagguuagauguauuaagugcauuuuca

SEQ ID NO: 4159804 - RNA, 77 nt, Human
uguaaauguuucucuagcagaucauaaugaaaaagugaaauugcugguucauagugauuguucagauagauauuaca

SEQ ID NO: 4159805 - RNA, 92 nt, Human
uguaacaucucaugaccugcagguguuuccacacuuccuuccccuugcucaggagguguaauuacucuugcaguuugccugugaauuguaca

SEQ ID NO: 4159806 - RNA, 88 nt, Human
uguaagaaaucgaggccaaggcacuggaagucccauugucucuggaugcugagaccuugaauuucaugccauggaccccucccuuaca

SEQ ID NO: 4159807 - RNA, 76 nt, Human
uguaagaaugggaugaaaaguucaggccuaugauaaacaucaguuuaagaggguuucauucccaaauaagcuuaua

SEQ ID NO: 4159808 - RNA, 57 nt, Human
uguaagaccaggcugggcagcucucauucuccgauuggcgguccauccgauuuuaca

SEQ ID NO: 4159809 - RNA, 124 nt, Human
uguaagauggugacaguaaggauuaggacagauuugaagguuugauccuuauuuauaagcuucuugcuugugaauagaagucagaccuacaauuuauuaacuuaccuucuucacuauuucuaca

SEQ ID NO: 4159810 - RNA, 99 nt, Human
uguaagcauucuccuugcuuggcagguuaacuuacaacugucauaacuggcugcaacagugguauagccucuaaacaagagaaauuugcuuuguuuaca

SEQ ID NO: 4159811 - RNA, 71 nt, Human
uguaagguuucucugcagugugaauucugguaugucuugccagguaugaauuacgcacgaaagccuuguca

SEQ ID NO: 4159812 - RNA, 63 nt, Human
uguaaguggaaggaggccacagagaaguuugcuucucuuuagagccuuuccucccgacuugca

SEQ ID NO: 4159813 - RNA, 110 nt, Human
uguaagugucugaauugggaagguuguaccagagagcagcaggaaaccgggaguuccucacgauguuaggcccugcucuguuggucaccugaccaguguauggcaggaca

SEQ ID NO: 4159814 - RNA, 60 nt, Human
uguaaguuuugugaaacaaacauacaaagaaauuugauuuguuuguuagagaagcuucca

SEQ ID NO: 4159815 - RNA, 66 nt, Human
uguaaucauuuacaaacucagcauuguaaggcuuaaaauucuagcgaaggcuguuguaaaguugca

SEQ ID NO: 4159816 - RNA, 64 nt, Human
uguaaucccagcuacucgggaggccgaggcaggagacucgcuugaacccgaggcggagguugca

SEQ ID NO: 4159817 - RNA, 66 nt, Human
uguaaucccagcuacucgggaggcugagacaagagaaucgcuugaacccgggaggcggagguugca

SEQ ID NO: 4159818 - RNA, 66 nt, Human
uguaaucccagcuacucgggaggcugagacaggagaaucgcuugaacccgggaaguggagguugca

SEQ ID NO: 4159819 - RNA, 66 nt, Human
uguaaucccagcuacucgggaggcugagacaggagaauuguuugaaccugaguggcggagguugca

SEQ ID NO: 4159820 - RNA, 81 nt, Human
uguaaugcuuugaaacuucacaagucugauuuuaagauaauggaaugaggcuugcauugugaacuuucuugaugcuuuaca

SEQ ID NO: 4159821 - RNA, 60 nt, Human
uguaauguuagaaacaauugcuggucaaguucaacuuguugcuauuguuuuuaauuugca

SEQ ID NO: 4159822 - RNA, 75 nt, Human
uguaauuauguaguuucauagaacacaguaauggagcugauuuaacugccuacugugcaaauaugcaugaauaca

SEQ ID NO: 4159823 - RNA, 104 nt, Human
uguacaaagcacuauauuggccauccuauuuccgagaaggcacggaagcaaguuuauguacuuuccugggaauguuaaaaugucagcuaggagugcuuucuaca

SEQ ID NO: 4159824 - RNA, 61 nt, Human
uguacacagguagauaaagacuaaaagugaaaaaauguuuaucugcuaucugcugugcuca

SEQ ID NO: 4159825 - RNA, 55 nt, Human
uguacagaacuugcugucccuuaagccggcucagggaugggaagaaauuuguaua

SEQ ID NO: 4159826 - RNA, 69 nt, Human
uguacagccuggucagcggcaucuucugggauccacagaggauccugaccacuaggaccaggcuggaca

SEQ ID NO: 4159827 - RNA, 70 nt, Human
uguacaugaauaaaagaucuuguaagucagaagucacaaaaugauagcaaugggcuguguucagugugca

SEQ ID NO: 4159828 - RNA, 68 nt, Human
uguacaugcauaacauguacauauaaaugcauauauaaaugaguuauguguacaugugugauaguaua

SEQ ID NO: 4159829 - RNA, 60 nt, Human
uguaccauaauguguauuuuaacacuuauuuugcaggaaugguuaaaauuacauggugca

SEQ ID NO: 4159830 - RNA, 59 nt, Human
uguaccaugcuugagauacagugaauacuaaguauuuaaugaauuaaggcaugagugca

SEQ ID NO: 4159831 - RNA, 101 nt, Human
uguacccccucccacccaguuucaacuuuccaguggaaaaauaacucagugauaauaagcaaauuauuuccuggaauggagguggguggguguuguguaca

SEQ ID NO: 4159832 - RNA, 55 nt, Human
uguaccccucuguuucccuuuugucccugggcugccuggaacagcagaggggaca

SEQ ID NO: 4159833 - RNA, 61 nt, Human
uguacucugggauuguuucugguauucccugugggagacaccugagcuaauuccagaggca

SEQ ID NO: 4159834 - RNA, 58 nt, Human
uguacugaauacucuguuaugugggguuuuccuaugcauuguagaauguuuagcagca

SEQ ID NO: 4159835 - RNA, 56 nt, Human
uguacugcauugucuuaauguugaauuuaaaaugagacacaaagcaauggaguaca

SEQ ID NO: 4159836 - RNA, 56 nt, Human
uguacuguauucaucuuuaacugcccugaggaaugcuauuaaaggaauacaguaca

SEQ ID NO: 4159837 - RNA, 106 nt, Human
uguacuugagaauguccacauugucaugacaugguauauuucauuuucaguggaauugcaccauguaagaaauguacgauguuaugcaguauuauucuauaauaca

SEQ ID NO: 4159838 - RNA, 63 nt, Human
uguacuugcuuauuagaaaucuggcuauuuugcucaacauuugaugcacaauggguaaguaca

SEQ ID NO: 4159839 - RNA, 65 nt, Human
uguacuuuagaagaggcaauugaauaagcuaacaaaaauuuuuauguagcauugccucaaguaua

SEQ ID NO: 4159840 - RNA, 73 nt, Human
uguacuuuaucuuguggugggccaguugggccaguuacaaaggucuguggcucagcacggggucaggaauaca

SEQ ID NO: 4159841 - RNA, 94 nt, Human
uguagaaauuuggaaauguagaaaagcagauugaagcauuugaggguauuuucuuugaaguuggucuuucuuuuacauauuugugauuuuuaua

SEQ ID NO: 4159842 - RNA, 56 nt, Human
uguagaacacuugugacaccuugaggucuucagggacacacuccaguguuauuaca

SEQ ID NO: 4159843 - RNA, 65 nt, Human
uguagaacucccagugguauuguucccugauucucacucaccagcagccacugggagugcuuaua

SEQ ID NO: 4159844 - RNA, 72 nt, Human
uguagaaggcggaagguaucaaaaaugaaacuguuguuuccauuauuuuuccaugauacuuaucuguuugca

SEQ ID NO: 4159845 - RNA, 128 nt, Human
uguagacaaaagcaaucaguagagccacaggagaagacacuggguuaggcacguggacucauugucuggagucuacuugccaucagaguuuauuaccuccuucagcaguuacuuuggaaagguuuaca

SEQ ID NO: 4159846 - RNA, 71 nt, Human
uguagacaccuggauuuugcuuagacaugacgugcuaguguaucaacaugugcaaauguccugugguugca

SEQ ID NO: 4159847 - RNA, 55 nt, Human
uguagagauauguguauuuauuuaagguauguaaauuaugucacaugacucugca

SEQ ID NO: 4159848 - RNA, 91 nt, Human
uguagagcuccugcuggauuugaccaaguuggaagguguuuuggacacuacgcggggucaagaguuggucaaauccaaaggaagaaugaca

SEQ ID NO: 4159849 - RNA, 66 nt, Human
uguagaguaauucauggcauuuaaauguugacaucaauacuuacugagugcuaagaauaaucugca

SEQ ID NO: 4159850 - RNA, 86 nt, Human
uguagauugcuuuuaaaggccuugcugagccacucuagaguucuccuauguggacucacaacacgaggguuauaauuccagucaca

SEQ ID NO: 4159851 - RNA, 103 nt, Human
uguagcaagucagguaugagaucuuucaggaaggugaggcacaugagguuaguaccacauuugccaggauuuuccagaaaggcaucuuccugaccuugguaca

SEQ ID NO: 4159852 - RNA, 77 nt, Human
uguggcuuugcaggcauuagcccccauggcugccuucgucggcugggcugguguugagugccuguggcuuuuccaua

SEQ ID NO: 4159853 - RNA, 81 nt, Human
uguggcuuuuccaugccuugcugcuuuggaguccucuguauccagccaguggauaagggaagaggggguagggcagccaca

SEQ ID NO: 4159854 - RNA, 71 nt, Human
ugugggaagcucugccuagauuucagaagauguauggaaaugccuggauguccagguagaaguuugcuaca

SEQ ID NO: 4159855 - RNA, 75 nt, Human
ugugggacaagccacugaguaaucguucuggaaaaaaaccauaaugaacucuucugguuauuuuucuguucggca

SEQ ID NO: 4159856 - RNA, 56 nt, Human
ugugggacagggacagcaagagaagccacugcucccugcacuugucuuugcccaca

SEQ ID NO: 4159857 - RNA, 129 nt, Human
ugugggagcacugggaggggguaggauuccagaaguuggucuugagccaccugcgaggaggggguccaugcaggcuggggaggcagacuuggccgccugggguuacaccugcauccgagaguuccuggg

SEQ ID NO: 4159858 - RNA, 76 nt, Human
ugugggcaaagcuucagguucuguuuugcaggaugcacaaugccuuccccaaguaaagauccugagauguccuaca

SEQ ID NO: 4159859 - RNA, 103 nt, Human
ugugggccuggggugcacacagugcugugcagucugcccucggggauaggccugaggaaggaggcuaagcagcaccuuuucaucguggcauuucaggacucca

SEQ ID NO: 4159860 - RNA, 110 nt, Human
ugugggcgugugcaaggaaucugugaaccgacaggggaagauugugcuuucuucagaacacggcuucuugacuguggguugcagagaaggaaaggucuuugcugccagca

SEQ ID NO: 4159861 - RNA, 61 nt, Human
ugugggcucagguuuaaagugcuuuagccuugcuagccagcugcugaaaccugagaaaaua

SEQ ID NO: 4159862 - RNA, 60 nt, Human
ugugggcuccccuggcauguccaugacagcccuucauggcucacuuccugggagcucaca

SEQ ID NO: 4159863 - RNA, 58 nt, Human
uguggggaggcugcagugcugcuguguagcauuucuuccuggugugagccucuccaca

SEQ ID NO: 4159864 - RNA, 129 nt, Human
uguggggccagaagucaguaucugggcuuaaucacagcucugccaugagccuguccugccaagagcaugugcuguguggucuucaaggcagaguguaguuaaaauguguggggugacuauugucuggca

SEQ ID NO: 4159865 - RNA, 60 nt, Human
ugugggguaguugaugggauaucuggugaacaccacuguuucugccacaauagccccaua

SEQ ID NO: 4159866 - RNA, 110 nt, Human
ugugggucacaguuaccacaugggacagcgcagauagagaacauucuugucacugcagaaaguucuccuggauugugcugcucuagacaguaauugcuguaaaacccaca

SEQ ID NO: 4159867 - RNA, 58 nt, Human
ugugggucccuaaacacaucccaauacuggugaugggugcugcuuuagggggucagca

SEQ ID NO: 4159868 - RNA, 68 nt, Human
ugugggucuggagucacacucaggacagcgggcucugauuuccuggagaacugauucgcggguccaca

SEQ ID NO: 4159869 - RNA, 55 nt, Human
uguggguggagugauauuagcuugauuccaauugcugacuucaugaccacugaug

SEQ ID NO: 4159870 - RNA, 87 nt, Human
ugaucaguuuauuuaagguacagcuagcagcauauucaugauuuugguauguuuuauacacauguaucacuugguuuaaacugagca

SEQ ID NO: 4159871 - RNA, 68 nt, Human
ugaucauguaagccaggugucauuaucaucucuaucuuagugaugaggagacuguggcuuggagguca

SEQ ID NO: 4159872 - RNA, 110 nt, Human
ugaucccaauuuagcccaccucucuaggccucaguuuccccaguugugaagaggaagguaauaaacuuugcauagcucuguaaggcugcuuggagacagcuguaagauua

SEQ ID NO: 4159873 - RNA, 63 nt, Human
ugauccuucuaaugucauagcaucuucuuuaguaaagugguuuaaugaccaauagaaggaaca

SEQ ID NO: 4159874 - RNA, 55 nt, Human
ugauccuucugucaucuuauuuuaaagccagagucuaagguggcagcagguauua

SEQ ID NO: 4159875 - RNA, 61 nt, Human
ugaucucacucacugcacuuugaaauguggggguaauuaggcccucagcugcagugaauca

SEQ ID NO: 4159876 - RNA, 103 nt, Human
ugaucucuggugaagacuacuguugcacucauaugaagcugugccuuuugcccagaaaaucgugcaucuuugugugaacaguaugucauuucacaauuuguca

SEQ ID NO: 4159877 - RNA, 55 nt, Human
ugaucuguauagggacuagccaugcagcugaggugggcuggggccugaccagaca

SEQ ID NO: 4159878 - RNA, 66 nt, Human
ugaucuuaauuacccaaugugguaggcauggucuuguugugauuaagauuguggugauuacaguca

SEQ ID NO: 4159879 - RNA, 63 nt, Human
ugaugaaauuuuaauuauaccucuaauucaaggauagagggagaggagaauuggauuucguua

SEQ ID NO: 4159880 - RNA, 67 nt, Human
ugaugaaucuugggaauuuuccaggagugacaagaaaauuauuacucccuccuucccagcuuccuca

SEQ ID NO: 4159881 - RNA, 85 nt, Human
ugaugaauuauauagagacaauuuucugucauuaguaauguagggcagaagacaauguuucugauagauagauguaaauucauca

SEQ ID NO: 4159882 - RNA, 75 nt, Human
ugaugacaucagacuuuugggaggucuguggccacaguuuaauuugaaaguuacaguuagaaucugaugaaauca

SEQ ID NO: 4159883 - RNA, 64 nt, Human
ugaugacaugugggcuguggcuagcaugaugccaggucauauagagugcucagccaugucguua

SEQ ID NO: 4159884 - RNA, 55 nt, Human
ugaugacuguucuuccuguugccuucagaccuggcauuaggauuuuaggucauca

SEQ ID NO: 4159885 - RNA, 75 nt, Human
ugaugaggaagucaggggaucuagacuugaauaaacuccauuaauucaagucucucuucaaacgucaccucuuca

SEQ ID NO: 4159886 - RNA, 66 nt, Human
ugaugaggacugggacagguacgugcacccugugcuucaccuaacugccugugccgaucucucuca

SEQ ID NO: 4159887 - RNA, 77 nt, Human
ugaugaggauauacucugagaaacgugucacuggguaauuuugccauugugcaaacaucauagaguguacuuacaca

SEQ ID NO: 4159888 - RNA, 56 nt, Human
ugaugagggagauuugagcccaggaauagggacuggguuuccuauuuaccuccuca

SEQ ID NO: 4159889 - RNA, 75 nt, Human
ugaugauguacuaguuaaauauuacuguguaacaaaucaccacaaaacuuagugauuuuaaaaaguaaguuauca

SEQ ID NO: 4159890 - RNA, 73 nt, Human
ugaugcaaagcaccacacuaagaugaguuucuuuaaccuucauguauuuauuuuguuaucagggcuuugcaca

SEQ ID NO: 4159891 - RNA, 57 nt, Human
ugaugcaauguuuacaucuugauggagguuuggguacauagauguaagcauuuguca

SEQ ID NO: 4159892 - RNA, 57 nt, Human
ugaugccaccaccuccagggagacuuccagggucuccuccaguaggaaguggccuca

SEQ ID NO: 4159893 - RNA, 74 nt, Human
ugaugcuaucaacucauuuguuuggcucaguugagcaaauauuaacugagggccaaaggcacugaguaggcaca

SEQ ID NO: 4159894 - RNA, 78 nt, Human
ugaugcuauggaauucaaauauuaaacacgacgauguugaugauuguucugcuuaaauuauugauccucgugggauca

SEQ ID NO: 4159895 - RNA, 56 nt, Human
ugaugcuauguccugagcuucuccugaacacugagguccuggacauaugugcauca

SEQ ID NO: 4159896 - RNA, 82 nt, Human
ugaugcuggcuuuucuuauuucccccuucaucaugguaagccuacuauggugaaggggggagcuaagaaaagcaggguauua

SEQ ID NO: 4159897 - RNA, 80 nt, Human
ugaugcuuaacagacuugggauuuucuagcagccucugccucucugccuggagauuuuccuacaguuuguuuuugcuuca

SEQ ID NO: 4159898 - RNA, 71 nt, Human
ugauggaaauaaaagcauagcuaguuucaaagguucccuugaauaaucauucuaugcuuaaguuucucuca

SEQ ID NO: 4159899 - RNA, 84 nt, Human
ugauggaggcagaucaacagugaagagaucaagagaggaaaugcagaaacugguucuagaccuggcacugcccugucuguguca

SEQ ID NO: 4159900 - RNA, 61 nt, Human
ugauggcugugcugauguuagggugaaaugguguuaaucuugucauuagcacaguguguca

SEQ ID NO: 4159901 - RNA, 56 nt, Human
ugaugggaggugcugcaggaccaccacugcgguaagguuucugcaaaccuuguaca

SEQ ID NO: 4159902 - RNA, 76 nt, Human
ugauggguauguucauuugcuugauaguaaucaguucauuaugucuaucaagauaagucaguauaucaaaacauca

SEQ ID NO: 4159903 - RNA, 71 nt, Human
ugaugggugagaaauuugggcuggaauguggucuucccgaugugccaguguucauaauuuuacacucuuca

SEQ ID NO: 4159904 - RNA, 62 nt, Human
ugauggucaggaugcauggagaggugauggcaagcacucaagucucagcgcugugaccguca

SEQ ID NO: 4159905 - RNA, 57 nt, Human
ugauguaagucuugacuuccuccagugugaaauggagaaggaaggauaacugcauua

SEQ ID NO: 4159906 - RNA, 81 nt, Human
ugaugucacugacuuaauauauuucugcuaagcucaacauauauguugaacuguggccaguaauuaauguuggugguuuca

SEQ ID NO: 4159907 - RNA, 57 nt, Human
ugauguccucaugucaagcuccagagccccuuggaggcaucugccuguaggacauca

SEQ ID NO: 4159908 - RNA, 64 nt, Human
ugaugucugcuauucauagggaaagagaacguagcaauccauuucucaaagaguggcagcuuca

SEQ ID NO: 4159909 - RNA, 73 nt, Human
ugaugugagcuugagaucuuagugaaaguguaaaaauguuucacauacacuaggauauuuuuuucucauguua

SEQ ID NO: 4159910 - RNA, 128 nt, Human
ugauguuuauucucuacuggucaguuauguaacuuucugaugucuucccauguucaugugugucccagacuuauauaaugucagcaugggaagacaaugaguuaucuggcagcaacaaaacggcauua

SEQ ID NO: 4159911 - RNA, 92 nt, Human
ugauuaauuucccauguucuaacaaugagaaaccuaauacagggaggaagaguggguuuugcaggguuaggcauaucugagggagauuuaca

SEQ ID NO: 4159912 - RNA, 55 nt, Human
ugauuaccaugugcuaugugccugcugggcacugcagaacauacacuggugaaca

SEQ ID NO: 4159913 - RNA, 80 nt, Human
ugauuaucucauccuucaguggaagacaguagcagagacauuugcucugcuggccaugaagagagaauuugggaucugca

SEQ ID NO: 4159914 - RNA, 104 nt, Human
ugauuauuaaaugauaaaauaagugugggccagucaaagagguucugacuuuuuuuccccagaauggccauuuucaacauauauauuuuuaauuugaauaauca

SEQ ID NO: 4159915 - RNA, 93 nt, Human
ugauucaauaaauuuaacaauuuugucauuguucaugccaaagaaucauuuuaauaggcauuuuaggugacagugguuaaaauuuguuaauua

SEQ ID NO: 4159916 - RNA, 58 nt, Human
ugauucaguacuuucucuaacuuuauugcacaauaguagugaguagagcacugaguca

SEQ ID NO: 4159917 - RNA, 76 nt, Human
ugauucauuuuauuucugacaaaaaaagacaugaguauaauuucaugguuuuagaaucaggaaaaaaagugacuca

SEQ ID NO: 4159918 - RNA, 56 nt, Human
ugauucuauuacaggaaagggucccaauccagaccccaaaagaguaauagaauuca

SEQ ID NO: 4159919 - RNA, 57 nt, Human
ugauucugcccuuucuucugacauuguuugagagaagucauuuugggggcagaauua

SEQ ID NO: 4159920 - RNA, 115 nt, Human
ugauucuuaugcaaagagagggccggggucagggucuguuguuuguucuggaaaagcuuguaggauuuucaccagaccuugugaccuuuggggacauuuuuuuugugugugauca

SEQ ID NO: 4159921 - RNA, 103 nt, Human
ugauucuugugggggaugaagacauuaaauaaagaagcaaaugguuguauuaucuuacccguuugccucuuuauuuacugucuucauacccuguaagaaugca

SEQ ID NO: 4159922 - RNA, 73 nt, Human
ugauugaaauagauacagaaguaugauuuucauaucaccuuggggauacauaaaaaugugcucuauccaauua

SEQ ID NO: 4159923 - RNA, 60 nt, Human
ugauugccuacuaugugccaugcucuguuccaggcuuuaagggugcagugguagcaauca

SEQ ID NO: 4159924 - RNA, 68 nt, Human
ugauuggcaagggauuguggagaacugaggcauuugccuacuagacuuccaccucccuggccuaguua

SEQ ID NO: 4159925 - RNA, 61 nt, Human
ugauuggcagggcuggaaucugaacccaggcagucuggggccagagcccacuuucuuauca

SEQ ID NO: 4159926 - RNA, 67 nt, Human
ugauuguaaacaguaggacuaaagagaaggaaaauauccuuccuuucauuuacacugcuuacuuuua

SEQ ID NO: 4159927 - RNA, 65 nt, Human
uguguuuucuccuaagacccuucaccaagguugcuggggugaagggccuuaggagacagaucaca

SEQ ID NO: 4159928 - RNA, 71 nt, Human
uguguuuuguucauugcuguauuuguagcacccagcaugcugacuaauaccuuuucagugcacaaaaaaua

SEQ ID NO: 4159929 - RNA, 77 nt, Human
uguuaaaaaaaugacuguagucauauuaaggaauaaaaggcuccauggcuaccuaaugacugcaaguuauuucaaca

SEQ ID NO: 4159930 - RNA, 80 nt, Human
uguuaaaaagauguaguaucuauauuucauggucuugcacagagagccucaugacauucaggugcuacaucauuugaaca

SEQ ID NO: 4159931 - RNA, 76 nt, Human
uguuaaaugcagucucaggcuggccugggagccacucagaccguccacaggcaagauccagaggcugcugucugca

SEQ ID NO: 4159932 - RNA, 67 nt, Human
uguuaacuccauacuuuuuauucuuguguuagucuuauaaugagcauaaaauauuaguaugguagca

SEQ ID NO: 4159933 - RNA, 72 nt, Human
uguuaaggcaauguuagcaacauaauaauagcaauauaggggcucauucugugccuggcauuguccuaaaca

SEQ ID NO: 4159934 - RNA, 68 nt, Human
uguuaaggcucuuguuuaugucuuaguaucccugaauuaggacgugucacaugaacagggcuacagca

SEQ ID NO: 4159935 - RNA, 66 nt, Human
uguuaaguaccuuauugauuccaaagaauucaucagagagaaauggaauaauaagguacauuaaca

SEQ ID NO: 4159936 - RNA, 55 nt, Human
uguuaaugagugggcuguggagaaggaagcuuuucacaacacaaucucguuaaga

SEQ ID NO: 4159937 - RNA, 70 nt, Human
uguuaauuaagaucucauugccuuggggugaguacauugcugcaagaauaaaauugaggucuuauuagca

SEQ ID NO: 4159938 - RNA, 72 nt, Human
uguuaauucaucacgggaaauaugaaagaguaccuccaauucuuuacacauuauuuucaguguguuuugaca

SEQ ID NO: 4159939 - RNA, 57 nt, Human
uguuacaggaaauagaauuaccuuaacuaauguuaagguagcuucccuucuggaaua

SEQ ID NO: 4159940 - RNA, 72 nt, Human
uguuacaggcacugaaaugcuuauuaauacauaauauggauaaagguuagaguauuaaagugccuugaaaca

SEQ ID NO: 4159941 - RNA, 92 nt, Human
uguuacaugauguuugaaaauuuuuacuggguuaucuguaauucuaaauagacaugccaagaaacccaguggcuucuaagcagcauguauca

SEQ ID NO: 4159942 - RNA, 86 nt, Human
uguuaccaacaccaauaacuuguacacucuggagacguucauugaauguuucaugacugagcaaaauuuauuauuguuuucugaca

SEQ ID NO: 4159943 - RNA, 77 nt, Human
uguuacucauaauguaguucauggcuggcuguuuuuugccucagcuucuacugaaauugcaauuaucauggucaaca

SEQ ID NO: 4159944 - RNA, 61 nt, Human
uguuacuggcuugugagacaaugccugaugagaagucagguacauucgugugccacugaua

SEQ ID NO: 4159945 - RNA, 64 nt, Human
uguuacuucugaccccccagccccagcaaagcaggaaguggggccuggguggagaggggugaca

SEQ ID NO: 4159946 - RNA, 63 nt, Human
uguuagacaugcagaaucucaggcaccauccagaacugcugagucugaaucugcauuuucaca

SEQ ID NO: 4159947 - RNA, 69 nt, Human
uguuagauaaacugaagggaacacugaggacaaggagcuuuuguucuaccuucuguuucagaucuagca

SEQ ID NO: 4159948 - RNA, 55 nt, Human
uguuagccauacuaagcagguacgcacaacaacgugauugcuuuguaagcuugca

SEQ ID NO: 4159949 - RNA, 72 nt, Human
uguuagcugcaucauuugaaaacugcagacaucgugacauuucacuucuguacacuucagcaugcaucuuca

SEQ ID NO: 4159950 - RNA, 119 nt, Human
uguuaggaaaauugagaaaguuugccaugaguuaaaucacccaucuccuaaucugggcuccuaucagauugcaaaaugggugauuuaauucaugggaaacuuucucaguuuucccaaca

SEQ ID NO: 4159951 - RNA, 92 nt, Human
uguuaguauuguucuuuaauaggugagcuuaucuccuauaauggcuaaaugaugucauuggaauuugcuucagcuaauaacaguaugcuaca

SEQ ID NO: 4159952 - RNA, 124 nt, Human
uguuauagucagaaaauauagucuauuggggcaguaaucaacacaacuaaguaauauugucauuugagcaauuuaguguguauugcuauuauuuccaacagcauaauaguuuuccucugaaaua

SEQ ID NO: 4159953 - RNA, 98 nt, Human
uguuauguauuagauugcuacaaaaguaauugugguuuuugccauugaaaauaacggucaaaaccgcaauuacuuuugcaccaaccuaaguauaagca

SEQ ID NO: 4159954 - RNA, 67 nt, Human
uguuauguucuuagaagaggcagcagagaguucauucacucucucuucucuguaugaggacauagug

SEQ ID NO: 4159955 - RNA, 116 nt, Human
uguuauuauaacuuuagauauugauauuccuaaugcuaaaauggcacuaaaguuaaagauaagacuauuuugugucauaguauagaguaauuguuaguacuuaaguaauaauaaua

SEQ ID NO: 4159956 - RNA, 75 nt, Human
uguuauuuacagaugaggaaacugaggcacagagguaaaacaacuuugcugaggucaccuugcugcuaagugaca

SEQ ID NO: 4159957 - RNA, 69 nt, Human
uguuauuuauuucaccuccagaauaauuuuaauuuaagauauauuuggaauugguggaggaagggaaca

SEQ ID NO: 4159958 - RNA, 75 nt, Human
uguuauuuccuuugauucagugugaguauauuacaugaacauuuuauucacacuguauacacaggaugucaaaca

SEQ ID NO: 4159959 - RNA, 58 nt, Human
uguuauuugucuggucuaaggagggacuuccaggcccucugcauacaggcgaggagca

SEQ ID NO: 4159960 - RNA, 62 nt, Human
uguuauuuugucaguguggagaauaguucaaaaagggccuuugcucacauuauaauguaaca

SEQ ID NO: 4159961 - RNA, 66 nt, Human
uguuauuuuuaaaccuugggcacguauuacuauuaaagaaaaacuggccuagggguugggaaagca

SEQ ID NO: 4159962 - RNA, 68 nt, Human
uguucaaaucuuuugcuuauuuuguguuggguuguuuuucuccuuccugaguaguaaggguuuggaua

SEQ ID NO: 4159963 - RNA, 56 nt, Human
uguucaacagagccuucuggggcaauggaaauguucuagaucugcacuguuggaca

SEQ ID NO: 4159964 - RNA, 55 nt, Human
uguucaaguggauguggcuuuucuuguuugagaagagcucacuaaggcuugaaca

SEQ ID NO: 4159965 - RNA, 58 nt, Human
uguucacacagucuauacggauggccugggacuggcugccuuuuauggugucugaaca

SEQ ID NO: 4159966 - RNA, 64 nt, Human
uguucagcagcugcuuugugcagaaccugcugaggucagcagcugcccuguagcuguucuagca

SEQ ID NO: 4159967 - RNA, 56 nt, Human
uguucagcccugaaaauauaugcauuuugugccauuguuuucuaaagggcggauca

SEQ ID NO: 4159968 - RNA, 82 nt, Human
uguucaguauuugaagccaagaagugaguaauaguauauuugugugcacccacuuguguauuugauugcuuugugcugaaca

SEQ ID NO: 4159969 - RNA, 77 nt, Human
uguucaguccccuuucauuugcuaguggcagaaacccaaccggauuagcuguugugaaagggguguugacugguuca

SEQ ID NO: 4159970 - RNA, 101 nt, Human
uguucagugacuugcacaccaguuuugauguggacaucaaacacaacuacuuaaugagaugccacaaaacugugugucaaagaacaugucaggacugaaca

SEQ ID NO: 4159971 - RNA, 78 nt, Human
uguucaguucccccucuguugcacguuugcaauuugccuuaaugagaacugcccaugugcaucaaguagaaucgagca

SEQ ID NO: 4159972 - RNA, 58 nt, Human
uguucauacucuucccugggcaaagcuaucuuuuguuugccuaaugaagacuauguca

SEQ ID NO: 4159973 - RNA, 57 nt, Human
uguucauggauccaguggcuucauguauaucugguagcuacaacuuuuccaugagca

SEQ ID NO: 4159974 - RNA, 71 nt, Human
uguucauuacugcuguuugccacugugacauucauuccuauguaugaaggugcagggagcaauugugaaca

SEQ ID NO: 4159975 - RNA, 130 nt, Human
uguucauucagaugaguaaauguguccuuagugaaggcugucaccugcaccuuucaucuguguuacugcugugcuccugcuaggguuaggggcugccauuauuaaaugcugaccucauuuggaacugcca

SEQ ID NO: 4159976 - RNA, 57 nt, Human
uguuccaggauggagacacuaguaguucucacgguuuugcuagugcacguccgaaua

SEQ ID NO: 4159977 - RNA, 67 nt, Human
uguuccaucuguguacaggcagcaaacaccauaaaugucugaucauuuggccugauaucuuggagca

SEQ ID NO: 4159978 - RNA, 79 nt, Human
uguuccaugccaaauuucuuucuguucugaugauucaaaccuuagcagucagacagagcugaacuugguccugguaaua

SEQ ID NO: 4159979 - RNA, 64 nt, Human
uguucccaucagggaugagggugcugaaguauuuacaacugcaccaucagucaugauggggaua

SEQ ID NO: 4159980 - RNA, 64 nt, Human
uguucccauggauaucugcauacaagucuuuguguggacauauguuuuaauaucucugggagca

SEQ ID NO: 4159981 - RNA, 106 nt, Human
uguucccaugucagaagccaucucuagguaucaauuaagguuugggagagagcuugcagccauaucucugcuaagauugugucuagugguguuggugaugggaaca

SEQ ID NO: 4159982 - RNA, 78 nt, Human
uguucccuggguuauuuuggucuagugggagucugucaauucuagggcauuuggaccaaaauagccaacagcgggaca

SEQ ID NO: 4159983 - RNA, 86 nt, Human
uguuccugcaagcaccuggcacggcuagcuucccuccucccuggcugcaggauugugaggugguugugcacggagcugcaggacca

SEQ ID NO: 4159984 - RNA, 71 nt, Human
uguuccugguucucauuagcuucccauuagaauacaguaaggcuagcaagaugagaauaaucuuuggagca

SEQ ID NO: 4159985 - RNA, 57 nt, Human
uguucgcaugucuagcucuaccuuucagggaaagggcucaauggugggcauguagca

SEQ ID NO: 4159986 - RNA, 66 nt, Human
uguucuaaauugcuagcuggaacauaguaaauacuuuaagaguuaugucucuggcaguucagagca

SEQ ID NO: 4159987 - RNA, 58 nt, Human
uguucuaaauuugcaugguccaauaugguagccaccagcgacacaaggauuuagggca

SEQ ID NO: 4159988 - RNA, 65 nt, Human
uguucuaagcugccaaaaugcucagguagacuuacguaagcaccugcuuuggcuguucaagagca

SEQ ID NO: 4159989 - RNA, 63 nt, Human
uguucuacaccagugaaaauuagcugcaccuuccucuguagcugccucugcugguuuagaaua

SEQ ID NO: 4159990 - RNA, 59 nt, Human
uguucuccuggauucugaagggccuggcacaucagagccugaagggacuccagagagca

SEQ ID NO: 4159991 - RNA, 86 nt, Human
uguucucugugugcaacaaauaguccugauuuaaucuggggcagaaaauccccuagcuuugccagugaucugcuuguuggagaaua

SEQ ID NO: 4159992 - RNA, 59 nt, Human
uguucugcagagaagggaucagggcccuaaggaaccccaggauccuggcugcauggacg

SEQ ID NO: 4159993 - RNA, 83 nt, Human
uguucugccccacuguuuccuuucugcuggcuggccugcacacuagccugccuuugugaggaagcggcuguuaagcagacaca

SEQ ID NO: 4159994 - RNA, 93 nt, Human
uguucugcucauuuuuguccuugaugaauaugaaauugcuauaaugacauuuacaauuuuauuaacucauuaaacagagaugugugaggaaua

SEQ ID NO: 4159995 - RNA, 60 nt, Human
uguucugggcccauucugcuggauaguaacuaagugauuaaugccaaugggccuugggca

SEQ ID NO: 4159996 - RNA, 59 nt, Human
uguucuguaccuguccuggggcaccucgccgcccaccagcuggaccacgguggggaaca

SEQ ID NO: 4159997 - RNA, 104 nt, Human
uguucuuauggucgugaauaagucucaugagagcugaugacuuuacaaggggcuuccccuuucacucagcucucauugucucuugucugcucccauguaaugca

SEQ ID NO: 4159998 - RNA, 65 nt, Human
ugggucuuugggcagaugugucugaaucuacaaaguucacugccaggcucucauccagggaccca

SEQ ID NO: 4159999 - RNA, 61 nt, Human
ugggucuuuuugcuuucagcucuacccaaauuccuaacagaaggaagcccuaaaggaccua

SEQ ID NO: 4160000 - RNA, 130 nt, Human
ugggugcugggggguugaggggggcgaggaggcagcuccuccugcaggccugggaggagagggagcuuugguuucccaaagccuggggugagugcugcugaaguuaugugacccggccuuggccaagcua

SEQ ID NO: 4160001 - RNA, 90 nt, Human
ugggugcuuauagagauagcaguauugauucgcuagcaacagcucuucgcucauagcuaugauccaaugagcuucucuggugguuuccca

SEQ ID NO: 4160002 - RNA, 72 nt, Human
ugcuaccauucaucauuaguuguggaauucuugaaacucaaaaacuucagaguaucuaacugauggguagca

SEQ ID NO: 4160003 - RNA, 60 nt, Human
ugcuacuuccaggaaugcugaggcauggucugcauucaacaguguuccggaagacuggca

SEQ ID NO: 4160004 - RNA, 108 nt, Human
ugcuagacagacaguaggaggccucuacucauggauaacccccuggauagaagaaacuaccccaggucaucugagaguccuaucuuccuaacuguguaccaccuagca

SEQ ID NO: 4160005 - RNA, 68 nt, Human
ugcuagagauaccguagucaacuaaaaguggaggcuuccacccacuagaacaucggugucuuggagca

SEQ ID NO: 4160006 - RNA, 62 nt, Human
ugcuagauuuguccugcuuucuaccucccaguaaacaguguacagaggucgggacagaagca

SEQ ID NO: 4160007 - RNA, 57 nt, Human
ugcuagcucacccuugccucccaacagcccugugagggcaugagagggcagcuggca

SEQ ID NO: 4160008 - RNA, 81 nt, Human
ugcuaggcagcuuucuggugcaccauaucuguuaagcuagaaugucauggaaaugagugucacugaugaaagcugacagca

SEQ ID NO: 4160009 - RNA, 64 nt, Human
ugcuagugcaggguuuucaguucuauauagguauaaucaagccacugacugccucugcagugca

SEQ ID NO: 4160010 - RNA, 79 nt, Human
ugcuauaaacuccugcauacucagaagccauauaguuuguuugcuuuuaagcuuuuuuaguggcaguguugcuauagua

SEQ ID NO: 4160011 - RNA, 87 nt, Human
ugcuauaaauguauaaucagcagacuuacuagaauguaagcuccagggaguuggaaauuuugucugcucuuuuuuaucaugauggua

SEQ ID NO: 4160012 - RNA, 58 nt, Human
ugcuauauaauggaauuucuaaccuagaagagaguguagaaaaucuugguauauagca

SEQ ID NO: 4160013 - RNA, 55 nt, Human
ugcuaucaccaacucugcuaagugaucaaguuucauggcacauguaaugauagca

SEQ ID NO: 4160014 - RNA, 57 nt, Human
ugcuaucucagauaaccugcaccaaugcacuucuucgcugggcaccauugagaagca

SEQ ID NO: 4160015 - RNA, 90 nt, Human
ugcuaugaaacagcaucaagugcuacagagaaaucuuucacgaaagaaagaggcaaucaauguagcaaacuucauuguugucuuauugua

SEQ ID NO: 4160016 - RNA, 97 nt, Human
ugcuaugauggugguggcgggggccggggaggcuguccugggcacuguacacuguugagcagcauccccggccuccacccacuggaugauuguagca

SEQ ID NO: 4160017 - RNA, 68 nt, Human
uguucuagcaacacaguuuuggaaaaaacuacaaucucauuauuuccaaaauuaaugaagcaaggaca

SEQ ID NO: 4160018 - RNA, 105 nt, Human
uguucuaucuuuuaaucuggugguggguaaauggguguacguuauuauuacuuuugaaaguguguacauaauuguacgcccucuuucauaucaugaagaugugcg

SEQ ID NO: 4160019 - RNA, 89 nt, Human
uguucuauggccuguuuccucugaaagaaucugacuguccuggaaucuuggcacaugaaggguccuucagaggacggcagccaggaaca

SEQ ID NO: 4160020 - RNA, 60 nt, Human
uguucucaguaauucuauuuuaagggggcuaucuuuucuuucuaaugcuuaccgagaaca

SEQ ID NO: 4160021 - RNA, 58 nt, Human
uguucuccaaggagaggacagucuuaggcucauuauaagcugcuucaccuggacaaca

SEQ ID NO: 4160022 - RNA, 57 nt, Human
uguucucgcucagaccuuagcaguaaaaagccaacuguacaacugcugagcagaaca

SEQ ID NO: 4160023 - RNA, 59 nt, Human
uguucucguuucugaagaaaaguauuauggagagguccgacauucacaggagcagagca

SEQ ID NO: 4160024 - RNA, 110 nt, Human
uguucucucauuacgggacugaaaauguaugcugucuuacaugaaugcaguugguaaacuguggauuuacuugagaagcuuugcauuguuaaguuuuccaugaaagagca

SEQ ID NO: 4160025 - RNA, 67 nt, Human
uguucuugccuggauucgguuguugucauuuuccacugaauguaaucacagggccaugguaauaaca

SEQ ID NO: 4160026 - RNA, 64 nt, Human
uguucuugggaaucuuacaguuugguuaaaaauguuaauacuguacauauggauucuaagaaca

SEQ ID NO: 4160027 - RNA, 81 nt, Human
uguucuuuauuucgaaagugcucagcaggugcaaagaauagauauucaguaaccauuuguugggacaaugaaaagagaaua

SEQ ID NO: 4160028 - RNA, 79 nt, Human
uguucuuugaauaauuagugggacagagaacaaugguugaaaguuauuguucagugucucucuauuuuauaaaugaaua

SEQ ID NO: 4160029 - RNA, 57 nt, Human
uguugaaguaucgcucugcucugcuaacaaccacagccaggccugaggauuucagca

SEQ ID NO: 4160030 - RNA, 71 nt, Human
uguugaaucagaggcugugaaaaucaagggcaaauauuuaucuaaagaugucacaacuuugaauuucaaua

SEQ ID NO: 4160031 - RNA, 61 nt, Human
uguugaccuagaaaaugacugcucuuuagcacaacauugaaggcagcaggauccagggaca

SEQ ID NO: 4160032 - RNA, 74 nt, Human
uguugagcagcagguuguuauugacuuuuuauuuccaacccagagauuuugaaaguaacauuuuguuguuuaca

SEQ ID NO: 4160033 - RNA, 68 nt, Human
uguugcaaugaauccucuugacaguuauccucugacccauggaacuggagagaauguucauugcagca

SEQ ID NO: 4160034 - RNA, 62 nt, Human
uguugcauguggcuguuugccaaggcacacaaagugcuuguaggcagcaaccauaugcuaca

SEQ ID NO: 4160035 - RNA, 64 nt, Human
uguugccaggcuggagugcaauggggcaauuuuggcucaaugcaacuuccaccucccaggcuca

SEQ ID NO: 4160036 - RNA, 67 nt, Human
uguugcccaggcuucagugcaguugcaggaucauagcucacuguagcuuugaacuucugggcucaca

SEQ ID NO: 4160037 - RNA, 77 nt, Human
uguugccugucuuuauuucacuuuacugcugguacauuuugcugcagaaauauggaugugauagauuaugggugaca

SEQ ID NO: 4160038 - RNA, 63 nt, Human
uguugcgagaaauacuuuaaagcagaagcuuaauuacauagugcucaaguuucucuggcaaca

SEQ ID NO: 4160039 - RNA, 55 nt, Human
uguugcuaaggggaaugagagcccaaguggggccagauguuccaguuuggcaaca

SEQ ID NO: 4160040 - RNA, 67 nt, Human
uguugcuggugacgaagcuggugcuaaaacacuuaucccucugagucagcauuuucacugagcuaca

SEQ ID NO: 4160041 - RNA, 95 nt, Human
uguugcuucuggagccuagauuuguuuugccaucucaguuuucuuaggucccccuuccuguuuaccacugaggggcagcugggccaggagcagca

SEQ ID NO: 4160042 - RNA, 100 nt, Human
uguugcuugcucagcuuagcuuacuauuuuaaccaaaaguuuggaagccauagcuaaugaagguauccaaaaaacguuugaauaguugcuguaugcaaua

SEQ ID NO: 4160043 - RNA, 100 nt, Human
uguuggaacacugccaggcacauucauuuaugaaauaucuauaucugcuuuuacgcaaugguagaguugaguagcaugaacagugaccauguggccagca

SEQ ID NO: 4160044 - RNA, 68 nt, Human
uguuggaauaagugcuugaaggaguuuuucuaaugccucuuccucucuuuugucaacugcauccagca

SEQ ID NO: 4160045 - RNA, 91 nt, Human
uguuggaauauugagucauuuuuuucguaauaguggcuuugcugccugaaacaaagaauagccaaaugaagggaugagcaguuuuccagca

SEQ ID NO: 4160046 - RNA, 57 nt, Human
uguuggacacuaccauaugggugucccaccaaccccacuugcucagcauguccaaca

SEQ ID NO: 4160047 - RNA, 57 nt, Human
uguuggagcccgagucagggagacuguggguggucugcuuguucuccagcuccagca

SEQ ID NO: 4160048 - RNA, 96 nt, Human
uguuggccaggauggucucgauaucuugaccuugugaucuguccaccuuggccucccaaagugcugggauuacaagcgugagccaccgauauaaca

SEQ ID NO: 4160049 - RNA, 73 nt, Human
uguuggcuguauguacuacacuagaacauuuguggauaauuacauaagcuuagcugugguauaauaaauaaca

SEQ ID NO: 4160050 - RNA, 78 nt, Human
uguugggcacuuagggaaucuuagagcuggaaggaugcaauagagucuccaucuuuucaccuggcuguaaccccggca

SEQ ID NO: 4160051 - RNA, 59 nt, Human
uguugggggcggcggggagaggcugagacugucuggaaggacccugccagcucccagca

SEQ ID NO: 4160052 - RNA, 82 nt, Human
uguuggguugaauaauauaauauugccauuuuuaugucaaaaaugaucaacuaucagcaauguuaugugguucaacuuaaua

SEQ ID NO: 4160053 - RNA, 60 nt, Human
uguuggucaggcuggucucaaacuccugacaucaggugauccaccagccucggccucuca

SEQ ID NO: 4160054 - RNA, 69 nt, Human
uguuggucugaauaccuacauagagacuggugauagugggacaucagccucagguguucagauuuucca

SEQ ID NO: 4160055 - RNA, 68 nt, Human
uguuggugaaaucuucacagagaaaauuagggccaagcauggcuuuaugaauaugauuuuaccagaca

SEQ ID NO: 4160056 - RNA, 71 nt, Human
uguuggugcagggagaaucagcccauggacacaacccacuccuccuccucuggcuucacucugcaccacca

SEQ ID NO: 4160057 - RNA, 58 nt, Human
uguugguuugcuuggauugagucacugcucuaugugacuuugugcaagugaauuauua

SEQ ID NO: 4160058 - RNA, 95 nt, Human
uguuguaagguaaagcuuuaaaugaguuaauaaaugugaagugcuuagugcaacacucagcacacaguauuagccauuguuacuacuuuagaacg

SEQ ID NO: 4160059 - RNA, 59 nt, Human
uguuguagagaagaaauuaaaauucagguuacuggauuucuaguucauuaucuauucca

SEQ ID NO: 4160060 - RNA, 78 nt, Human
uguuguauuuggaacuuguucugugcaagaacagauuuuggaacuuguucugugcaagaccaacuuucaaauauugua

SEQ ID NO: 4160061 - RNA, 81 nt, Human
uguugucaccuauucugcaugauauuaaauguaaaauugccagcauuuuugucauuucucagcaugaaauugguggaaaca

SEQ ID NO: 4160062 - RNA, 63 nt, Human
uguugucaugcagucagugguaugugaauuuuaggguuuuauuagggaacugcaagacuaaca

SEQ ID NO: 4160063 - RNA, 71 nt, Human
uguuguccucucuguuaugcuuucaugaagauccacccaucuucucgaacaaccuacaggguggaacagca

SEQ ID NO: 4160064 - RNA, 62 nt, Human
uguugucugcuacuagguagagugaauauggcugacauaauuacucuaccagggcagcagca

SEQ ID NO: 4160065 - RNA, 71 nt, Human
uguugucuguugugugugcuaucauaucucuagugucuagaaugugccuggaauacaguaagcacucaaca

SEQ ID NO: 4160066 - RNA, 80 nt, Human
uguuguguggguuaauuaguguuccuaaaauauugaacauuauuaaauguaguuagaagcacuaauuacucacauugaca

SEQ ID NO: 4160067 - RNA, 59 nt, Human
uguuguuagcaaagcaaagguuaagaaacaaaagaugacucuguguuuugguggcagca

SEQ ID NO: 4160068 - RNA, 56 nt, Human
uguuguuaucaggacuggaaacaacauaaaguuuucauauguugcugaaaacagca

SEQ ID NO: 4160069 - RNA, 128 nt, Human
uguuguuggucaucucaggaacuagauaucagaguaaacacauuuugccuaggcaauaagaaaagcuauguagcuaagugugaaaugcccugaguacuuuuguuugguuuauguugaacaguacagca

SEQ ID NO: 4160070 - RNA, 120 nt, Human
uguuguuuaagcuacccaguuugucauacuuugucacagaagcccucgcaaacuacuacauaagugguccauguccauucuguccuagcaaauaggcaaacuucuuuuguuuugaugaca

SEQ ID NO: 4160071 - RNA, 108 nt, Human
uguuguuuaagcugcccggucugugguacuuuguuauggcagcccaaguaaacaaauacagucaucugcugcuggaacaaaucaccccagcacuguggcuuggcagca

SEQ ID NO: 4160072 - RNA, 62 nt, Human
uguuguuugugugugugcgcgugugcgcaugcacaugcguguuuguauacacacaaaaaaua

SEQ ID NO: 4160073 - RNA, 92 nt, Human
uguuuacagagacagauuaauuuuuuucagcuuuuauuuucucuuugggagcuuaguuuacaaaugaagggagcugaagucuucucuaaaca

SEQ ID NO: 4160074 - RNA, 55 nt, Human
uguuuacauaucauuucagguccuguguucccaggauggagacugagagugagca

SEQ ID NO: 4160075 - RNA, 86 nt, Human
uguuuaccguagcauucucugugagcgugauaaauggguauccagcuguguggaaccuaugaacucuuggugugcugaccuaaaca

SEQ ID NO: 4160076 - RNA, 97 nt, Human
uguuuacugaguccauaguaugugccacaccuaauccuguguacugaagcuacaagaguucaaaggaaaggcagugucaacuauugugcaguuuaca

SEQ ID NO: 4160077 - RNA, 129 nt, Human
uuaagucaaggagaaaagucagaggaaaaugggcagguaauaguggaugaggagaacaucuaaaucagugggguucuuaacauugucugcacaucaucugugacauuuuuaaaaccacuagugacucga

SEQ ID NO: 4160078 - RNA, 115 nt, Human
uuaagugaaccaugauuuuauucuuucuacuucugucuauguuuucucucuucauguucuggggacagaggcaaacuagcagaugcugguagaugcaguagcuucauuuauuuga

SEQ ID NO: 4160079 - RNA, 70 nt, Human
uuaaguggaauuggaugugggguuuuuuguacuauuuaauacaacuaaaaccugauugaauucuauuuaa

SEQ ID NO: 4160080 - RNA, 108 nt, Human
uuaagugguuuucaucaaugcuuucucagaguccuucacuagacccuuugcaucagguugaagaaugaaggaagagaucaaguaugaaggaugaaugccccugcuuaa

SEQ ID NO: 4160081 - RNA, 63 nt, Human
uuaauaagccugugugacuaacucccaccaggagaggaugggccugugaugcugggcuauuaa

SEQ ID NO: 4160082 - RNA, 80 nt, Human
uuaauaaggugagcuccuuacuuguggauauguucaagcggaucuagccauguaucugugauguagggguuuccuguuga

SEQ ID NO: 4160083 - RNA, 129 nt, Human
uuaauacuaauacauugguaacuuuaguaaauuuaauuucuagaagugucuaugucuguauaguugauaguucaaaggacagaagugacaauuucuugggugaaacuaaaccaguauauguacugucaa

SEQ ID NO: 4160084 - RNA, 70 nt, Human
uuaauauaaagaucuggauuugauucuggcucaaccacugauuagcuguaaaucucagggaauauauuga

SEQ ID NO: 4160085 - RNA, 88 nt, Human
uuaaucagcaucuuuccuugugauuuggguuuuauaacaauaguauguaaacaaaacuuucuauagguugggauuuuuaguugauuga

SEQ ID NO: 4160086 - RNA, 58 nt, Human
uuaaucugugguuuuaugcagcuguaguuuuucacuguaugaauaugccacaguuuaa

SEQ ID NO: 4160087 - RNA, 88 nt, Human
uuaaugaaucugguguccuuguugaacgaaaauaggugaaaugaaaugccuaccauuugacucucuaaggauaaacaagaguuauuga

SEQ ID NO: 4160088 - RNA, 71 nt, Human
uuaaugucuucgucuucuuuauagcacaauagaagcacuaagugcuuuaaaaauaggagaugaaaaguuaa

SEQ ID NO: 4160089 - RNA, 72 nt, Human
uuaaugugcuuuccaaugcuguagguucuaaaauuuacucaaaaaucuucagcuuuagggaaagaacauuaa

SEQ ID NO: 4160090 - RNA, 67 nt, Human
uuaauuaaauucaugagcauuggacuuggaaaaauaaacuucuagggaaauguuuuugaauaauuga

SEQ ID NO: 4160091 - RNA, 66 nt, Human
uuaauuaacuagccaaccacuaguccuggucacauuggcuaagaggguuuggaggcuagugauuaa

SEQ ID NO: 4160092 - RNA, 64 nt, Human
uuaauuacuggcauggugguugcagaguugaaaugcagcuuuaaaagccuuugugaguaauuag

SEQ ID NO: 4160093 - RNA, 77 nt, Human
uuaauugcucuguccagccagcagguguuagcccucaagugugggcccaagggccggcugcugggcaggcaacuuaa

SEQ ID NO: 4160094 - RNA, 66 nt, Human
uuaauuuaaguugugaauguuuugcaacuguuaucagugccauugccuucacaauuaugaaauuag

SEQ ID NO: 4160095 - RNA, 112 nt, Human
uuaauuuacuaaaugauguacacugaauguuuaagaacuugacuuugagaauguuagugguuguuuauacaaguuuuuaaauuauuaguuugcagaaaaauugguuacuuaa

SEQ ID NO: 4160096 - RNA, 71 nt, Human
uuaauuuaucugauuacuucuguaaugaccuuauuuccaaauaggucacauucugagguauuagggguuag

SEQ ID NO: 4160097 - RNA, 80 nt, Human
uuacaaaagaagaaacagacugaagaguugaagcuucacccaagcucuugacucccaguucugugcacuuuaccuuguaa

SEQ ID NO: 4160098 - RNA, 69 nt, Human
uuacaagaagaggcagagcuggaaguuaaccuguggugcuuuuuucauccagugcuguuuccaauguaa

SEQ ID NO: 4160099 - RNA, 59 nt, Human
uuacaaguucagauuuucucaugaccauuuucuggaaagcagaaaaucugaaauuguaa

SEQ ID NO: 4160100 - RNA, 106 nt, Human
uuacacaugcucagauuccuguguaguuauagugcaaucaugugaccuauuuucuaugaaucauauguauccacaugagaccaggauuucuucaagggcaguguga

SEQ ID NO: 4160101 - RNA, 59 nt, Human
uuacagaaaagggcuuuaagagccuauguuccuuuggcuuuaagagcucuucacuguga

SEQ ID NO: 4160102 - RNA, 61 nt, Human
uuacagaacugcccuaguuggcuuaaaagcuacuagguguuaagcaguuacauaucuguag

SEQ ID NO: 4160103 - RNA, 64 nt, Human
uuacagagaggugacccuugggcaaaccaguaaaacuugugugccuugguuuccucuaauguaa

SEQ ID NO: 4160104 - RNA, 130 nt, Human
uuacagaggaaugcaaagcagaagaauuuagaauuggugacuuaguaagaaggggguguuacauuuuucaaggcuaguuuuaauuaggaaauuucauaugcucaggaaauaauaugguagaccccuguga

SEQ ID NO: 4160105 - RNA, 78 nt, Human
uuacagugaagauucagguucccauuguacuagagagugcagaaaggaaaccuuaauuauuacaccaccuuccuguaa

SEQ ID NO: 4160106 - RNA, 80 nt, Human
uuacaguggaaagagcucagauucuggugucagacccagcuuggguugaaccauggcucugcaguuucuuaauacuguga

SEQ ID NO: 4160107 - RNA, 78 nt, Human
uuacaguguauauuguuuaucuggaguuauggccucuugaaaccuauacaggccuuuauauaaauaaauauuuuguaa

SEQ ID NO: 4160108 - RNA, 56 nt, Human
uuacauauuauccaaaacugcuuuugugcuacaacagcagaguugaguaguaguga

SEQ ID NO: 4160109 - RNA, 56 nt, Human
uuacauauuguccauaguugcuuuugcacugcaaggguagaguugaauaguuguga

SEQ ID NO: 4160110 - RNA, 112 nt, Human
uuacauccgucucccaggguugcagggcugauaaauuacccagcaucuggcccaccccagagccugugauugucaucaccccagacagcccccgaggaggacagguaaguaa

SEQ ID NO: 4160111 - RNA, 74 nt, Human
uuacauggugagagcuggggcaagagagagaggaggaggugccuggcuccuuuaaacaaccagcucucauguga

SEQ ID NO: 4160112 - RNA, 63 nt, Human
uuacauguucucauacacagaguacuguauaacgugagucugccuguguguacaugcauguaa

SEQ ID NO: 4160113 - RNA, 73 nt, Human
uuacauguugaaguccuaacucccaguaccucagaacgugaccauauuuggagacaggauuuuucagagguaa

SEQ ID NO: 4160114 - RNA, 75 nt, Human
uuacauuauagguccuguuaguguuagacuucccuguaugugcuaagggaagacuuugaaaggcuuuaaguguga

SEQ ID NO: 4160115 - RNA, 60 nt, Human
uuacauucagaaagauuugaguacauuguggacaaauucauaagucauucugcaauguag

SEQ ID NO: 4160116 - RNA, 81 nt, Human
uuacauugcuuugagaaacagacgaaagacauguuuuuuuacaauugucuuacagcaaucuguucugagaguaacauguaa

SEQ ID NO: 4160117 - RNA, 56 nt, Human
uuacauuuugcacagauguccccagccggcagguagggccauuagucaagauguaa

SEQ ID NO: 4160118 - RNA, 76 nt, Human
uuaccaaagugugguuguuucauuaaacauuagcucuucaggauuagauguuacaugaaacggccuacuuuuguga

SEQ ID NO: 4160119 - RNA, 64 nt, Human
uuaccagcagacacgugugcucagacugaucugacucuggguuuugacauuucucucugcguga

SEQ ID NO: 4160120 - RNA, 80 nt, Human
uuaccagcuuuugucuaggcuuuuucuuccauguuguuucuccuuaauaggcaagcacaaagucaggacagaguagguga

SEQ ID NO: 4160121 - RNA, 66 nt, Human
uuaccauuguuuugccauuuguguucaugcauccucagaugcaugaacggaggguaagcuggguaa

SEQ ID NO: 4160122 - RNA, 69 nt, Human
uuaccucaauuuuuauugcuuuuuugcuuagaaaaacuauguagaagaugccuuaaaguugaaagguaa

SEQ ID NO: 4160123 - RNA, 57 nt, Human
uuaccugcagagacguggaggcgugagggagaacaugcuuguuaaauaugcagguag

SEQ ID NO: 4160124 - RNA, 55 nt, Human
uuaccuuggguuaaacuggcugcaggugugggguaaguuagcaaggccaagguaa

SEQ ID NO: 4160125 - RNA, 118 nt, Human
uuacgauucaguuuuuaaaaguaaaacagauaaaaguuuggauccagcaaaagagcaguuagauuguuuugcuagucuagauuuaauagucucuguauuaggugucauugaaugguaa

SEQ ID NO: 4160126 - RNA, 65 nt, Human
uuacggaucuuuuagaggcuagauuugggaggaagaaggaggagcaaugcugggagacucuguaa

SEQ ID NO: 4160127 - RNA, 96 nt, Human
uuacggccuugccuagcuggcagggacagcugcgugugaugcugguggagaugccagaugccgccugcccugugaggacggcuggcggggccgugg

SEQ ID NO: 4160128 - RNA, 64 nt, Human
uuacuaaacuacccaugacaguuucagaucuauggccuggaagagucucuggaugguuuaauag

SEQ ID NO: 4160129 - RNA, 79 nt, Human
uuacuagcugucaggcgaaaauuaaaugagcuugcuccgagcuucagauuuaucuuucugucuacaaaaggcuauguga

SEQ ID NO: 4160130 - RNA, 70 nt, Human
uuacuauuaaccuguauuauuuucuuagcucugaacuauuuuagggcauugaagcaauauggaaugguaa

SEQ ID NO: 4160131 - RNA, 62 nt, Human
uuacuauuucuugugggaaaugcagcaucaccccagagaucuguagccaucaggaagaguag

SEQ ID NO: 4160132 - RNA, 72 nt, Human
uuacuauuuuugcaacguauacacuucuaaaauugucauuaguguuuguaccaguguugggaagauguguaa

SEQ ID NO: 4160133 - RNA, 130 nt, Human
uuacucagccuccaugaucucuuguuaagacccagaugcacacacauuaugucugugaauucacaaagacgcgagacagcuggugguuaucgguuuagucgauuaauauagagagaaugguaaugaauga

SEQ ID NO: 4160134 - RNA, 75 nt, Human
uuacuccaaaacauauuugauuggcaucugcuugaagagacuuuggaugucuuucuaauacuggcuuuugaguga

SEQ ID NO: 4160135 - RNA, 90 nt, Human
uuacugagcaugaagugguaucucaugugguuuugauuugcauuuuuguaaugacuaaugacauggagcaucuuuucaugugcucagugg

SEQ ID NO: 4160136 - RNA, 79 nt, Human
uuacugagguauaaauuacagcaaagugcgcagaccuagguaucuaggacugugagguuuuccuguguuaccuguguaa

SEQ ID NO: 4160137 - RNA, 76 nt, Human
uuacugguuauuguuuuugcugcuuucuucuggggauugcuucuagaacaggaauaagggaaauaugaaucaguaa

SEQ ID NO: 4160138 - RNA, 59 nt, Human
uuacuuacaaaggcaaaggaagucgugcuguguuuugcuucuuuagcuuuuguggcuaa

SEQ ID NO: 4160139 - RNA, 82 nt, Human
uuacuucaaauagacaggcuuaaauaggacuguuaucuauucuauaucacuuaacucuuuugccucagucuaguugcuguag

SEQ ID NO: 4160140 - RNA, 76 nt, Human
uuacuugagcccaggaauuggaggcugcagugagcucuaaucccaucacugcacucuagccugggugacagaguga

SEQ ID NO: 4160141 - RNA, 77 nt, Human
uuacuugaguauuguauuuccagcuugaauguccauauaguaguggcaaacauuuugcuaguguaaugcuuugguaa

SEQ ID NO: 4160142 - RNA, 80 nt, Human
uuacuuugccuuguuuuguucaugaacauuggguuuagugccuggcaacuugaugcauauggaagagcaaugccaaguga

SEQ ID NO: 4160143 - RNA, 77 nt, Human
uuacuuuuauaccuucagacaucaacuaucuccaccagccccaugguuugggggaugagaguagggugugaaaguag

SEQ ID NO: 4160144 - RNA, 58 nt, Human
uguccauaccuuuaccuguguagcuaaaugaugcuagaggaaacaguaaagcuggaca

SEQ ID NO: 4160145 - RNA, 67 nt, Human
uguccaucaucuucgaaaaaagucagacuuaagcuggacuucuggcuguuuuagaugagcucagaca

SEQ ID NO: 4160146 - RNA, 62 nt, Human
uguccauggagaagcucagggcugucaauuuagaaagcagcugugugcuggcccauugggca

SEQ ID NO: 4160147 - RNA, 71 nt, Human
ugucccaagauucugagauacaaaauuuacuuuuagaguccuaaaagugggguaucuugaauagucuuaca

SEQ ID NO: 4160148 - RNA, 79 nt, Human
ugucccauccaucuuaacccucagccucccacgacuccaucuguagaggcaaccaguguugagaaaaauuguguggaua

SEQ ID NO: 4160149 - RNA, 88 nt, Human
ugucccauggucaagguggucuugccugaaacuaagacauagcucauuguacuguucaagucagagcaagccaagugugcuuuggaca

SEQ ID NO: 4160150 - RNA, 73 nt, Human
uucaaagguuauuauuacuauuguccagaguguuaccaccugauaaauauugacaguggaaugacccuuugag

SEQ ID NO: 4160151 - RNA, 58 nt, Human
uucaaaucucuccuaauccacuaaugaaccuuuauuaaagugggagagagagguugaa

SEQ ID NO: 4160152 - RNA, 76 nt, Human
uucaaaugucaaaggcuauacauucacacuacucauucacauguuuguaugaauguaugguccugugaauuaugaa

SEQ ID NO: 4160153 - RNA, 122 nt, Human
uucaaauuucugaaaauguagugcagcuaauguauaaaguguuaauaacuuuugaacuuaaauguucuuaaauuaggcauauuauaaggcauuuuguugaacuaagugacuuaacauuugaa

SEQ ID NO: 4160154 - RNA, 91 nt, Human
uucaacaaagauuagcaaauauuuacaaaguuuuagaacuaggaagcaggcaaauacuuuucuuauagagcuuaaaguuaaucuaguugaa

SEQ ID NO: 4160155 - RNA, 75 nt, Human
uucaacacuauccaggcaaucuuagacccauacuaguaauuuuaccaggacgaagaucccugcuguagugaggaa

SEQ ID NO: 4160156 - RNA, 77 nt, Human
uucaacauuugauacaagucaggcaaacucacuaaaggaagagucugcaaaugagggggcuugagucagaucuugga

SEQ ID NO: 4160157 - RNA, 103 nt, Human
uucaacccccaucacgugcugagaguguuauugucaaguacagcuacgacauccaugcuacaauccaaugccauuuuuauguacugcaucacucaggguugaa

SEQ ID NO: 4160158 - RNA, 129 nt, Human
uuagcuuuucaacagccaggacugaagcaaggaggauaccuggguuccauuucucccugcuauauggaauuauuaggcaucaggcuguauaucuugcacucaguaggcccuugguugauacuggcuaca

SEQ ID NO: 4160159 - RNA, 104 nt, Human
uuaggaaagugccucacauaguaagcagucaguaaauaguagcucuuguuauucauucaacaaguauugauaaaaugcucacuaugugccaggcacucuccuag

SEQ ID NO: 4160160 - RNA, 77 nt, Human
uuaggaaauguggcaguucuuccaaguuguuauugcuuaguuaacuuauuuggaagcauuuccaaagcauuuccuga

SEQ ID NO: 4160161 - RNA, 63 nt, Human
uuaggaauauagacuaaguagaaucccugaaguuaagccuucaacuuaguguaggguuccuag

SEQ ID NO: 4160162 - RNA, 67 nt, Human
uuaggacuagagcuaugaagccagaaugugguaagagccaggauuuggccauggcuucgggaacuga

SEQ ID NO: 4160163 - RNA, 127 nt, Human
uuaggagcgauagaugauaauagaauuaaaaguaaucuccaaggguuguggguggucacaugcuagcauuacaaguagcuacucucaaggccuguauggagguugccugugcauaagagugggauaa

SEQ ID NO: 4160164 - RNA, 90 nt, Human
uuaggaugaaauaaaguuuauuccagcaaucugcuuagcagccuuguuaaugucaaggcuaaugagugcugcugaugaauaaauuccuga

SEQ ID NO: 4160165 - RNA, 130 nt, Human
uuaggaugugauaugcuuugucugagcaggggauucuaggacuugagagcuaagcugggcuggauccaucuugaucuggaaaguuuugggaggccaaggaacuauguucagcagaaaguuucaauccuga

SEQ ID NO: 4160166 - RNA, 60 nt, Human
uuaggcaaaggaggccacuuagccagcuuagauucuaggccugggucuccuucugcuuaa

SEQ ID NO: 4160167 - RNA, 65 nt, Human
uuaggcagucguguguguguccgugugcgaauguguauuugugugcacauggccugagugccuga

SEQ ID NO: 4160168 - RNA, 76 nt, Human
uuaggccacaugucugucaucuuccaggaagcucguaugggcuucuucagagggcagucauaauucuaaagccuaa

SEQ ID NO: 4160169 - RNA, 73 nt, Human
uuagggacauuuaauaagugaugauaguaccuagaaaauaauuucaauguaagugaucacuguuauucucuaa

SEQ ID NO: 4160170 - RNA, 123 nt, Human
uuagggagcgcagauauuuaggaaaaggccaggagcgggaaaaggaagaagaaacgaaaaagauucuccccuuuucuuaccuuuugccccuccuuuccccucccgaaauuugcgccuacuuga

SEQ ID NO: 4160171 - RNA, 71 nt, Human
uuagggcgcagugaauuggaugaugccugaccacauuggugaaggcagauuuucuuuacucaguguacuga

SEQ ID NO: 4160172 - RNA, 101 nt, Human
uuagguaauauuccugcacccaaggucucacuuuguggaagugacaguggagauagaaaaaauguuauuuccaucaaaacugagaaggaaaacaauccuaa

SEQ ID NO: 4160173 - RNA, 76 nt, Human
uuagguaucgauuuguauaaaagcugagugugauuugugauuacacuuguaauuauauaacgcgaaauuuaccuaa

SEQ ID NO: 4160174 - RNA, 69 nt, Human
uuaggucaaggccagcgcagaccauuguccaucagcccagagagagauggucuaauuggcccauccugg

SEQ ID NO: 4160175 - RNA, 61 nt, Human
uuaggugcuagaaaaccuggguuucaaauucaacucagcccuaacuaauucuagggccuaa

SEQ ID NO: 4160176 - RNA, 56 nt, Human
uuaggugucuugucacuaccguucacuagcuguguaaucuuagaaaaggcaccuaa

SEQ ID NO: 4160177 - RNA, 70 nt, Human
uuagguugaacuauaugaaauugccaaagguaaaauuaaguugucagcaauuucauaugauucuaccuaa

SEQ ID NO: 4160178 - RNA, 78 nt, Human
uuagguuggugcaaaagcaguugugguuuuugccugaaaggaauggcaaaaaccgcaauuauuuuugcaccaagauaa

SEQ ID NO: 4160179 - RNA, 80 nt, Human
uuagguuggugcaaaaguaauugugguuuuaaccauuacucuuaacagcaaaaacagcaguuacuuuugcaucaaccuaa

SEQ ID NO: 4160180 - RNA, 80 nt, Human
uuagguuggugcaaaagucauugugguuuuugccuuuaauuucaaugucaaaaaccacaaugacuuuugcagcaaucuaa

SEQ ID NO: 4160181 - RNA, 55 nt, Human
uuagguuuaagugacuggaaucauuccuacaugauuccuggcggcagaaacguga

SEQ ID NO: 4160182 - RNA, 88 nt, Human
uuaguaagugcucuauacacauucagaaagguaaauggauuucucagagugggaaaaacagaccuuucaugauuucagcauuuacuga

SEQ ID NO: 4160183 - RNA, 98 nt, Human
uuaguacaucaagacauuuuaaaaugcauuuuuagcacagagauuauuuacaagaaaaucauuuauuuucaacucucuaugcgaggaugcuguacuga

SEQ ID NO: 4160184 - RNA, 68 nt, Human
uuaguacgggcuuucugggccuccugggucccuuacccaagcccugaccugagaguccgugaaacuga

SEQ ID NO: 4160185 - RNA, 62 nt, Human
uuaguaucucugaaccuccguuuccuggccuacaagcuggguauauggaggcagagagcuga

SEQ ID NO: 4160186 - RNA, 123 nt, Human
uuaguaucuucacaaucuuuuggguuaccugggugaauauucuuugugcaguauuggcuaaggugcuaacaggguugauugcucaaaaauagccucacucauauagcugaaaauuggugcugg

SEQ ID NO: 4160187 - RNA, 62 nt, Human
uuagucacaugcccaucucugaaccagcugcugaguccaaggagauggggcagugugacugg

SEQ ID NO: 4160188 - RNA, 59 nt, Human
uuagucuccagcuggacaauagucccuagguggauaccuaggccccagguggacacuag

SEQ ID NO: 4160189 - RNA, 78 nt, Human
uuagugacuuagauaaaacuauguuuguauuagaagaccuaguuuacauauuugucggagucucaaaauggaaacuga

SEQ ID NO: 4160190 - RNA, 58 nt, Human
uuagugagcuuuauugaagacugcucaaaagaggaaaucuuugauuaagcuugacuag

SEQ ID NO: 4160191 - RNA, 69 nt, Human
uuagugauauuuuaggaaaauugcguaaaagagaaucauaccucuuagaaguuuccagcauguuacuaa

SEQ ID NO: 4160192 - RNA, 86 nt, Human
uuaguguccccauaggguagcagcuacuuugaugauugacaauauaaauuuaaaagcugagauauccuguacuaucuugauacuga

SEQ ID NO: 4160193 - RNA, 58 nt, Human
uuaguuaucucugcuacagaaaauguuugugguagguuuucccagcagagauagcugg

SEQ ID NO: 4160194 - RNA, 82 nt, Human
uuaguucaacaauuagugucauguugaggacuugccaauuacaauauacggcaagugucuuuuaugaauuaaaaugaacuaa

SEQ ID NO: 4160195 - RNA, 59 nt, Human
uuaguucacugcuauaucaucagugcccggaagaguaccugaugcaugguagggacuaa

SEQ ID NO: 4160196 - RNA, 81 nt, Human
uuaguugaauccuaccaagauuuuaugaauuuuggcugccaaaguuagaacaucagguugaauuugguuuagauuuacuga

SEQ ID NO: 4160197 - RNA, 61 nt, Human
uuaguugacaucaucagccuggaguuuaucuugcucacuccaagugcagaauguccacuga

SEQ ID NO: 4160198 - RNA, 57 nt, Human
uuaguugaugcuaagggaucccagaaacacugggguccgacaaaacagcacaacuaa

SEQ ID NO: 4160199 - RNA, 90 nt, Human
uuaguuguuugcauuuccuauuucugaguuucccacuugguguguguuuauuaagugagcuagcagaagugacuugauguaagcaaguga

SEQ ID NO: 4160200 - RNA, 69 nt, Human
uuaguuuugugucuacauuuucauuuugacuuugacaugcauggugucagaagugggauacaaagcuga

SEQ ID NO: 4160201 - RNA, 83 nt, Human
uuauaagaaaauauggaauauuuuuuguuaacucaggauagguauaaccauccuggcuaagacaaaaaauccaaguuuuguaa

SEQ ID NO: 4160202 - RNA, 71 nt, Human
uuauaauuucucuugucagcuucucuguggauuuggugucuacaaagaaagcugaggggaaaaaauuauaa

SEQ ID NO: 4160203 - RNA, 71 nt, Human
uuauaauuuguugucuuugaccuguaggaacccaguugucuugauuacagugucuggauaucaaaggauga

SEQ ID NO: 4160204 - RNA, 77 nt, Human
uuauacagcugguaaguggcagagauucuggaggcagacugccugcauuugaauucugucgcuuacuagauguauga

SEQ ID NO: 4160205 - RNA, 73 nt, Human
uuauagaauauuucuggggguguguuucucaaaaauauuccuuugagguugugccuucagaaauaaucuguga

SEQ ID NO: 4160206 - RNA, 59 nt, Human
uuauagauagccugugaguguucugugaaguuagagaagauacacagagcugucuuugg

SEQ ID NO: 4160207 - RNA, 72 nt, Human
uuauagcauuaaaguccaaaaucucauaaucuagaucaucuaaauuagauaugugugagacucuggcuauga

SEQ ID NO: 4160208 - RNA, 101 nt, Human
uuauaggaaccuuuuguaaccuaaggcaggugaacaggguggcaggcuggcugagguccagauaccagcauugcuuuggguuauaguuuauguuguuuuaa

SEQ ID NO: 4160209 - RNA, 78 nt, Human
uuauagggaauuugccagucucuaauggagucuacuucauucuacaaaagaacuggaucucaaauaucugcccuauga

SEQ ID NO: 4160210 - RNA, 75 nt, Human
uuauagugugacauuuucaugaauuugagcuauuuuucuuucuguuaugucaaauuagugaaguguuacuuguaa

SEQ ID NO: 4160211 - RNA, 65 nt, Human
uuauaugcaagcacauagaauacuugcacauuugaguaaguuuuuagauuugcguuugcaugcaa

SEQ ID NO: 4160212 - RNA, 117 nt, Human
uuauauugaaaccaaugaaagcgguuggcaacauugaagagacgguaugagugaaauuucucaguuuauaucuuaugucauuucaauuuuuuagaaacuuuucguuuugaaauauag

SEQ ID NO: 4160213 - RNA, 114 nt, Human
uuauauuuuggaaguaaauuuaagaagcauuuucuguaaaagaccuccaaggaaacagcuagagagagguuuccugguggcucuuugggaaggacuuuuacauucaagauauaa

SEQ ID NO: 4160214 - RNA, 75 nt, Human
uuaucagauaaaauucuuauuuuacccguacuauugaaagauaauuguguuugaugcagaauuuuagguugguaa

SEQ ID NO: 4160215 - RNA, 122 nt, Human
uuaucagucuguguucuacugggaaagaaaagcugaggcuccucauuaaguuguaacccgacugguuuacuauucuguuacuuggugaucuucagaagauuuuggccaauauaaguugauaa

SEQ ID NO: 4160216 - RNA, 60 nt, Human
uuauccagacaucuugcacacauauacugcugguugacaaguaggcaagaguuuggguag

SEQ ID NO: 4160217 - RNA, 58 nt, Human
uuauccuugaguauuggggaagaggacuccaaaugucucuccaaauuccugaggauaa

SEQ ID NO: 4160218 - RNA, 94 nt, Human
uuaucucuccucccaguagucucccuccaucuucccauccaggucuggaggauccagcagccuccaggguagaggaggaagagaggagagauag

SEQ ID NO: 4160219 - RNA, 57 nt, Human
uuaucugcuuuaagccccuugcuuuccacaggaaaacaccaaggcucagagagauaa

SEQ ID NO: 4160220 - RNA, 74 nt, Human
uuaucuguagaccccugauuaaagaccugacguacuaugugguucagugucucauaugagguuucaugcaauaa

SEQ ID NO: 4160221 - RNA, 69 nt, Human
uucaagauggcugcaaauacuuguaccuaccuuccauugagaagcggggucuuugcccccauccuugaa

SEQ ID NO: 4160222 - RNA, 73 nt, Human
uucaagccaaggauacuuuuagagccugagcaccuaacugccaguucuggauagaguccacgaccggagugag

SEQ ID NO: 4160223 - RNA, 72 nt, Human
uucaaggaaugaugacuugucuucaauuuuggaguuaaacucacauauuuaagaaaguuaaaauguuuugaa

SEQ ID NO: 4160224 - RNA, 66 nt, Human
uucaaggacacccaggaauaaggacuggggauacagaauuccaguucccuuuuuggguggaaagaa

SEQ ID NO: 4160225 - RNA, 64 nt, Human
uucaaggacuuaggcagguccuuacugcaggcuuggagccugugggcucuccugaggccaugaa

SEQ ID NO: 4160226 - RNA, 67 nt, Human
uucaaggaugggaguggagguuuaggaaaagguuaaaagaagauauuaaaccuccccauuuucugaa

SEQ ID NO: 4160227 - RNA, 74 nt, Human
uucaagucaacucaaauuguuauccucauguuuauaguugaagaaacaggcuagaugaaguugagugauuugag

SEQ ID NO: 4160228 - RNA, 60 nt, Human
uucaaguccaggucccgggcucugggaguucugcuccugcagagcuugucuggaugugag

SEQ ID NO: 4160229 - RNA, 104 nt, Human
uucaaucagggucuagcccagagggucuggaggguucucacacaaguuuugcagaugaggugagagauuuucaugagugcuucauuguuagggccugauucgga

SEQ ID NO: 4160230 - RNA, 82 nt, Human
uucaauccuuacaacaauccugugaguagauaguauuguuauuuccauuguaaagacaaacuaaagcucacagagguuugga

SEQ ID NO: 4160231 - RNA, 123 nt, Human
uucaaugaauaaucucauauuuugucauaaaugggaccugaagcagguuggcaaagccaaugaggcuaugccccugcauuuaggccugacuguaacugaccucucuauuuauucucagaugaa

SEQ ID NO: 4160232 - RNA, 109 nt, Human
uucaaugaguagaagaguuucagguagaaagacccugggaccuggauucuggucacaggccugucucuuucuaacuuaagaccuuggaacaguacuuaaccucucugaa

SEQ ID NO: 4160233 - RNA, 57 nt, Human
uucaaugcaagggaggucugaagaagugaucacaauuucuucaggcucuugcaugaa

SEQ ID NO: 4160234 - RNA, 56 nt, Human
uucaaugcugguuuguaaaaauaugucaaaaaauuaacaugccugccagcauugga

SEQ ID NO: 4160235 - RNA, 101 nt, Human
uucaaugguuuuaagcuuuuacgaaagacaagaguaucuuugacuuuaggcugcuucugccuugaaaaauaugccuugcuucuuuaaagcuggccauagag

SEQ ID NO: 4160236 - RNA, 80 nt, Human
uucaauuagauauaccaagucaucuauucccauggugagugccacuaagauugguugauugguaagcaauauuuguugaa

SEQ ID NO: 4160237 - RNA, 78 nt, Human
uucacaauguuggcuaggcuggugucaagcuccugacuucaggugaucugccagccucagccucccaaaguguuggaa

SEQ ID NO: 4160238 - RNA, 62 nt, Human
uucacaccugcucaauuaugaggucuugauuuauuccaaaggcaugagaagggcagugugag

SEQ ID NO: 4160239 - RNA, 64 nt, Human
uucacacucagugggcuugaugucgaagauuuucacauguuuccagcuuauugcuuuaggugaa

SEQ ID NO: 4160240 - RNA, 71 nt, Human
uucacagaauuuuucgaauguacugugugaguagaacuucaagcagccauugagcgaaaaaaucuguugag

SEQ ID NO: 4160241 - RNA, 112 nt, Human
uucacagauacagaaacugaggccugcauugcucaggucaccuagcuaauaagagcugaaggugggugaaaucuagguguguguggcuccucgguggacugccaucucugga

SEQ ID NO: 4160242 - RNA, 60 nt, Human
uucacagauugacuggauuccugccauauauauaaccaggauuguuccaggcucugugga

SEQ ID NO: 4160243 - RNA, 58 nt, Human
uucacagauuucccugcacaugggaauggccaaugagcuagaaauggaaaucuuugag

SEQ ID NO: 4160244 - RNA, 88 nt, Human
uucacagcuuucagggauuaagagguggucgugucuguguggaucccauucagcccacgccaccuucuugggaccuggaagaaaagaa

SEQ ID NO: 4160245 - RNA, 56 nt, Human
uucacaguacugugugacuugagcagcucuggaagcuaggaaacacauacugugag

SEQ ID NO: 4160246 - RNA, 73 nt, Human
uucacauuaaugagcguuaaucauuaaaugucauaaccauucugucaaguaguggcugcuucauuggugagga

SEQ ID NO: 4160247 - RNA, 58 nt, Human
uucacauuucucugcuguuugaucuuaaauaagagcaacagacuaggagaggugagaa

SEQ ID NO: 4160248 - RNA, 66 nt, Human
uucacauuugaaaggaaagauauguuaagauauacaaugaauuguaucuuuccuuugaagugugaa

SEQ ID NO: 4160249 - RNA, 68 nt, Human
uucaccauauuggccagacuuauccuucagagcuuuuuaacuggaagauaugcugccagucuggugaa

SEQ ID NO: 4160250 - RNA, 80 nt, Human
uucaccauuuacuuauugugcgaaguugggcaaauaguguaacuucuguuucucaguuuccucauauguaaaaaugggaa

SEQ ID NO: 4160251 - RNA, 73 nt, Human
uucaccccuggggcccugggucugcccuccgccuggcagcugguggagaggagagccaggucccagcugugga

SEQ ID NO: 4160252 - RNA, 96 nt, Human
uucaccuuaggucgauaauuuauuuccauuuguaugcguuuguugauuuauacaaaauaaguuugcagauuauauuagugucauuuuaaggaugaa

SEQ ID NO: 4160253 - RNA, 56 nt, Human
uucaccuuccaggagggucuuugagguuaccuaguacagagacacuggaggaagag

SEQ ID NO: 4160254 - RNA, 95 nt, Human
uucaccuucucugcuacauacuagggcuuuaauaaaauguuacuugaaucuggauccccacaaaguaugagccucaugaagagaaacaagaugag

SEQ ID NO: 4160255 - RNA, 82 nt, Human
uucacgcucaguuccucgggcuuagggguggacuccucgguucagaaggcagaagaggucacacuagguccuagagcgugga

SEQ ID NO: 4160256 - RNA, 67 nt, Human
uucacgugucucggccaaggcgagcauuuccacaaugccguggaugcugcagucaggccagauugaa

SEQ ID NO: 4160257 - RNA, 130 nt, Human
uucacuagagccaaaaguagauuaaaaaucagucacucauuaauacuuugccuagcuacuaaauuggaggugccuaaacaagauacuaaugaggugacugagucuuaaccugguuuuggccuccacuaaa

SEQ ID NO: 4160258 - RNA, 61 nt, Human
uucacuaguuagcaaugcccaggaaugcaauacuugcuauuuaaucauugguagcuaugaa

SEQ ID NO: 4160259 - RNA, 61 nt, Human
uucacucagguucaugucuuuguuccucuugcacauaucugaacacacacaaccuggugga

SEQ ID NO: 4160260 - RNA, 92 nt, Human
uucacucaucaaggaagcagcaaugcaugauuguagccucaagaaauaaaugacuuuggucaugauuggguuuccuuacuugucaaagugaa

SEQ ID NO: 4160261 - RNA, 75 nt, Human
uucacuccccagcugagacugucuucugugauccuguucgaggguuaagucuggaaccucaugcuggcgauugaa

SEQ ID NO: 4160262 - RNA, 56 nt, Human
uucacucucccacaguuuaccccaggaguccaacaggcagagugugagagggugaa

SEQ ID NO: 4160263 - RNA, 66 nt, Human
uucacugcugggggacacagguccggguccagcaccauccccgaaaccuucccccucggcucugag

SEQ ID NO: 4160264 - RNA, 129 nt, Human
uucacugggcaguuggguauaugggccuggagcucagggagaagucuggucaguccuaagcuguggcuuggggcugccugagcaucuccuccugcagaucuggccuaaugcucagaggagaccagagag

SEQ ID NO: 4160265 - RNA, 59 nt, Human
uucacuguacugacugucuuauccauaccaguguggagucaggcagaaguugcaaugag

SEQ ID NO: 4160266 - RNA, 103 nt, Human
uucacugucagccagaagagccaucaucuugaaaaauggcaccaaaauuaaaaaccaauagucaaauuucaguuggaaugagcucuccuggcauaaugaugaa

SEQ ID NO: 4160267 - RNA, 78 nt, Human
uucacuguccauuaagggaccucagcuggcauggaacauugcuuuccuauuucagcugccuuugacugggauauugaa

SEQ ID NO: 4160268 - RNA, 65 nt, Human
uucacuguggagcaaauuuauuuaucugagaauaguaaagauagaaguauucccuccucagagag

SEQ ID NO: 4160269 - RNA, 63 nt, Human
uucacuuaauugucuucugugccauaugacaggcagaucacuuuaggagcaaugagaguagaa

SEQ ID NO: 4160270 - RNA, 62 nt, Human
uucacuuuguagacauguauuuuauagccagcuuugccaagaugcauguuccauaaaguggg

SEQ ID NO: 4160271 - RNA, 56 nt, Human
uucagaaaugucagccaucagagaacaacacaucugugguaaacaacauuucugga

SEQ ID NO: 4160272 - RNA, 82 nt, Human
uucagaaauguuuucaagcaucuggggcauugcuaugguuacaacuacaggccuacgaagucaggugcgagaacugcuugga

SEQ ID NO: 4160273 - RNA, 56 nt, Human
uucagaagcagcgaaguggaagggacucaaggacuauaccagcuugcugcuuggaa

SEQ ID NO: 4160274 - RNA, 60 nt, Human
uucagaagguaggaaugucccucuugauagggcugaaucaagggauuccuggcuuuagaa

SEQ ID NO: 4160275 - RNA, 127 nt, Human
uucagaagugggcaaaaauaucaaauauuuagcaguuaugugaaucaugugacaggugucucaguguagcuggagcaugggccauggaugcagggauauugacagauaaagcacagcccaaacugga

SEQ ID NO: 4160276 - RNA, 59 nt, Human
uucagaaguuuucaaaacuaagcauccccaauugcuuaguuuugucagaauugucagaa

SEQ ID NO: 4160277 - RNA, 69 nt, Human
uucagaauaacauggccaaaucuaaacuguuggaaacuucuucuauagaagguuugucaugguucagaa

SEQ ID NO: 4160278 - RNA, 66 nt, Human
uucagaauaacuuuuuauugaaaucagccagugagcuggcuaaacacaagagaaagaguuauugaa

SEQ ID NO: 4160279 - RNA, 68 nt, Human
uucagaaugauuacauucuggugacaucucuucagaaacagggucuucuuagagguaaucaaucugaa

SEQ ID NO: 4160280 - RNA, 96 nt, Human
uucagaaugccuggcugaggugacagguuuuaacgauaaaagaguuuacagccuucaccaccugcagccagguuuuuauuuaagucacauucugaa

SEQ ID NO: 4160281 - RNA, 82 nt, Human
uucagacucuaguguccauauugacaggacuuuaaauccacuacgugugcaucuggagcuuguuagauguuuauaguuugaa

SEQ ID NO: 4160282 - RNA, 92 nt, Human
uucagagcuggauccagggagcagcgcuggggccuccagacacacacccuucccuugaggccacaaugacugccccuuggcucggcccugga

SEQ ID NO: 4160283 - RNA, 65 nt, Human
uguuaugccccaggaggugccauccauagagaacacagugugagugguggccccugggguuugca

SEQ ID NO: 4160284 - RNA, 80 nt, Human
uguuaugggaaauggcaaguucuaaugauuagaauagcguuuuacuuuaauuaaugaacuguggcaggaagcccaaggca

SEQ ID NO: 4160285 - RNA, 119 nt, Human
uguuauuggaguccuugauuuugcuccuggcuguguguccucggacgaguuuauuuccuucucuggacugcucuguggaacgaggaauuggaguagguaaacauugacaucccuugaua

SEQ ID NO: 4160286 - RNA, 85 nt, Human
uguuauuuuugggguuugcuucuguuuauggaaagauacugauuuccuauaucuugcugcuacaaagugccccuuuaaaauaaua

SEQ ID NO: 4160287 - RNA, 97 nt, Human
uguuauuuuuucuaucucugaaugauuaaaugugauuucauuuauguagcaauacuaugauuguggcugcauuagaucacgcugauagaaagauaca

SEQ ID NO: 4160288 - RNA, 60 nt, Human
uguucaccaggggcuccaggugagccuggccucccaggcuccccaggaggcccuuggaca

SEQ ID NO: 4160289 - RNA, 61 nt, Human
uguucacuuauuguuccuggacccugagucaugucuuagguaaacggcacaguaaagaaca

SEQ ID NO: 4160290 - RNA, 60 nt, Human
uguucagaagccagaauauucauggauuugauauaagcaugaagauuuuuggcuuccaca

SEQ ID NO: 4160291 - RNA, 59 nt, Human
uguucagagacagaaauucuaaaaauggugacauuuugcaagagaggaugucuuuagca

SEQ ID NO: 4160292 - RNA, 70 nt, Human
uguucagaucuuuugacaauuuuuuuaauuggguugucuuuuuauuauugaguuguaagagcucuuuaca

SEQ ID NO: 4160293 - RNA, 82 nt, Human
uguucagcagccuuuacacaugauuucaguuucaacaaggaaguuaagcaaaagucgagugugagcauuguggcuuuggaca

SEQ ID NO: 4160294 - RNA, 57 nt, Human
uguucaguguaaacaguuugggguacaguacacuccucaggcaggucccacugaaca

SEQ ID NO: 4160295 - RNA, 88 nt, Human
uucacagccugagucuuaguuuuucauccaaaaagggugguuaacacuuauuucauggaguugagaaggcuaagaugacagaggugaa

SEQ ID NO: 4160296 - RNA, 56 nt, Human
uucacagcucauacuguucucaccugggaaacuugggaagggcugaugaguuuggg

SEQ ID NO: 4160297 - RNA, 56 nt, Human
uucacagugugaucuaugggcaaugugcugcuacaccaccauguuucaccugugaa

SEQ ID NO: 4160298 - RNA, 67 nt, Human
uucacaguuaaguuggacacauuccuaaaaaacagccuggguuggaaggaaguggccagauugggaa

SEQ ID NO: 4160299 - RNA, 60 nt, Human
uucacauuaucaggauuguuucagugauucucaaucucauaugcauucuguuaaugugga

SEQ ID NO: 4160300 - RNA, 55 nt, Human
uucacauuggugauauguuucuuugggaggaagaaacuuuuuuaaaugaugugaa

SEQ ID NO: 4160301 - RNA, 63 nt, Human
uucacauugugguucaugugaaaggcauucucuagaguugugcaaggcacgaccauaugugga

SEQ ID NO: 4160302 - RNA, 74 nt, Human
uucaccaagcaucuguuaagugccuucaauguguuagacauugagcuaggcacuacaggucaugaacuggugag

SEQ ID NO: 4160303 - RNA, 55 nt, Human
uucaccagauuuuguauagucagcauuuuaaguugacuggaaugugucuugggaa

SEQ ID NO: 4160304 - RNA, 67 nt, Human
uucaccucaucagucagaacuuaagcuuguuacaauugcagcauguuuaagcccauugagagcugag

SEQ ID NO: 4160305 - RNA, 59 nt, Human
uucaccugaaagucuggaguccagcugacugcugcugaauccaggcccacucagcugaa

SEQ ID NO: 4160306 - RNA, 61 nt, Human
uucaccugggagauugaagggaugagccagauugcucucauaccuuggaguuccaggugga

SEQ ID NO: 4160307 - RNA, 68 nt, Human
uucaccugucugcagcacccagcacaaagccugagcaaggcagaugcagggaaugcuugcagcaugaa

SEQ ID NO: 4160308 - RNA, 81 nt, Human
uucacgagcuucagggucgucacuuuuaagggccuuuucuaccuuguugggaagaaacaagcccuagaaguccugagugaa

SEQ ID NO: 4160309 - RNA, 130 nt, Human
uucacuaccuccuugaguuugggcuuggccauguggucugggcuugccugguugugcagccucucuuguuucucucacauugccauuaguucaguuucccauggaaagcguuuaacugaagaaggaugaa

SEQ ID NO: 4160310 - RNA, 111 nt, Human
uucacucacaaaguuauugacaagcauuuuucacagcaacagcucuucucugugacccucgugagcuguuuacaugaaaaaugcucuuccuuguagauuaaugagagugga

SEQ ID NO: 4160311 - RNA, 55 nt, Human
uucacucauuuuuguguccugcaaggcauuugcaaagaaugcagaagagagugga

SEQ ID NO: 4160312 - RNA, 81 nt, Human
uucacucugggccuggggcuguugagagguuccuugcuaaggggguucucucuccuaagagcucuaggaauccaaggugga

SEQ ID NO: 4160313 - RNA, 82 nt, Human
uucacugaauuaaaaagaguauaccacccaucuguucauaaauguuuuaccuagcugggaauacucuucuuuggucagugaa

SEQ ID NO: 4160314 - RNA, 61 nt, Human
uucacuggauccuagcugagccuugcaauguucuaggcacuggguacagauaugcagugaa

SEQ ID NO: 4160315 - RNA, 60 nt, Human
uucacuucacagauauuuauuugguauuuacuauauaccaggcacucuuguggcagugga

SEQ ID NO: 4160316 - RNA, 85 nt, Human
uucacuucuuaauagaaauuuaacuuuugauuuacuccccauauaccuuggaguucaaaaagguaaaguuuaucaggugagugga

SEQ ID NO: 4160317 - RNA, 85 nt, Human
uucacuuuagauuugucacauaaaauggagacugcgcaaugacaugcaaaguaaucuguuuaugugucuaaauaaaauaugugaa

SEQ ID NO: 4160318 - RNA, 86 nt, Human
uucacuuuauauuuagcacuugcuuuaccauuugaucucuagaguccacuggagguauugaggagagucagguuggacaaagugga

SEQ ID NO: 4160319 - RNA, 85 nt, Human
uucacuuuaucuuggccuuuauucuguacuucuguagcuaagauggagucagagagguggggaaugaggagcagagagaggagag

SEQ ID NO: 4160320 - RNA, 58 nt, Human
uucacuuucuauuuuugaaauauaccuucauggguggaauuuuuggugaggaagugag

SEQ ID NO: 4160321 - RNA, 62 nt, Human
uucagaaaucgaguuucauguccucacuaauaacauuuugaugacagaaaaguauuucugaa

SEQ ID NO: 4160322 - RNA, 74 nt, Human
uucagaacuuuucuuucagcuuuaccauuccaugauucuaacaucguugguugguaacugagaggggaugugaa

SEQ ID NO: 4160323 - RNA, 90 nt, Human
uucagaagcuucucugagaucagccacugacuuggagagauaacaguaaggcuuugagaucuagaggcugaucuuagucugcuguuugga

SEQ ID NO: 4160324 - RNA, 57 nt, Human
uucagagugguaugaagugaugauguagauauuugucauuccauuuccagcucugaa

SEQ ID NO: 4160325 - RNA, 91 nt, Human
uucagaguucaugugugacacagucaaucagaacagcauguacaguugcaugugcaguauucaugcauuugcuacacgcaugaacugugaa

SEQ ID NO: 4160326 - RNA, 67 nt, Human
uucagauaaacuacaaauaauuugggggacauauucauacuaaaacauuaauuguuguuugucugaa

SEQ ID NO: 4160327 - RNA, 59 nt, Human
uucagauguggcuuugucaggcguugccaaaguucccuuguuuuacaagccacauugaa

SEQ ID NO: 4160328 - RNA, 90 nt, Human
uucagcagcacgccuggccucuccuggcugaguuuccugcagggcggaggcaggugcgccagcucaaggggaggccggcagugccuagaa

SEQ ID NO: 4160329 - RNA, 72 nt, Human
uucagccgaauaacauucggucauggaggcugcacgacagugauuaucugugagcugaagugacaggcugag

SEQ ID NO: 4160330 - RNA, 64 nt, Human
uucagccucagggagucaucuugcuuauugacauuuguccuggugaggacucuggaggcaugag

SEQ ID NO: 4160331 - RNA, 76 nt, Human
uucagccuuuuaaaaauugcuuuuaugcagggcaugguggcaugugccugugguuccaguuuuuucggaggcugag

SEQ ID NO: 4160332 - RNA, 56 nt, Human
uucagcucaguuucaauaccagguuuaaacucuggacacgguuuauugcagcugga

SEQ ID NO: 4160333 - RNA, 69 nt, Human
uucagcugcaggccucuccuggggaugaccugaccuuggcgcacuccucucugaagucugcaggcugaa

SEQ ID NO: 4160334 - RNA, 79 nt, Human
uucagcuucugccugugcaugcagucagaacuucuugugucacugcaaaucuuuuugauucaucacacgcugaacugga

SEQ ID NO: 4160335 - RNA, 87 nt, Human
uucagcuugagaauauuugaagauguuagaagagggaaaaaauuccaaccaagaaucauauugauauuuaaaauauuuucaguugag

SEQ ID NO: 4160336 - RNA, 79 nt, Human
uucagcuuuugacacuaauugagugcaugaucuuugacaagucacuuaggguauuuaugccucaauuucuucaugugaa

SEQ ID NO: 4160337 - RNA, 59 nt, Human
uucaggaccacagugcauaagaaagguguugguaagcauuaugaauucuggucccuggg

SEQ ID NO: 4160338 - RNA, 73 nt, Human
uucaggacccucuguaauauaauucugggcaaauuuuggaaaggccagaggauuuacuagcaaggauucugaa

SEQ ID NO: 4160339 - RNA, 61 nt, Human
uucagggaggcagagaggaacuggccauauucuauggaagccucaguuugccuucugggaa

SEQ ID NO: 4160340 - RNA, 83 nt, Human
uucaggucaagaugaaauaucuugaagaaauucuuuucuacagagaugaaucccuaagauuuuuauaaaaacagggaucugaa

SEQ ID NO: 4160341 - RNA, 56 nt, Human
uucagguuauuugguuggccuuucucucuuucacggaagggcugcucuggccuggg

SEQ ID NO: 4160342 - RNA, 117 nt, Human
uucagguuuuuugugugugugucugccauugaggaguauaaaacuuuuuucaaagucguuuacauuuggcuuuggcaaggguuuuaauuguucauuggagaguaucuguaaccugaa

SEQ ID NO: 4160343 - RNA, 90 nt, Human
uucaguaggucugaggucaggccucagaaauugcacuggugacaagaucccagguaaucugauggugcuggucuagggccccacuucgag

SEQ ID NO: 4160344 - RNA, 83 nt, Human
uggauuaacuuagugaggaaucugcauaguuguacucagugguggcccugguacaaaaugcugauaucaacauaaguuaucca

SEQ ID NO: 4160345 - RNA, 56 nt, Human
uggauuauugagcugcuuggaaagcaauaguugcugccuguggcucuuguaauuca

SEQ ID NO: 4160346 - RNA, 56 nt, Human
uggauucucaugggaccaguagggauauccaacccagcuaguuccaccgguauuca

SEQ ID NO: 4160347 - RNA, 79 nt, Human
uggauuggaguguguuuuaucuauuguaucuuuaaauauauaaccagaagaagaauaaaucauagaauaccucuaggca

SEQ ID NO: 4160348 - RNA, 81 nt, Human
uggauuucauugacaugggagagaaauaaauguacauuuuauuuaugcuacuguuuugucuguuuuaugcaaccaaaucua

SEQ ID NO: 4160349 - RNA, 61 nt, Human
uggauuuuauguugaacagagugggcagggguuuuucucucuuaaagccaagcauaaacca

SEQ ID NO: 4160350 - RNA, 68 nt, Human
uggauuuucauccucacugauuuccuuugcaaaaugcccuugaaugucaggugugggcagagaaacca

SEQ ID NO: 4160351 - RNA, 58 nt, Human
uggauuuugagcuuccccacuaucucaggguucucugagguggagugcuuagcaucca

SEQ ID NO: 4160352 - RNA, 113 nt, Human
uggcaaacagcuuuaagaaauaaaugaugcucuaaagucuccauuuuuauagcauguuuugauguaaugauguacuuagaaggaucaaauguaauuucuuaauauguagguua

SEQ ID NO: 4160353 - RNA, 77 nt, Human
uggcaaacauuuacagaaacucuaggucaauugaggggcauaguucuuuuaaagucagaguuuuuccaguguagcua

SEQ ID NO: 4160354 - RNA, 59 nt, Human
uggcaaauucaucuuuaguucucugaaacaguucuaagagaccugaccagagguugcca

SEQ ID NO: 4160355 - RNA, 63 nt, Human
uggcaauacauaaucuuaauggcaagaucuaucauaacccuuugcuaugagguuaugauuuca

SEQ ID NO: 4160356 - RNA, 72 nt, Human
uggcaauauagagagaaaauuauguaauacgcauucaucuaauuacauaagcauaugucucuguaucuguca

SEQ ID NO: 4160357 - RNA, 75 nt, Human
uggcaaugaccaaaugugucacaggugaaaauguccaguaguuucuggcauuuaugacguguucggucaauguua

SEQ ID NO: 4160358 - RNA, 92 nt, Human
uggcaauuucugauuaacacugacaguaucagagcuguuuucacauuagauuaaaauaguaauuuagcugcuuaguaaaugauugaaugcca

SEQ ID NO: 4160359 - RNA, 62 nt, Human
uggcacaugguaagacucaguaagugucagauaagauaccucuacuguuguugcuguugcca

SEQ ID NO: 4160360 - RNA, 126 nt, Human
uggcacauuuggcaucuggugagggagucuuucugguucauggaugggcccagcucuguccucacaugguggaaggagcuagcucuccguggucucuuuuaugugggugcuaauuucaaccuccca

SEQ ID NO: 4160361 - RNA, 71 nt, Human
uggcaccucugucccaggccuaugguggagaucucaggugaaaauggugccugggacucaggaggagcuca

SEQ ID NO: 4160362 - RNA, 60 nt, Human
uggcacguaggagcuaugucagggcuccagcaugccuugacaugccuccuacaugaucca

SEQ ID NO: 4160363 - RNA, 71 nt, Human
uggcacuuuaaugauauucuuaauuugaguuggaagaguuuuccagagauccaaagaauaugaagaugcca

SEQ ID NO: 4160364 - RNA, 60 nt, Human
uggcagagcaaaaagauagaaugucuuuaugacaccgaagaacugucuuuuuucucucca

SEQ ID NO: 4160365 - RNA, 62 nt, Human
uggcagagcaggcuccaggcaaaauuucggagcacaaaacuguaucuucugggccuuuccca

SEQ ID NO: 4160366 - RNA, 98 nt, Human
uggcagagccaaaauauuguaacauauguugaaccagguguguaaguugaauaccuuuuagacauguaguugucacuguuaauauaaguggccugcua

SEQ ID NO: 4160367 - RNA, 55 nt, Human
uggcagaguaggauggcccuguagcugagaguggcaggauaaucccccucagcca

SEQ ID NO: 4160368 - RNA, 66 nt, Human
uggcagagucaucacaucuggaauguugugugccggguuccuggagccacguguggaugccugcca

SEQ ID NO: 4160369 - RNA, 63 nt, Human
uggcagagugagauaugaacccaggucuaucagcuaaaaccugaaaucuuggcucgucugcua

SEQ ID NO: 4160370 - RNA, 76 nt, Human
uggcagaugccaugccuuccuuucccuggaaaauuccccaugacucuuucaggaugcaaggaggccccaacugcua

SEQ ID NO: 4160371 - RNA, 103 nt, Human
ugggaaaaauguuguuuagucaauuugcauuggucauaaauugagugauuucauuguugugauuauauacaugacuugcacuugucugaaauagcauugacca

SEQ ID NO: 4160372 - RNA, 57 nt, Human
ugggaaaaggugccuggugccucggggcugggaagcuguggcuccaggaccuaccca

SEQ ID NO: 4160373 - RNA, 128 nt, Human
ugggaaaaugaauuuaaaaugaagucaggggaagcaucagaugugacugaaggcaggaagaguuugccuuggcauguggcauguggcugaaucugucugggcuucuauaucuguucagcagguuccca

SEQ ID NO: 4160374 - RNA, 91 nt, Human
ugggaaaauuaacggaacugucugcuuggaucauaaucccuccagucuaaauaaugcuuccaaaacagaacucugugaauuguuuucacca

SEQ ID NO: 4160375 - RNA, 86 nt, Human
ugggaaauaugcccaagauucuuacaucaugccaagacccuugaaaagggugguaccaugggugaaauaagggguaaaauuaucca

SEQ ID NO: 4160376 - RNA, 71 nt, Human
ugggaacagggauaaguaauuuggcaggcuuucucuuuucuauucaccuccauuugcuuaccuuguuucua

SEQ ID NO: 4160377 - RNA, 60 nt, Human
ugggaacauggaaauucugcucuguuucagccaaaacagaaaaacaggauuguguuccua

SEQ ID NO: 4160378 - RNA, 76 nt, Human
ugggaaccccauccacaugaccauugugcuccugguccuucuggaagaugaggaggugagcggucaugugguccca

SEQ ID NO: 4160379 - RNA, 121 nt, Human
ugggaacugcagucauuugaaaagauagcaaucaagcaucucuuucagagcccuguucaucuuucaguggcuuugcuucuccagaugcuuuugcuccuucaauuaucucugccuucuccca

SEQ ID NO: 4160380 - RNA, 121 nt, Human
ugggaacugcagucauuugaaaagauagcaaucaagcauuucuuucagagcccuguucaucuuucaguggcuuugcuucuccagaugcuuuugcucuuucaauuaucucugccuucuccca

SEQ ID NO: 4160381 - RNA, 55 nt, Human
ugggaagaugaggugccaugggauaacacacaaccauggcaggccuuuuuucuca

SEQ ID NO: 4160382 - RNA, 115 nt, Human
ugggaaggaaaagagaaagaaagugaaauuccuggucuuuguuguauguauccccuugcuuuuuagauaaauuaucagggguuuaaacacacacucucuccccucccuccuccca

SEQ ID NO: 4160383 - RNA, 119 nt, Human
ugggaagggcaagagaauguaagaggcagggcugaaggucccaggccagucaacagcgaggcugggagcucucacuucuggaucacuucucucacuucucacucuuggcaccuuuccca

SEQ ID NO: 4160384 - RNA, 55 nt, Human
ugggaagggucugaaucugagacuccagagggucucuuaccugagacauuuccua

SEQ ID NO: 4160385 - RNA, 71 nt, Human
ugggaagguaacauugccuccaucugaaaggcaaaaucacuugaacucagagaagguaagugaccugccca

SEQ ID NO: 4160386 - RNA, 59 nt, Human
ugggaauagucuuuacugcugaauugagguagaauggccucaaaagacacacauucuca

SEQ ID NO: 4160387 - RNA, 81 nt, Human
ugggaaucuuguuaaaaugcauauucugguucuguagguaaaggauggaaccugagauuuugcauauuuaagaagcuccca

SEQ ID NO: 4160388 - RNA, 84 nt, Human
ugggacacagcuagccucaauacggauaugcaaaaugcaucuuaagucuuuugugugcuugguauugaagacaggcuaaacuca

SEQ ID NO: 4160389 - RNA, 90 nt, Human
ugggacaggaguuagcucuucuaagucugcugucuucaucugcuuauguagaugguaacuuacaggccuuagcuuagcacuuauguguca

SEQ ID NO: 4160390 - RNA, 69 nt, Human
ugggacaugaugauuacucccauuugauagaugaagaacaugaaucagagaggguaaucaauuugccca

SEQ ID NO: 4160391 - RNA, 76 nt, Human
ugggaccuggugcuagcugguguguaacagggcaaagaggcugagaaagacaagcacagcuggugacuacaucuca

SEQ ID NO: 4160392 - RNA, 79 nt, Human
ugggacgaggccgccagugguugcuugcauggcuccaaaaguugacacuugggacaagcacuucacagccuccauccua

SEQ ID NO: 4160393 - RNA, 66 nt, Human
ugggacuggagucagggaaaaagugucuugaaaagugaaauuuuccuccauggcuccauauuacca

SEQ ID NO: 4160394 - RNA, 57 nt, Human
ugggagaaacugucucucccacaucuggauuggggcagagaccagcuguuacuccca

SEQ ID NO: 4160395 - RNA, 104 nt, Human
ugggagacacuaucuuaacucaucucauuacucaagccauuuguuguccuucaggcuuugacagccaggagaugggaaaguagcagaggugaugugaucucuca

SEQ ID NO: 4160396 - RNA, 119 nt, Human
ugggagaggagaguaggcgggagccccugggcgguuuucgccuacagacgcuaccacugugggagugugugugggcggaacggccccggagcagaacaauugcgccccucccccugcca

SEQ ID NO: 4160397 - RNA, 76 nt, Human
ugggagagggaacucaguauugacccaguuuguucucuuugaauagcacugggcauuuugaacguucuuucuugca

SEQ ID NO: 4160398 - RNA, 56 nt, Human
ugggagauggggcaggcaggaauuuccggaccaguucugccugcuccuggcuucca

SEQ ID NO: 4160399 - RNA, 57 nt, Human
ugggagaugguucugagacuuugcaucaccagggaucucuuuuuaaaaucucuccca

SEQ ID NO: 4160400 - RNA, 66 nt, Human
ugggagcacuuaugggccaacggggaguguggagagaaacccuggccagccuuuggacugcuccca

SEQ ID NO: 4160401 - RNA, 114 nt, Human
ugggagcagagggcaaauuggacaucaaagaguugcuaaaggcuuuucggcuguggaaggccgaggagcugaugauucuuugaucuccacuucccccuacacacacugcuccca

SEQ ID NO: 4160402 - RNA, 76 nt, Human
ugggaggaggggcgcuuugucuaugcagucuucuuacggcucaucacgguacagacagggcaccugccuccugcca

SEQ ID NO: 4160403 - RNA, 87 nt, Human
ugggaggaucucaugagcccaggacuuugaggcugcagugagccaugauugcaccacugcagccugggcaacagagugagacuguca

SEQ ID NO: 4160404 - RNA, 81 nt, Human
ugggaggcuuucuccgacuugauaaacuccuccuccucuauuccaguucagaugucaucucuugcaggaagccuucuccca

SEQ ID NO: 4160405 - RNA, 78 nt, Human
ugggagggauugggauggagccugaguauaguuuaccuucucagagaacauucagacaccguaccuauugcccuuuua

SEQ ID NO: 4160406 - RNA, 94 nt, Human
ugggagggucuugcucuuucacccaggcuggagugcaguggcacaaucucagcuaacugcaaccuccaucuugugggcucaagugauccuccca

SEQ ID NO: 4160407 - RNA, 55 nt, Human
ugggagguaaagaaugagaucucaucauuuaacggugagguacacauacuucuca

SEQ ID NO: 4160408 - RNA, 71 nt, Human
ugggaggugaugcaugugccaaaaucugaagugaguaagcacucaaauaaugccauucaucaucaucauca

SEQ ID NO: 4160409 - RNA, 73 nt, Human
ugggaggugcugacaggaggcuugaggccaggcaggagcagcccaucuggcccaucuucugccaccaccccca

SEQ ID NO: 4160410 - RNA, 76 nt, Human
ugggagguggggccugucagagauggggagucagaggugacucuuccgggucuucuugaugauccagggccuccca

SEQ ID NO: 4160411 - RNA, 71 nt, Human
ugggaguugugcugucuccggccucauuugucucccugcgacugauguggccuuaaugacagcagcucgca

SEQ ID NO: 4160412 - RNA, 69 nt, Human
ugggauacaagcagagguagggugugcaguuucugagaagugcauugcaucucugcuucaauccuccca

SEQ ID NO: 4160413 - RNA, 123 nt, Human
ugggauagaagugagggaagagguggcuaggccugaccggaauguagaggccggauagccuauuaacagugucuaguuuuagcuuuuggagccagcugccuagcuucaaaccacaacuuccua

SEQ ID NO: 4160414 - RNA, 63 nt, Human
ugggaugcaggagggcuaaaguaggcccaguaaggaugggcuuccuguauccuccuguaccca

SEQ ID NO: 4160415 - RNA, 87 nt, Human
ugggauggugcaagggguggcaguggucucugacagagcuggcuggcugcugauagccauggccuccuguaaagcugcgguauccua

SEQ ID NO: 4160416 - RNA, 67 nt, Human
ugggauucaaccaauguuuauugaaugaaugagcacugaaguucauuuaaugcugaguugaauguua

SEQ ID NO: 4160417 - RNA, 61 nt, Human
ugggauucaguuaagggucuugagaugggaagaucaucuuggauuaccugggugggucuua

SEQ ID NO: 4160418 - RNA, 67 nt, Human
ugggauuguaacuguggguugauuagaucauuuaaucuugcucucauuucucuacauuauuuucuca

SEQ ID NO: 4160419 - RNA, 56 nt, Human
ugggcaacuuaguguucucaaauacucuuccuauuuagggggcagugggaugcuua

SEQ ID NO: 4160420 - RNA, 63 nt, Human
ugggcacaccacagaauucugucuccaggagugaguaacugcuugugacagaacuguguccca

SEQ ID NO: 4160421 - RNA, 65 nt, Human
ugggcacccaggcaucacgggcauguggccucccaugggcggccucauuccaggagcagguccca

SEQ ID NO: 4160422 - RNA, 57 nt, Human
ugggcaccugaggccuggcaggcccgggcgagcugaggccccagccagggcugccca

SEQ ID NO: 4160423 - RNA, 65 nt, Human
ugggcaccuguucuugugcugccugcagagaagauuggagcacauaccagaaccacagguuucca

SEQ ID NO: 4160424 - RNA, 61 nt, Human
ugggcagacaggccccgucuggggguggugaggucaagccccuaaggacaccugcugucca

SEQ ID NO: 4160425 - RNA, 55 nt, Human
ugggcagacauugaguuuguucugcuaagacaacuuuacuacagaaugucuccca

SEQ ID NO: 4160426 - RNA, 56 nt, Human
ugggcagaggcucugaaguccaccgccuuauuugguauggaaaucuguuucucuca

SEQ ID NO: 4160427 - RNA, 58 nt, Human
ugggcagcagaaccaggccgaccacagggacagacgugguccaggcgugagcugccca

SEQ ID NO: 4160428 - RNA, 70 nt, Human
ugggcagcuagcacaucaggcccaggagucugcugcguugcagaagcugcugaaguguuggcccugccca

SEQ ID NO: 4160429 - RNA, 97 nt, Human
ugggcaggaaccgggccggggcgauggggcugggauucuccucgggcgccccggcaggaccccggccucacuagccucugcccaggauaucucucca

SEQ ID NO: 4160430 - RNA, 71 nt, Human
ugggcaggucacuuaccuucucugaguucaagugauuuugccuuucagauggaggcaauguuaccuuccca

SEQ ID NO: 4160431 - RNA, 57 nt, Human
ugggcaguagagcaauuuuaccuaagcugaaaugcacuauaauugcuuguacuccca

SEQ ID NO: 4160432 - RNA, 58 nt, Human
ugggcagucaucagcacaccggcucucacgagccugugggaaaggaugagauugccca

SEQ ID NO: 4160433 - RNA, 66 nt, Human
uucuaaauagaaaagauuucagcugccaagcgcuacugagguagagugaagauuuuguguuuagaa

SEQ ID NO: 4160434 - RNA, 85 nt, Human
uucuaaccagagcagcaguuguuacaaugaugccuuacuaaaagaagguagauuauuuuagagauugcuuagguaaaggucagaa

SEQ ID NO: 4160435 - RNA, 60 nt, Human
uucuaagauucaugaggacaggauuaggguuugugucuuguuuguuauuguuucuuagaa

SEQ ID NO: 4160436 - RNA, 82 nt, Human
uucuaaggacuaucaaguagguugguuuuuaucaacugcuguugacacacugcagaaaaucacaagcuugggucacuuaggg

SEQ ID NO: 4160437 - RNA, 71 nt, Human
uucuaaggcuugaagucagaucugacccucgaaguugacacuccagccucuuugacucucaggucuuugaa

SEQ ID NO: 4160438 - RNA, 59 nt, Human
uucuaagguguaggagagguggaaacuguagaagcugcugccauccuuauagcugagaa

SEQ ID NO: 4160439 - RNA, 64 nt, Human
uucuaaguccuaccugaaagcaaauaucagguuugauaaaccuugcagggcuggaggcuuagaa

SEQ ID NO: 4160440 - RNA, 77 nt, Human
uucuaagugcuccacuugcauagacccagcaggucagugccuggagggauagaaugcaagaggagaaggucacagaa

SEQ ID NO: 4160441 - RNA, 69 nt, Human
uucuacacucacccagcuguaacaaggugcuccaaccuccccgccucccaugcugagguggugucagag

SEQ ID NO: 4160442 - RNA, 67 nt, Human
uucuacagguguuuucuuuacuuuagagacaaggggcacugagguaaauagaaaaaccaugauagaa

SEQ ID NO: 4160443 - RNA, 67 nt, Human
uucuacaugauuugagggaagauagagacuagaaguuuauuucagcuuucugucagauuauauggga

SEQ ID NO: 4160444 - RNA, 59 nt, Human
uucuacauugugaaguucuuuauccuaccuguguaucccuagggcuuuacagaguggag

SEQ ID NO: 4160445 - RNA, 75 nt, Human
uuagguuugcuuuauguguaugacuugacuuuaaauaagaacagucaaacucauuuuaaacuagagaaaaccuag

SEQ ID NO: 4160446 - RNA, 64 nt, Human
uuagguuuuaaauaugggcaaauuggcuaaugcaaguugauaaccaucaucuuuaaaauccuga

SEQ ID NO: 4160447 - RNA, 72 nt, Human
uuaguaggaguaggaguagaacucaucauucaucuaaucaugggagcaaaugacuucugcuucuagaacuga

SEQ ID NO: 4160448 - RNA, 96 nt, Human
uuaguaugucgcauuuauucuaggcacuaugauugaugcuaggaauaaagacaaaaauaccacacaguccuugcucugggaugauguacauacuga

SEQ ID NO: 4160449 - RNA, 55 nt, Human
uuaguauuuguggugccaaugugaaugccacaaauggccaaaaccauauuauuaa

SEQ ID NO: 4160450 - RNA, 76 nt, Human
uuaguccccuucauaaucugaaauuuguaagguguuaucuccguuuuacagauaagcacauugugacugggaagag

SEQ ID NO: 4160451 - RNA, 63 nt, Human
uuaguccucuguuaugugcuaguaugccuguuaggguacuugacugcaaacagcagagacuga

SEQ ID NO: 4160452 - RNA, 82 nt, Human
uuagucucaucuguauaagcaugcuucauauggauacacaaugcugugcaucuccugacugauguucauuuagggagauuga

SEQ ID NO: 4160453 - RNA, 78 nt, Human
uuagucugauuguuuaagagcauuugcaauuuaugaaauauaucaggaaauguaauguucuugaaaaggaauggcuaa

SEQ ID NO: 4160454 - RNA, 57 nt, Human
uuagucuucuuccuuauauguuguuuauguauauucaagaaugagggacaaggcuga

SEQ ID NO: 4160455 - RNA, 65 nt, Human
uuagugaggaaagauuuuuaaagagcucauucaacauaguucuuugaaaagauauuccuccuuaa

SEQ ID NO: 4160456 - RNA, 64 nt, Human
uuagugaucauccaguuucuuguccagcaccagucuagugcuugacuagauuaucuggaucuaa

SEQ ID NO: 4160457 - RNA, 60 nt, Human
uuagugcuaguuucacaacaagcaaaauaaccauagugucucuugagaaauaagcacuaa

SEQ ID NO: 4160458 - RNA, 66 nt, Human
uuagugucuucuucauccucuguuugcagugaacaugauauucgcuaaucagugaagagacauuaa

SEQ ID NO: 4160459 - RNA, 55 nt, Human
uuaguguguccaguucugaaaauccuuuggguguuaaaggaacaaggcacacugg

SEQ ID NO: 4160460 - RNA, 93 nt, Human
uuaguguuugguuguguuagguuuccuaaaugagacaaagucauuaauguuuaaauuuagaagaaacacugaauugaccaaaaaaaauacuga

SEQ ID NO: 4160461 - RNA, 57 nt, Human
uuaguuacuuauaggugauagaccuuauagaauagaauguucucuauaggugauuga

SEQ ID NO: 4160462 - RNA, 106 nt, Human
uuaguuagggcuuuuaauuaacuuccaaaugaauauuuccauggguucuuguaauccauaaauucauggauuauguucaguguuuaugagagcuggcccuaacuga

SEQ ID NO: 4160463 - RNA, 76 nt, Human
uuaguuguggugagcucuuugauaaauaugugacaaaucuuacugagcaucuauuauuugcaaagaacuacacuag

SEQ ID NO: 4160464 - RNA, 70 nt, Human
uuaguuuccucccuggaaauucucuucccgcccccugggaaagcugugggaagcuccauggaggugcugg

SEQ ID NO: 4160465 - RNA, 93 nt, Human
uuaguuuguagaauggauuaaugaauacauuuuguagcucuuugcauagauuacacauauguccauuaaucaguagugagaaucuaaaacuaa

SEQ ID NO: 4160466 - RNA, 65 nt, Human
uuaguuuguuauucuguuguucaggguugggggaaaccuggagccugacagcugaauuguacuga

SEQ ID NO: 4160467 - RNA, 95 nt, Human
uuaguuuuguuuucagucacuuuauuaaauuauggauuuaggagauaacgucucaugcauacuagauauuuauucagugacuucacaagugcuag

SEQ ID NO: 4160468 - RNA, 56 nt, Human
uuauaaacgagaagacuaagucuuggagggaucaugagaguguucucguuuuauaa

SEQ ID NO: 4160469 - RNA, 66 nt, Human
uuauaaugcagcaguugcaacgaucuggggcaugaggccauuuugaaugaaauugcuguguuauga

SEQ ID NO: 4160470 - RNA, 90 nt, Human
uuauaauuauuuauaguaacugugguaagauauuucacaaaagaguuacccuuuaguggaauguguucuauuuuacagaaguaaauauaa

SEQ ID NO: 4160471 - RNA, 76 nt, Human
uuauaauucaugaaauagcacuuaaguaguacugcuuggacaguuacugcuuguuagcuguauuugcugaauuuaa

SEQ ID NO: 4160472 - RNA, 63 nt, Human
uuauacauguuuauaagguugauaugauucaucuuauuugcuaacuuuuauaaauguguguga

SEQ ID NO: 4160473 - RNA, 108 nt, Human
uuauacuauugguguaauaaaagaguuaaauugucauuugagcaaugaguuucuucuaagaagugugaauauuauuaaauggcagaauuuuugcaucuauagguauaa

SEQ ID NO: 4160474 - RNA, 79 nt, Human
uuauagaagcccuguaaauugcccuuaauuuuggaugauauaucauuaacucuuaacggucauugacuggguucuguga

SEQ ID NO: 4160475 - RNA, 59 nt, Human
uuauagcaggugacuaaugaguauuucaccaccaugauauuuugaguugcaagcuauag

SEQ ID NO: 4160476 - RNA, 60 nt, Human
uuauaggcuuaguucuguguguuuuucuauuauagaauuaaacauaagucuggcuuguag

SEQ ID NO: 4160477 - RNA, 63 nt, Human
uuauauauauaugugcuauugaguuuccuuugauugacagcuccuguaguacauauuauuuag

SEQ ID NO: 4160478 - RNA, 70 nt, Human
uuauaucugucgugauccauucccauggauuuacuggcaacaaagaaucuuggauuggagaaagaagugg

SEQ ID NO: 4160479 - RNA, 107 nt, Human
uuauauggaaaguaaucaaagaauuuuggggggauuaauuuauuuguuuuuauauaucagauacuaguuacagcacucaaaguuuucagguuagccuuuaaauauga

SEQ ID NO: 4160480 - RNA, 60 nt, Human
uuauaugucuauugcuuggguuacaucaguagauuugaguagcugcaacagacuguaugg

SEQ ID NO: 4160481 - RNA, 72 nt, Human
uuauauuucaucagcccugugagauuagaacagcagauauuguuauuuccauuuuaugggugugaaauauag

SEQ ID NO: 4160482 - RNA, 79 nt, Human
uuauauuuccugcuguaaaucacugauuaaaguuagaaugaugcauuauuuuaauucaaagugaauaguggaguuguga

SEQ ID NO: 4160483 - RNA, 128 nt, Human
uuaucacacaccuucacaguuuuaccagugucagaaggaggccuguuuucuccuggaaugcuacauucuuuggggaugaaguguuuugagucuuuagcacugcauuggagugucucuggaguguuuag

SEQ ID NO: 4160484 - RNA, 89 nt, Human
uuaucacauguuuauggaauagauuauuuuuauuucuauuucacagaugaaacugaaacuuaggaaguaaucuuuguaaaaugugguaa

SEQ ID NO: 4160485 - RNA, 124 nt, Human
uuaucaguagaacaguaaguaauuguauuaguauguucuaggaaugguugaugaaggaaggaagaaaauuucacaaauacuugaauuauuaaaauaagaaacuuuccaaaauuuuugcugauag

SEQ ID NO: 4160486 - RNA, 60 nt, Human
uuaucaguuccaauuccaaauuccaaggagaauccgauuggcucaaauuggaauagauga

SEQ ID NO: 4160487 - RNA, 71 nt, Human
uuaucauacaaagaaaagaguaaaaagcuuuuuagaaagaggcagguuuacucuuauuugguaaaagauaa

SEQ ID NO: 4160488 - RNA, 68 nt, Human
ugggcagucuuaucagcauuggacaugcauaaucuugccuugcaaaguuuuugcuaugaaauugcaca

SEQ ID NO: 4160489 - RNA, 65 nt, Human
ugggcaucaaacacgggccaugucacuuugaaugucuccugcuucaagggcuguguucaugccca

SEQ ID NO: 4160490 - RNA, 62 nt, Human
ugggcaucugacuugugaauccuucccauaacuaagccccgagagauuuccaaucaugccca

SEQ ID NO: 4160491 - RNA, 130 nt, Human
ugggcauuggggcccggggaccagccaaccucuugaacaccuggguccccuggggccuacccguguaaguugagccugagcccaggugugcagaggagaggcugggagccaugcccagccccacagccca

SEQ ID NO: 4160492 - RNA, 55 nt, Human
ugggccaauugcuccccaaacuaauaagaucagaguuuagaaguagucuggcuca

SEQ ID NO: 4160493 - RNA, 58 nt, Human
ugggccacuucuagugccucagacacuccgcggucugcacacugcuagauguggugca

SEQ ID NO: 4160494 - RNA, 59 nt, Human
ugggccagcuaacucaucuaaagaaaucauuccgugugauucuagaaguuugcuaccca

SEQ ID NO: 4160495 - RNA, 56 nt, Human
ugggccaguuggugacuacaaacuaucuugggccuguccucacucuuccuggcuca

SEQ ID NO: 4160496 - RNA, 59 nt, Human
ugggccauuuuuggaagacuggggauucugguaggagaccacauaguugaaaugggcua

SEQ ID NO: 4160497 - RNA, 66 nt, Human
ugggcccaggcauuuuucuaaucauuggcaucacaauagugaaccaaacaaaaaugccuguccuca

SEQ ID NO: 4160498 - RNA, 130 nt, Human
ugggcccuccuggggguugcagugccuugggcuuggccuuugaagaucuuugcauugcagggaagccucucuacacuccagagucucaucaugcuucccaggguccugcuuuaaaucucuucccagccca

SEQ ID NO: 4160499 - RNA, 60 nt, Human
ugggccucuguuuccucaucugcaaaguacccauuuuccagaugaggauacugaggccua

SEQ ID NO: 4160500 - RNA, 59 nt, Human
ugggccugcuggggcauuuucaaaagacaaauaguccugcugcugcuccagaggaccca

SEQ ID NO: 4160501 - RNA, 65 nt, Human
ugggccuggagcagagacuagggaaagcuucccuuuccuugauugcuuguuuucucuccagcuca

SEQ ID NO: 4160502 - RNA, 57 nt, Human
ugggccuguugccugaguccauccucaaaagggugacagcaccaggcaacacgccca

SEQ ID NO: 4160503 - RNA, 55 nt, Human
ugggcgccgugacuaaggcuccugucagcgucugcguggagcccacggcguccca

SEQ ID NO: 4160504 - RNA, 113 nt, Human
ugggcgggacuggagaaaggagagaguuuuuuggcuuugaaggauguagggcuccugagaauaccacagguccagcucaaagugcuccuguccuuucacggucccagagccca

SEQ ID NO: 4160505 - RNA, 103 nt, Human
ugggcgggggcacagcugccaccaugccaugccuugggcauuggaagagcaggacccaggagugcagggaugguaucacuguugccccuuugaaaaugaccca

SEQ ID NO: 4160506 - RNA, 83 nt, Human
ugggcuaauaaauagagauaucaauuucauggugaucgucacugaucuuuacuuuaaaaacugauaauucauuuuuugguuca

SEQ ID NO: 4160507 - RNA, 57 nt, Human
ugggcuagauauuuuugggcugcaagaauuccuuuugcuuagauggauuuuggccua

SEQ ID NO: 4160508 - RNA, 57 nt, Human
ugggcucauggcccagcacuggggcccauuaggguuagcugcuguggccagaaucca

SEQ ID NO: 4160509 - RNA, 65 nt, Human
ugggcuccacacugaaauauuaauaucuuauuguuuugaugaugaugaugauguucauuggccca

SEQ ID NO: 4160510 - RNA, 82 nt, Human
ugggcucccugggccugccacggagccagcccucugccgugggguucagggccucuggcaggcaggcccuccagggacccca

SEQ ID NO: 4160511 - RNA, 58 nt, Human
ugggcuccucgucacucgcuguguccucacuggccaugugcugggaaugagcagcuca

SEQ ID NO: 4160512 - RNA, 74 nt, Human
ugggcucuggagggccuaggauccugggacacggugggguuugcgaacucugggagccgggccugccaggcuca

SEQ ID NO: 4160513 - RNA, 57 nt, Human
ugggcugagaguaccuuauaaacagggacagugugucuuaaaaagugcucaggccua

SEQ ID NO: 4160514 - RNA, 78 nt, Human
ugggcugagugcuuccugugauauuagccacugugcagcacugggcaggguucauguuaucacaggugcagaagugca

SEQ ID NO: 4160515 - RNA, 56 nt, Human
ugggcuggaaggcccuuuguugaucucaagagagagaccuuuugccuucuaguuua

SEQ ID NO: 4160516 - RNA, 57 nt, Human
ugggcuggcugaggcauucacugaaacuacaucacagcugaaagucucucucaccca

SEQ ID NO: 4160517 - RNA, 64 nt, Human
ugggcuguucuuuggcuuccuuuccgucuuauguuugauguggaucacacaaggagcuggucua

SEQ ID NO: 4160518 - RNA, 78 nt, Human
ugggcuuagauugaaugcagucaugaaaaguugccacgcaaaaggaguagcuuguucucauccauucuucugaguuca

SEQ ID NO: 4160519 - RNA, 84 nt, Human
ugggcuucaaaaaugcauucucaucgaccuucagauauuuaaggauauuuggagaaaaguugagaccauguuuuuugccaccua

SEQ ID NO: 4160520 - RNA, 62 nt, Human
uucaguuugcugaacuaaaauucugaaggucugguuuucaggugugaugucugcgaacugga

SEQ ID NO: 4160521 - RNA, 105 nt, Human
uucauaaguuuacauguaaauucucuuggauacagaugaaaggaaggaccauagcacaaauguauuuuuuccaaacuguucuaagaauuuugaaaaacuuaugaa

SEQ ID NO: 4160522 - RNA, 63 nt, Human
uucauacauguguacuguuccagggauuuauuuuugaucuaaugguauauaucacaugaugag

SEQ ID NO: 4160523 - RNA, 70 nt, Human
uucauacuuuaaaauagggcaccauuuuuauuuagcagaauaaguaguccugauuuaaccuugguaugga

SEQ ID NO: 4160524 - RNA, 61 nt, Human
uucauaguaucauuuuaguagguguuaccuccuuuuaacuccugaggaaauggucucagaa

SEQ ID NO: 4160525 - RNA, 96 nt, Human
uucauauaaagcuuuauuugucauucacggcugguuggcaaaacugacuuugcuuuugaaaaugacaggugguacucuggugagcucuguauagag

SEQ ID NO: 4160526 - RNA, 60 nt, Human
uucauaugaauuggguuuuuuuuacuuuguuuugaaggaaaguuacccaaucucuaugaa

SEQ ID NO: 4160527 - RNA, 64 nt, Human
uucauaugauguaaauagagccuagguagcaggaguuuccuaccuagguauuuuacacagugaa

SEQ ID NO: 4160528 - RNA, 72 nt, Human
uucauauuaaauauuguuggucacuauauuuaaauaucucuaaauggagaaugugauauagugauaugugga

SEQ ID NO: 4160529 - RNA, 71 nt, Human
uucaucaaagagaaguuuuucuuauuacauguaauacauaguucaugauggacaaagacuucucuugugag

SEQ ID NO: 4160530 - RNA, 55 nt, Human
uucaucaccuugguagcacuccuggacugcaggacuuugcucagcuggugcugaa

SEQ ID NO: 4160531 - RNA, 70 nt, Human
uucaucacuguguguguggcuguuuuccagggagggguuggccuguggacagcccauacacaugucugag

SEQ ID NO: 4160532 - RNA, 123 nt, Human
uucaucagcccaccagaccugggccugcugggccccacaguccccugggagaguugccccuacccacaacccaugggacuugggaaggcccaagccagagguaggugggaagcugcuggugaa

SEQ ID NO: 4160533 - RNA, 63 nt, Human
uucaucuaaauaaaagugcuuaauguuucucuuuuggaaauugccaguguuuauuuaggugaa

SEQ ID NO: 4160534 - RNA, 70 nt, Human
uucaucucaucuguugauuuuaagucuuccaaagguugcuggaaagcaugauuagauagaugauugugaa

SEQ ID NO: 4160535 - RNA, 66 nt, Human
uucaucucuuauguuuauggauacauccccagauccagaacgguauccaucacauggucugaugaa

SEQ ID NO: 4160536 - RNA, 59 nt, Human
uucaucuuucauggcugauuuaagggaggacuugcuuccuguccagcccugaggaagaa

SEQ ID NO: 4160537 - RNA, 78 nt, Human
uucaugagaguuccugaaaucacuacugcuaugccuaaguaaaacaugugucaaguggaauuucaggguauguaugaa

SEQ ID NO: 4160538 - RNA, 76 nt, Human
uucaugcucugugagugaugaaacugagguuccaagagauuacuuaucuugcucagaaucauuucacuaguaugga

SEQ ID NO: 4160539 - RNA, 68 nt, Human
uucaugggcaguggucugacuucuucuuuaugcuuuucccuggagcagcagggucauugcucuuugaa

SEQ ID NO: 4160540 - RNA, 108 nt, Human
uucauguaaucuucuggauaauauauugaaaaggacagcuggcucaggagggaucauuugccuggguuaguaucuguuuccauuuauauuaagaaaauauugcaagaa

SEQ ID NO: 4160541 - RNA, 64 nt, Human
uucauguccagaggaaguugaggggcccagauucucuaccuucaaaacuuccuaggcgcgugga

SEQ ID NO: 4160542 - RNA, 69 nt, Human
uucaugucuuauauccugucuucaugucuugcuuguaccuuaguuuugaacaguaugugggacauugag

SEQ ID NO: 4160543 - RNA, 91 nt, Human
uucaugugaugauaguggaugccggcucuuagcuuccaacacugauugcuauucagggacugggauucuggaucugcuccaaucaugugga

SEQ ID NO: 4160544 - RNA, 60 nt, Human
uucauguuguguugugguuuccaggaagacaaaaugcacuuuggaccacaucaacuugaa

SEQ ID NO: 4160545 - RNA, 63 nt, Human
uucauuaagggcugucaugugucagugaccuuacgguaaggucugaguuacagucuucuugga

SEQ ID NO: 4160546 - RNA, 75 nt, Human
uucauucacuuaacauuuaccaaggaucuaccauaaaucagauaauguugaagauucuggagagagagugaugaa

SEQ ID NO: 4160547 - RNA, 79 nt, Human
uucauucauccauccauucauuaauucuaaagucugcaccacuggggucuauagaaacuugaggggauauaaugaugaa

SEQ ID NO: 4160548 - RNA, 71 nt, Human
uucauucccuuauauuagcauugcuacuuuuagauaaacuauuccugaaaugauuaguguaggaggaugag

SEQ ID NO: 4160549 - RNA, 93 nt, Human
uucauuccuuuuggcuguuuuugguuguuggguaagaguauaaauaucucuauacugauauuuucaacuagaagccagaaaacugggauugaa

SEQ ID NO: 4160550 - RNA, 76 nt, Human
uucauugagcuaggcccuaagagauuguggaguggagaacuucaagguggcuaaauggggcccuggguuggguggg

SEQ ID NO: 4160551 - RNA, 61 nt, Human
uucauugagcucuuccugugugccagguuucaaccuggguaggugcuggggauucagugga

SEQ ID NO: 4160552 - RNA, 61 nt, Human
uucauugagcuguacacuuaggauuugggugcuuuacuguuguauguuauaacucaaugaa

SEQ ID NO: 4160553 - RNA, 64 nt, Human
uucauugagugguuuauucuaauguuaggugaacugucacgaguaaaacuacuaacucaaugag

SEQ ID NO: 4160554 - RNA, 61 nt, Human
uucauugauuuccuuggaauaagauuuuuauaacuuucuuuauuccauagaagucaaggaa

SEQ ID NO: 4160555 - RNA, 77 nt, Human
uucauuggacauucuacucucugauucccuggguucgacuacucuagggaccucauguaaguggauuccagagugaa

SEQ ID NO: 4160556 - RNA, 62 nt, Human
uucauuggcuucucuaccgaauuaguucuauaauuucucucaucuuuggggaagcucgugag

SEQ ID NO: 4160557 - RNA, 55 nt, Human
uucauugguuugauauugccauggcaacucugcaacaugguaacacgccagcgaa

SEQ ID NO: 4160558 - RNA, 59 nt, Human
uucauugugaacacauucugccacaacagcugagguagaacauuguguuuauuugugag

SEQ ID NO: 4160559 - RNA, 111 nt, Human
uucauuucaguucucuucugaugcagaauuauggugcuggcuuccauugaauggcaaaugggaugagaugguacacauacgauucugccucacugaugaauuuggggugga

SEQ ID NO: 4160560 - RNA, 108 nt, Human
uucauuucuuuguaucucugccauuaaugugaaggaaggaaacagagaucccuacucuaauucccucugauuuuaucauuaauguagcucuggaagacauuuaaugga

SEQ ID NO: 4160561 - RNA, 62 nt, Human
uucauuugcaaggugauaaaagaaugaauggaaauuuaccuaugagcaccucuguaauugag

SEQ ID NO: 4160562 - RNA, 55 nt, Human
uucauuuuauaaacccugcugaaagucagguuagcaacaugguauguaaaaugag

SEQ ID NO: 4160563 - RNA, 76 nt, Human
uuccaaaaugugagucccaccucaaagcagggcuauugacugcaucaaaucauaauuugagguguucacuuuggag

SEQ ID NO: 4160564 - RNA, 70 nt, Human
uuccaaagaacaugaacacaauguuuagaaauugguuucugagcccuugguauguucauuguuguuggag

SEQ ID NO: 4160565 - RNA, 76 nt, Human
uuccaaagccuggcucugccguaaccaccaguggggaacugcuccagcucggccagcccagaaccgggccuuggag

SEQ ID NO: 4160566 - RNA, 55 nt, Human
uuccaacaccagcacagggcuccccagggacacugggagcaagcuggugcuggag

SEQ ID NO: 4160567 - RNA, 68 nt, Human
uuccaacaguuuaugugaggagaaacuggcauaugcuauuagaaucuucaguuguaaaaguguuggga

SEQ ID NO: 4160568 - RNA, 67 nt, Human
uuccaacaugaauuuuucuguggguuaauggauagguuugauuaaacacacugagauuuauguggag

SEQ ID NO: 4160569 - RNA, 90 nt, Human
uuccaagagacucuugaagauucuuuuuguuaguagggaaaacauucuccauuuuucugccaacuuuaggguuuucagagaaguuugggg

SEQ ID NO: 4160570 - RNA, 70 nt, Human
uuccaaggcugcuauuuguuucucagauaacuugugaaaauaaaucaagggcaguauuuccuuuuuggag

SEQ ID NO: 4160571 - RNA, 67 nt, Human
uuccaaggguaggucauauaagacaaccagcuuucuccugguucucuggggaugcuuauucuuggaa

SEQ ID NO: 4160572 - RNA, 90 nt, Human
uuccaaggugaauucagaggugggcugagaggauguggggagaggcaucaacaaagucugcugcagucguggcucuaaacacccuuggga

SEQ ID NO: 4160573 - RNA, 80 nt, Human
uuccaaggugacagggagugauauagcagagacagagucuccugucacuucuauaaaagacuuauccuguggcuuuggaa

SEQ ID NO: 4160574 - RNA, 84 nt, Human
uuccaaguauaugugugugugcauguguguguacccagguggaacccuccugcaugcucacauaugccuuuaugaauacuggaa

SEQ ID NO: 4160575 - RNA, 77 nt, Human
uuccaagucucucauggagaaaguuggcagacauucaacauggucaugccaauuucugcauggcuauuucuugcggg

SEQ ID NO: 4160576 - RNA, 59 nt, Human
uuccaauacaguuuuugaaaggcagaaugaaacaucucaaacuagaggcuguaauggaa

SEQ ID NO: 4160577 - RNA, 69 nt, Human
uuccaauucuccuacaccauuagaaguucuggggacaagcaccugcacaguggaggaaauuaguuggga

SEQ ID NO: 4160578 - RNA, 75 nt, Human
uuccaauuguuuaugagcugauuaguguuguagaaauacauucugcagcagaauaaucugcucaguaauuuggaa

SEQ ID NO: 4160579 - RNA, 84 nt, Human
uguauuguuuuugaguugcuuauuuaauaggccuuuauuagcacaagcaucuggucuagaagaguaaguguuaaaaaggaagca

SEQ ID NO: 4160580 - RNA, 64 nt, Human
ugucaaaaccagcaauuuuguuccuagguagauaaccaacagagaugcaaguguguauuugaca

SEQ ID NO: 4160581 - RNA, 67 nt, Human
ugucaaagaacauuuguccauuggcuucucgaaucguuuauucagucaaacaaauguuuauugagca

SEQ ID NO: 4160582 - RNA, 83 nt, Human
ugucaacagaaggauggcuuguaauagccaaaaccucaaacaauacauuugauaggcaaauuaauaagucauauaucuguaca

SEQ ID NO: 4160583 - RNA, 55 nt, Human
ugucaacagaucucaaagcuggcugucuccuauagcuaggaagauguguaugaca

SEQ ID NO: 4160584 - RNA, 56 nt, Human
ugucaacagucauucuaguaugguggcauuccuccaggagggggauggcuguagca

SEQ ID NO: 4160585 - RNA, 74 nt, Human
ugucaacuuccagcagacucuucuccuggggcuuaauaucuauagcagucccacuuuggauucugcuggagaua

SEQ ID NO: 4160586 - RNA, 56 nt, Human
ugucaauaguuuugaguucucuacaaaacuacagagaccaagguacacuauugaca

SEQ ID NO: 4160587 - RNA, 129 nt, Human
ugucaaugauuguugguguauuauauacgugccgggugcuucacugaccuguuuucacaagauagcccuauuuuauggaugaguucaaugaggcagagggcggugaggugaucugcucacuaucacaca

SEQ ID NO: 4160588 - RNA, 82 nt, Human
ugucaauggaucuucgugaguguuuugcuugguaugaaaucuguauacacauaaaaugcucaugguauaacacuaagugaua

SEQ ID NO: 4160589 - RNA, 73 nt, Human
ugucaauguauaugaaaauauccugcuuuagauggauuaaguaugugccagaauguuuuuauacacuuugaua

SEQ ID NO: 4160590 - RNA, 84 nt, Human
ugucacaaauuacucagcagacaguuagcuauauuggugucuuugaaaccauguuuggcucugcugugugcuuuuguuuguaca

SEQ ID NO: 4160591 - RNA, 78 nt, Human
ugucacaagaacauuagagaagcuuggagaugugcaagaaaaagcauuuuuacaauaaauucucaaguauaugugaua

SEQ ID NO: 4160592 - RNA, 64 nt, Human
ugucacaauggagguagcaguuuccuuuugagggacuggaaaugugaccuacuuccuuguaaca

SEQ ID NO: 4160593 - RNA, 55 nt, Human
ugucacaccucguuuagcauucuuuguguauguuggaugcaggggaggggugaua

SEQ ID NO: 4160594 - RNA, 80 nt, Human
ugucaccucugcucacauuuuuauaggucagggcaagucauauggcuucacuuaacuuccaaagagagcagagguaugca

SEQ ID NO: 4160595 - RNA, 78 nt, Human
ugucacugcccuguuccugccuccagcuguuaggccauagccacugccauaguugggaagagcuggaacagguugaca

SEQ ID NO: 4160596 - RNA, 61 nt, Human
uuccauucccuuugauucgcgcugauccugugaucugcuguguguaauggaaugcaacgga

SEQ ID NO: 4160597 - RNA, 90 nt, Human
uuccauuuugaggacacugaaggcuacaagguugaagucacuuggaagaugaaaucaauccugaagucuccuggauuuuucugaguggaa

SEQ ID NO: 4160598 - RNA, 58 nt, Human
uucccaacucugguucagugauuucagguugauagcuugaaaucagccaugaugggag

SEQ ID NO: 4160599 - RNA, 70 nt, Human
uucccaagacuucuuucacaauguuucuagggaaugggagucugaaacacacagagaagggagaagggag

SEQ ID NO: 4160600 - RNA, 67 nt, Human
uucccacuaaugccaucagagaaaacucuuucugaauacuaaucagaaacucucaugaagugaggaa

SEQ ID NO: 4160601 - RNA, 88 nt, Human
uucccacuccugaguaguagcauugucaacauauaauaugaaagccaucaauucauucugacaguguuugcacuucaggugguaagaa

SEQ ID NO: 4160602 - RNA, 71 nt, Human
uucccagagggccaggucggugaauggucaucugucugcccagauggaccgaggccuggccugccagggag

SEQ ID NO: 4160603 - RNA, 61 nt, Human
uucccaggaugcaauuuugaaucagcccuggcuacugagagcugucucuggcuccugggaa

SEQ ID NO: 4160604 - RNA, 62 nt, Human
uucccaggccuuccucaagcaccuauaaauauacauacacagugcagggccuaaaaagggaa

SEQ ID NO: 4160605 - RNA, 59 nt, Human
uucccaggcugugcuaccagagaaucuguuuuucucuggccuggauaugagucugggaa

SEQ ID NO: 4160606 - RNA, 87 nt, Human
uucccagguuucgagcaagacuacaggcagaugaguaaggacacuuguagaacucaucuugcaguguguguucugaaaauugaggaa

SEQ ID NO: 4160607 - RNA, 94 nt, Human
uucccauauagcucccagaccuuggcugggcuccagcaucuacaaaggaggaagagaugcugggcccagaucccaggaucuuggacauggugaa

SEQ ID NO: 4160608 - RNA, 62 nt, Human
uucccauccauauggugacaaggugcucucuggguuaaccucaaaccauguuggauaaggaa

SEQ ID NO: 4160609 - RNA, 61 nt, Human
uucccaucccccaucugcugccuuccuccagcuaacgacaacagcagaaauggggugggaa

SEQ ID NO: 4160610 - RNA, 64 nt, Human
uucccauuaauuuauuuucaaaugaggaaaacccacaacuuugagaaacugauuauuaugggga

SEQ ID NO: 4160611 - RNA, 61 nt, Human
uucccauuucaugcuggcuguggcaugcuuugaguuuguugcuuccacuguaaguggagaa

SEQ ID NO: 4160612 - RNA, 68 nt, Human
uuccccagcuuggccagaaucuuccuagugagcucacauucugcucacuccugcccaggcuuggggaa

SEQ ID NO: 4160613 - RNA, 57 nt, Human
uuccccaggcggcuuuuucagcaucuggccacauguuggcaaggugagccuagggaa

SEQ ID NO: 4160614 - RNA, 58 nt, Human
uuccccauggguggggacacauaugauggagcauccccaugugcccacccacggggaa

SEQ ID NO: 4160615 - RNA, 86 nt, Human
uuccccuaauuuucauguuuuaaugccuuuuucuuaauuuguuauagaucuggaaagugaugaaacugugugagaauuaaugggag

SEQ ID NO: 4160616 - RNA, 72 nt, Human
uuccccucacccacauuccucuaguaugugacuaugaucacguaugugguggaaauguccccagguugggaa

SEQ ID NO: 4160617 - RNA, 65 nt, Human
uuccccucucagaucuggccuacuucaggucuaaaagcuggggaaugggcugggcuagaagggaa

SEQ ID NO: 4160618 - RNA, 56 nt, Human
uuccccuucuucuugucuucacccaggggcucugggaccugcagaggaaaggggag

SEQ ID NO: 4160619 - RNA, 65 nt, Human
uucccgaaggacaccugcagagggaccagaagagcacuuuguguccuucugggagucccagggaa

SEQ ID NO: 4160620 - RNA, 80 nt, Human
uucccgcggcccuugccucccgggagcggcuccccucugacgacugaguggacugcgcuugagggggccgccgcugggaa

SEQ ID NO: 4160621 - RNA, 73 nt, Human
uucccgggagcaaaucacuucagucauuuccucccugaggaaguugcuaaugauguguuugcucuucugggga

SEQ ID NO: 4160622 - RNA, 65 nt, Human
uucccgugcuguucuugugauagugaggaagucucacgagaucuuuugguuauuauaagagggag

SEQ ID NO: 4160623 - RNA, 90 nt, Human
uucccuaaaucccucuuaaugccuacccaugguuagacauacagcaagugcuucugaaguggaugggugcauggauggaugcaaagggga

SEQ ID NO: 4160624 - RNA, 62 nt, Human
uucccuacuaucagaaggcccguugcuaagagaugccuuguuucuuugccucuuagagggaa

SEQ ID NO: 4160625 - RNA, 55 nt, Human
uucccuccccuucaagccaguggcagccugcugcccaggaaggagaggaugggaa

SEQ ID NO: 4160626 - RNA, 128 nt, Human
uucccuccgccuguccacccagccacccacccugucuucuccuuuguuucaggggugaugggagcuggaggucucugaaauaagggagaagggaaucugggagagcucagauggacacauggauggaa

SEQ ID NO: 4160627 - RNA, 72 nt, Human
uucccuccuccauguucaguccagugucugcaacuguccgacacugucucauaugaggggacaucacgggaa

SEQ ID NO: 4160628 - RNA, 75 nt, Human
uucccucuuuccuccaaccauuuaucugggaagcaaguuauuggcaacccagagcugauuguuggagccggggaa

SEQ ID NO: 4160629 - RNA, 56 nt, Human
uucccugacaagagcacaccccaggaaacuccaucucagggucugugucuagggaa

SEQ ID NO: 4160630 - RNA, 79 nt, Human
uucccugacaguucugggaggugcacguccaagaucaggguguccucagaguuggugccuuccgagagcugugagggag

SEQ ID NO: 4160631 - RNA, 72 nt, Human
uucccugacuuguggucauugggcccugccugguccaagcagccaggcagugcucaagacagcagcacggag

SEQ ID NO: 4160632 - RNA, 72 nt, Human
uucccugcucaaccuuaauaguaaacagcaagggcagaagccacagacuguuaacgguaugaugcucggggg

SEQ ID NO: 4160633 - RNA, 76 nt, Human
uucccugcuggcuucccuaccugcaccuuguagauagcaccacccggggugcaggcuggggcaggcugugguggga

SEQ ID NO: 4160634 - RNA, 105 nt, Human
uucccuuccuuagccuugaagcgggaguaaccacuagacagaaggcugugagggaggacucuggcacuuccacuguggcugcuuugccuuugggcaggaggggaa

SEQ ID NO: 4160635 - RNA, 63 nt, Human
uucccuugcgccagggcuucacuggacccuuauaaacuccgccuggcuuccaagguaggggag

SEQ ID NO: 4160636 - RNA, 64 nt, Human
uucccuuucacaauaucuaauuugccaauuaugaagagcacagugauauccuugagaaagggaa

SEQ ID NO: 4160637 - RNA, 60 nt, Human
uuccgggaagauucccaggaacuuccggcgacgagggaauuccuggggacuuccguggga

SEQ ID NO: 4160638 - RNA, 115 nt, Human
uuccuaaaagguucucauucugguuaagguagagggagcacacucacaguuuagauucaaagucggcucaaaucuuggaaguguccacugguguagccagaaagagcccuaggaa

SEQ ID NO: 4160639 - RNA, 79 nt, Human
uuccuaaauaagagauguggaaucauuuacaaggagaauuaucacauugugaagauacgccaucuucauuauugaggaa

SEQ ID NO: 4160640 - RNA, 92 nt, Human
uugaauuucggagcugccaguguaugaauucuuccagacucucccugacagaaaccaucuuuauauaucugcuaagcaguucuauuuuuuaa

SEQ ID NO: 4160641 - RNA, 66 nt, Human
uugaauuuuggacugcccaggauuaaugcugaucuaaaguccaaucuuugcaggccaaauuguuaa

SEQ ID NO: 4160642 - RNA, 67 nt, Human
uugacacaaaaggaagagaaaagcugccucucgguuauaaaaaguaucuuuuccuuucugugugcaa

SEQ ID NO: 4160643 - RNA, 64 nt, Human
uugacagauccacccuuguagugacacauuuuaaaucucugucugucauuuauggaucuggcaa

SEQ ID NO: 4160644 - RNA, 75 nt, Human
uugacagcaaagauugugccuagcccccuaaaagacaguacaggguaaugcaaaggucacaggcuuugaaaucaa

SEQ ID NO: 4160645 - RNA, 60 nt, Human
uugacagcaacacaugcuuagugcagagaccucucugaggaccauaucugugugcugcaa

SEQ ID NO: 4160646 - RNA, 58 nt, Human
uugacauaggauuuggcauuugggaugugauuccaaaucaccagcagccaaugugcag

SEQ ID NO: 4160647 - RNA, 63 nt, Human
uugacauuauuaucaugucaccacccuguugcccaggcuggagugcaauaguaauaaggucaa

SEQ ID NO: 4160648 - RNA, 92 nt, Human
uugacauucagaauauuuguuuucauaauagugcaguuuguuggauuuauauuucaauauuuugguuaugauaauuuuuuuguauaugugaa

SEQ ID NO: 4160649 - RNA, 100 nt, Human
uugacauuuuagauuuaagucgguaaagcacugauuuaaacuggauuuuaacuggaugaaauucugauuuaauaaguguacugacuggauaaaaugccaa

SEQ ID NO: 4160650 - RNA, 72 nt, Human
uugaccacauuaaguguaguuguagacuccuuccaguuucaggaguucacagaugaauuuuaauuguguuag

SEQ ID NO: 4160651 - RNA, 80 nt, Human
uugaccauucugaguguuauugaggcaaaacuguguuaagaugaacugagacaguaaucuuagaaucuaagaauugucag

SEQ ID NO: 4160652 - RNA, 59 nt, Human
uugaccuuggcuuuuaaaauauagcuaaccaccaaguauacgcugaagacuaaggucaa

SEQ ID NO: 4160653 - RNA, 67 nt, Human
uugacuacuaccaaggcucugaggugguauuagaaaccuccaggaagcucuugguaccucuaggcaa

SEQ ID NO: 4160654 - RNA, 87 nt, Human
uugacuccauagugugaaagauugucaacaacagcauuuucuauuuguacuguuuaagauaguguugguggucucuucauuugucag

SEQ ID NO: 4160655 - RNA, 98 nt, Human
uugacuccuagcagccaucaccagcaugaauguguucguagggccuuugaguguggcgauugucauauucuguuggauaacaauguauugggugucga

SEQ ID NO: 4160656 - RNA, 85 nt, Human
uugacucuugcaccagcuacauuagcuucaauggcuaggguaaccauggcauuuuguagcuguguaucuguuugucaggaguuaa

SEQ ID NO: 4160657 - RNA, 111 nt, Human
uugacugcagcuguaacagaugcguuuacacauguaaaagauaaauuaacaaagauguuuauugaaguuuugcaugaaauagaugauaacugacaacaauguaaaugucaa

SEQ ID NO: 4160658 - RNA, 74 nt, Human
uugacuuccucugagggaagaaauuuguaaaacauaaacucacuaaacaaaccucuuuccauuagaggaauuga

SEQ ID NO: 4160659 - RNA, 130 nt, Human
uugagaaagagaacgucuaugcacuuuggcuuggcuucuuuagucaguuuggaauucucucaaauaagagaauaaccagaaaacccaaaaugacaaaggucaaguauagcauauuuuuuucuugcaucaa

SEQ ID NO: 4160660 - RNA, 55 nt, Human
uugagaaauacuuuuguagccuaaggaagaagguggagcaagggauauuuuucag

SEQ ID NO: 4160661 - RNA, 68 nt, Human
uugagaacagccacuaugacagauuuagagcccuuuugcccuaaacuucauauguugcuuuaauucaa

SEQ ID NO: 4160662 - RNA, 58 nt, Human
uugagaaccacuguggagggcuaucaagugcuucuagucccucccagaugcuucccaa

SEQ ID NO: 4160663 - RNA, 67 nt, Human
uugagaacuagcauggucuaucaguuugaaugcuuucagcugcaaguaauagaaccugcaguuucaa

SEQ ID NO: 4160664 - RNA, 72 nt, Human
uugagaauaaauuuguguugguugcuaaguuuacagugauuuguuauggcagcaauagaaauauaaucuuaa

SEQ ID NO: 4160665 - RNA, 62 nt, Human
uugagaauagcuuaaauguuucacaguggggguaauuuggauacauuuuggcauacucucaa

SEQ ID NO: 4160666 - RNA, 66 nt, Human
uugagacacagcagugccugccucagcucuucuugggggaaguggggcggggcaccugcuucucaa

SEQ ID NO: 4160667 - RNA, 103 nt, Human
uugagacacagucuugcucugucacccaggcuggaguacaguggugcaaucuccacucacugcaaccucugccucccagguucaagcgauucuccuuccucag

SEQ ID NO: 4160668 - RNA, 103 nt, Human
uugagacacagucuugcucuguugcccaggcuggagugcaguggcacaaucuuggcucacugcaaccuccgccuuuuggguucaagcaguucuccugccucag

SEQ ID NO: 4160669 - RNA, 102 nt, Human
uugagacagagucucguucugucaccaggcuggagugcaguggcacgaucucggcucacugcaaccucugccucccggguucaagcgauucuccugccucag

SEQ ID NO: 4160670 - RNA, 106 nt, Human
uugagacagagucuugcucuguuguccaggcuggagugcaguggcaugauggucucugcucacugcagccuccaccucccauguucaagcaauucuccugccucag

SEQ ID NO: 4160671 - RNA, 82 nt, Human
uuccuugcagagaggcaugcggucagaacgucacuggcagaucucgccugagaguuuugacgcuuguaacucugcccuggaa

SEQ ID NO: 4160672 - RNA, 98 nt, Human
uuccuuuauucagacuaagguacagaaggauuucuaguaguuguauaaaaaaugaguaacugauacauuauuauuugaguuccucucuaccuaaggaa

SEQ ID NO: 4160673 - RNA, 64 nt, Human
uuccuuuccuaaacuaaucuccuaaaugaacaugucauauccagggaguuuuagggcuugggaa

SEQ ID NO: 4160674 - RNA, 125 nt, Human
uuccuuuccuuuguuaucucuguggcaucuuuugaccuacaccugguaauucucugugaugaaaaugugcagaagaaaacagcugugugcagauagacaauagggaaaaggcacaggaagaggaa

SEQ ID NO: 4160675 - RNA, 79 nt, Human
uuccuuucucaucuguauggcuuuucuuuccuaguguuauugcacuggcuaagaccgccacuacaauauugaguuggag

SEQ ID NO: 4160676 - RNA, 58 nt, Human
uuccuuugccucagagauuuguucacaguuaaaaugcaaauaucuuuggcaaagagaa

SEQ ID NO: 4160677 - RNA, 93 nt, Human
uuccuuuggcuuuuugacauacacagugcuaugcuuucccccaauguuuucacaaaagaacuugcuggcaggcacugaagcagagcagaggaa

SEQ ID NO: 4160678 - RNA, 74 nt, Human
uuccuuuucaaauguaucagcccagggauuuguaucauuacaaauuugugaauauggaugcagauuuguuggaa

SEQ ID NO: 4160679 - RNA, 55 nt, Human
uuccuuuucuucuaccacaugucuugaacauucacauggguuaaagaagauggaa

SEQ ID NO: 4160680 - RNA, 64 nt, Human
uucgaagagcucauuuguuugcucucggucucccugggccucugggcaggcaguggcauucgga

SEQ ID NO: 4160681 - RNA, 86 nt, Human
uucgagguguguuacagguagcaaaaccuuuccugaaugcacaauuuuauauaggaaaggauugcugugcuguuggucacugagaa

SEQ ID NO: 4160682 - RNA, 55 nt, Human
uucgcaccuggacagugacccuagccuggcagaucauggaggggccgggugggaa

SEQ ID NO: 4160683 - RNA, 109 nt, Human
uucggagaucucagauuacccgcccuucugaucaacugacuccaaaucuggggucuucucaaaacaccccucagguuagauaguuuauuagaacucacagaacucagaa

SEQ ID NO: 4160684 - RNA, 130 nt, Human
uucggaggcugcugcauggagaugauagcucccugaagacacgccgggaggggcagcugcccgccugccagcacuucuggcugucugaagugcuucguuucagcuccacgugggugucuuuguugucaga

SEQ ID NO: 4160685 - RNA, 75 nt, Human
uucggcaguggcagagugcacucaggcaccauggcaaccagugcgucagccuggguacacuuagcagcagcggaa

SEQ ID NO: 4160686 - RNA, 78 nt, Human
uucgugugacacugccgggcagcugccuuggcaugagccuucucuguccaagaacagacugccaggccugaacacgga

SEQ ID NO: 4160687 - RNA, 59 nt, Human
uucuaaaagauccaugggcagucauggcagccucauccucuguccugaucuuuucagaa

SEQ ID NO: 4160688 - RNA, 61 nt, Human
uucuaaaccuggagcacccucauaucugucucaauagaggaggaaaaauuuagguuuugaa

SEQ ID NO: 4160689 - RNA, 99 nt, Human
uucuaaagacagauuuaauauuguucgccuugguucuggaaccuagguauuaacugcugggacacaaaagugaauaaaauaggauccuugccuugagga

SEQ ID NO: 4160690 - RNA, 84 nt, Human
uucuaaagcuccuuccacuaaaaaguugacauuuuuaugugaaaauauaucaaaauucgaacgucuuguggauucaggcuagaa

SEQ ID NO: 4160691 - RNA, 66 nt, Human
uucuaaagugcaaucugacagagaauguggcaaaaaucaaacauuaggauguugugcacucuagag

SEQ ID NO: 4160692 - RNA, 103 nt, Human
uucuaaaugccuuuuagccuccuguaguauuuuuagguaaggaaaguauguugaauuauuucucuuuguagggauauaggguugaaaugugaaguauuuggaa

SEQ ID NO: 4160693 - RNA, 78 nt, Human
ugucuaacauuagaaacuguaaacacagcaguacaacuaguguuuggagcugucuuuauaguguuacagugucagaca

SEQ ID NO: 4160694 - RNA, 75 nt, Human
ugucuaccuacaugcaugugaauauggacacaccuauguauaugugugugugcauauauguguauguauauuaca

SEQ ID NO: 4160695 - RNA, 76 nt, Human
ugucuacgaaauuauccuuuuauuguaguaaguuauuuuagaguauuauugcaacuuuagggauagaaagaagaca

SEQ ID NO: 4160696 - RNA, 65 nt, Human
ugucuagcccagauacaaaucaugauaaaagaucuauccaugugaaauguauggggccaaggaua

SEQ ID NO: 4160697 - RNA, 83 nt, Human
ugucuauaggcaguuuuauagucaugucaaugucacauagauucugaguaacaaugauuagugacuacagcaugcuuuccaca

SEQ ID NO: 4160698 - RNA, 65 nt, Human
ugucuauugcuuguucuugauaaggaaugaaucuagaacauuucuauguguugacaagccugaca

SEQ ID NO: 4160699 - RNA, 111 nt, Human
ugucuauuuuuauauacucuccugaaaugcuaucuuuuuugguaggcacacuaucaacaaaugcacuuucacaaagcauagcacuuuaugggauuuaaaugaagaaagaua

SEQ ID NO: 4160700 - RNA, 66 nt, Human
ugucuccacuauaucaagcugccuucauggggaagaagcagggggcaguaaggauauggaaagaca

SEQ ID NO: 4160701 - RNA, 72 nt, Human
ugucuccauguaagaugucaaagggucacaguugcuuacagcugcgacucccugagaucuuucaucaggaua

SEQ ID NO: 4160702 - RNA, 67 nt, Human
ugucucgugcagacuaugaggguagcagauuccuacaucugugccaagcuuauaucugucugaagca

SEQ ID NO: 4160703 - RNA, 77 nt, Human
ugucucucuucagccagggcagagcaggugaggcccugcgucacccgcgcaaggcuugugguucagccagggagaca

SEQ ID NO: 4160704 - RNA, 82 nt, Human
ugucucuguauuuuuaugaugcuauagaacuuuugaguuucucgauauauaauauggguaucaaugacaaacaucagagaca

SEQ ID NO: 4160705 - RNA, 78 nt, Human
ugucucuucguggcauuugggagaugcgugggcggccugccccccgaccgccgccccugcccaccacaugcugggaca

SEQ ID NO: 4160706 - RNA, 71 nt, Human
ugucucuugaccucuggggagaccaggaggaguagccacacgugucagggguccccagggcaucaggagca

SEQ ID NO: 4160707 - RNA, 56 nt, Human
ugucucuuggagggucuagugaguaucagccccugagucacuccucccaggggaca

SEQ ID NO: 4160708 - RNA, 60 nt, Human
ugucucuuugcagcaaggagaaggccaguauuaacuuucaugaggcugcauaaggagacg

SEQ ID NO: 4160709 - RNA, 83 nt, Human
ugucugagcguaucugugaguagccugggagugaaauuggaacugauacuaacccucagcucucacacuuagcuucuaugaua

SEQ ID NO: 4160710 - RNA, 65 nt, Human
ugucugaggccugaggcccugggagcugcugggaccacucgggaacccagagccauagccagaca

SEQ ID NO: 4160711 - RNA, 59 nt, Human
ugucugcaaaguccagcacaggcuuggauugccugugcugccagaaacuauggaagaua

SEQ ID NO: 4160712 - RNA, 69 nt, Human
ugucugccuuucauuguucuacccagcauccgguuuggacuugacugagggcagugaugaaggugaaca

SEQ ID NO: 4160713 - RNA, 61 nt, Human
ugucugcgcgguguugggggaacccugggugccuuggcccagcccucugccauagccagca

SEQ ID NO: 4160714 - RNA, 57 nt, Human
ugucuggauuuaaaucucaaugcugccacuggaagcuuugugacuuugagcuaguca

SEQ ID NO: 4160715 - RNA, 55 nt, Human
ugucuggccuucucuguuacagaaaaucuggaaaauauagaaaggguuaaagaca

SEQ ID NO: 4160716 - RNA, 56 nt, Human
ugucuggggaacugugcauccagggccacacggcuagagcgcaggcccaucagaua

SEQ ID NO: 4160717 - RNA, 72 nt, Human
ugucugggucaccccuccuggcugcccucuuggagcugaauaacagaaggggagggguuaguaacccggaca

SEQ ID NO: 4160718 - RNA, 63 nt, Human
ugucugguacaugguauauucuaauggcaauaaaauggcacaagcagccuugugugccaggca

SEQ ID NO: 4160719 - RNA, 125 nt, Human
ugucuguagguuauggaugugauugagauuggaaauacugagagauaaacacacguucuagugaguucacugguuuaacuuugucuuugcagguuucaguuuuuauugcucuaccccuuuuuaca

SEQ ID NO: 4160720 - RNA, 78 nt, Human
ugucuguccagaaguuccuaagcaucauuguccuuggaagugauugauuucuugggguuacucuccacugaccagaca

SEQ ID NO: 4160721 - RNA, 69 nt, Human
ugucugucucucuccagagugcagggagcaugacccagccacucugcaccuccggcagggacacgggua

SEQ ID NO: 4160722 - RNA, 71 nt, Human
ugucuguuuuguugauugcuguagcccuggcaucuugggcagugccagcaccuguuagcauuaaauacaua

SEQ ID NO: 4160723 - RNA, 60 nt, Human
ugucuuaauuuggaugauguuuuuauucuacaaaauagaauuauuaucuuguucgaggca

SEQ ID NO: 4160724 - RNA, 60 nt, Human
ugucuuaguccuuuccggcugcuauaauaaaaauauuauaaacuggauggauuauaaaca

SEQ ID NO: 4160725 - RNA, 63 nt, Human
ugucuuaugcuucucuuuugauagaugacaugacugucuuuuaaugggagcaguauuuggaca

SEQ ID NO: 4160726 - RNA, 58 nt, Human
ugucuuauugcguauguauacaaggcauuguuuuguaguacuuuuuguaauaagagca

SEQ ID NO: 4160727 - RNA, 64 nt, Human
ugucuucaugaggccgcucuuugacuggugugacuaaaucagaugaagcagcuucauguagaca

SEQ ID NO: 4160728 - RNA, 63 nt, Human
ugucuucauguccuguugcugcuagugaugaguuguaacaucuucacucaggaaaugaugaca

SEQ ID NO: 4160729 - RNA, 64 nt, Human
ugucuucuaccuugacagcauugcaugcguuuguuucuugcuauggcuguacaguaaggagaca

SEQ ID NO: 4160730 - RNA, 62 nt, Human
ugucuucucuugcagucccaucugggagcucauuacuguacugcugggcugcaggggaugca

SEQ ID NO: 4160731 - RNA, 75 nt, Human
ugucuucuucaaaucuauauguugauauucugauucccaaugugaggauauuaaaagguggggccuuaggagaua

SEQ ID NO: 4160732 - RNA, 79 nt, Human
ugucuugcccuggcuuagucauuaguucccucucuagggacuggagaggagcuggccacuaggaugcaggugcaacaca

SEQ ID NO: 4160733 - RNA, 58 nt, Human
ugucuuguaagccucaagaaaaugcaauguugguaauaauuggggugaaugccagaca

SEQ ID NO: 4160734 - RNA, 83 nt, Human
ugucuuuaaaaccugaaacuuggcuaccagcguuaaauauucuaauauuuuaguuauguggcccaggauuugacaccaagaca

SEQ ID NO: 4160735 - RNA, 66 nt, Human
ugucuuuaauccucaugcauagucaaggacucaucucuggaccaugagcugcagguguucuagaca

SEQ ID NO: 4160736 - RNA, 62 nt, Human
ugucuuuccaaggcucugugccucuuuguaguaaagggaagcuggggagcuuuggagaggca

SEQ ID NO: 4160737 - RNA, 112 nt, Human
ugucuuucucuaacaauaccgucugaaaauuuuccagcuuuggaaaaccugcuuucuaggguauugcagaauucgcuggaacauaugccucaaauuauugcugagacagaua

SEQ ID NO: 4160738 - RNA, 83 nt, Human
ugucuuucuucagcugcucccuauccuuuccuuuucaaagagaaauaaagagaaagggacagcaccuugaaugaaccaagaua

SEQ ID NO: 4160739 - RNA, 65 nt, Human
ugucuuugcuauugugaguagugcugcaaugaacauacgcaugcaugugucuuuaugguagaaca

SEQ ID NO: 4160740 - RNA, 62 nt, Human
ugucuuuggaggcacuguugagugaauaaaauauaucacuucccguuggccucuagagguca

SEQ ID NO: 4160741 - RNA, 91 nt, Human
ugucuuuggugaacacauacacauuuuuugcguuauauacuuaggauucgaauugcuggguauuagaaugugugugucuucagcuuuagca

SEQ ID NO: 4160742 - RNA, 80 nt, Human
ugucuuugugccacuaucacacuguuuuaauuacuuugguuuuucaaugugucuugcggcaguugguaacaagaaaggca

SEQ ID NO: 4160743 - RNA, 56 nt, Human
ugucuuuguguacaggaucgccaugggagugguaaacauaggucuugaacaaagca

SEQ ID NO: 4160744 - RNA, 76 nt, Human
ugucuuuguguauacugucuuguuucacaguggacugaaaaccacuuggaaagaugcaacacaguaaaacagaaca

SEQ ID NO: 4160745 - RNA, 83 nt, Human
ugugaaaauguagugacauuucauugaaaguagguuuugaaucauuaagcuuacuuuagaaauagucaucaaaacuugucaua

SEQ ID NO: 4160746 - RNA, 59 nt, Human
uucuucuguccuaagucaaagcaacuggcaaggccuccugcagacagggacagaaugga

SEQ ID NO: 4160747 - RNA, 92 nt, Human
uucuucuucauugcugucuucacuuccugguuucucaaaguauagauaaguggauucagaaagggagugaagaugguauagaaaacggagag

SEQ ID NO: 4160748 - RNA, 130 nt, Human
uucuucuugcuccugauaauccugggcagucuggaggugggggcaagaguguuuguggccacacauucacagacagacacugcacucccaccuucccagcaucugcccgcacccaaggcagagagaagag

SEQ ID NO: 4160749 - RNA, 86 nt, Human
uucuugaaagccccagggcaugggaagaacugaauagaccuggcccucacuuacggauucuaccuauacccacagcagaucaagga

SEQ ID NO: 4160750 - RNA, 75 nt, Human
uucuugaaauagguucuucaggagcuguuuauaaauugaguugugguuaaauauaugagggagcuauuugaagaa

SEQ ID NO: 4160751 - RNA, 69 nt, Human
uucuugaauuuccagaauagauggagcucuaagguaaacuggaacucugauuuuuuggacauucaugaa

SEQ ID NO: 4160752 - RNA, 67 nt, Human
uucuugacaagcauuuugcaugcaguuaaauagacaaauguauucugcugccaggauuuugcaggaa

SEQ ID NO: 4160753 - RNA, 129 nt, Human
uucuugaccugccaacccugugacugagagugugaguuggggcuggguggagaaagagagucccugacuucucaacugcacuugccaggaauuuagccuuugcaacuugguguuggaggugauaagaaa

SEQ ID NO: 4160754 - RNA, 67 nt, Human
uucuugagaacaaauuccuggauacuggcauuagugacaaagaagugucaggacaguuugccaagaa

SEQ ID NO: 4160755 - RNA, 59 nt, Human
uucuugauucuuccuugaaggauacugcgugguccauuccuacacaggauaauuaagaa

SEQ ID NO: 4160756 - RNA, 83 nt, Human
uucuugcaaggugauuuucucucucuuguuaggaagagugacuuccauucuuaacaaaguaacgggaaaagaagagguaagaa

SEQ ID NO: 4160757 - RNA, 98 nt, Human
uucuugcauuuuacaguuggucauauucucacuuuaugagcugauuuucagcuugcacaguuugaagaugacucuggugauuguuaaaugaaaaagaa

SEQ ID NO: 4160758 - RNA, 82 nt, Human
uucuugcccagauucucucuugagguuauuaagcuguuagccagggcuccagacaucucaagaagauucagcugggaaagaa

SEQ ID NO: 4160759 - RNA, 55 nt, Human
uucuugcugggcaucagaagacuuaaaccuaagcugucugucaucucugcgggag

SEQ ID NO: 4160760 - RNA, 86 nt, Human
uucuugcuggggcucaugauguaggcugguaaaaagaaccccuauuuauuuauuagcuuuagccuuuggaugagcucuaggaagaa

SEQ ID NO: 4160761 - RNA, 109 nt, Human
uucuugcuguagaugguaguuugccauuuugcucagcaccaccagcacuguaucaggagugucaaauggcccugcuggccaaaggcuacaaucaacagggugguaagga

SEQ ID NO: 4160762 - RNA, 62 nt, Human
uucuuggccugcuccagaacaaggggcgagucuaugcacuccuggagcagcaggcgcaggga

SEQ ID NO: 4160763 - RNA, 93 nt, Human
uucuugggugaaaaauacauccucaggguucggaugagaacagguguugcuuguucaguaucucaagcccagaaagaugaauuaauccuugaa

SEQ ID NO: 4160764 - RNA, 97 nt, Human
uucuugguugcucccaaaagaaacauauugugauccucuucauuuucugaucuugauucaguguguuacuuucuccuauggagcguuguuucaagag

SEQ ID NO: 4160765 - RNA, 68 nt, Human
uucuuguguaggcccagaaaacggauuuacucaggacuaaauuaaaaucuggagcccuaagcugagaa

SEQ ID NO: 4160766 - RNA, 117 nt, Human
uucuuguuuuuuagaaguuucccaagugauuuucaugcccugcuagggucaggaaccauugcuguuacugaagcagggagugaugaaguaggccuguggaucuuucuaaauguggaa

SEQ ID NO: 4160767 - RNA, 130 nt, Human
uucuuuaauguucccgucuuucucauuucccuaaauaaacugaagccuuuacuggaaggucaaguaaauguuacugugaaucacuacuaguagaggcuccagaaaagggaauccugguugcucucaaaua

SEQ ID NO: 4160768 - RNA, 77 nt, Human
uucuuuaauuguggaagagcagccuucacugauaauaaauuuaacucaagcuguuguucucccuaacaauuacugga

SEQ ID NO: 4160769 - RNA, 59 nt, Human
uucuuuacccucucugcacccuuucuguaagggaaauuuaugcagagagaggcaaagaa

SEQ ID NO: 4160770 - RNA, 70 nt, Human
uucuuuaguucuggagguuauuaggagucucuauugauacucuuuaugacauuccagcauccuuaaggaa

SEQ ID NO: 4160771 - RNA, 65 nt, Human
uucuuucucagugggcagauacuguugccauacacuucucuguuucccugccuccuguggaggag

SEQ ID NO: 4160772 - RNA, 58 nt, Human
uucuuucuucaagcuggucucaaucugacaccacugucugauugaguuuaagaaagaa

SEQ ID NO: 4160773 - RNA, 102 nt, Human
uucuuugaucauuucuccuggguggauugggaaagaaguccuagcugaggcaauugcuucugggcucucuuucugugugccugguaaaugaaacacaaggaa

SEQ ID NO: 4160774 - RNA, 66 nt, Human
uucuuuggcauuuccuguaugucccugccacauucccacucuaagcucaugauaggagccagggaa

SEQ ID NO: 4160775 - RNA, 75 nt, Human
uucuuugguaaaugcagguucuucucacaaagccuuucaucccuuauugcagggagagccacauuuuccaaagaa

SEQ ID NO: 4160776 - RNA, 64 nt, Human
uucuuuggucaucaugggaagcaaggacuuccucagccccugccccucuccugugauccaagaa

SEQ ID NO: 4160777 - RNA, 66 nt, Human
uucuuuggugucgaugucaccugucaacugaacugccuuuuugaaagucacaauggcauuaaagaa

SEQ ID NO: 4160778 - RNA, 84 nt, Human
uucuuuguacauucugacuuaaauagaacuccucaauagggaaacaguucuuaugaggauuuuucuuugacuuuaugcagagaa

SEQ ID NO: 4160779 - RNA, 73 nt, Human
uucuuuguauuucuuuacauaugcucauuggaauauaaguucgauggaagcagaccggaggaauauuuuggag

SEQ ID NO: 4160780 - RNA, 61 nt, Human
uucuuugucuggcagcugugagaacuuuuuaccccauccccucacagaaacaaauagagaa

SEQ ID NO: 4160781 - RNA, 119 nt, Human
uucuuuuaacauaaguucaguaacucaauuaacagaaaauaaaaugucauuguucagagguauggacaaugaaagguauucugaacuuaaagagggauuaaauagagagguuagaagaa

SEQ ID NO: 4160782 - RNA, 65 nt, Human
uucuuuuaauugugggggagugugaguugcuuacguccuuacucaaaucccucagaauuauagaa

SEQ ID NO: 4160783 - RNA, 60 nt, Human
uguuccugauucuuugaagaugcacccucuuauagagaugccaucuugaagaauuuugca

SEQ ID NO: 4160784 - RNA, 55 nt, Human
uguuccugggcacucagcuaacccacaggacuauaaauugaguggccgggggaca

SEQ ID NO: 4160785 - RNA, 63 nt, Human
uguuccuuaaggucuugagugaaugagacuguacauguucagcuuaguguaggaccuggaaua

SEQ ID NO: 4160786 - RNA, 69 nt, Human
uguuccuucuuaucugucccuccucacagccucuccauugaugaauuuguguugggacaaguugggaca

SEQ ID NO: 4160787 - RNA, 81 nt, Human
uguucuaacuuacucaguuugagucauuuccaaccaaaagguuaaugcagaaaucaaacugacaauaagaagccuggaaca

SEQ ID NO: 4160788 - RNA, 91 nt, Human
uguucuacuuuuucucaggaagaauuuaaaugccuugccuaugugcauguacuauaacaaugcaaaaugaauuuaggaugaaaaaagagca

SEQ ID NO: 4160789 - RNA, 77 nt, Human
uguucucuuaccacaaaacaguuagaagucaaaucagccacuacauuuugcacuuuuugcuugugugagagagaaua

SEQ ID NO: 4160790 - RNA, 84 nt, Human
uguucugaccccucuggcugcaggucaauucaccauggccagccauggucugaacuaagacaguaguguggaggaggcagaaua

SEQ ID NO: 4160791 - RNA, 66 nt, Human
uguucugauggccauuuuuucaaaccacucucaguuugacuguagaugugaaauaucaucagagca

SEQ ID NO: 4160792 - RNA, 79 nt, Human
uguucugcagauaauaacacauauuucaagaguaguugugaggauuaaaugagaucauguguuugaucuuugcuuggca

SEQ ID NO: 4160793 - RNA, 72 nt, Human
uguucuguaccugguguguuaguuuccugugccugcccuaacaaagcaccacaaaccaggugaguuaaaaca

SEQ ID NO: 4160794 - RNA, 73 nt, Human
uguucuguagcaagugagaggcauuuuaggucaugaaaagacaauacccaauuccuuuacuugcuauacuaca

SEQ ID NO: 4160795 - RNA, 63 nt, Human
uguucugugcccauuuuaaaauggaaauuugguauuuuaucauuuugauggggcucagaguca

SEQ ID NO: 4160796 - RNA, 58 nt, Human
uguucuguggguccugcugcaucucccaccucacgggcagcagcaggaccccagagca

SEQ ID NO: 4160797 - RNA, 58 nt, Human
uguucuuaugaauucaagacaccuuaauaguagguggcauagaauaucauuaagaaua

SEQ ID NO: 4160798 - RNA, 56 nt, Human
uguucuuccuggaaguggauuuccuguuaucuuuagggaaucuuugcaggaaaaua

SEQ ID NO: 4160799 - RNA, 64 nt, Human
uguucuuuguucaggaauucgugcagacacugaucagcugcucuguacaauugagaagagaaca

SEQ ID NO: 4160800 - RNA, 72 nt, Human
uguugaaaggcuguauguuuccauuugaacucaucauuguuuaauguggcuacaauacagaaccauacaaua

SEQ ID NO: 4160801 - RNA, 68 nt, Human
uguugaacagucacccugggaguuuggugagcagcucucgcuccaugcuuucagggucacugucaaca

SEQ ID NO: 4160802 - RNA, 66 nt, Human
uguugacuugaaccaaaguguugugaaacuggccaaguuguaaacauuuuaaaggucaaguccaca

SEQ ID NO: 4160803 - RNA, 62 nt, Human
uguugagcagucagccauguuccugggauuauccuuccuuuggagcaucugucugcugugca

SEQ ID NO: 4160804 - RNA, 81 nt, Human
uguugauguugguaaauaagagcacuggcuuuggaguauggcagacccaagcucgaauccuugcugugcccuucauuagca

SEQ ID NO: 4160805 - RNA, 55 nt, Human
uguugcaggccccugggguaugugccugucuaucgcgcaccgggucccagcagca

SEQ ID NO: 4160806 - RNA, 86 nt, Human
uguugccauaaauugggguaauugagcaguuuuuaaaacgagcaugaauaacugcauuuaacaaauacucuaucuucaugacaaua

SEQ ID NO: 4160807 - RNA, 69 nt, Human
uguugcccaggcuggagugcaguggugcuaucucggcucacugcaaccuccgccucccggguucaagca

SEQ ID NO: 4160808 - RNA, 85 nt, Human
uguugcuaggaaaaccauuugagaaccuguguccuuuagcaaaauaaaauggagaaaggauaagguuaucaauuuuuguucaaca

SEQ ID NO: 4160809 - RNA, 89 nt, Human
uguugcuuuaagaaauacagaaagggcugaauguggauguauugcgugagcuaauuuuuuuguauuauuauuauuuuuagaagucaaca

SEQ ID NO: 4160810 - RNA, 55 nt, Human
uguuggaauuaggauacagaggagugcaggcaucauugguccuugaauuccaaua

SEQ ID NO: 4160811 - RNA, 105 nt, Human
uguuggaauuuuaacuguucaaacuaguuaaaagucagaaauagucaauuccuauuuggauugcuucuaacguuuaacuaguuugaauaguugucugugaugaua

SEQ ID NO: 4160812 - RNA, 92 nt, Human
uguuggauauucauguuuuagaaagacaaugggaagugcugauuuuuguuucuuuuuccagaaucuucucuaugcagcagaaacuccaaaca

SEQ ID NO: 4160813 - RNA, 92 nt, Human
uguuggauuaauugaaaguuacaguuaugaaacucacaagaacagcccgaccaauuuuucugugggcuuuagagauggugacuuuucuaaua

SEQ ID NO: 4160814 - RNA, 70 nt, Human
uguuggcaggaggcuucaguuccucaucacaugggccucuccauaggauugcuugaguguccucacaaca

SEQ ID NO: 4160815 - RNA, 108 nt, Human
uguuggcagugaugucuggcuucggaggguacaguccuggcucccagacaaggggcggggagaacacuguguccuuccagaggcuguaccacacucccacugcuguca

SEQ ID NO: 4160816 - RNA, 102 nt, Human
uguuggccagaugcaguggcuuacgccuguaaucccagcacuuuggaagccugaggugggcggauucaugaggucaggagaucaagaccaucuuggccaaca

SEQ ID NO: 4160817 - RNA, 88 nt, Human
uguuggccaggauugucuugaucuccugaccuugugaucggcccaccucggccucccaaaguacugagauuacagacgugagccacca

SEQ ID NO: 4160818 - RNA, 69 nt, Human
uuggggggaucuaggggaugggugaggaauggcccagcccagucccagccggugccugggucccaacag

SEQ ID NO: 4160819 - RNA, 85 nt, Human
uuggggguggcuuuuucaggacacuuggcacaaggucacagauauuuguggcuuuggaauggaguucugcccucggcacccccag

SEQ ID NO: 4160820 - RNA, 62 nt, Human
uugggggugggaauuaucaugcuccaguacagaguggauggaugaaugauuucuacucuuaa

SEQ ID NO: 4160821 - RNA, 114 nt, Human
uuggggguuggguuuuauuugcuggagugggggguccgucucagugcauccuccuggauuccccauuaggacgccccgcccauacauccagccuccucucccggauacccccag

SEQ ID NO: 4160822 - RNA, 80 nt, Human
uugggguaagaggacaaggccuugcaauucugaguaggauuuuuauuaagaauaucuccaagccuucuccucuucuuuaa

SEQ ID NO: 4160823 - RNA, 64 nt, Human
uuggggucuucugugcuuugcaagugagugcaccaccacaguuugcuuuacggcaaggccccag

SEQ ID NO: 4160824 - RNA, 67 nt, Human
uugggguucacaacacccggcuguccccagacuuguguccagggaagauaguguugagggcccucaa

SEQ ID NO: 4160825 - RNA, 66 nt, Human
uuggguaucuauuaagaaaacagccauuucaucacggcucguaaaaauugguucauggaugcccaa

SEQ ID NO: 4160826 - RNA, 114 nt, Human
uuggguauuauuuuauucucauuuugcagcugaggaaauugaagccuaaagaaguuaaauaauuugcugaaaauuccauagcuaguaaguguuggaguugagauucaaacccag

SEQ ID NO: 4160827 - RNA, 129 nt, Human
uugggucagauguccaucccuuacccaggcuuuacagcuggcccacugugugguccauucccaaccauggguccaucacugugggccaggaggcagagucguguaagaagaacuguauuaauggcuuga

SEQ ID NO: 4160828 - RNA, 64 nt, Human
uugggucaggaauccagacagggcacagugggaauggcugucucugcuccauuuacuggaccaa

SEQ ID NO: 4160829 - RNA, 99 nt, Human
uugggucuaguuguuaaagugcacuuuauguuuuguuuucaauguguuacauugugauuagagaauauagaguaugccauuuuaaaauuauagauuuga

SEQ ID NO: 4160830 - RNA, 92 nt, Human
uugggucucuccaccgcccccugugagcggcuggaugccuggaggaagcuggagaggcuggccagugcugcagugggccgggacaggaacaa

SEQ ID NO: 4160831 - RNA, 88 nt, Human
uugggugaaacacugggagaaguggagcugcuagguaauaggauaaaugugcacuuuacuuuucaaaaacugccagaguuuuccacaa

SEQ ID NO: 4160832 - RNA, 75 nt, Human
uugggugacuaacuugacaggacaugaggaaucucuucaagaggaaucagauuuucuucaggauacgucauccag

SEQ ID NO: 4160833 - RNA, 66 nt, Human
uuggguuagcuuaucuauacagacuuuuuaacucuaaaauguaacuuuauaggugagaaaacuuaa

SEQ ID NO: 4160834 - RNA, 103 nt, Human
uuggguuaggcugggagugggacagggcaggaaagguucagugauugaaaauugcuuuuuaguucccugaaacuuuuggccacuaacuuugagcauaucccag

SEQ ID NO: 4160835 - RNA, 73 nt, Human
uuggguuaguugagaauauuuuuuaaaauuagggcaaaauauuaaugcuaaagguguucuguauuuaacucag

SEQ ID NO: 4160836 - RNA, 60 nt, Human
uuggguuuuugggagacauuuucucaaaaaaaugagauucugucauuucaagaaaaacaa

SEQ ID NO: 4160837 - RNA, 60 nt, Human
uugguaauaugauggucuccuugccugaacuguucuuugcaagggauuucaugucucuaa

SEQ ID NO: 4160838 - RNA, 130 nt, Human
uugguaccuuauagggacuuaguauauagcuuuuggaaaguuaauucuuacugaauuuugaugauacuucuuguuucauguaaauguggaugcuuccguuaugugaguccuaagauuugggauuuaccaa

SEQ ID NO: 4160839 - RNA, 61 nt, Human
uugguaggggacuagaguccaguguggauauaugcagggcuaaacaaguucccacuaccag

SEQ ID NO: 4160840 - RNA, 56 nt, Human
uugguauaauacaguaaguguuguacaguuuacaacaguuuauaguguuaucuuga

SEQ ID NO: 4160841 - RNA, 62 nt, Human
uugguauauugugcuacuuuauguccacuucuccguggacuuggagagaauauauauaccaa

SEQ ID NO: 4160842 - RNA, 88 nt, Human
uugguaucagacuaauuauagagucuuggcugagaacaagaauauaaauaguguucuuggucucucucaguggcucuguagacaccaa

SEQ ID NO: 4160843 - RNA, 76 nt, Human
uuggucacaggccacggugauuuccuagcaaaggcucaaagaccuuggguuccaagucacugaagccugugacuga

SEQ ID NO: 4160844 - RNA, 65 nt, Human
uuggucacugaguccacugucaugagccacacugugugguuugaaugacaugauucaggcauuaa

SEQ ID NO: 4160845 - RNA, 56 nt, Human
uuggucacuugcuaugugccaaagauguuucucagagcucauagcuuggugaacaa

SEQ ID NO: 4160846 - RNA, 58 nt, Human
uuggucagaugugucuccuccuccucaaccccagagggaggaaggagaaucugagcaa

SEQ ID NO: 4160847 - RNA, 57 nt, Human
uuggucagcuaauaaggacagguagacuugcuccuaacugcuuagcuuccaggccaa

SEQ ID NO: 4160848 - RNA, 81 nt, Human
uugguccaugaguccaggaagaaacagucuuuauauaauccuuuccaugucuccugcugucuccuccugucucuugaucag

SEQ ID NO: 4160849 - RNA, 57 nt, Human
uugguccugcagaggggucuggcuugugacaagggagaucccuacugccaggacgag

SEQ ID NO: 4160850 - RNA, 68 nt, Human
uuggucuguaugccuuggugcuagaagugauaagacuuagguaauggaaagccagagcauaucuccag

SEQ ID NO: 4160851 - RNA, 59 nt, Human
uuggucuguuauuuccuugaggaugggaauuaucccuaauaucuuggaguaaugaucaa

SEQ ID NO: 4160852 - RNA, 83 nt, Human
uuggugaucccagggagcaggcucuguccauccccugcauaaagccagagagggcaccgccugcaccuguggcauuuugccag

SEQ ID NO: 4160853 - RNA, 64 nt, Human
uuggugauuacacagcaguaauuucaggacuguuuuccuuaggaauccggaugguaauuacuaa

SEQ ID NO: 4160854 - RNA, 76 nt, Human
uuggugccucuuagaaagaaacacacuggagccuguuauuuucaguaacccugcuguucagagagaaaagcaccaa

SEQ ID NO: 4160855 - RNA, 79 nt, Human
uugguggaagcagggacaucaguuaggaggccauuauaauacaguaauccaggagaaaacugacggugguuuguaccag

SEQ ID NO: 4160856 - RNA, 83 nt, Human
uugguggaggaugaaaagaucuccccuucaaagaguaugugaggcauaguuuuuugauaauagauaugcauaccuucucccga

SEQ ID NO: 4160857 - RNA, 65 nt, Human
uugguggcaauuaaguuuaucagagguugugagaucaagagcagccauauuuacauugucaccga

SEQ ID NO: 4160858 - RNA, 105 nt, Human
uugguggcaggaccuggagucucucucucucaggccaggcgcuauccaugguuucuggauaaagcauccuuugugucugggggagugacauccucugcucagcga

SEQ ID NO: 4160859 - RNA, 67 nt, Human
uuggugggagagaugaggguugcccauagacugaauuaaagaggaggcccugguuucaacucaugaa

SEQ ID NO: 4160860 - RNA, 101 nt, Human
uugguuauugacuguucugugaauccuggguuccuuggcucaugggagcuucaauguggcuuuucuggccaggaacuugccugacauuuucaauaagccaa

SEQ ID NO: 4160861 - RNA, 64 nt, Human
uugguucagaccagguccaaagcuacugucagggcagcugacagcccugugccugguuccccaa

SEQ ID NO: 4160862 - RNA, 55 nt, Human
uugguucaggacauauuugagugccugcuguauucaaggugcugugcugugcuag

SEQ ID NO: 4160863 - RNA, 82 nt, Human
uugguucuagcaaguagauacucauuuagauguccuuaagaaaagguguuaauuauaugaguaucauaucacuuaggauuaa

SEQ ID NO: 4160864 - RNA, 62 nt, Human
uugguucuccuugagugucccaggggaggcaacugcugugcugauucucaggugagagcugg

SEQ ID NO: 4160865 - RNA, 70 nt, Human
uugguucuucugcuucugggaugauggaguaggccuacuuuuuccuauuccucccaguaaguacaacuaa

SEQ ID NO: 4160866 - RNA, 75 nt, Human
uugguugugcuuguuuuugacccaaauguucacuuuagcccauggucugaucuuuucaaagacaagcuuacucaa

SEQ ID NO: 4160867 - RNA, 78 nt, Human
uugguuuacugaauuccuggaaaugaacuguuuuaagaguuuguacauuucagaaauucauggaguucagaaugccaa

SEQ ID NO: 4160868 - RNA, 62 nt, Human
uugguuugguuuuucugucugcuuaauuauauguuuugauuugcauuuagaaagaucacugg

SEQ ID NO: 4160869 - RNA, 80 nt, Human
uuguaaaaugucagcaguaucucuaucucagagucguuguaaggauuuccugagaugggaugugcacuuggcagugucga

SEQ ID NO: 4160870 - RNA, 59 nt, Human
uuguaaacuggauagaccuauuuauucaauaauauaaaugggaauauucuguguuacaa

SEQ ID NO: 4160871 - RNA, 63 nt, Human
uuguaacaguagcugucagcucauaacucauuggagaagggcugaauuuguugcauguaacag

SEQ ID NO: 4160872 - RNA, 69 nt, Human
uuguaagaguuggaauuuauuuugggaggcuuuauaacccuuacaagcuaauuguuucagcuaauacag

SEQ ID NO: 4160873 - RNA, 58 nt, Human
uuguaagucaaagaggcuaagguuauuugaguaaguaaccugaguuuuuuagaugcaa

SEQ ID NO: 4160874 - RNA, 60 nt, Human
uuguaagucacaccagggcaggaaguagaauagagauuugagcccaaguguaccugacaa

SEQ ID NO: 4160875 - RNA, 64 nt, Human
uuguaagugucuguaagcuuauuguguuguaaaccaagccugacagcacaauagacaccgauaa

SEQ ID NO: 4160876 - RNA, 95 nt, Human
uuguaaucaugccaaaauuaauaacauuguguaucacccagagagacucucagggaggaaagugaaaugguuauuaacuuggguuauuauugcag

SEQ ID NO: 4160877 - RNA, 65 nt, Human
uuguaccuucucuugacaaaugucaaaaugucauuucucaucacaaaugucuagagaggguguga

SEQ ID NO: 4160878 - RNA, 92 nt, Human
uuguacucuccucuuuaaacguuuucuuucauaauaaauagcagagacaaaaguguuucuauugggaagugugagaguaaagagauauacaa

SEQ ID NO: 4160879 - RNA, 75 nt, Human
uuguagccacucacgguuugcaucaagaguguuuuuuguaacugccucuggacuugggacagugaguaggaucaa

SEQ ID NO: 4160880 - RNA, 67 nt, Human
uuguaggaggucaaaauuguaucaggcuccaucuaugggucugagaacauaaauugacuucuuauag

SEQ ID NO: 4160881 - RNA, 81 nt, Human
uuguaggauagggaagaaagcacacaaacuugagugaguuauucuccaauuaauuuuauuugcuuauuccuucucaaauaa

SEQ ID NO: 4160882 - RNA, 64 nt, Human
uuguaggcagugguuggaagagaacuccaucagauguccucacacccauaccacugacccauaa

SEQ ID NO: 4160883 - RNA, 97 nt, Human
uuguagggaagauaacauuuuugagauagucuuguaagaauggguagaguuaccaaagucugaagauauucuugcagggaaaauggaauuaacgcaa

SEQ ID NO: 4160884 - RNA, 61 nt, Human
uuguagguauggaggggacuagggauggugucauuuuacauucagccuucucauccugggg

SEQ ID NO: 4160885 - RNA, 84 nt, Human
uuguaggugcaggguccaucuuucaucacugccaugcgagugagcugugaagugggaggggaccguauauggacuggaccucag

SEQ ID NO: 4160886 - RNA, 123 nt, Human
uuguaguagcccagauaggcugaauugaaaccuuauguuauuuuguuuuguucuauucuggcuuuggucugaaagggcaggcagagaucauauaguguuuuucuauugcacuaguuuuuacaa

SEQ ID NO: 4160887 - RNA, 73 nt, Human
uuguaguccuucaggaaauguauaauuuuauaaaauuuaaaguuuugugaaguuauuuuuucucaggauccaa

SEQ ID NO: 4160888 - RNA, 89 nt, Human
uuguaguggccauccucgaagcgcugacucacagcuugcaggccgcaggguccugggugcaguugcuucccaucuggcccacacugcaa

SEQ ID NO: 4160889 - RNA, 75 nt, Human
uuguaucugugucguucugugcucuggcagcuagaccagcucucacuuacagcaacggaggcgacauaaaagcag

SEQ ID NO: 4160890 - RNA, 80 nt, Human
uuguaugaucuccagagguagggagcuauguuauguucauacaaacauuuaguuucccauuuaguuaaagaucacuacaa

SEQ ID NO: 4160891 - RNA, 59 nt, Human
uuguauucagaaggaugaucuaguagucauuugacauuuaccauugcuuuugaauacaa

SEQ ID NO: 4160892 - RNA, 114 nt, Human
uuaugaaaacaagcaaagggccaaauuugcucugaaaguuuuaguguaugggccaccgguauacacaaaacugauacacaggaagcaauuucagagcaauguaugaugucauaa

SEQ ID NO: 4160893 - RNA, 59 nt, Human
uuaugacagggucuuuauuuuauuccucuguaugagucaagguaggaucggugucauaa

SEQ ID NO: 4160894 - RNA, 77 nt, Human
uuaugagggcagcauugccuuucuccaguuacaucaucgacucccuaaagcugagauuccccaguguguccucauaa

SEQ ID NO: 4160895 - RNA, 70 nt, Human
uuaugauuaggugggguuguuacuguuuaugaaacucaucugucaaauagggugccucauuuaauccuga

SEQ ID NO: 4160896 - RNA, 70 nt, Human
uuaugccuggaaccuuucucuuuggcgggugccaggaagcugagagagaggaaucucaagccagguauga

SEQ ID NO: 4160897 - RNA, 90 nt, Human
uuauggaauuauaaaaucuuaauaggcauugagcacuugcuagguccaagcauagugcugagugauugauauuuuaguuagucuucauaa

SEQ ID NO: 4160898 - RNA, 62 nt, Human
uuauggcaaaugaaagaaagccagucucagaaggcgaugggcugggugauucauuuccauaa

SEQ ID NO: 4160899 - RNA, 66 nt, Human
uuauggcuucuuguguuacugugggagaaggaaacuuuauacgcacaugcacagguugagcaauaa

SEQ ID NO: 4160900 - RNA, 65 nt, Human
uuauggucggguuggauggagugugagcacaaguaagagugugccauuucuaagccuggcuauag

SEQ ID NO: 4160901 - RNA, 93 nt, Human
uuauggucucaucacuggauuaaaaaauguaauaauauucucaguuuaaagaaaaugcacagguuuuaaauccucugugauaagggcccauga

SEQ ID NO: 4160902 - RNA, 94 nt, Human
uuaugguuauugacucugccaucaguaauucucucacguugugauuccacaguguuccuuuguugugacuggcaaagccacauaauagcuauaa

SEQ ID NO: 4160903 - RNA, 75 nt, Human
uuauguaagaaucauauuucucucugugcagaucacuuacagaagugucuguuaacaggagagaaugauacauaa

SEQ ID NO: 4160904 - RNA, 69 nt, Human
uuauguauuaucugugacugcuuugcacuacaaugucagagcugaguaguugcugcagagaauacaugg

SEQ ID NO: 4160905 - RNA, 64 nt, Human
uuaugugcagaggcuuccuugacucugucuccuaacuuggugagucuuagagucugugucauga

SEQ ID NO: 4160906 - RNA, 55 nt, Human
uuaugugggguggaugaauuugugagugaaucacaucaggugucuccccaagugg

SEQ ID NO: 4160907 - RNA, 72 nt, Human
uuauguuccuuacgccucuugccugggcuucaaagggaagaaguacaggaggcaaggguguaaaggaaauga

SEQ ID NO: 4160908 - RNA, 59 nt, Human
uuauuaagauaacacaaugcaucuaggacaggguccagagcuuuccaguuucuugguga

SEQ ID NO: 4160909 - RNA, 72 nt, Human
uuauuaggguggugcugguaaaacuacagcuauuuguguaguuugcgaaauuccugccuccacccuguguga

SEQ ID NO: 4160910 - RNA, 61 nt, Human
uuauuagugcuuuguuauuuuaauagaguuauauuucuaguggaaaaauguggccuaguga

SEQ ID NO: 4160911 - RNA, 61 nt, Human
uuauuaugguauuucuuugcaguugauggguccucagcaggcagaggaaugguauacauaa

SEQ ID NO: 4160912 - RNA, 61 nt, Human
uuauuauugauucgcucucaaacugucaaucuggggacagcucugaggcagucagugaugg

SEQ ID NO: 4160913 - RNA, 57 nt, Human
uuauuauuuuguguacagcaaagucacaguuaaaggaaaaugugcauagaauaauga

SEQ ID NO: 4160914 - RNA, 73 nt, Human
uuauucagcuguguaucccagggccuaguuuaguauagccucugcaaggugcuuaucuauauuuguugaauga

SEQ ID NO: 4160915 - RNA, 130 nt, Human
uuauucauaaguuauuaguucuaauuuucuuguauuuuauuagagaugccgcuaaguaggaaauuaaguggucuccccaguagaauaacaaaggucguaaguagagaauuuagaucauugcuuacuauag

SEQ ID NO: 4160916 - RNA, 79 nt, Human
uuauucuuuugcaccuuuuaaguaaugcgcuacagggcuguagcuaagaacauggacuucugaaggugugucaguuuga

SEQ ID NO: 4160917 - RNA, 77 nt, Human
uuauugagcauggaucaugugcugggugcugggcuauauauuggugggggccagagagacugauacaugcuugauaa

SEQ ID NO: 4160918 - RNA, 89 nt, Human
uuauugaugcuguuaaggccagaggugguacauagcuucucaguucugagauuuuaguaucauuuuuggcauagaauagauuucaauaa

SEQ ID NO: 4160919 - RNA, 88 nt, Human
uuauuggcuaacuguguauuucuaguaauucaaagucuaguguuuaauuuacauaaugaaaugcagaaaucaauuacuuggucaguag

SEQ ID NO: 4160920 - RNA, 57 nt, Human
uuauuggucacggcuaggaugcuauccuuuaggcauccaaucuaguaugauaaauga

SEQ ID NO: 4160921 - RNA, 86 nt, Human
uuauuguaugcuguguaggucuguuugggaaaugugacugccuggucuacuguuaaauuuuagaaacagacucuggcugucaauaa

SEQ ID NO: 4160922 - RNA, 130 nt, Human
uuauuguuuuucacagcauaucuuaugguacaaugauggauaguggcgaauauuuaucucuucauuaucucuuaaaaucggcgucacaucuccauguguuguucauugcuauaucugaugucuacaauaa

SEQ ID NO: 4160923 - RNA, 89 nt, Human
uuauuuaaaaaauaauaauaguaaaugaaagcaauuuuagagguggaaaauaccuuagaauggaaucauuugcauuauuugacaaauga

SEQ ID NO: 4160924 - RNA, 98 nt, Human
uuauuuacaaaaauggcacuuguguauguucuacuuaauauuacugugguaacaugaugguauuacuucuagacacaagcaugugccuuggugaauga

SEQ ID NO: 4160925 - RNA, 81 nt, Human
uuauuuauauuauguugggcaggggucagcaaacuauggccugcaugccaaaucuggccccuugccuauuuuuguaaauaa

SEQ ID NO: 4160926 - RNA, 93 nt, Human
uuauuucucagcuucucugaaaucugaagcauuuauuaagaaacaauaaaauaaauauaaaggcuuuaaagaaccagaacuagugaguuauga

SEQ ID NO: 4160927 - RNA, 99 nt, Human
uuauuucuguuucacuguuguuuuucuuaaaguauauuuuaacuucagaauucuauuuugacaguuuauuuugcagaaugcuguguggcucggaaauga

SEQ ID NO: 4160928 - RNA, 58 nt, Human
uuauuuggaagaucaggcagauuacauagcauuuugucugccugaaauucacauguaa

SEQ ID NO: 4160929 - RNA, 55 nt, Human
uugagaugcacuuuugcacuuguuacccaggcugagugcaauggcgcaaucucgg

SEQ ID NO: 4160930 - RNA, 102 nt, Human
uugagauggagucuagcucugucaccaggcuggagugcaguggcacaaccuuggcucacugcaaccucugccucccggguucaagcgauucuccugccucag

SEQ ID NO: 4160931 - RNA, 103 nt, Human
uugagauggagucucacucuguugccuaggcuggagugcagugacacaaucuuggcucacugcaaccucugccucccggguucaggcgauucuccugccucag

SEQ ID NO: 4160932 - RNA, 102 nt, Human
uugagauggagucucgcucuguugccaggcuggaguucagugaugcuaucuuggcucacugcaaccuccaccucccggguucaagcgauucuccugccucag

SEQ ID NO: 4160933 - RNA, 101 nt, Human
uugagauggagucucgcugucgcccaggcuggagugcaguggggcgaucuccgcucacugcaggcuccgccucccggguucaagccauucuccugccucag

SEQ ID NO: 4160934 - RNA, 72 nt, Human
uugagauggagucucgcuguguuccccaggcugguccugaaccccugggcccaagagagucuccaaccucag

SEQ ID NO: 4160935 - RNA, 103 nt, Human
uugagauggagucuugcucugucacccaggcuggagugcaggggugcgaucucggcucacugcaaccucugccucccggguucaagugauucuccugccucag

SEQ ID NO: 4160936 - RNA, 103 nt, Human
uugagauggagucuugcuuugucacccaggcuggagugcaguggugugaucuccacucacugcaaccuccaccucccagcuucaagugauucuccugccucaa

SEQ ID NO: 4160937 - RNA, 104 nt, Human
uugagauggaguuuuacucuuguugcccaggcuagagugcaauggcgcgaucucggcucauugcaaccucugccucccagauucaagugauucucccauuucag

SEQ ID NO: 4160938 - RNA, 56 nt, Human
uugagauggaguuuugcucuuguugcccaggcuggagugcaauggcaccaucucag

SEQ ID NO: 4160939 - RNA, 101 nt, Human
uugagaugggagaauugcuugaacccaggaaguggagguugcagugagccgagauuauaccccugcacuccagccugggugacagcgagauucugucucaa

SEQ ID NO: 4160940 - RNA, 82 nt, Human
uugagauuugauugagccuccugacccucuguggguaccacucccauuuaaguggaggccaggaaggcucggagaguuuuag

SEQ ID NO: 4160941 - RNA, 91 nt, Human
uugagcagagucaaguaagaugcagcuuuacaauaagggaggcuuuucucuucccucuccguuauacucuaucuugugaacuucuguucag

SEQ ID NO: 4160942 - RNA, 67 nt, Human
uugagcccaggaugucgaggcugcagugagcugugauugcaccacuguacuccagccugggcgacaa

SEQ ID NO: 4160943 - RNA, 88 nt, Human
uugagccccuugaaaugacaggagcacaucaaggcaaccaaacuccuuuuucacugugguaagcuuaaauuauuuuaagggagcacaa

SEQ ID NO: 4160944 - RNA, 78 nt, Human
uugagcccuuguacauaaugaaaggaggcugugcauaaaagccaguuauucauuuauucuguacauuagaggcuucaa

SEQ ID NO: 4160945 - RNA, 71 nt, Human
uugagccuggaaucuuacuuguguuaacucucauccaugaguuuauguugcaagaguuccaaacuguucaa

SEQ ID NO: 4160946 - RNA, 81 nt, Human
uugagcuaaugagagcacugucaccuaaauuuucauuguuuuaagagcaaguggaggcugacaguuuccuuucaagcuuga

SEQ ID NO: 4160947 - RNA, 56 nt, Human
uugaggacugcuaagcauuugaguaauuuuauaacuaaaugcugagaaguccuuaa

SEQ ID NO: 4160948 - RNA, 56 nt, Human
uugaggaggugggcacacagagucagcauccacucgauucuuguuccauuucccag

SEQ ID NO: 4160949 - RNA, 103 nt, Human
uugaggcagagucucgcucugucacccaggcuggagugcaaugacgccaucucggcucccugcaaccuccgccucccagguucaagugauucuccugccucag

SEQ ID NO: 4160950 - RNA, 77 nt, Human
uugaggcagguagucuuguuaucccaguuuuacagaucaggaaacugaagcacagagaaacuaagacauuugcccaa

SEQ ID NO: 4160951 - RNA, 60 nt, Human
uugaggccccauggaugagaacauucuguaauucucuguguacuuguuuauagggcccag

SEQ ID NO: 4160952 - RNA, 71 nt, Human
uugaggcucagagacuuuaaguuucuaucaacauauauagugagccugaggcuugaggcuccugaguccaa

SEQ ID NO: 4160953 - RNA, 67 nt, Human
uugaggcucagggacagugagugacugauuugaccaaacggauuuaaacucaaaucaccugccucaa

SEQ ID NO: 4160954 - RNA, 59 nt, Human
uugaggcucugugaugugccaggcacuguucuaagugcuggggacauagcaggcagcaa

SEQ ID NO: 4160955 - RNA, 59 nt, Human
uugagggagcacagauucuuauugccucacuggagagaaacuuagacugugcccuuuaa

SEQ ID NO: 4160956 - RNA, 55 nt, Human
uugagggcaagaaggcgauuuagugugacagaucgaguccuuccaauguccucag

SEQ ID NO: 4160957 - RNA, 55 nt, Human
uugagggcaagucuuuuccauaccuaaauaacaggggaaaaguacuccuccuuaa

SEQ ID NO: 4160958 - RNA, 112 nt, Human
uugaggucuggaucagguaucugagugucucuugagcucaguucugaugucucugacaucaagugguucuccagguugcacucacaacugaugcuuaauaaaagaauauuaa

SEQ ID NO: 4160959 - RNA, 74 nt, Human
uugaggugaaaauggaaaaucaacugcagaauauaugguauucagaggguugaauuuuuagggcuuugccuuaa

SEQ ID NO: 4160960 - RNA, 56 nt, Human
uugaguagaaaggguuguauagugagcaaauuauucccagccucuuucuaucucag

SEQ ID NO: 4160961 - RNA, 68 nt, Human
uugagucacuuuccuggaggcagcacuucaaguccaauuagaguggcagccgagcaggagauggccaa

SEQ ID NO: 4160962 - RNA, 99 nt, Human
uugagucaggagaaacacaagcccagguggcagagguuucagugagcugagaucacaccauugcacucuagccugggcgauggagcaagacugucucaa

SEQ ID NO: 4160963 - RNA, 59 nt, Human
uugaguccuagcccuggauccaucauuuaagaacugaaugauucuggcaagugacuuaa

SEQ ID NO: 4160964 - RNA, 59 nt, Human
uuucccaucaaauccuuggaguuuuuguugauguuuagagagcccacggaggugugaaa

SEQ ID NO: 4160965 - RNA, 77 nt, Human
uuucccaugggguucagccuugugccagccuuugggguuccagaggugaacaggaggcuguuucuccccucaggagg

SEQ ID NO: 4160966 - RNA, 130 nt, Human
uuuccccaccaucccugguaucuaccaaccuuauuuuccccuuucuuugucauacccuaugcucuugggggguagugaggugaaagagaggugauguuuaaggugagaagaucuagagaugguucucuaa

SEQ ID NO: 4160967 - RNA, 82 nt, Human
uuuccccugaauuuuuuauuggaaaguuacuuacaaguugcugaaacuuacaaguucccuuucucagguagauugggugaga

SEQ ID NO: 4160968 - RNA, 81 nt, Human
uuucccuaagggaagguuccauuauacuucagcaguggaaagcaucuaguagaauguaugcugugguaucuucucaggaag

SEQ ID NO: 4160969 - RNA, 80 nt, Human
uuuccgaguccuuaaauauauguugauacuaauucuggguaagguuuauugcuuaugggaacaaugugaaggauaggaag

SEQ ID NO: 4160970 - RNA, 69 nt, Human
uuuccgcucaucugcaugcaucuuagagagagcugcccugagguggcugauguagcagugugcugggaa

SEQ ID NO: 4160971 - RNA, 58 nt, Human
uuuccuaacacaaugcaugagauauacaaauagacaugucauguuuugugauuggaaa

SEQ ID NO: 4160972 - RNA, 75 nt, Human
uuuccuacugcccuauacacacaagccuauuuuauuacuuuguuugaagacugggugugucuaauguaguggaaa

SEQ ID NO: 4160973 - RNA, 59 nt, Human
uuuccuacuugaacucaauucuccuguuuuagcaggaaaguucucuugcgugugggaaa

SEQ ID NO: 4160974 - RNA, 58 nt, Human
uuuccuacuuucuggggagguauaggaagaaugggccuucucagaucgaguagugaga

SEQ ID NO: 4160975 - RNA, 72 nt, Human
uuuccuagaaugguuagaaaauauguuggcagcaaucaguauaauuuaauauuuucauaacauucuaggaaa

SEQ ID NO: 4160976 - RNA, 67 nt, Human
uuuccuagauguuaguuagucuugacaauaaggccuauauucaagauugaacuggcagauaaggaaa

SEQ ID NO: 4160977 - RNA, 82 nt, Human
uuuccuauuucuaaacaccacucagguuuguggucaguuuucgagaucuagaaaucuuuccugaaguguuuucaauaggaga

SEQ ID NO: 4160978 - RNA, 84 nt, Human
uuuccuccaucucugcaucauuuuucagagccggccaguuucuauggcaacgguuagauugaaagaugagcggcgagcaggaga

SEQ ID NO: 4160979 - RNA, 84 nt, Human
uuuccuccugcaagacuccucacuuucucugggaaaaaaauuugggggaaaguugagaggaucuugauauuauuguaguggaaa

SEQ ID NO: 4160980 - RNA, 63 nt, Human
uuuccuccuguacuuuuauauucgcucgaagucaggugaguauauuuaccauugggugggaga

SEQ ID NO: 4160981 - RNA, 55 nt, Human
uuuccucuucgauuaaguuugggauccucaucugcauuugacuuggagagagaaa

SEQ ID NO: 4160982 - RNA, 71 nt, Human
uuuccucuuguugucacacucugucuaauuuugcugaguuacuggcaggacauugacuacagugauggaga

SEQ ID NO: 4160983 - RNA, 98 nt, Human
uuuccucuuguuucucuuucugcucccucauuaaaugucacaauuccuuggacaaugaugcagaugaguaagauuucugggguagacagugggggaaa

SEQ ID NO: 4160984 - RNA, 55 nt, Human
uuuccugcuccauuugcugagcuccccaaagaagggaucagggagggagaggaga

SEQ ID NO: 4160985 - RNA, 64 nt, Human
uuuccuggaguggagucuguuguuugcaacuaagaacaauaauugauaugccacccaaaggaag

SEQ ID NO: 4160986 - RNA, 84 nt, Human
uuuccugguuuuagaaaagagagcucagcuaaguugacacacaguuaaauuagucaagcuucucuguguucaaaaaucagggaa

SEQ ID NO: 4160987 - RNA, 82 nt, Human
uuuccuguaucagauuuuccacagacuggaagggaaauucccuucuauugggacuuuugugaagaaugccuggcaccggaga

SEQ ID NO: 4160988 - RNA, 62 nt, Human
uuuccuguuuugcaacuggcugccauacucacccgagaacuggcuuuauugcagugcugaag

SEQ ID NO: 4160989 - RNA, 56 nt, Human
uuuccuucccuccugggccuucagccaggccugcugaggaacuggaagggaggaaa

SEQ ID NO: 4160990 - RNA, 87 nt, Human
uuuccuucuuuuuaaaggcugaguagaaucccauuguguagauauuuaauggcucaauuuugaaucaccuuggaagaagcaaggaaa

SEQ ID NO: 4160991 - RNA, 129 nt, Human
uuuccuuuaaucagggcgauuaaagaugccuacucacuuuccauucaagcaccuacugucuucaagucgggguggugaugugggcgggaaggaaaagcgcauuuuuccaugcuuuuguacuuaagguaa

SEQ ID NO: 4160992 - RNA, 118 nt, Human
uuuccuuuagucuuggaaauucagcucucaaaagauuauuuccucgcaggcaccuggcuuacaaucaggaugagcugccugugggugaugauuugauuuucuuugaaauauggggaaa

SEQ ID NO: 4160993 - RNA, 70 nt, Human
uuuccuuuauuauuaaauccauaggaagucuauauuacuuuacuuuggaauauuuuauugagaagggaga

SEQ ID NO: 4160994 - RNA, 89 nt, Human
uuuccuuuauucauucauuugccuacacaguuuuugauuggcugcacugcacuaggcacugcuguaggcagugaggagauggcaggaga

SEQ ID NO: 4160995 - RNA, 61 nt, Human
uuuccuuucccucuuucagcaaauauuuuuaugcgccuuuauuugcuggagaaaaaggaga

SEQ ID NO: 4160996 - RNA, 65 nt, Human
uuuccuuuccucuuauuuucccagugaugucuucugagauaugacaggcccaggagaaaagggaa

SEQ ID NO: 4160997 - RNA, 55 nt, Human
uuuccuuugaggguccuacacuaggcaaacugagggugugaucgucaaagagaaa

SEQ ID NO: 4160998 - RNA, 91 nt, Human
uuucgaugucuauuuuuaucucaugguuuccugucgagcauuuuaaaaaagaauuggaauggcaauucagugaaauuauagaacaugggaa

SEQ ID NO: 4160999 - RNA, 59 nt, Human
uuucgccaucuaccugcacccaagcuggcacaggcccccagcugcagcugauggggaaa

SEQ ID NO: 4161000 - RNA, 86 nt, Human
uuucgcuuccuaaagggguaaucuaaggaauuccagacuuaugccacgauuuagaaucccuugcauuaucccuuuaaaagguggga

SEQ ID NO: 4161001 - RNA, 73 nt, Human
uuucgggaaaaacugguaagacgcuugguucaaaucacuugaaaagaaaaucacuugcauaguucaccugaag

SEQ ID NO: 4161002 - RNA, 63 nt, Human
uuucgucauuuguaaaugaucaagaguucuugugcagcucugaucagaagacaaaugaggaga

SEQ ID NO: 4161003 - RNA, 71 nt, Human
uuucuaacuuaacacuccugugauuaaucuguggcuggauaguuguagaucagggaucuguuaguuggaaa

SEQ ID NO: 4161004 - RNA, 62 nt, Human
uuucuaaggccagagacugcuguuacucaaugcguuagucagucuuuucuuggcuucaggaa

SEQ ID NO: 4161005 - RNA, 63 nt, Human
uuucuacagugauuuggacaaguucaaugaggaauugaaaauauuccuugugacugugugaaa

SEQ ID NO: 4161006 - RNA, 82 nt, Human
uuucuagcauacagguaaucacacuguuauuuuaguuaaaguuagcuuaagccagagguugugugaucaguaaugcuagaaa

SEQ ID NO: 4161007 - RNA, 59 nt, Human
uuucuaggaugugaugaccugcuuaauaaaauagcaagaauguuuacacauucuagaaa

SEQ ID NO: 4161008 - RNA, 56 nt, Human
uuucuagggcaaugacucaaagcgggccucuugcuagauggagucaguucaagaga

SEQ ID NO: 4161009 - RNA, 75 nt, Human
uuucuauguacuguaauucauucaacugaagaaauacucuuucuacagguacugaaguacaugcaaguuuagaga

SEQ ID NO: 4161010 - RNA, 71 nt, Human
uuucuaugugugugauuugggauugguuguuuaaccucuaagcuauuauuuccucaucuauaaaauggaaa

SEQ ID NO: 4161011 - RNA, 66 nt, Human
uuucuauuaauauguuaauucugugaaguacuguauuucuacacgguuacaacguacuaauggaga

SEQ ID NO: 4161012 - RNA, 77 nt, Human
uuucuauuguaccuuuucucucaaacugguuuuauuuugacggauuuagcuucccuggagaaagcugcauauggaaa

SEQ ID NO: 4161013 - RNA, 94 nt, Human
uuucucagauuaagaugucuuggguuucaguuuacuucuuuaaagaaagauucagaguuaguacugaggacccagacuuucuugaugugggaaa

SEQ ID NO: 4161014 - RNA, 56 nt, Human
uuucucagcuuuccuugcaguuaugugcagucauguagcugauacacagugagaaa

SEQ ID NO: 4161015 - RNA, 92 nt, Human
uuucucagguacucuccccacuuuccugcccuugccuuccuuccaagagcucuccuggaagccaaggucagaaggagacaagcuugaagaga

SEQ ID NO: 4161016 - RNA, 119 nt, Human
uuucucauuauguccauuucaguggaaguagcauggagauaaugaaagaugcuuaauauugauugucucuuaaauguggaaauuacuguuguccacugagaaguaaauguggugagaaa

SEQ ID NO: 4161017 - RNA, 69 nt, Human
uuucucauucuguuugugaacuggcugagaggcaaaccuucuugaucuaauuuagaaauagaagagagg

SEQ ID NO: 4161018 - RNA, 65 nt, Human
uuucuccagcucagcauccuugcuuugcaaacccaaucaagccuuaggagcucugugcugggaag

SEQ ID NO: 4161019 - RNA, 129 nt, Human
uuucuccccaauaccuucugccagggguggaaucacugguuuccaggagaaaagagcucugaucaagcaauuucuccuccagagagacacaggccaccccauucugcacaguugguacaggaucagaaa

SEQ ID NO: 4161020 - RNA, 74 nt, Human
uuucucccuggagcccugaagcaucucugugauauaagcaguuacauguuuuauguuccacucaagggaugaga

SEQ ID NO: 4161021 - RNA, 77 nt, Human
uuucucccuuucuacaguacugauuucauaacuuaucuuuagguagaguggaaauuagauuuuaaaaagugaguaaa

SEQ ID NO: 4161022 - RNA, 104 nt, Human
uuucuccugugcugcuuccuggccuuaacgcuuccuggggacuuaccgucauuugcucaguuacgguuucuaugggaugaguggggaagccgcguggugaggaa

SEQ ID NO: 4161023 - RNA, 57 nt, Human
uuucuccuuacaguaaaccugugccuugugggccucaggggucacugugaggagggg

SEQ ID NO: 4161024 - RNA, 60 nt, Human
uuucuccuugugucuccuuugaguuaggcauggaaauagcuaaaggagaacaaagaggaa

SEQ ID NO: 4161025 - RNA, 81 nt, Human
uuucuccuuuccaaguuuacuacuaccugugugucuguucucaugacgcauuagagcuuugaacuucuuggaagaaaggaa

SEQ ID NO: 4161026 - RNA, 106 nt, Human
uuucucggugauggcagguuucucggugauggaagguuucucggugauggaagguuucucggugauggaagguuucucggugauggcagguuucucggugauggaa

SEQ ID NO: 4161027 - RNA, 63 nt, Human
uuucucuccuccaaaccaaagagagcccuuaguuuaagcucucuucauuuuguaggaaaggaa

SEQ ID NO: 4161028 - RNA, 93 nt, Human
uuucucucucugucacauaauuuaucuguaggaacaucuguuguguguguguauaaugucuauggaaagauuaaugugacaaagauuuggaaa

SEQ ID NO: 4161029 - RNA, 74 nt, Human
uuucucuguggauccuaauucuaacaacagauguccucauaaggacauucuuauaagagugaggcagagggaga

SEQ ID NO: 4161030 - RNA, 59 nt, Human
uuucucuugcgauaugcuacaccuauggucauagacagccaguguaagugcaagaggaa

SEQ ID NO: 4161031 - RNA, 55 nt, Human
uuucugaacucuaagggcuuugcaaugaaaacaguugauagagcugguucaggag

SEQ ID NO: 4161032 - RNA, 83 nt, Human
uuucugagcauugcuucccuguuauuuggccucuguaccuugaaccuagguugacaucaugagcagaggacaguucuuaggaa

SEQ ID NO: 4161033 - RNA, 79 nt, Human
uuucugaguaugaagcaguaggagggacaacuaccugaagcauuaggagcuugaucuguuuacugaaaccacuuuaaaa

SEQ ID NO: 4161034 - RNA, 64 nt, Human
uuucugcaagauguugucauaugcucagacauuuuacuugacauaugacuuauccuugaagaaa

SEQ ID NO: 4161035 - RNA, 90 nt, Human
uuucugcuuugcaauucuguuuucaucuaauccgucuucgacugcaguuugggggagaacaggggauuagauagcaggccaucacagaaa

SEQ ID NO: 4161036 - RNA, 61 nt, Human
uuucuggaaacuguaaagaggacaaggccagcaaauuguucauuugccugugguucagaag

SEQ ID NO: 4161037 - RNA, 68 nt, Human
uuucuggccagcuacccaucugcgucaaagugguguuggcuuuggcgccuggguggcuggauuggaga

SEQ ID NO: 4161038 - RNA, 125 nt, Human
uugcggaucucccauauaugucguggugauuuaguccuucagaccagagaguuuuccaauauuuuuuucuggauaacuguaucucuauuucuaacuucugcugagauggcugaggggaucugcga

SEQ ID NO: 4161039 - RNA, 120 nt, Human
uugcuaaacgaaaaggugaggugcuguaaugagugucacauguggagucagucuagugagcgacuguuuccagcuuucugaugcuuggggaagcaguacuguuccugaacuucccagcag

SEQ ID NO: 4161040 - RNA, 61 nt, Human
uugcuaacgagugcagauuauucaauaacagcucuugaacaguuaauuugcacaguugcaa

SEQ ID NO: 4161041 - RNA, 79 nt, Human
uugcuauugauuuacauauugucaagaaguuuauaguguauaguaccuauguuggcaauguguagcuaaugagaagcaa

SEQ ID NO: 4161042 - RNA, 57 nt, Human
uugcucauaaucuauggggcaaggcuuccgccgccuggcuccaggauggcugggcga

SEQ ID NO: 4161043 - RNA, 94 nt, Human
uugcucuaacaauagccuucauggcacaaguuugaugugaguuaaauaagguauugcaugaaaaacacgcaggcuugugccugguacagaguaa

SEQ ID NO: 4161044 - RNA, 55 nt, Human
uuucccaguuagugaagacaugaaaauggacucuguaagcacuuaaucuggggag

SEQ ID NO: 4161045 - RNA, 60 nt, Human
uuucccaucuuagcagauuaaaagggggaaacccuuauaaucucuucaagagaaggggaa

SEQ ID NO: 4161046 - RNA, 83 nt, Human
uuucccucuuauaccucucgggcagaugcuacguagaaaugucaggaacuaagccucccugggaacaaaggaugagaggggga

SEQ ID NO: 4161047 - RNA, 74 nt, Human
uuucccuguucuaucauuaaaagcuauuugcaacauaagugggaaucagaagcagagggcuugggggagggaga

SEQ ID NO: 4161048 - RNA, 76 nt, Human
uuucccuucccugaguugaagucauuagugacccagaaaacaggaagggggugaggccucauuuagggagaggaaa

SEQ ID NO: 4161049 - RNA, 63 nt, Human
uuucccuuguaccuuguggaaucacuggcaaauuguguuggaggucugaggagcagugggaaa

SEQ ID NO: 4161050 - RNA, 100 nt, Human
uuucccuuuauaauuaggaggugcuggguccuccacugcuucccagcuuuggaacuaauuucaggggaagcaggaggaggaggaccuccuagaagggaga

SEQ ID NO: 4161051 - RNA, 60 nt, Human
uuucccuuuguuaaauuggaagaguuuagaaugaaaacucuuuucacagacaaauggaga

SEQ ID NO: 4161052 - RNA, 112 nt, Human
uuuccguuaauuccugggaacucuuuucaguacucaguuuuguaguuucugaggaaaucauuauaguaaacacaagauuguguauugaauuaaagugacaggaauccagaga

SEQ ID NO: 4161053 - RNA, 82 nt, Human
uuuccguuuaugagucugccuggaucuccugcuggguaauggcagaaaagcucaggagacccagguuaggaaguaacugaga

SEQ ID NO: 4161054 - RNA, 69 nt, Human
uuuccuacauucucugaguuuuccuauuuacuauuugugcagagagagaaaggcagagagagagagaaa

SEQ ID NO: 4161055 - RNA, 77 nt, Human
uuuccuagucacauaaauuauacaauuucagcuuuuccuuuaucuggauuugugaaaagugaucauggauuagggaa

SEQ ID NO: 4161056 - RNA, 56 nt, Human
uuuccucaagucugaaacaaaagcucagagugucuucuauguuucacuuggggaaa

SEQ ID NO: 4161057 - RNA, 60 nt, Human
uuuccucagaagugucuacuauggggcuccaccucaugugagugaugcauuucugggaaa

SEQ ID NO: 4161058 - RNA, 71 nt, Human
uuuccucauuugugaagugaaggguuagauuugaugaccaccaaaguucagcccuuuucacgaaaaggaga

SEQ ID NO: 4161059 - RNA, 81 nt, Human
uuuccuccccucagagcacaguuuaugacaguucaaguuuuguucucuguucuguaagcugcuguugugcaagggaggaga

SEQ ID NO: 4161060 - RNA, 76 nt, Human
uuuccucuccccuuccgccagcucuugacgcauuuggccgugguggggagucacagggaggggaauguugaggagg

SEQ ID NO: 4161061 - RNA, 59 nt, Human
uuuccucucugcaaccuucaaagcauauuuugugucuuugugaaaguguugagaggaga

SEQ ID NO: 4161062 - RNA, 82 nt, Human
uuuccugagaugagaaagauggugagagaaauuugagguggaaaaaucaaggguuugguuuuggccaucuuccauguggaga

SEQ ID NO: 4161063 - RNA, 82 nt, Human
uuuccuggcuuuaucucuugguggauggcuuuaucucuuagucuuccuaaaagcuucaagagaagagugaguuucuaggaaa

SEQ ID NO: 4161064 - RNA, 55 nt, Human
uuuccuuguucauuugcccuauucuaaugggauggggaaugcacaaacaaggaag

SEQ ID NO: 4161065 - RNA, 72 nt, Human
uuuccuuuaauguuaucuucccuuugaugauuuaucuguuugauagagacuccaaagaagguaacaaggaaa

SEQ ID NO: 4161066 - RNA, 62 nt, Human
uuuccuuuugucccuauauccuggaagguuuguuuuuccaggaaguaaggauaaucuggaag

SEQ ID NO: 4161067 - RNA, 73 nt, Human
uuuccuuuuucaauauagaauugcauucgggcuauccauagagugccugcaauuucaaauaucagaaaggaaa

SEQ ID NO: 4161068 - RNA, 65 nt, Human
uuucgauuccuauuuggcuccuguuccuuccaaugggaacuuuguggggcugagaggaagggaga

SEQ ID NO: 4161069 - RNA, 56 nt, Human
uuucgcagccagugagcagaggagcuagugcuugugcugagcuucuagcuguggga

SEQ ID NO: 4161070 - RNA, 59 nt, Human
uuucgugacuggacaaacuuggguggcuuuaagccacggccgaugacuccagcauggaa

SEQ ID NO: 4161071 - RNA, 91 nt, Human
uuucuaaaucgcugcuacauuucucccugcaugccugccuguacacuguauacaggaucagcucagaguaaaucuauuagcaauauaggaa

SEQ ID NO: 4161072 - RNA, 104 nt, Human
uuucuaacaagauaaugcugaaucuccuuuugcaugaauguuuguugcucuuaaaaguuaucuaaugauuuggcaaaggaauccaguaauuuacuugucaggaa

SEQ ID NO: 4161073 - RNA, 71 nt, Human
uuucuaauacuguguccacuagccacauguggccauugaacauuggaaauguggcuagugagaccaagaaa

SEQ ID NO: 4161074 - RNA, 108 nt, Human
uuucuaaucaccuaaaucacuuuaagucucaucuuuuugacauggugauggucaaagauuggcacauuauucuuaucaaagcacaggauagggugcuagguggaggaa

SEQ ID NO: 4161075 - RNA, 56 nt, Human
uuucuacagaagauacacugcuguuuucauguuacggagugaauuuucccuggaaa

SEQ ID NO: 4161076 - RNA, 63 nt, Human
uuucuacagcuggugcaacuuucuaugcacagucaugccuguaaagauguuucaucugagaaa

SEQ ID NO: 4161077 - RNA, 58 nt, Human
uuucuagaaacaugacauugaucucuuuauucagagagguaauugcagguuucugaaa

SEQ ID NO: 4161078 - RNA, 55 nt, Human
uuucuagaaugacucaucugagacccgggucucagagugugagacauauuggaga

SEQ ID NO: 4161079 - RNA, 85 nt, Human
uuucuagauuuauucauuuauguacuuauucauucauuuauucagcagcuguauguuauaguuauaaaaugaggagaucuagggg

SEQ ID NO: 4161080 - RNA, 91 nt, Human
uuucuagcagaggucagaaggagcuguuuuguucagcaaagcuuuaaugcuucaugaacacacggaaagcuaaucucuggcuaguuagaaa

SEQ ID NO: 4161081 - RNA, 67 nt, Human
uuucuagcaugacacaguccucauacucaaaaaacugggggcuauugcuauuguuacuugcuagaaa

SEQ ID NO: 4161082 - RNA, 63 nt, Human
uuucuaggucuuccauacugccauacugcccccacuuccaggcagacguagggaaaccagaag

SEQ ID NO: 4161083 - RNA, 61 nt, Human
uuucuaguggguauucccuguugcauaaaauaccacagcaauagcaaaugcucauuugaaa

SEQ ID NO: 4161084 - RNA, 72 nt, Human
uuucuauacugauuugucuauacucuaggaaguccauucucccaaagaaguaguagacaagacucggagaaa

SEQ ID NO: 4161085 - RNA, 71 nt, Human
uuucuauucacauaaugauacaaagcuucugcuguuaaguggcaaagaaucguaaaguuaagugaaugaaa

SEQ ID NO: 4161086 - RNA, 69 nt, Human
uuucuauuuggcuggaugauagaacuaagaauaguauuucuuacauucuuaucucaguuauuuuggaag

SEQ ID NO: 4161087 - RNA, 60 nt, Human
uuucucacauucagaacuuuuauagauuuucuucaguaugaaauuucugauguagagaga

SEQ ID NO: 4161088 - RNA, 70 nt, Human
uuucucagaggagccagacgguccacauacaucaucaacugccucugagcuuucuggcugcucugugaga

SEQ ID NO: 4161089 - RNA, 69 nt, Human
uuucucagaugucuuacccauguugaaaacauuugugugaucacacuggguaacauaucuguuaagaga

SEQ ID NO: 4161090 - RNA, 66 nt, Human
uuucucagggagguccugugcugaaagggaacuugacucaauuccacggagaugcucccuuagaaa

SEQ ID NO: 4161091 - RNA, 79 nt, Human
uuucucaucuguuaaauagauggguuaaacagcaaauuggucuaauaugcugugauucuauacuaaagaacaugaggaa

SEQ ID NO: 4161092 - RNA, 58 nt, Human
uuucuccaauguaucagcacacauuccacuuuauuuugugagcugacccauuuagaag

SEQ ID NO: 4161093 - RNA, 59 nt, Human
uuucuccaugccacuuacuucuccaagagggaaccguagugacuuggcaugaugagaag

SEQ ID NO: 4161094 - RNA, 65 nt, Human
uuucucccugugguucuguggcuucaccgggaaaaugugggccuugcugagcuauggaggggaaa

SEQ ID NO: 4161095 - RNA, 63 nt, Human
uuucuccuucccucccuccuguguucuaauagaggagugcauuugggguaguggaagcagggg

SEQ ID NO: 4161096 - RNA, 57 nt, Human
uuucucgaagauuugggguaauauguagaccucucucaacuucaaaucuuagagaaa

SEQ ID NO: 4161097 - RNA, 93 nt, Human
uuucucuacauuuugcucagcuguuggcagcagcccuacuuucucucuccccaagcagagagagggaaacugcuaaacugcaaaaagaagaaa

SEQ ID NO: 4161098 - RNA, 116 nt, Human
uuucucucaaugggggaugagccauggucauuuuuauuguguugauugguuugaaacuuuaaugaaccuuuucagcuggauguggaagugcuaggagguauccccucucagagaaa

SEQ ID NO: 4161099 - RNA, 62 nt, Human
uuucucuccugcagcucugacuugcuuguaauuaaacgcaagucagagcugcaggagagaaa

SEQ ID NO: 4161100 - RNA, 79 nt, Human
uuucucucgauccucacucuguacaaggauugcucccaaucacugcauuuccugcaaggaguggguuuucaagaagaga

SEQ ID NO: 4161101 - RNA, 84 nt, Human
uuucucugaggugcauucugaaucuuugcagggucuaucugccuagcaggaauaugagguuaauaugagugcauuugagaggaa

SEQ ID NO: 4161102 - RNA, 58 nt, Human
uuucucugcugccugugucgaugacauccagaccauccaagcaggaaagguauagaaa

SEQ ID NO: 4161103 - RNA, 61 nt, Human
uuucucuggccucaguuuaacaggauuugccauauuuuggugaacaaugaggugagagaaa

SEQ ID NO: 4161104 - RNA, 60 nt, Human
uuucucugugugauuuggugugugcgcagaguggguacacagggcggaaagcaugagaag

SEQ ID NO: 4161105 - RNA, 68 nt, Human
uuucucuuagguaaguuaagcauuccccuugaauuuuuaauuggaagaauugauuugcuuaguaggaa

SEQ ID NO: 4161106 - RNA, 71 nt, Human
uuucucuugcuuaauuucuaaguuuuggauaauucuuaccaaaaaguuaagagagguucagucuggagaag

SEQ ID NO: 4161107 - RNA, 114 nt, Human
uuucucuuucacuuaaugcucccaugacccuggcagauaccgucacaaucugcguggacugugaggcuaccugccagggucaugggagcauacagaauguaaggcuuggagaag

SEQ ID NO: 4161108 - RNA, 79 nt, Human
uuucugaaaaccuguaggggacuguugcauccuucuucaauagagcuggguggcugaagcagucuucggggaccaggag

SEQ ID NO: 4161109 - RNA, 64 nt, Human
uuucugagaaauuaaacacuuuauaugacauuuuacagcauguagagagguugaaacucagaga

SEQ ID NO: 4161110 - RNA, 57 nt, Human
uuucugagaauauuucuguucaucgugaaauagaugaaaaaugaaguuguucaggaa

SEQ ID NO: 4161111 - RNA, 57 nt, Human
uuucugcagguauugcauaagucaggaccucccuguucucauccagugccucaggaa

SEQ ID NO: 4161112 - RNA, 96 nt, Human
uuucugcauuuguccuucuucauucagucccgaaccgacagccacaaguggcgcccgaacagggacgugagugaagaaggucugcuggagcagaga

SEQ ID NO: 4161113 - RNA, 64 nt, Human
uuucugccagguuucuggaugagucuugguaccauuugcaucaacuagauccugacuccagaaa

SEQ ID NO: 4161114 - RNA, 58 nt, Human
uuuugcuuucaaugaauuguauacugggaaaccaguuuacccacuguugaaauuaaag

SEQ ID NO: 4161115 - RNA, 65 nt, Human
uuuuggaaccaacagugcaccuggacaaagcagaaaaaaauugcaaucagggcgacugaccaaag

SEQ ID NO: 4161116 - RNA, 83 nt, Human
uuuuggaagucagggaaaauuugguagauuuuuuuaaaaggcaauaaaaugagaagauuuguuguaauuuuuagcuuccaaaa

SEQ ID NO: 4161117 - RNA, 70 nt, Human
uuuuggauguucagaugcuguuuucuuauauaggugaaaguacacaccuauaucagcaaagcauuuaaaa

SEQ ID NO: 4161118 - RNA, 79 nt, Human
uuuuggcaaaggcauucucuuuucaaauugcuuaagaacaggcauagugagauaucagagggagauguuuuucucaaga

SEQ ID NO: 4161119 - RNA, 59 nt, Human
uuuuggccaugcucaaggguauacauacaaagucuuguaucaucugggcagggccaaag

SEQ ID NO: 4161120 - RNA, 88 nt, Human
uuuuggcucaagaaaggcaaaagcugucuucacgauguaucuguugcaugcugagauaaggcuuuagucauucuacuaugaauuaaaa

SEQ ID NO: 4161121 - RNA, 56 nt, Human
uuuuggcucuugguaggucagaguggccuuuccuucaugccugccaaagcacaaag

SEQ ID NO: 4161122 - RNA, 58 nt, Human
uuguccugaggacuguuaucagagaaagaaagaucuggaaauagugccuuauggggaa

SEQ ID NO: 4161123 - RNA, 78 nt, Human
uuguccugauagcugaaacuucccauuaauuguccaagaauacugugcugguggguuagaguuugcgaagcaggacaa

SEQ ID NO: 4161124 - RNA, 109 nt, Human
uuguccuugaaacuuccacugaaagggaagaggcugaacccagugaaacuuauucagcaggguacagaguuuucuaaacuuuugugugagaagaagcccuaguggacag

SEQ ID NO: 4161125 - RNA, 56 nt, Human
uugucugaaagaucauuacauuuugucauccugagagauguguuaaauucagacaa

SEQ ID NO: 4161126 - RNA, 60 nt, Human
uugucugaauucuucuaggcagcaacugugucuauaacagugacuugauaauuuagacaa

SEQ ID NO: 4161127 - RNA, 57 nt, Human
uugucuguaauucagacaguaagcaccaagccaagguuugucugaguaugcugacaa

SEQ ID NO: 4161128 - RNA, 68 nt, Human
uugucugucacaaguaacuggcaaugccacagaaguggcugucgguggcucugugaaagugcugacag

SEQ ID NO: 4161129 - RNA, 108 nt, Human
uugucuuccugugguaacucuggguagaacucaugaguaugaagcaacuuguaucugugcuuccaugguuuauuagagcuuauuuuaugaaaaggaugggaagggcaa

SEQ ID NO: 4161130 - RNA, 101 nt, Human
uugucuucucaaaguucagcuucugauuuagacucugucauucaagaacauaaugaauauuaucaguauuuaggauuaggagagacagugcaggaagacaa

SEQ ID NO: 4161131 - RNA, 77 nt, Human
uugucuuguuuacaacacagcucaaauauuuccuggucagaaauauccaggacuagcuuuggugaugugacagauaa

SEQ ID NO: 4161132 - RNA, 69 nt, Human
uugucuuuucccaaugaguccuugagcauuucuggaauguugguguuuacuggaccagggaggggacag

SEQ ID NO: 4161133 - RNA, 58 nt, Human
uugugaaaucguguuuggaagcuagauugcucuagaccacuaagguaugauuucacag

SEQ ID NO: 4161134 - RNA, 73 nt, Human
uugugaagauaagaaaagugggacccguaaagauugagaccuuggcuagguucacacuuucaugauuucauag

SEQ ID NO: 4161135 - RNA, 62 nt, Human
uugugaauagugccgcaauaaacauacgugugcaugugucuuuguagcagcaugauuuauaa

SEQ ID NO: 4161136 - RNA, 57 nt, Human
uugugacagcuccacccuggggaacaaggccaauuccuccaaccagcagcugcauaa

SEQ ID NO: 4161137 - RNA, 64 nt, Human
uugugacucugggaccagugaagcaacucagcagugaguuccaaaacugcaucccaggauauaa

SEQ ID NO: 4161138 - RNA, 67 nt, Human
uugugauugcuguuuaguaguugagccaacauaaaauugauguugagcuuuacaacagcuguuauag

SEQ ID NO: 4161139 - RNA, 69 nt, Human
uugugcaaaaggacuucuggguugaaacgaguuuacucacaucagagaagccagauccauuuugcaugg

SEQ ID NO: 4161140 - RNA, 84 nt, Human
uugugcaaauguguuuuuucuucuacaucgcccuugaaguaacucuccauguguuucuguaaggaaaauucaugucuuguagga

SEQ ID NO: 4161141 - RNA, 55 nt, Human
uugugcaaggcucuuggaauguacuaaaaacacuuuuuaagucaguguugcacaa

SEQ ID NO: 4161142 - RNA, 59 nt, Human
uugugcaguggaugcuuucaccuguccaaacagcaaaagcaagucucuacaaaguacaa

SEQ ID NO: 4161143 - RNA, 82 nt, Human
uugugccuuaguuuccguggcuauagaauggggauaauaauagcaccagucucuguguguugucaggaggauuaaggcacag

SEQ ID NO: 4161144 - RNA, 76 nt, Human
uugugcuaaacugcaguuuuauccagcauuguuuuuguaucaacagugcaaauaucuacgcggugaaaaaggccaa

SEQ ID NO: 4161145 - RNA, 67 nt, Human
uugugcugguggaauggcagagggaacuucacaggaaccuuaguguucuuuuaccucaaagccacag

SEQ ID NO: 4161146 - RNA, 55 nt, Human
uuguggaauaaaaaucaguuaugugauuuaacugggccaacuauuuguucuacaa

SEQ ID NO: 4161147 - RNA, 80 nt, Human
uuguggaggguucucuugguguguugucgggcauuuaguaacauucccucuacccacagaaugccaaugagaccucccga

SEQ ID NO: 4161148 - RNA, 61 nt, Human
uuguggaugcuugaucagguccugauaguucacuaaugccaucaggcucaaaucaucccaa

SEQ ID NO: 4161149 - RNA, 68 nt, Human
uuguggcacccagaacugagaaaauaaauuucuguuauuugaaguauuucagcgguucuuuguuacag

SEQ ID NO: 4161150 - RNA, 71 nt, Human
uuguggccucugggaaagcagauucccaauaaggaugaucucuccuugaggagcuuccuaugaguccacaa

SEQ ID NO: 4161151 - RNA, 121 nt, Human
uuguggccucuugaguguuggagcuggaggaggcgcugugaauccuguuugcccagccaauuuacaaaugagacagugaggcagagcuuccguggccacuaccgucuugcagaggccauga

SEQ ID NO: 4161152 - RNA, 66 nt, Human
uuguggggcccgaguggccaccuugugggaaggcucccauuaugagcuaaguuguggcccccucaa

SEQ ID NO: 4161153 - RNA, 84 nt, Human
uugugguaaaccucugaacauuuuuaagacucuaguguguagagaaccuuucuuuagaaauucagaucuggugggauaccauaa

SEQ ID NO: 4161154 - RNA, 78 nt, Human
uugugguaauggcaaccauaugggcuggugacugcugucaguaaaaauagcccacauggccuguguggccagacacaa

SEQ ID NO: 4161155 - RNA, 91 nt, Human
uuguggugggggcuguuguuugcauuguaggauguuagaagaauccuucuuggacuucuacccacuagaugccagaaacaccccaccacaa

SEQ ID NO: 4161156 - RNA, 61 nt, Human
uugugguuguugacaagcucggucaugguaacauuggcucaggcuugaaaauagauuucaa

SEQ ID NO: 4161157 - RNA, 60 nt, Human
uuguguaaugaaguuaucauguuuuauagaacaugaaaaacuugcuucauuuuuacacag

SEQ ID NO: 4161158 - RNA, 70 nt, Human
uuguguauuucuggaacagacuauagagagaagauuuaauauuauauuuguagacuguccugaagcacag

SEQ ID NO: 4161159 - RNA, 72 nt, Human
uugugucuuuauuuagguaaacaugaguuuguucuuauuuuaauaaacuuagagcucuccuaaaugacucag

SEQ ID NO: 4161160 - RNA, 62 nt, Human
uugugugaaguuuuggagagggaaaauccucuaauaggcuugaccuuuuuuaacuucagcaa

SEQ ID NO: 4161161 - RNA, 74 nt, Human
uuguguggaagagcagguuucaaugcugaugcuuguuuuauaaagacauuggcaagugaaccugcaucauacaa

SEQ ID NO: 4161162 - RNA, 55 nt, Human
uuguguguagacucagccauuguauauaggccaugguccagccagcugcacagga

SEQ ID NO: 4161163 - RNA, 62 nt, Human
uuguguuucuggccaagauggagugauaaggacuggacugacucucuggccagaaacaacag

SEQ ID NO: 4161164 - RNA, 73 nt, Human
uuguguuuuccuugauuaguacaugaaggaacagcucuguuuugaaugcccugcgugacuggagguuacacag

SEQ ID NO: 4161165 - RNA, 77 nt, Human
uuguguuuuuucacaguggcccucucugaguuuuaaaacugggaauuagaagggaguuauugauaugaaaaccacga

SEQ ID NO: 4161166 - RNA, 86 nt, Human
uuguuaaaacagugucuuagguuccauugccagagucucugauucaguaggucuggaguggggccugagaaucugcacuuuaacaa

SEQ ID NO: 4161167 - RNA, 85 nt, Human
uuguuaaauuugugacaccauugacaguguuaaaguugccuggauaccaucaacacauggacaguguuaaaggugcaauugacag

SEQ ID NO: 4161168 - RNA, 129 nt, Human
uuguuaauucgugaugucacaauucaagugugcuuccugucacuuauguguaguuuaaaauguucuuuaauguagcgugaaaugauugguuagcuuugaaaugguugugaagucaugugaagaaaauaa

SEQ ID NO: 4161169 - RNA, 57 nt, Human
uuguuacagaucacauuucugcggaacaucacguggaccuugucgaaucugugccga

SEQ ID NO: 4161170 - RNA, 90 nt, Human
uuguuacccaguuuuuaaccuguuuuugacgacugugucucuguuuaugcaagaggcaaauugucuagaagggguguagcuagguauuaa

SEQ ID NO: 4161171 - RNA, 62 nt, Human
uuguuagauggugguccauagcuggugaucgaaguggaucaguccagcuccucauuucccaa

SEQ ID NO: 4161172 - RNA, 58 nt, Human
uuguuagcaaagucccacagcuucaggggaauccugccugugggcccuuggcuggcaa

SEQ ID NO: 4161173 - RNA, 77 nt, Human
uuguuauucuugcuacaacuggacaacagauugggcucuuaagcuuucugacacaucaguuguaaaguuaaugacaa

SEQ ID NO: 4161174 - RNA, 62 nt, Human
uuguucacaggauauaugugcaggguuggggagcugcacccuugcacccuuuccugugacaa

SEQ ID NO: 4161175 - RNA, 59 nt, Human
uuguucaucaggugacacauacuaagugccacuuagcacauguggucauccugggacga

SEQ ID NO: 4161176 - RNA, 83 nt, Human
uuguuccugagccugaaguuacuuccauuguugcuacuguuguagauaaugagaauacaguaacuauuucaacugaggaacaa

SEQ ID NO: 4161177 - RNA, 97 nt, Human
uuguuccugugacuaauaguaugcauuugauuugcaauuuuucagcugggaucacaguuuauggccaacaggcauauuucuagauuacaagggauaa

SEQ ID NO: 4161178 - RNA, 90 nt, Human
uuguucgauacaaggagcuuugaaaguuuccgguucuuaguacauauggaacacuuagauuuuuaagguuuuuuuaauuguuuuagacaa

SEQ ID NO: 4161179 - RNA, 60 nt, Human
uuguucucuuaucuggcauuauuggguuagcccccacugugccugguguggagaggguag

SEQ ID NO: 4161180 - RNA, 72 nt, Human
uuguucuucagugauuuuggucugccuuagaguuugaugaguccaaggcuucccagagaugcucaaaaacaa

SEQ ID NO: 4161181 - RNA, 58 nt, Human
uuguucuuccaucaucccucagccugcagagaacagagccugauggugggagugacag

SEQ ID NO: 4161182 - RNA, 81 nt, Human
uuguucuuugcaaauauacacaaucccucugcauuuugagaaaggaugcaucuguaguguuauaugauuagugucggacag

SEQ ID NO: 4161183 - RNA, 100 nt, Human
uuguucuuuuuguucaacucuuauaugcuagcugcucagaguuaaccuaaacuauccauguauucugaccuguaacuguaagagacaaagaaaagaguag

SEQ ID NO: 4161184 - RNA, 77 nt, Human
uuguugagagauuaacauaucuuguaauguaaaugcuuuaucacacauuguugaaagauauguuaaucuuucaguaa

SEQ ID NO: 4161185 - RNA, 69 nt, Human
uuguugaucacuguacagagaccguagaucugaguaacugagagauacaucuuugucuaugaccagcag

SEQ ID NO: 4161186 - RNA, 130 nt, Human
uuguugcuuguaucagaacuucauuccucuucaugguucaguaaucugcuagaaauuugaaaaaacuauuuuugucaguucagugauuacaaaauauuugaaguugaauaacuauaauuuuaagcaagga

SEQ ID NO: 4161187 - RNA, 86 nt, Human
uuguuggaacacagcagcugauuuugaacagcuccaaaauguaacucaaaauccuuuuggcugaauauauauuuguguuuuaacaa

SEQ ID NO: 4161188 - RNA, 66 nt, Human
uuguuggagaagccuuucguggagagaagcucugugccucggauauggacaggcuuauaacagcaa

SEQ ID NO: 4161189 - RNA, 59 nt, Human
uuuuaaugcaggggcauguucucuaguagacacauaaugaaaauggccuuguauuaaaa

SEQ ID NO: 4161190 - RNA, 59 nt, Human
uuuuaaugugcucugcaaugauugaacuguucucaggagaucauuuuugcacaucaaaa

SEQ ID NO: 4161191 - RNA, 81 nt, Human
uuuuaauugaaaaguuuugaaacacucuuuuuguagaauaugcaauuggauauuuggagugcuuugaagccuucauuagaa

SEQ ID NO: 4161192 - RNA, 63 nt, Human
uuuuacagcuucuauacuaugugaucauguguuauggccaaguaguccaaaggagcugcaaag

SEQ ID NO: 4161193 - RNA, 83 nt, Human
uuuuaccauuguuuguaauuaccucuuuugacagagaaaauguucugaguaggagcaaguuacgucucccaaugaaugugaaa

SEQ ID NO: 4161194 - RNA, 87 nt, Human
uuuuacguuucacaaguccauagguuucaugaggguauaaacuguaccugugaaacaaugucuaugugguaaagugcagguguaaaa

SEQ ID NO: 4161195 - RNA, 77 nt, Human
uuuuacuauucaggaacaguuuauauugcauggggauuaucuguuccuugaaaguuugaacugacuugauaauaaaa

SEQ ID NO: 4161196 - RNA, 105 nt, Human
uuuuacuuaaccaaaccggcacuuucucuuuaaguauaaucuuauauggaaccucauuauauaaaacuaaacagaagaguagcugcugcccugguugaaguagaa

SEQ ID NO: 4161197 - RNA, 85 nt, Human
uuuuacuuaacuguuuugugccuuaguuuccccauguggaauauggggauaacuuuaguaccuaccucauaggaauagugugaag

SEQ ID NO: 4161198 - RNA, 78 nt, Human
uuuuagaggugacaucaaguaacauuucaaugauuuaaaggaggaaaucuuugaagaggacuugaagugccuuuaaaa

SEQ ID NO: 4161199 - RNA, 65 nt, Human
uuuuagagugaugaguguguaccagacacaaugcuaagugcuuuacauacauuaucuuuuuaaaa

SEQ ID NO: 4161200 - RNA, 79 nt, Human
uuuuagcaguccugaauacuggacggugggauuaauuuauccuuaaaaucaaacaccuugggaauuuggacucauaaaa

SEQ ID NO: 4161201 - RNA, 69 nt, Human
uuuuagccgaguaaaugcuagcccuuuaaaguugauaucaauacuuugggaagcugcaauugccuaaaa

SEQ ID NO: 4161202 - RNA, 75 nt, Human
uuuuagccuauaaaauggcaucagcuccaaaguucucuccugaugcuuugaagcuaggcugugcauaugcuagaa

SEQ ID NO: 4161203 - RNA, 118 nt, Human
uuuuagcugaaaugguugcuuagaauauuaaguuugugacucacaugaaaccagcauauaagugaaugcuucauaagugguuuauaugcuugaucauuuuucguaauuuagcucaaga

SEQ ID NO: 4161204 - RNA, 58 nt, Human
uuuuagcuuggcaggcuuuccacuaaaguuaauuuuuuggcuucugccaauguuaaga

SEQ ID NO: 4161205 - RNA, 76 nt, Human
uuuuaggaaguagugugacaauuaauauuugaugugaaauacuaacagauauugugcauacugcuguuuucuaaga

SEQ ID NO: 4161206 - RNA, 57 nt, Human
uuuuaggcuuugaugggugagaugugguuugccaccuccaugguaagaagcuuagag

SEQ ID NO: 4161207 - RNA, 71 nt, Human
uuuuaggguugccauggcuuuaauuugauuguuauuuauugagcauucaaacuguguuaggcagcauaaag

SEQ ID NO: 4161208 - RNA, 129 nt, Human
uuuuaguaaacuauuuuuaaauauaugauucagucaguuuugauuccugguucucaguuugguuguggacauguggcauuaaaacauauuuugguuuuauuuuauuucuuagauagaucagcuuaaaua

SEQ ID NO: 4161209 - RNA, 78 nt, Human
uuuuaguaguguggaaaugacuucuaauggaaggcgggauaccaucuuuacagaaugucaauuucuauacuucucaaa

SEQ ID NO: 4161210 - RNA, 67 nt, Human
uuuuagugguacucagggagggaacagcacuaaauauacuuguucaaucugccauguauaacuagaa

SEQ ID NO: 4161211 - RNA, 79 nt, Human
uuuuaguguggcacugauguucaauguuuccuauauuucucuauuuggacaaaauugaauacaggaaaauauacugaaa

SEQ ID NO: 4161212 - RNA, 64 nt, Human
uuuuaguuaauaggucuucagcuuaagcagaauggaugaauaaguugagguauauucauuaaaa

SEQ ID NO: 4161213 - RNA, 59 nt, Human
uuuuaguuacugcaguagcaaagagauucaugaguuuagccuauugcacauagcugaag

SEQ ID NO: 4161214 - RNA, 69 nt, Human
uuuuaguuuuacggugcggauguggguuucaacaccauaauggguuaacuucugcacagaaaauuugaa

SEQ ID NO: 4161215 - RNA, 59 nt, Human
uuuuauaaauacagagugugccagauguuguucaucuuuggcacuucuguuuuaaggaa

SEQ ID NO: 4161216 - RNA, 70 nt, Human
uuuuauaaauucacucuguuccucauggugaauuuauaaauuccucauggagcagggugaauuuauaaaa

SEQ ID NO: 4161217 - RNA, 92 nt, Human
uuuuauauuuugcauuugcaaauaaugaaagcucacauggguuguaauaauuguuacuagcuuuuaauauugggcaaagcacaaauacaaaa

SEQ ID NO: 4161218 - RNA, 79 nt, Human
uuuuaucaacugagauuaaauauuugugauuaaagcaucuucugccuuuuauaaauaaauugggcggcaguugaagaaa

SEQ ID NO: 4161219 - RNA, 65 nt, Human
uuuuaucagcagggauaacaagagucuuuuuuccuucuuucucaacucagucccugcuggucaaa

SEQ ID NO: 4161220 - RNA, 65 nt, Human
uuuuaucaucuucugaauuuggaaucaauggaaaaacagauccaggagucagacagauggugaga

SEQ ID NO: 4161221 - RNA, 89 nt, Human
uuuuaucuccuuuuugcuuucccuuguagaaaguugacaaauagucccuaaagcugucaauagguuggaaauaagaaggaaaaguaaag

SEQ ID NO: 4161222 - RNA, 65 nt, Human
uuuuauggggaccucuauguaucucuagacuacacuuugagaagcguuggccuccccugaugaga

SEQ ID NO: 4161223 - RNA, 74 nt, Human
uuuuauguucaucuguguaugaaaguauaacugcugcauaacaggcaguuuucuuucgcaaagguacaauaaaa

SEQ ID NO: 4161224 - RNA, 74 nt, Human
uuuuauguugaagucuuaacuccagguaccucagaauguggcuguauuuggagauaagauuuuuagauauuuaa

SEQ ID NO: 4161225 - RNA, 92 nt, Human
uuuuauuaaugcacucuagggacaguuguguuugagucaaccuccagcuaaaaugauagaaaacagauguccuuaaaacaggcuaugugaaa

SEQ ID NO: 4161226 - RNA, 86 nt, Human
uuuuauuccuccacagcucuaccuauucaauaucuuauaaaauuuauuuuauggguaaagggcuaggguuuggggcaaaaaugaaa

SEQ ID NO: 4161227 - RNA, 77 nt, Human
uuuuauucugcaccauguauucaguuuggcacagaaccuggcucauaguuggcugaaauacaugacaaugaaugaag

SEQ ID NO: 4161228 - RNA, 120 nt, Human
uuuuauuucagguuaaaaaaagaaaaagacugguguguuacauauaucucaugcuuaggaauauuagugauuuuuucuguuuuguguguggcaucuuguuuuuacggacccuugauaaaa

SEQ ID NO: 4161229 - RNA, 60 nt, Human
uuuuauuugauguuucauuuuaguauggauauuuugcuaaacuugagcagucagaugaag

SEQ ID NO: 4161230 - RNA, 102 nt, Human
uuuucacaaauggcuaacaagaagugagagaaacagauaagaggacuugggcagggaaccuuuaguuguuauuucuucacacaauuuguaacauuugggaaa

SEQ ID NO: 4161231 - RNA, 87 nt, Human
uuuucacaacugauugaaaguguuguagaguacuaauacaaugaauuguacagaaaucacaucgcuuugaguuaagaacagugaaga

SEQ ID NO: 4161232 - RNA, 63 nt, Human
uuuucacaaggguccaacuaguaaauaucuuagguuuugugggccagauggucccugugaaaa

SEQ ID NO: 4161233 - RNA, 57 nt, Human
uuuucacucaugagagaaaacgugcuucucagauucugaaggcuuucugagugaaaa

SEQ ID NO: 4161234 - RNA, 89 nt, Human
uuuucagguuauauuuugaguugugucagccaaagugcaaugugcauuaaggaacaauucuacacacccucaguuuuauguuuugaaaa

SEQ ID NO: 4161235 - RNA, 82 nt, Human
uuuucaguaggcuuggcaugacaguacauccucauaaugaguuugcugcagcuuugucacaugcacaggcauucauagaaag

SEQ ID NO: 4161236 - RNA, 103 nt, Human
uuuucaguauucauaauacauuucuagaguucaucaugguaaaaacagaugagauuuugggagauuacucuggugugcuuuagucuauugugcauggugaaaa

SEQ ID NO: 4161237 - RNA, 59 nt, Human
uuuucagugcuagguaauggagcucagaacacacugacucaaaauuuggcauuugagga

SEQ ID NO: 4161238 - RNA, 63 nt, Human
uuuucaguggagugacaugaucuuacuuguauuguaaaaggauuaugcucauuucggugugga

SEQ ID NO: 4161239 - RNA, 59 nt, Human
uuuucauuuaagaaggaaauauugggcauuaauucucaguauucuuuaugaagugaaaa

SEQ ID NO: 4161240 - RNA, 117 nt, Human
uuuucauuucgcuaccugaaagucagggcuggcucaugaaaaguuguuaaacaacagcuaaaugugaaaugucaacccucccucuaaacuuucccuguucugagcaucaaaugaaga

SEQ ID NO: 4161241 - RNA, 81 nt, Human
uuuuccacaggucucccaucguuugugaggaagagcuaguucucauuuucucuaaauagggaggcuuaagacuguggagaa

SEQ ID NO: 4161242 - RNA, 62 nt, Human
uuuuccaggaagaaaacaggaaucaagucccacagacggauucuucauuaucuucuagaaaa

SEQ ID NO: 4161243 - RNA, 93 nt, Human
uuuuccaucaaaauagucaaaacuccuuggauuguugguuuugguuuaaaauaucaaaguaaccaaggcucaauuaacuaagaaguuggagaa

SEQ ID NO: 4161244 - RNA, 102 nt, Human
uuuuccaucugucacauggaaauccuuuucuauacagcauaagugaacacuucucagcugugcuccauaagggagaggcaauuccaugaagggcagggagag

SEQ ID NO: 4161245 - RNA, 62 nt, Human
uuuucccagcccucuuucuuugaucuccuucuuaaucuuucuaagaggggagagugggaaga

SEQ ID NO: 4161246 - RNA, 81 nt, Human
uuuuccccaagugguucagagcauuccaaaggacacaaggcuauuuuuauucaguggagcuugggacucuugguaggaaaa

SEQ ID NO: 4161247 - RNA, 57 nt, Human
uuuuccuccauuguuacuuuuuguuuauuacuugcaccuuggacacaugggggaaaa

SEQ ID NO: 4161248 - RNA, 89 nt, Human
uuuuccucccauuaaauagauggcuuaagaguaaaaggcaaaacagauuuugucuaguacuugguagcucucaauuccauggaggaaag

SEQ ID NO: 4161249 - RNA, 75 nt, Human
uuguuuaagcccaggaguuggaggcugcagugagcugugaucacaccacugcacuccagccugggcacagagcaa

SEQ ID NO: 4161250 - RNA, 129 nt, Human
uuguuuaaguaauacuugguuuuauaaucuuguaagagaaaagaagugaaaggcauuucagaauucuacuuuuauuuucuauguguucauuucucucugcuguuuguuaugaccaaaucugcuaucaaa

SEQ ID NO: 4161251 - RNA, 64 nt, Human
uuguuuacucacuguauccacaaaucaaugccuggaauuuugcugauacauagugggcaaacaa

SEQ ID NO: 4161252 - RNA, 59 nt, Human
uuguuuacuugucuggcauuauguaguuuuauccuacacauguacagauuaguauuuag

SEQ ID NO: 4161253 - RNA, 94 nt, Human
uuguuuagaacaaugccaacagcaugcuggguaacauuguagacucuuccagguuugccaugguagcacuuguggggcauuccuuuuugaacag

SEQ ID NO: 4161254 - RNA, 68 nt, Human
uuguuuaggcaauuaguaacgcagaaacagcauuacugcuuuucucaguuacuagcugugguaagcag

SEQ ID NO: 4161255 - RNA, 72 nt, Human
uuguuuauuagcaauuauccugguuuucuugagacugauuuccaggggaguacagaauugcuacaugagcaa

SEQ ID NO: 4161256 - RNA, 56 nt, Human
uuguuucaguccagaaggaagucuggugccugucaguccaucuugggcagaagcag

SEQ ID NO: 4161257 - RNA, 59 nt, Human
uuguuucccauuacuuagagguacuuuauucaucugaagggccuaggaaagggaggcaa

SEQ ID NO: 4161258 - RNA, 69 nt, Human
uuguuucuagaugagggugggggcggguguccuuagcccaaagcuugugccagucucuaucagaaauaa

SEQ ID NO: 4161259 - RNA, 59 nt, Human
uuguuucugaggcucagaugacuccaugaucucuguuauuugggcaguccaugaaauaa

SEQ ID NO: 4161260 - RNA, 85 nt, Human
uuguuucuguguauucugcuaagugauuucuacacauuuccuuuuagugaagugggcuucccuuaagccagagagcuagaggcag

SEQ ID NO: 4161261 - RNA, 68 nt, Human
uuguuugaaauauuugggaguguuugacuuagaacuguuaauacuuuugccuuguauucauugaacaa

SEQ ID NO: 4161262 - RNA, 101 nt, Human
uugagauggagucuugcuguugccugggcuggagugcaauggcgccauccuggcucacugcaaucucugccuccuggguucuagcaauucuccugccucag

SEQ ID NO: 4161263 - RNA, 102 nt, Human
uugagauggggucuugcucugucaccaggcuagagugcaguggcacgaucuuggcucaaugcaacaucugccucuugguuucaagcaauucuccuaccucag

SEQ ID NO: 4161264 - RNA, 60 nt, Human
uugagcauuuguuuugaaagaguaguaacagagaagguuccaagauagacagaugcucaa

SEQ ID NO: 4161265 - RNA, 62 nt, Human
uugagccaggucucacucaccuucaaggccuuucuuccaggaagauuuaugggacuugccaa

SEQ ID NO: 4161266 - RNA, 58 nt, Human
uugagccuccucucaguuuucucacuaguacucuaggguggcacacuggggagcucgg

SEQ ID NO: 4161267 - RNA, 81 nt, Human
uugagccuugggacagaaaaggagaagauaacugugaauggaaaguauaucauucuccugguucuggccacaggugcucaa

SEQ ID NO: 4161268 - RNA, 127 nt, Human
uugagcuauccauguguacuuucuguuccuuuugugaguacugcuauuuauauauuccgguaauguuaacuggcaaugguuauguguauagucuguaggacagaaggaaucaaagugaucuguucaa

SEQ ID NO: 4161269 - RNA, 80 nt, Human
uugagcuaucucaggcacucacauuuggaguuucagcuuugucaucuccaaaaugaaggugcuggacugggguucuucaa

SEQ ID NO: 4161270 - RNA, 61 nt, Human
uugaggacaggagacucacuguuugccuauuugagccaaucaccaucucucuuguccccaa

SEQ ID NO: 4161271 - RNA, 82 nt, Human
uugaggacgacuuggcucugacauuaaaacaauggcauauuaccacagccaugaggaugggaagggagccaagauguuccaa

SEQ ID NO: 4161272 - RNA, 68 nt, Human
uugaggagagggauacugaguuuugguuggagaaagaacagcagaaccuggcauccucuugaccucaa

SEQ ID NO: 4161273 - RNA, 66 nt, Human
uugaggagguaguacagaguauuccuguguaccccacccagguuuucucuauuauuaauuucuuaa

SEQ ID NO: 4161274 - RNA, 103 nt, Human
uugaggcacaagaaucacuugaacccgguaggcagagguugcagugagccgagauugugccacugcacuccagccugggcggcagagugaaacugcgucucaa

SEQ ID NO: 4161275 - RNA, 103 nt, Human
uugaggcagagucuugcugugucacccaggcuggagugcaguggcgugaucucggcucacugcaagcucugccucccggguucacgccauccuccugccucag

SEQ ID NO: 4161276 - RNA, 79 nt, Human
uugaggcgccuggaucucgugggccuuucgucugagucgcugucuaacucugaaaacuccaugagcucgucuuccucaa

SEQ ID NO: 4161277 - RNA, 76 nt, Human
uugaggggauucuaaagugguggcaggguuugguuucuugaccaauauuacugauauucauuauggagcuccuuaa

SEQ ID NO: 4161278 - RNA, 73 nt, Human
uugaggucaggcuucugaaaucucugugcguguguggggugcagcucaugaguuuacagagcaaagacuacag

SEQ ID NO: 4161279 - RNA, 64 nt, Human
uugaggucagggcucuuccaguggcucugguccccaggaugguccaacacggggcccugcucag

SEQ ID NO: 4161280 - RNA, 65 nt, Human
uugagguuuaagugucauaguguauuugaagaacuuaguaacauggcuggcaccuuaaauuucag

SEQ ID NO: 4161281 - RNA, 82 nt, Human
uugaguacacggcaaggaauguuggcgaguucucaaguuggaauauuuaacauugaaauauuugcaauagugguguacugag

SEQ ID NO: 4161282 - RNA, 82 nt, Human
uugaguccccucucgcuuggcugaggugagaaaaaauaucccaucugaucccucaugagagacagagaggggaaacacucag

SEQ ID NO: 4161283 - RNA, 58 nt, Human
uugagugcucuggguuuugcugaugaaaaucuuuucagaagugaaauggaguauucaa

SEQ ID NO: 4161284 - RNA, 82 nt, Human
uugaguguacuggagcuggugugugcccgagcacaaacuaauuaacguuugugugcugcccaacucgcagauucacacucag

SEQ ID NO: 4161285 - RNA, 58 nt, Human
uugaguguacuuuagucaucugauacaauuuguguaagauuuauguggucacacucag

SEQ ID NO: 4161286 - RNA, 62 nt, Human
uugaguguauauccuauaugucuuuagaaagcauguggcacaaagaaggaaauagcacucaa

SEQ ID NO: 4161287 - RNA, 78 nt, Human
uugaguuauaggaaauaguucaugcgaucaguucucacuacucaugggucaguucugcauaacuauuucccagaccaa

SEQ ID NO: 4161288 - RNA, 64 nt, Human
uugaguugcuucuaagacaaucuguuagagaugcucaucaggcagguaggauggaagggcucaa

SEQ ID NO: 4161289 - RNA, 103 nt, Human
uugaguuggagucuugcuuuguugccuaggcuggagugcaguggcacaaucuuggcucacugcaaacugugccucccggccucaagcgauucuucugccucag

SEQ ID NO: 4161290 - RNA, 87 nt, Human
uugaguuuucugguccuugcagcuaaacuagguaaacagcaggauuucauuuuuguuuguuuguuuuguuuaggccaagauuuuuaa

SEQ ID NO: 4161291 - RNA, 76 nt, Human
uugauagauuuggcggaaguucaucauuuccagggguauuuagcugcugaaugauaaucuuuugcuggucuuucaa

SEQ ID NO: 4161292 - RNA, 58 nt, Human
uugauaucucugcuguguuaggggaugcucacgagacagcugaaagggauaauauuaa

SEQ ID NO: 4161293 - RNA, 87 nt, Human
uugaucaaucagaucuguugaaguaugauaaguaccuaaguguaucagaggguaaguggacauuucagcaaaguuuugauuggucaa

SEQ ID NO: 4161294 - RNA, 125 nt, Human
uugaucaauuuguuuaacucagugccccauuuacccaacaguaaauugcagaugcuaaaugacucauuacuuuggcagagucacugguucuguaauuaauuauggagcacuuuaagauugaugaa

SEQ ID NO: 4161295 - RNA, 104 nt, Human
uugaucauccaaauugucaggcaaggacucugguaauuuaaucacucuuggaugaaugagaauacagaaguuaucagcuucuuuucuggggggugggaggacag

SEQ ID NO: 4161296 - RNA, 76 nt, Human
uugaucuauucuugcugaggcauuacucuuuaggaccucauccuuacuguuugaucagcaagauaaauagagccaa

SEQ ID NO: 4161297 - RNA, 88 nt, Human
uugaucucccguugcugggugcccaccggauugccuacuauauacuuugaauaagcacgucuggagccccagucaaugaggauuucaa

SEQ ID NO: 4161298 - RNA, 55 nt, Human
uugauggccaccacccucaugacaucauagaugacaucaacaguggugcugugga

SEQ ID NO: 4161299 - RNA, 56 nt, Human
uugaugggauagcaaguuacuccuuggagccagccuaaugcuuuucccaaagucag

SEQ ID NO: 4161300 - RNA, 76 nt, Human
uugauguaagaagagguggacuggaaccuguuauaugauaagacaugacaggaacccagaaacauuucuauaucag

SEQ ID NO: 4161301 - RNA, 55 nt, Human
uugauguagccuaagacagaaccugcaccucccacugcugcuugggagacgucag

SEQ ID NO: 4161302 - RNA, 94 nt, Human
uugauguauuagagugaaaaccuaaucaugcaguuguucauccucauuaauauggauaagucauguguucaucuuucauucuaauuuaauucaa

SEQ ID NO: 4161303 - RNA, 80 nt, Human
uugauuauacauucauugaagucaagaacugugaauuuauguucaacaguguagugugaugucaaaauguguauaaacaa

SEQ ID NO: 4161304 - RNA, 101 nt, Human
uugauucaaccacuuaauaaucuacccagcaguauacuuaccugucuuccauguacacagguaaguauacuguuggguagauuauuaagugguugaaucaa

SEQ ID NO: 4161305 - RNA, 77 nt, Human
uugauucagaauacaaagagagaauagggacugucccugaacaagagaugcccugugacucuccuggaccugagcaa

SEQ ID NO: 4161306 - RNA, 64 nt, Human
uugauucuaggcuugaaacaugaagcaguuuuccgguuuucuucacaaauggccuagaguucaa

SEQ ID NO: 4161307 - RNA, 60 nt, Human
uugauugaauuaugaggucuguaaaucauguaguuuacagucaggcaugaauucagucaa

SEQ ID NO: 4161308 - RNA, 93 nt, Human
uugauugcaaagcagaaaugaaagcaaauuauaggccaucucuuaguagaguaauggucacuuuuugacuguucaucaaugcuuugucaucga

SEQ ID NO: 4161309 - RNA, 74 nt, Human
uugauuguaguguagauccacaaaguacuuaaaggaaugugucuugucucugugagaucugacgaugcuaacaa

SEQ ID NO: 4161310 - RNA, 97 nt, Human
uugauuguaugacccaggaaaaggcugauugauugugggaaaguaggguucacuacuugcauuauauuuaucacaauuucugggcccaugaagacag

SEQ ID NO: 4161311 - RNA, 58 nt, Human
uugauuucagucugggccuggcucuggugaagcugggucaguccaggcuagaaaacaa

SEQ ID NO: 4161312 - RNA, 106 nt, Human
uugauuugaugauuuggguuaauauaaugaggauuugcauauuaggcuagcauuccuauuuuaauuuaagugaaagucuucauuauuuccccagacaccaacucag

SEQ ID NO: 4161313 - RNA, 64 nt, Human
uugauuuguuuagguuuugguugcauaaagccuauuuuucaugcaaaagacuugaacuuuucaa

SEQ ID NO: 4161314 - RNA, 57 nt, Human
uugcaaaguguugagauauaugcuagucaaccagcuauguucuuuacaucugugcaa

SEQ ID NO: 4161315 - RNA, 61 nt, Human
uugcaaauacuuuuagccuauugaguuaauagugauucauaggaucaaaagcuguuugcaa

SEQ ID NO: 4161316 - RNA, 61 nt, Human
uugcaaauauguucuccuauucuguggguugucuucacuuacuugacgauaucauuugcaa

SEQ ID NO: 4161317 - RNA, 71 nt, Human
uugcaaauucaaacauuuuccugugcaguuuaauuuaaugcaugguuggaugcauaugaauacaccugcaa

SEQ ID NO: 4161318 - RNA, 62 nt, Human
uuugcauuucucguaaggaaacacauagcaacuugucuccuugaaugaagagaggugacaaa

SEQ ID NO: 4161319 - RNA, 65 nt, Human
uuugcauuuguucaaguauugauuugauuuagcaaauaugacaccaaucuuggauaaagugcgaa

SEQ ID NO: 4161320 - RNA, 84 nt, Human
uuugccaauuauuugucgagugucugcuaugggcugagccuuauucuagguccuagggauucaacacugaacaaaauaggcaaa

SEQ ID NO: 4161321 - RNA, 73 nt, Human
uuugccuagaacuuuauucuuuauuuccuuacauagaauaauaaaggacauaaaaaaaggaaguucaggcaga

SEQ ID NO: 4161322 - RNA, 83 nt, Human
uuugccuuguuauucaacucucuggaauguuuacaugcccuguuuccucaaacagauuguaaguucauagagggccaggcaaa

SEQ ID NO: 4161323 - RNA, 93 nt, Human
uuugcggggguugugggaggcacaggaggaugccuaguauucugauacuuuucaaagggcaugcuucugagaugucuccucccucaaugcaga

SEQ ID NO: 4161324 - RNA, 57 nt, Human
uuugcgggugagggcauaaggaggugguuguauuuguuuccaggcuccauuggcaga

SEQ ID NO: 4161325 - RNA, 89 nt, Human
uuugcuaucugcaaggaguugacauugucugacaagugaaauauaauuuuugugaggcuguuuuucucuauuugcaguacuauugcaaa

SEQ ID NO: 4161326 - RNA, 64 nt, Human
uuugcuccucugucaaaugagaguguuggucugaacgaucucuaaagccuggaagaggagcaga

SEQ ID NO: 4161327 - RNA, 65 nt, Human
uuugcucuuaugaacaaggugguaaugggcaggcuugugcauggaucuugcugcauaugggcaag

SEQ ID NO: 4161328 - RNA, 61 nt, Human
uuugcucuugagcuaggccuggagucugggucccacuuucugggcugagcucgaguguaga

SEQ ID NO: 4161329 - RNA, 60 nt, Human
uuugcugaauaaaugugugacugaagauucccacuucuguuucaggcaguuauucacaaa

SEQ ID NO: 4161330 - RNA, 69 nt, Human
uuugcugacugagccucugggaauggagccuucuccugaggaaauaccacaacauggcucagaggcgga

SEQ ID NO: 4161331 - RNA, 58 nt, Human
uuugcuuuguuuaaaagugguauuucauguauuucgugacccucuugcacaaagcaaa

SEQ ID NO: 4161332 - RNA, 130 nt, Human
uuuggaaaucaucagaagcuugaaaaaaauacugaugcucagaccucacccccaggaauucugauguaauuggucuguggugggcccugggcuucaggauuuuuaaaagcuccucccagcauuucuacua

SEQ ID NO: 4161333 - RNA, 64 nt, Human
uuuggaaggcccagcuggacaaacugcuugaccccaggaguuugagaccagccugggcaacaag

SEQ ID NO: 4161334 - RNA, 55 nt, Human
uuuggaauguaguuuaaucaucuuuaaaaugagaggauugaacuagaucuccaaa

SEQ ID NO: 4161335 - RNA, 69 nt, Human
uuuggacaaguuuccaguaugaauuuuaaaacaguuuagaaacucaacucugggaauccaugucacaga

SEQ ID NO: 4161336 - RNA, 115 nt, Human
uuugugcucaguagcuggcuucagaaggcagccuugacuagugacuuaguuacaaucucaucccugcucugaguggcuggugagguuagcccuggggucagcuugggaaugugga

SEQ ID NO: 4161337 - RNA, 81 nt, Human
uuuguggacauuuuguuuguuugcagugggaugauuuguuuucuuuaaauagcuuucccagcauaacaaacugcccgcaag

SEQ ID NO: 4161338 - RNA, 64 nt, Human
uuuguggacucgcauggcugaggcggugauaucuguggucacguugaaguaaggcagccacagg

SEQ ID NO: 4161339 - RNA, 88 nt, Human
uuuguggcuucuuuguuugggguucuuuguuuccugccuauagguaccuagaggcuuaagccugaggccccagacauuagaucacaga

SEQ ID NO: 4161340 - RNA, 57 nt, Human
uuugugggcauauggcuggcugcagugggguaaggcugagcagauguugcccagaag

SEQ ID NO: 4161341 - RNA, 94 nt, Human
uuugugguaugagucaucagagugaccuuacauggucuuagucugucuggaccauaaaagagacuguugggguccggucugaaaccaucacaaa

SEQ ID NO: 4161342 - RNA, 67 nt, Human
uuugugucccuguaagacaaagccagggacguaaagccuuggucuuucaaugucaggagacaauaaa

SEQ ID NO: 4161343 - RNA, 63 nt, Human
uuugugucgucacugucuucucaaaucauguguaagaguuuggagaugucauggcggcacaaa

SEQ ID NO: 4161344 - RNA, 76 nt, Human
uuugugugaucuggcuauggggcacuuuuguagaaaccaaaauuuaugucuguuuucauaucagauauucagcaga

SEQ ID NO: 4161345 - RNA, 66 nt, Human
uuuguguuguuuuaagccacuacauuuuugguaauuuauuguaggagcaauauaaacuaacacagg

SEQ ID NO: 4161346 - RNA, 77 nt, Human
uuuguguuuugaggucuugcaauguuuuuguguuucugaugcuaauaacuaaaguuuguaagacuguagaaugcaaa

SEQ ID NO: 4161347 - RNA, 98 nt, Human
uuuguuaagccaauacauuacaguucugcagguaguuuuuaagagacuacuacaugucaggcacugugcuaacuguuggagauaaaauaauuaacaaa

SEQ ID NO: 4161348 - RNA, 59 nt, Human
uuuguucagaaauuuggacuccuguugcaccaggaaaucuuugguuucugagaagcaga

SEQ ID NO: 4161349 - RNA, 59 nt, Human
uuuguucauuaaaagugcuguaaauaacaguuucugugauaguaguuuuaauuaacaaa

SEQ ID NO: 4161350 - RNA, 69 nt, Human
uuuguuccuaggcugugaucucaugauuuguuccagggaacauucacgcucucaaagcugaggaagaaa

SEQ ID NO: 4161351 - RNA, 69 nt, Human
uuuguucguucaugcacgguaggccucagagccaguuguggaaggaaccaguggaugaaugauaacaga

SEQ ID NO: 4161352 - RNA, 67 nt, Human
uuuguucuaacuucugcagacaucaauuuuuucaagaaauuugucauuugagagaagggaggagaga

SEQ ID NO: 4161353 - RNA, 60 nt, Human
uuuguucuuaguccuguuuuugcccugauuuuucagaugggcgcccuggacugaggcaaa

SEQ ID NO: 4161354 - RNA, 62 nt, Human
uuuguugcgugaggaaaugagugggaccuuaaauaaaggcaugcauuccuccauccaacagg

SEQ ID NO: 4161355 - RNA, 80 nt, Human
uuuguugcuauuccaguuuauaugaggguaucaaggcuacaguuuuauguucuuggcauauaaaagaugauaaaaauaaa

SEQ ID NO: 4161356 - RNA, 67 nt, Human
uuuguugggcuuggcugccaagaagaaggagauaaacaucaccaucaucaaacagcugcucaagaaa

SEQ ID NO: 4161357 - RNA, 85 nt, Human
uuuguuguucagcuucauuugucuuuaugcuacaucucccaucuccucacccuuugaguauuaagcugcagcugaucauaacaaa

SEQ ID NO: 4161358 - RNA, 64 nt, Human
uuuguuuacaucucuugacucuuuuaggaguauagccaaggaaggagucauaaaugugaacaaa

SEQ ID NO: 4161359 - RNA, 91 nt, Human
uuuguuuaccucauuagauaguaauguucagugucucacuuaucuuucuaguggcuuaucugggacagcuaacaaauaauguauaaauaga

SEQ ID NO: 4161360 - RNA, 69 nt, Human
uuuguuuagccuuuaacacuucacauugauggaauacaugaguguagaaguguguagaagccagacaga

SEQ ID NO: 4161361 - RNA, 82 nt, Human
uuuguuucaguuaaauucuccaguuaccaauucacuuuagacagugaaaaaauggaaugacagagagucugaaugaaacaga

SEQ ID NO: 4161362 - RNA, 86 nt, Human
uuuguuuucaaauucagaaagugaaucuuguuauuuugguuuuagaauagcaguauuaugagauaacuuacugccuuugaaucaaa

SEQ ID NO: 4161363 - RNA, 76 nt, Human
uuuguuuugcaguuugcaaaugacuuacagagcucuucuggcaggguuucuguuucuccacuugcaaauaaacaaa

SEQ ID NO: 4161364 - RNA, 93 nt, Human
uuuuaaaaaggucagaaugguucacuacacaauauauuucagaguguuuguaaagcauuugaaugugugaguuaacuuuuuugaaaaauaaaa

SEQ ID NO: 4161365 - RNA, 93 nt, Human
uuuuaaaaugucuacuccccuuucuucuugacugaaaacuaaaguuuaaagucuuggaaggaggaaugguaauuuuuagguagauuuuuaaga

SEQ ID NO: 4161366 - RNA, 79 nt, Human
uuuuaaacagagaagacuuugagcaaauggggaucuaauuugaggaagguuuucuuggugcuuaaguagcuguuugaaa

SEQ ID NO: 4161367 - RNA, 96 nt, Human
uuuuaaaggggagaauauuggcuuaguuggcaauuguuauuugggguuuauugaucuaaacggacaguuuuguaauaaggccaaccucugucaaaa

SEQ ID NO: 4161368 - RNA, 129 nt, Human
uuuuaaaguauuaaucauuuugaugugacuuaaaggcugaucuuaauauuaucaaaggauuugguacauuugugugcuugauauuaauacaguggcuuaaaguuguacaguugaaauauaguuuaauag

SEQ ID NO: 4161369 - RNA, 103 nt, Human
uuuuaaaugguauauugaaguuuaucccucucacaguuacuggggaacagucuaacccuauugacagagauggaaugaaucuuuauuguaaaucacuuuaaag

SEQ ID NO: 4161370 - RNA, 68 nt, Human
uuuuaacacauuuuaagccauuuuaacaucucuugagagaagguaggggcuguggaauguguauaaag

SEQ ID NO: 4161371 - RNA, 71 nt, Human
uuuuaaccugggcauucuuugaguucucaguuucgaggugauggggagcaaaaaugaugcccaaguucaaa

SEQ ID NO: 4161372 - RNA, 57 nt, Human
uuuuaagacaccucucugcccuucauguaauauggggaguuuagcgguuucucggga

SEQ ID NO: 4161373 - RNA, 97 nt, Human
uuuuaaguauuugguugguucaaaaguaauugugguuuuugcuauugaauguaauggcaaaagcugcaauuccuuuugcaccaaccuauuaguaaaa

SEQ ID NO: 4161374 - RNA, 77 nt, Human
uuuuaagugacaggugguaaaauggacugucuugaguaugugcuugauacuccaaacuuuaccagucugcacugaga

SEQ ID NO: 4161375 - RNA, 69 nt, Human
uuuuaaucugaguguuggauuuauuguaaucuuuagaauaugagcagaaaggaaagcacucaguuaaaa

SEQ ID NO: 4161376 - RNA, 63 nt, Human
uugcugaaaaugcguaucuuccaggacacacaggagucuuggccuugccacauuugucagcaa

SEQ ID NO: 4161377 - RNA, 76 nt, Human
uugcugaauaaauguuuacuuaguuuaaaaauuaagaguuuaguuuugaauuuagauugauaaacauggacagcag

SEQ ID NO: 4161378 - RNA, 71 nt, Human
uugcugcaaugggaagauucuuugaacuagaccauacuugucugauaauggacuucucaucugcccagcaa

SEQ ID NO: 4161379 - RNA, 78 nt, Human
uugcuggccugcaggaaggggacggaguggggcgccagggaugaggaggcggcgccauccccccuccugcaggagcaa

SEQ ID NO: 4161380 - RNA, 61 nt, Human
uugcuggggaagcauuuuucccuuaugauuuguucagggccauaaaauguucccccauuaa

SEQ ID NO: 4161381 - RNA, 118 nt, Human
uugcugguugacaagaaaaugggugaggagugaggggcacagguccuggugggugaaaaugauugcccucuaucagaagcuuguagucucucuucaguuguguuucaucagccagcag

SEQ ID NO: 4161382 - RNA, 79 nt, Human
uugcuguagguucagugacaucauacugguaucuugaaacuggccaugauggcaguauuuguaucacagaaaucagcaa

SEQ ID NO: 4161383 - RNA, 99 nt, Human
uugcuguuugaugcacuugcugugaccacucuaacuuucugugggaauguccaaagaaugcauuuccuaggguagaugucacagcugugucaauagcaa

SEQ ID NO: 4161384 - RNA, 127 nt, Human
uugcuuaaguaguuuuuuuuuggucuccugcacaaucccuaagguguuuuucagucuuaauugugagauaacaaugauauagggauuggcagugagcaucaucaaucaacaaagagcauaguagcaa

SEQ ID NO: 4161385 - RNA, 69 nt, Human
uugcuuaauugcuaaagauuauguuuucaacaguuuuugaaaaugaugauuuggggcaaauaugugcaa

SEQ ID NO: 4161386 - RNA, 78 nt, Human
uugcuuaccugugauuuugagaccuauauagugaagguuuguugccacuuuuuaguuuccucaaacaugcagaaguaa

SEQ ID NO: 4161387 - RNA, 60 nt, Human
uugcuuccuuccacaccuucagaaugaggaacucccagccuaggaauuuggaggaaacga

SEQ ID NO: 4161388 - RNA, 63 nt, Human
uugcuuccuugagcuggucugaggauuauugccuauaagguucucagcuuaguaaguagguaa

SEQ ID NO: 4161389 - RNA, 67 nt, Human
uugcuucugcagcccacuaauggguggcgaucacauuguacacagggaaguggcugggcagaagcaa

SEQ ID NO: 4161390 - RNA, 106 nt, Human
uugcuucuguucacuucucuccucccuucccaucccucuucuaaacuuugugguggcagauuaguugggguggagaaggauaugggagcauguagggagaaagcaa

SEQ ID NO: 4161391 - RNA, 67 nt, Human
uugcuugaaaucggaaggcggaguugcagugagccgagaucgugccacugcacucuagccugagcaa

SEQ ID NO: 4161392 - RNA, 76 nt, Human
uugcuugaacccgggaggcggagguugcagugagcugagaucgugccacugcacuccagccugggugauagagcga

SEQ ID NO: 4161393 - RNA, 76 nt, Human
uugcuugaagccgagagguggagguugcagugagccaagaucgcaccacugcacuccauccugggaaauggagcaa

SEQ ID NO: 4161394 - RNA, 76 nt, Human
uugcuugagcccaggaguuugaggcuguggugaacuaugaucacaccacugcacuccagccugggcaacacagcaa

SEQ ID NO: 4161395 - RNA, 76 nt, Human
uugcuugaggccagguugucaagggugcagugagcugugauugugucacugcacuccagccugggcaacagagcaa

SEQ ID NO: 4161396 - RNA, 129 nt, Human
uugcuuggguuuccuuguaaacaggggcaaaauguguaagacgucuuauggggcuuagcacuguagcuaagacauaaauaggcuuuuuaaagauuguuuccucuguacaaaauucagugacucaaauag

SEQ ID NO: 4161397 - RNA, 77 nt, Human
uugcuuuagguugggaggucagaaaguuauuaaaaagaagaugacauuuaaguuaaaaccucagugaccaaaaggaa

SEQ ID NO: 4161398 - RNA, 63 nt, Human
uugcuuucuguuuuucauauaauuuggucauguuuaucuagauuguuagcuuuuggaaagcag

SEQ ID NO: 4161399 - RNA, 58 nt, Human
uugcuuugguuuucauagcuccacucuggccagggggacucggugaaaaccaaaacag

SEQ ID NO: 4161400 - RNA, 65 nt, Human
uugcuuuguguggauuauuguccuuugggaauuaaggaauagaucugugugcacauuuggagcag

SEQ ID NO: 4161401 - RNA, 56 nt, Human
uugcuuuguuuaaaagugguauuucauguauuucgugacccucuugcacaaagcaa

SEQ ID NO: 4161402 - RNA, 72 nt, Human
uugcuuuuccuucuccuuucuacuaaggggauccuccguuugcuucuccacuguagaggagaagggaagugg

SEQ ID NO: 4161403 - RNA, 56 nt, Human
uuggaaacgucaccuuuuccuuuagaugcuaauaugcauaaggggauguccuccaa

SEQ ID NO: 4161404 - RNA, 110 nt, Human
uuggaaagggcuuuuucaugcaucuagaacaugcucauguauaaauaaacaauauauuugacaacuuucauugauuuauguuuggcaugcagaagcagugaguuauccag

SEQ ID NO: 4161405 - RNA, 67 nt, Human
uuggaaauagagccuugaaaggggcaauuaagguaaaaugaggcccucagaaugggcucuaauccaa

SEQ ID NO: 4161406 - RNA, 114 nt, Human
uuggaaauguaaugaaacaaaauugaagcuaccaggauuugcuaauauauuacagaaaaacaauacuguguuuauuguucuucacuggucuuauuuuguuggccucaauuccaa

SEQ ID NO: 4161407 - RNA, 61 nt, Human
uuggaaauuuugugacacuucuugagacaccuugaguuucucugaguuguuacaaaaccag

SEQ ID NO: 4161408 - RNA, 65 nt, Human
uugugcugcguaggacguggacaaggaugucacgugaucuccaauaucaaguccuaggcccacaa

SEQ ID NO: 4161409 - RNA, 60 nt, Human
uuguggaacaccuagaauggguaaucuaagagaacuauccaguaccuggguauuucaugg

SEQ ID NO: 4161410 - RNA, 62 nt, Human
uuguggaggacaaaagaagccuuuacaacacaggacguaaagcagggcgauguccuccucag

SEQ ID NO: 4161411 - RNA, 67 nt, Human
uuguggaguggugguucucagucugugugaugucgacauccagggcuccccagaaguacccccauga

SEQ ID NO: 4161412 - RNA, 61 nt, Human
uuguggcagauugcucaccaugguuuuucauuuucagaaacgccuagcucaaucuguccga

SEQ ID NO: 4161413 - RNA, 77 nt, Human
uuguggcauccugguuuugaauaugucugcuucugguggauaagaauuaugguauguucaacaacuggauaccauaa

SEQ ID NO: 4161414 - RNA, 69 nt, Human
uuguggcucagaccucccagcuccagucuaccaggauugugcagaaucagugggggcccugaaucacag

SEQ ID NO: 4161415 - RNA, 56 nt, Human
uugugggaaccuaacaguggcagguuauaaaaggaaaaugcagcauguucccauaa

SEQ ID NO: 4161416 - RNA, 55 nt, Human
uugugggagcuauguaaugagauggggaguuucaucuaaugacauccucugacaa

SEQ ID NO: 4161417 - RNA, 94 nt, Human
uugugggaucuaguguggccuuggcccagaggcccugagccaugauauggcaaagcguggacugcugggcaagguaggcacauggugaucacag

SEQ ID NO: 4161418 - RNA, 68 nt, Human
uuguggugugugcugagguggaaagugauaguguucccucuuugcauucucagcacagagcacugcag

SEQ ID NO: 4161419 - RNA, 72 nt, Human
uugugguguucuaauucuuuuauucaaauuaaaauggggauuuguuuagugaacaaguuaagaacacuaugg

SEQ ID NO: 4161420 - RNA, 100 nt, Human
uugugguugaagcaacauuaagcaacaggcauaauguguugaucuaaaaauucauaggugaaauuaugcauuguuguaccaaggaugagcaauacuauag

SEQ ID NO: 4161421 - RNA, 81 nt, Human
uuguguaugaauacauggaagaguccccauggaugaguauacaauacugugccugaugcuuuuacuacuauucauccacaa

SEQ ID NO: 4161422 - RNA, 61 nt, Human
uuguguccccuguucuaccuguaguauugcuuaauugaauaaugggauuauggggacagaa

SEQ ID NO: 4161423 - RNA, 55 nt, Human
uugugucugguuugaaguccaugauuuuuugaucugccauccgguccagacauaa

SEQ ID NO: 4161424 - RNA, 78 nt, Human
uugugucuuauacagaucaagggaaaagaacuucggaguauaaacagcaaaaucccuuuuaacuugaucugagaccag

SEQ ID NO: 4161425 - RNA, 129 nt, Human
uugugucuuuuguaucuaauuccagaauuauuuaggcuuuccuuguugccauguuaccgaaguguuccuauaguaugugugcaucaaugauagaucuagaaauuguguuuggaaaacaaaaaucaauaa

SEQ ID NO: 4161426 - RNA, 81 nt, Human
uugugugaaccuagaauggacauuucugggagaaccugucaagguuuuggcagccguguucacauaagguaauucaugcaa

SEQ ID NO: 4161427 - RNA, 55 nt, Human
uugugugacuccuagaguagagggaagccuccgcugcucggaaggugucacgugg

SEQ ID NO: 4161428 - RNA, 83 nt, Human
uugugugguagucucagggcaguauuccaagagggcaaaaguagaaacaguaaccuuugagauaggcucugaaacucacacag

SEQ ID NO: 4161429 - RNA, 65 nt, Human
uuguguguccacugaauguguauuaaaauuguuucccaagaaugaugccaagcauggagauacaa

SEQ ID NO: 4161430 - RNA, 69 nt, Human
uuguguuauauaguucuguggguuuugucaaugcacagugucacauauccacauuacaguaucauacaa

SEQ ID NO: 4161431 - RNA, 100 nt, Human
uuguguucugaugguuucaaguuauucuccaauaugguauugacucaaaacguugacucagagaacuggauuagaggaaguacauugaacugggaaccga

SEQ ID NO: 4161432 - RNA, 58 nt, Human
uuguguugagcggccaagaggauaguggugccauuugcuaugcuuuaugcuuauauaa

SEQ ID NO: 4161433 - RNA, 70 nt, Human
uuguguuuguugcauuucuuguguaacugagcuuacucauaugcauaaaauaugagaaauguauucauaa

SEQ ID NO: 4161434 - RNA, 59 nt, Human
uuguuaaggguuaugcagcuuuugggagcaacaaccaagaugcaaccucugcuuaacaa

SEQ ID NO: 4161435 - RNA, 75 nt, Human
uuguuaagucauuugguaggcaugaguugauaaaacuauuguuugugcaauuuauguacuauauaaaggcagcaa

SEQ ID NO: 4161436 - RNA, 99 nt, Human
uuguuaggguaagggugaccuaucuuggucuccagguugagcugagcagaccccagcuauguucauccugacuuggauuagugcucuuaccaguaauaa

SEQ ID NO: 4161437 - RNA, 81 nt, Human
uuguuauaaaucauuguucuucagauuugacuggguaaauauucccucagguuauuuccugacacagcugauuaauaacag

SEQ ID NO: 4161438 - RNA, 129 nt, Human
uuguuaucgaagggcucuuuuugagggggaaaaauggcaacagaagggaguucccugcaccagcaaaaaugcccaugagaagccuucuguugccauuuuuccccuucaaaaagaguccuuggauaacaa

SEQ ID NO: 4161439 - RNA, 57 nt, Human
uuguucacugcuacauccaggugccugggaaagagccaggcuccuagcagcauacag

SEQ ID NO: 4161440 - RNA, 81 nt, Human
uuguuccaagucuuugcuauugugaguagugccacaauaaacauacgugugcaugugucuuuauagcagcaugauuuauaa

SEQ ID NO: 4161441 - RNA, 88 nt, Human
uuguuccuucucuuuuuguuguccacacuaggagacagugauucucgccaagcuccugugugggcaggaugagaacgaggaggaauaa

SEQ ID NO: 4161442 - RNA, 95 nt, Human
uuguucuauuagguugaugcaaauguaauggcagguuuugcuauuaaaagugauggcaaaaccacaauuacuuuuacaccaaccuaacagaacaa

SEQ ID NO: 4161443 - RNA, 65 nt, Human
uuguucuguggagugaccugggcuuugggauauuuaaagucucccaagaucacucuacugugcag

SEQ ID NO: 4161444 - RNA, 69 nt, Human
uuguucuuaacuuuuguguauaugggagaguugacuaucucuuguaaaugcacaauaaaguaaaggcaa

SEQ ID NO: 4161445 - RNA, 82 nt, Human
uuguucuuagaguuucggguguuuuucuccagucuuguuacuguagacuguagaaagcacgggccccaggcucugagcuuag

SEQ ID NO: 4161446 - RNA, 63 nt, Human
uuguugcaaucacuguugcuggguugcuguauauauauucugggcaauauaugagugcaauaa

SEQ ID NO: 4161447 - RNA, 86 nt, Human
uuguugcagaagucuaagacuuccuaagauucaggaauguuagggcaucucuuucauacccaucucuaggagugaguuuguaacaa

SEQ ID NO: 4161448 - RNA, 77 nt, Human
uuguugcuugcucauuuaagaaauauuuugcuguguaaaaguaaugcacacuuagaaaacuugagcaaguagaacag

SEQ ID NO: 4161449 - RNA, 68 nt, Human
uuguuggacaguccaccucagugaagacagauuuagcucuaggugcuuuaaaauggacuguuuugcaa

SEQ ID NO: 4161450 - RNA, 62 nt, Human
uuguugggcaugcaguggcuguaauucuauacaaaaaucacaacgcacuaagugcuggacaa

SEQ ID NO: 4161451 - RNA, 62 nt, Human
uuguuggugaaguaggaaggugcugugggaugaauucugcacugugcuuaguucacuauuaa

SEQ ID NO: 4161452 - RNA, 61 nt, Human
uuguuguaugacucugugaggagaagaaacaaaccauuuuuccucugcucucauaccacaa

SEQ ID NO: 4161453 - RNA, 84 nt, Human
uuguugucugugaccagucucucagcuuucagcuguguaauagaacaugggcauucagguugagaggcaaacauuugacuucag

SEQ ID NO: 4161454 - RNA, 95 nt, Human
uuguugugaggggcuguccugugcguugugaaauguuuagcaucauucuuggccucugcucacuaaaugccaguaguacuccccucguuguacaa

SEQ ID NO: 4161455 - RNA, 79 nt, Human
uuguuguugaugaugaugauauuuugacuggagaaucucucaugauuuuucauagacaaaaugucacucucaacaggga

SEQ ID NO: 4161456 - RNA, 56 nt, Human
uuguuguuggagccaauaugcaaaugcaaguguuuuuauuuggcauccagggagaa

SEQ ID NO: 4161457 - RNA, 69 nt, Human
uuguuguuguuguuuuucuuauggugggaccuauuucuugaagcacuauacagaagaggauaggaacaa

SEQ ID NO: 4161458 - RNA, 62 nt, Human
uuguuuaacgcagaugcugagugagauuuaaaaagaaauuagaaaagcauuuguguuaacag

SEQ ID NO: 4161459 - RNA, 84 nt, Human
uuguuuagauauuugguggccuuguguuuuagagaaagcugagcuucccugauccacaaaggcaaucuguauuagucuaagcaa

SEQ ID NO: 4161460 - RNA, 77 nt, Human
uuguuuauguauuauucaucagugggacauuuggguuguuuccacuuuuuuacuaugaauaauggugcuguaaacga

SEQ ID NO: 4161461 - RNA, 85 nt, Human
uuguuucagaagggugaauagaauuacaguguguuuggaauauaauucaaagauaauguagcauuuuaaagaacccuacuaauaa

SEQ ID NO: 4161462 - RNA, 130 nt, Human
uuguuucauagacagagagggagggugaaaaugaaggcuuuaaagucagggagauugaggcuugaauccuucuggcucuggcuccuggcuuugugguccaggucacauuccuuaaaucugugauccucaa

SEQ ID NO: 4161463 - RNA, 62 nt, Human
uuguuucccucucugaguguuucuuuucccaaagaauaaaugcucaccacagggaugugcaa

SEQ ID NO: 4161464 - RNA, 70 nt, Human
uuguuucuguuguaggaacagcagcaguauugguaucgacagcacuugcuuaguuugcaacagaggacaa

SEQ ID NO: 4161465 - RNA, 111 nt, Human
uuguuugugauugucuguccuaacuuaggugguuuaucuugaagaucuuagguaauuuagccucauagauuuagauagaucgagaaauggcaggcuucaaucacugaauag

SEQ ID NO: 4161466 - RNA, 74 nt, Human
uuguuuguuuugagauggugucucgcuccguugcccaggcuggagugcaauggcacgaucucaguucacugcaa

SEQ ID NO: 4161467 - RNA, 59 nt, Human
uuguuuguuuuucccuuggugccaagcagaguauuuagcaccugggauuagauacccaa

SEQ ID NO: 4161468 - RNA, 80 nt, Human
uuguuuuccugagcuucaguuucuucaucuggugauguuaacacuggcuucauggggaguuugaggaucacaagagauaa

SEQ ID NO: 4161469 - RNA, 130 nt, Human
uuguuuuccuuuuucugaccuguguaaaaaguugacuacuaaggaauguguguuuuagagaauggaagugcugaaaauauuucugugguuuguaaaauuaauuauaugaggugugggguaagggaaggaa

SEQ ID NO: 4161470 - RNA, 72 nt, Human
uuguuuucugcuuaauaauguuuuaggugcugugguaaaaauaucuagacaucugaaacauuuaggaaacaa

SEQ ID NO: 4161471 - RNA, 72 nt, Human
uuguuuuggagaugagcuaaaaggacacuuuauauuuuccccuauccaacacaagcguuaucuucagaacaa

SEQ ID NO: 4161472 - RNA, 78 nt, Human
uuguuuuuggugcauuugaaaguaacuugcagaccucuguacacaacccugcaaacacuucaacgugcaucuuaucag

SEQ ID NO: 4161473 - RNA, 75 nt, Human
uuguuuuuuacaugcuucuauaugugaaguuuagaauaggaacuuuagcuuauauaguaagucugugauauucag

SEQ ID NO: 4161474 - RNA, 77 nt, Human
uuuaaaaaaguguugggaagaaagugcagugacucuauucugauuuucacugcauauucuccuuuauuuuguuugag

SEQ ID NO: 4161475 - RNA, 65 nt, Human
uuuaaaaggcagcuucuuuugucuuaugugcccuuggcuaggaaacaaaggaagucucuuuuaag

SEQ ID NO: 4161476 - RNA, 123 nt, Human
uuuaaaauuucauuguucccaugucugcauucagauuuagaaucuaacauucuuaucugcaggcugcaagauuguuuagauucuaaacuuucuguuggaggauggcgaagaauauauuuuaaa

SEQ ID NO: 4161477 - RNA, 75 nt, Human
uuuaaacaucaguauauggugaugugugugugcauuuaguccauacauguuguaccauauguuuuaaccuuuaaa

SEQ ID NO: 4161478 - RNA, 71 nt, Human
uuuaaagcaacuguugaauuggacuagagugauacuucuugaucugugcugguaaacaguaugcuguuaaa

SEQ ID NO: 4161479 - RNA, 102 nt, Human
uuuaaaggauguggacauaaggaagagcaaagaauuauguucaaacgcaacacacaauuaguuuuaugcuuuaggaugauuccuuuguuacaaaccauuaaa

SEQ ID NO: 4161480 - RNA, 71 nt, Human
uuuaaaggucaugcaguauucaggacaguucuuccuuguaaggacugccuaugcagugcaagauaucuaaa

SEQ ID NO: 4161481 - RNA, 75 nt, Human
uuuaaauaauuuuagacuuagagaagaauuccuaaaauacuauagagaguuucucucaguauagaauaguauaga

SEQ ID NO: 4161482 - RNA, 85 nt, Human
uuuaaauccuugauagcucagugucuuauuugaguucuccaggaaguggagguugggucagagauugaaugcaucuagauuuaag

SEQ ID NO: 4161483 - RNA, 84 nt, Human
uuuaaaucucuuucucucucuguauguguauauuuauauauauauauauauauauauauauauagagagagagagagagagaga

SEQ ID NO: 4161484 - RNA, 77 nt, Human
uuuaaauguggcaauggaaaagugaaaauagcuuuuaagauaaagcaauugucucugaauuuccagcugcaucuaaa

SEQ ID NO: 4161485 - RNA, 73 nt, Human
uuuaacgaaugucauugagcuccaauccuuuucuccaggaauuuauggggguuggaggaaugagaccguuaag

SEQ ID NO: 4161486 - RNA, 83 nt, Human
uuuaagaacaaacugccauaugucaacuguacuaaaaucugggaauuguggaguacaguuauaaguggucuugaauuuuuaaa

SEQ ID NO: 4161487 - RNA, 110 nt, Human
uuuaagacuacauuauccuguuucuaauuccuuuucuuucuuccugcggaaauguaauugcagaagcugggagaagggauuggagugugggcuucuauaucugucuugaa

SEQ ID NO: 4161488 - RNA, 57 nt, Human
uuuaagacuuagauuuauugggggaaccagauauccuaaugacugucaaguuuuaaa

SEQ ID NO: 4161489 - RNA, 73 nt, Human
uuuaagcauaauuugaggaguaauuguuguuccuucuuuucauaaaauaacaugcuuccaaauuauguuggaa

SEQ ID NO: 4161490 - RNA, 93 nt, Human
uuuaaggauauugugaauuuuacaagugaucauuuugguuuuaauuucaacacccagagagauugcuucuaaagaacagagcucaucccuaga

SEQ ID NO: 4161491 - RNA, 130 nt, Human
uuuaaggcaggggucaugucuguuuaaauuaugguauucucagcaccuagcacaauaaauuacuguggguguaaacagaagauuaugauauuuauuauuaguuaaaucagauaauaugaaucucaguaaa

SEQ ID NO: 4161492 - RNA, 59 nt, Human
uuuaagguaaguuucagcuuggaagaggauccuucaguggcaguaagauuuacuuuaag

SEQ ID NO: 4161493 - RNA, 71 nt, Human
uuuaagugggaauaaaugcuucaguuacuaacauaagagaaaaugacacugugcaucuauugccauuuaga

SEQ ID NO: 4161494 - RNA, 72 nt, Human
uuuaaguuccauuccaccugcagcacauucccugccugggaggcauggcaggaacuggagcuggauguugaa

SEQ ID NO: 4161495 - RNA, 127 nt, Human
uuuaauagaacucugugcauuucuugggacaccaaaggaauguuuugacucuagucauagaagugaaguguuuuuuauaucuaucuaguuauacguaugagguguccccaguguuucuguuagugga

SEQ ID NO: 4161496 - RNA, 99 nt, Human
uuuaauauaaaugcauuugucuaugucuuuaaacuuuuucuaaaauaucuauuucauaggaaugggcaagacaaagaaacugauguagauuaucuuaaa

SEQ ID NO: 4161497 - RNA, 96 nt, Human
uuuaaucguggccauuuucaaacacagaucugcacagugaacaauuuucugaggaauucuuacaaagcagagucuguucagaggaugcugauuaaa

SEQ ID NO: 4161498 - RNA, 93 nt, Human
uuuaaugaaauuuuggaacuugaccaguguauuauuugagaaauuggcaauauagucaagaguaauggacuuuaagguauaauuuuuaaugga

SEQ ID NO: 4161499 - RNA, 75 nt, Human
uuuaaugaggcaucugcagucacuagaaaauuaccaccaagggugaaagcuagugccuuggggaguuucaauaaa

SEQ ID NO: 4161500 - RNA, 110 nt, Human
uuuaaugucuugucuguuaguaccaaggccagagggaaaaggggaguaauauuuuauuauaaccuuuucuuuauccuccacaaaggccuuuuagcagaacugaccuuaaa

SEQ ID NO: 4161501 - RNA, 73 nt, Human
uuuaaugugggcucaucuuuaaauuuaugacguuaacuacguacaucauuuuggagaugagcauugcuauaga

SEQ ID NO: 4161502 - RNA, 70 nt, Human
uuuaauuauuucaggaacauuuaaccacaggguuggcaggccggaucuugauacguguuucuuaguugga

SEQ ID NO: 4161503 - RNA, 86 nt, Human
uuuaauuguuauuguuuaugaugaugauguuuuaauuguugauguaacacccugagcaucuucgugaaagcuucauaauaauuaaa

SEQ ID NO: 4161504 - RNA, 90 nt, Human
uuuacaaacaguuacuuugauguacacacacaucuuugcguacuuguccuguuguaugcugagauaguuuacaagaaguagaauuguagg

SEQ ID NO: 4161505 - RNA, 60 nt, Human
uuuacaaagaugucauaugugcucauguguuuacaaauguacauugauuauguuuguaga

SEQ ID NO: 4161506 - RNA, 79 nt, Human
uuuacaagaauguucagugccuuuaaacauacuucucaaaugauagagucuguguccucaggcacuacgaucagguaga

SEQ ID NO: 4161507 - RNA, 56 nt, Human
uuuacaaggcuuuaaauaaccguaaaguuagaaacuuugcaguauagccuaguaga

SEQ ID NO: 4161508 - RNA, 55 nt, Human
uuuacacccgggaccagccgugggcugaccuccuuggcugagccaggugugugga

SEQ ID NO: 4161509 - RNA, 60 nt, Human
uuuacacugccauucugaauacaugcuaacggacauaaagauucagaauaggcauguaaa

SEQ ID NO: 4161510 - RNA, 60 nt, Human
uuuacagcauugcugaaaguucagcagaaaauacagcagaauuuucagcuuuguuguaaa

SEQ ID NO: 4161511 - RNA, 67 nt, Human
uuuacauuuuagccuucaaagcauucucucaguagcagagcaggcuagcuuuaagccaaaaugugaa

SEQ ID NO: 4161512 - RNA, 62 nt, Human
uuuaccaguguuaaacaccagcagaaacugaaaucauguggggugcaagagaggcugguaga

SEQ ID NO: 4161513 - RNA, 65 nt, Human
uuuaccuguuucugaaccacuaaaggcaauucgugucuguuucagcugguuuaggaaaagguagg

SEQ ID NO: 4161514 - RNA, 78 nt, Human
uuuacucauguaauauaugauugacacuggcacccugguuauuuugcaaguagaugcucauguaaugcaugaaguaaa

SEQ ID NO: 4161515 - RNA, 67 nt, Human
uuuacugagguauaauugacauaacauucgcuuguuuuaggugugcaguuaaauuauuuucaguaaa

SEQ ID NO: 4161516 - RNA, 58 nt, Human
uuuacuguaugcugcuaggagccuggcucuuucccaggcaccuggauguagcagugaa

SEQ ID NO: 4161517 - RNA, 57 nt, Human
uuuacugugccccuggggaucucuguaaugccagagagaaagggauaacacguugaa

SEQ ID NO: 4161518 - RNA, 80 nt, Human
uuuacuguguguguacagaugaccuuuuguuuagauugaauugucuccccagaaguaagauuacugugagucauggugaa

SEQ ID NO: 4161519 - RNA, 92 nt, Human
uuuacuuauuguauaagaucauauuguaacuuuauuguguagccauaugucaaaagagaauuuacaaugcgugacuuuacaguguuauuaaa

SEQ ID NO: 4161520 - RNA, 69 nt, Human
uuuagaagacugucccagacuuauuaacacagaauaucugaggaaugagcccuggaggcauuuuuuaaa

SEQ ID NO: 4161521 - RNA, 102 nt, Human
uuuagaagcuauuaaggaagacagaagccuacagcuucauagacauuugguaugagguuuuguuucauuuuguuucauuuuuaauacaauacuacuucuaaa

SEQ ID NO: 4161522 - RNA, 60 nt, Human
uuuagacaucuauaauugcuaaacacccacauggguguuuagcaauuauagaugucuaaa

SEQ ID NO: 4161523 - RNA, 130 nt, Human
uuuagaccuuaauuuuccauagcaggcuggcugcuuuaacauucugaugcuguaauuaccuuuauugaaacauugcuguguaaaaggugauugaagcagcugucccuguuacgaguuuugauuuucugga

SEQ ID NO: 4161524 - RNA, 83 nt, Human
uuuagaguagcagaguuuugugaacaacuugguguuucagggcaacagcaucccaagagguaauacgagauaucugcucuaag

SEQ ID NO: 4161525 - RNA, 66 nt, Human
uuuagaguaguuuauuaugcuaagggccugggaaacacuuuagauucaguaaaaaaacuaccuaga

SEQ ID NO: 4161526 - RNA, 71 nt, Human
uuuagauaucuugcacugcauaggcaguccuuacaaggaagaacuguccugaauacugcaugaccuuuaaa

SEQ ID NO: 4161527 - RNA, 71 nt, Human
uuuagaugugcuuggaaaagcagugguggaaagaaaaccauucaaauauucuccaagcaccauacucugag

SEQ ID NO: 4161528 - RNA, 56 nt, Human
uuuagcaaagaagauauuauugcaugggacauacaugcaauauauauuugccugaa

SEQ ID NO: 4161529 - RNA, 76 nt, Human
uuuagccagagguggaagauuguuuuguggcauuuuaaguuugauguggaucagaagucuucacugucugguugaa

SEQ ID NO: 4161530 - RNA, 56 nt, Human
uuuagccugucaaauuggagccuagccuccccuggccucagugaugauggguuaaa

SEQ ID NO: 4161531 - RNA, 103 nt, Human
uuuagccuucuucauacauacuuuuaaccugugaaccuguuuaacaauuaagcacaugugggaacuguaaauuuugguugcagguaaaagagagaagguuaaa

SEQ ID NO: 4161532 - RNA, 55 nt, Human
uuuaggacugugacuuuuaugguuuguuuaucuagauagaaucacaaguccugaa

SEQ ID NO: 4161533 - RNA, 87 nt, Human
uuuaggcaaauuauuguaugcaguugccuaauuguuagucacagcaggccuaaaauuacaaaacugcuugagauauguuugucuaga

SEQ ID NO: 4161534 - RNA, 84 nt, Human
uuuaggcaaauuucagaugugcuggacuuuacccccacagcauagacacuguguaaaaaguaccaggcacuggaguaucuugag

SEQ ID NO: 4161535 - RNA, 67 nt, Human
uuuaggcaagggcaagauuaucauugugcuuuucccacuguaucagaucuacugcucucugccuaag

SEQ ID NO: 4161536 - RNA, 65 nt, Human
uuuaggggacaccauacucauguugguuccacaccagugcaacugaacauguguguggcccugga

SEQ ID NO: 4161537 - RNA, 84 nt, Human
uuuaggugggcaccuagcaggacucagcagauauugagugaaugcagaugugugugcccugggccugccagugucugacccgaa

SEQ ID NO: 4161538 - RNA, 78 nt, Human
uuuagucaacuguauacaauugucagacauguagaaaucaucagugucuccuuucagggguguauagaauugucuuga

SEQ ID NO: 4161539 - RNA, 129 nt, Human
uuuaguccauuucuuauguguaaacuucuguaagauauuuuuaggauggugaagugagcacaugcauugugcugacacuuccaguuaaaaauauuauuauagaaaaauucacuagaauugaggaauaaa

SEQ ID NO: 4161540 - RNA, 65 nt, Human
uuuagugcuuugcuauucauggagauaggccuggauaguggcugaacagaaagcagggcaguaaa

SEQ ID NO: 4161541 - RNA, 73 nt, Human
uuuaguguagaggauauugaauaucacagugaauggguaaugcuagcugucacaaauauuucucagcacugaa

SEQ ID NO: 4161542 - RNA, 55 nt, Human
uuuaguguagccuaagcagaauuagcugugagucaccuucuguugcugcgcugaa

SEQ ID NO: 4161543 - RNA, 63 nt, Human
uuuagugugacaguccccaguagcugcccaccuuacacuggggacuccccaauauacacuaga

SEQ ID NO: 4161544 - RNA, 56 nt, Human
uuuaguguuuagaggaggaaagaugaaaaacuaucucaaagcuucuggacacaaaa

SEQ ID NO: 4161545 - RNA, 77 nt, Human
uuuaguugggcugagcugguucucuugugaaauugugcugguuaucuuuaagcuuaucaguuauuuguccaauuaaa

SEQ ID NO: 4161546 - RNA, 58 nt, Human
uuuaguuuccuaggcuguauuguugcuuauucagcaaacuaggucacaggaggcggga

SEQ ID NO: 4161547 - RNA, 81 nt, Human
uuuauacauagaacaucugcugagggccaacuaugcugcuugagaacauaaauauggcuaauagauguuuccugucauaaa

SEQ ID NO: 4161548 - RNA, 73 nt, Human
uuuauagagguaaccaguuauuaugaggucauuaggauggguccuaauccaauauaacuggugucuuuguaaa

SEQ ID NO: 4161549 - RNA, 55 nt, Human
uuuauaguguuaauuuccuagggaaaagaauucucccugggucuuauucugugaa

SEQ ID NO: 4161550 - RNA, 71 nt, Human
uuuauaucauacauucagcagauauuugagcaccuacaugcuuuacuuugcagauguguaugucuuaugaa

SEQ ID NO: 4161551 - RNA, 80 nt, Human
uuuaucagacugacuuucuguggcuauacaccauacacaguauaguaaaguaacccucaggaaggacauuagucuuuaaa

SEQ ID NO: 4161552 - RNA, 83 nt, Human
uuuaucagaggccauuucucagagugugacuuggucaugaguuaucagccauuaacauuccugauagcugguguaguggugaa

SEQ ID NO: 4161553 - RNA, 78 nt, Human
uuuauccacagaaaaaggcuugaaaaucccccagagacacuagcugggcugauuggcaaaggucuuucacuguaugaa

SEQ ID NO: 4161554 - RNA, 83 nt, Human
uuuaucuauguuuggccuggcaauuucagcuccaggaaauuuuaagaaaacaguucagauuguuggagccaaacagucaugag

SEQ ID NO: 4161555 - RNA, 124 nt, Human
uuuaugaaauggaugaugguagauauaaauugcuauggcauuuuaucuaauuguauaaacuuaguagaauguuauagcaauuuuauuuuaaaauggaaguauuuaccauauguuagaaaauaaa

SEQ ID NO: 4161556 - RNA, 89 nt, Human
uuuaugaacaauuuguuucauggggauguuuauuauguuuauuaaauauugagccuuuaauguuuucccagugcagacgauaucauaaa

SEQ ID NO: 4161557 - RNA, 58 nt, Human
uuuaugaaccacucuacaccuuaguuuccuucucuauaaaauggggaugguucaugag

SEQ ID NO: 4161558 - RNA, 79 nt, Human
uuuaugaagacaaacgacguugcaaaugugggccaaucuaacuccauugggguugacaauguccuuugaauuucacaaa

SEQ ID NO: 4161559 - RNA, 75 nt, Human
uuuaugacauguuagggaaaugugauaugccauuuaauugaugaacaauccauccucuuugacucauguuaugaa

SEQ ID NO: 4161560 - RNA, 80 nt, Human
uuuaugcagggucaagaggcagaguucuuggcaaggccagagcuaggaacuauggccugugcuuuugauccuagccuaag

SEQ ID NO: 4161561 - RNA, 63 nt, Human
uuuaugccuuuacccauucaaagguuagaagagcuuuccagggcagauggguaaaggcauaaa

SEQ ID NO: 4161562 - RNA, 66 nt, Human
uuuauggcuggcuacauuuauacucucauuaguuuucugaugauugaauaaauauggucacauaga

SEQ ID NO: 4161563 - RNA, 67 nt, Human
uuuaugguaagauggcaaucauuuggagaguuugaauaauguaaucugauuuccaucuuaaaauaaa

SEQ ID NO: 4161564 - RNA, 58 nt, Human
uuuauguuauauuuugucaauugugaguuuauuuacagugggacauuuguuacaugaa

SEQ ID NO: 4161565 - RNA, 130 nt, Human
uuuauguucuucucuuuacuuccuaaagaaugguagaugcauuucaaacauccugacaucuuggcugcugaggauucuguauggaaaagcacuaugaggucuuuaaugcuugguuggaaggagaacuaaa

SEQ ID NO: 4161566 - RNA, 81 nt, Human
uuuauuaaaccguauacaugaagacauugcugagagagcuaaaaccuugccgugcuucugugugugcucuuuguuuaugaa

SEQ ID NO: 4161567 - RNA, 72 nt, Human
uuuauucauuguuucgucgcagcauguugcucagugguuugcaaauacuuguccgaugaaagaaugagugaa

SEQ ID NO: 4161568 - RNA, 60 nt, Human
uuuauucucagcaacacacauggagguguaaugaccuaccaaaguuuucugagugauaag

SEQ ID NO: 4161569 - RNA, 66 nt, Human
uuuauugcaauggugcuucccuucuauguuuagacaugaaagugaaugucacuguugaacaguaaa

SEQ ID NO: 4161570 - RNA, 127 nt, Human
uuuauuggccaccuacugugcaccaggcagugaacuuggaacuggggcuacuggguuacagcagugaccaagacagaggucccuguucuuaaggagcaagugagggcaacagaaaagagcagguaaa

SEQ ID NO: 4161571 - RNA, 65 nt, Human
uuuauuuaaagucguguguuaacaguagaaaauauuccucuaaugaugacaugacuugaaaugga

SEQ ID NO: 4161572 - RNA, 88 nt, Human
uuuauuuaacuuuuaagcuaguguagagauguugcuuauuuauauuaaugaaggucaugguaauauuuuugcuaaaagaguaaaugga

SEQ ID NO: 4161573 - RNA, 74 nt, Human
uuuauuuaaggauaucuacaauguugaaaccucaaaguaggguuuaacuuagaagagauauccucccugaugaa

SEQ ID NO: 4161574 - RNA, 104 nt, Human
uuuauuuauccuauguuucacuacaaauauguuaagguguuugaucauggagcugcuccgaacacauucauauaucugcagugaaacaugggguguuagauaga

SEQ ID NO: 4161575 - RNA, 58 nt, Human
uuuauuuaugcaguguugcaugaauuuucuuguuugugcaucuuucugcauauguaaa

SEQ ID NO: 4161576 - RNA, 89 nt, Human
uuuauuucagaugaaaacugaauucccaagggcauguuuuucaaaaaauauaacuuuguaauguuugugaucauauaguuugaaaugaa

SEQ ID NO: 4161577 - RNA, 63 nt, Human
uuuauuugggauuucucaucugacuaggcuugcuuuuuagagacugauggaucaccaaauaga

SEQ ID NO: 4161578 - RNA, 58 nt, Human
uuuauuuuccucugcauucagcucauguggcaaguuugaaugcaagaaggaacaugaa

SEQ ID NO: 4161579 - RNA, 129 nt, Human
uuuauuuuuaauuuuauaacagauuuacagauuguauucuuccaaaugaauaugguuuucgauuuaacacacuuuugaaauuguucauuggaagugcauuauaggcucuguguaagccauaaaauacaa

SEQ ID NO: 4161580 - RNA, 90 nt, Human
uuuauuuuuucaaggcaaagagagugucucuuuuuaauuugacccgcaaguuagagauuccaucaugcugcuaaugccugauaaaaugaa

SEQ ID NO: 4161581 - RNA, 92 nt, Human
uuucaaaaaaugucuuuuucagaauuagcauaccauugggucgugacuucaaaugccaguguguugauuccagguggugauauuucaggaga

SEQ ID NO: 4161582 - RNA, 88 nt, Human
uuucaaaggguuuuuaggaaggagacagcugaugacuuugucagucaaacagccuccuguucuaaaagaagccaacaaaccauugaag

SEQ ID NO: 4161583 - RNA, 77 nt, Human
uuucaaagguucaugcuuauugcauauuuggagagaucguuccaggcauaagccuugaguguaaugagcuuuugaag

SEQ ID NO: 4161584 - RNA, 61 nt, Human
uuucaaauugcagguuuugacucguucauguauugugaaaucgauucaguggaguuugaaa

SEQ ID NO: 4161585 - RNA, 79 nt, Human
uuucaaccucuucauccagcuuggcagagcuaccugggguguguaggagaggccagagcuggaagaaaggaggcuggaa

SEQ ID NO: 4161586 - RNA, 84 nt, Human
uuucaagaggguucuaguucuuaggaacagacaggaaaauggugacagguaauugguuccugggaggcuggcacauucuggaga

SEQ ID NO: 4161587 - RNA, 72 nt, Human
uuucaagcaugucaaguuaguccuccaaagagacauuuccuuugucuuguaauuuacuuguuguguuaggaa

SEQ ID NO: 4161588 - RNA, 79 nt, Human
uuucaaggauaauuuuagcauuccagugcacaguagaaauaaccuuauucccugcuaauuggaauguauaauucugaaa

SEQ ID NO: 4161589 - RNA, 81 nt, Human
uuucaaggccuauuacagaaaacuucaagcagcagucaccaacucaugacauggcuuuuuuauucugaaugaggcuugaga

SEQ ID NO: 4161590 - RNA, 76 nt, Human
uuucaagguaaguggacucuucccagugcuugggccagggcuggaaaugggcgggacagggugcacgggcgugagg

SEQ ID NO: 4161591 - RNA, 84 nt, Human
uuucaauuggguagaauucacauucaguucuuuucuguuaaguuucacaggguagaucuggaacugagguuuauuggauugaga

SEQ ID NO: 4161592 - RNA, 57 nt, Human
uuucacagcauauagguguacuucuuugggggacuagugcaauuauugugcuagaga

SEQ ID NO: 4161593 - RNA, 55 nt, Human
uuucacauaaauggaguaaagagcauuuaaugaacugagcuccaugcaugugaaa

SEQ ID NO: 4161594 - RNA, 56 nt, Human
uuucacauguggaaugccagguuaaauucuuguugggccaaauuccaugugugaag

SEQ ID NO: 4161595 - RNA, 64 nt, Human
uuucacauuuaggcgugaauugccaguuuugauuugcuaacaauggccuacccuaagugagaaa

SEQ ID NO: 4161596 - RNA, 68 nt, Human
uuucaccaagcuucguggaggaaguuacucaugaacugagcagauguucuccagggagauuguagggg

SEQ ID NO: 4161597 - RNA, 69 nt, Human
uuucaccccaaaggcauuuugcugaccaauuuggagacaugguuacaacucgucuuaugguuuguggga

SEQ ID NO: 4161598 - RNA, 71 nt, Human
uuucaccuauguuacaaauccuacagguagguguccaacagggccagccugagccuucuguagcaaugaaa

SEQ ID NO: 4161599 - RNA, 65 nt, Human
uuucacgcugggagcaagucaggaaaggugaugccucucaccgccaagaaggcucccagcagaga

SEQ ID NO: 4161600 - RNA, 68 nt, Human
uuucacugccagagacucuuagcggccuucaguucucuugagcuggagccacugggucuuguaugaaa

SEQ ID NO: 4161601 - RNA, 65 nt, Human
uuucacuucuuccucuuugucuugagucagcagugacugggaugucuuuaggggaagagaagagg

SEQ ID NO: 4161602 - RNA, 57 nt, Human
uuucacuugaagaugcugaugauaguauuccacagucuuuagccauccacagugaaa

SEQ ID NO: 4161603 - RNA, 68 nt, Human
uuucagaaaaagggauuugugauccaggucucucauuuaucuuacagaucuggugccccuuccugaga

SEQ ID NO: 4161604 - RNA, 92 nt, Human
uuucagaaaacuagagaaggcuuauuuucuuuguaaaaauguugcuuugcuuugcuucacagaaugauccuucucccaaaguguuucugaga

SEQ ID NO: 4161605 - RNA, 76 nt, Human
uuucagaaagacauauuucuaaguuuauuucuagcuuugaagaaagcauaucugccuaguaaugugucgauugaag

SEQ ID NO: 4161606 - RNA, 76 nt, Human
uuucagaaggaggccgaauacuuuaagucauuauccugaugaaaugacuuugaaauauuugaguuucgauuugaga

SEQ ID NO: 4161607 - RNA, 60 nt, Human
uuucagacaugggggcaaacagaggacugggaccugugguucugccaucccgguuuggaa

SEQ ID NO: 4161608 - RNA, 65 nt, Human
uuucagagaugcagaauucaggucccgcuccagacccaugagucagaaucugcauucuccugaga

SEQ ID NO: 4161609 - RNA, 62 nt, Human
uuucagagcucagcagcuagaguccuugcuuaauuauacuccugucagcuggaacucugaaa

SEQ ID NO: 4161610 - RNA, 59 nt, Human
uuucagaggacaaccagccaucuccacucaccauaggaagguggcugcauccucagaag

SEQ ID NO: 4161611 - RNA, 66 nt, Human
uuucagaguaagaauagaaacauucuccuuuagaaaugguggauguauacuuuucuuucucugggg

SEQ ID NO: 4161612 - RNA, 70 nt, Human
uuucagcaauaguauuuugggacaacuuuauaaaauugcugaagugcaaccugaaauacuagaguagaaa

SEQ ID NO: 4161613 - RNA, 84 nt, Human
uuucagcacaaugcaggcuggucugaccaucccucggcccuggccagggggaggauaauggacauaggcuacagcaggcuggag

SEQ ID NO: 4161614 - RNA, 77 nt, Human
uuucagcugaagauccaggcaaaaguuggaaauaaaugcaauuuucaaguucuguucuaggguaacuuaaguugaga

SEQ ID NO: 4161615 - RNA, 76 nt, Human
uuucagcugcucuguugagcugaaggaagcuaggccaguuucagggauacaauucagcucccagggccuguuggaa

SEQ ID NO: 4161616 - RNA, 105 nt, Human
uuucaggaggcaugacuggauucaggggcucaaaugaaguccaaagggcuuaaauuuuaucccuuagcuucauuuuccuguuuuguuuuguuuuguuuucuggaa

SEQ ID NO: 4161617 - RNA, 64 nt, Human
uuucaggcauggaaacuggauuaggauaaucuuuaauuacuaaugcacagguaccugucugaga

SEQ ID NO: 4161618 - RNA, 93 nt, Human
uuucaggcuuccgaacuauuugcuucuagucaguuccaugugcagguaacuccagccaaaggucuugucuugacagaguuugccagccugaaa

SEQ ID NO: 4161619 - RNA, 55 nt, Human
uuucagggaaaaauggguuuucugagaaaaugaaaaucauuaauuuacccugaaa

SEQ ID NO: 4161620 - RNA, 69 nt, Human
uuucagggugcuccagacacccauggccacuucauguaaaccacugacaauuucuagagcacuuugaga

SEQ ID NO: 4161621 - RNA, 79 nt, Human
uuucaggucauagguucaaaaggcagauuucaaaucuuauauuuguuaauaucaaugcugugaauuugcugaaaugaaa

SEQ ID NO: 4161622 - RNA, 59 nt, Human
uuucagguucagugguauggcuaaaaacuuuagccaauaaauuuacaacuagacugaag

SEQ ID NO: 4161623 - RNA, 122 nt, Human
uuucagugagccaacgucaaauaucaggggauuuuacacauaaauguguagacacaaucuggauuuugugucuacguguuuauguguaaaaucccuugauauuugguguucgcucauugaaa

SEQ ID NO: 4161624 - RNA, 60 nt, Human
uuucaguguguaaauugaaauagcaacuaauaguuggaauuucaguguaugacagugaaa

SEQ ID NO: 4161625 - RNA, 88 nt, Human
uuucaguguuacugauaaguuuaguuaaguaaacucuuuacacaguuuaaggaaauuuauaugacagauaaaacagucaauguugaaa

SEQ ID NO: 4161626 - RNA, 78 nt, Human
uuucaguuuucccacauuuggggcgcuagguagacucaaccugaacuacauucaccccaaaguguuggauaauugaaa

SEQ ID NO: 4161627 - RNA, 60 nt, Human
uuucauaccauuucaguaaaaacuuaggaaaaagcaauuguuccacugagagguuugaga

SEQ ID NO: 4161628 - RNA, 55 nt, Human
uuucauaguaucuugcaaaggaaagaaucuuuuccuuugcaagaugucuaugaaa

SEQ ID NO: 4161629 - RNA, 88 nt, Human
uuucauccuucccuccuuguguaagaaaauaauguaaauagccuuuauugcucuuaguuuuucuuguaaaagcugugggaaggugaaa

SEQ ID NO: 4161630 - RNA, 78 nt, Human
uuucaucuucuauuaggucagcguacaaugcacucacaaaaucaaaguuuauugucacgucuuaauucuaggauggaa

SEQ ID NO: 4161631 - RNA, 57 nt, Human
uuucaugagacauuggcauuugcgucccucugcaauaauagucacugucuaaugaag

SEQ ID NO: 4161632 - RNA, 74 nt, Human
uuucaugauugaggguaucuuugcucauuauuccuaugaaagacgugagcuucugccucucaguccaaaugaag

SEQ ID NO: 4161633 - RNA, 100 nt, Human
uuucauguuucugauuucuugacugauuuuucuaaaauuuggaacuuagaaaaacauauaaauuucuugagaaaugucaggaaagaagucccgcauggaa

SEQ ID NO: 4161634 - RNA, 73 nt, Human
uuucauguuugagacuaauuuuucccauuguaggugaauauuauuuaaggagcaguuauuuuuagacaugaaa

SEQ ID NO: 4161635 - RNA, 83 nt, Human
uuucauucagaucucgugccugggcaccagcgucucgugagaacucaaaugggcugagugucccaggccgaagugagaagagg

SEQ ID NO: 4161636 - RNA, 78 nt, Human
uuucauucuaccacuaaaaacauucuguggaaggcaggaccuuccauacacauugaauuuuaguacgguagugugaag

SEQ ID NO: 4161637 - RNA, 75 nt, Human
uuucauugcuucaucuuuucaaacuguagcugccauucuuuuguguuugguuuuggaagggaagagcauuugaga

SEQ ID NO: 4161638 - RNA, 59 nt, Human
uuucauuguagaguagacacaacugcagugagcaguaguggauuacaagacaguugaga

SEQ ID NO: 4161639 - RNA, 81 nt, Human
uuucauuguccccaggcaagacauagauagcgggccagacgcuccuuuccccuuuccugggacucugauaaggcaaugaaa

SEQ ID NO: 4161640 - RNA, 59 nt, Human
uuuccaaguugagcgauuuuccuuucaacguuuuaguagagggucuucagcuuuggaaa

SEQ ID NO: 4161641 - RNA, 60 nt, Human
uuuccaaguuguuaccuucuacaaaaauugcaguacaaguggaagaaaauaacacggaaa

SEQ ID NO: 4161642 - RNA, 60 nt, Human
uuuccacagcuguauaaaauaaggaaauaacuauuuugauuauugagacauuuguggaaa

SEQ ID NO: 4161643 - RNA, 83 nt, Human
uuuccaccaccccguuucccacuguggcagagccucgcauagaagauucgagggccugggugggagaagaggcacuggggaaa

SEQ ID NO: 4161644 - RNA, 86 nt, Human
uuuccacccugaggacaacaggacauguaccagguggucuguauggucaacuagacuuugguuuuguuccuucuucaguuaggaag

SEQ ID NO: 4161645 - RNA, 68 nt, Human
uuuccagaucugcuccucuguccauguagucuuaaagagaacuggaaagagauggcaggguuuagaaa

SEQ ID NO: 4161646 - RNA, 68 nt, Human
uuuccagaugcuagguugaaaggcucauggauaaagcauagagaaauauuugaugaguggucugggag

SEQ ID NO: 4161647 - RNA, 72 nt, Human
uuuccaggaaugacccaacaguuucauauauugugaaauauuugagaucgugucgucauuuauuccuggaag

SEQ ID NO: 4161648 - RNA, 77 nt, Human
uuuccauccuaauaaaagaaguuacucagauggauauuccagauguauuuaagcugcuuuuauuaggacaauggaga

SEQ ID NO: 4161649 - RNA, 57 nt, Human
uuuccauggcagcagccagagucuggaaaagaggccuggagaggaagccgguggaga

SEQ ID NO: 4161650 - RNA, 61 nt, Human
uuuccauguuggugaaaugaggaaaaaucccacccuccccagguuucauuaagauaggaaa

SEQ ID NO: 4161651 - RNA, 60 nt, Human
uuuccauuuucagcuggcuguugugguacaagggcagccacagugagaaauaaauggaaa

SEQ ID NO: 4161652 - RNA, 129 nt, Human
uuucccaaauuaggaguuaauuaguaccaaaaugugcagugcguugaccggccuuccacuggguucccaaagcagagaacugucucauuuugaaaguaccuaauugugccugcaucucuguuuggagaa

SEQ ID NO: 4161653 - RNA, 73 nt, Human
uuucccaaucuaauccccaaguccuguauugacugcaugaucuguacaguucuuugaaggaucuaggaggaga

SEQ ID NO: 4161654 - RNA, 66 nt, Human
uuucccacacugucagaacagaaggcccagcaagcccgcuugagcaccucccugacaguggggaaa

SEQ ID NO: 4161655 - RNA, 78 nt, Human
uuucccagucuccagaucaauuggcagaagccucugguuauuuccuucuggaugcuucuauuauuuggagcugagaag

SEQ ID NO: 4161656 - RNA, 83 nt, Human
uuuccccugaugacuugaguaaagacauuagauuaacguacaucugcuuuuauuuguguguguguaaugucuuuuagggggaa

SEQ ID NO: 4161657 - RNA, 101 nt, Human
uuucccucauggaguuuauaagagcagagguugaauaaauaauuacaagugcaucauuuacuuuaguaaacuuauguuacuuuuuauauucuagaaggaaa

SEQ ID NO: 4161658 - RNA, 83 nt, Human
uuuccguugguuuucuuugacaaaaucuggcgaccugugccaacaagaccugccaggcagugucagauugaggaccauggaaa

SEQ ID NO: 4161659 - RNA, 87 nt, Human
uuuccuaauauuuuauucuugguaaauuauuucuuccaauuacuuaauuuugauggauggauaacgugccacugaauggaaaggaga

SEQ ID NO: 4161660 - RNA, 85 nt, Human
uuuccuagaagaccggugagagcauuugaauuauaauccaaauauuuuccuggcuuucauugaaauacagucuugacuuaggaaa

SEQ ID NO: 4161661 - RNA, 72 nt, Human
uuuccuagagagccagcauuugggcccugcuggcuucauugaaaguaggcaggcucaaaagcugguaggaag

SEQ ID NO: 4161662 - RNA, 59 nt, Human
uuuccucacucaugucaucaguguagcaauugguuugggucagguguauggggagggaa

SEQ ID NO: 4161663 - RNA, 67 nt, Human
uuuccucaggcacagggcugguugugguaauggccacaccugguaaggccucugucauccugggaag

SEQ ID NO: 4161664 - RNA, 81 nt, Human
uuuccuccagguucugugcuuaccugcccaggugagucaaugagcucaucugagguuugaggcaguuguccuggaaagaga

SEQ ID NO: 4161665 - RNA, 73 nt, Human
uuuccugcagcuauugucuccugggcccagcugauggagacagacaaagaggguccagccaauuccaaggaaa

SEQ ID NO: 4161666 - RNA, 83 nt, Human
uuuccuggcuuugaggauccccucuuaaacuagaaaaggcccuugaagucuccagagaaggggggauauaaggcuacuggaaa

SEQ ID NO: 4161667 - RNA, 73 nt, Human
uuuccuggggccagcacugguggacuuaugguaaaugauuguacuucuuaauucaaugcugguccuaaagaga

SEQ ID NO: 4161668 - RNA, 59 nt, Human
uuuccuguacuuccggccugcuacaugaauggcaaaguaggcccuggaggucagagaaa

SEQ ID NO: 4161669 - RNA, 57 nt, Human
uuuccugucucccaacugacauugaucauaauucagugccugugcggacucagggaa

SEQ ID NO: 4161670 - RNA, 62 nt, Human
uuuccuguggguuuucuguagaaaucccuuuuuggauuguacagaugaaccucacucugaaa

SEQ ID NO: 4161671 - RNA, 130 nt, Human
uuuccuuaaaccucaggaaucacugucugccagcuuucaacuuuuuuucugaagauuucucauuucucucguucuucaaaaaguugaagaguuggggccuugcucuggauuagacuuugguuuaagggaa

SEQ ID NO: 4161672 - RNA, 82 nt, Human
uuuccuucauauuuugaauuauuucugaugcuaacugggcauuuagggagucaaagaagaugguuccaaaauaggugggaaa

SEQ ID NO: 4161673 - RNA, 70 nt, Human
uuuccuucaucaucugagagcuggagaacaagcaugugugugccggccaugagaugacuguacaggggaa

SEQ ID NO: 4161674 - RNA, 55 nt, Human
uuuccuuccaaaugcccgggagccaaccaauugcauuccuggcauuuguaggaaa

SEQ ID NO: 4161675 - RNA, 59 nt, Human
uuuccuuccauagcaaaacaugccagccaccaaacaguuggguuuagaauggaaggaaa

SEQ ID NO: 4161676 - RNA, 58 nt, Human
uuuccuuccuaaggugaagcaaugauugaacaaggauugcugagcuuuggcaaggaag

SEQ ID NO: 4161677 - RNA, 82 nt, Human
uuuccuuccucuuucuggaaggaccccaggacuccagaacaccuaagcaccuggcugagccuccaggaagagccugaggaag

SEQ ID NO: 4161678 - RNA, 56 nt, Human
uuuccuucucagggagcuucaaugggaaaggucucgaaagcuucaggaggagcaga

SEQ ID NO: 4161679 - RNA, 63 nt, Human
uuuccuugggucucuuaguggcaugguuuaaugguaauucagaucacucuuggauaaaggaaa

SEQ ID NO: 4161680 - RNA, 73 nt, Human
uuuccuugugagagccagcaguaaagacauugggggaaucugaaugugauuuggaugguauacacaagagagg

SEQ ID NO: 4161681 - RNA, 92 nt, Human
uuuccuuuggcauuaguaaaguaaacccacuuuguagucagcacacagcauguuaaagagaaaguguuugucuuacaguguguuaaagggaa

SEQ ID NO: 4161682 - RNA, 61 nt, Human
uuuccuuugggcacccgagcucacagugcagcauggagcaucaggguaggucugugggaga

SEQ ID NO: 4161683 - RNA, 73 nt, Human
uuuccuuugugcagcuaagaaaauggcaccagugucagaauucacucuagcccuauuaucugcauaagcgaag

SEQ ID NO: 4161684 - RNA, 65 nt, Human
uuuccuuuuccuccuucguauuguugcuuacaaacauaagacaauaacugcugaggagaagcaaa

SEQ ID NO: 4161685 - RNA, 79 nt, Human
uuucgcucgguugucagcuuccuugaauucuguagaagcaauugcuccugcuggaaguagggaaugaucgcuagcgaaa

SEQ ID NO: 4161686 - RNA, 91 nt, Human
uuucggccccugugggacaauggaggccucucucccuucguguccaggccugggccucuggagagagaccuccaugcccagaggucagaag

SEQ ID NO: 4161687 - RNA, 65 nt, Human
uuucuaaaauucugaaagauuccuuauuccagcauaaaacuggccuaaggauuucagaaaagaga

SEQ ID NO: 4161688 - RNA, 80 nt, Human
uuucuaaacuaguuaguuugcauuauuuguauaguuaaaagauaaugcuuauguuaugcaauuugcuuguaguuuagaaa

SEQ ID NO: 4161689 - RNA, 62 nt, Human
uuucuaagccaucagugauuucccuauuggaacaagggaaagaacccuggauggcugggaaa

SEQ ID NO: 4161690 - RNA, 58 nt, Human
uuucuaauccuucacucucacagccacacaauccucagcugagggugagcuuuggaga

SEQ ID NO: 4161691 - RNA, 81 nt, Human
uuucuaccuugcugaguccauguaagauagauuaccuucauggcuguuuccaguuacguggauaaagggaggagauagaaa

SEQ ID NO: 4161692 - RNA, 76 nt, Human
uuucuacuugaaaacauuuucucuugauuccguguaugaacaggaugauggaauggaggacaugugggaguggaga

SEQ ID NO: 4161693 - RNA, 55 nt, Human
uuucuagaggcuccaggggaguauuguuuuccuugccuuuuccagcuucuagagg

SEQ ID NO: 4161694 - RNA, 61 nt, Human
uuucuagagugggcaugucuuauacauauuuagguuuuuaaaauaugcagcuacucagaaa

SEQ ID NO: 4161695 - RNA, 87 nt, Human
uuucuagauuuguuacuuguagaaccuguuuauuauagagaguucuaggcuucuuugaaagcuguucuagaguugauaaaucugaaa

SEQ ID NO: 4161696 - RNA, 97 nt, Human
uuucuagcucaguucuccucagacucugaugcagccuugugaggcaaagccacauaucuuauccaugcucagauuugggggcuucugagcuauggaa

SEQ ID NO: 4161697 - RNA, 60 nt, Human
uuucuaguaaaagcuaauuaccgugcucaauacaguacuuuaaacaguauuuacuaggag

SEQ ID NO: 4161698 - RNA, 82 nt, Human
uuucuauaccugagaauuucccagaggccaugaggagcuaauccucccaaggcuuuugggaauuuucaacccuguguggaaa

SEQ ID NO: 4161699 - RNA, 60 nt, Human
uuucuauaguaugugagcugaccuuccuaauauucugucaguucaugucucaaauagaaa

SEQ ID NO: 4161700 - RNA, 75 nt, Human
uuucuauuagguuggugcaaaaguaauugcgguuuugccauuacuuucaauuacuuuugcaccaauauacagaag

SEQ ID NO: 4161701 - RNA, 82 nt, Human
uuucuauuuguugucagguuacaaaacaguuaaauuaaauuuucuaaacagaaaagaaacuguugcgugacagcgauaggga

SEQ ID NO: 4161702 - RNA, 58 nt, Human
uuucucaagaagagcgagaaggcuuggaccacagccuccgcuuccucuucuggagaaa

SEQ ID NO: 4161703 - RNA, 59 nt, Human
uuucucagcuugaguggaugagcugguaaauaccaccguacauaucaaagcuguagaaa

SEQ ID NO: 4161704 - RNA, 82 nt, Human
uuucucaggcauauagggguaucauuucuuaauaaaucaugacuugauaacugguuaagggugaaauccauaaacugagaaa

SEQ ID NO: 4161705 - RNA, 76 nt, Human
uuucuccaucuuccuuucuuuuccuauuuugcagaccuuguaaugaggcacuuaaaagugaagauacuggcaggaa

SEQ ID NO: 4161706 - RNA, 67 nt, Human
uuucucccuccucaaauaucuuuguguucucaucauuaaaaggaagacaaagaaaggagaggggaaa

SEQ ID NO: 4161707 - RNA, 94 nt, Human
uuucucccuuagccugaugauguauuauauuaauauaucauuaaagagacagcuuucagaaaugauguauuaguacaacacaucacuggagaaa

SEQ ID NO: 4161708 - RNA, 65 nt, Human
uuucuccuucgaggcccagcuccccagugucccccacuggagagggagcuucuggaaggcaggaa

SEQ ID NO: 4161709 - RNA, 87 nt, Human
uuucucggcauuuuggucgggaacacgggcacuugcugggguauuuccgcuaguacaugugguccuggccagagauggugacaggaa

SEQ ID NO: 4161710 - RNA, 82 nt, Human
uuucucuacuacuuuucgcuacuggaacaccugcucuuugagggggcuggccuccugcuagauggaaccugugggagagaaa

SEQ ID NO: 4161711 - RNA, 106 nt, Human
uuucucucaaacugacuucaaaugaauuuugucuaaaauucuacugauguaaaugaugaguaaguggaggagcucagccauucauuugaagguggucugggagaag

SEQ ID NO: 4161712 - RNA, 56 nt, Human
uuucucucgagguggaguuuuccagagcuugcgaaaaucuucugccuaugaagaaa

SEQ ID NO: 4161713 - RNA, 64 nt, Human
uuucucucuauccccuucuucauucucagagauaacuuugggugauauuaaggauagagacaag

SEQ ID NO: 4161714 - RNA, 65 nt, Human
uuucucuggcauuagguauaaaagucauucuguguaacuuggcuccaauaucacuuguagagaaa

SEQ ID NO: 4161715 - RNA, 62 nt, Human
uuucucugggcacucuccaaaccucuccccuacacauuggguugaccagaugcccugaggag

SEQ ID NO: 4161716 - RNA, 80 nt, Human
uuucucuggguagcaaacugaacugugugaaaaaguuucuucuuuauaugugaagguuugcagaaaggagcacagagaaa

SEQ ID NO: 4161717 - RNA, 55 nt, Human
uuucucuguucucuaacuguaauauauuuuaauuacagauggaggaacagauaga

SEQ ID NO: 4161718 - RNA, 84 nt, Human
uuucucuguuuuccacauucuguccuugaacugcaggugucuagugucuuuagagucagaaggaacagacggggagcagagaaa

SEQ ID NO: 4161719 - RNA, 83 nt, Human
uuucucuuggacuucaguguuauuagaugagguuugggaaaguuuuauuagcacuuuuuaucaugacacugggacaggagaga

SEQ ID NO: 4161720 - RNA, 78 nt, Human
uuucucuuguucuggauguugcggaguacagaugucacgucuggaacugcugcagucauuuugcuaccaugagagaga

SEQ ID NO: 4161721 - RNA, 71 nt, Human
uuucucuuuugguccauuauaugcugucaugggcucuacuccugcagccccccagauggccguaugagaag

SEQ ID NO: 4161722 - RNA, 93 nt, Human
uuucugaaaguaucgacagaugacaguagcacuuuuaacuuggagaagaagagcacuuuaagugcauucugucaucuugguuacuuacugaaa

SEQ ID NO: 4161723 - RNA, 78 nt, Human
uuucugaacuguggguaauauauuagacguagaaaaguacaucauguuaugugugaaagagucuuauaguuucagaga

SEQ ID NO: 4161724 - RNA, 65 nt, Human
uuucugaauuuacucaaggucaacacuaugaaacaucaaugacuaaacagcuguaaauucagaga

SEQ ID NO: 4161725 - RNA, 119 nt, Human
uuucugaccaguuccaggugacauggauccuggugagcucuaggguaugcuuugaguaacagagaauauuagaguuaguuuauaaugauaaccauagcaccugaagcuaaauuagcaaa

SEQ ID NO: 4161726 - RNA, 63 nt, Human
uuucugcagaagcucacuaaauccaggaguccccugggugcaaguaaugaauuucugcagaga

SEQ ID NO: 4161727 - RNA, 125 nt, Human
uuucugcagagagcugcugauugauagcugacaguuuuugcuguauuguaaugucccuuuuaucccagcucuauaguugcaguaaaaaauguuuuuguguggcgaaauacaguaguauccagaaa

SEQ ID NO: 4161728 - RNA, 62 nt, Human
uuucugcagcagacucaguguggagccgucagccagcagcacuuagucucuggguacggaaa

SEQ ID NO: 4161729 - RNA, 82 nt, Human
uuucugccaucuaccccuuugacuuuccucacaagucuggagauauuucuagcccagaagagggaagcaacagaggcaggaa

SEQ ID NO: 4161730 - RNA, 62 nt, Human
uuucugcucgcucucaaucaggcagacaacaucccucugacugauuaagacacggggggaaa

SEQ ID NO: 4161731 - RNA, 75 nt, Human
uuucuggcacugcccagccucugcuccaaccucucuggaggcaaaggagguaacaggagggcacaaggccaggaa

SEQ ID NO: 4161732 - RNA, 55 nt, Human
uuucuggcagcgggacagggguggugaggcagucccucccaggaguggccagaga

SEQ ID NO: 4161733 - RNA, 96 nt, Human
uuucugguccagugugugagcuucuggacucugcagagaaaaguaacuuaaaaaaauuugcuuuguguuccagguucagcaggcacuagccaggaa

SEQ ID NO: 4161734 - RNA, 62 nt, Human
uuucuggucccuacgauaagaagaguuguuuggcuagaagguuuuaucugugggaguggaga

SEQ ID NO: 4161735 - RNA, 64 nt, Human
uuucuguaaagaccaagccagcuguucucugccagccuauaauuggccauugagucuauagaaa

SEQ ID NO: 4161736 - RNA, 57 nt, Human
uuucuguaaguucaggcuuuccuaguugaaauggaaagaaaacugaacuuggaguga

SEQ ID NO: 4161737 - RNA, 59 nt, Human
uuucuguagaggaacaagagcucuucccgguucaaaggggaagucuucugucacagaaa

SEQ ID NO: 4161738 - RNA, 84 nt, Human
uuucugugcaauguuugcaacuugcuguauuuuggcaggaauaacaaagccaagugcagagagcugacgaacuucucucagaag

SEQ ID NO: 4161739 - RNA, 82 nt, Human
uuucuguggcauagugauguuuggcuucugguucuuauugagaggugcaguauauggauuuuaaacauugcagcuauagaaa

SEQ ID NO: 4161740 - RNA, 56 nt, Human
uuucugugguuaguuccacuaucuguauuugauagcuauggaaauugaaacagaaa

SEQ ID NO: 4161741 - RNA, 98 nt, Human
uuucuuaacaaauaaggggaagagauguugaaguuuauuaguaaucaaauuauuauugauuaaaaugagacaucauuuuuacuuguugaauuaggaaa

SEQ ID NO: 4161742 - RNA, 64 nt, Human
uuucuuaccagccuuuuaacaugggccuccacugggugcaugugagaaagacugggaucagaga

SEQ ID NO: 4161743 - RNA, 85 nt, Human
uuucuuagauacagaguuuuagagagauuuuugugugugacuuuucucagucuuucagguauuuucaaggcuuguguuaaaggaa

SEQ ID NO: 4161744 - RNA, 56 nt, Human
uuucuuagggacuguaaaauagcaucacuaaaacuauuugaucaagcccugagaaa

SEQ ID NO: 4161745 - RNA, 86 nt, Human
uuucuucacagauuuguauuagcuguaaauuuucugucugaaacccugacacagacagagggagaagcuaaaauaacuggagggaa

SEQ ID NO: 4161746 - RNA, 97 nt, Human
uuucuucagggccugucaauuacaguagagguuagagagccccagugacaauucuuccuuggggguccuccucugcuuaagacaucucuuagggaga

SEQ ID NO: 4161747 - RNA, 73 nt, Human
uuuugaaaacaaauuuggagaaguuugauucacccuauuggaaggagaagcuggacuuuccaaacuuucagaa

SEQ ID NO: 4161748 - RNA, 127 nt, Human
uuuugaaagaaugagaaagggagagaaugagagagaguguguguuuguguauauguguaugucuaaguacuugguauauaucggcacuauuuuaaguuauuuuaauucuuacaucaaccuuuugaag

SEQ ID NO: 4161749 - RNA, 75 nt, Human
uuuugaauaacucucauguuuaggaaugggauuuucuuauuuauuuacauuucugauuacuugaguuauuuagaa

SEQ ID NO: 4161750 - RNA, 90 nt, Human
uuuugacacagcaggcauuugauauauauuucuugauuaaaugaaagauuaaaugaauaccaucuuagaugucugcauagugcuuuaaag

SEQ ID NO: 4161751 - RNA, 76 nt, Human
uuuugagaugacugaauucaaugacucuguguggggaaaacuaaucucugaauaguauauugaaagcaucuaagag

SEQ ID NO: 4161752 - RNA, 83 nt, Human
uuuugagcagcguauugcauggaagcugaaaaagacacgguuaguagccguaugucuggguuucuuaauacguucucucagaa

SEQ ID NO: 4161753 - RNA, 88 nt, Human
uuuugaguggcagcaggguauggugggaagaaucagaggcaugaacuccccuccugguuugcccacaccagccacgggucacucagga

SEQ ID NO: 4161754 - RNA, 90 nt, Human
uuuugaguuacaagaggaaauaaauggggaaaguaagggaaaggagaucacucucuguucuugcuuuucuccaaccuacuaacauuagag

SEQ ID NO: 4161755 - RNA, 66 nt, Human
uuuugaguucuugacuggggugcuucuuuucucuauaagauuguuuaacagcagagacauucaaaa

SEQ ID NO: 4161756 - RNA, 94 nt, Human
uuuugauuaauguuagcuauggauuagaggugaugauuauaaaugcauuuguagguuuugcccauuuaauauauaguuugauaaauuaucaaaa

SEQ ID NO: 4161757 - RNA, 63 nt, Human
uuuugcaaauauuccccuaggucugcucuugcugacagauugauaguugggaauauuuugaaa

SEQ ID NO: 4161758 - RNA, 67 nt, Human
uuuugcagacacagaaaccuggguucaaauuaauguucugacacccauuaucugugugaccucagga

SEQ ID NO: 4161759 - RNA, 63 nt, Human
uuuugcaggguuugcauuaaagcauaagaaaugacaacuugcugaagagcaaaccaggcaaaa

SEQ ID NO: 4161760 - RNA, 69 nt, Human
uuuugcccagcucccugaagccuggucuugguuaacugggagcgugucguagggagugggguuagggaa

SEQ ID NO: 4161761 - RNA, 79 nt, Human
uuuugcccauuucuauuucaagcuucugugaaugaacuuaaugucaaauagguaugaguagaaaucucaaagggugaaa

SEQ ID NO: 4161762 - RNA, 85 nt, Human
uuuuuuguguuacaaacauuccaauuguacuugcuuuuauucucagggaguaaagaaagccauuggaguguuuugagccaaggag

SEQ ID NO: 4161763 - RNA, 82 nt, Human
uuuuuuguuaccuccccaacuagaauguaauucccugaggauggggacagaagucacaucuaauucgguuagguucaagaaa

SEQ ID NO: 4161764 - RNA, 102 nt, Human
uuuuuuguugauuuuucuggauuguguguauuaucuaauuuguucuacugaauucugaacccucuuuaaaugaugcauaucauuuagaaggacaauggaaga

SEQ ID NO: 4161765 - RNA, 88 nt, Human
uuuuuuuccaguaagaaugacuaccaaacuggagguuuaaucuagcaacaugaaucucagucaaugugucagcucuccuggaagagaa

SEQ ID NO: 4161766 - RNA, 64 nt, Human
uuuuuuuccugcacauuugagcaugacuauguauugaaugcuauuuuuguaagcaggugagaga

SEQ ID NO: 4161767 - RNA, 89 nt, Human
uuuuuuucucaacggucucauggcuuucagccaacuaaacacuaauucaaggauuuggugccaagcaugaggacucuucuagaaaaaga

SEQ ID NO: 4161768 - RNA, 105 nt, Human
uuuuuuuuucgccuuuacuguaugucagugacuucuccuaaugucauauccuccucauucuggggguagcaucaagggaacacgauuuacacagagaaauaagaa

SEQ ID NO: 4161769 - RNA, 65 nt, Human
uuuugcuauggucuucauggacaagguuguuguucacuaccacuccagcagacucaucagcaagg

SEQ ID NO: 4161770 - RNA, 75 nt, Human
uuuugcugaaagguagcuguguggucuugggcaaauaaguuaaccucucugagccacgguugcuuuucuguaaaa

SEQ ID NO: 4161771 - RNA, 71 nt, Human
uuuugcugaaauuagggaaaacauuugcuuuucacaagagagguauguuauuucuugaaaccuuugcagaa

SEQ ID NO: 4161772 - RNA, 63 nt, Human
uuuugcugagcugagaaugugggaacgggauaaagaaaccaacaaaugcuuaguucaccaaaa

SEQ ID NO: 4161773 - RNA, 60 nt, Human
uuuugcugcauugaagucagauacccucuuauuagggagcagcuuucaaagcagucagga

SEQ ID NO: 4161774 - RNA, 101 nt, Human
uuuugcuguuaaauauugcagagaauaucuuguacaucuaaguagaaaagagauuuuugcuauaagaauuauauuacucugugcagguuuggcuagcaaaa

SEQ ID NO: 4161775 - RNA, 56 nt, Human
uuuugcuucucaugauagguuagcuagccaugggggacuuuaauuugagagcaaaa

SEQ ID NO: 4161776 - RNA, 56 nt, Human
uuuuggcaagcugggagauauucuugauaacccauaacuuccccaagcugccaagg

SEQ ID NO: 4161777 - RNA, 78 nt, Human
uuuuggcuauuguuaacagugcuguuauaaauguacaugugcauguauuuguuugaguacuuguuuucauuucuagaa

SEQ ID NO: 4161778 - RNA, 71 nt, Human
uuuuggcuuuaagguuuaggaagcaauagaucuaguuacuuauuguaauuucccaagccuugaagaaaaaa

SEQ ID NO: 4161779 - RNA, 61 nt, Human
uuuuggguguucuuuugaguccuuuggaguacaauuaauucagacuaugaacacgucagga

SEQ ID NO: 4161780 - RNA, 91 nt, Human
uuuugguaguagagauggcguuucaccauguugaccaggcugaucucgaacuccugaucucaagugauccacccaccucagccucccaaag

SEQ ID NO: 4161781 - RNA, 72 nt, Human
uuuuguacuugaaacccagggcccugguggucuaggcacccaagggaaucuccuggucuucagguugcaaaa

SEQ ID NO: 4161782 - RNA, 87 nt, Human
uuuuguauauauucaugugucuguagcacauauguauuugagcagaauauaucuauaugugcaaggcauguguauauauguauaaaa

SEQ ID NO: 4161783 - RNA, 104 nt, Human
uuuuguauucuuauucgagggcauguacauaaucuagaaaucauuacaauggcaaauagugauuucuugaccacuauguugauauagccauugggaauauuuga

SEQ ID NO: 4161784 - RNA, 58 nt, Human
uuuugucauugauugaaaccugaguuaagaaucucagugaucagucuauuguauaaga

SEQ ID NO: 4161785 - RNA, 68 nt, Human
uuuugucucccacuuucuggccucuuccaggcauugcagcuggauggggccaggagugggggacagag

SEQ ID NO: 4161786 - RNA, 83 nt, Human
uuuugugaugcauuugucuugucucaugaacuaacuuguaaacucuaugaaguccaggaccaaagacacauguaaucucaaga

SEQ ID NO: 4161787 - RNA, 57 nt, Human
uuuugugauuauuugaucaguguccugagauggauacaauggcaaguaaugacaaaa

SEQ ID NO: 4161788 - RNA, 79 nt, Human
uuuugugcuuuuaucagcaucugaccaauaucuacaggacugacuucuccuuuaggcacagaguugagggaccacaaaa

SEQ ID NO: 4161789 - RNA, 80 nt, Human
uuuuguggacaaagacuggguuugauucugaaagcuccagaacccagcccagagacaaugcucaguauauguuuguagaa

SEQ ID NO: 4161790 - RNA, 56 nt, Human
uuuuguguaaauauacauauguauguaugaauguauguauguauguuuguauggaa

SEQ ID NO: 4161791 - RNA, 78 nt, Human
uuuuguguucuggucaguagcuuuacccucuacaccugacaaaguguauggaaguauaaguuuugaaggaagaugaag

SEQ ID NO: 4161792 - RNA, 65 nt, Human
uuuuguguuuagguucgugucagauaaguuuccauuguuugcaacuaaaagaacuugacacaaaa

SEQ ID NO: 4161793 - RNA, 56 nt, Human
uuuuguuaucuguaagacagacccuaggagggucagucucuccccggacagcaaaa

SEQ ID NO: 4161794 - RNA, 59 nt, Human
uuuuguucaacucugcuaugcuaauguauccauagucaagcaggugcuguuggaggaaa

SEQ ID NO: 4161795 - RNA, 79 nt, Human
uuuuguuccauauaugcauacauguacauaaauguagcacauguaugugcuggguuuccauguagcuguguggacaaaa

SEQ ID NO: 4161796 - RNA, 73 nt, Human
uuuuguucugccuucuacgcuuggaguaagauuuuguugaauaaaacauuccagguuguagaaaaguuugaaa

SEQ ID NO: 4161797 - RNA, 83 nt, Human
uuuuguuugcuuuaaaguggauacaacuauaaaugaagguucaguuauauuguuugaaguuguaguucagugaagaaauaaaa

SEQ ID NO: 4161798 - RNA, 77 nt, Human
uuuuguuuuauagguccugugagauguaugcauuaaagagguucuguuuugauguguuuccaggauuuguuucaaga

SEQ ID NO: 4161799 - RNA, 95 nt, Human
uuuuguuuuuaauugaaggaauaacaucauuuuuguaagcugguaggaauaauuuaauagcaaggaaaaaugagaucuuccaauagagaagaaaa

SEQ ID NO: 4161800 - RNA, 90 nt, Human
uuuuuaaaaagagugaaaaaaguuacauugcacuguaugaaagaaaaauguucacagugguaggauaacuguuuuccucuauuuugagag

SEQ ID NO: 4161801 - RNA, 75 nt, Human
uuuuuaaaagcuguuuuucuuagaacaucagaaaaguugucugaauaaaagagaggaaacauagguuuuuaaaaa

SEQ ID NO: 4161802 - RNA, 55 nt, Human
uuuuuaaagccuucugcagaaauuguauacaucucugccuugauggcauugagaa

SEQ ID NO: 4161803 - RNA, 79 nt, Human
uuuuuaacuuucuuucucagcauucucuuuggaguucaaccuagcgcccaugagccaggcugaggaagcugagugagaa

SEQ ID NO: 4161804 - RNA, 104 nt, Human
uuuuuacaaccucgacagcacugacugaaucaauaguugcaaguauuagccugaauaaugaaggaaguaguguacaucuguugauuucucugcauuugugaaaa

SEQ ID NO: 4161805 - RNA, 76 nt, Human
uuuuuacgguucacauaggccagaagauucaaagagcuauucucuuuccuucuuuuucuucuguggaagguggaag

SEQ ID NO: 4161806 - RNA, 95 nt, Human
uuuuuagguuuagaggacugauuuagauuucacacgugagucuaggauuugucaaccuugugagaacugagucacacuaacuaaauaccuaaaaa

SEQ ID NO: 4161807 - RNA, 58 nt, Human
uuuuuaguuaguaguccuugugaucccccagagauaaucagggccuaagagcugaaaa

SEQ ID NO: 4161808 - RNA, 85 nt, Human
uuuuuaguuucauuuauguuguugcauguauuuguaguucauuuguuuucuauugcagagacacaucauauaaguauacugaaaa

SEQ ID NO: 4161809 - RNA, 94 nt, Human
uuuuuauaaaugaaguuuuauuggaacauagccaugccuggucauuuacauacgucuauggcuucguuugcaauauagcaacagaauauauuaa

SEQ ID NO: 4161810 - RNA, 130 nt, Human
uuuuuauccuugacugaaaaugaaagauuccuuggcugucucuuaaauaccuaaauacaucaaauucaauuuuauuuggucaaggacauuacaguuuugguaauuuauucacuugaggucaaguaaguca

SEQ ID NO: 4161811 - RNA, 98 nt, Human
uuuuuaugaugucucaagguuucuggucaagggaaguaaauguaggauaguauuuuuacaccaaaaugacacagagagaauugagcacaccagaaaga

SEQ ID NO: 4161812 - RNA, 129 nt, Human
uuuuuaugugguucuuugguucauguggguaccaagcugcuugggggcagaaaccccaauucuuauucaaaguuggaucccagggcccacaguguagcagguacucagugaagacaggccagauaugaa

SEQ ID NO: 4161813 - RNA, 67 nt, Human
uuuuuauguuagaaacacauucuuauugauuggacacagucagaagcuaguaguuuuuaaagagaaa

SEQ ID NO: 4161814 - RNA, 62 nt, Human
uuuuuauuaagccaucuuuuagcugacaugugaagagugagcaaaugcuggcuggaugagga

SEQ ID NO: 4161815 - RNA, 56 nt, Human
uuuuucacugcuagcucucuucaacuuuuuguugagaugguuaucuaagugaaaaa

SEQ ID NO: 4161816 - RNA, 60 nt, Human
uuuuucagucuguccuugcugugaucgcuggaauauggaacacagagggcaacugagaaa

SEQ ID NO: 4161817 - RNA, 68 nt, Human
uuuuucaucugugcugccaagacugagugguuggauggcaagcauguggucuucagcaaggugaaaga

SEQ ID NO: 4161818 - RNA, 55 nt, Human
uuuuucaugagacuagaagucauuuauuuaugaaucuuuuaugugucaugaggag

SEQ ID NO: 4161819 - RNA, 83 nt, Human
uuuuuccaggacaauauuuauuguauaugauauucacuucuucaaaauuauugacaaucuacuauguucugguucugggaaaa

SEQ ID NO: 4161820 - RNA, 79 nt, Human
uuuuuccauagauagauagguagcaucauugauuugaaauaaauuaaauugcauugagcugcuuauuaauccagagaaa

SEQ ID NO: 4161821 - RNA, 62 nt, Human
uuuuucccccucugcuguuaggaauuugaauccuacuuguaaugcagcaguggaaggaaaaa

SEQ ID NO: 4161822 - RNA, 86 nt, Human
uuuuuccucuuguaucacuguucauguguagucaccauguguauuagguacucaugcaaugagucaggaggcauuuccaggaagaa

SEQ ID NO: 4161823 - RNA, 64 nt, Human
uuuuuccuuggaugugucucucugagagaagccagcuacuuuaucaugagaaucuauggagagg

SEQ ID NO: 4161824 - RNA, 113 nt, Human
uuuuucuccauccuuuaacuaacauuuaaaauuauuuugcacuuucauuuguaacuaccuaggggugaaaugcaacaguuauuuuuguggugguuagaguggucccugaagaa

SEQ ID NO: 4161825 - RNA, 72 nt, Human
uuuuucucugauuuauauuauaaagugccauggucaaaguggcauuauguugugaaauagauaagcuaaaga

SEQ ID NO: 4161826 - RNA, 90 nt, Human
uuuuugauuuacugagguaaauaaacugaaacaacauaggauaucuuucaaguuguaaaauauaguugaauuuaucaguagcauuagaaa

SEQ ID NO: 4161827 - RNA, 60 nt, Human
uuuuugcacuuuaaaaaauggugaugcccacuggugucauuagaguuaguagugugaggg

SEQ ID NO: 4161828 - RNA, 55 nt, Human
uuuuuggauggggguucuaauucuucacaaauagaauagaaugcccacuuaaaaa

SEQ ID NO: 4161829 - RNA, 63 nt, Human
uuuuuggcaagaucuggggcagagggcaguuuuaaucuugcuucaguuucagucuugcaaaaa

SEQ ID NO: 4161830 - RNA, 112 nt, Human
uuuuugggggaagggguaugugucacuaauagaauaucucugaagcuggauugauacggggaaaacaucuuucccuucuaguuuugagagacuuccucuuggcucccaggag

SEQ ID NO: 4161831 - RNA, 116 nt, Human
uuuuugguuuagaggcauuuuuucuuuaugacaugggaggcagucauaaugacaucuaagagcuuggagucacugggcugcuuccuauaacaucaagguuucuacagguuuaaaag

SEQ ID NO: 4161832 - RNA, 114 nt, Human
uuuuuuacaagccacguaguuuuugguauuuuguuauaggagcugaaauggacuaauacaccagccaacuucugaaugauaggagcagacagagacuauuuuaauuugaaaaaa

SEQ ID NO: 4161833 - RNA, 83 nt, Human
uuuuuuaugccucaucuuguuacagaauggacuuggggcgcuuucauaagggcauauaagcugugggagauuggcauaaagga

SEQ ID NO: 4161834 - RNA, 98 nt, Human
uuuuuucagcauugugccuuucauucuaauaauguuaauugagccccaauuuugugccaggcaauguguuagaagcgaaggauaaacuacugaacaaa

SEQ ID NO: 4161835 - RNA, 56 nt, Human
uuuuuucugggggaguuggagugggcuacaggccucucccaagugaccaggaaaga

SEQ ID NO: 4161836 - RNA, 55 nt, Human
uuuuuugcucugcacagaaguuauaagugcuuagcugaggugcagauccaaagaa

SEQ ID NO: 4161837 - RNA, 93 nt, Human
aaacaauguauuagcuucugugcauggacuuuguagcucuuuaaguuggagacuuuuaaguuaacuguauuaagaaguuuuguauguauguuu

SEQ ID NO: 4161838 - RNA, 71 nt, Human
aaacacuaauaacaguggcugguacaugguaaaagcuccauaaauguuagcauuacuauuacauaguguuu

SEQ ID NO: 4161839 - RNA, 78 nt, Human
aaacacuaguacaagcauucucagaaugucauuuuuauauauacuugauuagaaauggcaagaggauugccuguguuu

SEQ ID NO: 4161840 - RNA, 100 nt, Human
aaacacugcaccaugacaaagggcuuuugagcgcacgucugaagauccggccucuaacuucagcuaugcuacuaacagcccuucugaugcagagcuguuu

SEQ ID NO: 4161841 - RNA, 57 nt, Human
aaacacugcgugguggcaacucuguuagugagcgccauucuaaauuaugcuguguuu

SEQ ID NO: 4161842 - RNA, 76 nt, Human
aaacagacaacacauguguauaugugugugauauauauaugcauguucauauauauguguauguguuugucuguuu

SEQ ID NO: 4161843 - RNA, 63 nt, Human
aaacagcuccuuaguuuccaucugugccgucagcucucaucagaggaagcacaggagcaguuu

SEQ ID NO: 4161844 - RNA, 84 nt, Human
aaacagcugagugaagaaacauugcuuuuauugcugcagggaauaaaucaguuuaaagcaaguucucaucauuuauacucguuu

SEQ ID NO: 4161845 - RNA, 80 nt, Human
aaacaggugaaaauacuggagaaaggugcuauguuguuuuuaaacuauguauguuacuucuguaucugcuuucccuguuu

SEQ ID NO: 4161846 - RNA, 62 nt, Human
aaacauaugccagguuacaaaagugaggcugguaggaaucacauuuuccuugguaucuguuu

SEQ ID NO: 4161847 - RNA, 66 nt, Human
aaacauaugccuucuuuuguaacuuauuguuguuucaaguuacaagaucuuugaaggcaaguguuu

SEQ ID NO: 4161848 - RNA, 76 nt, Human
aaacauggacuuaagagucagaagcugaaguucaaauucugcaaaugacuagcugugugaccucaggucuguuuuu

SEQ ID NO: 4161849 - RNA, 84 nt, Human
aaacaugucaucaaucugugguuccaccacuuugggaaucuucaaacuuaaggagcagcagaauuugaagauuuuaaaauguuu

SEQ ID NO: 4161850 - RNA, 92 nt, Human
aaaccauuaugugucuuuuauuucucuucaaaauugauguaguguguaucaguaugauaauucgaugagaaaaugugaaauacuuaugguuu

SEQ ID NO: 4161851 - RNA, 60 nt, Human
aaacccuuuggugaagaaccagucguaacauuugacuguuaauucaaucaacagguguuu

SEQ ID NO: 4161852 - RNA, 59 nt, Human
aaaccgcacugggagccagcagccuucaagagggaaguugggaguuccuacugcgguuu

SEQ ID NO: 4161853 - RNA, 129 nt, Human
aaaccgcuuucaccuuucucucuuucuuccccucugagccucaggacuucucacugcccauccaguuuuuagaacuugaaccacagaagcugccuuaguggggagaaagugcuggguuuaagucaguuu

SEQ ID NO: 4161854 - RNA, 64 nt, Human
aaaccucuucucaagauuucuggguauuuaaauccucagcaucacagaaaucauuuugggguuu

SEQ ID NO: 4161855 - RNA, 70 nt, Human
aaaccuuaguggucauuguuaaggucacacagccaucgccugaaggugaccugacaguggcuucugguuu

SEQ ID NO: 4161856 - RNA, 79 nt, Human
aaacgaucgaauggauuguugcuucugagaaauuguuccuuguuuuuuggauaauaaacgaucuuccuuuugguaguuu

SEQ ID NO: 4161857 - RNA, 83 nt, Human
aaacgccaaaaagagaaaaaguacuauuuuaacaaaguaggaccauucuuuuaaaauguuaauugaguauuuuuugaguguuu

SEQ ID NO: 4161858 - RNA, 58 nt, Human
aaacuaagggaccagaggugaaaggcccagugacugcacugcugugguccuuuauuuu

SEQ ID NO: 4161859 - RNA, 57 nt, Human
aaacuauugagauguagcuggcaaugauccagcuucuuaguucacuuuuaauaguuu

SEQ ID NO: 4161860 - RNA, 118 nt, Human
aaacuccagcugcucaugaauauagggucagggagggccggcuaaauguuucucugugcuuucucuccagcacagccagcagagcuguuuccuguucuuuguuucaaggcugggguuu

SEQ ID NO: 4161861 - RNA, 67 nt, Human
aaacucuagcuacuaggauaacaucuguugguaccuaauauagagauauuuuacauugcuaguguuu

SEQ ID NO: 4161862 - RNA, 72 nt, Human
aaacucuuaggugucaggcagucagcauggagagcuucuuuucauccccugagugucuggagaugugaguuu

SEQ ID NO: 4161863 - RNA, 65 nt, Human
aaacugaggcuuagagaauuaagugauuuguccaaggucccuuaguuaguaaguuaggucgguuu

SEQ ID NO: 4161864 - RNA, 73 nt, Human
aaacugaguugguuaacugcaacuuggguaaaguaaauaaugaggccucagugcauguucacuggcaugguuu

SEQ ID NO: 4161865 - RNA, 64 nt, Human
aaacugcugguugcuggccagccaauguauuaauuguccuuggucaaaugccaaucuguaguuu

SEQ ID NO: 4161866 - RNA, 62 nt, Human
aaacuguuuaccauacacagugacucgaggaggcaggagucacuguuagaagugaauuguuu

SEQ ID NO: 4161867 - RNA, 129 nt, Human
aaacuuaaaaauuuagagaauagguuaucaguuagagaacacagaaaucuuuggauuaaaauauuuguaugaauaccaaguacuuuuuauaaugcaaagaaaauguuuuugccugucucuuuaugaauu

SEQ ID NO: 4161868 - RNA, 64 nt, Human
aaacuuauuaaacauuuauggaggcagcaacacaauucuguugguuuauguguuuggcaaguuu

SEQ ID NO: 4161869 - RNA, 80 nt, Human
aaacuugucuagaaaaggugucaggcuugggaaagugacauaugguggagcuuugccuguagcauuggccuagagaguuu

SEQ ID NO: 4161870 - RNA, 71 nt, Human
aaacuuuagagauguuggacccauagaguuaguggacaaacaagcacugugguggaagcaucaagaaguuu

SEQ ID NO: 4161871 - RNA, 72 nt, Human
aaacuuuggcgguggagguaguggagguaacggcgugagcuuuacagcacagugcuuuuacugaacaaguuu

SEQ ID NO: 4161872 - RNA, 83 nt, Human
aaagaaacagacuauauaagauuggcauuuuuaaaaaaucaggcauuuuuaaaaauagcuuuuuuggugucgugguugucuuu

SEQ ID NO: 4161873 - RNA, 114 nt, Human
aaagaaaggauguggcauuucccaaacauauuuaucucagagcucacaccuccuggaguaucuugggugggggaugagugcugggcaggaaauggguaugcuaaguaaagcuuu

SEQ ID NO: 4161874 - RNA, 61 nt, Human
aaagaaauguuaucagggaauuguccuagccauauaagggcaguccugcaaauaauucuuu

SEQ ID NO: 4161875 - RNA, 80 nt, Human
aaagaacagguggcauaggcaguuugaagucagauaaaccugaguuugaaucuuagcucugccacuuggacaaauucuuu

SEQ ID NO: 4161876 - RNA, 83 nt, Human
aaagaaguuacaguuacagaauggaguaguuguuuaccauuugcugcucucccuuuagauauucaaauugccccgacuucuuu

SEQ ID NO: 4161877 - RNA, 80 nt, Human
aaagaauuugcuucaaggcuuauuccaguuguugacaaaccuuaguuuguugaagcuguaggucugagguccuguuuuuu

SEQ ID NO: 4161878 - RNA, 61 nt, Human
aaagacugugauccaaauggccuauuuuccagugaaugccaacuuggauauacauuucuuu

SEQ ID NO: 4161879 - RNA, 79 nt, Human
aaagacuugagcuacacacuaggcauggggcaaagggauggugcugcuaccagugccaggugugguaguugaugucuuu

SEQ ID NO: 4161880 - RNA, 64 nt, Human
aaagagaggcugcuggacuauaugcccuuucugaauacuggggccucagauuuuguuucuuuuu

SEQ ID NO: 4161881 - RNA, 85 nt, Human
aaagagcagagaguaucgauuauauuauguaguuuuguccuaugcuauagacugaauaauuuuauaguugcugcugcugcuguuu

SEQ ID NO: 4161882 - RNA, 56 nt, Human
aaagagcuugcuugcuuuauaucauaggguuauaugaggcauuaaacaggcuuuuu

SEQ ID NO: 4161883 - RNA, 57 nt, Human
aaagaggugguauuuucugacacauucguugugaauccagaguaauuauuacccuuu

SEQ ID NO: 4161884 - RNA, 84 nt, Human
aaagaguccauguguauuuauccaugucagauugccccacaaaguaugguaggcagucucucaggugauccucaaagauucuuu

SEQ ID NO: 4161885 - RNA, 91 nt, Human
aaagaguucauguaugugugcgggaaggaaagugauauuuggggguugggagguguuacugaggguaccgaauacauauaaacaacucuuu

SEQ ID NO: 4161886 - RNA, 130 nt, Human
aaagauaacuguguuuaacauuuugcggaacuguuuuccauagcagcugcaucauuuuacagucccaccagugaugcacaaugguuccaguugcuauacagccucaccaacacauguuauagauuucuuu

SEQ ID NO: 4161887 - RNA, 75 nt, Human
aaagauacagauauagagauuuauagaugugagugggauuacugaaucauaugguaauucuaugucuaaauuuuu

SEQ ID NO: 4161888 - RNA, 73 nt, Human
aaagaucuccuuccucugagucaguuugguucugaguuuaagaagucaaagcuuucagaggaaaguuguuuuu

SEQ ID NO: 4161889 - RNA, 81 nt, Human
aaagauggguuuguuuguuauaacaauaaaaagucugggaaauagacuguuugggguuauuacaacuuggagaccguuuuu

SEQ ID NO: 4161890 - RNA, 71 nt, Human
aaagauuaggcggcaacugggcuuagagaccaccugcugucacugauuguccccacugcuggcuaauuuuu

SEQ ID NO: 4161891 - RNA, 84 nt, Human
aaagauuccagcucaguucuucaagugcuucgguucuuauuaaauuuguggaauaugcacacguagaagaacuugacuuucuuu

SEQ ID NO: 4161892 - RNA, 70 nt, Human
aaagauuguacaggaacaugucuccaauuagacagaagucucucaggaggcagguuccuacaagguuuuu

SEQ ID NO: 4161893 - RNA, 76 nt, Human
aaagcaagggguuuagacaagaugacagaggucuuuccagcucugacauucuauuucaucaugucuagugugcuuu

SEQ ID NO: 4161894 - RNA, 63 nt, Human
aaagcacauaguagaaggauuugcugagcaaagaauuaaagcaaaguccacuguaugugcuuu

SEQ ID NO: 4161895 - RNA, 77 nt, Human
aaagcacuccugaugugggcugaugacauuucuaacauaacauuuagugcuauacauguacauauuaguacugcuuu

SEQ ID NO: 4161896 - RNA, 74 nt, Human
aaagcuauccaccaagucccacuauaauuugaaagacauacugaaaaguaguauugggacuugggagauguuuu

SEQ ID NO: 4161897 - RNA, 71 nt, Human
aaagcucagcaugucuccuagaacuagcuaauaacacaaaugcggugaauaggauuuugugcuugagaguu

SEQ ID NO: 4161898 - RNA, 63 nt, Human
aaagcucucugaacaccagaccacucuuaacuauauuuaaguggcuggguucaucagaguuuu

SEQ ID NO: 4161899 - RNA, 61 nt, Human
aaagcugcuuugguuucuggaaucuaagaaaacacuuaccucauugaauuaaagcugcuuu

SEQ ID NO: 4161900 - RNA, 56 nt, Human
aaagcuguuaaaugcauaaugccacuuggcaaaacuacugugcauuuaaugguuuu

SEQ ID NO: 4161901 - RNA, 55 nt, Human
aaagcuucuaggccuauugcuugucacccauuauggcacuggccuggacuguuuu

SEQ ID NO: 4161902 - RNA, 66 nt, Human
aaaggaagaagaaaggcaauacuugcaaccaaugauaaagagguauucugacuuucaucugccuuu

SEQ ID NO: 4161903 - RNA, 129 nt, Human
aaaggaguguuuuugaagggaggcagugaaagcccuauucccugggcuuggggguugcuccuuggaaauguuuccauagaaccacccagagccuuuugggcuaaauuuucaguucagauuacucuuguu

SEQ ID NO: 4161904 - RNA, 70 nt, Human
aaaggaguugaucaucuaagaguaauaguuaucuguaugguaguuuaucauuagcaaugaucaaaacuuu

SEQ ID NO: 4161905 - RNA, 74 nt, Human
aaaggaugaacuuucagcagugcugaaaaucacguaauauuugugcuugucagugugcuagaaacaaaucuuuu

SEQ ID NO: 4161906 - RNA, 59 nt, Human
aaaggauggcucugcauauuuguguaccaaccagaaauagauugcugaggcauuacuuu

SEQ ID NO: 4161907 - RNA, 67 nt, Human
aaaggccacacaacucuuagagauuucagauuaaauuguguauaucucucaggaagguguggaauuu

SEQ ID NO: 4161908 - RNA, 61 nt, Human
aaaggcuauucagggacuugcccugcagagacaguagcaaaacaagucucugaaagcuuuu

SEQ ID NO: 4161909 - RNA, 78 nt, Human
aaaggcucccagcugcgggcagccugugggaaacagagacccuccuggcccaaagcagcccagcagguggaggccuuu

SEQ ID NO: 4161910 - RNA, 64 nt, Human
aaaggcuucucagaaaggccuugcuuauguagucaaggaucaauauuuuugaaaagaaguuuuu

SEQ ID NO: 4161911 - RNA, 65 nt, Human
aaacaagcaggaggagaaguuucugacauuuccuucuccagaggccuugucuucuuugcuaguuu

SEQ ID NO: 4161912 - RNA, 72 nt, Human
aaacaauauucagaaaugaauauugguauucauaacacaagugaaugccaauauucauuuguguuaguguuu

SEQ ID NO: 4161913 - RNA, 59 nt, Human
aaacacacugaccuccuuugugguuguugaggaugaucacaguugaggucugguuguuu

SEQ ID NO: 4161914 - RNA, 105 nt, Human
aaacacagcuugccuaccuuauuauuuuagcacugaggauuacaggcuaggcuuggaaagauguucagugguugaccauaaauaaaggcagcagguuuuguguuu

SEQ ID NO: 4161915 - RNA, 130 nt, Human
aaacacaggauuccuuugcaccuuggaaauucugauuagguagcucugggguggagcccaggaaucuguauuccuaaagggcucuccagauuauuuugaugaggaccaugcugugagaaaugcuguguuu

SEQ ID NO: 4161916 - RNA, 55 nt, Human
aaacaccagucccaguauacacuguaaaggugugugcagaacagggaguggguuu

SEQ ID NO: 4161917 - RNA, 71 nt, Human
aaacaccaugcaggcagauauguucgcuuuaaauacaacuuacugugcuguauauuugccucauauugauu

SEQ ID NO: 4161918 - RNA, 57 nt, Human
aaacacuugaaaguaaugguugugcugcuucaggauaguacaaccucaucaggguuu

SEQ ID NO: 4161919 - RNA, 64 nt, Human
aaacagagugaaaguauucacaaaguucuugauggugaccaccauuucaaugcuugcucuguuu

SEQ ID NO: 4161920 - RNA, 96 nt, Human
aaacagcuuugacagaauuucuuuugaggugguccaaagacuguuuucuggaacauaaaaagcaucuauauuccacugugauuuuguuaacuguuu

SEQ ID NO: 4161921 - RNA, 61 nt, Human
aaacaguauaugaaauguuaggauauucuaaauuggauaucuguauuuuaagaugcuguuu

SEQ ID NO: 4161922 - RNA, 91 nt, Human
aaacagugguacaaucuuuccaguccuuucugaaauccuauacucaaccaugguaucaguccucugagaagaccaaagauagcacuaguuu

SEQ ID NO: 4161923 - RNA, 57 nt, Human
aaacauagcacacacagcucuuguccacuugggagauuucugugugugcauguguuu

SEQ ID NO: 4161924 - RNA, 69 nt, Human
aaacauucauaggaggagaugauuaauuacuguuugaagagugcuuugagauccucuaaugaaggguuu

SEQ ID NO: 4161925 - RNA, 78 nt, Human
aaacauucucagcccugcuugcucugccugucuucuaucuuuguggaccugguuugcauuugggguguggggguguuu

SEQ ID NO: 4161926 - RNA, 123 nt, Human
aaacauugagcuacacuuucuagacuucuuuccuguugacuuuuaguuagauucugccacugaagcacuaguauuagacuaaaagucagaauaaagggagaagagauaaucugccuuauguuu

SEQ ID NO: 4161927 - RNA, 78 nt, Human
aaacauugguacacaaaagaggaaaccggagcagauuucugcauucauuucuauuuuuauuguguucugcuuuuguuu

SEQ ID NO: 4161928 - RNA, 57 nt, Human
aaacauuuuucuucaucauccugaaaccgagcagugaugauccgcugaggaauguuu

SEQ ID NO: 4161929 - RNA, 64 nt, Human
aaaccaauguuuuaggaaguugaggagcuugcucaaagcuacaauuguauaaagcaaaugguuu

SEQ ID NO: 4161930 - RNA, 69 nt, Human
aaaccaauuccauccauuuguuucaacaguaccuaauguuuaauuaaaugguguggagaagagggguuu

SEQ ID NO: 4161931 - RNA, 113 nt, Human
aaacccacacagcccugacccccucgugcucuggcuggucucccggucagcagccccugagggccggcaggcaggccacugagcugugggugacacaggguaguccacgguuu

SEQ ID NO: 4161932 - RNA, 63 nt, Human
aaacccagagacuagaaagaccaggguguguuguggaaggagcuuacugugucugauggguuu

SEQ ID NO: 4161933 - RNA, 56 nt, Human
aaacccauggcugauaucacuaauggaaauccagagugcugacaguauguggguuu

SEQ ID NO: 4161934 - RNA, 67 nt, Human
aaacccucaaaacaaccuacaugugccagagugcagcacuggccuugugaguuauuuucaggaguuu

SEQ ID NO: 4161935 - RNA, 58 nt, Human
aaaccuguuuuuucacugaccuuuagauguuuagacucuucaguggaugaacauguuu

SEQ ID NO: 4161936 - RNA, 59 nt, Human
aaaccuuucugcucucagcguagacugcuggaaagcacuuccugugggcaggaggguuu

SEQ ID NO: 4161937 - RNA, 75 nt, Human
aaacgcugcucaugucuuggcuuaggcacagacuuccagggucuggguccuggaacaggaggugugccgguuuuu

SEQ ID NO: 4161938 - RNA, 57 nt, Human
aaacggagcaaggugugccuggaacuuuucuugaguggggcaucuuugcuccuguuu

SEQ ID NO: 4161939 - RNA, 66 nt, Human
aaacgggggcucucaggucuccccaaauuuagcuguauuuggaccuggaggcaggaguugcuguuu

SEQ ID NO: 4161940 - RNA, 98 nt, Human
aaacgguggccgggagcugcgcagugcccuuccaggacugcaggagugguuguggccguggcugcagggcagggccuccuggcacguggccgcuguuu

SEQ ID NO: 4161941 - RNA, 101 nt, Human
aaacuaugauuuaagaauaugacauugaauauguuaacuagacucacuugagauggauagucacuaacaguucauuguagcccuauucagaucacagguuu

SEQ ID NO: 4161942 - RNA, 84 nt, Human
aaacucuaaacuguuuugcaaaccggagcucugcaagccauauugagcucacacaagccuuugguuuguuggaacauagaauuu

SEQ ID NO: 4161943 - RNA, 130 nt, Human
aaacugaaccuguaagaagugugccuggcaagaacuauguguccuguuaccggcagcuuucuauggaagccuggcugcauguauuaggagacauaucaacucaggaggaacuucuuuaaauugacaguuu

SEQ ID NO: 4161944 - RNA, 55 nt, Human
aaacugaggaaugacagcauuauccuagaugguuuguguuauccuuucuggguuu

SEQ ID NO: 4161945 - RNA, 99 nt, Human
aaacugccgucuuaacgguguugcuuuuacugauaauaaugcuaucuuuuaaaccaaagaagacaucagugaugacauuugacuuuaacauggcaguuu

SEQ ID NO: 4161946 - RNA, 58 nt, Human
aaacuguuuuggcuauucuggggcgcuucaauguccauaugaauuuuagaggcaguuu

SEQ ID NO: 4161947 - RNA, 74 nt, Human
aaacuguuuuugcauuauguuuaauuguuggucuuucaugauaagacuaacagagauagaaauguaaagaguuu

SEQ ID NO: 4161948 - RNA, 84 nt, Human
aaacuugagcugcugcagcuggcucaugggauaucugagcaaggacaacuguauacccugaggcagcugaacagagaaggguuu

SEQ ID NO: 4161949 - RNA, 76 nt, Human
aaacuuuaucuacucugugcuucuuauugguguuugguuucaagcuuuggggguagguauagaguagcccuuguuu

SEQ ID NO: 4161950 - RNA, 78 nt, Human
aaagaaaaagaugcuuauugcuccugcaguguucucucucaggaccuuucugcucuaggucauggguacuuugucuuu

SEQ ID NO: 4161951 - RNA, 74 nt, Human
aaagaaacuucaagaugucuucacaauaguuagcauacauuauuguuuagauguauugguccagugguuuuuuu

SEQ ID NO: 4161952 - RNA, 63 nt, Human
aaagaacauucgccucaaaccaggauaucucaacgauuggcguuugaaagugggugauucuuu

SEQ ID NO: 4161953 - RNA, 66 nt, Human
aaagaacugagugaagggucgccaccagggugcuuguggacacagguggcuucuuucaucuucuuu

SEQ ID NO: 4161954 - RNA, 72 nt, Human
aaagaagacaagccuuguuuuucugcaucuggaaauauguuauagaaaacccaggguuugauuuucuucuuu

SEQ ID NO: 4161955 - RNA, 73 nt, Human
aaagaagugagguggcuagggaggcacucucaggaaugagaaggaccuucacccuggccuccuuguugccuuu

SEQ ID NO: 4161956 - RNA, 56 nt, Human
aaagaauuuguacacccuacuacagagcuuggcaguggggaaucaacagauucuuu

SEQ ID NO: 4161957 - RNA, 122 nt, Human
aaagacaaauguuguauuauuccacuuuucuaaggcaccuagagucaucaaaucuauagagacagacuggacaaugguggcuaccagguccuggggaggguggugauuggggaguuguuuuu

SEQ ID NO: 4161958 - RNA, 95 nt, Human
aaagacacagcuuucucucagccaggcugcaugaauucaggauuugcauucucuugguuggggcugggcugagagaagguggaaugcguguuuuu

SEQ ID NO: 4161959 - RNA, 55 nt, Human
aaagcacuuugagacugacagguguuuaugaccugugcacauuuuccagugcuuu

SEQ ID NO: 4161960 - RNA, 68 nt, Human
aaagcagagaggagcacaaagugaaguuaauuugguuggcuugcuuuaucugguuucucauuuucuuu

SEQ ID NO: 4161961 - RNA, 55 nt, Human
aaagcagcagaaucucucaggggcagcgaggaccuugagguggucucuguguuuu

SEQ ID NO: 4161962 - RNA, 69 nt, Human
aaagcagucuguuuuaaccugaaauaauucuguugauauuugaaucacuuucagugggacauuugcuuu

SEQ ID NO: 4161963 - RNA, 102 nt, Human
aaagcagugcuucuuaaacuuuaaugugcuuaggaaucaccugcagaucuuguagagcugcaaguuccugggugauccugauguugcgguagagcaugcuuu

SEQ ID NO: 4161964 - RNA, 58 nt, Human
aaagcaucagaucugacacuucguuguagcauuugcagugugacaguccugcugcuuu

SEQ ID NO: 4161965 - RNA, 70 nt, Human
aaagcauggaggaguuuucugguacuggguuccacagggaaagcacaugcuaauuaauuccaccugcuuu

SEQ ID NO: 4161966 - RNA, 123 nt, Human
aaagccaucacaggacuagagcuaggacuaggacaggacuagagcauuucuaaugcuuuuuagagcaucucuaaaaagagaaaugcucuaguccuguccauaccugcgacugugagaacauuu

SEQ ID NO: 4161967 - RNA, 73 nt, Human
aaagcccuggccagacaccaguucauuaguggaaauaaaagcuuccuaaauugcagggaacuggcugggcuuu

SEQ ID NO: 4161968 - RNA, 92 nt, Human
aaagccguuguuguagaugacuccugaagucagcucugggaggcaccguggcuuguugggauguuucagagucuggcugcagccuggacuuu

SEQ ID NO: 4161969 - RNA, 90 nt, Human
aaagcggcuugauggaauguaugcagccugggaugagagucagcuagcuggauucuggccuuggcucugucacuucauccaugucacuuu

SEQ ID NO: 4161970 - RNA, 70 nt, Human
aaagcuaucaugaguuuuuaagaguaaggacaguguacuaugucuucuucauguauacucaugguacuuu

SEQ ID NO: 4161971 - RNA, 76 nt, Human
aaagcucuggauuccuauuuuauaucaucuucuuuaggacagauacuauaauguaaagugggaaguguuuaguuuu

SEQ ID NO: 4161972 - RNA, 59 nt, Human
aaagcucuuauagcagagugugauuugggaacuaaccaacagacucugugugagacuuu

SEQ ID NO: 4161973 - RNA, 63 nt, Human
aaagcugacuagcauuuagugcuguaaacauuuucaaaagcauaaagcuagaaccuuagcuuu

SEQ ID NO: 4161974 - RNA, 56 nt, Human
aaagcugcugugaaugguuuggggucuuccacuucugucguucaacuggcugcuuu

SEQ ID NO: 4161975 - RNA, 88 nt, Human
aaagcuuaaauaaucuauauaggaugauaaaauuagaaacuggggaaccaagaaguuugauuuuucuccuagaccucuggauagcuuu

SEQ ID NO: 4161976 - RNA, 63 nt, Human
aaagcuuagaggccaguggagggagaacuuaggaguucuacagggcauuugucucucagcuuu

SEQ ID NO: 4161977 - RNA, 130 nt, Human
aaaggaaaaacuaaaaauuuuugaauggcaaggagagaauuacugggugucauauggcuggugucauauggcugggugcuauccaguacuuuaauuuggguucuuuaaguucauaguagucugcgccuuu

SEQ ID NO: 4161978 - RNA, 77 nt, Human
aaaggaacuuuguaugugauaagacuauucuguaucuugaugggguauguuauguauacacugcaaucaguuccuuu

SEQ ID NO: 4161979 - RNA, 75 nt, Human
aaaggaagcagaguugaauugaugcuguucccagugucuguaaacuuugagaaguaugaauucauuguuuuaguu

SEQ ID NO: 4161980 - RNA, 67 nt, Human
aaaggaaugcgaggaaagagauggaaaauguauaaaccccauuucuaguccucaugcaucauucuuu

SEQ ID NO: 4161981 - RNA, 56 nt, Human
aaaggagccuccgaacuuuguuuuaaaucuugaggggacaaagugcgugcucuuuu

SEQ ID NO: 4161982 - RNA, 91 nt, Human
aaaggagugaagaaaacagucauuguauugaggauacuuaagguuggagaacuuucuucuuaauacuggcugcuaggggcuuuauuucuuu

SEQ ID NO: 4161983 - RNA, 69 nt, Human
aaaggaguuaccaauucagacaucucuuccacuuguggugaugguuaaguuagguaagugaccucuuuu

SEQ ID NO: 4161984 - RNA, 117 nt, Human
aaagggccuugaaugauuuuuuguucauuuucuguuuacauguaauguguuauugaugucauuaccuuauaauacggcagcuuguuucauagaaaaaccaggaauuauucauucuuu

SEQ ID NO: 4161985 - RNA, 68 nt, Human
aaaggggaagccagcggccacugugucuggacauucccauggccacacaguucguuguuuucuacuuu

SEQ ID NO: 4161986 - RNA, 67 nt, Human
aaaggugguuaacguuggaucacuuguaaaacggaaccucaaggagucuaaacaaaaaugcaccuuu

SEQ ID NO: 4161987 - RNA, 130 nt, Human
aaagguuccuuuuccaauuguggggguuagugagacaaaguguaugaaaagcauaaacgcugaagugccauguugguauugcuuagcaacacuuuguucacacugucacguauugcacugcauuuccuuu

SEQ ID NO: 4161988 - RNA, 60 nt, Human
aaagguuuauugauucugcucuuaauuucuguaaggcaaagagcugaguuauuggccuuu

SEQ ID NO: 4161989 - RNA, 70 nt, Human
aaaguaaaaacucuacauggucgcaaaaauguguuuauuucuaauguccuuguggggucauuguugcuuu

SEQ ID NO: 4161990 - RNA, 59 nt, Human
aaaguaagauuugcauuucagauagaugcuuuuacauggaauacagaucuuuagacuuu

SEQ ID NO: 4161991 - RNA, 98 nt, Human
aaaguaaugaucaauuuauguauaaaugauuacaguauuugagauccaagauccuuggaaaaucugauguugcaaucaaaacauaauugagcuauuuu

SEQ ID NO: 4161992 - RNA, 64 nt, Human
aaaguacauguaauuugggucaguucuguaaccacauuaguugagcuccaaaaucauguauuuu

SEQ ID NO: 4161993 - RNA, 80 nt, Human
aaaguacugccuuuauaugcuuuuaaccuguaacugaaacuuucaguuuuguugcauuucaaguaugagagguacacuuu

SEQ ID NO: 4161994 - RNA, 79 nt, Human
aaaguaggagccagaggguugucaggcgccuugucaccauguggacagaggaucccaucagcucuuccucucccucuuu

SEQ ID NO: 4161995 - RNA, 85 nt, Human
aaaguaucucauaaaccauuaaucucacaaggauaaaauaaaagauaaaguauuauccuuggucugguggaguugguggagcuuu

SEQ ID NO: 4161996 - RNA, 65 nt, Human
aaaguauguguaaguaugccaccuucuggauaacaagaggggguaaagauacuuauauguaguuu

SEQ ID NO: 4161997 - RNA, 71 nt, Human
aaaguauugggacuuagugaagacuuacucccuacuucccuagugaaaucuucacuaagucucuucgcuuu

SEQ ID NO: 4161998 - RNA, 56 nt, Human
aaaguccuugcaguuuccucuuacugaacugaaagaggugggaacugaggggcuuu

SEQ ID NO: 4161999 - RNA, 130 nt, Human
aaagugaagccagcuaaaagcuuugucagcucgcucuugaaagcaauaauauggucacaaaacuugcugugaccauucugucucuuuacaaauuuuguaaggcuggccugcuuuuuucuuccuucuaaau

SEQ ID NO: 4162000 - RNA, 94 nt, Human
aaagugcaagguuuuagcauucucugugugcauaaaguuacuuucuuaaugugcuuuauguaugaauauaguagaaguuuuuaaccuuaauuuu

SEQ ID NO: 4162001 - RNA, 57 nt, Human
aaagugcugggauuacaggccugagccacugcacccggccugaaucauccagauuuu

SEQ ID NO: 4162002 - RNA, 71 nt, Human
aaagugugcgucuuauuucagggcaaaguucuuaagugaauugucaaacacaaauaagagucgcacgcuuu

SEQ ID NO: 4162003 - RNA, 56 nt, Human
aaaguguugggauuauaggcgugaaccaccaugccuagccugucuucguauacuuu

SEQ ID NO: 4162004 - RNA, 64 nt, Human
aaaguuagaagcacaaaguguaguuccgaagagaaccucuugcugccuuucguguuccuccuuu

SEQ ID NO: 4162005 - RNA, 71 nt, Human
aaaguugaccgaaagauuuugaaaauccuuaccaguuguuugucauauguuaaagucuuaugguuaauuuu

SEQ ID NO: 4162006 - RNA, 64 nt, Human
aaaguugaguaggguuugggccuuuuacaugaacucuguauuuuccacaagcccuguuauuuuu

SEQ ID NO: 4162007 - RNA, 64 nt, Human
aaaguugugguuugaugcaguugcuggcauagauuuauaugcaauugcauaaauuauauacuuu

SEQ ID NO: 4162008 - RNA, 98 nt, Human
aaaguuuggauuuguaauucuaaaugcagaguaaauauuuaauucuugaucuaagagugagagguuaguucaguaauaagacuugcuaaucccacuuu

SEQ ID NO: 4162009 - RNA, 94 nt, Human
aaauaaaaaucagggacugacaagguugaauugucccaucuuguaagcaaaucuuuuacuggaauuuugcuuugucaggccaggucuuuuauuu

SEQ ID NO: 4162010 - RNA, 63 nt, Human
aaauaagagcauguaauuggauuucugaaaagcauugucaguccucuggaguaugccuuauuu

SEQ ID NO: 4162011 - RNA, 66 nt, Human
aaauaaguuagcagauuccaguacauucuuuggaaugaaggcaggauagggauaugcugaguauuu

SEQ ID NO: 4162012 - RNA, 76 nt, Human
aaauacagaaauugccaccagcucuguaugagagaacccacacagcuccagagcuguggucugauuucauguauuu

SEQ ID NO: 4162013 - RNA, 57 nt, Human
aaauaccacaugagaaaccuaguuaaugaugaagcuaggaauuuugcaugggaauuu

SEQ ID NO: 4162014 - RNA, 78 nt, Human
aaauagaauggaaugaaaaacacaugcaacuggaguuauuaagcuaguauugcucuuuuguauuuuaucuuucuguuu

SEQ ID NO: 4162015 - RNA, 80 nt, Human
aaauagaugguuuuuguuguuuguuuuuaaaggaguuagacauagccuaacaaacuggaaauugacauuuccaucuauuu

SEQ ID NO: 4162016 - RNA, 80 nt, Human
aaauagauugagccaaagcaggaagaauauugaaaaguaagauccuuaucuaguuugucuagcuuugcaaaaucuuauuu

SEQ ID NO: 4162017 - RNA, 58 nt, Human
aaauagcagcuuugacagcacagcuucugcuaggcuaugauaguuaauauugcuguuu

SEQ ID NO: 4162018 - RNA, 76 nt, Human
aaauagggggcauuauuucccaugguacucaaaacuuccuagagugucaugccaggaaauagucccugaucuguuu

SEQ ID NO: 4162019 - RNA, 66 nt, Human
aaauauauuaaauuuaggagguuugaguuagacuucugauucuggcuguaugauauuuaauaauuu

SEQ ID NO: 4162020 - RNA, 96 nt, Human
aaauaucuccuggggagccccugccuugucugggcuaggugagaggcacaucgaucccgcguaaggccccgucuggggaaauccuggaagauguuu

SEQ ID NO: 4162021 - RNA, 76 nt, Human
aaauauguacagauauguguguacaguuguuuuauauaacauuuuauacaaaugacauguauaucuuacgcuauuu

SEQ ID NO: 4162022 - RNA, 56 nt, Human
aaaucagcagcaccuguaagccgugaguggcacaggacacaggguguggcugauuu

SEQ ID NO: 4162023 - RNA, 57 nt, Human
aaaucaggaggccggcaggauuugaccuggaggucagaguuugcugaccccugcuuu

SEQ ID NO: 4162024 - RNA, 77 nt, Human
aaauccuagauauacuguagacuggagugcugaagugaauuacacaugaggugcccagucucacguauacaggauuu

SEQ ID NO: 4162025 - RNA, 76 nt, Human
aaauccucacccuccacuuuaucugucuuuagcacgaaugcagagaccuccuagggaagugugaagggauggguuu

SEQ ID NO: 4162026 - RNA, 68 nt, Human
aaaucgguuucauuuccagugucagcuuugacugauuggucauggcugccuagaggugagauggauuu

SEQ ID NO: 4162027 - RNA, 127 nt, Human
aaaucuuucugaguggugacuggagcuuucuggaguggaaagguauuguaaaugaaagaaagacaggugccaccucuacuccaggguuaucgagagcuugucugaaauacuuuguaaugaaugauuu

SEQ ID NO: 4162028 - RNA, 119 nt, Human
aaaugaaaaggugacccuacaaaucugaggguuuugcaucccacagauguuguauuuucuauucacauuuuguggcagaugcagaaccugcagauacagagggcugaccauauuuauuu

SEQ ID NO: 4162029 - RNA, 73 nt, Human
aaaugaaaggugcgccaaagguccaucugcuguguggggguagauuuacuggagucuuugguguucucaguuu

SEQ ID NO: 4162030 - RNA, 90 nt, Human
aaaugacaaaaagugauggcaaguauaucaagaacugaaucaaugccuccuaaucuaguugauuucuguauguaugccagagcaucguuu

SEQ ID NO: 4162031 - RNA, 64 nt, Human
aaaugauggaaaugaggcugaaucuguggaaaaucagguuuuagcuaaucaguuucagccauuu

SEQ ID NO: 4162032 - RNA, 61 nt, Human
aaaugcaagaucacaccaaacacgugccaucacaauuuguguuagauuugaucuugcauuu

SEQ ID NO: 4162033 - RNA, 58 nt, Human
aaaugcaaggccaugugaaggaaaauaccaguuuucugagcagcuuuguuuuguguuu

SEQ ID NO: 4162034 - RNA, 76 nt, Human
aaaugcagauucuugaguucuauccacagagauugugaaucaauagguucugggugggcccgagaaaucuucauuu

SEQ ID NO: 4162035 - RNA, 70 nt, Human
aaaugcagcugggcaugagaggggaggcucagguacugcagcugugaaaccucugcucgggcaugcguuu

SEQ ID NO: 4162036 - RNA, 75 nt, Human
aaaugcaggugcugauaccuacucccaauguuucuaauuuaauuagucuggagugaggugugggcaucaguauuu

SEQ ID NO: 4162037 - RNA, 63 nt, Human
aaaugccagggucauccccugggucuuugacucccgaucccagcauuuaaauccuggccauuu

SEQ ID NO: 4162038 - RNA, 67 nt, Human
aaaugccugaaugguauuugguucuguugugaauugagacagaguuaauaaauauuauuugguguuu

SEQ ID NO: 4162039 - RNA, 88 nt, Human
aaaugcucuuuguguagacugggauucucccugaucaaugaagcagauugaaccagggaaccauucuugucacauaugaagaaaguuu

SEQ ID NO: 4162040 - RNA, 84 nt, Human
aaaugcugaguaauuucuuacggagaccuuacagauacaguucuuuuuucuauuguuuccccggaauuauucagaaaagcauuu

SEQ ID NO: 4162041 - RNA, 59 nt, Human
aaaugcugaguguuuagagaucaaaggcuuccuuaauggaugucugaaucucagcauuu

SEQ ID NO: 4162042 - RNA, 62 nt, Human
aaaugcuguaacugauauucugggaaaacaaaccugguuccagaagugcagcugugguguuu

SEQ ID NO: 4162043 - RNA, 69 nt, Human
aaaugcuucacauuucucaugaagcugagguagcccagcauucucuacuuuagaaaucuggauguauuu

SEQ ID NO: 4162044 - RNA, 64 nt, Human
aaaugcuucaccucauuaaacuuagaaggcaaugacauucauggcaggaugggguggggcauuu

SEQ ID NO: 4162045 - RNA, 58 nt, Human
aaauggagaggcugugagugagagccucguguacucucaaguagaagccucccuauuu

SEQ ID NO: 4162046 - RNA, 55 nt, Human
aaauggaggauuuugagcugcagccagaaaaacaguagcaaugaguguuccauuu

SEQ ID NO: 4162047 - RNA, 87 nt, Human
aaaugggauggcauuuauuacccagaaaguucugaaaaaacuuaucaggagauacuuguuuucuagggugcuaaaugaacccuauuu

SEQ ID NO: 4162048 - RNA, 76 nt, Human
aaauguagauucuuggaucccauuugccugagguucuaauucaaaggucuggaauaagguccaggaauuugcauuu

SEQ ID NO: 4162049 - RNA, 66 nt, Human
aaaugugacagcuuaauuagugggauaaauagaaaauauggugccacuucuuaggcugguacauuu

SEQ ID NO: 4162050 - RNA, 102 nt, Human
aaaugugggcuuuuauuccaauauucauuaaaaugcagugguucaagugacugaaucuguaaccuguguuaagugaauguuuuuuggauaaaaguuacauuu

SEQ ID NO: 4162051 - RNA, 75 nt, Human
aaauguguauuuguaucaaucucaauauauugcuuuggaaacauuaugugguugguugcauaugugugugcauuu

SEQ ID NO: 4162052 - RNA, 128 nt, Human
aaauguucauuuccuuugcuuuuacuuacaauuccaacauaguacccagauaaaugacagggcuuuagguauacuuucaggucucuuucucauauuacugaucaacuggaauaaggagaugggcauuu

SEQ ID NO: 4162053 - RNA, 117 nt, Human
aaauguugacaaaaacacacaaaaauaucuuaaucagugguauaguauuugaugauuucuaucuauacuacaaauggcugguggguugaguuuuuuguguauacuuuugaagcauuu

SEQ ID NO: 4162054 - RNA, 67 nt, Human
aaauguugaccuccugaauguuuucauaccaguuuggauuggaaaacagaaggguagguaaacauuu

SEQ ID NO: 4162055 - RNA, 76 nt, Human
aaauguugugaguuaauaucgugguuucaggggaacaauuuuucuccucaaaucuuuagaguuauuuccagaauuu

SEQ ID NO: 4162056 - RNA, 76 nt, Human
aaauuaagccguauuucuugaguggucaguuucuaaaauaguagaagagaagcaucaauagguaauggguuaauuu

SEQ ID NO: 4162057 - RNA, 76 nt, Human
aacucaaacuguccaagaaucugguggauuuaaaguuucaaagaaaaacuaaaaccuucagguuuggaguuugguu

SEQ ID NO: 4162058 - RNA, 69 nt, Human
aacucaugguacuaaguugaguuuaauauguuugccacaaaagccaacugcaacuucguaaagugaguu

SEQ ID NO: 4162059 - RNA, 79 nt, Human
aacucgggcuuguucauaaagacaguucagaaaccucuguccuauacuuuauguaauagaauaaagccccuuuggaguu

SEQ ID NO: 4162060 - RNA, 57 nt, Human
aacucuagcucacuggggauuggagaacaccaagucucaguuuugcuagcuggaguu

SEQ ID NO: 4162061 - RNA, 103 nt, Human
aacucuaucaaauguacuaacacuucccuugaaagcuuugcgucuucuagcuuacccggcaggguucugggaggccaccaagcccaagagaacagugagaguu

SEQ ID NO: 4162062 - RNA, 123 nt, Human
aacucuauuaaucuaaacaaggaauccuauuuucuuugugugaagaaaaaaccagcagauaaauuucuaagugucacaaagagaauuguggguguaaaguuguuguuauuauuaauaugaguu

SEQ ID NO: 4162063 - RNA, 60 nt, Human
aacucugccuuucucacucaggcuuuucuugguugacagguuugucucagaggcagaguu

SEQ ID NO: 4162064 - RNA, 73 nt, Human
aacugagucauucgcacaagggaauggcuagcuguaucagucacauucauggugcuaauaaaagagcucaguu

SEQ ID NO: 4162065 - RNA, 73 nt, Human
aacugauguuuuuacuauuguccuucgauaauuuaucagagucagugucagugcuauagugggaauaucuguu

SEQ ID NO: 4162066 - RNA, 56 nt, Human
aacugauuucaaguucaguuucucacaaaacagagauugaaagucaacaaucaguu

SEQ ID NO: 4162067 - RNA, 66 nt, Human
aacugcaagcucuuuacugcuagcuugaaaaauggggagcucuagacacuguaaagaauugcaguu

SEQ ID NO: 4162068 - RNA, 78 nt, Human
aacugcagcaggagcauguccuuaaggcacagaucacucaugcuauuguuuguggcuuaagaaugccuuuaagcaguu

SEQ ID NO: 4162069 - RNA, 86 nt, Human
aacugcagcuugcacagagaauacaguauagguucuuuugacuuugggcaugagucuguaacugugugcucuguggagacccaguu

SEQ ID NO: 4162070 - RNA, 69 nt, Human
aacugcauaauauaucaugcagacuauaccacaguuauauuaaacagucugcuauauugaagugcaguu

SEQ ID NO: 4162071 - RNA, 64 nt, Human
aacugcauuaucaccaagauguaaccgaacccccucgguuugucccuaugagugguaaucaguu

SEQ ID NO: 4162072 - RNA, 62 nt, Human
aacugccuguauugucugcuugggcugccauaacagugaaguuaacagaguacagaguuguu

SEQ ID NO: 4162073 - RNA, 129 nt, Human
aacugcucaaggaaccuggaucaucagcuucuucucuguaucagcaccugcugggcugcuagaaaggugaucaggagauucagcagggcugggagcugugacccaauuggaucccuaaauugagcaccu

SEQ ID NO: 4162074 - RNA, 55 nt, Human
aacuggaauauaaugugguaggugcaguagcaggguccacaaaauuauuuuaguu

SEQ ID NO: 4162075 - RNA, 61 nt, Human
aacuggcauaugaacuuguucuucuuguauacagcucugagcaaagcaccauauggcaguu

SEQ ID NO: 4162076 - RNA, 75 nt, Human
aacugguaacgccuucucucaaaggguuagguuaucauuagcuaguaaaaugcuuugagggaagaugaaaaaguu

SEQ ID NO: 4162077 - RNA, 95 nt, Human
aacuguaguauuagguuggugcaaaaguaauugcgguuuuugucaucacuuucaauggcaaaagccccaauuacuuuugcagcaacuauauaguu

SEQ ID NO: 4162078 - RNA, 57 nt, Human
aacugugggaugcauuaauucauaauuucacaccugaaaugauaagcucccacaguu

SEQ ID NO: 4162079 - RNA, 105 nt, Human
aacuguuuauccuggaauacacugcauagaguugucaguuugagaagcaacuugauuucaaaucugagucuacaauuuuagcguguuuccuugugacuucuaguu

SEQ ID NO: 4162080 - RNA, 95 nt, Human
aacuuaccucguuuuugauuuagccaauauuauauguccauagauuacuuugcaggacauuucuauugagcuaagaccaaccacaaggcuaaguu

SEQ ID NO: 4162081 - RNA, 61 nt, Human
aacuuccuuuucucacucccaagccgggggagcuugggucagaguaagcaaggacaaaguu

SEQ ID NO: 4162082 - RNA, 65 nt, Human
aacuucucaagggacacugguauuccgugaaacauagucugggaaaugcuguuccuugugcaguu

SEQ ID NO: 4162083 - RNA, 82 nt, Human
aacuucuuuaggacaggcucagcucuggccagugcaccccuuacugggaagccugaguccucugaguuuggguuaggaaguu

SEQ ID NO: 4162084 - RNA, 75 nt, Human
aacuugaaaucaugguggaagaaacagacaguguuagcucaugauuugauuugguucuaccuuuggccuugaguu

SEQ ID NO: 4162085 - RNA, 95 nt, Human
aacuugaaucccauaccaguauguuuuucaucuauuugcuuugugaagaaaacguguguuuuucaaaggccaguggagaacaugggauauaaguu

SEQ ID NO: 4162086 - RNA, 62 nt, Human
aacuugugaccuagcuguggauuugcuuucacuguuuaucggcagugucaugguuucaaguu

SEQ ID NO: 4162087 - RNA, 65 nt, Human
aacuuuacacugggcuuccccguguauauggcucucgcuuaugacuauagggcuuaguguuuguu

SEQ ID NO: 4162088 - RNA, 70 nt, Human
aacuuuagugcagaauucucagcuaggcuggcaauccagccuucucugaaauucuguuucuauucaaguu

SEQ ID NO: 4162089 - RNA, 103 nt, Human
aacuuucauuccuuugucaacugcaagaaugguaauauuugacaagaaaaacccaacuugucaaauacuacgauucuugcaguugacaaaggaaugaaaaguu

SEQ ID NO: 4162090 - RNA, 66 nt, Human
aacuuucucuacggcauuuguugaucuaaccccaggguaggaagucuaaacucugaggagaggguu

SEQ ID NO: 4162091 - RNA, 62 nt, Human
aagaaaaaucuuggcgcuugucuggcuagguaaauagccagacaagggccaagauuuuuuuu

SEQ ID NO: 4162092 - RNA, 68 nt, Human
aagaaaacacagauuauugcuggagaccccuaaggccuacuuugucugugcaauaguuuguuuuacuu

SEQ ID NO: 4162093 - RNA, 107 nt, Human
aagaaaaccaacagauaacaagcauacuaaaguauagaacuuaguuuuuuuagugagacacuuaguuuacuuaaguggaauguuuuuguaaaugcagugguuuuuuu

SEQ ID NO: 4162094 - RNA, 99 nt, Human
aagaaaacgcuggaaaaucauugaccaaggaaauuagguuauuuugcugcucacaccauuaagaaucugguuuccuggcaggcuuucauagucuuucuu

SEQ ID NO: 4162095 - RNA, 85 nt, Human
aagaaaagaaauauaauuuuuagguaacuggugaaaugugaauauggaccaggcuugauaccaagaaauuauucuuucuuuuguu

SEQ ID NO: 4162096 - RNA, 60 nt, Human
aagaaacguuugagcuuugacuuugaucucauucagaauauuuugguucaaaaguuuuuu

SEQ ID NO: 4162097 - RNA, 68 nt, Human
aagaaagcucuuucacuuccguucuguguuccaggaaauagaaggccagauggacggggcuuauucuu

SEQ ID NO: 4162098 - RNA, 66 nt, Human
aagaaagugcuuuguaaauuauauagcauaguagaacugugugcaauaauguacaaaaacugucuu

SEQ ID NO: 4162099 - RNA, 60 nt, Human
aagaaaucaauaucuauauguugcagaauuaaaucugcaaguaguugugauugauuuuuu

SEQ ID NO: 4162100 - RNA, 59 nt, Human
aagaacauugacuaagaggggccagaagcuaugacuuucccccucugaucaguauucuu

SEQ ID NO: 4162101 - RNA, 56 nt, Human
aagaacugaaauauauguauguauguguguguguguguguguguauuucaguucuu

SEQ ID NO: 4162102 - RNA, 57 nt, Human
aagaacuugggcugagugaaagucccaaaugggaccuucauuucugccuaguuucuu

SEQ ID NO: 4162103 - RNA, 100 nt, Human
aagaagaauuuagcuuuguaaugacaagaacuuuccauaguaauuccucuaaauguuuaggaccuuauuagggugguuuauguucugugauauucuuuuu

SEQ ID NO: 4162104 - RNA, 81 nt, Human
aagaagacaaaagaagacuuacuuuucagggguaagagaaggucaucuugauugaaguguuuaagucuucuuuguccucuu

SEQ ID NO: 4162105 - RNA, 86 nt, Human
aagaaggguggaauaguuggagguuuagcucuuuuggagguuuacagcccuuuuuagaggcugucccuugcuauuccucucuccuu

SEQ ID NO: 4162106 - RNA, 127 nt, Human
aagaagugcagcuugaagugggcuaaaggcaguguguuuauuggguauuguggagccuggagaccuguuuuucucccagguacucauuuauagagaacuguucaaguccugccauuagucauuucuu

SEQ ID NO: 4162107 - RNA, 58 nt, Human
aagaauaaauuaagauacuuagcuucuguugugaagcuggggacuuguuuuguuacuu

SEQ ID NO: 4162108 - RNA, 58 nt, Human
aagaauacagagacccaguccugcugagguggaaaagauccugggccuuuguauuuuu

SEQ ID NO: 4162109 - RNA, 101 nt, Human
aagaaucaacagcauuuagauagauguuuuaggucccuguagcucaaaguauggcccugagauuaucagcaccugggaacuuauuagaaaugcagaaucuu

SEQ ID NO: 4162110 - RNA, 56 nt, Human
aagaauggaacaguuaaaugggaaaggguuuauccuuaacuacuucuucuauucuu

SEQ ID NO: 4162111 - RNA, 66 nt, Human
aagaauggagagagauuugauuugucagguucaugucagauguugacaaagucaucucuccuucuu

SEQ ID NO: 4162112 - RNA, 89 nt, Human
aagaauuugaagaucuucaguacuugagucuuuccaaagccgucauuaacauggaucuuuuggaaaauucagaaaguuuucuguuucuu

SEQ ID NO: 4162113 - RNA, 71 nt, Human
aagacaaggcuggaguuuaggcagagguguuguacaaucacaugaugugcuuugacucacggcuuaguuuu

SEQ ID NO: 4162114 - RNA, 95 nt, Human
aacaaauuuuuaucauccauuugccgugcuaugugccagauacuauuuuaggugcuagagauacgggaguggauaaaucagauaaaaauucuguu

SEQ ID NO: 4162115 - RNA, 77 nt, Human
aacaacagcacaaauaccucaaaguaaugaugugauuaagucacucugaaugguacugaggauaaguguugugaguu

SEQ ID NO: 4162116 - RNA, 92 nt, Human
aacaacaguuccacaugugauauggccaaucggguggacgccagccauaaaggaugagugcugccuaauggccugucccagugcuguguguu

SEQ ID NO: 4162117 - RNA, 69 nt, Human
aacaaccuaggucucccguauuagugcucauuucauugcauaauacuugggcugagauuuuugguuguu

SEQ ID NO: 4162118 - RNA, 83 nt, Human
aacaagcaccugcuucuugggccaccauguggcagccagccugcugagcauugcugugacgccucaggaauccaaugcguguu

SEQ ID NO: 4162119 - RNA, 58 nt, Human
aacaagcagaugcaaugcacuuuggaacucaugaauuccugcuuugcaucugauuguu

SEQ ID NO: 4162120 - RNA, 73 nt, Human
aacaagcauuuauugaacaucuacuaagugccaggcacucuucaaugugcuagggauauaguagugucuuguu

SEQ ID NO: 4162121 - RNA, 61 nt, Human
aacaaugucucauccuaugugguuuuuaccugguuggagcuuacugggaugaugcuguguu

SEQ ID NO: 4162122 - RNA, 92 nt, Human
aacaauuuguagaguaaaauacugaauuaguugagacaagacuggguaucauuuuuauuguuucaaauauuucagaauaccagcauguuguu

SEQ ID NO: 4162123 - RNA, 81 nt, Human
aacacaaggagagucauuucuguagucauguuucauuucaaaauggagacgggaagaagagaaauugagucaucuugaguu

SEQ ID NO: 4162124 - RNA, 71 nt, Human
aacacacauuaaaaaauguugcaugaacguuacuuccugcucucauguucuguagauuuuuuaauggaguu

SEQ ID NO: 4162125 - RNA, 72 nt, Human
aacacacuuugaaggcuuuagaucuuuguagcugaaauuugcaacagauauccucagucuccaacaguuguu

SEQ ID NO: 4162126 - RNA, 55 nt, Human
aacacagcaucccuuaggucgucaugcaaaaguaaugauaugguuuggcuguguu

SEQ ID NO: 4162127 - RNA, 63 nt, Human
aacacaggaggcuauguuuucuaggugagaaggcucacuguuguaacuggagcuuuuuguguu

SEQ ID NO: 4162128 - RNA, 64 nt, Human
aacaccaagcugcucuggauaguccaugcugugaguuccaggacugcagagcaugcaaaauguu

SEQ ID NO: 4162129 - RNA, 71 nt, Human
aacaccucuggcucugcaccuuucuuaaaaaucgcuuugcagugauucagcauggagggcagauggguguu

SEQ ID NO: 4162130 - RNA, 73 nt, Human
aacacguuucccaagagguguuuguuuacuuauuucuauuauuggaauaaauuacccuuuagggaauuguguu

SEQ ID NO: 4162131 - RNA, 63 nt, Human
aaccuuucaguggcuaccgaugcuuuugggacaaccaaaaucuucagcacagcugacaagguu

SEQ ID NO: 4162132 - RNA, 86 nt, Human
aaccuuucccucucacauugaugugaugcagaaguggcagugguacaaacucuaccaugcagugcuuaaugaugaugguagagguu

SEQ ID NO: 4162133 - RNA, 76 nt, Human
aaccuuuuuucaaugagaaaaacauuagccuucuuuuguuacacauaagagaguucuuucuaguugaagagauguu

SEQ ID NO: 4162134 - RNA, 102 nt, Human
aacgguggguccauuucguuuaagguccacauuuuuggagucaguggaaaacaguauuacgcugacccauauaagaguggagggaaggaagcacucacuguu

SEQ ID NO: 4162135 - RNA, 56 nt, Human
aacuacagcucuugucuuucugauguuuuggacuauuaaaggcaaugacugugguu

SEQ ID NO: 4162136 - RNA, 128 nt, Human
aacuagaagauaugaguauucuauucacaccaaguuagauaaauuaagacuuuacauauucuugugucaggucaguauuugaugccaagugaguguaggauuggccauguuuugccaccaauuaaguu

SEQ ID NO: 4162137 - RNA, 65 nt, Human
aacuagcagaggaaaagagaacauugucuuuugauacugucuuuuuaauuuccuugggccugguu

SEQ ID NO: 4162138 - RNA, 130 nt, Human
aacuagucaugacuccugauuaggcagagaccuaggaagcugugcggacccugcagguuugcuacagcucuuucaggaguguuugcuacaguuuccuuugcuuugcuuuaaccauaaggagacacaaguu

SEQ ID NO: 4162139 - RNA, 68 nt, Human
aacucaaagaugcaugacgcuuucauucuuuuuacaaagcccuuuucuagucauugugccuuuggguu

SEQ ID NO: 4162140 - RNA, 55 nt, Human
aacucacagucucaagaugcuggugcuaauguacauugcagcugacacuggaguu

SEQ ID NO: 4162141 - RNA, 55 nt, Human
aacucacuuuguggcuucugaagaagggaccuuuguggacugucauggaguaguu

SEQ ID NO: 4162142 - RNA, 73 nt, Human
aacucagaaugcaagauucagcaggaagaugauuuauuucugucaucuggauagguuguuuugcaucuggguu

SEQ ID NO: 4162143 - RNA, 58 nt, Human
aacuccuccagacuuacugaaucccacacucuggauguggggcccagcauggaggguu

SEQ ID NO: 4162144 - RNA, 64 nt, Human
aacuccugaccuagugauccguucgccucugccucccaaagugcugggauuacaggcauaaguu

SEQ ID NO: 4162145 - RNA, 89 nt, Human
aacucgccucccuguucuuccacaauacuucugagauucucaaucaggucugucuaugcaauggaaggacugguugaugcaacugaguu

SEQ ID NO: 4162146 - RNA, 88 nt, Human
aacucuauagaaaucagcaagacaauuaaugaggaaauacacaaauaauuuccagcuauuaauguuuuugcugaauuugaauagaguu

SEQ ID NO: 4162147 - RNA, 56 nt, Human
aacucugcaaccuauguagaccaguuuaaagguuuuaaaaaggugaugacaggguu

SEQ ID NO: 4162148 - RNA, 74 nt, Human
aacucuggucucuugagaaaaguacauggagaagcugcuggaaagauuucccuauaguuuucucuuucggaguu

SEQ ID NO: 4162149 - RNA, 70 nt, Human
aacucuguuaauauacuaaaauccacugaauuguacacaucaaaagaguggauuuuaugguauaugaguu

SEQ ID NO: 4162150 - RNA, 71 nt, Human
aacugauuguuuuucauaaucuauaggguuuuagaugaaacucaacuagaacuuauuagaaaggcucaguu

SEQ ID NO: 4162151 - RNA, 58 nt, Human
aacugcaugucuagcauccacuuauuuuaaaggagauauguaaauaggcauuguaguu

SEQ ID NO: 4162152 - RNA, 85 nt, Human
aacugccuuucaaaacaguucuccaggaagccagucugaauuuacucugguuuuuaaaaaagaaucauguguuugaccagcaguu

SEQ ID NO: 4162153 - RNA, 75 nt, Human
aacugcugugaacaauagcagcaucuuugguauucucucaagcucuaggaaauguguuuguuuuaaacagcaguu

SEQ ID NO: 4162154 - RNA, 88 nt, Human
aacugcuuauuagauuugugacauugauuaaacuaugggcaaucccuuuuuccauauuaggauuuguuauacuuccaagauggcaguu

SEQ ID NO: 4162155 - RNA, 68 nt, Human
aacuggaaaugauccugucacaccuuugacgauauuuugugcacaggacuuaagucauuuauaaaguu

SEQ ID NO: 4162156 - RNA, 63 nt, Human
aacuggaaugaaguuaaucugauagucuuuucuacugacauuaaaucguaauuuuuuccaguu

SEQ ID NO: 4162157 - RNA, 59 nt, Human
aacuggaguccugagcauucuggacccaugaagucugcacauguucuauccuccaaguu

SEQ ID NO: 4162158 - RNA, 67 nt, Human
aacugucuuucucccuggguuagccuaaaaguuccuuuucuguucauuuccaggagcaaagccaguu

SEQ ID NO: 4162159 - RNA, 58 nt, Human
aacugugccuuucacuugcacuugacugaaaacacccagaagacagaaaggcacaguu

SEQ ID NO: 4162160 - RNA, 57 nt, Human
aacugugcuguggggagauaguaaaaauggauguaggucaucuuuccauagcauguu

SEQ ID NO: 4162161 - RNA, 92 nt, Human
aacuguuaaucuguaacagagauuuaggaguucuguccaccaagggcaacgugugggccugauucuugaauccugaugcagacagaccaguu

SEQ ID NO: 4162162 - RNA, 76 nt, Human
aacuguuuuucacgugucucauaacuguggugaugagcaaaucagaagucaucaaaugaaauauggaagaaagguu

SEQ ID NO: 4162163 - RNA, 70 nt, Human
aacuuaacccgucacaugccagugcacacaggagccagacccuucguuugcaaagugugcggaaaagguu

SEQ ID NO: 4162164 - RNA, 113 nt, Human
aacuuacaguuuacuuuggcuuuccaauaaggcuaggaauucucugaagucauauagagcuuauucuucacagagucccugauuguuggcagaauugcugaacaauguaaguu

SEQ ID NO: 4162165 - RNA, 61 nt, Human
aacuuacuuuccuauuaaugguugcucagaauacauaaugccagagagagggaaguggguu

SEQ ID NO: 4162166 - RNA, 64 nt, Human
aacuuaggugccuuagacacugccauugaguaagaauuugaacccagucucugaggccuaaguu

SEQ ID NO: 4162167 - RNA, 62 nt, Human
aacuucaucuacuucagucuacugauuuuacagauaaaaauccugaggcaaagagaugaguu

SEQ ID NO: 4162168 - RNA, 83 nt, Human
aacuucuuaugaaaacagaauuguacaccagggagauagauuauaauuuccuugggaauaauaauucugagcuuucagacguu

SEQ ID NO: 4162169 - RNA, 68 nt, Human
aacuucuuugaaucagaggaagucaacggaucuuuccaggucuuaguuuucuccuuugagaagugguu

SEQ ID NO: 4162170 - RNA, 62 nt, Human
aacuugaaacuguuccagaaaaagagggcaugucccauucuggcgaaacaguuugaugaguu

SEQ ID NO: 4162171 - RNA, 76 nt, Human
aacuugcaucauuuucuucuuccugcagguaaaagaggcaaaugaaaacuugcaagaggaugaagacgaugcaguu

SEQ ID NO: 4162172 - RNA, 67 nt, Human
aacuuguacuuacuggaccuagaagaauauaguuuucuauuauggcagcauucaguauguucagguu

SEQ ID NO: 4162173 - RNA, 60 nt, Human
aacuuucuagagaugaguucgggcuuugagauccugaguucuccugcacucuggaaaguu

SEQ ID NO: 4162174 - RNA, 76 nt, Human
aacuuucucuggauggcuuccuccaauaaacaauaucuuacaaugugaguuaacaggaagccacugaaugaaaguu

SEQ ID NO: 4162175 - RNA, 77 nt, Human
aacuuuguaggaagggcuacucuuuaggggaauagucaugauuauuucaaacuuaaauaccuuuccuuugcauuguu

SEQ ID NO: 4162176 - RNA, 75 nt, Human
aacuuuguuuuauucacugcuguguugggaaugccuagaaucauaacuggcacaugguacugagucauuagaguu

SEQ ID NO: 4162177 - RNA, 56 nt, Human
aacuuuuaugaaggaaaucauacauggaaucccaauguaugaaguugauaaaaguu

SEQ ID NO: 4162178 - RNA, 70 nt, Human
aacuuuuuuccuaaggcaacaugauggcauuaaauauuuguuugcuuucaauuaucaauggaaagaaguu

SEQ ID NO: 4162179 - RNA, 56 nt, Human
aagcaccaaguucaacauucccauuuuacagaugagcagguugaggcaugguguuu

SEQ ID NO: 4162180 - RNA, 77 nt, Human
aagcacucaaucagggauguaauugugagcuaaaaaaaauuacaguauauuuucuugauuguuccaucucacggcuu

SEQ ID NO: 4162181 - RNA, 56 nt, Human
aagcacugagcacaguggcugacagauaaugaggucuccacugaggcuugguucuu

SEQ ID NO: 4162182 - RNA, 87 nt, Human
aagcacuggggucuccccaaaggaauauacuauuuugccaguacguugugcagcacugagcacuugguauauuucccccggcugcuu

SEQ ID NO: 4162183 - RNA, 71 nt, Human
aagcacuucacccacauuccaucacucugccacaccagguagagagagagagagugcugggcaaagggcuu

SEQ ID NO: 4162184 - RNA, 76 nt, Human
aagcagcagaggcaaaagagguggagguggcaguggcaacagcagcagcuuugcagacucuuuuaucuugcuguuu

SEQ ID NO: 4162185 - RNA, 56 nt, Human
aagcagcugaaggauucaggguuaacacuuugccuuuugaagagacuucaguucuu

SEQ ID NO: 4162186 - RNA, 99 nt, Human
aagcaggcacccaggacaccuguuuaaggaggggcucacgugggcuucugcaagugcggagugagugccccuuaaguguugcaccugggcaccugacuu

SEQ ID NO: 4162187 - RNA, 78 nt, Human
aagcagguacugugguucaguggacgugucuguuucuacguauuugagaugugauucccacugaaucacugccuccuu

SEQ ID NO: 4162188 - RNA, 61 nt, Human
aagcauaaauuguaagaugaugguaguuuuaagacugccugaacaugaauaguuuaugcuu

SEQ ID NO: 4162189 - RNA, 78 nt, Human
aagcaucuuagaccugaguuccuucauguauaaaaugagaaggaggaaccauaucaccucuaagaucccuuccagcuu

SEQ ID NO: 4162190 - RNA, 94 nt, Human
aagcaugaggauggauuucagagcccagcaguggggacccuuggucaauuaaucucccuguaguucguggucuuugaggcacauucucacguuu

SEQ ID NO: 4162191 - RNA, 94 nt, Human
aagcaugccuaaaauggucucaugugguuacuuuggucgcucuuccagcaggugauauuggauaaagugaguacaaaaugagggugggcggcuu

SEQ ID NO: 4162192 - RNA, 55 nt, Human
aagcauggagcaauagaaugacacuagaucauuucauucuuucccuucagugcuu

SEQ ID NO: 4162193 - RNA, 59 nt, Human
aagcauggccucuccgcuccccucccuccucaagaguccgguggugaugagccauguuu

SEQ ID NO: 4162194 - RNA, 56 nt, Human
aagcauggcugagugcaaugguacccucuuauugaccauuuuguauugucaugcuu

SEQ ID NO: 4162195 - RNA, 109 nt, Human
aagcauguugcaaaauaacuuggugucuaugauucaguuuauguaaaauaauaaauguauguaggaauacguguguugaaagauguacaucaauuugcuaacaaugguu

SEQ ID NO: 4162196 - RNA, 55 nt, Human
aagcauuugugaaauucagauggagaaauacaaaacugaugucacggaaaugcuu

SEQ ID NO: 4162197 - RNA, 58 nt, Human
aagcauuuuguuuuaagaaugagguugcaaaacgccucugcuuuagaauacaauguuu

SEQ ID NO: 4162198 - RNA, 80 nt, Human
aagcauuuuuaucuugcuuauguugaauuguucaagagaccaaaggaauuuggcaaagaucaacauguuaggaugugcuu

SEQ ID NO: 4162199 - RNA, 69 nt, Human
aagccaacaguuguguauuaguuugcuggcuguggcugucauaacaaauuauuacaagcuaguuggcuu

SEQ ID NO: 4162200 - RNA, 75 nt, Human
aagccaagagcucccagaccugggcagcucaggagcugacagaaaccaccccccaggucuggaguucaaggguuu

SEQ ID NO: 4162201 - RNA, 78 nt, Human
aagccaagucuucacacuuuuagcccagcaucuuaucucuuagauuaacuguggcauugugaggacugcaagugguuu

SEQ ID NO: 4162202 - RNA, 100 nt, Human
aagccaaucugaauugcacuaggaaaaggcagccauucuuuuggguagggggagaagugagcuuggcuggucauucugguuguuagcaauuaucuggcuu

SEQ ID NO: 4162203 - RNA, 76 nt, Human
aagccaaugagauucaauuccaacuuuuccuaaauguuggagaaguaucuaaguugugaauagaucugauuggcuu

SEQ ID NO: 4162204 - RNA, 55 nt, Human
aagccacuauggugauucucaaacuugaguggacuuaagaauuaccaaagugcuu

SEQ ID NO: 4162205 - RNA, 61 nt, Human
aagccacuuucagcugucucagaugucguucuacccauuucugauccggcuggaagugcuu

SEQ ID NO: 4162206 - RNA, 58 nt, Human
aagccagccccaucaaagcauuuuccuacugacgaaugcaggguuacagggcugacuu

SEQ ID NO: 4162207 - RNA, 115 nt, Human
aacugaaacauuuuggaagcaucaguuggcaggaaaaacauuggagaucucaaucaugaagaaagaucgccaguucauuuuccugcuugcuuugaucguuuuucaaugugaaguu

SEQ ID NO: 4162208 - RNA, 64 nt, Human
aacugaacagaacucagagauuguaaauucaguaauugaacaagauuucagguuguguucuguu

SEQ ID NO: 4162209 - RNA, 79 nt, Human
aacugaaggaaagagggaaaguacugaguuaaauucuaaugugagcuuugugcacauugcuuuucuaugaccugcaguu

SEQ ID NO: 4162210 - RNA, 96 nt, Human
aacugaggcacuguggaaacucuugggcugcaugcuguuuaaugaucauuuucaaaccaaugugguuuaggagcagucugcugguggucuccaguu

SEQ ID NO: 4162211 - RNA, 70 nt, Human
aacugcaugcuuugagaagaugaaugguucuuagguguuuuaugcauaagaaucuuccagggcauguguu

SEQ ID NO: 4162212 - RNA, 129 nt, Human
aacugcccaauguccucccuuccaguucaugagcggcccaguucuguaccaggagaagcugcugaagccggcagcuuugcugcuggagaagggugccgaccaggaggaagacgaggcccugcgggugcu

SEQ ID NO: 4162213 - RNA, 82 nt, Human
aacuggaacaggacgcagaucaauccugcggagauuggaguauucagucuugcucuugcaucugcuucuuccuguauuaguu

SEQ ID NO: 4162214 - RNA, 63 nt, Human
aacuggaucaguugagggaggcaucuguuuuacucaguccuuuccuucuaaaccgaucugguu

SEQ ID NO: 4162215 - RNA, 58 nt, Human
aacugggagugggccauguguauacucauguacauaaacacacuacacauuccuaguu

SEQ ID NO: 4162216 - RNA, 76 nt, Human
aacugggucccaauagcuuuuguuucuguaaaucacugucucuuagaggaaaaggccacagggacacauuccaguu

SEQ ID NO: 4162217 - RNA, 84 nt, Human
aacuggucggugauuuagguaguuuccuguuguugggauccaccuuucucucgacagcacgacacugccuucauuacuucaguu

SEQ ID NO: 4162218 - RNA, 79 nt, Human
aacugguuucuucucuuguaauuuaaaaaaucuacccacuaggggaagauugauagcuuaggagaauagaagggcaguu

SEQ ID NO: 4162219 - RNA, 93 nt, Human
aacuguacuuucacagucaugguaauuuguauuggccugggcaugguagucaguuucaggcaggacagaccaagaucgugcuaguagccaguu

SEQ ID NO: 4162220 - RNA, 82 nt, Human
aacuguagcaauuauuuuuuccauucaucagugacaaaaauauguuaguggaacaugaauugaaagaagaauaucuaaaguu

SEQ ID NO: 4162221 - RNA, 74 nt, Human
aacugucccaguuggccugggaccgagggucuacuauuaaaccuguaguagucucaggcaaaccaggacaaguu

SEQ ID NO: 4162222 - RNA, 60 nt, Human
aacugugaaagcuaacaucuuagcuugcaaguagguuaaaauauuggaugcuuuacaguu

SEQ ID NO: 4162223 - RNA, 106 nt, Human
aacugugccaaaaauagcuuugaaauuuccacuugaauucuuagaaagggcccuuuucucuccauuuccaucugaggaaaagaggagguagcuuauuuucacaguu

SEQ ID NO: 4162224 - RNA, 58 nt, Human
aacugugccuuucugucuucuggguguuuucagucaagugcaagugaaaggcacaguu

SEQ ID NO: 4162225 - RNA, 91 nt, Human
aacuuaccaacuuuuuuguugccuaugcuuuuggugcuauaucuaaaaauccuuugccaaauacaaggucaugaagguuuacccguaaguu

SEQ ID NO: 4162226 - RNA, 83 nt, Human
aacuuagaauccccuaucuuauucuuuuugguuuuaugaacucgucugauaugaagaaucuaggauaggcaauugacugaguu

SEQ ID NO: 4162227 - RNA, 63 nt, Human
aacuucacgauuuugcaggagacuagcucugucuaguucccacaccugcagggaugagagguu

SEQ ID NO: 4162228 - RNA, 65 nt, Human
aacuucauggagcugguauuuuuaugcccauuuuauggaugugaaaucugaggcccaugaugguu

SEQ ID NO: 4162229 - RNA, 59 nt, Human
aacuuccuuggguaugaaaacacuuaaguuuucuuuucuccccaaugccccaggcaguu

SEQ ID NO: 4162230 - RNA, 105 nt, Human
aacuucgaggcuuagaacauguauuuagcucgugauauaaggucgucuucuucauguaucugaggucagcugugugugcaugaggugguucuacuucugagaguu

SEQ ID NO: 4162231 - RNA, 118 nt, Human
aacuucucuccaucucacuagugaggaugaaugcugucuuccucuaggguaguggaggacaaucaggucacugccagaagacagcuuuucacacucucgcuuuccucgagagaauguu

SEQ ID NO: 4162232 - RNA, 62 nt, Human
aacuugaauucaaagcgaaagcacuggacccuuuagucugugugagcuugggauucugaguu

SEQ ID NO: 4162233 - RNA, 83 nt, Human
aacuuggaggcaaguauuuucagagggugcuuaaagaauuauuuaaaaaaaaggccauucugaacaauucuugucuuuuaguu

SEQ ID NO: 4162234 - RNA, 76 nt, Human
aacuuuagggucugggaaguaaaaagugacagugaugaagaaucacuuggauauguucacuagaccuccugaaguu

SEQ ID NO: 4162235 - RNA, 103 nt, Human
aagaaaaagaauccacaggaacacaauuauuuugaccuuguauccagacaagauuuauaucugugacagggaucagaaugcaauuccuaguugagucauucuu

SEQ ID NO: 4162236 - RNA, 105 nt, Human
aagaaaacuggggcugcugguuugaggggcaucucuuucuuuuguguuuugacucauuaucugagagacuguguccaucgugccuggcaguucuccuuuuuucuu

SEQ ID NO: 4162237 - RNA, 78 nt, Human
aagaaaagaagcagggagauuuauuaaacuguuacauauaaguuauguuaguaaauaaagucuacuuucuucuggcuu

SEQ ID NO: 4162238 - RNA, 83 nt, Human
aagaaaaggaagauaugaaaguaagcaugugugugaauguguuugugccuccaccacauguaacugcuuucuuuucguuucuu

SEQ ID NO: 4162239 - RNA, 83 nt, Human
aagaaacaguuucauuuucaugaccagcaagggguucaggaagcauccuaccacagggucccuggaaaugaaaccugaaucuu

SEQ ID NO: 4162240 - RNA, 125 nt, Human
aagaaaccaaaaacugcugugcugaagacaaagauguguguaauuuaaagagaagugggccauuuaaaauuacuaucuuccuuaugccuaucaaguaucauguaauuuaggaaaaaucauuucuu

SEQ ID NO: 4162241 - RNA, 75 nt, Human
aagacagcagcagauucagcgucuggugaaggccugcuuaccaguucacaaauggcuguguuuuugcugugucuu

SEQ ID NO: 4162242 - RNA, 59 nt, Human
aagacagcucaggacagauucaccauguugaaagcaggagugcugauugauguugucuu

SEQ ID NO: 4162243 - RNA, 92 nt, Human
aagacaggguggaacaggcaauacuuugggguuucuuugucaugaauuuuuuuccaaaguauaagauucugucuguaguacuaccuuaacuu

SEQ ID NO: 4162244 - RNA, 74 nt, Human
aagacaucccucagggugcaguugcuuuugaugaaggauagcaucguuagggcggcaucacucgggggcugcuu

SEQ ID NO: 4162245 - RNA, 56 nt, Human
aagacaugacugcacagccaaauguggcagaguuagccacuuuugcaguauguuuu

SEQ ID NO: 4162246 - RNA, 112 nt, Human
aagacauuuauuuuuauaugucaagccauauuuugaagaaugaauaauauuacagaaaaugacaucauuuaugcaggaauggcauaacauguagauaaauaguauuuguuuu

SEQ ID NO: 4162247 - RNA, 72 nt, Human
aagaccaauggucuaagccaucauaacugcggaaaugucuuucuucaguaucccugcuuggacagugguuuu

SEQ ID NO: 4162248 - RNA, 89 nt, Human
aagaccacacaugugggggauucaucucagagcguaaugaucuagugucucagauacauguaugagagauucuuuuauuguguuuucuu

SEQ ID NO: 4162249 - RNA, 79 nt, Human
aagacggaggaagaaggagaagggcaguucuugauaaggacacaacucagcaauuucccaucucuucugcucacaucuu

SEQ ID NO: 4162250 - RNA, 65 nt, Human
aagacuauaccaucuuaguuaccauagcuuuaucauaagucgugaaauuaggcuguguaagucuu

SEQ ID NO: 4162251 - RNA, 80 nt, Human
aagacucugccagccucuccccucccaaggcgggagucgaguuugcucccuccgcaagggggagagccuggcggaguguu

SEQ ID NO: 4162252 - RNA, 72 nt, Human
aagacucuggcagcagaaccaguguuugaauccacauuucuuguucuuuacacucucgcugcuauaaguguu

SEQ ID NO: 4162253 - RNA, 70 nt, Human
aagacugcauaucugggaguauggagaauggagagaacugauuugcuguauaucaugguuuugcagucuu

SEQ ID NO: 4162254 - RNA, 111 nt, Human
aagagaacagaagugugugcugugcucagcccuccuguccuguccccucaggguaggucugccuuucuggacaagacagagggaguaagagccagaccucuauuagcucuu

SEQ ID NO: 4162255 - RNA, 95 nt, Human
aagagaauagucaagugcaucuuugcagaacgaugaagaugugauucaagguuauuuuucucaugauugccaagaaguagcugaugacuucucuu

SEQ ID NO: 4162256 - RNA, 57 nt, Human
aagagagaacacagcuugggcaaaagcccugagucagaaacauguggacuuauucuu

SEQ ID NO: 4162257 - RNA, 71 nt, Human
aagagagaaggaaacagaugaguugcagcugguccaggaggaggacggcacugaucugauuucccucccuu

SEQ ID NO: 4162258 - RNA, 59 nt, Human
aagagagaccaugggggacagggggaauggagucccuuaagucccucaugucaucucuu

SEQ ID NO: 4162259 - RNA, 78 nt, Human
aagagagggauguucugggguugagagacaaugggccuuuucuaccaugcuugaaaaccccaugaauagucuucuguu

SEQ ID NO: 4162260 - RNA, 120 nt, Human
aagagauaaaaauaaguaaaacuccagcagguuaggaucagauccuggaggguggugaaugccaagccacuacuuuggauuuuauucuguggcaaccuggaagcuacugaggauucucuu

SEQ ID NO: 4162261 - RNA, 69 nt, Human
aagagauuucugauaacauuuaguugauuuagucacauaauuaacuauaaugggguuaggaaaugucuu

SEQ ID NO: 4162262 - RNA, 90 nt, Human
aagagcaaauggaaaugagaaaaagauuuucuucaggcuauuaaauuacagacuuuuggagauggucuguucucauauuccuauguccuu

SEQ ID NO: 4162263 - RNA, 58 nt, Human
aagagcacuaacagagcugauaggaccuagauugccugacagcaacuguaguccucuu

SEQ ID NO: 4162264 - RNA, 81 nt, Human
aagagcacuuuacaguuacgcugagaaacgaauguucaggacuauuugugucucaagugugaacucuuuuauaaggcucuu

SEQ ID NO: 4162265 - RNA, 62 nt, Human
aagagcagguccaccaugccucaagccagcuggcagcugcgcaggcccagguggauguacuu

SEQ ID NO: 4162266 - RNA, 76 nt, Human
aagagcauaguauaugggaaacuuaguaccuuuuaaaugcagagagacaaaguuucaaauguugauuaugccacuu

SEQ ID NO: 4162267 - RNA, 65 nt, Human
aagagccuggggauuggcaagggaaggggccuggccaacacccuucaucacuuccagagguucuu

SEQ ID NO: 4162268 - RNA, 63 nt, Human
aagagccuuuccccacccucugaccuagagaaaauagaaggcauuaugugggaaaauguucuu

SEQ ID NO: 4162269 - RNA, 108 nt, Human
aagagcuaugcagcacagguugcuauaaugaccagggcaucuucuucuacaaggaauaggaggggagcaggacauaauagcaauacuuguuguuugugcauugcucuu

SEQ ID NO: 4162270 - RNA, 128 nt, Human
aagagggauuucaagggauaugaacgugaaagguuuuagauaaugcucaagcaauugcauagcaauuauacauugaacaaucuagauucuagaccuuucuguccaaucccuuuucuguuauccuucuu

SEQ ID NO: 4162271 - RNA, 62 nt, Human
aagagggugguucacuuuuugauggucaaccauuuagaagucuuagaacuauauuuccucuu

SEQ ID NO: 4162272 - RNA, 77 nt, Human
aagaguaucuggggagaaaaucauuuguuuuggauaaacuucugucucacaauauuuaucuuccaauuugaucucuu

SEQ ID NO: 4162273 - RNA, 83 nt, Human
aagaguguucacuccauaggcccugcaguaaucauggcuuaccucauuuauguucacagcaaaccuaugaacugggcauucuu

SEQ ID NO: 4162274 - RNA, 65 nt, Human
aagaguuuaccagugcugcuucccacuuuguguaccuugggaagucugaggcacuugagcaucuu

SEQ ID NO: 4162275 - RNA, 70 nt, Human
aagauaacaucaaacugcauuuucuaauauacuuaaaaauaguagguuguguguuuuugauguuuauuuu

SEQ ID NO: 4162276 - RNA, 70 nt, Human
aagauaugaggucaccugcugggcucuuuccuguguaucugaguauagcuggcaggucauuugauaucuu

SEQ ID NO: 4162277 - RNA, 80 nt, Human
aagggaaauucugggguuagugcagaucugguauagucuauaguccuggaugcugugguaagccccaccggagcucccuu

SEQ ID NO: 4162278 - RNA, 74 nt, Human
aagggaaucagagauugaagacugguggagcugccccaggcaaaugugcagcuuuugucuucaguuuagcccuu

SEQ ID NO: 4162279 - RNA, 78 nt, Human
aagggacauggagagucucugagccagggcaaauaaaaagcuugcuugguuucuaacuuuucauauauuuuguuucuu

SEQ ID NO: 4162280 - RNA, 81 nt, Human
aagggagaggagggucuuguugaacuugaaaaaacuaaauaagcaaaguugauacauaaggacacccuucucuuuacccuu

SEQ ID NO: 4162281 - RNA, 64 nt, Human
aagggcaggaaaagauggaugucccagcucaagcagggagugaaucugccuuuccucagccuuu

SEQ ID NO: 4162282 - RNA, 59 nt, Human
aagggccauugcugagagcagucucccaugccaaaauggaagcuguugguaagguguuu

SEQ ID NO: 4162283 - RNA, 60 nt, Human
aagggcugaaugaaggguugaaccagauuaacaaaggucucuccaaccuuauucaucuuu

SEQ ID NO: 4162284 - RNA, 84 nt, Human
aaggggaccuacugauaggaacacagggacuugaugaccucauggucauugucaucccuguguuuguaugaaauguagcuuuuu

SEQ ID NO: 4162285 - RNA, 61 nt, Human
aaggggagucaggcucccucagagacuggaaagucugggugagcaacugacucggccccuu

SEQ ID NO: 4162286 - RNA, 77 nt, Human
aaggggaguuagugucucaccuaaaaucuggggccaugaugucaccacauuaaauaguagggaugcuugcucaucuu

SEQ ID NO: 4162287 - RNA, 75 nt, Human
aaggggauagaguaugagagauuaagaucaggcuguggaguguuugucaguuaaucaauguggucuaaaccacuu

SEQ ID NO: 4162288 - RNA, 62 nt, Human
aagggggaaauuucaauguuuaaaaaugguuuauaauaggaucacauugaauuuucuucuuu

SEQ ID NO: 4162289 - RNA, 85 nt, Human
aaggguacucauuucugaggaacauacuuauuauucuggcauaagcuaugugaacagacuguucucuacagauuugaguaucuuu

SEQ ID NO: 4162290 - RNA, 64 nt, Human
aagggugagagucaggcagagauuugcuuucuugggcuuugagucaugccgauacucaucgcuu

SEQ ID NO: 4162291 - RNA, 100 nt, Human
aagggugagugguggcauggugauugacugcugagcacacaagagugucugccacggaacauagucuuacucagcagugacccucuuaccauuuucccuu

SEQ ID NO: 4162292 - RNA, 60 nt, Human
aaggguucagugaagaggugcuaaggaaacucuugugacccucuuuguuggcaaacucuu

SEQ ID NO: 4162293 - RNA, 108 nt, Human
aaggguucccagccaagugcaaugaucaggaucagggcuagcagagccacacagccaugugccuuucacagccuucguucugaaacacuuaacucgggcugaccucuu

SEQ ID NO: 4162294 - RNA, 67 nt, Human
aaggguugaguucuaaaggcagaacauaaaauaaaccuuuuauuaaucuuaucuuuggaaaucccuu

SEQ ID NO: 4162295 - RNA, 64 nt, Human
aaggguuggggaagagcaaauucacucucucuuugagcugggacaucugucuucuucugcccuu

SEQ ID NO: 4162296 - RNA, 65 nt, Human
aagguaacacagcuucugagugaggauuuaaguaaaguaaaucugauacaaagucuguauaccuu

SEQ ID NO: 4162297 - RNA, 64 nt, Human
aagguaacagcuucagcuucagaaucggagcgaaaauucuucugccccugacuguugugaccuu

SEQ ID NO: 4162298 - RNA, 123 nt, Human
aagguagcacuugcacguaauguagauaguaaacagacuggcauucugccugcugcugaccugacaggaagcaucuggcagaaagucagaagggcaucugcauuaccuguuaucuagcuccuu

SEQ ID NO: 4162299 - RNA, 59 nt, Human
aaggucacaaagccuggagauacugaaauuagaaagaaaauccagggcuuuauggcuuu

SEQ ID NO: 4162300 - RNA, 56 nt, Human
aagguccuguagccacagagccagacaaggaucaagguucuguggucccaggccuu

SEQ ID NO: 4162301 - RNA, 65 nt, Human
aagguccuuuugcagugugaucucgcugaugauuacugaagcugacauaucugcuaaaggauuuu

SEQ ID NO: 4162302 - RNA, 68 nt, Human
aaggucuguaccuaauaaagguaaauucuguuucauuuauggggcaguguuuacauauuagaaaccuu

SEQ ID NO: 4162303 - RNA, 77 nt, Human
aaggugaaggacccaggguggucaccugaaauguguuugucagaugcaggucauccuuccugggaaucuuuggccuu

SEQ ID NO: 4162304 - RNA, 55 nt, Human
aaggugaaggugggaggggagaaguuuccuccccuucuccuuucucccucaucuu

SEQ ID NO: 4162305 - RNA, 94 nt, Human
aagaaaaaugauggacagcuuuuguguauguaugcuuguacauuuaucuguuuuuaguauuauacauaaaacaaucauguugguuaauguucuu

SEQ ID NO: 4162306 - RNA, 117 nt, Human
aagaaaagcagagagugaauuuucauggaguuagacugcguugagacgaaugaagcuaaggcucaggucucuuucauuacguguuugacuuguccugauucaaaaucuaaauaacuu

SEQ ID NO: 4162307 - RNA, 59 nt, Human
aagaaaagcuauuuuauugcagcucuuucccaagagcuguucugggaauggcuggucuu

SEQ ID NO: 4162308 - RNA, 122 nt, Human
aagaaaagcuuuaggacagggucaugcuugaagaugaguacuuagaagccugaaaguccgugacaucuuccauggguggcucucaaguccuuuugcucagggaccauuccuuaggaaaucuu

SEQ ID NO: 4162309 - RNA, 77 nt, Human
aagaaaauuaaucacuguuuuuauguaaucagugcuucaaaaguacuugaggguacuugaaagcaguugauuuucuu

SEQ ID NO: 4162310 - RNA, 91 nt, Human
aagaaaucucuaguagcaaaacaaucacaguuuacaaaccugcuguuuucugucaaauuucaguuagacuguguuuucauugggguuucuu

SEQ ID NO: 4162311 - RNA, 72 nt, Human
aagaaaugcuggugaauauagguacuuggaaaauaagguguuuucaucaccucccaccuauuucacuuucuu

SEQ ID NO: 4162312 - RNA, 96 nt, Human
aagaaauugagcacagagcagaguaggagaacuguuuaugcuuggaagacuccagagaguaaacauuuuccgggaacuuucggcuuaaauuuacuu

SEQ ID NO: 4162313 - RNA, 118 nt, Human
aagaaccuaaaaguuauaucaauaaugggagcuuagcuguaaaauuuuuuuuagacuggaaguauaccuaagaaaauuuuacugguguuuccuuuggauugugggaguauagguuuuu

SEQ ID NO: 4162314 - RNA, 82 nt, Human
aagaagccuuaagauaagagcgagagauucaacagcaaguacuaucuguaagaacuuugauuucauugcauuuaagcuucuu

SEQ ID NO: 4162315 - RNA, 87 nt, Human
aagaaggcuucucugcuccuaucugugauucuaagaagauuuaaucagcuuccugguaauuuccgaagugaguaagaagagccucuu

SEQ ID NO: 4162316 - RNA, 60 nt, Human
aagaagggcugccagggggugccagggauucccccaaggcucugccuguagaccuagcuu

SEQ ID NO: 4162317 - RNA, 64 nt, Human
aagaagguggcaaguggcaaaucccauggcaguucuuugggaacaacaugcacugccaccucuu

SEQ ID NO: 4162318 - RNA, 72 nt, Human
aagaauacuauguugugacacaugaaaaucauaugaaauuuggauuucagugucuauagauaagguuuucuu

SEQ ID NO: 4162319 - RNA, 80 nt, Human
aagaaucuaaaggacguguacuaggucuaacaugaguaaugcucaacauguuaaaccuaguacagguccuuuagauuguu

SEQ ID NO: 4162320 - RNA, 58 nt, Human
aagacaagcacagauaaaacaggauucuguuguuaagcagaguaaccugugcugucuu

SEQ ID NO: 4162321 - RNA, 95 nt, Human
aagacaaguaccaauauguacagugauagagcaguauuaucaaaauuguguuagauaauuacaacuaucauuuuacaugguugguguuucaucuu

SEQ ID NO: 4162322 - RNA, 73 nt, Human
aagacagacagagcuggagcuugaauggagagcauugcuugguaugcauaggacuccuggcuugcauagucuu

SEQ ID NO: 4162323 - RNA, 57 nt, Human
aagacagauuuggcuaugcaccucugaauuugaaacuaacgaagucaaaucuguuuu

SEQ ID NO: 4162324 - RNA, 56 nt, Human
aagacagcguaacagauugaauacaaaagaagguaugagaacccauacgcugucuu

SEQ ID NO: 4162325 - RNA, 94 nt, Human
aagacagucauguucuaaucccugcuauguaugaauguuaccuuaugguauaugguaaaagggacuuggcagauggaauuaaguuaaaggucuu

SEQ ID NO: 4162326 - RNA, 63 nt, Human
aagacauauacuauggaugguucucauagaugaaaaaaaugagagaagauucuuauaugucuu

SEQ ID NO: 4162327 - RNA, 59 nt, Human
aagacaugccucuuuaucuuccuguccuaaauuagaagcaggauuugagaaggcgucuu

SEQ ID NO: 4162328 - RNA, 58 nt, Human
aagacauuccaaaguggcuaaucauguauauaaguacacaaugcuguuugggaugcuu

SEQ ID NO: 4162329 - RNA, 67 nt, Human
aagacauuuugcaauggguagcuuagaaucugguauccaagaacagugacccauuucagggugucuu

SEQ ID NO: 4162330 - RNA, 70 nt, Human
aagaccugacuuuaaaaguuugugcuugggaguuaaauauuuuuaaacauauacauuuugaaguucucuu

SEQ ID NO: 4162331 - RNA, 83 nt, Human
aagacucacaaaacauuuuucuaggucuugguagucccaauuuuagaauaucggggacuagauagagugaggcugugugucuu

SEQ ID NO: 4162332 - RNA, 56 nt, Human
aagacucagaauuuugccugggugcuucauacacaguaggcagcauucuggggcuu

SEQ ID NO: 4162333 - RNA, 66 nt, Human
aagacuguguccaugugcuggauugcaccacuuaugagcaaucagagcaagacauggaacagacuu

SEQ ID NO: 4162334 - RNA, 114 nt, Human
aagagaaaagauaugggauaggucugugcacuuaggauaggguagaaauggggagaaggaucacaucccugacuucuaggugacauaucagaguuuauguccuguguaucucuu

SEQ ID NO: 4162335 - RNA, 80 nt, Human
aagagaaaugagcaaggaaggagagaugaugggugucagguccggaacccagcaaacguuuccuccagcucccuucuuuu

SEQ ID NO: 4162336 - RNA, 71 nt, Human
aagagaagucaggaacaauaucuguccugguucugacuuggacuugauuuuguuaucuuuuacuuucucuu

SEQ ID NO: 4162337 - RNA, 70 nt, Human
aagagacuggaguuacgaguucauuuuccucuuguuacugaggggucugggccagggaguccgguuucuu

SEQ ID NO: 4162338 - RNA, 72 nt, Human
aagagcagacaggacuucacuguguugccucugauccaggaggcugcauaggcagaagcugugucuguuuuu

SEQ ID NO: 4162339 - RNA, 71 nt, Human
aagagcaggaauggggugcagagggcagacccgucaggccaggcuucccugcuuucccacuccaugcucuu

SEQ ID NO: 4162340 - RNA, 55 nt, Human
aagagcaucaaugacucgcaguuaggauuuaagucuguuuguuauuauugcuuuu

SEQ ID NO: 4162341 - RNA, 56 nt, Human
aagagccagacaagauggggacacuaacaacacaaucuccagugcuucugccucuu

SEQ ID NO: 4162342 - RNA, 69 nt, Human
aagagcgguaggagagacagaaguuagcguuuaggaaguaaauuaauuucuucaucucugcagcuacuu

SEQ ID NO: 4162343 - RNA, 84 nt, Human
aagagcugaaaucauuggaugagucugagauugggcaucaagagaucucacucuuucacuuaccagcaguguugaaagcuacuu

SEQ ID NO: 4162344 - RNA, 75 nt, Human
aagagcuguagaaauaagcuuagcuuuaggacacaguucagagcaaauuccugugagccuuguuucuuuuaucuu

SEQ ID NO: 4162345 - RNA, 105 nt, Human
aagagcuuaagucacacagcugguggaggugccaggauuugaaauuguguguguuugacuuuaaagccucuauucuuaaccacugugcuauacugcauugcucuu

SEQ ID NO: 4162346 - RNA, 87 nt, Human
aagaggaugauuauuuguguaagaugcaauaugguaguaaaacuugcaauacuuuaguuuguauuuuauauuuggguuauuuugcuu

SEQ ID NO: 4162347 - RNA, 83 nt, Human
aagaggcuuucuaaauguguaauugcaggcaaguaacaacacuugagucuccuucauugcaucuuuaagagagagaaccucuu

SEQ ID NO: 4162348 - RNA, 81 nt, Human
aagagggcacaauugaaugucacuuauggggcaguggaagcacuuccucuguuauauugguauauuuacauggacucaauu

SEQ ID NO: 4162349 - RNA, 98 nt, Human
aagaggguuagaaacauaucucagaguguacaagauuacgaauuguuuggaaugauuuuuagcuauucugaagauguguggacuuaacauagccccuu

SEQ ID NO: 4162350 - RNA, 81 nt, Human
aagagguaaggaagaacgaacuuugcuaauuguucuuggucaaagacauuaccuggcauuugaucuucagacaggccucuu

SEQ ID NO: 4162351 - RNA, 60 nt, Human
aagaggucugcauggcagcuggguccacggccagguaauccagcagcucaaggaucucuu

SEQ ID NO: 4162352 - RNA, 68 nt, Human
aagagguggagcagauaucuuucccagcccucugcugugacagaauuggucuguucucucaccuacuu

SEQ ID NO: 4162353 - RNA, 58 nt, Human
aagaguaauaaagucucaggacaguccucuccuugggcucugggacuccugauaccuu

SEQ ID NO: 4162354 - RNA, 78 nt, Human
aagaguaggccuaugggcacaggaugagcacaaaacuguaugugucuucuaacaucaguguucacuauuccuucuuuu

SEQ ID NO: 4162355 - RNA, 76 nt, Human
aagagugcuggacucaugaccagaaggccuggcaucagguuuggugcugccaauuucuggucuugaacaagcuuuu

SEQ ID NO: 4162356 - RNA, 65 nt, Human
aagagugguguuuggcuggcaaauucugauucaucuuucaggacccugcucaagcaucuccucuu

SEQ ID NO: 4162357 - RNA, 75 nt, Human
aagagugugugugugugugugugugugugugugcgugcaugcacgugcacacauguguacaagugcauuucuuuu

SEQ ID NO: 4162358 - RNA, 61 nt, Human
aagaguuauuagucaaauagggaaugauuuacauuguuauaacccaauacuaaugacuuuu

SEQ ID NO: 4162359 - RNA, 62 nt, Human
aagaguuugucagaucugcacgauucugcauucuugugcuuucagcagucuaacacacuuuu

SEQ ID NO: 4162360 - RNA, 99 nt, Human
aagaguuuuagaguuuucauucuuaaauuuaggucugugauucauuuugaguuaauuucuguguaugguuugaagaaugagcccagcuuuaauucuuuu

SEQ ID NO: 4162361 - RNA, 66 nt, Human
aagaguuuucuauaaucuuggcaagacuuauaauccuuguccuucagagaauugugaaaaucucuu

SEQ ID NO: 4162362 - RNA, 72 nt, Human
aagauaagaggccaguauacaaacuuccggugugcugggcacugggacuguaugugcuggacugaaaaucuu

SEQ ID NO: 4162363 - RNA, 77 nt, Human
aagauaaucugaggcuagugauuuuagagacuuagcagcuuccagcugagucucuuaaagacaguguugacaauuuu

SEQ ID NO: 4162364 - RNA, 84 nt, Human
aagauaguguuuuuuaaaauccaggagaauuuccacuuggauuuuuuucaaguggcuguuagacugaggugauuauauugucuu

SEQ ID NO: 4162365 - RNA, 59 nt, Human
aagauccaugagggcagagauugugucugucuuauucagcauuguguuuucaggaucuu

SEQ ID NO: 4162366 - RNA, 65 nt, Human
aagaugaaacaguaggcaugaauugcacugaaaauauuguuugguugccuuuccuguuucaucuu

SEQ ID NO: 4162367 - RNA, 87 nt, Human
aagaugaaagaaguucacagacuggucagucaacuuauuuuuugaaccauguauuagcugaugguccugucuuaauuccuuuaucuu

SEQ ID NO: 4162368 - RNA, 66 nt, Human
aagaugaaggaacuaacuauguagagauucaggcucucuuaucucucguuuuuauucccucguguu

SEQ ID NO: 4162369 - RNA, 127 nt, Human
aagaugagagagaaucuauuuuaaaaugucaagcacauugccuggcacauagguuuuaacauuuaaggcaugaaucuaaguguacaauauguuugugucuuuugaaauauaaauuauccaucaucuu

SEQ ID NO: 4162370 - RNA, 64 nt, Human
aagaugauguuguguuuucacuuuguuggugugaauaguugagugaaaauauccaacucauuuu

SEQ ID NO: 4162371 - RNA, 55 nt, Human
aagaugcuaauuguggaaguugcuuuucaugcaaauaaaaccuaguuggcaucuu

SEQ ID NO: 4162372 - RNA, 129 nt, Human
aagauggggcuugagauaggccuuggcggccccauucaguuugccuugguggagagaaaacagugauccucuacuguagugaugcugcaguguagggcugugaauguaggcaugcuuaagccaggucuu

SEQ ID NO: 4162373 - RNA, 129 nt, Human
aagaaagaauugagguuggcuaaguagacaaacaaugagcuuacgugggaacagacuguguuguaaauaaaggcauugcaguguucuagcgcugugcuuguuguauugagccugcaacuuugagaacuu

SEQ ID NO: 4162374 - RNA, 60 nt, Human
aagaaagggaguggacaacaggcacagcggcaaaacaagcugugucaguuucccuuucuu

SEQ ID NO: 4162375 - RNA, 65 nt, Human
aagaaaggugacugcagcagcuauucacucaacccugaaaggcugaaaauggggucaccugucuu

SEQ ID NO: 4162376 - RNA, 107 nt, Human
aagaaauaaauacaaaagauaaacacagcaauacuggcugucaaagauggaaaauaaccauuuagacaaucuaauauuguuuuguuuugguuugguuuuuacuuuuu

SEQ ID NO: 4162377 - RNA, 89 nt, Human
aagaaaugucagagaagagcaaugauaaauuuucucuuuacaucaagaagaccaaguucaagucugcaucuuuuuuugauuaguuucuu

SEQ ID NO: 4162378 - RNA, 99 nt, Human
aagaacauuaagcaaacaucuuagccauagaguuauaaauaugucaggaauacagacuuuccugccgcucuaugagcagaaugauuguuccauguuguu

SEQ ID NO: 4162379 - RNA, 59 nt, Human
aagaaccgagauuacaugauccaucagcacuucagcugauucucugacucuuggcuuuu

SEQ ID NO: 4162380 - RNA, 80 nt, Human
aagaaccuuuugaucagguugcugugguguauuagauccacuauuauaaaaccaugcuccugauuuagugaggauuucuu

SEQ ID NO: 4162381 - RNA, 130 nt, Human
aagaacucccuccucccaggaacucuggggaaccuagggcaggauggguggggcgucugaagugcccaaaccucuccuagcucuccuccuggucccucggccucccaccuggcuuccuacaaaaucccuu

SEQ ID NO: 4162382 - RNA, 55 nt, Human
aagaacuguaauaggaggucaaaggaaagggcuuauugaaauccauuacguucuu

SEQ ID NO: 4162383 - RNA, 63 nt, Human
aagaacuguuuacaauuuucacccuggaaagguuuuucucuugugugaacuguagauagucuu

SEQ ID NO: 4162384 - RNA, 64 nt, Human
aagaagauucugcuuaccauuugaucugcagauuuguagguuccuuaucugagcugagcuucuu

SEQ ID NO: 4162385 - RNA, 69 nt, Human
aagaagcuggcagcaggagaguaauagcggucaucuggaauagauuguaucgcuuuuuucugucuucuu

SEQ ID NO: 4162386 - RNA, 57 nt, Human
aagaaggccugguagacgucuugaaagucuaauaucgggagcucugucaugcuucuu

SEQ ID NO: 4162387 - RNA, 96 nt, Human
aagaagucugaauagaaaaacauaaaguuaagcuguaaguauuuuguccauaaaaugaaugcuguaaggcuuugugcuuuugacucuaggcuuuuu

SEQ ID NO: 4162388 - RNA, 58 nt, Human
aagaagucuggagcaaugcaauuggaacaaugacuaacaaguaagcaccagaccucuu

SEQ ID NO: 4162389 - RNA, 83 nt, Human
aagaagugaguuacugagagaucaagccacaggauggugggaguaggccaagauccagugcuugacuguugaacuugcuuuuu

SEQ ID NO: 4162390 - RNA, 83 nt, Human
aagaaguuacagucaggagauauuuuguucccuauagaaacugaauauaacaucuuaaaauuugucccugaguguuguuucuu

SEQ ID NO: 4162391 - RNA, 77 nt, Human
aagaauaacuuauacacgaacacaagguguguaccaugccauguacauaucauguuugccguguauaucuuuagcuu

SEQ ID NO: 4162392 - RNA, 73 nt, Human
aagaaucagacccacuguagccacucuggguaacucuuucaauauagaagcucagagugauacauuuauucuu

SEQ ID NO: 4162393 - RNA, 99 nt, Human
aagaaucuaauuuggucuccugguugagucauccauuuacuccauggacacguaaguucuauuucugguggcaaaucaggacacuucuuugcauuacuu

SEQ ID NO: 4162394 - RNA, 102 nt, Human
aagaauggaugaggcuuuuaugguggucagggagcagagccaugaugaauauucccacgugucaucugagccuugggcgauuugaaauccuacacccaucuu

SEQ ID NO: 4162395 - RNA, 66 nt, Human
aagaauggggaagacagcagacacugucucugauguugacauauccugcuuugucuccccucgcuu

SEQ ID NO: 4162396 - RNA, 69 nt, Human
aagacaacaugacauaguagaaaagcccuuguuugucaaucaggaagccugggcucuacucucagucuu

SEQ ID NO: 4162397 - RNA, 83 nt, Human
aagacaauuuuguggaucugucaaauggauuuugucagaaugagcugauggaauucauuaagaaagagcuaaagaacuguuuu

SEQ ID NO: 4162398 - RNA, 65 nt, Human
aagacacugggggcugcagccaagagagcagaaggaguugguggcagcauggucccaguguacuu

SEQ ID NO: 4162399 - RNA, 130 nt, Human
aagacagucuagugggagauguggcuggggcuaagaggaagagcugcaguuuccugggccaaagagcugaguuggacagggagauggcagcuuaccaaggccugcugguucucagcucuagagucugccu

SEQ ID NO: 4162400 - RNA, 55 nt, Human
aagacagugaucucugagagauggaaacaaccaagcugagaacuaugacugucuu

SEQ ID NO: 4162401 - RNA, 63 nt, Human
aagacaguugcugaaguaugaaaaagacaguuacuaaacugucuuuaguucaguaacugucuu

SEQ ID NO: 4162402 - RNA, 61 nt, Human
aagacccgucuccucagggcugggggaaggucaccagcacaggaacauggagaugggucuu

SEQ ID NO: 4162403 - RNA, 55 nt, Human
aagaccugcguuauccugccuggugucucucuccaaagcagaugugccagguuuu

SEQ ID NO: 4162404 - RNA, 82 nt, Human
aagacgcauguaaggaugaaaugaggugaugcccgcucagcacaugugaaaucucuuucucauucauacccuacaugcucuu

SEQ ID NO: 4162405 - RNA, 89 nt, Human
aagacuagcuuuuacagguggcagaagcauuuacucuggcauuccuaggauuaaguacagugcucaguaaucuaauagaagcuuaucuu

SEQ ID NO: 4162406 - RNA, 81 nt, Human
aagacucacuucucuuaggcccugauccgaauccagauuaugauggauugggcauggggaucagggcaugcagaagcucuu

SEQ ID NO: 4162407 - RNA, 69 nt, Human
aagacucagcugggagaaaguuuuagguuucugcucuaacaccugaaaugaguucugcucacugcucuu

SEQ ID NO: 4162408 - RNA, 102 nt, Human
aagagaaaacauuagguuggugcaaaaggcauugugguuuuugccuauaaaaguaauggcaaaaaccgcaauuccuuuugcaccaaccuaauauuuuuacuu

SEQ ID NO: 4162409 - RNA, 82 nt, Human
aagagaaauucaucagaaugcagccagcaguuauuauuugacuaugccuguugauucuuauuuuugccauagaaauucucuu

SEQ ID NO: 4162410 - RNA, 77 nt, Human
aagagaauguaaaaaaggaaaauugcauauagugccucuuugcugaggauacaaagguaucuuuccuagauucucuu

SEQ ID NO: 4162411 - RNA, 57 nt, Human
aagagacuuguccgaaguuguaaaauucagccauuggaacuuuagacauaaucucuu

SEQ ID NO: 4162412 - RNA, 66 nt, Human
aagagagaacuaaaagcuaacaucaggcaaguuucauauuaguuuucugcauuuuaguuuucuuuu

SEQ ID NO: 4162413 - RNA, 79 nt, Human
aagagagagauggaaauagauaguaucauucagcauucagaagcuugaagaguauuagguuauuugaaacucugcuuuu

SEQ ID NO: 4162414 - RNA, 120 nt, Human
aagagaggcacugggauagcgccaucacaacuguucacaaaauucuggccaguggaacagcuagucacaaggccaagguuuugugaacugugucuauggcuguaucucaguacaucucuu

SEQ ID NO: 4162415 - RNA, 65 nt, Human
aagagauauauauuuguuuaccacaagccguggggaguaugaugguauguagaaauaugucccuu

SEQ ID NO: 4162416 - RNA, 55 nt, Human
aagagauuccucacucagaaugucugagaagggguucugagaaaacgaauuuuuu

SEQ ID NO: 4162417 - RNA, 68 nt, Human
aagagauucugugucaaaacgaacuuguaggagaugagaagccauagcuuuguuccauagagucucuu

SEQ ID NO: 4162418 - RNA, 80 nt, Human
aagagcacacauggccuaugcuggguuuuuugccuugugcagaaauaucuuucucuguugcaagcccaguguaugcucuu

SEQ ID NO: 4162419 - RNA, 56 nt, Human
aagagcccagccacuauuaaauguuggucaaaguuuggcaacaugguugagcucuu

SEQ ID NO: 4162420 - RNA, 64 nt, Human
aagagcuagagggagaagggcacuugcggaguagccaagcugcagagagcucccuguagcuguu

SEQ ID NO: 4162421 - RNA, 55 nt, Human
aagagcuuuggagacaggcuggcugaaucugaaucccagcuugccucaagcuuuu

SEQ ID NO: 4162422 - RNA, 82 nt, Human
aagaggaagaaagcauagguggggagagggaggaaagaaacuaugaccuuggccccuauacacucugcauucuuuuauucuu

SEQ ID NO: 4162423 - RNA, 59 nt, Human
aagaggaccaguagauaaauuuugugcuuaauuuuguacuucuuuauaauuggccucuu

SEQ ID NO: 4162424 - RNA, 81 nt, Human
aagggugaaaggaaacagaguagaagaaagcagacuuucacaaaggaaaguugcugauucugucugugaucaaucacgcuu

SEQ ID NO: 4162425 - RNA, 130 nt, Human
aagguauauagcccgguugucucucauuuugcccgguguucaaagucugguaugcuuaauuccauuuugauugugcgucuuaaacuaagacaucauuuuauucuacagagcgcugucgggcuuuggccuu

SEQ ID NO: 4162426 - RNA, 61 nt, Human
aaggucagagcaggaaggagucccgugagcauaccauccucucuuacccaccucugacuuu

SEQ ID NO: 4162427 - RNA, 65 nt, Human
aaggucauugguucugaauucucagguucucucaccucucaauaagaauuuagcucaauggacuu

SEQ ID NO: 4162428 - RNA, 111 nt, Human
aaggucugaagaaacuguuuccucuucugccaagcaagucaucuuuuauagacagugagugcuggucauaaagcuuguugcauuuagagaaaauuaauuucuacagauuuu

SEQ ID NO: 4162429 - RNA, 82 nt, Human
aaggucugugugauuaucuggcauggauguugacauugaauaaacugaaaucauaaaacacaccagguaguuagcauaucuu

SEQ ID NO: 4162430 - RNA, 68 nt, Human
aaggugacguucagggggcugcaguagacuguguuagcugcuucuccucccuggggaugaucacacuu

SEQ ID NO: 4162431 - RNA, 84 nt, Human
aaggugauauuuuuauuucaugguagcaaauggauuguuuugacauauucaguguggacccauuuaaaguaggcauguuauuuu

SEQ ID NO: 4162432 - RNA, 87 nt, Human
aaggugguaguacuacaguagagaggauguagaaauagggcagaaguuguuaagucuugcucugcuguugacuacccaugugaccuu

SEQ ID NO: 4162433 - RNA, 55 nt, Human
aagguuucuccgaggcuauuuuugugaccaccauuuuagucucugaugaggcuuu

SEQ ID NO: 4162434 - RNA, 125 nt, Human
aagguuucuuauuuccaguauuaaaaggaaaaucaucaaggcaaaguaaauauucaaguggcuuugaacaauuugugccugauuguuggccuguuaucuuuaauucaacugugaaguuuaacuuu

SEQ ID NO: 4162435 - RNA, 59 nt, Human
aagguuuggauuuuguuuauuuauugguuuguuucaaccuguuccaaaggccagaccuu

SEQ ID NO: 4162436 - RNA, 97 nt, Human
aagguuuuggaaggagccuguugguaugaauccugugugagcaacacucagauuuguugcauacugaacagcaugcuaaaucucacuucacaaucuu

SEQ ID NO: 4162437 - RNA, 122 nt, Human
aaguaaaggagacuauacaguaaguguuuuuccauuccaaaaggauguuagaaugagacaucuccauccuagaaaacccuauggaacggaaaccucauuuucuuacuaaucuccugcugcuu

SEQ ID NO: 4162438 - RNA, 66 nt, Human
aaguaaaguuaggaauuuguuacuguguauauucacaaugcacauauaaguucuuuagcauagcuu

SEQ ID NO: 4162439 - RNA, 111 nt, Human
aaguaacuaacuacccaucuucaggggcuacaucuguaacuacucagucacuaguucuuagagaaguagcacucuagaagcuuaguuuccaaauauuuccaaacaguacuu

SEQ ID NO: 4162440 - RNA, 83 nt, Human
aaguaauguagcuguuuaugcacuccugccucugaauuccuuuuaacuggggccugaggagaagugcauaagcaacauuacuu

SEQ ID NO: 4162441 - RNA, 59 nt, Human
aaguacagaaauagcaggugcacauuguugaaggauguagcaacugagguuuugugcuu

SEQ ID NO: 4162442 - RNA, 118 nt, Human
aaguacaggugucuucgaaguaguucaacaugccaugggcaaaccuuuacugaguacuuaaauaaagcagagauuaugccauggaaagcaugagaacugaaaagaauauggcugucuu

SEQ ID NO: 4162443 - RNA, 81 nt, Human
aaguaccaauaguaauuauuagugauguuguuacugucauucugaaaauaauaguaaguagcuaauauuuacuggguauuu

SEQ ID NO: 4162444 - RNA, 81 nt, Human
aaguagaacucuucaugguuucaugagaauuacccauucauguguugugaguccugugaagcaugccuauugguuuuacuu

SEQ ID NO: 4162445 - RNA, 76 nt, Human
aaguagcauaauaugguaaaagaacuugagcuuuguaauuggacagagccugguucaaauuuuaccucugcuauuu

SEQ ID NO: 4162446 - RNA, 79 nt, Human
aaguauagacagcuaggccuuuucaguuucugauauuuauugucaggauuauuuuauuaaaagaagccuuacuauauuu

SEQ ID NO: 4162447 - RNA, 102 nt, Human
aaguaugaaacgaaagugcaucucuacagaaucuaugcuucacagucucuuuagugcucuguagcacugauucugcuacagcuuccauuuucauuuaugcuu

SEQ ID NO: 4162448 - RNA, 66 nt, Human
aaguauggauuccaaccugaaacaugcucccaugaauuguaggguuuuagggaggauauuuaacuu

SEQ ID NO: 4162449 - RNA, 77 nt, Human
aaguaugucaaucauacuucaauaaauuuguguacauuacuuucaaaagcuauuauguugaagagguuugcauacuu

SEQ ID NO: 4162450 - RNA, 60 nt, Human
aaguaugugauacauguuaauuagcuuaauuuagccguugcacaguguauacacauauuu

SEQ ID NO: 4162451 - RNA, 88 nt, Human
aaguauucguaggcaaaagguggcuuucauuucaggauguguuacaugggcuuucuugaaaugcaagcccauuggccugaugaaucuu

SEQ ID NO: 4162452 - RNA, 129 nt, Human
aaguauugauaaauaaaguacuaugggacauuagcuuuaaugaguugguaagauauaauaaucauuuuguauaugaugcaauacauuagaguguaaagguuugauauauuacacauaauuuaagucuuu

SEQ ID NO: 4162453 - RNA, 83 nt, Human
aaguauuguuuguggguuauguauggagucugguguucaacuucugguuuacugcuaauucuguagguuugcgcaaauuacuu

SEQ ID NO: 4162454 - RNA, 64 nt, Human
aaguauuugcuaaauaaacuaauggaaugcauauauguauucauggguuaauguuaggauacuu

SEQ ID NO: 4162455 - RNA, 66 nt, Human
aagucaaaugaucuccuggguauuuguuggagaccacagaaacagaaccaggugucauuuagacuu

SEQ ID NO: 4162456 - RNA, 69 nt, Human
aagucaacuuuggauguuagcgacugucuugggaauucuaucagagaaagaagcccauucauugugcuu

SEQ ID NO: 4162457 - RNA, 62 nt, Human
aagucaagcaagcugcuuuguuuauguagggcaugucaacaaagaaaauuguuaauagacuu

SEQ ID NO: 4162458 - RNA, 72 nt, Human
aagucauuugagcucucacuuuaaccuccuaggcuauugggcuuuggaacuguaaggagauggaaauggcuu

SEQ ID NO: 4162459 - RNA, 57 nt, Human
aaguccagcauuuggguagauugaucacaagcaacaggucuaacccaaaguugacuu

SEQ ID NO: 4162460 - RNA, 75 nt, Human
aaguccuugcucuuuucacuguaauaugcugcgugucugaucacauggaauauuugugguaaagguaagaaacuu

SEQ ID NO: 4162461 - RNA, 75 nt, Human
aagucucagaaaacuaguguggcuccuuuuaaaauuuuugcuggacccuauuccacgcagguuuuguugaggcuu

SEQ ID NO: 4162462 - RNA, 55 nt, Human
aagucuggagcucagacuugggagccugguguuccuggguuugaauucuagucuu

SEQ ID NO: 4162463 - RNA, 55 nt, Human
aagucuguuugagugucacacugugaaaucuccagugagggcugcaggcggacuu

SEQ ID NO: 4162464 - RNA, 68 nt, Human
aagucuuugcuauugugaguagugccacaauaaacaugugugcaugugucuuuauagcagcaugauuu

SEQ ID NO: 4162465 - RNA, 88 nt, Human
aauaucaggagguggggcucacuggggccaucuugaagguaguagccagcuuucaagauggcaccagugagugccaccucuugauauu

SEQ ID NO: 4162466 - RNA, 101 nt, Human
aauauccuucacuucacauauuacgaggccucagaaauagaguaaaauugacugucaauccuagcuuuauaugaggugguaagugaagaaagaaggggauu

SEQ ID NO: 4162467 - RNA, 108 nt, Human
aauaucuuucuaauuaaccugcuccauacuucaacaccauaugguccuguuaaaaagcagauaacauauaccuggguggggguagagggcaguuuauacaucauuguu

SEQ ID NO: 4162468 - RNA, 76 nt, Human
aauaugcuuguuuguaaggcucuuagaauaacugucuuugacugcucauuuuuagucuugcugcaaucaguauguu

SEQ ID NO: 4162469 - RNA, 71 nt, Human
aauauggcuuuacuuaaacugaaucacaugaagaacuuucuaaaugguucacuaugggcauaagucauguu

SEQ ID NO: 4162470 - RNA, 73 nt, Human
aauaugguggcaaaggcaugauuaauucugugucucauacuugacacagguaucauugccuguuguuuguauu

SEQ ID NO: 4162471 - RNA, 62 nt, Human
aauauguaguguugagaaugcuugcuaucaaaauagccugaagcacaaaagcacagcuuauu

SEQ ID NO: 4162472 - RNA, 98 nt, Human
aauaugugcucuuuuugugucuagcuucuuuaauucagcaugauguuuuugagccuuauccgcaucaugcugaauuaaagaagaacaucguacauguu

SEQ ID NO: 4162473 - RNA, 94 nt, Human
aauaugugugacuaagggugaagguaaaggaaggaggcuuuuaaaauuaauuagauaugccucugcuuuauuuauugacuuuuucacauguauu

SEQ ID NO: 4162474 - RNA, 82 nt, Human
aauauucauuaguuuguggaagaugguagagaauuguuccaagaagaccauuauugccagcuauuacaacauauuggauauu

SEQ ID NO: 4162475 - RNA, 104 nt, Human
aauauucuuucuguuacaguaaaccacagacccagacuagagagaucaauuaggaauuauuuauucacaaaucucagucuuuuugguuacucaaaaguaguauu

SEQ ID NO: 4162476 - RNA, 56 nt, Human
aauauuggagaaaaguuaguggcauugcauuuuaugucaagcuaguuuccaaaguu

SEQ ID NO: 4162477 - RNA, 103 nt, Human
aauauuguucuugguguauucugagaguauuuuggcauuaucaguauguuauuaaaauacugaagagucaugaaaauauuuauuagaauaaaagggauauguu

SEQ ID NO: 4162478 - RNA, 77 nt, Human
aauauuuaucgaaugccuacuauguuccaggcaccauccugggcccugagcacacaguagcaaagaaaacaaauauu

SEQ ID NO: 4162479 - RNA, 80 nt, Human
aauauuuccaagccaguaaguuuuugucauuuuuuauaauguaaucuaaaugaugaaauguguuggcucugggcuguguu

SEQ ID NO: 4162480 - RNA, 60 nt, Human
aauauuucuccuucguuauagcuucacaaguuggcuaaagacugaggaaggggaaguauu

SEQ ID NO: 4162481 - RNA, 109 nt, Human
aauauuuugauaacuguauuucaagauauuugguuuccuuugauagcuguuucaauauaacugguuuccuuggugcccgauguauuuauguuauggguuuaaaaauauu

SEQ ID NO: 4162482 - RNA, 66 nt, Human
aaucaauuuugaggauacaagaaguuccugggaauccacacugcuauucuuguaccuuaaaugauu

SEQ ID NO: 4162483 - RNA, 55 nt, Human
aaucacacuuauccucaauagccauauuuauggcuuccuguguaaugaggugauu

SEQ ID NO: 4162484 - RNA, 55 nt, Human
aaucacaugaaaacuguguguuuaaguacuagaauacaagucaauccaugugauu

SEQ ID NO: 4162485 - RNA, 58 nt, Human
aaucacauuaagcccuguucagugaaugacaaacuugacucugggaguuuaugugauu

SEQ ID NO: 4162486 - RNA, 99 nt, Human
aaucagauuagaccaggcuuuaccacuugcuaaggacaugggugaauuuguaugcagauugauucacagagugguuagugguagucugguaucgugguu

SEQ ID NO: 4162487 - RNA, 78 nt, Human
aaucagggagcccugggcuccuaaccauccagguuucggaguaggaaucaugaggaaaggaguuagggcaccuuaauu

SEQ ID NO: 4162488 - RNA, 85 nt, Human
aaucaguuuggucagugaugcagauuuaauuaguauaggguaaggaccugguauuuuuauaguuuguaaagcuccccagaugauu

SEQ ID NO: 4162489 - RNA, 107 nt, Human
aaucauuggacacuugccuguugauaaggcgaugccuugcacuucguccuuuauuccugaaggagcaggagcaauggccuaucagaaauggccagguaucuuggauu

SEQ ID NO: 4162490 - RNA, 105 nt, Human
aauccaaaugauuacagauagcacuuaaauuaguugaccuguuugggagauuuuauuacuuccaaucaggauaauaauuagaguuugcuaauaaaauuuuggauu

SEQ ID NO: 4162491 - RNA, 61 nt, Human
aauccaggcaaaaaccaacuacagcuugcauuaaaauaagacugauagauguugcuggauu

SEQ ID NO: 4162492 - RNA, 129 nt, Human
aauccagugaaauguuccggauguuuuggaugagggaauucuauuucauacaggucacacucccuuaccaaccucaggccuggcugaaggaagauucuucuaauccaaaacauccugcaauuuuaauuu

SEQ ID NO: 4162493 - RNA, 72 nt, Human
aauccauaacuugcuuuggagcccggccucagagauuuaaauaaagugccggagggaggcaaguuguguuuu

SEQ ID NO: 4162494 - RNA, 67 nt, Human
aagugggaggaucucuugaggccaggaguucaagacgagccuuggcaacauagugagacccccauuu

SEQ ID NO: 4162495 - RNA, 62 nt, Human
aaguggggacaaugagagcaggucuauucagcugugagaccugugcucuuugcuccccauuu

SEQ ID NO: 4162496 - RNA, 55 nt, Human
aagugugagccagcccuuugcaugaagaagcauuagaagggaucacugcauacuu

SEQ ID NO: 4162497 - RNA, 76 nt, Human
aaguguuaaugguagaaucugaguguuuguauuagagcauuuacuguaaaaacucacucggauuugcuauaugcuu

SEQ ID NO: 4162498 - RNA, 76 nt, Human
aaguguuacauauucuaaaaugcuagcuucugaaaaugaaugcaauacaugguguuuuucuaguuauguugcacuu

SEQ ID NO: 4162499 - RNA, 86 nt, Human
aaguguuauaagacaguacuuacaguuuacauaagaauuguuuaccugaggauuuagcaugaaaugugaaaacuguuuuaauauuu

SEQ ID NO: 4162500 - RNA, 79 nt, Human
aaguguucuccugaggacccuuaggucagacagagaagcuuucucuuucugaugggaagggucaaaguggaaaucucuu

SEQ ID NO: 4162501 - RNA, 96 nt, Human
aaguguuuacaugauucuuuugaguauucucacaaaagcgcauccuuuagugcuauguuuacuuaugagacacucaacaaagauaugacaacacuu

SEQ ID NO: 4162502 - RNA, 91 nt, Human
aaguguuuuuauucguggacucucucccaggccucagaauauggaguaauuuccuguguuaaagggggugcuaggacagaguguagcacuu

SEQ ID NO: 4162503 - RNA, 90 nt, Human
aaguuaccuaccucaaguagccaguuucuuuaacagcaaagugaugauaaaaucuuuguguuaaggugguuggcaaaguguuaggaauuu

SEQ ID NO: 4162504 - RNA, 72 nt, Human
aaguuaggcucuuaagcauaacuuaaaggcccauaagcauaaauuaacuuuuaagacaugugagcauaacuu

SEQ ID NO: 4162505 - RNA, 77 nt, Human
aaguuauuaaguauuagaaugaaguauaggauuugggucuuuugaaguucuauagucuuucuacuaacugcuaacuu

SEQ ID NO: 4162506 - RNA, 61 nt, Human
aaguucagauuugacugguuucucaugagccacaugugggaauguagcaaaucugcaauuu

SEQ ID NO: 4162507 - RNA, 64 nt, Human
aaguuccuugaaugaagcuaggguucucuaccugggcuacacuuuagagucaucuagggaacuu

SEQ ID NO: 4162508 - RNA, 95 nt, Human
aaguucucccacuugcaauauauaaugaggagacauauuuuugaagcaauuaacuguuccuucaaaauuguucuuuauuguugguguaaggacuu

SEQ ID NO: 4162509 - RNA, 110 nt, Human
aaguucuugacugcauuguuuggccuucugguguucauuuuggcuuaugaaugcaaccaauccuuaucuuggcuaaugugaauauaagugggcugucuuguuggggauuu

SEQ ID NO: 4162510 - RNA, 98 nt, Human
aaguugcaaccuagugaugcaucuucagcccucagccagguuucuacucagauguggacccugagcugguggaagcaugcagauuaauugugaaacuu

SEQ ID NO: 4162511 - RNA, 60 nt, Human
aaguugcaagauguucaugggcuguuuugauaauagagagaacacgugcaucugcaauuu

SEQ ID NO: 4162512 - RNA, 85 nt, Human
aaguugcaaugcaugggugucaugcucucgucucauauugccugaagaguguguucaguaugacauucacaggccucugcaauuu

SEQ ID NO: 4162513 - RNA, 60 nt, Human
aaguugcuguuucucugugucugguggaaggugucuaugguugcagagugagggucucuu

SEQ ID NO: 4162514 - RNA, 57 nt, Human
aaguuuacugauucuucugucagcucaaaucugcuguugaaguccucuaguaaauuu

SEQ ID NO: 4162515 - RNA, 81 nt, Human
aaguuuacuucuacagucuuuggaaagagauaguuugcaaagcaaauugauacuuuaaaaaaggcuguagggggaaugcuu

SEQ ID NO: 4162516 - RNA, 55 nt, Human
aaguuuagcgcucucucaaggaguucaagagcuucagagccagacugcugaauuu

SEQ ID NO: 4162517 - RNA, 72 nt, Human
aaguuuaucaacaugugagaacucaggaaauacuguuccugcaaguuuuuccugauuuuacagaaugagcuu

SEQ ID NO: 4162518 - RNA, 64 nt, Human
aaguuucagagaauuagaagcugauuuuagaaaaguaagauuaggugaauauucucugaaauuu

SEQ ID NO: 4162519 - RNA, 99 nt, Human
aaguuuccuucaaaaagaugugccaaauuauuggguaccauuuuaaaaaauuaaaaaguuauuaagaagguacucaaagaucuguauauaaggaugcuu

SEQ ID NO: 4162520 - RNA, 87 nt, Human
aaguuucuaauguguugugugccaguuacuaacaccuuuggcuccaugucggaguuaaaugucaguagcuuaaccauaagggaauuu

SEQ ID NO: 4162521 - RNA, 55 nt, Human
aaguuuggaagccgucugcaaaucuccugggguucucagaauaaauuccuaacuu

SEQ ID NO: 4162522 - RNA, 58 nt, Human
aaguuuguggucauuuauuauagcgcccagaaggcacuaagguaauggccaagaauuu

SEQ ID NO: 4162523 - RNA, 84 nt, Human
aauaaaacuuauuuuaagccagggguugguaugcuaugaccugcaggccaggcuggcccaccucuugucuuuuuaaguuuuauu

SEQ ID NO: 4162524 - RNA, 130 nt, Human
aauaaaguuuuauuggaacacagccaugcccauucaucaugcccauugucuauggcugcuguccugcugaaaggcgaagcugaagcacugggauggaagcaguaugaccacaaaucuggaaauauuuacu

SEQ ID NO: 4162525 - RNA, 81 nt, Human
aauaaauaaugacagcauuuaaggacugcugacccugagcuaggcaguguucuaagucuuuacauguguuauauauuuguu

SEQ ID NO: 4162526 - RNA, 69 nt, Human
aauaaaugucuguaggggcugcaggcuucauuguuugguaagccugacagauuucuccuaucauuuguu

SEQ ID NO: 4162527 - RNA, 81 nt, Human
aauaaccaugaguaugauuauacccaguaaaaucggcuaccuaaaaagacuauacuguugauuucauguuuauggauuguu

SEQ ID NO: 4162528 - RNA, 88 nt, Human
aauaacucaucugccugcugauuaguauugucugagggaaacaaggcacuccgagaacaggauacucaguuagggggcuaugguuauu

SEQ ID NO: 4162529 - RNA, 73 nt, Human
aauaacuugaagaucucuuccaaaccugaaauuguguguaucacagacauugauggaaggcaucugcauuauu

SEQ ID NO: 4162530 - RNA, 74 nt, Human
aauaagaauauuucauugaucaccaaauuugugccaggcauuguacugggugcuucaaggaaugucauuuuguu

SEQ ID NO: 4162531 - RNA, 126 nt, Human
aauaagcaugauauaaucuguaggaugcuuuguuuggaaauaguuugaaagauacaacagagauaggaagacuguagaauagacuuuucaaaaucuagaccacagauuauauuuaagugacuuauu

SEQ ID NO: 4162532 - RNA, 87 nt, Human
aauaagccgcggcauuuguaaaagcuagucaaugauguauuagccucuggauuaucauaaaacuaguuugguaauucugugauuguu

SEQ ID NO: 4162533 - RNA, 59 nt, Human
aauaaggugugggugcuaauauaucacaaacuauaauauauuugcaacuacaucuuauu

SEQ ID NO: 4162534 - RNA, 61 nt, Human
aauaagucacagcagaaggagcaauuuaggagauuguuuuuaaacaugugacugaauuauu

SEQ ID NO: 4162535 - RNA, 64 nt, Human
aauaagucuuuuacuuaguugacauguaucaauuguguguuuucuggguggaagguacuuuauu

SEQ ID NO: 4162536 - RNA, 60 nt, Human
aauaauaguugcaaaguguuuagcacagugcuagacuuacaacuaguugcaguuauuauu

SEQ ID NO: 4162537 - RNA, 84 nt, Human
aauaauuauguuuugggaagugcuuccauugucuacugcugugugacaaacuccaggacuuagugaccuaaaacaacaguuauu

SEQ ID NO: 4162538 - RNA, 84 nt, Human
aauaauucuacgugguuuuauucacccacucagcaagugguacauaaucaauugucaagaaaaauggaugaagcguaaauuauu

SEQ ID NO: 4162539 - RNA, 86 nt, Human
aauaauucuuucuguauguucagugacaucuuugggugcccaauaaccuaagugucuaaaaggcagaacugcagaucauauuuauu

SEQ ID NO: 4162540 - RNA, 67 nt, Human
aauaauuugugaggcuguuuugaggauuaaacaaggaugucucagaaaagagcuucagaaauauauu

SEQ ID NO: 4162541 - RNA, 67 nt, Human
aauacaagacgagggaaguucuuuugacauacaaguuugagagaacuucuuuuguaguuccuuuauu

SEQ ID NO: 4162542 - RNA, 61 nt, Human
aauacaggaaguuacagacuaugaacacugguuaccagcuucagucuguggcuuccuuauu

SEQ ID NO: 4162543 - RNA, 83 nt, Human
aauacaucuggugagaagccguugccagucccagccccugcuuugagucugguauuggucuuuaaucucucauucuguguguu

SEQ ID NO: 4162544 - RNA, 78 nt, Human
aauacaugggauucaguuucauggcacagcuauauuuagcugaagauagcugugccaugaaacugaaacccacauauu

SEQ ID NO: 4162545 - RNA, 96 nt, Human
aauaccugagagauagaaugauauaguauauaggacaagucccauaauauaauuaaauauggcacugauguuuacugcauucuauuugcuuguguu

SEQ ID NO: 4162546 - RNA, 63 nt, Human
aauacucauuagcacucuaaggaagagauccuauugggucucuucucugugcugagagauauu

SEQ ID NO: 4162547 - RNA, 85 nt, Human
aauacuggcuuuugucauuaucuuugaaguugaaguaguuggccucugucaacccuugucuucaaaguuaagaauuugucauauu

SEQ ID NO: 4162548 - RNA, 96 nt, Human
aauagacccauuuguccagcaaagauauugagcacucacuccuauucauauuuguugagcacucacuccuguuugucugcuggacaaauagcuguu

SEQ ID NO: 4162549 - RNA, 120 nt, Human
aauagagaauugaaagugaaaauguagcacugaaugcuuuuacuguaaugccuaguguugucagugucaguaguaucacagugucauauuaucaaugugauauuuguucguucaucuauu

SEQ ID NO: 4162550 - RNA, 130 nt, Human
aauagagagcuagugcuuugguaauacguguguuuaaauauuuguguauuuuuaaggauaauuuaucuuuuuuuaaaaaaagaguauuugguauagaacacucuuuaaguauuaguaaaggcuaugguuu

SEQ ID NO: 4162551 - RNA, 63 nt, Human
aauagcaaaaaugaacaaagcuugcauuuuaaaaacagcaggaauagagguucauuuguuauu

SEQ ID NO: 4162552 - RNA, 67 nt, Human
aauagcaccugagguaguuuguagacucugguucugucuaauaaauuggcuucuucaggugucuauu

SEQ ID NO: 4162553 - RNA, 122 nt, Human
aauagcauuagaauuauuuguuuguuaaaaguuagcuaggacaaaguguaaaacaaucuaauccugaugacacuuuuaauaguagauuuuuaaucagcuuugugauuucuuuaauaguuauu

SEQ ID NO: 4162554 - RNA, 110 nt, Human
aauaggcagugagcauguuuaagccauuaugaacacuauuuuuaagggcuuuagcaaauuaauuuuaugcaaaugguguuucuaaugcuagagcugcuaaucuguucauu

SEQ ID NO: 4162555 - RNA, 62 nt, Human
aauagggaugacuaugauucccaccucaugaguuaggaggauuaaaugagaucauuccuauu

SEQ ID NO: 4162556 - RNA, 83 nt, Human
aauagguagucauauagagggagaaaucagaaaggcaaaucuuuucgucugucuccuugcuuuucccuguaguccuaucuauu

SEQ ID NO: 4162557 - RNA, 85 nt, Human
aauagugccuaccuaguggcauuguugugaggauuaagcuaauuaauauaggaaaguucuuacaguagugccuggauguacuauu

SEQ ID NO: 4162558 - RNA, 59 nt, Human
aauauaugauauugcuuugggcauuuacaauuucaguaaaugguauaaugucauguauu

SEQ ID NO: 4162559 - RNA, 77 nt, Human
aauauauuuucucuucaaagauuauugaaaacaaacugaaaaccagguuguugucauuuugaagggugguuuauguu

SEQ ID NO: 4162560 - RNA, 92 nt, Human
aauaucuagagagauugggagugggaggcugagucuggaggugagauaucuguauccaaucagagaaguuuccuaugccuuccuguaauguu

SEQ ID NO: 4162561 - RNA, 67 nt, Human
aauaugauccuuaaccuucauguuacagugagagauaaauuagcaucaugggaaguaggauuauauu

SEQ ID NO: 4162562 - RNA, 57 nt, Human
aauaugaugcuaagcggugacauguacugaauauuugcuguugccagguaucauguu

SEQ ID NO: 4162563 - RNA, 55 nt, Human
aauaugcauuauacagacugaugccgaguggcguucaaucuguguaauacauguu

SEQ ID NO: 4162564 - RNA, 78 nt, Human
aauaugcuucuuuuucacuuauccugaauaaacauauguaagucuuacaucauggaggguauugaaugaggcuguguu

SEQ ID NO: 4162565 - RNA, 84 nt, Human
aauauguaucugaggaguaaacauuucagauuuauuuucauuuguauaagguaaaugaauguuuagucuuuuuccagacguauu

SEQ ID NO: 4162566 - RNA, 78 nt, Human
aauaagauggcacugaccucccuuguaaguacagagacaauguggagcuuuggggcuggucagaaucugucacuuauu

SEQ ID NO: 4162567 - RNA, 77 nt, Human
aauaagucuuguuggaguucuugcagcuuagcucuuugagggcuaaauaugcaaagcaaaaacccaauaaauuuauu

SEQ ID NO: 4162568 - RNA, 61 nt, Human
aauaaguggcagaguugguaauauuguccacaaccaccuguuaauacaucugccacucauu

SEQ ID NO: 4162569 - RNA, 66 nt, Human
aauaaugagacucaauuguguguguguauuugcuuacuuacguauauauaaguagguuuucuuauu

SEQ ID NO: 4162570 - RNA, 66 nt, Human
aauaaugugauauuucauuuacagcaguaaaggagcauagcuugugaauguuaauauuggauuauu

SEQ ID NO: 4162571 - RNA, 99 nt, Human
aauaauuuaaucggugaagcauaacugaaggauuuagaaaaagugccuaaacuauuaaaagauucuucagcugcugcuuaauguugauaucaaguuauu

SEQ ID NO: 4162572 - RNA, 80 nt, Human
aauaauuuuacucaaguaugcauuuaugguuggaaaugguuagcuaauuauaaaugagcugcuggagcauuaaaacuauu

SEQ ID NO: 4162573 - RNA, 64 nt, Human
aauacaacaaaaugaggaaguggucagcuauagagacugcauuucuuuaauguuuuguuguauu

SEQ ID NO: 4162574 - RNA, 66 nt, Human
aauacagauguuggccaagucacugguuaaugaacauuauuauucauuuuggcucacauuaguauu

SEQ ID NO: 4162575 - RNA, 61 nt, Human
aauacagucuuacuagaaaauccaagagaauucuaucuucugcaauugaugagacuguauu

SEQ ID NO: 4162576 - RNA, 79 nt, Human
aauacauaaauugaaguccuaaucuccaguaccucagaaugugacuguauuuggagaugggaucuucaaagaggugauu

SEQ ID NO: 4162577 - RNA, 56 nt, Human
aauacaugggaugcuaagagaucaaaagaagaauuauucuuaguagagcauguauu

SEQ ID NO: 4162578 - RNA, 71 nt, Human
aauacauguaaagaauuucacacaagaucugacacacaaaauauuaagaucuuaguguaugugcauguguu

SEQ ID NO: 4162579 - RNA, 115 nt, Human
aauaccaacuauacuuaagcaguccugggauacuaagaaauuuugaagugcaaucacuuccuucaaaguacuuacaguaugcuuggaaaaaaacuguuuuaaaagauaguguauu

SEQ ID NO: 4162580 - RNA, 69 nt, Human
aauacucagagugguagccuauuuucugcauauaaauguaaaaauuccugguuacaacucuguaauguu

SEQ ID NO: 4162581 - RNA, 96 nt, Human
aauacugauggauguuuuuuacugguuuacccaagauuugcugaguucuuauaaugaauucggaaaagcucugugaacaggaagacaaucaguguu

SEQ ID NO: 4162582 - RNA, 67 nt, Human
aauacugcccccacucugcccagauccccucaggaccuucacugggaagagugucgguugaaguguu

SEQ ID NO: 4162583 - RNA, 76 nt, Human
aauacugcuuccauucuguaauuuucucuucccagcgcacccgugggaccuguuacauugaguuagaggcaguauu

SEQ ID NO: 4162584 - RNA, 75 nt, Human
aauacuggcuuugagacugaguggcagguguagaaaaacaacuguaacaucuauucagccucuaagacaaguauu

SEQ ID NO: 4162585 - RNA, 69 nt, Human
aauacuucaugaaaguugggcuguuuaaaaaacauacuagcaacaagcccacauuggugcaugaauguu

SEQ ID NO: 4162586 - RNA, 67 nt, Human
aauagaagaaguagauagugcuacggaguuuuaagggagguccagggcuuaucugcuauaucucauu

SEQ ID NO: 4162587 - RNA, 56 nt, Human
aaguauuuuauauggugguuguguaguuuaagugaaauuauacauguaaagugcuu

SEQ ID NO: 4162588 - RNA, 72 nt, Human
aagucaacuaggugguucuaucucggccucucagaaugccugguaccucagcuuggacagcuugguugacuu

SEQ ID NO: 4162589 - RNA, 57 nt, Human
aagucaagauaaaggugcuggcagauucaguugcuaugaggacccuuauccuggcuu

SEQ ID NO: 4162590 - RNA, 124 nt, Human
aagucaaggcaucagcagggcugugcucccucuggaggcucuaggggagaagcucuucucugccuguucaagucuucuagaggcugcucacauuccucagcucaucucacucccaccuuugcuu

SEQ ID NO: 4162591 - RNA, 74 nt, Human
aagucaaugugcuuugcuuuuagaguaaguuucaggccauugcuugaagcaaugauagcagaaugaauugauuu

SEQ ID NO: 4162592 - RNA, 60 nt, Human
aagucacacaguuaacaugaggaagauuuauggggaauugaacuuauauuugugugauuu

SEQ ID NO: 4162593 - RNA, 86 nt, Human
aagucaccucuguccccacccacaugcgcacugcuacacgcugugccuaccaaggcuggcagaagugugcuggcugggagugauuu

SEQ ID NO: 4162594 - RNA, 59 nt, Human
aagucacuugauuguugacagaauuuauuucuuugcaccuguugaauucauggugacuu

SEQ ID NO: 4162595 - RNA, 61 nt, Human
aagucccaucugccuccauguaccagcugaucgcagagcuggacuggggcaggcugggcuu

SEQ ID NO: 4162596 - RNA, 56 nt, Human
aagucuaaccuauuccgguguucucucucccaugagacaagccguuauauagacuu

SEQ ID NO: 4162597 - RNA, 77 nt, Human
aagucugcuuuuaauuagggaggacaaagguacacaucucacauucaaguugcccauucuuccuaauuuguaggcuu

SEQ ID NO: 4162598 - RNA, 61 nt, Human
aagucuggaagucucaguuuucucaucuguaaaauggagauaauauagacuuuauagacuu

SEQ ID NO: 4162599 - RNA, 59 nt, Human
aagucugggaucagggugccagcaugguugauuucuggugagggcucucuuccagacuu

SEQ ID NO: 4162600 - RNA, 70 nt, Human
aagucuuugcuauugugaauagugccacaauaaacauaugugugcaugugucuuuauaguagcaugauuu

SEQ ID NO: 4162601 - RNA, 70 nt, Human
aagucuuugcuauugugaguagugccacaauaaacauaugugugcaugugucuuuauagcagcaugauuu

SEQ ID NO: 4162602 - RNA, 119 nt, Human
aagugaauaaaacagauaggagaggugagacagaugagacuccaggaccuuugcuucaaaguagucacagucucaucuguuuuauauuuugaacuuuuauaguuugguguguaucacuu

SEQ ID NO: 4162603 - RNA, 57 nt, Human
aagugaauggggcagacuucaggguaugagccugacaugaacuuucucccuucacuu

SEQ ID NO: 4162604 - RNA, 70 nt, Human
aagugaauguuagguggaaauucccaaaugcauuuuccaauguuaggaagcuucauaccuuuauuuacuu

SEQ ID NO: 4162605 - RNA, 78 nt, Human
aagugaauuaaaggaauucgaauucuggaaggaauguuuuuuuagcucuggaaggauucugauuuauuugauuuauuu

SEQ ID NO: 4162606 - RNA, 76 nt, Human
aagugacucagccuggcucuuggggcccugcccagaguccccccaggcuccuaagagcugaggcauugggacauuu

SEQ ID NO: 4162607 - RNA, 81 nt, Human
aagugagauauuuuguaagagcauauguaaagguacuagcucagugccacacauuauaggcacuugucauguaguucacuu

SEQ ID NO: 4162608 - RNA, 71 nt, Human
aagugaggaaauugucuuuuuccuugucagauucuaaacccuggcauggagucugacuguuuucuuuucuu

SEQ ID NO: 4162609 - RNA, 59 nt, Human
aagugaguggccuggagaggugaggaaagaaucaaugguaacuccaaggucucuggcuu

SEQ ID NO: 4162610 - RNA, 57 nt, Human
aagugagugguaaggagcaugggcuauaaucagugccccuggcucugucacucacuu

SEQ ID NO: 4162611 - RNA, 61 nt, Human
aagugaugccaugaugcaagccaggcucuggugagcagcuggcucuguagguggcauccuu

SEQ ID NO: 4162612 - RNA, 73 nt, Human
aagugaugcuuuuacacucaucugggaggggguagggucagcauccccuggcagaagguguagaagccuauuu

SEQ ID NO: 4162613 - RNA, 69 nt, Human
aagugauucauugaugaugaggugccauuauuuuugaaaccugcacuugagucgacguaugaauuacuu

SEQ ID NO: 4162614 - RNA, 64 nt, Human
aagugcaggaguggggaaaguagcugccaaccuggaaguuuuuaaucccccuuccugaacacuu

SEQ ID NO: 4162615 - RNA, 116 nt, Human
aagugcauuaaaaugcuuucucagauuuuacuacuccaauuaaugauuccauuuucuucaaggguuauugacugaaaugagagugauucccaugugggaggcauguucauguacuu

SEQ ID NO: 4162616 - RNA, 66 nt, Human
aagugcauuacaggaauuuguuacugaaccuugugaguuuuaguagaaaacagccuguguugacuu

SEQ ID NO: 4162617 - RNA, 90 nt, Human
aagugccgagggcacagaccuuagggagacacucacugucacgguugugcaagugcagcaucuccuuaaaucuuguccccugugugucuu

SEQ ID NO: 4162618 - RNA, 61 nt, Human
aagugcuagugagucuauuguaugguagauaaugacagaauagccuugacucacagcucuu

SEQ ID NO: 4162619 - RNA, 62 nt, Human
aagugcuuuauaaacaaugaagcauaaugcuaauaguguaacagauuguuaauagaguacuu

SEQ ID NO: 4162620 - RNA, 86 nt, Human
aaguggauggucacugauccaguaaaagucuccauuuuacccaucuucaagacuaaaacucagggcuagguuaguggcuaacauuu

SEQ ID NO: 4162621 - RNA, 58 nt, Human
aaguggcagacauaucacaagaguccccagacucugccuagaaacaguguuugcccuu

SEQ ID NO: 4162622 - RNA, 64 nt, Human
aagugguauccucagagcgcguggcauuauucugguucagaaauaaugucuugugcucucacuu

SEQ ID NO: 4162623 - RNA, 83 nt, Human
aagugguuugagucagcccuuuacuuccucuuuuccugaugggcagcagggcccaguggagagcugagcuuacaccccaacuu

SEQ ID NO: 4162624 - RNA, 77 nt, Human
aagugguuuuuccugucgaauacagacaaggcuugggcccgcaucucagucuucauuuguguucaagacaucuacuu

SEQ ID NO: 4162625 - RNA, 86 nt, Human
aaguguacauucaaaagcuccauguuuguuuuuauuucacaaguuaauauuaggaauuaggcauauaugcuuuuaauaguacauuu

SEQ ID NO: 4162626 - RNA, 114 nt, Human
aaguguacuguauauaaaauuagagguuacauuucauguuuaaauacuuccagggauauaaaucaguuaucuguaaauaaauguguguagccaucugugugugugugugcauuu

SEQ ID NO: 4162627 - RNA, 60 nt, Human
aagugucagcagcuugauuuauaauaucuuuauaguggugauauacaagcucuguuacuu

SEQ ID NO: 4162628 - RNA, 90 nt, Human
aagugucagcagggcucucugagggcucgagggacgcguaccucccugccucuugccagcucugcagguuacuggcccucgcuggcgcuu

SEQ ID NO: 4162629 - RNA, 56 nt, Human
aaguguuaagaaugcucuggcgguccuaggugaccgacacaguaaucuuggggcuu

SEQ ID NO: 4162630 - RNA, 82 nt, Human
aaguguuuccaaugccauuaagcuuuagggugcggggcucuaauucugggacucuaaugcuaauaguauuuuuugagcauuu

SEQ ID NO: 4162631 - RNA, 93 nt, Human
aaguuaaguaagaggcaguagccauucagaguauaugucuaauuucagcuucuuccuuauauucuuugaaauacuguuuugcccccuuaauuu

SEQ ID NO: 4162632 - RNA, 59 nt, Human
aaguuacacagaguuggaggcugaguucacuagaaggagucuccgcuuguguguuccuu

SEQ ID NO: 4162633 - RNA, 70 nt, Human
aaguuagcagcucaaguuucccaggucagcgagaguaagauuuucugauuggcuuacaugaugcuuucuu

SEQ ID NO: 4162634 - RNA, 105 nt, Human
aaguuaguggucaccaacagcaagauagcacacacugcaucuacaaauguaugugacauaucuucacauuuugugugugugugugugugugugugaccacaacuu

SEQ ID NO: 4162635 - RNA, 83 nt, Human
aaguuauucaaacucucugagucuugugauccucaucuauaaaauaggcauggaccacaauauuugugagguuuaaauaaguu

SEQ ID NO: 4162636 - RNA, 89 nt, Human
aaguucaguuucuucacugggauuucuucacuggaauaaaaauagaauaagaaguaacuuggacaaucccacaagaaacacuggcacuu

SEQ ID NO: 4162637 - RNA, 121 nt, Human
aaguucuaguuaacgaaguuuuagcauggguuuguguguagcuacuuuguguucaugucacauucuacugcagccuuaugaacagaaggggguauuuacauuuuuauggugacuaggucuu

SEQ ID NO: 4162638 - RNA, 64 nt, Human
aaguucuuguauuugccuuucucuuuucuaacuucuugagauuuggcuuuguguucaagaauuu

SEQ ID NO: 4162639 - RNA, 65 nt, Human
aaguugauuaaucuuucgagaacacccacuuugauguguuuguacuuuggaguauugagggacuu

SEQ ID NO: 4162640 - RNA, 57 nt, Human
aaguuggagaggcagacagaggcccaucucuacccuucacugccugcucuccagcuu

SEQ ID NO: 4162641 - RNA, 67 nt, Human
aauuagcuaggaaauuuugugucucuuucaaucaauuauucuuugaggccaaagacuccagcuaauu

SEQ ID NO: 4162642 - RNA, 71 nt, Human
aauuauuuaacaaucauaggaccauuuagguuaucuacuuuaucaugaaugaguuuugguuguuugugguu

SEQ ID NO: 4162643 - RNA, 83 nt, Human
aauucaaauagcuguauucuccagcucacuguccauauuguguaucuguguguguauguguguugggggagagguguugaauu

SEQ ID NO: 4162644 - RNA, 77 nt, Human
aauucagcaagugggaagguucggaugaagaucuuguggaaaauuaucugaacaaccuuuauuacuuuuccagaauu

SEQ ID NO: 4162645 - RNA, 68 nt, Human
aauucagugagguggggcuuauguucacuaucugggaauuucacaggcuggccccucucacaggaguu

SEQ ID NO: 4162646 - RNA, 67 nt, Human
aauucaguuauuuacuuugcuauagaccagagaaaaagggaaaaugauagugauagauaacugaguu

SEQ ID NO: 4162647 - RNA, 61 nt, Human
aauucaguuggcaaacaugcugauugaucaucugucugcaugccuucugccagauugaguu

SEQ ID NO: 4162648 - RNA, 62 nt, Human
aauucaucugguagccacagucauugcauuuauuuuugccaguggaaggucccagaggaauu

SEQ ID NO: 4162649 - RNA, 95 nt, Human
aauucauuccagggugcauacccaugcauaccuuuagaagaaaauagccuagggugaauuucuguaugugugaugugcacccagggacuugaauu

SEQ ID NO: 4162650 - RNA, 56 nt, Human
aauuccaggggguaccauucauauuguagucuacaggaauggcuuccucugaaguu

SEQ ID NO: 4162651 - RNA, 71 nt, Human
aauuccggaggugacuuuaacuucagauuagauucuagaaucaguuuguaaaauagagucauuuaugaauu

SEQ ID NO: 4162652 - RNA, 61 nt, Human
aauagaauuuguacuguguuuucugagagcuuguucucugaaauacagaugcaaaucuguu

SEQ ID NO: 4162653 - RNA, 69 nt, Human
aauagacacuaugauaggugguauguacgaacgugacuugaugccaugcagcuuauuaaaguggauguu

SEQ ID NO: 4162654 - RNA, 80 nt, Human
aauagagaaggaaaccccuagagcaaggagcuauggcuauagcagaagcuaagcuguugcccugcucuuucuucuucauu

SEQ ID NO: 4162655 - RNA, 80 nt, Human
aauagagccgggcuaggggcgcgucacgugaccugugcagccaacuguuccgagacguggccuuugccugagcugcuguu

SEQ ID NO: 4162656 - RNA, 74 nt, Human
aauagagcuuauucugcucauuuuauuuccagcaaaaauugacugaaguauaaagggcagguugccagucuguu

SEQ ID NO: 4162657 - RNA, 60 nt, Human
aauagaggaagaaaccugauuguucguccagggucagaauaucaggauucuugcuuuguu

SEQ ID NO: 4162658 - RNA, 83 nt, Human
aauagauuuuguacuugcugaaugcaaguuggauagcucaggucaaugagcauccacugaaguauuucagcaucgugccuguu

SEQ ID NO: 4162659 - RNA, 75 nt, Human
aauagccuagcacuaaagaagccaaaguuuucucuaaaacaaucauggagaaaugcuccuuuaugcaaaguuauu

SEQ ID NO: 4162660 - RNA, 63 nt, Human
aauagcuauuugagcauauuccagcuguauuguagggucuggagaagcauucaaauaauuauu

SEQ ID NO: 4162661 - RNA, 69 nt, Human
aauaggcugaccuccuuucucgacuaauugcauuacaucgccagcuggcuccagaaggagucgucuguu

SEQ ID NO: 4162662 - RNA, 96 nt, Human
aauaggggcccgagagccaacuaauucuugauaacugugacaacuagcauuugggucuuuaacaggaauuauuacagaaugcuguugggauuuauu

SEQ ID NO: 4162663 - RNA, 101 nt, Human
aauaguaaauuuaauuuuuaaaagucugcaaauuggugaggaccacuuguauaaaauuauauauuuggccacuaauugcaucucaaauugauacagcuauu

SEQ ID NO: 4162664 - RNA, 105 nt, Human
aauaguagcacuuguuuguacuucguaguuuacaaguucuuuucacauguaacauucagaaucuuguaaaaucuugugacuuaggaaggacacauacauauuauu

SEQ ID NO: 4162665 - RNA, 88 nt, Human
aauaucaaauagagcugaugagagcagauauucuuauucuugauguuaggaagaagucauucugucuuucaccauuaguuuugauguu

SEQ ID NO: 4162666 - RNA, 88 nt, Human
aauaucaagagguggcacucacuggugccaucuugaaagcuggcuacuaccuucaagauggccccagugagccccaccuccugauauu

SEQ ID NO: 4162667 - RNA, 79 nt, Human
aauaucacagggaguguacaccauguguacaccaugucgcagggacuguauaccaugugugcacacucccugugauauu

SEQ ID NO: 4162668 - RNA, 107 nt, Human
aauaucacaggggguauacacccccugugauauuguucauaauaucagaaaaauaggggaugauauuucucccaguaucgcagggguguauacuccccugugauauu

SEQ ID NO: 4162669 - RNA, 81 nt, Human
aauaucagaaagagcuauuauuuuuuagacuggacaaaguuggcucuuuggaaguaaugaagaggugggucugacuguauu

SEQ ID NO: 4162670 - RNA, 80 nt, Human
aauaucagggaacuguacaggagacgucugugcacuaccccuccgaagaacccaauggugcaccuguagucccugauauu

SEQ ID NO: 4162671 - RNA, 115 nt, Human
aauaucaguaugggaagugguuugaaguguaacagucuacaaagugaugugugggaaaaguauuagaacucauauuuauuuuuagcuacauagaaaauuaaauuuuacuaauauu

SEQ ID NO: 4162672 - RNA, 63 nt, Human
aauaucgggcacucugcucagugcaagguuuuauuaaugaugugcugucaggggcuggauguu

SEQ ID NO: 4162673 - RNA, 57 nt, Human
aauaugguaguuacuuuuuacgucuuccugguggaggaaaaaagaggcuauaauauu

SEQ ID NO: 4162674 - RNA, 71 nt, Human
aauauggucaguaaugauucugaauaaugguuauguagcagaugccauuaaguauuauuaaugauuauauu

SEQ ID NO: 4162675 - RNA, 104 nt, Human
aauaugucauuuucauucauuuggaaacuaaagagcugugcuuugcaccacguccuugaugucagcaaagccagcucugucggacuaaaaugcagagacauguu

SEQ ID NO: 4162676 - RNA, 62 nt, Human
aauaugugaacccuccuccuaaggguuuuuauaauccuuucuaucuuggguaucuacguguu

SEQ ID NO: 4162677 - RNA, 129 nt, Human
aauauuauuuuuacugauugagaugcacacaauuuaucugcauucugaccaucuguuacuauagacagaauuugucagauaaauuuguguugaaaauuaagcaaauuaucaguacuuuaagguuauguu

SEQ ID NO: 4162678 - RNA, 75 nt, Human
aauauucauguauuugugauagaugaccaaaaacauuuaacugaugggaugggcaaugacaaaaauaugaagauu

SEQ ID NO: 4162679 - RNA, 71 nt, Human
aauauucuaauaaaugcccaucaauggaugaauggauaaaccaauugugacaugggcauauaagggauauu

SEQ ID NO: 4162680 - RNA, 76 nt, Human
aauauucuauucuccuggcaugugggucaucucucauugacaucuggagguguugcaguggggaaagcagaauauu

SEQ ID NO: 4162681 - RNA, 57 nt, Human
aauauucucuugucacccucaaccugcuuuuccccagggaggucagcaagaaguauu

SEQ ID NO: 4162682 - RNA, 61 nt, Human
aauauuuuugaggcccuguuaugugccaggcacuguuagcugauaggguuuuaguuauauu

SEQ ID NO: 4162683 - RNA, 70 nt, Human
aaucaaucaaguagauaaaaaugauguuguagaugaugucugcuagcagcucugauauuuacaauugauu

SEQ ID NO: 4162684 - RNA, 82 nt, Human
aaucaauuaccaaaugaaauagagauuuuuuuuaaagguucaaaccuuuucaaauuuuuauguuauaggguuuauauugauu

SEQ ID NO: 4162685 - RNA, 76 nt, Human
aaucaauuuggcucccacagauugcuuuuuuucacucuggccaagaagaaaaguaguccuuggagcgaaauggguu

SEQ ID NO: 4162686 - RNA, 89 nt, Human
aaucacuuaggaaaagauguuaugaaauaacuauggucauaaaugggccauggauggguuuaacauaauaucaugauccauucgugauu

SEQ ID NO: 4162687 - RNA, 69 nt, Human
aaucagauaaaggaaaagacagguuaacugugacucugcuggucaguuaagacugcuuuucauaggauu

SEQ ID NO: 4162688 - RNA, 58 nt, Human
aaucagcagaagagaggucuuacugucauagaagaauaccuugaucuacugcuguauu

SEQ ID NO: 4162689 - RNA, 71 nt, Human
aaucaggagaccaggaaggccuacagauagagcaggugcuuugauuuuucaugguuuucuggcuccugguu

SEQ ID NO: 4162690 - RNA, 77 nt, Human
aaucagguagcacaugauuuugauaugucccauuacuggugauauuuaauuuugauuaagauggugucugccagguu

SEQ ID NO: 4162691 - RNA, 130 nt, Human
aaucaguuuauaucaaauauuuuguaugauauuuuaugauaacaugaaaagugcuuaugauauaacuaauuuuaagggcugcauuugaugugucauaauauacaaaauucauuuugaaucuagauagauu

SEQ ID NO: 4162692 - RNA, 55 nt, Human
aaucaugugggauagucugcucuaaaucauguuuagagcagacugccucuagauu

SEQ ID NO: 4162693 - RNA, 57 nt, Human
aaucauugagacaaauuagcuuuaauguuuacaugugaguugagagucacgaugauu

SEQ ID NO: 4162694 - RNA, 89 nt, Human
aaucauuuuuaggaaccuacugugguuuuaauguguccccucuaaaaucagguguugaaacuaagaggugaggucuuuaagagaugauu

SEQ ID NO: 4162695 - RNA, 61 nt, Human
aauccacaggucuggucugggugggacagggugcucgcugagaaucaggcccguagggauu

SEQ ID NO: 4162696 - RNA, 63 nt, Human
aauccuagaacaggcagugguucauagcucuguugguccaguuguccugugucuguuuggauu

SEQ ID NO: 4162697 - RNA, 64 nt, Human
aauccucggaagccugaagauuuuaaccuuguugaauggcuucuagguucucccuuaaaggauu

SEQ ID NO: 4162698 - RNA, 65 nt, Human
aauccuuuuguucaugucuuuuacuuaugccaagcugucacacugugugcaugaacugagggauu

SEQ ID NO: 4162699 - RNA, 103 nt, Human
aaucuauguuuacuaagugagucuauuggucugcaggcaguuuucuguaagcauauacccaggauucugucuguugaccauaguuugcugauugagccagauu

SEQ ID NO: 4162700 - RNA, 87 nt, Human
aaucucacaugggcacgugcuuucuuggaccauuccugccaccauugcaagugggucuucuggaaagcagacugugaaauggagauu

SEQ ID NO: 4162701 - RNA, 57 nt, Human
aaucucagcuggcuuguuuguucuugaggacuuucaggggucauuccaguugggguu

SEQ ID NO: 4162702 - RNA, 75 nt, Human
aaucuccuccagaaaggcugaggauggcugcaaaggcucagacaggcucuaaauaaagucucuucggaggagguu

SEQ ID NO: 4162703 - RNA, 59 nt, Human
aaucuccuuuuuacugaggcuuuuguguuuccaaaaggcucagccccugggaggagauu

SEQ ID NO: 4162704 - RNA, 64 nt, Human
aaucugaagggagauacauguauugguauuuauccaaguaauuucauucaucucuuuucggauu

SEQ ID NO: 4162705 - RNA, 64 nt, Human
aaucugacaucuacuagaacagaagauugauucaacuuaacuuuuguuuuguucagaugugauu

SEQ ID NO: 4162706 - RNA, 72 nt, Human
aaucugcaguguaacaggcucuacgucuccauuaaagagaagucaguuuaauucugugcuacacuccagauu

SEQ ID NO: 4162707 - RNA, 57 nt, Human
aaucuguaguaaaccugcugucuuaguucaagcugcuguaacaaaauacugcagauu

SEQ ID NO: 4162708 - RNA, 104 nt, Human
aaucuguuuaauucuuccaaauucugcuuuaauguaagauauaccaauauauuacuuuaucaugguaaaucuucaaugaggcauuauauggguggauauagauu

SEQ ID NO: 4162709 - RNA, 56 nt, Human
aaucuucuuuucaaaagguggagccuaaucucacuccuauugaauauaggaagauu

SEQ ID NO: 4162710 - RNA, 69 nt, Human
aaucuuuauuuacaaacacaggcugugggcuggauuuggccugcaggcuguaguuugugauccuugauu

SEQ ID NO: 4162711 - RNA, 98 nt, Human
aaucuuugaaauucuagcagaagcagggcaggggcaaauauuggcauguuucacuaauuuguccuaaauguccuguaucuaccgguuuugaaaagauu

SEQ ID NO: 4162712 - RNA, 94 nt, Human
aaucuuuucauuuucugaauaacucuaugauauagacuguuauuauccccauuuugcagauauuaaaacuaugguuuucagagaguuuaagauu

SEQ ID NO: 4162713 - RNA, 64 nt, Human
aaucuuuucuaggaacaaguacauggcugcuuugacauuaugucugcuugguuuuggaaugauu

SEQ ID NO: 4162714 - RNA, 83 nt, Human
aaugaaagcaaaauguuuagaaucauucaaaaguuugcaacaguugaaaugauauuugaaggaucuaauaguugucuuucauu

SEQ ID NO: 4162715 - RNA, 69 nt, Human
gcugucuuugguucaggcaaggagcgcaaaucugagacugcaguguuccuuguggaaacuauggacggc

SEQ ID NO: 4162716 - RNA, 61 nt, Human
gcugugagcugccugugucacacgcgaugaagcugacuacugcauaggacagcuuaugugc

SEQ ID NO: 4162717 - RNA, 91 nt, Human
gcugugagggcuucugaaguggguggugauaucacugccagaugcagccaucgacgguauagcugccccccaccacagcagucucuacagu

SEQ ID NO: 4162718 - RNA, 71 nt, Human
gcugugagguaaccucaaaggcaaagucguucaaaugacugguuuuccagguuacuucuuaaugguacagc

SEQ ID NO: 4162719 - RNA, 90 nt, Human
gcugugcagcuacgugggagaauuucccagucugugcugagaauaccuuucuugccaccacuuuugaaaucguccuguagagggcacagu

SEQ ID NO: 4162720 - RNA, 59 nt, Human
gcugugcaguaguagguacagucuugcacacugcauaaaaugucugcuccugacauggc

SEQ ID NO: 4162721 - RNA, 92 nt, Human
gcugugcccagcaguuuauuccuaacucugaauccucacagcagccuugguggguuggagugacagaugaggaaacugaggcugggagaggc

SEQ ID NO: 4162722 - RNA, 58 nt, Human
gcugugcccagccauucuagauacuguccgggaggacaccuuagaagcuuaggacagc

SEQ ID NO: 4162723 - RNA, 82 nt, Human
gcugugcccagcccuggcucacggcugucgccccacaggucccugggcgugaccaucugggagcucuuugagcugggcacgc

SEQ ID NO: 4162724 - RNA, 64 nt, Human
gcugugcccuuacacauggaaagggauaacucuggucucuucagcccauuauaagggcacuagu

SEQ ID NO: 4162725 - RNA, 62 nt, Human
gcuguggcaauguuuauaauuaggacauaguaaacaaccuaaauuauuuuaaaugccacagu

SEQ ID NO: 4162726 - RNA, 60 nt, Human
gcugugggacagguccagccagagcccaggccagaggggcagaagcuggaguccuggagc

SEQ ID NO: 4162727 - RNA, 61 nt, Human
gcugugggccacacggcugaguucuuccaauacggaagccccgagcuggaggcucacacgc

SEQ ID NO: 4162728 - RNA, 86 nt, Human
gcuguguaaacaucagcgcagaauaagugugugcuggguaaaguugggccaauauacaacuuuaucuguaaugagugaaaugcagc

SEQ ID NO: 4162729 - RNA, 76 nt, Human
gcuguguaaacuuguacagugcauccaaucucccugugccucgaucauuucacuguaaaacagguuucaucauagu

SEQ ID NO: 4162730 - RNA, 84 nt, Human
gcugugucagggcuuugagaauaguggaacaguuuccuugacaugguauacguucccaguguauuucagagcccauuccagagc

SEQ ID NO: 4162731 - RNA, 73 nt, Human
gcugugucaucagcauauaagacagugccugguuacaaauaggcauuuaauaauuauuugcugguggaugagu

SEQ ID NO: 4162732 - RNA, 72 nt, Human
gcugugucgcccaggcuggagugcaguggcacaaucuuggcucacugcaaucuccgucucccggguucaagc

SEQ ID NO: 4162733 - RNA, 89 nt, Human
gcugugucuauagggcauacaaaauuuuccagaacuuuuguuaauuucacauaacugaagagcaaaaauuggagucaugucaggacagc

SEQ ID NO: 4162734 - RNA, 70 nt, Human
gcugugucugcuuggucaucuuucacugggccagagaaagaaucccugaggguuggacaaggggagcagc

SEQ ID NO: 4162735 - RNA, 72 nt, Human
gcugugugagaaugugugacucuauugagcaagucagauuugcuuuuaacauaauauggauuuucaugcagu

SEQ ID NO: 4162736 - RNA, 76 nt, Human
gcuguguuaaccaccaccguaauuuacccauuagcaucaggaauaauaaugaguuugucugagugguaacaacagc

SEQ ID NO: 4162737 - RNA, 83 nt, Human
gcuguguugcacagcuccaugggacuccauucacaucgaaaguguaugcaguguguggcccuuggaguugugaccuguacagc

SEQ ID NO: 4162738 - RNA, 58 nt, Human
gcuguguuugacaguagcagaccccuagguuggcaaguauagcuaagguaagcgcagc

SEQ ID NO: 4162739 - RNA, 104 nt, Human
gcuguguuuuaugcacuugguugcugugaguuuggcccugagaggugacucuacucuuaguguguaaagccaaauuugugagcccccaaggugagaagcagagc

SEQ ID NO: 4162740 - RNA, 130 nt, Human
gcuguuaaggaagauuuaaugagauaaaugugcauggaguccuuaauacacugguggacgcagagaaaucugauauuuaccuguuauuacaguguuuguuguaacucuggauugucuuuaaauuaugugc

SEQ ID NO: 4162741 - RNA, 81 nt, Human
gcuguuacagucucaaguugcucugccucuguaggaaaacagugguaucugagagguaagagucaaaaagauaaaaauagc

SEQ ID NO: 4162742 - RNA, 85 nt, Human
gcuguuacuaguuauauacuuguguauauguuugacaaacugacugugagcuuuuaauauacagguguuuuauaguaaucuaagc

SEQ ID NO: 4162743 - RNA, 64 nt, Human
gcuguuaggugcccugaccuuguccacauaaagaugugauuuaugaagugcagggcacagcagc

SEQ ID NO: 4162744 - RNA, 81 nt, Human
gcuguuauuuaugcugcuccauucuugucacuuuuuaauuugacacugaacuuugagugggcgcugcaaaauucugacagc

SEQ ID NO: 4162745 - RNA, 57 nt, Human
gcuguuauuuuacaagacuuaugcuguaagaagaauuuguuuuaguaaaauaagagu

SEQ ID NO: 4162746 - RNA, 62 nt, Human
gcuguucacauuuugggccaaauaauucucuguuguagggggcuguccugugcauuaacagc

SEQ ID NO: 4162747 - RNA, 92 nt, Human
gcuguucauuauaauauucauaaguuuucuggugauauuugacaucuuagcagugugcagagcccacaggcagcugaaauauaaugaauugc

SEQ ID NO: 4162748 - RNA, 58 nt, Human
gcuguucuuugcaucucuggugccuagcacagugcccagcauggagugaggacucagu

SEQ ID NO: 4162749 - RNA, 68 nt, Human
gcuguugaugggucucagguuuuugucauguggaucucuccacagagcaacuugaguauccucauggc

SEQ ID NO: 4162750 - RNA, 60 nt, Human
gcuguugcagaugagacuggauuuggugcccauguugaagaugaagauaucugcaggggc

SEQ ID NO: 4162751 - RNA, 75 nt, Human
gcuguugcagauugacuguagcuaauguacuugccuaaaugaagaaguauacauuuauuacaggucuucaaccgc

SEQ ID NO: 4162752 - RNA, 63 nt, Human
gcuguugcugggagcagggauccuguuuggaauuacaggauucguucuacucuaagcauaggc

SEQ ID NO: 4162753 - RNA, 62 nt, Human
gcuguuucaguuccucuucuaugugcucugugggaucugaacaggggagaacuagagacagc

SEQ ID NO: 4162754 - RNA, 58 nt, Human
gcuguuucuuuccuggcacuugaacccaugucauucuggguaguuaguaaagaaaagc

SEQ ID NO: 4162755 - RNA, 79 nt, Human
gcuguuuucauggcaggagucagaagcuaaaggggaacaacaagggcuucugcaaguuucugcuuggcauuaggacagu

SEQ ID NO: 4162756 - RNA, 80 nt, Human
gcuuaaaacuuacauuuucaaguuauuauacugacuuccagauuucagaguaguucuuugcagaguggaaauguuuaagu

SEQ ID NO: 4162757 - RNA, 68 nt, Human
gcuuaaaagccacuuagucuauaguacuuuguuauaguacccucaaaggacuacaguagcuucaaagc

SEQ ID NO: 4162758 - RNA, 70 nt, Human
gcuuaaacugccacaagagggacaucauuuaauauaccagagaacuuccuaacagugagcagugaggggc

SEQ ID NO: 4162759 - RNA, 74 nt, Human
gcuuaaaggagacauaucuacagacaggguuugagccuaguaauggugagaacuuucuuggaugucucaacagc

SEQ ID NO: 4162760 - RNA, 94 nt, Human
gcuuaacccuugcuccucccugugcagacccagcuagacagaagaauccagagcugggagggcugggagcugguggagggagagcagggcaagc

SEQ ID NO: 4162761 - RNA, 70 nt, Human
gcuuaacuuaggaacgcucugccuagugaggggucugugcuaagcagaguguuccuaaauguaacugagc

SEQ ID NO: 4162762 - RNA, 85 nt, Human
gcuuaagcagaagaacucuggauuucuugggccucaggcauauuacaaagcuugagguuaggaaccaguguuugacuguaaaugc

SEQ ID NO: 4162763 - RNA, 63 nt, Human
gcuuaagggaauguuguggcugguuugaucuguucagaccaccaaaacuuucuccauaucagc

SEQ ID NO: 4162764 - RNA, 95 nt, Human
gcuuaaguacauuuaucauugccaaaauccuaauuaugaacacuuuauaguugaugauucaagaaaauaggauggccauggaugaacuuucaggc

SEQ ID NO: 4162765 - RNA, 75 nt, Human
gcuuaaguguuuguacauugugaugguuaauuuaugugucaauuuaacuggcuuauggagugccagacauuuggc

SEQ ID NO: 4162766 - RNA, 86 nt, Human
gcuuaaucuuuccuugccaucccuuaccucagucaacacaaguuguugaaaaaugacugaugaaaaagcaaggcugagaaugaagc

SEQ ID NO: 4162767 - RNA, 121 nt, Human
gcuuaauugcuguggcaccaaagcgugggcggcauucucucucuaaauguugucuggguacauugcaauacgcuuaggagaggcaugaguauugucccuguugaguaucauuugcuuaggc

SEQ ID NO: 4162768 - RNA, 69 nt, Human
gcuuacaaggcaucaugauguaguggaaaucuaggcuuuggagccacucacuaucugaguccuuuaagc

SEQ ID NO: 4162769 - RNA, 61 nt, Human
gcuuacacagcuucuauccuugaagaaccuuggugccuacaauagcugagagcugguaggc

SEQ ID NO: 4162770 - RNA, 62 nt, Human
gcuuacaugcauaugucaaaaaagcuacauauauguguuugugugucuaugugcaugugugu

SEQ ID NO: 4162771 - RNA, 80 nt, Human
gcuuacccagccguccugcgggcugguaagaggcuuccuacuuuaggaggcagcuggcagcacccaggggcugggagagc

SEQ ID NO: 4162772 - RNA, 62 nt, Human
gcuuacccaggaggaugguuguuagguggaaauuuaaauucauaggaaccaacuuuuggugc

SEQ ID NO: 4162773 - RNA, 68 nt, Human
gcuuaccucucuugaaggcccaccgcuucagccacagcuuggagaaggccggccaggagugguugagc

SEQ ID NO: 4162774 - RNA, 62 nt, Human
gcuuacuguuccuguuggugcugaaagaaugcucguaauuguuaccaaacaguggacggagc

SEQ ID NO: 4162775 - RNA, 123 nt, Human
gcuuagaaucaugaauuagcuccuucuuuggcuuugccacacccaaugacagccacacaccucuccccagcuuauuugagguggaacagaaccaaagaaagagccaguuccaugauccuaagc

SEQ ID NO: 4162776 - RNA, 64 nt, Human
gcuuagagaggggcugggcagucccuggaugaaaacacauuugcaugagcagccccuccucugc

SEQ ID NO: 4162777 - RNA, 76 nt, Human
gcuuagcaagcuguauuccaagucacuguguccuggcuaagccgccaagggcauugcuugggaccuugcuauaggc

SEQ ID NO: 4162778 - RNA, 60 nt, Human
gcuuagcacagaaugagaguucuaacuuacuguuguugcuauuauggcuguugcuguugc

SEQ ID NO: 4162779 - RNA, 89 nt, Human
gcuuagccagcuauccuaugacaguuuuacaaguauagaacucuugaauaugcugaaguugaauauucugggaaaggaagggcgaaggu

SEQ ID NO: 4162780 - RNA, 84 nt, Human
gcuuagcuggcaguuugcucacgacugcauucaaaggaguaucuuaccuauugcagaguaaaagcagaugcuacugauaaaagc

SEQ ID NO: 4162781 - RNA, 57 nt, Human
gcuuaggaaggaagagccucagauugaagugcagaucugagaaauccuuggccaggc

SEQ ID NO: 4162782 - RNA, 78 nt, Human
gcuuagggacucuugguacaugcagauauuuaguuaugguuauaaugacaaaaaguaaaugugccaggagucugaagc

SEQ ID NO: 4162783 - RNA, 79 nt, Human
gcuuaggguuuuuguucauuaguacaguuguaaaacuuucauuugcuacgugaacucagaacaguucuaaauuucaagc

SEQ ID NO: 4162784 - RNA, 101 nt, Human
gcuuagucacaaacuaauaugcaagugaauuucauuccaauucuuugcuuucaacagaauugaaggaggauccaaaugaauuguuagccgugugacuuugu

SEQ ID NO: 4162785 - RNA, 69 nt, Human
gcuuagucucauaugaagacucauuuauuggguaauuguuacccgacaaucugucuuuauuuagaaagc

SEQ ID NO: 4162786 - RNA, 90 nt, Human
gcuuagugcuaaacaucuguugcuuccuaacaagugcugcauucauuuuaauggcacuggugcacagagguaaacggagcuuuggcaggc

SEQ ID NO: 4162787 - RNA, 70 nt, Human
gcuuaguggcuugcugaggggcuugcuagcugagaggcuuuuugagggccugauuagcaggcuagcuggc

SEQ ID NO: 4162788 - RNA, 71 nt, Human
gcuuaguggggaauuaaaaauauauguagguuagcaauuuaacauacauaugaguucguucuaugcuaagu

SEQ ID NO: 4162789 - RNA, 67 nt, Human
gcucagcugggugauucuucuuuuccucaugguauaaacagaggucacuugguguuauucagcuagc

SEQ ID NO: 4162790 - RNA, 70 nt, Human
gcucagcuucucgggagcgcaugugcucaccccaucugugaaaaaugcgugcgccuugaagaggcguggc

SEQ ID NO: 4162791 - RNA, 57 nt, Human
gcucagcuugggagcgcccgguucuuuuuacuacucugucugccucccuuucugagu

SEQ ID NO: 4162792 - RNA, 62 nt, Human
gcucaggacacagcagacagcaugaucuugaaguucaugccagcuuugcuugucccgugagu

SEQ ID NO: 4162793 - RNA, 60 nt, Human
gcucaggagcugacagccucaagucuagaaccucacuuaugggggccgucugcuucuggc

SEQ ID NO: 4162794 - RNA, 84 nt, Human
gcucaggagggagaacugaaugggggcaacugugcugagaggggaaaugaucuucucuuuggcuuugacucccauuccuugagc

SEQ ID NO: 4162795 - RNA, 67 nt, Human
gcucaggcaccauaugauguguuuccagacuuccauaccuggugcagugcacacguugugcuugagc

SEQ ID NO: 4162796 - RNA, 60 nt, Human
gcucaggccuccagaggggcaaagccacaagcucuccugcuucaacccucuuugccuagc

SEQ ID NO: 4162797 - RNA, 59 nt, Human
gcucaggccuggcccaugggacaucaucuguguguuguaugagucagugucugacccgc

SEQ ID NO: 4162798 - RNA, 68 nt, Human
gcucaggggcaguuuccuaugaucuuuaggccucaaaaugucucuuggacucaaaauugccuuagggc

SEQ ID NO: 4162799 - RNA, 85 nt, Human
gcucagggugaauucagagagcaggcucugaaugggcccaguacucccauucauguggggagccuucuguuuggcagcccugagu

SEQ ID NO: 4162800 - RNA, 72 nt, Human
gcucagugcuagaaguagauugccuggcuucaagcucugcauuugucacuuacuaccugucuggccuugggc

SEQ ID NO: 4162801 - RNA, 65 nt, Human
gcucaguggcuguucauuuuacacaauauaaguauugauguuccuaagugcacagccuauauagc

SEQ ID NO: 4162802 - RNA, 57 nt, Human
gcucaguggguggcugaaggggucuggggucagcuccgcuccaccccacccacuggc

SEQ ID NO: 4162803 - RNA, 93 nt, Human
gcucagugguuaaguucuguccacacccccuccuugcagucuccauucaagcuauucugagacggcagggcuguugaccaaggaccacaaagc

SEQ ID NO: 4162804 - RNA, 80 nt, Human
gcucaguguguuguugauugaauuuacuuuucauucuaaugaacuugagaacauuaauaguuaauuuugccaugcugagu

SEQ ID NO: 4162805 - RNA, 58 nt, Human
gcucauaaauguugacuaccagaccagcugguguuuggcaguuuucuuuugugccagc

SEQ ID NO: 4162806 - RNA, 72 nt, Human
gcucauagggaccuggaaucuggaguuggaaucccugacugggcuuuccaaccugugauuccaauugugagc

SEQ ID NO: 4162807 - RNA, 60 nt, Human
gcucauauucacccgacuuugagucaggggccugaucucagagcaagaugauguaugagc

SEQ ID NO: 4162808 - RNA, 71 nt, Human
gcucauauuccuggcuaguuuugcugaaauaauugcuuugaauuacuuccucaggacugcccaggugacgc

SEQ ID NO: 4162809 - RNA, 60 nt, Human
gcucauccacgugcuuuucuaguugggacuuuuucuuggcuuaaauuguuuguggauagu

SEQ ID NO: 4162810 - RNA, 57 nt, Human
gcucauccagcaagccagggccugucccaaaggccaaggcucuggaaucuggugggc

SEQ ID NO: 4162811 - RNA, 59 nt, Human
gcucaugcugcuguauacugugaaugccucugauacacagugaaacacgcaguaagagu

SEQ ID NO: 4162812 - RNA, 61 nt, Human
gcucauggccaaagucaggagugugcaucuucugagcgcagugggaagguuggcacauggu

SEQ ID NO: 4162813 - RNA, 70 nt, Human
gcucaugugucuugcugcccuccaugugaccccgaguggguccgagugugggcugcagaggcacagcugu

SEQ ID NO: 4162814 - RNA, 107 nt, Human
gcucauuucggucauguugcggugcuuugcuggaaucgaggaaugugcuuaauucgaaggugucuuugucgguuacagcaacgcugcugcugaaugcccugagaagc

SEQ ID NO: 4162815 - RNA, 81 nt, Human
gcuccaaagagaacagaguuguguuuguacaacgcugcacaugcuaguguuggaaggcaagcagcaauuuucucugaaagc

SEQ ID NO: 4162816 - RNA, 65 nt, Human
gcuccaaaucauacagaaccugagcacuucuagacaacuaucugggcaggaaauuguaugagagc

SEQ ID NO: 4162817 - RNA, 73 nt, Human
gcuccaaggcuuccagugaugccucuuugccuagcaaagguuaggacccacagcaguggccaagcccuggagc

SEQ ID NO: 4162818 - RNA, 64 nt, Human
gcuccacuuuggcaagcgaguacuuucugaagaccaacuucaagaaauggugucacgugagagc

SEQ ID NO: 4162819 - RNA, 62 nt, Human
gcuccagagguuacacccucagccccaaauucaaggggaaaagagugugaaucucucccagc

SEQ ID NO: 4162820 - RNA, 55 nt, Human
gcuccagcaccuagagcagguccaggacccauaaauguuuuuaggaugucugagu

SEQ ID NO: 4162821 - RNA, 55 nt, Human
gcuccaggagagggaagcagauuggcacagucaguuuugguccuggcuuaggagc

SEQ ID NO: 4162822 - RNA, 67 nt, Human
gcuccaggagcaaagaucacugggagaggaaaauuccccaucccuggagguguuugcucagggccgc

SEQ ID NO: 4162823 - RNA, 62 nt, Human
gcuccaggaggaugaccuuccucccauuucuuuaauuaaagggggaccaauccucuucgggc

SEQ ID NO: 4162824 - RNA, 62 nt, Human
gcuccaggcaaggauaauaaacaugccacaucuguaucuguggauguuccuucagccugggc

SEQ ID NO: 4162825 - RNA, 70 nt, Human
gcuccaggcagagccucuuucgugugggugggaaaauagggaaaauuucaaggaggagaugcucuggagc

SEQ ID NO: 4162826 - RNA, 62 nt, Human
gcuccaggcagcucaaccuugggagcuucggggccccgagagguggagccugugaguggggc

SEQ ID NO: 4162827 - RNA, 63 nt, Human
gcuccaggcgccgcuuuugcagucccccauuggccgguuuauugccagacggccccugcucgc

SEQ ID NO: 4162828 - RNA, 77 nt, Human
gcuccagggcccucucuccaauuuucaccucauucugggccugagacugagaugagacuggggagaggucugguagc

SEQ ID NO: 4162829 - RNA, 60 nt, Human
gcuccaggggagacuagacccacaccuacucaugagcugggguguagcucuucuggaugc

SEQ ID NO: 4162830 - RNA, 107 nt, Human
gcuccagggugucccuguuccccacagcauucagacugacucaggcucaguauggaaaugcuucaugcuugcccauguuucugaaguaauaguacuuccacuugagc

SEQ ID NO: 4162831 - RNA, 63 nt, Human
gcuccagguauuugcccuuuuagaugaucugaucacucccuguuugaauggcacauuuggggc

SEQ ID NO: 4162832 - RNA, 110 nt, Human
gcuccaguuucauugaucaaggcugccagcaaaguucaucuuaccuagauuuuauccaagugacuaagagaggggcagauggaccuggcacagugucauuugucuggggc

SEQ ID NO: 4162833 - RNA, 69 nt, Human
gcuccaugguuuggccucugaguaccuucucuuuacuuuuucucaggacagauuuuuggccaccagggc

SEQ ID NO: 4162834 - RNA, 78 nt, Human
gcuccauuuuuugacaucauuuucuucaguguuugcucugcucugagcucagggaaacuaauuauguccagguggggu

SEQ ID NO: 4162835 - RNA, 71 nt, Human
gcucccacagguauucuggccaugcgggcuuggcacuaauucaggagucuguggcugaguccuguuggagu

SEQ ID NO: 4162836 - RNA, 86 nt, Human
gcucccacccgugccucaguguccuccucugagggauggaugugucucugcaaguagaugacagugagguuaccauggggaggggc

SEQ ID NO: 4162837 - RNA, 75 nt, Human
gcucccacggggagggucaggccacauucuucucuggcuggagccugagggguggcuggcaccuccugguggagu

SEQ ID NO: 4162838 - RNA, 57 nt, Human
gcucccagaaaccugccuugcuggacuguccacuuggagcaagaagguugugggagc

SEQ ID NO: 4162839 - RNA, 102 nt, Human
gcucccagggccccagacauugcagggacuggugauugaggaguuucaccuuagaccaggaagcaucccuuuguaagugacuuucuggaagcuacugaaagc

SEQ ID NO: 4162840 - RNA, 91 nt, Human
gcucccagucggcaucguuaaucagcaccagaauuccuggccgccugugggaaagaugguggugaguagcaaggagugagaggcaggaggc

SEQ ID NO: 4162841 - RNA, 70 nt, Human
gcucccauggcuggcaggcacaguaugcaagggaaaccuuuguugcugcuccaaccaguguucauucagc

SEQ ID NO: 4162842 - RNA, 71 nt, Human
gcuccccaacucccagcucagggcuuucccugguggacaguggaagccuaagaguagggagccuggcaggc

SEQ ID NO: 4162843 - RNA, 56 nt, Human
gcuccccaaggcggcagucacaguggugacgcuggcugccaugacgccuggggagc

SEQ ID NO: 4162844 - RNA, 127 nt, Human
gcuccccgaccccgcuagucaucugccuuguugucagugguguccuuugugucccgccuuggcacaggcucaggaccugggauugccagaugcugagaggagaugagauggaaaggaugagggaagc

SEQ ID NO: 4162845 - RNA, 124 nt, Human
gcucccuccccaaggcaggugaucuaauuggucugggugugaccuggacaucaggaccuucaaauuuucccagugauuuccacgugcacccagguugagaacgcugcggcccauaaaagggagc

SEQ ID NO: 4162846 - RNA, 61 nt, Human
gcucccucccugcacccccagcugugauuuucauccugagguguguccccagggagguggc

SEQ ID NO: 4162847 - RNA, 87 nt, Human
gcuugcuuaaaauuugcauucccaaaagacacuuacccaaucaggaccuuggagagugaggccugggaaucuaauuuugaagcaggu

SEQ ID NO: 4162848 - RNA, 56 nt, Human
gcuugcuuaugaauaucuuaugucucagcugauucaaagaaguugguaagcagugc

SEQ ID NO: 4162849 - RNA, 60 nt, Human
gcuuggaaauaauucugugucugaacauuucucaaugucuagacaagaaguauugccugc

SEQ ID NO: 4162850 - RNA, 64 nt, Human
gcuuggaggcagagucuugcugaggugcccgugggucugccucagcaauuaccugugucucugc

SEQ ID NO: 4162851 - RNA, 70 nt, Human
gcuuggcacucucugggugaggcuuugugucccuugauccuuuagaccgcacucaggguaugugccaggc

SEQ ID NO: 4162852 - RNA, 84 nt, Human
gcuuggcgagcccugaagaaaggugugggauacuccaggcaaccucguggaguacucuacuccuuccuucuggaagcuggaagu

SEQ ID NO: 4162853 - RNA, 68 nt, Human
gcuugggaggggagcgacauuccgugccgggcuccacgcucggcuacgcugagcuucccagaccgagc

SEQ ID NO: 4162854 - RNA, 66 nt, Human
gcuugggagucugggccugauggcuaaagccccuucuaaucuaggguagccuagagcccuuccagc

SEQ ID NO: 4162855 - RNA, 56 nt, Human
gcuugggcugaaggccugggucucuguguugcuggcacaggcuuacagcagcaggc

SEQ ID NO: 4162856 - RNA, 64 nt, Human
gcuuggggagcucaguguccuugcagaauugggacuggcugcuuuggaccugggccccccaagc

SEQ ID NO: 4162857 - RNA, 81 nt, Human
gcuuggggugguggaggagaggcgccuugcggaaagcccucuucaggcacucgaaggccucuugcuccucgacuccccagu

SEQ ID NO: 4162858 - RNA, 73 nt, Human
gcuugggguugugugcgucgaacuuugaggcuggauucccugcacuugggcagagacgcacagacgcccgagc

SEQ ID NO: 4162859 - RNA, 94 nt, Human
gcuugggugugggauuggaagggaugccagcugcuuuggggggagcgggugcuugcuucuagcagagggcaucugcuguuguugccacuguugc

SEQ ID NO: 4162860 - RNA, 69 nt, Human
gcuugguagauuugagcgugaguagcugacaaauguuaucaauuuuaugcagucgacaucugaucaggu

SEQ ID NO: 4162861 - RNA, 78 nt, Human
gcuuggucacuguuauuuugaaagguuucucaggucgguucccuagggcaagcugaugugauagugaaaaacccaggc

SEQ ID NO: 4162862 - RNA, 99 nt, Human
gcuugguucuguuuauugucgcaucagcccuucagaaugcugucagcaagacugcucacauuuaaagguugaagcugaaguacucauuuuacccauagc

SEQ ID NO: 4162863 - RNA, 72 nt, Human
gcuugguuuccagcugccuccuaucauuuccuugcuugcugucccaaguugagaugucauaggagaccaagc

SEQ ID NO: 4162864 - RNA, 69 nt, Human
gcuuguaggaagacucaucuuggagaaaaugugaaguaaucaaauugcuugagauuagucuccuauugu

SEQ ID NO: 4162865 - RNA, 88 nt, Human
gcuuguaguguuuuauuucagcacuuugaauaugucaucccacuccuuucugacuugcaggguuucuguugagaaguccacuguuagc

SEQ ID NO: 4162866 - RNA, 82 nt, Human
gcugagaagacugcauagucauuucuaucagaugcugccaaauagcaaauacaaugaguggagacuguguguagaguucagc

SEQ ID NO: 4162867 - RNA, 76 nt, Human
gcugagaccagaacccagagggagcacagagccugcuaacaggcaccugaugacugcuucccugggcauucccagc

SEQ ID NO: 4162868 - RNA, 76 nt, Human
gcugagagauucaaacaggccaauugaccugguaccaagugaaaaggcaauuagucuuuuguuauuccaucuuggc

SEQ ID NO: 4162869 - RNA, 82 nt, Human
gcugagaucugcaacuugccucuagccauuacaauauugcaaagguaaagugauuuuggcagagguaauucaaaucccaagc

SEQ ID NO: 4162870 - RNA, 107 nt, Human
gcugagaucuuuccuccaggcaacuccuccuugguuuagccucugauacagccaaaccucuggauucagggaaaccuaaggaagccaggcaagaagggucccgcagc

SEQ ID NO: 4162871 - RNA, 71 nt, Human
gcugagcaaaauaccacgacuuguuuuagccggacaggcauuaaaauauccaguguuauuuugaccucagc

SEQ ID NO: 4162872 - RNA, 56 nt, Human
gcugagcagguuugaugcuuuuaugaagcaagauagaagcaaaaauaugggccagc

SEQ ID NO: 4162873 - RNA, 81 nt, Human
gcugagcccagagcccuuguagggaagaaacuucguuuuauuuauguaacauaucuacccuucaagcucucuggguuuugu

SEQ ID NO: 4162874 - RNA, 71 nt, Human
gcugagccccccugcgugggucccacggcauggaaacacugccuaacgcucccgcaggcugggggcccagc

SEQ ID NO: 4162875 - RNA, 68 nt, Human
gcugagccccuggccgggcuggcauauggaacugauuuagugcccugcuggggcaggagaaggcgggc

SEQ ID NO: 4162876 - RNA, 76 nt, Human
gcugagcugaggcagggcuggggauggugaguaggggccucagcugacccuccggcccccagcccuccagcucagc

SEQ ID NO: 4162877 - RNA, 65 nt, Human
gcugagcugcugcaucgcuucuccccucucuuucccuuuccuaggggagcugacagcagcacggc

SEQ ID NO: 4162878 - RNA, 75 nt, Human
gcugagcugugacucaggcuagacaaagccccaguuaaccuagcagggagcuggcuggcgugaguucugcccagc

SEQ ID NO: 4162879 - RNA, 80 nt, Human
gcugagcuuuaguguccagaguuuuuauuaggguuucaugauguacugauuaaagcacuggccagaugauuaaacucagc

SEQ ID NO: 4162880 - RNA, 58 nt, Human
gcugaggaggugugguuagguggcagucaaaggccaccuauccugcuacccucccagc

SEQ ID NO: 4162881 - RNA, 63 nt, Human
gcugaggcaggaggaucauggaugcaguaagccaugacugcaccacugcacuccagccugggu

SEQ ID NO: 4162882 - RNA, 68 nt, Human
gcugaggcaugaugauugcuugagaccaggagaucugggcugcaguaacgaucauggugccuguaagu

SEQ ID NO: 4162883 - RNA, 55 nt, Human
gcugaggccccagggugaugggagagcucagacuuccuucagcuggcaccucugc

SEQ ID NO: 4162884 - RNA, 55 nt, Human
gcugaggccucagaaggcugaggaucacuugagccuaggacuuugaggcuguagu

SEQ ID NO: 4162885 - RNA, 56 nt, Human
gcugaggcugggagcagccuguauuuacuaguaacauuguuuccuaaagccccagc

SEQ ID NO: 4162886 - RNA, 64 nt, Human
gcugaggcuggggaggcagaggcugcagugagccaagauuguggcacugcccuccagccugagc

SEQ ID NO: 4162887 - RNA, 59 nt, Human
gcugagggagaauugcagccagcguucuguuaauacaauggugguguucuauccugagc

SEQ ID NO: 4162888 - RNA, 60 nt, Human
gcugagggauucugccugcucaggagacucucccuggugacuccugaagauuuccucagc

SEQ ID NO: 4162889 - RNA, 68 nt, Human
gcugaggguguccacauggguugucauuuaacuuuaaucuaccagcauccauggagagcacucugagu

SEQ ID NO: 4162890 - RNA, 61 nt, Human
gcugaggucaauuugccuccccagaguguguuagucugcaggcauuuuugguugucacagc

SEQ ID NO: 4162891 - RNA, 63 nt, Human
gcugaggugcacugaggugggaacuagccccauagcugccacuuucacccagugcucccaagc

SEQ ID NO: 4162892 - RNA, 55 nt, Human
gcugagguggugaugguucaucuuuaucugccuguguuucucugcucaucucagc

SEQ ID NO: 4162893 - RNA, 109 nt, Human
gcugaguaguuaaagaagacauuugguuuuugguguucacagaggccauuucauugugccuaugagaaauaaaaucaguuguuggaaaguuuuacacaaaccacucagu

SEQ ID NO: 4162894 - RNA, 60 nt, Human
gcugagugaaaucuuugggcuuuguuaaaaaugacagaacuuggaacuuuucacacaggc

SEQ ID NO: 4162895 - RNA, 55 nt, Human
gcugagugaggcugucaaaauguuuuacuucuccauuagcauagccugucuuagc

SEQ ID NO: 4162896 - RNA, 65 nt, Human
gcugaguggagcagucagcgcuggagagagcagagagaguagggcuggcuucuauagccaccagc

SEQ ID NO: 4162897 - RNA, 97 nt, Human
gcugaguguuuguguuuaugcaaaggggccucuuccugcauauuuaaucuagaguaaggcaguggcuuuuguuguguuuagcccacauaccuucagu

SEQ ID NO: 4162898 - RNA, 74 nt, Human
gcugaguuuauuuugaaagucuguuuugaauuugcagcacugccucuuuaggaggguauuuuaagaugcucugc

SEQ ID NO: 4162899 - RNA, 82 nt, Human
gcugaguuucuugcgaggaucauuguguccagaugcucaacgucucuuaacgucaaacauucacaacugauccuugcucagc

SEQ ID NO: 4162900 - RNA, 57 nt, Human
gcugauaaauaguugauguaccugucacucaugucgcuacaugaacuguuucucggu

SEQ ID NO: 4162901 - RNA, 74 nt, Human
gcugauaugccagggacauuuccaagagaauuccuuuuuugagagaaaucuccuuugauaucccaucagucagc

SEQ ID NO: 4162902 - RNA, 120 nt, Human
gcugauauugugguaauagugguuauuguuauuguuagaagcagucacauuauuauuguuagugacaauauuauuugacaguaauaaagcacaaguuaauuaguugccaugacauucagc

SEQ ID NO: 4162903 - RNA, 92 nt, Human
gcugaucaguucaguagcagcugccuaaagugcuaagaaagauaaugcauccacaucuggacucuagggggacugugcucugauagauuagu

SEQ ID NO: 4162904 - RNA, 71 nt, Human
gcugaucugggugugguaucuuagccauguguaguuaucucuaucuggcagaugccucauuuccaguuggu

SEQ ID NO: 4162905 - RNA, 60 nt, Human
gcugaugaugcuuuucugagggcuuggcaugucccaucuucaguucacauguaucauggc

SEQ ID NO: 4162906 - RNA, 95 nt, Human
gcugauggaccacgcgcggugugcacugucccccauuuuaagaaagagggaacugggcuucagaggggacagccaccugcccgaggucacccagc

SEQ ID NO: 4162907 - RNA, 62 nt, Human
gcugauggauguuugaaguugcaugugauaugugucauguuuuauaauaaacaucaaguagc

SEQ ID NO: 4162908 - RNA, 61 nt, Human
gcugauggucuagggacucugguguaggaguaacugaacuuagaaagucaaagcuaucagc

SEQ ID NO: 4162909 - RNA, 63 nt, Human
gcugauguaagacuuuugguuuucaauugaauuuaggaaacuuggggcuuucuuacauuuugu

SEQ ID NO: 4162910 - RNA, 99 nt, Human
gcugauguccuuaguucuguagauuaucaaggugccaauuuucagugaacagagcccucuucugaaaggcagguuguuugcaagcuuggucucaucugc

SEQ ID NO: 4162911 - RNA, 73 nt, Human
gcugaugucucagaguggucacugggaagacggaugacgguccugcccgauguccauuguggggccggauagc

SEQ ID NO: 4162912 - RNA, 59 nt, Human
gcugaugugaagcuugugcuaacauaugaaaaguauuuagaaagagcuuggcauguagu

SEQ ID NO: 4162913 - RNA, 58 nt, Human
gcugauucugaugcuucacaaagguaaugauuuauucauucucugccucagaaugagu

SEQ ID NO: 4162914 - RNA, 122 nt, Human
gcugauuucauuugaguuuauaguugcugcucauuauguucagcaucugcuuuauuaaaugaaucaauaaaucaguuaugaccauagagcaugagcuagcaaaagagcaaaaauucuaaagc

SEQ ID NO: 4162915 - RNA, 71 nt, Human
gcugauuugacaggaggcagagcucaggugguaaugcucacuugcccuccgcucaccuccugcucugcagc

SEQ ID NO: 4162916 - RNA, 58 nt, Human
gcugauuuuaauuauaggagguccuuguuauccaaagacaauuuauguuagggucagc

SEQ ID NO: 4162917 - RNA, 108 nt, Human
gcugcaaaaauugaugaaaguaaagaacuuagcagagauaugggcauagaucgugucaaaaacauccccaauaauuuuguuuucuuugcauuaaaaagaacaugcagc

SEQ ID NO: 4162918 - RNA, 84 nt, Human
gcugcaagaugaaguuucagccuuuauuacaugauuugauuucauugagauccauggagauaaacugaaauauuuagugacagu

SEQ ID NO: 4162919 - RNA, 81 nt, Human
gcugcaaggaggcacuuugucuuuccucuuggcugaggcuguuuucugcccagggacaggacacagguugucucaaaaagc

SEQ ID NO: 4162920 - RNA, 63 nt, Human
gcugcaagugcauguugcaacuucgcgugauguucccagggcgguucugcggcaacuugcggc

SEQ ID NO: 4162921 - RNA, 76 nt, Human
gcugcaccgucauugaucaugcagaugcuucacuuuuccacuaagaugaggucuacauuguuaaaaauaguucagu

SEQ ID NO: 4162922 - RNA, 60 nt, Human
gcugcagacuucucaucucauuaguucuuuuagaauacugugggugaagacagcuguagc

SEQ ID NO: 4162923 - RNA, 87 nt, Human
gcugcagagaagccuccacucuggggugggugagaugguggaagcgccuccacccgcuuccagcgguuuggaaguaugucuagcggc

SEQ ID NO: 4162924 - RNA, 74 nt, Human
gcugcagagcucauguuuauaaccauuaggcaaacuguuagccuguuguggaaaaagccugauugucaugcagc

SEQ ID NO: 4162925 - RNA, 56 nt, Human
gcugcagagggucuuagagaggauuuaacccagccucccugagaccagagagcagc

SEQ ID NO: 4162926 - RNA, 57 nt, Human
gcugcagcuguaggacacaauuaauuaugcuaauaguuugugaggagcggauguagc

SEQ ID NO: 4162927 - RNA, 111 nt, Human
gcugcagcuuugaaucugguguuugcgggcuggaaacucagguaggguugcaguucugaagcagcuuugaaucugguguuugcaggcuggaaacucagacaggguugcagu

SEQ ID NO: 4162928 - RNA, 64 nt, Human
gcugcaggagugcgggugggugcucgccccagaaucgguuugcauugucuccccacuucugggc

SEQ ID NO: 4162929 - RNA, 55 nt, Human
gcugcagggacagggcagggccuuuggauccaauuagaggugcccacacccuggc

SEQ ID NO: 4162930 - RNA, 57 nt, Human
gcugcaguagcugaauggcauuucuccaaaggaaaaaaaaccauguaggcacucagu

SEQ ID NO: 4162931 - RNA, 55 nt, Human
gcugcagucacugaggcagagggugcccauguccugucucucagugacugauagc

SEQ ID NO: 4162932 - RNA, 101 nt, Human
gcugcaguccgugggccacacauugagcagcuguuuguaacuaaggugacuuuuaaaaugguuuauaacaaacagcguuucagaugugguuaggaugcugc

SEQ ID NO: 4162933 - RNA, 63 nt, Human
gcugcaucugucagccugggauuaggggccagugguccacgcucauccucucugagaggcagc

SEQ ID NO: 4162934 - RNA, 55 nt, Human
ggaaguugcuguuccaaggguauaauguuucaguuauacaagaugaguaauuucu

SEQ ID NO: 4162935 - RNA, 68 nt, Human
ggaauaaaagaauggugugugaaguuuagugccaauacagucuaauaugcaugcuauguuuuuauuuc

SEQ ID NO: 4162936 - RNA, 82 nt, Human
ggaauaaaauuggcgcucagcugcauuguguaugauauuucgaaacauuaaacuugcuuggcuguaaucccaaauuaauucu

SEQ ID NO: 4162937 - RNA, 61 nt, Human
ggaauaaacauaaaagaacagcagagacacauucuugcuaguucuuaacuguuaugauucc

SEQ ID NO: 4162938 - RNA, 67 nt, Human
ggaauaaguagaguucuggauuauaguguggugaacauauagcaaggucuggauuucugcuucuuuc

SEQ ID NO: 4162939 - RNA, 82 nt, Human
ggaauaagugagaaaacgcgugcagugcuuagcacagugccugccacacaguaagcauuucacgcacacucauuacuauucc

SEQ ID NO: 4162940 - RNA, 60 nt, Human
ggaauacacacugcagcauggggaaaaugaagaaaccucacaucugccguaguguauucu

SEQ ID NO: 4162941 - RNA, 66 nt, Human
ggaauacacagcaaggucugacuuugggauauggaguguaaacuaggugacuaugcugauggcucu

SEQ ID NO: 4162942 - RNA, 57 nt, Human
ggaauauagccaguaacagucaugcaauuauuugcuuucuguuucuugcuguauuuc

SEQ ID NO: 4162943 - RNA, 129 nt, Human
ggacagggccggccucugcugccucacacccaccugucuggccaccagggcgauaguccccccuuuggccuaggcugacgauuguccuggaggaccacaggcuggggcagccaagcacaggcccgacuc

SEQ ID NO: 4162944 - RNA, 72 nt, Human
ggacaggggaagaugccaagggagauagcaaguuugggcaaaguccuccagggggaucuucagccugauucc

SEQ ID NO: 4162945 - RNA, 69 nt, Human
ggacaguauucauggcagugguaacguuucuaguuugggaacccacucacugcaugaagaacaugggcc

SEQ ID NO: 4162946 - RNA, 61 nt, Human
ggacagucagagccuuggccgcuuuccagcugaaggccuuggccaguggccuugacuuucc

SEQ ID NO: 4162947 - RNA, 68 nt, Human
ggacagugaauguggggaugcauuuuaaaaucaguccaaauguuuuuuuccuccccucacccauugcc

SEQ ID NO: 4162948 - RNA, 86 nt, Human
ggacaguggaauaugguccuggucauugaugagcuggauucauugcuuuagccaaauaauauuucagaaccaucccaaacacugcu

SEQ ID NO: 4162949 - RNA, 75 nt, Human
ggacaguggugucuuaaaaucagaggauauaggcucuuguuuacuccacugauuucuaagauugcacuacucucu

SEQ ID NO: 4162950 - RNA, 74 nt, Human
ggacaguucuguugaauuuugacaaauguauauaguuguguaacuacuaccacagucaagacaaagaacagucc

SEQ ID NO: 4162951 - RNA, 86 nt, Human
ggacauaaaauuucuggaugaaagggcuauauauuuuuaagguuuuuggauagcuacugcaaaaaugcccuacauuuuuuaugucc

SEQ ID NO: 4162952 - RNA, 64 nt, Human
ggacauacagcgauucucaguuggggguuccuucuaggauccccagggagugagcugucugccc

SEQ ID NO: 4162953 - RNA, 71 nt, Human
ggacaucaaacucugugucugauuucuggcuauguugguuaugugacagcaggagaucaugauagauguuu

SEQ ID NO: 4162954 - RNA, 74 nt, Human
ggacaucagcagugguugugggacucacaguaaagaacaccuaugacacucacccucccacugccugguuaacc

SEQ ID NO: 4162955 - RNA, 86 nt, Human
ggacaucuauuacaucugcuuagaauucauuguccagaacuacaagaauucugggcaauaugaagggagcacauauauauuuguuc

SEQ ID NO: 4162956 - RNA, 57 nt, Human
ggacaucuguugugguagaggagauuuauuuucccuuccauuucuucagcagagucu

SEQ ID NO: 4162957 - RNA, 102 nt, Human
ggacaugggacauaagugaccuguguuugcuguugcucccccauccccaucucacaacacuggacugugagcucuggcagggcaggucugcugucucauucc

SEQ ID NO: 4162958 - RNA, 72 nt, Human
ggacauuauacuaagugaaguaagccaggcacaagaagacaaauauucugugauuccacuuauaugaggucc

SEQ ID NO: 4162959 - RNA, 82 nt, Human
ggacauuauuuuuagccuuuaucucuuagugguuuuguuuucuuuccgccgccuuuugaccugagagcuggaaauaaagucc

SEQ ID NO: 4162960 - RNA, 129 nt, Human
ggacauucacuaagcccaucaugcauguuauuagagaguuggcagcauuccagccaagcacauaaagugcuggcaccagaaugacugcagacucucauguccacagcagcuguuaggucugugaugucc

SEQ ID NO: 4162961 - RNA, 90 nt, Human
ggacauuuagauugccauauccagaguuauauccaagcagcaaaugauugcacugcuuauaaauucuaggcagaugauaauuuaaagucc

SEQ ID NO: 4162962 - RNA, 104 nt, Human
ggacauuuucuccuuggcuuucagaaucccuaucugccuuuuuaugccagaacagggacuggaggcuucaauguagaggggcaaaaaaaaaaaaaaaaaauucc

SEQ ID NO: 4162963 - RNA, 70 nt, Human
ggaccaaacaugccaucuuugucaggagugggcacgaucagaggcuccugaggagagggcagcgggaucc

SEQ ID NO: 4162964 - RNA, 55 nt, Human
ggaccacagaccucucuggcgucagaagaaguuauucugaauuaguuugugguuu

SEQ ID NO: 4162965 - RNA, 61 nt, Human
ggaccacaucuuuuuuccugaacagcccugaaaaggagcaucaagaaauggaugugggguc

SEQ ID NO: 4162966 - RNA, 62 nt, Human
ggaccagguuguaaauugcuacggaagaacaauuuccgguacucaauucugcaacacugucc

SEQ ID NO: 4162967 - RNA, 72 nt, Human
ggaccagucacagggaggacaucaacaguguggaagugaacagcauuuugaucuguucucccuggacucucu

SEQ ID NO: 4162968 - RNA, 59 nt, Human
ggacccagcucugagacccugccucucuggccagggcuguggugucagugcugggcucc

SEQ ID NO: 4162969 - RNA, 129 nt, Human
ggaccccagaaagcagucugcucucaguuuuuacuacagggcaaugggaugugcugggcuaguacuaguugaaggacauccuauuucuagaagagacuggaacagagccugggcuguucuggucaguuc

SEQ ID NO: 4162970 - RNA, 86 nt, Human
ggacccuauccuggugccugcaucuuggaggccccacccuagcagaaguagagugucagagagcaggcaguagaaugaugggcuuu

SEQ ID NO: 4162971 - RNA, 60 nt, Human
ggacccugaccagcaguacuugguaugaguuuacucuuacuauaacgcugugucagcucc

SEQ ID NO: 4162972 - RNA, 61 nt, Human
ggaccugaaaaucucgagggcucuuucccauuccagucuuucagcauucuaguucagguuc

SEQ ID NO: 4162973 - RNA, 79 nt, Human
ggaccugaccaggcuauccugcuguuaacagggaagaaagaaaacuaccuacagcagagaccagccacaucagucaucc

SEQ ID NO: 4162974 - RNA, 62 nt, Human
ggaccuggagcugagaaguggagcucugguccuagggccaccucucuggguucccaaagucc

SEQ ID NO: 4162975 - RNA, 60 nt, Human
ggaccugggguggaaggaaggcaagacugaccuuaauguucucuguucaccccagcugcc

SEQ ID NO: 4162976 - RNA, 82 nt, Human
ggaccuucuguccagggacagugauucacccagcccagaaugcucacaucugcaugggagaacacugcucuggaugggcgcc

SEQ ID NO: 4162977 - RNA, 76 nt, Human
ggacgaggugcugcuguacuucuugcggcuggaggccaucccugcccugaacagcaagagacagagcauccuguuc

SEQ ID NO: 4162978 - RNA, 101 nt, Human
ggacguaccacaggggguggcagacuuuuucucugaaggggucagcauggcuccauugagacuuucuuuagagacacugagguuucccuggugagacggcu

SEQ ID NO: 4162979 - RNA, 82 nt, Human
ggacguuagaagagaaagcccuuggauuagaggcucucaauauaaauuuaaccaagaggguuuuccuugaaucucagccucc

SEQ ID NO: 4162980 - RNA, 61 nt, Human
ggacguuauugaaucuuuguuauagcaaggcauuuuguaacagaguuguacaguuacgucu

SEQ ID NO: 4162981 - RNA, 76 nt, Human
ggacuacaacaauaagaacagcucuauggaaauggucaguaugucaaucuuuuguuguuguuuuugccagcagucc

SEQ ID NO: 4162982 - RNA, 80 nt, Human
ggacuacauuucccagcagccccuggggcauaccagcuggggcgagucagggccucuagggcuguugggaauuggagucc

SEQ ID NO: 4162983 - RNA, 63 nt, Human
ggacuagaagagcguaccuauccugucuccuuugcgaguaccacuugggugguuuuucucucc

SEQ ID NO: 4162984 - RNA, 77 nt, Human
ggacuagauuucuugggagcuuggccgagauguaggauggaccugggugucuguagguucuuaaccaucuggacucu

SEQ ID NO: 4162985 - RNA, 77 nt, Human
ggacuaucuaacucaugauauacgggaaauuauaguucuaaaaugcauauauaaaauauucuggguuagauauguuu

SEQ ID NO: 4162986 - RNA, 70 nt, Human
ggacuauuauguaaucauuacaguacauggacauaaaaacugugcauaacuagaguaauuacaguagucu

SEQ ID NO: 4162987 - RNA, 108 nt, Human
ggacucaaagccauauacuaguucccaauaggccugcacaaguuauuagaacaagcugcuuugcauucuugugugaucagaaccaguaacuagauggcaaucaggucu

SEQ ID NO: 4162988 - RNA, 80 nt, Human
ggacucaaggccaguucuucugacucugcagccagaagaaugaauguaauaaaagucaggcagcugagcuuuauggguuc

SEQ ID NO: 4162989 - RNA, 81 nt, Human
ggacucaugguuucucacugugucuauggcauguaaaccuggcauucaaguaaacacugaaggaaccauuauguagaaucu

SEQ ID NO: 4162990 - RNA, 57 nt, Human
ggacuccauaucucugucucugggcaaaaucaaaccauaaucaggguuguggggucc

SEQ ID NO: 4162991 - RNA, 67 nt, Human
ggacucucagggcugcgggcuuggcccggcccgggcggcgcaggcagaccgcgggcucgaggagucc

SEQ ID NO: 4162992 - RNA, 55 nt, Human
ggacugaaggcauuccuuggaacacucuuuccuuuugaauuuaucucuucagucc

SEQ ID NO: 4162993 - RNA, 66 nt, Human
gcugcauuguaggcauuuccuuaguguaguuaagugaaaugcacugaggaacauauauaagauggc

SEQ ID NO: 4162994 - RNA, 62 nt, Human
gcugcauuucaaguguucaguagccacauguggcuaauagauaccacauuggacagugcagc

SEQ ID NO: 4162995 - RNA, 71 nt, Human
gcugcauuucuggaauuuucuagggcaucauuuuaucuugugauaguuacaagaaggguucaaaaugcugc

SEQ ID NO: 4162996 - RNA, 56 nt, Human
gcugccaaauuuucucagagaugcugaacacagcuuuugcugagagauuugggggu

SEQ ID NO: 4162997 - RNA, 56 nt, Human
gcugccaccguggagaugaguggugauuaauugcagguugcaagccacggugcagu

SEQ ID NO: 4162998 - RNA, 93 nt, Human
gcugccagggaagaggccccagguugcuuggguccuagaacaagacauauuguuccagcccaucccuagccugggagaucuguuucugguugu

SEQ ID NO: 4162999 - RNA, 79 nt, Human
gcugccauccugggcaguuuugagugcuaagaacuggaaaucuacccaaagcagucaauuugcugccaugggaggcagu

SEQ ID NO: 4163000 - RNA, 62 nt, Human
gcugccauguggcggggcaggacugcaaacccgcaugcucagucacucugcuacaugacagc

SEQ ID NO: 4163001 - RNA, 64 nt, Human
gcugcccagagcucagugugcaaggucagcagacuaccaugcugccagcucuguuuagagcagc

SEQ ID NO: 4163002 - RNA, 56 nt, Human
gcugcccaggguggagccggcugcucgggagagagcuggugccugcuuugggcugc

SEQ ID NO: 4163003 - RNA, 61 nt, Human
gcugcccauugcacguuguggccgugaaucaacauugugacagagagggcacugggucagc

SEQ ID NO: 4163004 - RNA, 94 nt, Human
gcugcccccuguguguagucaguucauggcucuguccucauucuaagcaggaaccagagagucagagcugaaggcaaacgcuggcaugugcagc

SEQ ID NO: 4163005 - RNA, 76 nt, Human
gcugcccccuuguccaccgaacucggccccgggcagcgaggcuguccugcggccucaguggugagaaggcggaggc

SEQ ID NO: 4163006 - RNA, 56 nt, Human
gcugccccgagccauccuucagugaaucuuuaacugagggcugacaggaggacagc

SEQ ID NO: 4163007 - RNA, 63 nt, Human
gcugccccuauuucagcaagaagaauguggaggcugaugccuuguccauagcuggaugguagc

SEQ ID NO: 4163008 - RNA, 98 nt, Human
gcugccccugagaaacagguaacgagggaggggcuaagcgccacuggcagaugcucagcuugaagcugccucccugugcuuguccccucagccugagc

SEQ ID NO: 4163009 - RNA, 62 nt, Human
gcugcccggggucauguagucccuguguggcuucaaacuuaggcuucugcuguccccgacgc

SEQ ID NO: 4163010 - RNA, 60 nt, Human
gcugcccucucuggccccacacuguuuuugagacaggcaucuggagcccagagagggggc

SEQ ID NO: 4163011 - RNA, 76 nt, Human
gcugcccucugcggagccuuuguacugggcuucaaagucaugaugcuggagcucaaaggccugugggagugguggc

SEQ ID NO: 4163012 - RNA, 81 nt, Human
gcugcccucuucaacaaaaucacugaugcuggagucgccugagucaucacucagcaccaggauauuguuggagaggacagc

SEQ ID NO: 4163013 - RNA, 55 nt, Human
gcugcccugacuccagcagccugcagcuccaacccacgcugcugguggagggagc

SEQ ID NO: 4163014 - RNA, 55 nt, Human
gcugcccugugguagaggguggaggaaagccccaccaccccuggaugaggggggc

SEQ ID NO: 4163015 - RNA, 56 nt, Human
gcugccugaaauguugccuagcuucaaacacgagcagguaagaccguuuaggcagu

SEQ ID NO: 4163016 - RNA, 60 nt, Human
gcugccugaagugucuacacugcaccucuggugcacugaugugguuaacuucuggcaagu

SEQ ID NO: 4163017 - RNA, 58 nt, Human
gcugccugcaguguuuucccaguacacaugcugcuggggugaaugucugcaggccagu

SEQ ID NO: 4163018 - RNA, 91 nt, Human
ggagcccagagcugggucugcuggugccuggccugcggcagcugcuuacacaacagugcaucagcaggugcucccagggcuucugggcucc

SEQ ID NO: 4163019 - RNA, 117 nt, Human
ggagcccagcccaaaaucccauucccugccuccugguccuguguucuuccugccucccuuaaagauaggagcugcaagucuguguggggaggaggcgggaauggguggcucuucucc

SEQ ID NO: 4163020 - RNA, 100 nt, Human
ggagcccagcugcugcugagcugcuccuucccuucccagugagcuccaggcagauguggggcacacgggaugggcagggagacggcaggcaagcugcucc

SEQ ID NO: 4163021 - RNA, 72 nt, Human
ggagccccacccacucugaccagaagcuccccauccauggcugugcugucuagaguuggaaguucuggcuuu

SEQ ID NO: 4163022 - RNA, 91 nt, Human
ggagcccccgcggugcagaacugacagcaggaaccauuccgaggagaaagcugucggaaguucaguugcuaguuucauucgcaaaugcucc

SEQ ID NO: 4163023 - RNA, 68 nt, Human
ggagccccguguggccagcugaccgcuccuccagcuaugaugggcagcaguccauggcccaaggcucc

SEQ ID NO: 4163024 - RNA, 86 nt, Human
ggagccccucuccgucuguauuuguuaauuucagguucugugaacaucgccucugcucuggaggucagguguggugguggggcucc

SEQ ID NO: 4163025 - RNA, 73 nt, Human
ggagcccuaagaggaggacagcugacuccgagauggucaguuccgucugagaguagagcugccucuuuucuuc

SEQ ID NO: 4163026 - RNA, 59 nt, Human
ggagcccucaccggcgagugccugacaccucggccuuuucucuuccggaggggcgcucc

SEQ ID NO: 4163027 - RNA, 64 nt, Human
ggagcccugaagcaagaaaguagcuugaccauccaaaacugucuucuuugucuuccacgggucc

SEQ ID NO: 4163028 - RNA, 84 nt, Human
ggagccgagcuuucccuuacaggcugugggggguuugcccaccuugcccauggcaaagccuucuucggucugugauucuguucu

SEQ ID NO: 4163029 - RNA, 70 nt, Human
ggagccgauuaccaagcguguuuaggaaaugcugccucuguaagggcacauuacacgcaguaauugcccc

SEQ ID NO: 4163030 - RNA, 86 nt, Human
ggagccggaugucgugaaauccaugggcuccuccucugacuguggcuugugagccagagccuguggauuuaaccucuucugguucc

SEQ ID NO: 4163031 - RNA, 129 nt, Human
ggagccucauucacccuugccuuuguuuucauuucuccucuccagagugcagugggggcccucccagcuacagcugcgcuucuggaaggagcuuauugauaggcacagaguaugggugagucuucaucc

SEQ ID NO: 4163032 - RNA, 66 nt, Human
ggagccucccuaugcaccuucaggaacaacacccaagcagggugccugucugcaagggguggaucc

SEQ ID NO: 4163033 - RNA, 97 nt, Human
ggagccugcuggccacaggaaucaaacacuggccacagccacuuugcaguggaucauugcaggcuggcagugcugaaauccuggccacagaggcucu

SEQ ID NO: 4163034 - RNA, 72 nt, Human
ggagccugguggaaggugagugaggccucguuggugccaacccaaguugccuuugaccuuccccacugcucc

SEQ ID NO: 4163035 - RNA, 113 nt, Human
ggagccuguccaggaggaaggggccagggcugcggugcggggagcccugucugaggaggguuucccaaagccagggaucccugcccucagccuggacacucggggugggcucu

SEQ ID NO: 4163036 - RNA, 56 nt, Human
ggagccugugcccaagcccagagucgucucagguuuccugggcuuaggugggcuuu

SEQ ID NO: 4163037 - RNA, 59 nt, Human
ggagccuguggccgucacgacucaaccucaguacauguggcaguccggccgcacguuuc

SEQ ID NO: 4163038 - RNA, 56 nt, Human
ggagcgagcaagccacugagguuaaugcacagugagugacccuggcaugcucuucc

SEQ ID NO: 4163039 - RNA, 62 nt, Human
ggagcgcagcacuggggccacuggaguuaaugcagacuccucccgcucccaugccgucaucc

SEQ ID NO: 4163040 - RNA, 59 nt, Human
ggagcguauauaaauauauaauauauguguguguacauguguguauaaauauauguuuc

SEQ ID NO: 4163041 - RNA, 61 nt, Human
ggagcuacacugaaaaggagaucccucuuacguccuagauucuccaguugacagugucucc

SEQ ID NO: 4163042 - RNA, 67 nt, Human
ggagcuaguugcgugucccagaauggaggguguucugacaccccacccugagccgcaagagcagucc

SEQ ID NO: 4163043 - RNA, 82 nt, Human
ggagcucacaaucugagaauaaagccagcaggagcuaauguuggggcauuuacucugagccaugcuuuguucuaaauucuuc

SEQ ID NO: 4163044 - RNA, 76 nt, Human
ggagcucagaaaaguuuuguugauuguggaauuguggaaaaaaacagcaauauagaguuggaaagaccugagcuuc

SEQ ID NO: 4163045 - RNA, 130 nt, Human
ggagcucagaugucagacagcaggaggaauaaaaaugcuacuugugaaaacccaggcuguagguaaaacuuacucuuuuguugguugcacugguggguugggacuuucuccugaacuggccuugaaaucc

SEQ ID NO: 4163046 - RNA, 76 nt, Human
ggagcucaguagaguccucuuugaucaucugaccugccccagagaauagaccuaaagagacugauacggaaguucc

SEQ ID NO: 4163047 - RNA, 62 nt, Human
ggagcucugugucucuccugccacagugcgguggauugaccgggaugggggcacagggugcc

SEQ ID NO: 4163048 - RNA, 59 nt, Human
ggagcugaaccccaucgugcugcugcuggacaacaagugaggcuccuggggcucagccc

SEQ ID NO: 4163049 - RNA, 65 nt, Human
ggagcugcagcugcaguucugagagaaacucuauuuuucagccagaauacaguugcaaaggaccc

SEQ ID NO: 4163050 - RNA, 74 nt, Human
ggagcugccuuucaugcuuggagggccacacaaugacucaaggcucauggccccccagagcuggaggacagccc

SEQ ID NO: 4163051 - RNA, 61 nt, Human
ggagcuggcuacagagaacuccuccguuaaggagccucucuccaaagggcccuuuggcucc

SEQ ID NO: 4163052 - RNA, 86 nt, Human
ggagcugggcauaggucucgaggccccaguuccucuggggucagaacaugggagcuggucagccuugagcauuucauccccucucc

SEQ ID NO: 4163053 - RNA, 63 nt, Human
ggagcugggggaagggcuggguucugguccuuaagcccaagccuggcuuaauccuccuuuucc

SEQ ID NO: 4163054 - RNA, 77 nt, Human
ggagcuuacgauucagaggggcuaaguacuugcucugaaacacauggcaguaaguggugaucccuggauuggcaucc

SEQ ID NO: 4163055 - RNA, 104 nt, Human
ggagcuucucuccgaggaggaccugggccugguguggcaccugcugugugagcggggccauguccaacggccuucuuggggacuuugggucggggagaaguucu

SEQ ID NO: 4163056 - RNA, 74 nt, Human
ggagcuugggugccaugcugagcccaaagaaaauuauaaagguguccaggcuuguuugcaugguccccagcucc

SEQ ID NO: 4163057 - RNA, 84 nt, Human
ggagcuuggguuucacauacaguguauaguagauuauagcauaccauuuucuguucagugcauauguauugauuuccaaguucc

SEQ ID NO: 4163058 - RNA, 76 nt, Human
ggagcuuguucaaaugcagauucucauuccauaaaucuguggcagggccugagaauuugcauuucuaacaagcucc

SEQ ID NO: 4163059 - RNA, 55 nt, Human
ggagcuuguuggggaaggagaaagggcaagucccucgugguccacagcaggcacc

SEQ ID NO: 4163060 - RNA, 81 nt, Human
ggagcuuguuuaaaaugcaugugccugggccauacugagaauuuuauuucaagucuguuuaugcauauuuaaaaccccucu

SEQ ID NO: 4163061 - RNA, 101 nt, Human
ggagcuuuagaaaauggcauuaagaugucugcugguugagugaccucauagaacagaagagguuuauucugccaggagcgucagugcaaugaaaagacucc

SEQ ID NO: 4163062 - RNA, 55 nt, Human
ggagcuuugaguugagcuggcuccaugugagugacggaaacucggcucugguucc

SEQ ID NO: 4163063 - RNA, 56 nt, Human
ggaggaaauccuuaguaaggcaguccggcucguccaggccugcguggauguccucu

SEQ ID NO: 4163064 - RNA, 73 nt, Human
ggaggaagaguuggucugagguugcaccacaagaaguuuauaugcaccugaccuaccugaagucuacaccucc

SEQ ID NO: 4163065 - RNA, 73 nt, Human
ggaggaagccaggcugcacuugcugggcagucggaggggacagguggcaccagaaggcaguuggacuuacccu

SEQ ID NO: 4163066 - RNA, 63 nt, Human
ggaggaagcuagagccaccggacuggguccucuuuucacaggaggcaggcauagcauuccucc

SEQ ID NO: 4163067 - RNA, 76 nt, Human
ggaggaaggcccagcaagaacaaucagggaacaaggacagaauccuggauuugccuauggugcuuuaugaucuucc

SEQ ID NO: 4163068 - RNA, 81 nt, Human
ggaggaauacuauauaggugauauuauuugaggcagcaccuccgauaccucugaauaauguccuuguaucauuguuccuuu

SEQ ID NO: 4163069 - RNA, 65 nt, Human
ggaggaauucaccugcuuucccaaggucacacaauuauuuagggacauggcuaggauuccaaucc

SEQ ID NO: 4163070 - RNA, 65 nt, Human
ggaggacaaguuguggagaagagggugaccuuuaacacaccccuacauucccaaacuuggucucu

SEQ ID NO: 4163071 - RNA, 67 nt, Human
ggaggacaggagugaaucuggcacuuaucuuucaguggggccugagugcaaauucuuccuaccuucc

SEQ ID NO: 4163072 - RNA, 57 nt, Human
ggaggagaugcuguugaaggccagaaacaggucauucacagauuaaauauuucuucu

SEQ ID NO: 4163073 - RNA, 90 nt, Human
ggaggagcaagacacaggucaugaaagugccaggccaugggggcuucaguccuggcugcugucacugaccauggacacacuugcuuuccc

SEQ ID NO: 4163074 - RNA, 85 nt, Human
ggaggagcauuucuaaggaaugcaguaugacuuuggugggcucacgguucucaguguuuacaugcauccuugaaugugcugcuuu

SEQ ID NO: 4163075 - RNA, 65 nt, Human
ggaggagccacagccugguaacagggugacuucuggagucugggugcaggcugugcgcuccugcc

SEQ ID NO: 4163076 - RNA, 59 nt, Human
ggagaaagaggcauguuuuaugccugcugaauuucaagguggccuuugccucuuucucu

SEQ ID NO: 4163077 - RNA, 91 nt, Human
ggagaaagaucaucaguuauuuuuaagcuauaaaaucaaccauagaauuuguagacugaaggaacuuagaugaaccucaagcuuuuucuuc

SEQ ID NO: 4163078 - RNA, 66 nt, Human
ggagaaaggaggcagaacucacauggacacacccagugcaguccagaguuugagucuccuuccuuc

SEQ ID NO: 4163079 - RNA, 61 nt, Human
ggagaaaggcauagcagaaccuggacugagaccuacgggagacagguauugcuuuuucucu

SEQ ID NO: 4163080 - RNA, 78 nt, Human
ggagaaagggggcggcagccaguggaaggaucgcauggagucucuaauuccaaaggcugcaccuugcccccagucucc

SEQ ID NO: 4163081 - RNA, 129 nt, Human
ggagaacaauuucuuuauauuaguucauaugguauuggaauaguuaaggaagauuauauuaagaaucugaguuuacuuuaaugcuauuuacaaauuauuaagugacagacuggaaaagaaaaauacuuc

SEQ ID NO: 4163082 - RNA, 58 nt, Human
ggagaacagagccugcuauucucuuggaauaucuuucaucagcaggugcuguuucuuu

SEQ ID NO: 4163083 - RNA, 78 nt, Human
ggagaacagcugccugucuggaggcaaugauagcagagacauaaugaccuuagccuccgaaaggcagcugcagaaucc

SEQ ID NO: 4163084 - RNA, 79 nt, Human
ggagaacaggaugcucugucucuugcuguucagggcagggauggccuccagccgcaagaaguacagcagcaccucgucc

SEQ ID NO: 4163085 - RNA, 76 nt, Human
ggagaacgcagcccugcagagggcgcuccucagcagaaaggccgagcagccagccagcccacugcaggugcgcucc

SEQ ID NO: 4163086 - RNA, 76 nt, Human
ggagaacguuccagacagagggcacagaaagugcaaagaagaccacuugcugugccuucugccuggaacauucucc

SEQ ID NO: 4163087 - RNA, 64 nt, Human
ggagaacuagaacgagaaagcugaacugggcaagucaguugccuucuaugauucucaguccucc

SEQ ID NO: 4163088 - RNA, 87 nt, Human
ggagaacuuggucagcccacgguccuuaaacugggagacaccaguuuagugugcccauuccacuugaguaccgagggcaccauuucc

SEQ ID NO: 4163089 - RNA, 71 nt, Human
ggagaagaccagggaaagggccugaaaugagugaccuuuaggggcauuucuguucucuuccuguacucucc

SEQ ID NO: 4163090 - RNA, 95 nt, Human
ggagaagagagccaagagaagggguaaagaguccugggguugagcccccagaauugucuuaugaccccugauuagucacuucggcucucugagcc

SEQ ID NO: 4163091 - RNA, 96 nt, Human
ggagcaguaacugccgugaaucgggugguuuaauguuguuguguucagaaacccaggcccaacaacaugaaacuaccuaauucacucagcaguucc

SEQ ID NO: 4163092 - RNA, 106 nt, Human
ggagcaguggaugugggccaugggccauggugaagccaggucccgagacaggcagagugagccaguccccugagcuuuccuggcccucccgaguaugcacugcucc

SEQ ID NO: 4163093 - RNA, 55 nt, Human
ggagcaguggucauucagcuggccuuuucuucagcugauugauuguccugacucu

SEQ ID NO: 4163094 - RNA, 80 nt, Human
ggagcaguuuuccugagcuccucaugcaaauggacgccacucccuucggcaaaguccugggagcucaagggaggcugccc

SEQ ID NO: 4163095 - RNA, 57 nt, Human
ggagcaucaucacacacacccaugccagaccaggccacauggcaagaugaugcauuc

SEQ ID NO: 4163096 - RNA, 62 nt, Human
ggagcaucuccagggugucccacucccugggaugucacugggcauggacaccuggagucucc

SEQ ID NO: 4163097 - RNA, 81 nt, Human
ggagcaugagaaaccugagugcagaucaggaaaauuauuaauuuccaacugucugccaucaguaucauuucucuuuguuuc

SEQ ID NO: 4163098 - RNA, 89 nt, Human
ggagcauggagggcagccaggagccucugcaacuaucuccaucucaugguaaaaaucucuagucagagucuucucuguuguccagcuuc

SEQ ID NO: 4163099 - RNA, 97 nt, Human
ggagcaugguuguaucugaagcucugugugugugcauaaggaauauaauauaggcucuccaaauguuuuucauaccaguguugggauuuagccuucc

SEQ ID NO: 4163100 - RNA, 65 nt, Human
ggagccaaaugugcagacauuguuccaaaaugaauauuugcaugcauggaugcacgcuuggaucu

SEQ ID NO: 4163101 - RNA, 60 nt, Human
ggagccagaaaugcugugguuggggcauuucaucaaccaaaucacaguuguucugccuuc

SEQ ID NO: 4163102 - RNA, 63 nt, Human
ggagccagaaguaaggaaagaauuucuaccaggaucuccuguguagaaucuacuauuuggccc

SEQ ID NO: 4163103 - RNA, 90 nt, Human
ggagccagacucagagcagagcagccugaggagcauucucacuaaacaaacaugucuccagaacugcagugcucuguaucuccaggcucc

SEQ ID NO: 4163104 - RNA, 55 nt, Human
ggagccagaguuuaauguggagcucuuccauuuaauagaaguuacuuuggcuacc

SEQ ID NO: 4163105 - RNA, 99 nt, Human
ggagccagcagugugggcccagguccugggagaagugagguucacccugucugcucgcagcccuggcuuagucuccaaacugccuuccuuauuggcucc

SEQ ID NO: 4163106 - RNA, 56 nt, Human
ggagccagcuacauggucugcaaaugggcacaucuuugaguccagguacugguucu

SEQ ID NO: 4163107 - RNA, 71 nt, Human
ggagccaggcuuucuccugacucacauaaacauggcccaaaugugcagcucuagagccaagccucuguucc

SEQ ID NO: 4163108 - RNA, 60 nt, Human
ggagccaguauuuaguggucuuccacauauaaggaguguuacuacagacugguuaaagcc

SEQ ID NO: 4163109 - RNA, 89 nt, Human
ggagccccagcuuguggugaccaguguccccucugaggagugagagggagacccugaccccacaggggugcuagagccaccugaguucc

SEQ ID NO: 4163110 - RNA, 90 nt, Human
ggagccccagguggguuaaggggagugggcuuauuggacauggaacccuucugucugcauaccccuuuagcagagucagcuuggggcucc

SEQ ID NO: 4163111 - RNA, 67 nt, Human
ggagcccgucuucccucccuggguguguccaucagcucugcccaaaccaggcugggagggcaguucc

SEQ ID NO: 4163112 - RNA, 76 nt, Human
ggagcccucaccucugcauucgcuuuaugacugaguuucuccugaaacaguggagaagcaaaugcagugaggaucu

SEQ ID NO: 4163113 - RNA, 128 nt, Human
ggagccuauguaagggugaugguuauaugcaaguuuacaauguguauguguuggggcugggaacugaaaagcugaaacacugcagauguaauuugagucauguggcuagcuacuuuuucauaggaucc

SEQ ID NO: 4163114 - RNA, 80 nt, Human
ggagccucuaaacaguucucaucaugaagcauaagauuugugauuuugacagcuugcagugagaccugugcuuauguucu

SEQ ID NO: 4163115 - RNA, 59 nt, Human
ggagccugagagcagggguccaguggaggcugccauguugagcccuugccucagagccc

SEQ ID NO: 4163116 - RNA, 59 nt, Human
ggagccugcagggaagggcuaggauggucaggaucucuucagugcaugcccucaggccc

SEQ ID NO: 4163117 - RNA, 97 nt, Human
ggagccugggugggaacugcuuuagagcugagccucagaucagaucacagcacuggugccacugaguuuucuuuggguguuccacacccugagcucc

SEQ ID NO: 4163118 - RNA, 77 nt, Human
ggagccuuacaaaauaacaagaaauacauugguucuuacauuaggugauggacuuauaguauucucuugguugcucu

SEQ ID NO: 4163119 - RNA, 80 nt, Human
ggagccuucgagaaggcaguaaauggcuguuuuuauugacaaaaggaaaacauuuuacugccaucucacugauggcaucu

SEQ ID NO: 4163120 - RNA, 66 nt, Human
ggagcgagcucugggaaacaaaguguagcucuuguugcugccugcccuuuccacacagccagcucc

SEQ ID NO: 4163121 - RNA, 104 nt, Human
ggagcgcgaugagccaguccgcgcgcaggcguggaacgccgagacgcuggcgcggagccggcucugcggcgugugcgcaggcgcgaggucggcggcucgccccc

SEQ ID NO: 4163122 - RNA, 84 nt, Human
ggaggagcggggacgggcgagacuggcauaagcgucuucgcgagggagcaaggcggccugugggucggccucaccccggccucc

SEQ ID NO: 4163123 - RNA, 84 nt, Human
ggaggagcuuaaccagcaggugguagggaaacaauauuaaaaaccuaucaggauuuggccuuguguucucuccauuucuccuuu

SEQ ID NO: 4163124 - RNA, 96 nt, Human
ggaggaggaggaggaaggaggaaagcuuaaaaugggauggaacuuccacuugacaauaaacugagcuuuuuuagccuuuaauccaauucuuucuuc

SEQ ID NO: 4163125 - RNA, 81 nt, Human
ggaggaggcugaagauguguuucuaguuccugcaugcugcuuuguugugugaccucggacaugucaccuccagccuucuuc

SEQ ID NO: 4163126 - RNA, 57 nt, Human
ggaggagggcagggguugaccagagaaggccuccucugcaccugugccccauccuuc

SEQ ID NO: 4163127 - RNA, 64 nt, Human
ggaggagggggacguauccugguaugaagcugcagguggugugcagaaugcuucccccaccgcc

SEQ ID NO: 4163128 - RNA, 56 nt, Human
ggaggaggucccccgacaugccugaggcaaaaccagguggcgccaggacccccucc

SEQ ID NO: 4163129 - RNA, 77 nt, Human
ggaggaggugcagaaacuguuuguuaauauuuacccaaauuaauaagauguugagcaacagcuucuacacaaaagcc

SEQ ID NO: 4163130 - RNA, 56 nt, Human
ggaggaguguggggcacucugcccugcagccaacagggcccucccuccgcuccucc

SEQ ID NO: 4163131 - RNA, 57 nt, Human
ggaggaucacuugaggucaggaguucgagacgagccuggccaacguggugaaacccc

SEQ ID NO: 4163132 - RNA, 73 nt, Human
ggaggaucccagcucacuuacuugguaugaccaccacuugguuccccuucccaaaagcgagucuguuguuccc

SEQ ID NO: 4163133 - RNA, 55 nt, Human
ggaggaugaggguggugguguugggcacacuuugcagggccucacccacaccucc

SEQ ID NO: 4163134 - RNA, 56 nt, Human
ggaggauggauccgaccccuuccagcucccauggcugggagguuuuccaucucucc

SEQ ID NO: 4163135 - RNA, 69 nt, Human
ggaggcaaugcugcaagaggugaaaagauggaagcuccgucucuucugcugcugcggcagcgucccucc

SEQ ID NO: 4163136 - RNA, 55 nt, Human
ggaggcagaacuucccgucaguaaaacuuucucugugugaggacaucugccuacc

SEQ ID NO: 4163137 - RNA, 68 nt, Human
ggaggcagaaguagggggagacaaaaugcuagguuuugauggcaaugcuguauucuucuccuuccucc

SEQ ID NO: 4163138 - RNA, 65 nt, Human
ggaggcaggaaagacagguucagugaugugacaugagaaguauuuaaccugucauuucugucuuu

SEQ ID NO: 4163139 - RNA, 63 nt, Human
ggaggcaggggaggcucuccaggcuuuggggccgugacagcagcuugggucucuccugcuucc

SEQ ID NO: 4163140 - RNA, 57 nt, Human
ggaggcagggucgaggccuuggugcugaccuccggcuuccucugccagcccgccucu

SEQ ID NO: 4163141 - RNA, 72 nt, Human
ggaggcagugaauucuucaguuucugggacuccuggcaacacagggccugugagaaucaaggaaaagcuucc

SEQ ID NO: 4163142 - RNA, 63 nt, Human
ggaggcaguguuuacugcccuguggauucauuagcacuccaaggccggccugcucucgccucc

SEQ ID NO: 4163143 - RNA, 60 nt, Human
ggaggccaauuuucuaacugcauuccauuucaaaggauguaagaaaaaucauuugccucc

SEQ ID NO: 4163144 - RNA, 108 nt, Human
ggaggccaccagauguccccaccuccagggucaggccagcaaaggggcccaccuucauuugaccaccccgacugcugguccuggagcuggguuccuggaggggcuucc

SEQ ID NO: 4163145 - RNA, 62 nt, Human
ggaggccaccauggagucacuucugggaaggcaauagaacgcagugguucaugguggccucc

SEQ ID NO: 4163146 - RNA, 58 nt, Human
ggaggccacgguuuagcaccgaugucugcggaggaggugggugcucgcccuggucuuu

SEQ ID NO: 4163147 - RNA, 56 nt, Human
ggaggccaggaagagccgcccuuccuccuagcaggcgcgggccucccuggcacuuu

SEQ ID NO: 4163148 - RNA, 65 nt, Human
ggaggccaggugggagucaucucacccugccagguaacggggcuggugggcccgcgcuggucucu

SEQ ID NO: 4163149 - RNA, 77 nt, Human
ggaggccaggugggcgugucuucaccuucccucuuacgggugaggauguuguagagaugcccaguugaaaaggcccc

SEQ ID NO: 4163150 - RNA, 71 nt, Human
ggaggcccccggcgccccccgguguccccgcgagggguccagggcggggucugccggcccugcgggccgcc

SEQ ID NO: 4163151 - RNA, 61 nt, Human
ggaggcccucuguaacuauuuguugaaugaacacaucacaguagaguaaaagggagccucc

SEQ ID NO: 4163152 - RNA, 56 nt, Human
ggaggccuggcucugcccuccuggcccuuccaguccaguggggaggagaggccucu

SEQ ID NO: 4163153 - RNA, 55 nt, Human
ggaggccugggcucuagaucucucacaugcugugugaccuugggcaagugccuuc

SEQ ID NO: 4163154 - RNA, 56 nt, Human
ggaggccuuacgaagcaagccuuguuuugcugagagcucuguacguuggugccuuc

SEQ ID NO: 4163155 - RNA, 75 nt, Human
ggaggcgcugaccagcagugugggacuccuggggcccaacccccagccugcucucagauguugagccagcccucc

SEQ ID NO: 4163156 - RNA, 102 nt, Human
ggaggcgcugagcugggagcagagggagcagggaggggacugcugaguagggcuccuccccggccuccacuuuucucucuccuguggcugcccacgcccacc

SEQ ID NO: 4163157 - RNA, 75 nt, Human
ggaggcggagguugcaguaagccgagauugcgcuauugaacuccagccugggcgacagagcaagacuccgucucc

SEQ ID NO: 4163158 - RNA, 109 nt, Human
ggaggcggcugccgucuggcuccgcugggcccccggacaggcauucauccgauaucuggaucucccagacggguggucugcgaggccugagugccaaaugguccccucc

SEQ ID NO: 4163159 - RNA, 100 nt, Human
ggaggcgugcccgguucauccaaggcgcaagauggcgcugcuuuuugcacguucuuugcgcuugugccgcuggggagccaaacgauugggaguugccucc

SEQ ID NO: 4163160 - RNA, 63 nt, Human
ggaggcgugcccuggccccgaggcugcugcaccgccucagccucacugucagugccgucgucc

SEQ ID NO: 4163161 - RNA, 58 nt, Human
ggaggcucagacuccauccucaaggcuggcaagaagacagggugagacaugagccucc

SEQ ID NO: 4163162 - RNA, 63 nt, Human
ggaggcuccaggauauguuggauaccuggcgcagugccuggcaaauaacaauccugagugucu

SEQ ID NO: 4163163 - RNA, 58 nt, Human
ggaggcucccacgcagcucacacacgagggaggugugagacucagaugugugguuucc

SEQ ID NO: 4163164 - RNA, 60 nt, Human
ggaggcugagaaguccaagaucauagcaccaacaucugguaaggacuucuuacagugucc

SEQ ID NO: 4163165 - RNA, 75 nt, Human
ggaggcugaggcaggaggauugcuugagcccaggaguucaaggcugaaguagcuaugauccugccagugcacucc

SEQ ID NO: 4163166 - RNA, 70 nt, Human
ggaggcugagguucaguccugcucugucaugaauuggcuacaugacugaggaccaaggacuugaguuuuc

SEQ ID NO: 4163167 - RNA, 72 nt, Human
ggaugccugaauaucauuuacauuuggagucuaagcaagugaaugauucccaaugacacuugauuuucaucc

SEQ ID NO: 4163168 - RNA, 56 nt, Human
ggaugccuucuuggugcuacaccagcugcgcugcaaugggguccuggaggggaucc

SEQ ID NO: 4163169 - RNA, 105 nt, Human
ggaugcggaaaaauaggaaugcuuuuacacuguuggugggaauguaaguuaauucaacuauuauggaagacagugugguuggugguuccucaaggauuuacaacc

SEQ ID NO: 4163170 - RNA, 74 nt, Human
ggaugcgggggucuucaggucuaguugguaucacuccacagaaauccauucaucugagggccaggccuguuucc

SEQ ID NO: 4163171 - RNA, 101 nt, Human
ggaugcuaauuguuggauacagagaugaauuagacagggucucugcccucagggaguuucacagucugucauuguuuguauuguaauaguuaaguuacucc

SEQ ID NO: 4163172 - RNA, 59 nt, Human
ggaugcuaugaugugccauuucuuugggcuuuuccgaggacugcucacuugaggcuucc

SEQ ID NO: 4163173 - RNA, 126 nt, Human
ggaugcuccgaagccaguguuaguauuuguucucauugaccucugugguauaagcguccugaagaagcugggcccuuuaucauggagguaaauaugcauagcugccccaugaaaaaaggagaaucc

SEQ ID NO: 4163174 - RNA, 60 nt, Human
ggaugcugagggaaggcggcaaaagcugcagcugcugugcugcccugccuucagcucucc

SEQ ID NO: 4163175 - RNA, 82 nt, Human
ggaugcugcagauucgggcucaagcuggaggaggggcccaggugguaucgaccagccccucuccgcccugagucguggcgcc

SEQ ID NO: 4163176 - RNA, 117 nt, Human
ggaugcuuaugguggaaugaaggagcacuauuuaggcaauaucauuggaguugcuuugaaauacucaauuaacuaguaauucuguugcuaauguucuguacagauacauaagcaucu

SEQ ID NO: 4163177 - RNA, 79 nt, Human
ggaugcuuauugaguucugcuagcaguggugcacuuaaaccagcuuguacuaacuucugagaaccaauuguuagcaucu

SEQ ID NO: 4163178 - RNA, 88 nt, Human
ggaugcuugcugcaggcacaucucugcugcuccccacaacugcaccuccaugaagccuugucuagcagaagugccuuagcaaucacuc

SEQ ID NO: 4163179 - RNA, 80 nt, Human
ggaugcuuugcucuuguuugagguuguuugcauacagaauuguucauguguuugauagcccagagaaugcacagagcucu

SEQ ID NO: 4163180 - RNA, 74 nt, Human
ggauggaacugaucaggagugccaagucaaaagcagcagaucuuaagcccucacugguuguuccuuuaacaucc

SEQ ID NO: 4163181 - RNA, 66 nt, Human
ggauggaagcagaggccacagagugggcaugaaaacuaaaugaucacuccucauucugccccaucc

SEQ ID NO: 4163182 - RNA, 78 nt, Human
ggauggacucgaucucuugaccucgugauccgccugcuuuggccucccaaaguacuuggauuacaggcaugagccacc

SEQ ID NO: 4163183 - RNA, 57 nt, Human
ggauggagcaggggccagcucccuugagggccaggccuuuuguguccuugcccgucc

SEQ ID NO: 4163184 - RNA, 72 nt, Human
ggauggaggaccccagcagcuccccagccggcugucagcucgcuauggaggagggcuggugucuguauuucc

SEQ ID NO: 4163185 - RNA, 64 nt, Human
ggauggaguuaacucugaaaagacauuuauuuaaaaauuagaauaaucacaguuaacucuuucu

SEQ ID NO: 4163186 - RNA, 56 nt, Human
ggauggcaaacugggaccagaggaucuccugggcccuggguucuggauuugccucu

SEQ ID NO: 4163187 - RNA, 56 nt, Human
ggauggcaagcacauaauaaaugcucucugaauagcaauuauuggugcugcuguuc

SEQ ID NO: 4163188 - RNA, 71 nt, Human
ggauggcucgugguuggugcuccgcaccgccgagaaggcgaccuuggaguuggccgcccggaccgauaucc

SEQ ID NO: 4163189 - RNA, 113 nt, Human
ggaugggcacacugugaauucauuagcaugguagccaggucagcagagucauuaguggucauuuuaaugaugacuuggaaacccugccuggucaauuuaagugaggcucauuc

SEQ ID NO: 4163190 - RNA, 102 nt, Human
ggaugggcacugauccugaguuuggccacugccaggguggucaauccuccucccgauaacccucagacagcuguggccagauguggacuucuuccugccucc

SEQ ID NO: 4163191 - RNA, 121 nt, Human
ggauggucagccaggcgcgguggcuuacgccuguaaucccagcacuuugggaggccaaagugggcggaucacaaggucaagaguucaagaccagccuggucagcauagugaauccccaucu

SEQ ID NO: 4163192 - RNA, 57 nt, Human
ggauggugacggcggcccgcuucaucugcaggaagugccgacgcuccagcaccaucc

SEQ ID NO: 4163193 - RNA, 71 nt, Human
ggaugguuuccuuucagaucuguaacuggcaagguguauauuuuguuuagagaauugaagcagagcccucc

SEQ ID NO: 4163194 - RNA, 58 nt, Human
ggauguagccauucuugugacaaaucaaaaacagacucagaggaauaaugcugcauuu

SEQ ID NO: 4163195 - RNA, 75 nt, Human
ggauguauuucuuuccauuauagucagcgaaauaugacauacacuucaacuggcugagaaaaaagagcuauaucc

SEQ ID NO: 4163196 - RNA, 59 nt, Human
ggaugucauugcuuuguagagagggucugcuuucugauacaucugccugcagggcaucu

SEQ ID NO: 4163197 - RNA, 91 nt, Human
ggauguccugggacaaguuuccccuaagugaaguguugauaagucugcuuaucagaaagauauuacugggggugugauauguagggcaucu

SEQ ID NO: 4163198 - RNA, 87 nt, Human
ggaugucuuuuguuuucuuuucuugccugauugcucuggcuaggacuuccagugcaauguuaaauaggaaaggagaaagugggcacc

SEQ ID NO: 4163199 - RNA, 71 nt, Human
ggaugugcugaccuaaauugaggaagaguuuucuuuucuauuaacucauuuugcaugguaacagcauaucc

SEQ ID NO: 4163200 - RNA, 73 nt, Human
ggauguggaggccuaagguacaguuugcaucuggagugagaggcaugggccagaaaaggcuucccaggcauuu

SEQ ID NO: 4163201 - RNA, 71 nt, Human
ggauguggaggggaagguuagagugaucuccaugguggccucugaggcaccuuugccaaaccagugcagcc

SEQ ID NO: 4163202 - RNA, 103 nt, Human
ggauguucaguggcuagggauucccaggucuuguuugacaucaauuaccguacaguuuccuacauuggugaacaaauagggcuauaacuuagcuuagacuucc

SEQ ID NO: 4163203 - RNA, 92 nt, Human
ggauuaaaugagaucaugaauguguagcauuuaaugcagucucugacacgugggcugcauuccguucacuuuagcgaucaucauuauuaucu

SEQ ID NO: 4163204 - RNA, 89 nt, Human
ggauuaacucggauaagcaauaagggauccucuauaagucaaaggggugauuuagggagauuugcuuaguugugguuugaaggauggcc

SEQ ID NO: 4163205 - RNA, 75 nt, Human
ggauuaauguaauagaacacucagcauggaaagccaccccggggcugcuccuguauauauuuuguuacauauucc

SEQ ID NO: 4163206 - RNA, 64 nt, Human
ggcauguggucaucuaacuaaauuuucuuugauuuuuuggagaaggguguggguguuacaggcu

SEQ ID NO: 4163207 - RNA, 63 nt, Human
ggcauguuaaugacuuacgauaguguccuacucugggcagcuguguaggaucauaacacgguu

SEQ ID NO: 4163208 - RNA, 86 nt, Human
ggcauguuuacauacuucuuggccugauuccaauaccugccagcaguuuuauugcaauuuggcuaaagaauacaaucaaacugacc

SEQ ID NO: 4163209 - RNA, 129 nt, Human
ggcauuaauuggcaaacaacuuaauuaaaaugcuuucucaaguaauuagcaacaaauacgucccuaucuguuuugcaugccauuugucuuguuguguuuguuaagcuggccugucagucaaacuuugcu

SEQ ID NO: 4163210 - RNA, 74 nt, Human
ggcauuagauacauucacauuguugugcaacaguuucacucguuuuaccaaauugaauguuuugucuacuggcc

SEQ ID NO: 4163211 - RNA, 86 nt, Human
ggcauuagggcugcacagacuugcucauuuaucuauuuuaacaguuaacaaaguauuguuuguguaucucugaaauucuaaaugcc

SEQ ID NO: 4163212 - RNA, 80 nt, Human
ggcauuauuacuauuuuuauugucacaacuguuaucaauaauaaagaaaaugguuacagaaaugaaaguaaggaggugcc

SEQ ID NO: 4163213 - RNA, 96 nt, Human
ggcauucacuguacugccccccaaagcugccauugcggucggaccccaggucgaacucauagucguagcuguagcuggggcgguagggguugugcu

SEQ ID NO: 4163214 - RNA, 72 nt, Human
ggcauuccugcagagaguaacugaaauauagacaguaacucuaugccuuucaugugacuccuguugauagcc

SEQ ID NO: 4163215 - RNA, 61 nt, Human
ggcauucuugguaugaaggacagacugguagacacaaccuagccuauguuaucaagaagcu

SEQ ID NO: 4163216 - RNA, 71 nt, Human
ggcauugcaggcaaagugcuguguccucagugaugaacccugaagggccaugcuaggugcccgcagcugcc

SEQ ID NO: 4163217 - RNA, 83 nt, Human
ggcauugggauugggaaaguuaaauuaaagauuggagaaggaccucuugcuaggucuuucuuuauuuugguguccuuaaugcc

SEQ ID NO: 4163218 - RNA, 82 nt, Human
ggcauugucuuuaaaaauauacaaccaaaacagaaaaaucuaagccguggugccuggggauguguauuuggaagacaaaacu

SEQ ID NO: 4163219 - RNA, 79 nt, Human
ggcauuuacuuguuugggguguucaggguacuucugggggaacuugagaagccccuucccacccccacccagugaaucu

SEQ ID NO: 4163220 - RNA, 68 nt, Human
ggcauuuaucuaauauaguuuauggcuaugugagcauauggagagcagaauuaugcuagagaggugcc

SEQ ID NO: 4163221 - RNA, 130 nt, Human
ggcauuuaugucugggaugcaaacugaguaugccccugguugucuguuaucucuuuuaauaaucuuuuugcaggaggaggcuggaguacacccagggggugggcaagugggcagauaccagauuagaucu

SEQ ID NO: 4163222 - RNA, 56 nt, Human
ggcauuucagucuuguggacuuuugggaaaaaaauguuaaacauaacugaagagcc

SEQ ID NO: 4163223 - RNA, 86 nt, Human
ggcauuucuaacugguuucauaucauuuccggguggaaacaauccagauuuacgaggaaagagauugcaaucuuuuagcaaaugcc

SEQ ID NO: 4163224 - RNA, 127 nt, Human
ggcauuugcagguccccacgguggcggaggcagcugggccccagccucuccacugucacccucaccccaggacguggugcgaaggagccuggagcccaccuggccguccccgggaccggcuggugcc

SEQ ID NO: 4163225 - RNA, 57 nt, Human
ggcauuuguucuccaucccgaaggucacagcccacccaagguggcaggucagaugcc

SEQ ID NO: 4163226 - RNA, 80 nt, Human
ggcauuuucugcucagagaaaugaaguagggauucagugauauagacaaauccuagaaauuuauuugaaguagaauggcc

SEQ ID NO: 4163227 - RNA, 69 nt, Human
ggcauuuucuuucuugcuggcaaaaaauuccuaucagccaguaggguggacaguaggguagacagugcc

SEQ ID NO: 4163228 - RNA, 61 nt, Human
ggcauuuuucuccucauaauguuuccugaagcaugaaaggauccuugaucagaagagugcu

SEQ ID NO: 4163229 - RNA, 90 nt, Human
ggccaaaaugggcagagguuucugcagcauaguggcaggucugcuuaccuugcauugugaagcggagaucuuguuuugaaccauagggcu

SEQ ID NO: 4163230 - RNA, 114 nt, Human
ggccaaaccuacugagagcuaggcugggcuggcauggcuguugaagucagcuccacgggggagcugaccuugacguuagcagacggagaccagucccaguuccagggggaggcc

SEQ ID NO: 4163231 - RNA, 59 nt, Human
ggccaaaugaaggcaaugggacuugauaagaacaaucacaagaaccccucuaucuggcc

SEQ ID NO: 4163232 - RNA, 63 nt, Human
ggccaaauuuauuugcagcuggauauugaaugggacuuuucugguugucuuagaauucuggcu

SEQ ID NO: 4163233 - RNA, 116 nt, Human
ggccaacuaagugugagugaaauggaagguggagugugccacuucugggccaaggaaguuaaacacagaugugcuccacccucacacucuucccuuguaugcugaccuuggaggcc

SEQ ID NO: 4163234 - RNA, 102 nt, Human
ggccaagaaucaaguguuuaugucuggcauguuguaauuaauuaaaccauuuuuaugcaauaauugcagggugucagaauacaaugcauuuggugacaagcu

SEQ ID NO: 4163235 - RNA, 74 nt, Human
ggccaagcccucugugccucguguccucugcaccgcgauggcuucgcugggggagggaguggggagagcuggcc

SEQ ID NO: 4163236 - RNA, 59 nt, Human
ggccaagccucuuccagcuccuuucuaguccuuaauacugacaguaaugagaggcugcc

SEQ ID NO: 4163237 - RNA, 55 nt, Human
ggccaauucaggcuuuggccuccugugagaaccaggauuucaaagcagaguggcc

SEQ ID NO: 4163238 - RNA, 83 nt, Human
ggcagaugaccaaccauccugguuuuucugguuuuagcauugaaaauccuguacucaagguaaaccaggauaguuggucaccc

SEQ ID NO: 4163239 - RNA, 64 nt, Human
ggcagaugaguggugggagugaguguuuggcacaaacaagcuucucucuuugcacucacaggcu

SEQ ID NO: 4163240 - RNA, 72 nt, Human
ggcagaugcccugaaagauucaaaggcugucuguaaauggagaaugccuuuauuguuuauucagugccugcc

SEQ ID NO: 4163241 - RNA, 55 nt, Human
ggcagcaacuuggacagcagucuuggcaacaaguacccaauauuaggauguugcc

SEQ ID NO: 4163242 - RNA, 116 nt, Human
ggcagcacacacuaggcucugaacgguggagaggauggcacacauuuaauaaacugugcucagcacuuucuccaaccacuaaguucagguuuggaaaugacuguggaauuugugcc

SEQ ID NO: 4163243 - RNA, 79 nt, Human
ggcagcaccccagcucuagcugccccgaggcagggucggggcugaugcuaucucccugguaguuaauggggccgcugcc

SEQ ID NO: 4163244 - RNA, 57 nt, Human
ggcagcaggguagccauuucucccugacugggguguccaccauggugcucugcagcc

SEQ ID NO: 4163245 - RNA, 57 nt, Human
ggcagccacccugggaggcagacauggccuguuuccugaggcccagguuggacugcu

SEQ ID NO: 4163246 - RNA, 60 nt, Human
ggcagccagcaguugaaauugacaugugagaguucuucuaagucccagaugcuagcugcc

SEQ ID NO: 4163247 - RNA, 88 nt, Human
ggcagcccagaagcaaggcucagagccuggagcugcugaccucuuggggacacugcagcccuggccuggccuacuuuucucuucuccc

SEQ ID NO: 4163248 - RNA, 56 nt, Human
ggcagcccuggacccuggagaaucuggacuggaggagcucuggcuccugggcugcc

SEQ ID NO: 4163249 - RNA, 56 nt, Human
ggcagcggcgccugcuucagucacuugaguagaguugcuuggcagguuuuguugcc

SEQ ID NO: 4163250 - RNA, 67 nt, Human
ggcagcuaaacagagggggacccaacccccaacaucuggggcaguggcuucaacucugucggcagcc

SEQ ID NO: 4163251 - RNA, 62 nt, Human
ggcagcuaacacuugggggcauccuuagugaucucacugggguacccuccaggguaccugcc

SEQ ID NO: 4163252 - RNA, 129 nt, Human
ggcagcuauucuucacucaguuauuuagggaucuaggcugaagacagcacuggcauuuucaagauauggcuucuaagauggcuuagugcguccccagucuauagguagaaaagaaaagaacagauagcc

SEQ ID NO: 4163253 - RNA, 84 nt, Human
ggcagcucagcagagauggcagcuggcuugggcaccucggaggagggagacccgaggaaguugccugacugcuggccuccugcu

SEQ ID NO: 4163254 - RNA, 60 nt, Human
ggcagcuccuccuagucugccccucccguggcugccacagacuccaggagggaggcugcu

SEQ ID NO: 4163255 - RNA, 62 nt, Human
ggcagcuccugccugggcagcugucugagaaggacagagucugacagguaggcgcccaugcc

SEQ ID NO: 4163256 - RNA, 62 nt, Human
ggcagcuccuggagacuucauggcaaaccaacauauugaaugcaggaaauuccaggguggcc

SEQ ID NO: 4163257 - RNA, 64 nt, Human
ggcagcuggguagugugggggcuggauuggaauuuucuagaaaguuagcagacucuuggcugcc

SEQ ID NO: 4163258 - RNA, 60 nt, Human
ggcagcugucucauucacaccugaucagaguccacacagaacaggugcaaauuagcugcc

SEQ ID NO: 4163259 - RNA, 67 nt, Human
ggcagcuuccuugguuuuaucuuaagauucuuugcaagagcaaacugugaggccgggaagcacagcc

SEQ ID NO: 4163260 - RNA, 63 nt, Human
ggcagcuuuuguguguucgcuccuacuuggucuugucagacuuccugggcaugcagagucccc

SEQ ID NO: 4163261 - RNA, 74 nt, Human
ggcaggaaaacaaggcagcucagcucauggcaguccugaugaugaucccugagggcugaucuuggccucuagcc

SEQ ID NO: 4163262 - RNA, 77 nt, Human
ggcaggaagcccccauggggaaggguggggugugugaccccagcagccuugucccuucucuugggggcgguggugcc

SEQ ID NO: 4163263 - RNA, 62 nt, Human
ggcaggaagcucauguggacugauucuagccauuggcuccagcuuagcaugggcuuccuguu

SEQ ID NO: 4163264 - RNA, 64 nt, Human
ggcaggacucucaggaccaagcaagguagcagaagagaggcucagagcuuuccuuagggucucc

SEQ ID NO: 4163265 - RNA, 86 nt, Human
ggcaggacugaucagugggauggucccuacggaauggaaugucccagcugccgucaccacugccaccuccccaucucuguccugcc

SEQ ID NO: 4163266 - RNA, 99 nt, Human
ggcaggaggaucacuugcaucugggaggccaagguuacagugaguggcgauccugccauugcacuccagccugggccacagaguaagccucugucugcu

SEQ ID NO: 4163267 - RNA, 70 nt, Human
ggcaggagugcagguggugaggcaggcagacacagugcccagccugggccugacucaccugccucccgcc

SEQ ID NO: 4163268 - RNA, 89 nt, Human
ggcaggauuaaggugaggggaguaaagccauguuacacagauacaaaaaacauucaguaaucgcaaugguucccucaccucaccuggcc

SEQ ID NO: 4163269 - RNA, 62 nt, Human
ggcaggcacuguguuuuguguugagaauaaaaucaugaacaagguaagacccaggcucugcc

SEQ ID NO: 4163270 - RNA, 58 nt, Human
ggcaggcaggagcucugucucccggccuucuccacuggagccugaagcaccuccugcc

SEQ ID NO: 4163271 - RNA, 70 nt, Human
ggcaggcaggccggccggccccagcucugcuggugaaugcagaggggcucaagcaguggucuucccugcc

SEQ ID NO: 4163272 - RNA, 62 nt, Human
ggcaggcauccucguugguuacuggcuaaagaaaauuaccaugugagcagggagaugcugcc

SEQ ID NO: 4163273 - RNA, 59 nt, Human
ggcaggccugcaguggcccuucauuucaccuauuugacucugccugccuagagcuugcc

SEQ ID NO: 4163274 - RNA, 75 nt, Human
ggcaggcuagaaacucaggcaagaaagacccugcuuucucugcagcauuuucuuguuugaguuuaccuagcugcc

SEQ ID NO: 4163275 - RNA, 68 nt, Human
ggcaggcuccguguuccauuccagcugagccuuugcuggaguaauuacccacauggagucuucaagcc

SEQ ID NO: 4163276 - RNA, 67 nt, Human
ggcaggcuguaggggcugggcugcugcggccaccagcacagacagcccugucccugagggaccuguc

SEQ ID NO: 4163277 - RNA, 57 nt, Human
ggcaggcuguuugaaggauuaggccagauaacccuggcaagcccucuuuagccugcc

SEQ ID NO: 4163278 - RNA, 66 nt, Human
ggcagggacagggguucugcuccuucucacuucaccaccggcacacagcuugccccugucuuugcc

SEQ ID NO: 4163279 - RNA, 58 nt, Human
ggcagggacgcagcacucuccgucacaugcugugugacgugcaguggagugucccgcc

SEQ ID NO: 4163280 - RNA, 68 nt, Human
ggcagggagggagucgggaacugugggucugugguaugcggcuugcaaaccuguuucucucaccuguc

SEQ ID NO: 4163281 - RNA, 58 nt, Human
ggcagggcaggaaagucaggaagccagaacaggcucccuccccuucccugccucugcc

SEQ ID NO: 4163282 - RNA, 74 nt, Human
ggcagggcuauggaggaggaggcugagaagcugccuauuuugcaggcaauagcuuuuacuccuccgaggagguc

SEQ ID NO: 4163283 - RNA, 58 nt, Human
ggcagggcugagucaggugcuggggguauuugcgcccagagaucuacugagcccagcc

SEQ ID NO: 4163284 - RNA, 76 nt, Human
ggcagggucgaggagcucccgugaggagaccaaucgccuagcgugagucuucuuccgggauugcucgcccucugcc

SEQ ID NO: 4163285 - RNA, 90 nt, Human
ggcagggugggguacuugggacuccugguaccuuugccagggcaaaugaugcccaggaaccaggagagucccugaacccaagcccaggcc

SEQ ID NO: 4163286 - RNA, 58 nt, Human
ggcagguagcagcaccaugagcacgaccugcgcagcucaugucccguugcuggcugcc

SEQ ID NO: 4163287 - RNA, 55 nt, Human
ggcaggucagguccaugaccaacacguuggcaguggggauauggaaggccaugcc

SEQ ID NO: 4163288 - RNA, 60 nt, Human
ggcaggucaguuuuaggaaagagcaccuaugggugucaugggucuaaacauugauaagcu

SEQ ID NO: 4163289 - RNA, 88 nt, Human
ggcaggucgcugcaucucugugagccucaguuuccucaucugugauauggggugagcaguaacagcucacaggguuguggcgacgguu

SEQ ID NO: 4163290 - RNA, 78 nt, Human
ggcaggucucagcagugugcuuggaauggaacaagauguuuagccucuaucuucaaucuguaguagcugagaacugcc

SEQ ID NO: 4163291 - RNA, 66 nt, Human
ggcaggugaagaggauaaaaaguugggaaaaacuggacucaaccauguuauuuauuaucacguguc

SEQ ID NO: 4163292 - RNA, 58 nt, Human
ggcaggugccaguuggcuugggggcuugaaagccauaaaaaggagccagggcuuuguc

SEQ ID NO: 4163293 - RNA, 55 nt, Human
ggcaggugcgcauguugcauuagugucauaagguggcaugagacuguaccaggcc

SEQ ID NO: 4163294 - RNA, 112 nt, Human
ggcagguggauccgucugcaggcaggaaagagcugaugcauuucaaccgcauccuguguaaugaaggccagcucuuuaucagccugccuggcccuggauuuuuaucucugcc

SEQ ID NO: 4163295 - RNA, 80 nt, Human
ggcagguucacagcccagucauuccuaaccaagaacaucagcaccugacuggagggugggaaugagguuccugaccugcu

SEQ ID NO: 4163296 - RNA, 76 nt, Human
ggcagguugguguccugguuacaaggacuuugggaucagauagauccaggcuugagaccaggcucuggcaguugcc

SEQ ID NO: 4163297 - RNA, 68 nt, Human
ggcaguacccuggcacugaguggcuuaugaccucugcuggcauccuguccucgggggccgaugcugcc

SEQ ID NO: 4163298 - RNA, 87 nt, Human
ggcaguaggcagcugcaaacauccgacugaaagcccaucuguggcuucacagcuuccagucgaggauguuuacagucgcucacuguc

SEQ ID NO: 4163299 - RNA, 67 nt, Human
ggcaguaggggcaguguucugguugucaggacuucagagucccagccuggacccugccagugacucc

SEQ ID NO: 4163300 - RNA, 58 nt, Human
ggcaguaguccauuaaauuagauucaauuaaaguugauuugauugaugaacuaagguc

SEQ ID NO: 4163301 - RNA, 108 nt, Human
ggcagucaucuuggccagcccucaauuuuagguauaaggacugcaccugagacugaaggaggcugauauaccuuacaccuaaaaugagaguuggccaacaugacugcu

SEQ ID NO: 4163302 - RNA, 86 nt, Human
ggcagucugcuccuuggcucugcauguuugccucuccuuaggaaagacucaagugggaauagaaaugaaggucugggguuguugcu

SEQ ID NO: 4163303 - RNA, 89 nt, Human
ggcagucuugggucccacaguucagaagagucuacggcuucuggcggcuaugggagcagcuguucugacuugucuacccauauucugcc

SEQ ID NO: 4163304 - RNA, 72 nt, Human
ggcagugagcugagaugcuuuuaggaaaggcugcuagauugugguuucuugauuagucucaugccaacuguu

SEQ ID NO: 4163305 - RNA, 84 nt, Human
ggcagugagucuucacauaggcaguguucaaguuguggucuuaacucuuagaaugugaacuuugucauguaaccacucuaggcc

SEQ ID NO: 4163306 - RNA, 68 nt, Human
ggcagugcaguugguggcagggguuggggagguccaggaaucaacucccucuaccaauuucacaugcc

SEQ ID NO: 4163307 - RNA, 62 nt, Human
ggcagugccacuaagcucugcugugaccucgagguuaccucugaaguuuaugagccacugcc

SEQ ID NO: 4163308 - RNA, 115 nt, Human
ggcagugcggccagcucccgcaggcagcccggguucccgugaauguaggacaguagugugucuggcccccacaggcgggcucggguuccugugccaugcucaccacuugucugcc

SEQ ID NO: 4163309 - RNA, 74 nt, Human
ggcaguggaggcucagggccggagggcauuugccugagaccauggggcaggccaggcccugggcacuucguguu

SEQ ID NO: 4163310 - RNA, 71 nt, Human
ggcaguggcuguagucucuuggaauaugcuaccccaucuaccaguuccuugacaaggacacagucccugcu

SEQ ID NO: 4163311 - RNA, 63 nt, Human
ggcagugguuagaaacaugagcuccagaaucagaaaaaccuguguucagauucugauucugcc

SEQ ID NO: 4163312 - RNA, 64 nt, Human
ggcaguguccuuggggucauccauuauccauguguuggaggagugggacccuagggaagaugcu

SEQ ID NO: 4163313 - RNA, 61 nt, Human
ggcaguguugagccagcugggggcuggacccugcugucuguucugagcacucaucacuguc

SEQ ID NO: 4163314 - RNA, 65 nt, Human
ggcaguucuggaugcauugucacuugguguccauccauguuuucacuagcauccaguaacaugcc

SEQ ID NO: 4163315 - RNA, 122 nt, Human
ggagugcaguggugugaucauagcucacuguagccucaacucuuggacucaagugaucuuccugccucaaccucccaaguaguugagacuacaggugugugcugucucacccagcuaauuuu

SEQ ID NO: 4163316 - RNA, 70 nt, Human
ggagugccaggccaggcugcauuugccccucgcaguaaacccuggggugaaaccagccagccugugcucc

SEQ ID NO: 4163317 - RNA, 74 nt, Human
ggaguggauauuuaaaaaaauuaucuaguuauaauggaauuucacuguauaauuuuuguuugauguccaauuuc

SEQ ID NO: 4163318 - RNA, 84 nt, Human
ggaguggcuaaaguaugucauggccuaguaagucuuucacauuuuccccuuucugccuuaauccauggcauaauuuuccucucc

SEQ ID NO: 4163319 - RNA, 61 nt, Human
ggaguggcuguuucugcccccauuucucaaccaucccuguggaggguccugagccaccucc

SEQ ID NO: 4163320 - RNA, 60 nt, Human
ggaguggggagcgaggcucagcccuguccucuggacagccuggacuggcucucugcaucu

SEQ ID NO: 4163321 - RNA, 103 nt, Human
ggagugggguagguaguggcaggucacgagccuagaggagaugguuuggggccauuuggggcuuuggucuucuagcugugagccaacaggacccacacccucc

SEQ ID NO: 4163322 - RNA, 58 nt, Human
ggagugggugccaagcgggugcaacaggcuccuggcugcucuucuuggcgaccucuuc

SEQ ID NO: 4163323 - RNA, 83 nt, Human
ggaguggugcugguggcuuugcaguuagccuaggauugagcaauugcugcaauuguugcucucugcaucuucgguguuacuuc

SEQ ID NO: 4163324 - RNA, 64 nt, Human
ggaguguaaaguuguagaucccugugggaggcaccagucccuggagggauuucucaaucacuuc

SEQ ID NO: 4163325 - RNA, 62 nt, Human
ggaguguuguuaugucauauuguaauucguaggaaaauuauagaagauuauugcaacagucc

SEQ ID NO: 4163326 - RNA, 104 nt, Human
ggaguguuugugagagcacuguguguugcugugcgcgugcagcggaguguuugugagugcagccuguguugcugugcgcauguugugguuguuuucuucauucc

SEQ ID NO: 4163327 - RNA, 64 nt, Human
ggaguuaaaaccuuaaauuucucugugaucugugauuaggcaaagaaagccaaggucuaacucu

SEQ ID NO: 4163328 - RNA, 65 nt, Human
ggaguuaacaugguccugaaugccuucauagucccauacccugggaggaggcaucuuaggcuuuc

SEQ ID NO: 4163329 - RNA, 63 nt, Human
ggaguuaaggguauucucuccgguaggcccaaaucuacaaagguugaggugcccuggugaccc

SEQ ID NO: 4163330 - RNA, 98 nt, Human
ggaguuaccguugugguuauagguuggugggaagcaauguaaauuauuuuauuacaaugucucucaccugacuucucuuuggcuaacucaguggcucu

SEQ ID NO: 4163331 - RNA, 85 nt, Human
ggaguuauaaaugaaauuuagcaagcaggcaaauucacaaaugcaaaauuuguaaauaaugagguuugacuguauuucugauuuc

SEQ ID NO: 4163332 - RNA, 59 nt, Human
gggaaggagcacaggacuuugauuaucauaagaugugaaaauacuacugucuucuuccc

SEQ ID NO: 4163333 - RNA, 73 nt, Human
gggaaggaugacaggcagugguccagguaaacaaaggugggagucugagcuacgaugccugucaccccuucuc

SEQ ID NO: 4163334 - RNA, 60 nt, Human
gggaaggcagcuucaccacagcauugccuuaggacaggcucugaguagagcugccagccc

SEQ ID NO: 4163335 - RNA, 64 nt, Human
gggaaggcuggucuauacggagacgagacugacaucagucauugcuccaacaagaugcuuucuu

SEQ ID NO: 4163336 - RNA, 86 nt, Human
gggaaggcugugacuucagcucugaacucgagggcgucguuagaacccugaguggccaggcagcugugggaaguuggggccuugcc

SEQ ID NO: 4163337 - RNA, 67 nt, Human
gggaaggcuuuagagagauauaaauuuaucuccuuuauuuaguuuaucuccuuuacuuagccuuuuc

SEQ ID NO: 4163338 - RNA, 77 nt, Human
gggaaggggcgucuguaggcagugggugaggaggcugucucugucccagcuggacccugacagaucucucuuuuccc

SEQ ID NO: 4163339 - RNA, 68 nt, Human
gggaagggggggcgccugagauuugccagccccucgggcccucaggucucugcagccccucugugccc

SEQ ID NO: 4163340 - RNA, 61 nt, Human
gggaagggugcauggagggaaguccagaggaaacuaggcacacgcuuuggugucucucccc

SEQ ID NO: 4163341 - RNA, 55 nt, Human
gggaagguagguaagauggggcaauuugauaaauucugacuugaucuauucuccc

SEQ ID NO: 4163342 - RNA, 74 nt, Human
gggaaguccagugucaaggugccauuagguuuggugauucugauuccaggauggcaccuugaacgcugcguccu

SEQ ID NO: 4163343 - RNA, 100 nt, Human
gggaaguggcauguugucuugucuugacauuucagauaugguauuuuuccagcuuuacugaugaaaaacccugaaguucaauuaaguucauucgcuuccc

SEQ ID NO: 4163344 - RNA, 56 nt, Human
gggaauaggggaaaggaggaguuauuuacauguguagcaccuucaauucuauuguc

SEQ ID NO: 4163345 - RNA, 98 nt, Human
gggaauaugaucuuauuuggaaauagggucuuugcagauguaaucaaguuaagaugaggucauuaguguggacccuaauuuaauaagacuaguguccu

SEQ ID NO: 4163346 - RNA, 75 nt, Human
gggaauauuaguguagguagcuaauauuaguguagguaauauuagguaggaauauuaguauagguagcuuguccc

SEQ ID NO: 4163347 - RNA, 78 nt, Human
gggaaucuuuuaauuauacucaucgaaauuagcagugccucuggccggggcagcaugaugagugcaguuuggaguccu

SEQ ID NO: 4163348 - RNA, 99 nt, Human
gggaauggaauggggucaggaagccacaggacagguagagaaucaaaacguguuggcuguuuuugugcugugucucccugucaugccuugcuccagccc

SEQ ID NO: 4163349 - RNA, 63 nt, Human
gggaauggccaguuagaaaucaaaaagucccauaaauggucuuucaguuaaguggcuaguccc

SEQ ID NO: 4163350 - RNA, 62 nt, Human
gggaaugggaaagaggcagccuuuauuuccugagguucagcaggcugccuccuuccuuuccu

SEQ ID NO: 4163351 - RNA, 79 nt, Human
gggaauguugcagagguaauaaaauugugucaaacaucuucuaaaguguuuauaaauuuucuugccaugcuuuauucuu

SEQ ID NO: 4163352 - RNA, 59 nt, Human
gggaauuauagcugucacaggcucagcaguaaugucuuaggcuuaauaauguaauuccc

SEQ ID NO: 4163353 - RNA, 86 nt, Human
gggacaaaauaagguaauauuugaaaacuguuuagcagcgucccacuucgcuaaugaauuuaaaauaaauguaguuuguuguaccc

SEQ ID NO: 4163354 - RNA, 87 nt, Human
gggacaaaggaucagagguugggagagcuuguuacacauuuuauaaacagaugauucaaacguuugguuuuuugaaaauuacuuccc

SEQ ID NO: 4163355 - RNA, 60 nt, Human
gggacaaaugauuaucacagaggaguacauguguguucucucugugucauuauggacacc

SEQ ID NO: 4163356 - RNA, 100 nt, Human
gggacacucaugaacuuuuucccaggugauauguuccucaaacugcugcaacugcagaaugcugagagcuguccaccugugggaauggucagagggucuu

SEQ ID NO: 4163357 - RNA, 68 nt, Human
gggacacucuuuuuguauagaaaugaacuaaugugcacuaacuugguggaaaugggauaagagguccu

SEQ ID NO: 4163358 - RNA, 64 nt, Human
gggacagagcagcacccagccccucacaggaugauggagugaggaggagguugcucucuguucu

SEQ ID NO: 4163359 - RNA, 56 nt, Human
gggacagcuguagugcuuggcuugaguuccccuccgcauggagcacagagcugccc

SEQ ID NO: 4163360 - RNA, 92 nt, Human
gggacagcuuagcgcuggcugcaaaggauuguggcucaggguuggaagaugcacggacuugguuacauauccuuuggagccucaguuuucuc

SEQ ID NO: 4163361 - RNA, 110 nt, Human
gggacaggggacacugagaaaagauuuuguugaacugagggacaccugacagccacuuaaguggcucagugcauucacaguaaaaacuauuuugccuucuccccauaccc

SEQ ID NO: 4163362 - RNA, 76 nt, Human
gggacauguccucagaagccugcuuagcuucuuagccacuagcaagaaggcagacuuaccuucuggggagaugccu

SEQ ID NO: 4163363 - RNA, 122 nt, Human
gggacauucuuccacaaagacuuagcuuuuuccuccguucauaccucugcucccauuacccacuucccuuaugacauggcaugauaggaggugcagaauggaaagagcugauggagauuccc

SEQ ID NO: 4163364 - RNA, 125 nt, Human
gggaccaagguuuacgcccccaagcugauccgucccuggcugggggcugccuugggugagguggcuacucuguucuaccaaggcaguuccccagagggcugacagcucugugaccuugaaguccu

SEQ ID NO: 4163365 - RNA, 65 nt, Human
gggaccagaagaaggauggugaaauucccaggauuauacaagcucacuuuccucucuuugggccc

SEQ ID NO: 4163366 - RNA, 57 nt, Human
gggaccagcuggugaaaaccaauuguuaaauagacaggaauuuuacaagcugguugc

SEQ ID NO: 4163367 - RNA, 74 nt, Human
gggaccccagggcugccagccuccuaagggacagagacauugggaucggcccuggugagcccuggguagguccu

SEQ ID NO: 4163368 - RNA, 125 nt, Human
gggacccuggacuuucgaagggcgggcagagccgggaggcagcgagaggaaagucccacucggcuccuuccugugugggccccuugguuuccugagccacugucauuuaccgaaagucagggccc

SEQ ID NO: 4163369 - RNA, 60 nt, Human
gggacccugggcucugggccuauccagcaaggauggccuaaaaugcagacccuggguccu

SEQ ID NO: 4163370 - RNA, 102 nt, Human
gggaccgugcacccguggcuaucagagccccuccgcugucccacccugggccugggacacgggccuggggcagugugugucugcuggucaugugcuggugcc

SEQ ID NO: 4163371 - RNA, 63 nt, Human
gggaccuagggcuuucuggaauacaguuugaaaaucaguguguccugugaucucuaggguucc

SEQ ID NO: 4163372 - RNA, 58 nt, Human
gggaccuggcgagggucacacagccuuucugugauagggcguugaucucccagcuucc

SEQ ID NO: 4163373 - RNA, 70 nt, Human
gggaccuugcagaugugacuaaauuaaugaucuagagaugaggagauuauuuuagguuauccaggggccc

SEQ ID NO: 4163374 - RNA, 56 nt, Human
gggaccuugccugcucaagccuccauugcccuggcccgagcauggcacaggcuccc

SEQ ID NO: 4163375 - RNA, 79 nt, Human
gggacgagagagacauaggaguuuuuauucugguaauuuauguuuaacagaagcauugacuccuugcucuucuucuucc

SEQ ID NO: 4163376 - RNA, 120 nt, Human
gggacgcagcaccaagaucccauuuuagagucuguuccuaggauccuuccuggcaccaacugucacagguuggguucccaggaaaacacucgaggacggagauuugugugcaggcuucuc

SEQ ID NO: 4163377 - RNA, 63 nt, Human
gggacgggcaguccaaggggucuaggaacugguaucguuaauaaccuccagaguguuuguucc

SEQ ID NO: 4163378 - RNA, 75 nt, Human
gggacggggcugcgcucuuccugccgcuucggccggaggcuucauugugcagugggaagaaugcagccuccuccc

SEQ ID NO: 4163379 - RNA, 72 nt, Human
gggacggucacgagcagagcucccaaggggaccgcuggggacugggcgggggcucugcuucucaccuguucc

SEQ ID NO: 4163380 - RNA, 88 nt, Human
gggacuacaggugcgugccaccaugucuggcugaguuuuguauuuuuugauagagacgggguuucgacauguuggccaggcugguccc

SEQ ID NO: 4163381 - RNA, 97 nt, Human
gggacuaggcuaaggcaaacaaagcacaggaucuugaggagcgagugccuucuuaaauuuuguaccuuaggugccuugcuugccucacacuagugcu

SEQ ID NO: 4163382 - RNA, 90 nt, Human
gggacuagguaagccaugacaucugcacugcuuucugagucauugucgugaaaugauacaugcuuggguguagugcggcuacuugguucc

SEQ ID NO: 4163383 - RNA, 63 nt, Human
gggacucagggcuggguucucugcaaaccuguccacagggaggccacaguccugaggcauccc

SEQ ID NO: 4163384 - RNA, 98 nt, Human
gggacuccaugggccucugugccuuaaugccaguucucugcgauaauguccugguuauuccuaauacuuguuuuggggaccagggguccugagagccu

SEQ ID NO: 4163385 - RNA, 80 nt, Human
gggacuccuucauuugcauuuggauaauugugcaguuauaugauuuguuacauggagaccagauggaaguaagagagcuc

SEQ ID NO: 4163386 - RNA, 68 nt, Human
gggacucugagggucucucucggcuccacgcgcccacucaagugucgcggcagaaagagucggagccc

SEQ ID NO: 4163387 - RNA, 100 nt, Human
gggacugaaauacagcaggagagaagcagaacugggaaguagugggucugauaugccccagugcuaagguagccucugcugcucugcuggcuucagucuc

SEQ ID NO: 4163388 - RNA, 57 nt, Human
ggcgagggaaguuuacugugaguugggcuugucuuucucuagguaagguucucagcc

SEQ ID NO: 4163389 - RNA, 58 nt, Human
ggcgagguguccucagccaacucugcuacaccugaagcuugucccugaggucgcugcc

SEQ ID NO: 4163390 - RNA, 56 nt, Human
ggcgaggugucugccaucaagcuggcuucugcccugaauggcagcagcagcucucc

SEQ ID NO: 4163391 - RNA, 130 nt, Human
ggcgaucucagccuccagcuugaccuugauguuuggcagggccugguacuccugggccuggcccugucccucugcccaggucugugccagcucugacuccaggugcagcaggaucccauugaguuguucc

SEQ ID NO: 4163392 - RNA, 56 nt, Human
ggcgcaagcggggguugugagcguuggucaaacaugcuggcucaaaugcuuguguc

SEQ ID NO: 4163393 - RNA, 59 nt, Human
ggcgcaaggugcagucggagaaggccaaccugaugauccucuuugacaaguaccugccc

SEQ ID NO: 4163394 - RNA, 56 nt, Human
ggcgcaggccccccuggagggccccgcucagggccucucgccagcggggcugcgcu

SEQ ID NO: 4163395 - RNA, 57 nt, Human
ggcucuugcccgcccaggcuggcacaguugccauccagggugccugggcggagagcc

SEQ ID NO: 4163396 - RNA, 99 nt, Human
ggcucuugcuccauccccacugccccuggugauggacgccaugggaaauggugagcaaggcagggagguggagggagguggggaggaggagggggagcu

SEQ ID NO: 4163397 - RNA, 73 nt, Human
ggcucuuggucugccugaaggggccuggggcuauuuguacuccaccccagguccuggcagcugacucagggcu

SEQ ID NO: 4163398 - RNA, 60 nt, Human
ggcucuuuagaguugaguuucuaugagaacugaguuccuguuccaucucucaacuuugcc

SEQ ID NO: 4163399 - RNA, 73 nt, Human
ggcucuuuuagguguuuugcucaggauuugagacacguuuucucucccucagaggagcaccuguugaagaauc

SEQ ID NO: 4163400 - RNA, 61 nt, Human
ggcugaaacagauuucaagacacugcaaugucagugacuugaaaagaaucuguuucuugcc

SEQ ID NO: 4163401 - RNA, 58 nt, Human
ggcugaagcgauccucccaucucaaccucccacguggcugagacuacaggcgcuugcc

SEQ ID NO: 4163402 - RNA, 100 nt, Human
ggcugaaggauacugagggaaucauaugccuacagagcagcaggaccagaguuuguauccagaucuguccagcucuggggcucaccucuuccuguuagcc

SEQ ID NO: 4163403 - RNA, 67 nt, Human
ggcugaagggaggcggccagugcggggcccugggacucugcgccacccucgccugcucgcaccagcc

SEQ ID NO: 4163404 - RNA, 70 nt, Human
ggcugacauuuggugcugugugucuugguccugacugacaaaggcagcacagcaacugcucaugucagcc

SEQ ID NO: 4163405 - RNA, 93 nt, Human
ggcugacccucugugggccuggcugggcugccggggccacccuggcggugaccaccccuggcagcgccgaagcuggccccaugugggaaagcc

SEQ ID NO: 4163406 - RNA, 115 nt, Human
ggcugagagaagugugccuuccagaagugcuccuuucauugcugcccaaauccaaaccucuucuuugagaagggaagggcacaagaaaggagguaccugaacccuucucugaguc

SEQ ID NO: 4163407 - RNA, 77 nt, Human
ggcugagaguauuuguaccugugaauuccucagcaggauuuauuccuugagcuguaggaaugacauguaccuuaguu

SEQ ID NO: 4163408 - RNA, 69 nt, Human
ggcugagagugagcacuggauauaauucauuuugauugaaauugauaugguguuauuguucuuccaguu

SEQ ID NO: 4163409 - RNA, 57 nt, Human
ggcugagcacuuuaggcaggagcccauucuggcugggauuccugccugcgggcuccc

SEQ ID NO: 4163410 - RNA, 77 nt, Human
ggcugagcagcucuggcuauugaggaccacccugaggaauaagggugguccucacccuacccagcugcuccucaccc

SEQ ID NO: 4163411 - RNA, 96 nt, Human
ggcugaggcagacggauuaccugaggucaggaguucgagaccaaccuggccgacauggugaaacgcugucucuacuaaaaauauaaaaaauuagcc

SEQ ID NO: 4163412 - RNA, 76 nt, Human
ggcugaggcagguggaucaccgaaggucaggaguuuaagaccagccugaccaacguggugaaaccccgucucuacu

SEQ ID NO: 4163413 - RNA, 70 nt, Human
ggcugaguccccuucaucuggaugucugguuagaagaacucucauccagaguccaaggcugggcucuccc

SEQ ID NO: 4163414 - RNA, 72 nt, Human
ggcugauacaggaguauuuaaucagaaaauuguccuagauuuucacagguacaaacacuccugauguucgcu

SEQ ID NO: 4163415 - RNA, 82 nt, Human
ggcugauagauuucagguuuugucucugucuacaugaucucaccaugauagaaaaugaagacgagauaaaauggugucagcc

SEQ ID NO: 4163416 - RNA, 69 nt, Human
ggcugaugacuggagaccucaguagggucuccaugacaaagacucucucugauggaacuuuagccagcc

SEQ ID NO: 4163417 - RNA, 78 nt, Human
ggcugaugcagcacaacuuucuuucacagaaguaucuugcagaauacaguaugagauacagaaaggcugcauugaguc

SEQ ID NO: 4163418 - RNA, 77 nt, Human
ggcugaugcuggacacaugcuggaugaauuaccuacacauggcucuuuuguguucacauggcauuuucacaucgguu

SEQ ID NO: 4163419 - RNA, 72 nt, Human
ggcugauuggcauuccauuguauguguagacuauauuuaucuaucuuuucauucaacaauggacaguuggcc

SEQ ID NO: 4163420 - RNA, 63 nt, Human
ggcugcagagggguugaaggguccaggcacuagcugggcucuuuuaccucuccucugagggcc

SEQ ID NO: 4163421 - RNA, 55 nt, Human
ggcugcagcagagggacucacgggggugugcagguucugaggccucugcugggcc

SEQ ID NO: 4163422 - RNA, 75 nt, Human
ggcugcaggagggcuggggaagccagacucaguccccuagaccugggagcugggcuccuugcccauccagcagcc

SEQ ID NO: 4163423 - RNA, 74 nt, Human
ggcugcagguugguuggcagcuagagagacucccccaucuuccccgucauauuuuugccagcuaagcugcagcu

SEQ ID NO: 4163424 - RNA, 86 nt, Human
ggcugcauuacaguuugaguccauuauaguuauugcaaguuaaauuguuuauaguaagugauuuguaguauacuaugacuucagcc

SEQ ID NO: 4163425 - RNA, 57 nt, Human
ggcugcauugcuauaaaauacaauccauuccuuuuuguuaacaauagcaauguaguu

SEQ ID NO: 4163426 - RNA, 65 nt, Human
ggcugcccuaugcggugggagcuggggugcccagagccucaaugcccaccccauaaggcagaacc

SEQ ID NO: 4163427 - RNA, 61 nt, Human
ggcugcccucgucuacugcccaugcuguccucacagaccuuucagagaagagguguuaguc

SEQ ID NO: 4163428 - RNA, 63 nt, Human
ggcugccgagugguggguauugccuuauagcugcucugcccugcaaggccuaucauggcagcu

SEQ ID NO: 4163429 - RNA, 71 nt, Human
ggcugccgccccaccugcuaccuuccagcagccguccugggcgcugucccaggcaggcugggguggcagcu

SEQ ID NO: 4163430 - RNA, 94 nt, Human
ggcugccgggggcccaccgccgcccaggcaaggccgcccugccuugggcgcagcgcugccauggcugggggccguggggcccccgggcgcggcc

SEQ ID NO: 4163431 - RNA, 63 nt, Human
ggcugccuacuuucccagaguuuguaccaugucuuuugagaauggucuguggagagggcaguu

SEQ ID NO: 4163432 - RNA, 55 nt, Human
ggcugccuccacugcuugucccagagaauacagaggcguuggcaguuuggcggcc

SEQ ID NO: 4163433 - RNA, 64 nt, Human
ggcugccuggaaacagugagcgaaggaaaugaggcuucuaccucccugcuguuuccauggggcc

SEQ ID NO: 4163434 - RNA, 57 nt, Human
ggcugccuggaccuccucuuucagguuaacgcugacagaauggaggcucaggcuguc

SEQ ID NO: 4163435 - RNA, 81 nt, Human
ggcugccuguguggggacugaagcugggcgcuggcugcugcgcgagaugagggggccagguccagcuuccaaagggcagcu

SEQ ID NO: 4163436 - RNA, 56 nt, Human
ggcugccuucagacuccagcuucagccucaucucuucccugggucuccaggcugcc

SEQ ID NO: 4163437 - RNA, 59 nt, Human
ggcugcucaaggacucugaucgcuagauccuuuuuccagcuucaugucucugggcagcu

SEQ ID NO: 4163438 - RNA, 66 nt, Human
ggcugcucggagagagugugacgguggauuccauaaauuaacugaaaaucccucuucuccggagcc

SEQ ID NO: 4163439 - RNA, 70 nt, Human
ggcugcucugccuuccagcugggaggaggccauuguaugggugcuggggacagagggaaggggagcagcc

SEQ ID NO: 4163440 - RNA, 86 nt, Human
ggcugcugacacaguaaccccaggacugggacccuuuaucaguuugggugcuucagcuuucuuggugucaccauguuucagcugcc

SEQ ID NO: 4163441 - RNA, 79 nt, Human
ggcugcugggcaccacccaagggagaccugucccugagccagcccugcagcccucccugggugugucugcccugcagcu

SEQ ID NO: 4163442 - RNA, 73 nt, Human
ggcugcuuuauggcacacaaauaucaaaaugaguuuuauacauuugaauuagugauuccaugcaaaugcaguc

SEQ ID NO: 4163443 - RNA, 83 nt, Human
ggcugcuuuucugguuacaguggcagaguuggguaguugcaacaaaguauuuacucucuggcccuuuagaggaaaagcuggcc

SEQ ID NO: 4163444 - RNA, 87 nt, Human
ggcuggaacuguucugguggguccagagguuaucagcccaggacuugacccucucuggcugagucugugacccaugcguuuccagcu

SEQ ID NO: 4163445 - RNA, 57 nt, Human
ggcuggaagagacugaggacacuggccagguugucaagaucugagucuuguuccacc

SEQ ID NO: 4163446 - RNA, 78 nt, Human
ggcuggacauggggacugaugggccggguguguucauggcgcccuuguggcacugccaucaggccuccguguccagcc

SEQ ID NO: 4163447 - RNA, 63 nt, Human
ggcuggagucagcaaggacgaggccuaggacagggagcccagccuccgccuuccugucucccc

SEQ ID NO: 4163448 - RNA, 83 nt, Human
ggcuggagugcagugaguuaugaucaugccacugcagugcaguggugccaucauagcucacugcagccucaaacuccuaagcu

SEQ ID NO: 4163449 - RNA, 105 nt, Human
ggcuggagugcgguggugcgaucacgguucaccgaagccuccaccucccaggcucagcaauccucccacaggugggcccacaggugugcaccaccacagccagcu

SEQ ID NO: 4163450 - RNA, 62 nt, Human
ggcuggagugcugaggugcaguggugcaaucauagcucacggcagccucaaacuccugagcc

SEQ ID NO: 4163451 - RNA, 70 nt, Human
ggcuggcaauggaggcagcaccccagcagcuuauuaucugauugagguaguggccuccaaaugaauggcu

SEQ ID NO: 4163452 - RNA, 79 nt, Human
ggcuggcacaaaggcauaggauguggaaucggcaggcucugcuacucguccacaggcugugugaccuuggauggugguc

SEQ ID NO: 4163453 - RNA, 78 nt, Human
ggcuggcaccuuccugggaugaaagcagcccacugugcugcaugugcucugaaaaucucagaagaaaguaugccagcc

SEQ ID NO: 4163454 - RNA, 73 nt, Human
ggcuggccaggcugggcacaugauugcaggagccuguguccugcagcaaauggggcccguccuggcagcagcc

SEQ ID NO: 4163455 - RNA, 60 nt, Human
ggcuggcuacauuggaggaaggaaaacuggucgcaucccuagcccugcaugugcacagcc

SEQ ID NO: 4163456 - RNA, 65 nt, Human
ggcuggcuaucugugguugccugccaaucuucugcagccagucaguccccagaucccugccagcc

SEQ ID NO: 4163457 - RNA, 75 nt, Human
ggcuggcucagagaaggcugaggaucccuguguucucccugaacagggguacagggccccucagcagggccagcu

SEQ ID NO: 4163458 - RNA, 58 nt, Human
ggcuggcucagggcuugagagaaucuagcaaaaugauucuaugacucgucagucagcc

SEQ ID NO: 4163459 - RNA, 64 nt, Human
ggcuggcucauuuuagcaucagguuucauuucuaaugucaccucugccaagaugugcucccgcc

SEQ ID NO: 4163460 - RNA, 56 nt, Human
ggcuggcugcuaggacagcuacagagagaagggcucuguuggccuugcaggcagcu

SEQ ID NO: 4163461 - RNA, 96 nt, Human
ggcuggcuguggagcugagcaggcuccaggcuggccaucuggaacaccugcagcuggcccagcguggggccgugcgccaguccaaacggcccagcu

SEQ ID NO: 4163462 - RNA, 63 nt, Human
ggcuggcuuugcacugggugcauggucacagggaauugacacagucuagugggguagccagcc

SEQ ID NO: 4163463 - RNA, 63 nt, Human
ggcugggaaugggccuagaaggcuggcuuugcagccagaagcccgcuuccuaacuucccagcc

SEQ ID NO: 4163464 - RNA, 63 nt, Human
ggcugggacgaugaggauuaguuuaacgagguuuguuugcacagaguuccguuggccccagcu

SEQ ID NO: 4163465 - RNA, 88 nt, Human
ggcuggucuggaacuccugaccucgugauccacccaccucggccuccugaagugcugggauuacaggcaugagccaccacacccagcc

SEQ ID NO: 4163466 - RNA, 66 nt, Human
ggcugguuccuccaucagcaggaagucuaaaaaggcaaguucaauucugaugaaggcaauacaccc

SEQ ID NO: 4163467 - RNA, 66 nt, Human
ggcugguucguugagucuuucaucguugagugauaccaccucugcagauggcucaguggggcagcc

SEQ ID NO: 4163468 - RNA, 74 nt, Human
ggcuguaacacacagaaggaagccccacuuaaucaaaaguaacugggccaacuccuccugcccaaccccaugcc

SEQ ID NO: 4163469 - RNA, 83 nt, Human
ggcuguaauguauuuguucagaagaguuagcccaaaaacuccuaaguagauucuuuagccagcagguauauauccaaucaguc

SEQ ID NO: 4163470 - RNA, 102 nt, Human
ggcuguaauucaauagaaaauuucugauaaacguaagcugcaagaaucuaguucuagccaggguacauuuugucagagccuccugugaauugaauuacagcu

SEQ ID NO: 4163471 - RNA, 83 nt, Human
ggcuguaggaagacugugcagagcugagacccaaaaucuggccuccugauuccugauucaugcucuuuguacuuccuugagcc

SEQ ID NO: 4163472 - RNA, 79 nt, Human
ggcugucaccucuuucagcuauaacauugagacuuuccccauaggaaagcuuuugauuuuuaguuugauggaacaugcc

SEQ ID NO: 4163473 - RNA, 82 nt, Human
ggcuguccaugcgaauguaacaggugaagcucugagaguacauaacccuccagugcaaugauacauucucauauguguagcc

SEQ ID NO: 4163474 - RNA, 82 nt, Human
ggcugucgggguuaugaggggaguggggcuguggccaggacagggcggccccgugccuggcucucugcagauccuggcagcc

SEQ ID NO: 4163475 - RNA, 97 nt, Human
ggcugucuagaagagucaguuguugcaccacuagugucuguuuuauuucuacauggguguuaugggcgaugcaaaccugauuuucuucgaaucggcc

SEQ ID NO: 4163476 - RNA, 78 nt, Human
ggcugucucaugugucuaucaugugggucaucuggaggcuuggccauccaggcuggccucgcgugacauguggcaguu

SEQ ID NO: 4163477 - RNA, 73 nt, Human
ggcugucugcccagcuucaggagauacaguccagccuccuuggugacugugugaggcugggugagucacugcc

SEQ ID NO: 4163478 - RNA, 55 nt, Human
ggcugucugugguggagcguugugcacccucaggaugauaccaucacuggcaguc

SEQ ID NO: 4163479 - RNA, 59 nt, Human
ggcugucuugaucauuuacaggccaauugugaagccacugaugaaaucacugggcagcc

SEQ ID NO: 4163480 - RNA, 62 nt, Human
ggcugugaacacucuuagcauccauucaaagauaggaagaggugcagggauucuucacagcc

SEQ ID NO: 4163481 - RNA, 56 nt, Human
ggcugugaggaaugaauuugaugguguucaaauaugaccaauuucauccuuaagcc

SEQ ID NO: 4163482 - RNA, 71 nt, Human
ggcugugagugucuauuaacacgugcacuuuugcuucacaaauggaggaaaaaccuguuaaugguagagcc

SEQ ID NO: 4163483 - RNA, 70 nt, Human
ggcugugcagaggugagaauccaaccucccacccugggucugcggucucuuugguucuccuuccacaguc

SEQ ID NO: 4163484 - RNA, 56 nt, Human
ggcugugccaccagugcuuuugaaauauaucucacaaagcagcccauggcacaguc

SEQ ID NO: 4163485 - RNA, 58 nt, Human
ggcugugccucuucugccacuggacuuuuuguucagcuaggaauggagaugcuuagcc

SEQ ID NO: 4163486 - RNA, 59 nt, Human
ggcuguggaguacagagcugguucagaugaaugaauagcuuucucaugacuucaccccc

SEQ ID NO: 4163487 - RNA, 69 nt, Human
ggcuguggggccggguacagugacagaccugagaccccaucagcgcugacaccauaggccccaagagcc

SEQ ID NO: 4163488 - RNA, 59 nt, Human
ggcuguggucugggugcuccccauccacuaucuaaagugcagcccccagacagcaggcc

SEQ ID NO: 4163489 - RNA, 68 nt, Human
ggcugugguggcucaugccuguaauuccagcacuuugggaggcugaggcaggcagaucacuugaggcc

SEQ ID NO: 4163490 - RNA, 69 nt, Human
ggcuguguaauacuccauuguauggauggaccauauuuuguuuauccuuucaucugguaauauauagcu

SEQ ID NO: 4163491 - RNA, 63 nt, Human
ggcuguguccuguaugauuauuuauggaaagagagucagacaaucaggccgaggacaucagcc

SEQ ID NO: 4163492 - RNA, 80 nt, Human
ggcugugugguccagcccugguggagaggggcggagcggccacugcuccaaccaccgccgccaccgccacacucgcagcc

SEQ ID NO: 4163493 - RNA, 55 nt, Human
ggcuguguuccaagugucaggaucaaguggauccaaugaccuauucagcaaagcc

SEQ ID NO: 4163494 - RNA, 74 nt, Human
ggcuguuccuucugccuggauuccauucuccagccccuucuguuggcagcuguguccagguagaaggaauggcu

SEQ ID NO: 4163495 - RNA, 77 nt, Human
ggcuguugccccugagagacugggcagggccggcagcucuuugcuugcugauucucucaucucccagagcaacagcc

SEQ ID NO: 4163496 - RNA, 62 nt, Human
ggcuguugggcucucagucagacuggcaaauggaugccauuuuugaguggggccucagagcc

SEQ ID NO: 4163497 - RNA, 100 nt, Human
ggcuguuguaaagaggaaugucagugacauuacagcagugccucucauuggaguaagcacacaugugaguguccuuucuuccuccuuuauuccuuuaguu

SEQ ID NO: 4163498 - RNA, 75 nt, Human
ggcuguuuggagaguucugcugugucucagcagguuuucaguaaagcugucaugggagagcuuggaaagcagacc

SEQ ID NO: 4163499 - RNA, 77 nt, Human
ggcuguuugucucuguguggcuucccuagggcucaccuggaagcccugggaagacuccucaggaggcgugcugagcc

SEQ ID NO: 4163500 - RNA, 70 nt, Human
ggcuguuuguucuuuuguaccuaaggcauuaacuaauaaauccucaggucaaagcaggagaaucuaugcc

SEQ ID NO: 4163501 - RNA, 81 nt, Human
ggcuguuuucaguguuccuuggagcgcuaaagcucuaagguuccguaacuuuauagcgagcucuccaggaaagcauaagcc

SEQ ID NO: 4163502 - RNA, 67 nt, Human
ggcuuaagaacagcugagaagugauagcugcauucccaucuugauugcagcauuauucacaguagcc

SEQ ID NO: 4163503 - RNA, 59 nt, Human
ggcuuaagauuugagauaccuaauaccuagcuggcauuagguaucgcaaaucuuaagcc

SEQ ID NO: 4163504 - RNA, 62 nt, Human
ggcuuacacuucaucucauccaggagcaucugucuugggggccccugggaugagggugggcc

SEQ ID NO: 4163505 - RNA, 65 nt, Human
ggcuuacuguagaaggaaccaacuagucugauuggcaaaagcugggaagaguuuucugcagagcc

SEQ ID NO: 4163506 - RNA, 79 nt, Human
ggcuuagagguccacuuagucccuuaggagacagauggaagaauaaguuaguuugaauggacugagaaucuugagagcu

SEQ ID NO: 4163507 - RNA, 76 nt, Human
ggcuuagagucauggaguugaacugugcuuccuuauaccaagagaagugagcuuguucacucuucccucuaaagcc

SEQ ID NO: 4163508 - RNA, 73 nt, Human
ggcuuagggcggucucugcaggcguguuggacuucagugcgcuccgacacccagcuuuugaaugcccugcucc

SEQ ID NO: 4163509 - RNA, 72 nt, Human
ggcuuagugaguuugcucagugccuacagaaaucagaaauguguuuaccaaggcauaguaaucucugaggcc

SEQ ID NO: 4163510 - RNA, 65 nt, Human
ggcuuauaaauauuaggcuuuggguaaaaacuaauacuguggauucaaggggaguaguaugggcc

SEQ ID NO: 4163511 - RNA, 74 nt, Human
ggcuuauuuaauuuucacagugcugugagauaauaauagcuaucgucaguccugugagauauuauuauuaaucc

SEQ ID NO: 4163512 - RNA, 78 nt, Human
ggcuucaacagguguuugcugaauucaucucaggaacaaaaguagccacagaugaaguaaacaacucuuugagaagcu

SEQ ID NO: 4163513 - RNA, 74 nt, Human
ggcuucaaguugggcggcgggcagcgaacuugacagaaccucgaaacucugcagauccgccgcccaacccagcc

SEQ ID NO: 4163514 - RNA, 57 nt, Human
ggcuucacagccccauuagugcucuugcuuuccggcugaaguguggucuguggagcc

SEQ ID NO: 4163515 - RNA, 58 nt, Human
ggcuucacaguuguagcagcucaccaccaaggcucuuaguucugccagcuguggggcc

SEQ ID NO: 4163516 - RNA, 61 nt, Human
ggcuucagacaucaaacuggaaguuuucugaauuuaggauaucagguagaucuuugagguc

SEQ ID NO: 4163517 - RNA, 55 nt, Human
ggcuuccagccuuuucuccucugugggucaccucaagaugacaaggcuggaggcu

SEQ ID NO: 4163518 - RNA, 56 nt, Human
ggcuuccagugugcccuggucucuaaacaacaggcagaaauucucacacugaggcc

SEQ ID NO: 4163519 - RNA, 76 nt, Human
ggcuuccggggugaggggccgacuucagggccuuuuuccuaaaagaagcuucaaggccggccuccucuggcaggcc

SEQ ID NO: 4163520 - RNA, 86 nt, Human
ggcuuccuagggcuacgguaacagauaccacagacugguggcuuccacagcccaaguuuauugucuguaucacagcuccggaagcu

SEQ ID NO: 4163521 - RNA, 93 nt, Human
ggcuuccuauucuguguuuuuaguuuguucugugacaguucuaugcuaccuuaauuuuuacaguuucuaguaauacuugauaucugguaggcc

SEQ ID NO: 4163522 - RNA, 56 nt, Human
ggcuuccugggcauguguucuaaugcagucacacaggacagguguucagaggggcc

SEQ ID NO: 4163523 - RNA, 68 nt, Human
ggcuucucccugggaguccacugaugucagcuguggucacuaggcaucagggcuucuaggaggcagcu

SEQ ID NO: 4163524 - RNA, 59 nt, Human
ggcuucucuaaagaucaugcgugaacccaacaaaacgcauuuccgggucagaagaagcc

SEQ ID NO: 4163525 - RNA, 67 nt, Human
ggcuucugcagcagggcuugcccaccucugagugggagugaaaaguaggcccuccugcuccccugcc

SEQ ID NO: 4163526 - RNA, 67 nt, Human
ggcuucuggugaaccucggguguauucucaaaauuauguguugugaauucuuaaggucacuaaaguc

SEQ ID NO: 4163527 - RNA, 66 nt, Human
ggcuucuuccugugaacauguucuguugaaagugcuaccgaaaaaggauacuguucuaaaggagcc

SEQ ID NO: 4163528 - RNA, 66 nt, Human
ggaugaagcacagaaugguuaacaugucguuaugcugucaguugacaaauuuuugcugcuauauuc

SEQ ID NO: 4163529 - RNA, 80 nt, Human
ggaugacagacagcaaaugguuuucugucugaggcuggauugaccaggcccgggcacugccuuuguugauuugucucucc

SEQ ID NO: 4163530 - RNA, 88 nt, Human
ggaugaccugcuuuucuuuucuacagaggaggugguugggagugguuucuucauuugugagaugcuuccuuugguaaagugguuguuc

SEQ ID NO: 4163531 - RNA, 67 nt, Human
ggaugacugaugucuggggcagagucuagcuuuuuagaaggcagacucuuccuccgacauccucucc

SEQ ID NO: 4163532 - RNA, 74 nt, Human
ggaugacugcuuuuuguaggucccagaggcaacuguucauagaucuuuuugguagccaacaaaauguugucucc

SEQ ID NO: 4163533 - RNA, 79 nt, Human
ggaugacuugugcuuuuuccgggcuguuuucagaaagcucuguaacucauguccuaggaguaaagcacccugcucaucc

SEQ ID NO: 4163534 - RNA, 75 nt, Human
ggaugaggauauaaggaugccaaugacaucuugcagugucuaggucuagguuggcaauuccuaauaauuacaucc

SEQ ID NO: 4163535 - RNA, 58 nt, Human
ggaugagggcagcuauguaaguguaagucauuaucauuaaacuaaacugccuuccucc

SEQ ID NO: 4163536 - RNA, 64 nt, Human
ggaugaggugggcucaagucacuugcuccuaaguuauucaucuggaagcagagcccaugcauuc

SEQ ID NO: 4163537 - RNA, 97 nt, Human
ggaugaguuugagcaacauacaugguucucagcccuugcccuaccuuuuguuucucugguguauugguggaggcccaugucaugugugaacugauuc

SEQ ID NO: 4163538 - RNA, 113 nt, Human
ggaugauaguuaacauuuauugaguguuuaucugcaggaaucugugcuaggugcugcauagacauuaccucauuuauuccucacaacaacauucaagguagaacuuaucaucc

SEQ ID NO: 4163539 - RNA, 82 nt, Human
ggaugaucccccucuugggcuauaaauauaaccauaugaugccauacaugaauauaugaaguucaacagggauaggguuucc

SEQ ID NO: 4163540 - RNA, 79 nt, Human
ggaugauugugagguuuugaaugauaguauuggaccuaagaaauaggauuagcaucaugaucagaacuguugagaaucc

SEQ ID NO: 4163541 - RNA, 57 nt, Human
ggaugcaaggggaaagacuguuuagacuaggcuacacaacaguaccccccuuguucu

SEQ ID NO: 4163542 - RNA, 76 nt, Human
ggcuuauucguuuucuaggaccaacagagacgggggacauuagguuuguuuguggcguaguuccuaggaagaagcc

SEQ ID NO: 4163543 - RNA, 85 nt, Human
ggcuucaagccucuccagugccucccagugccuuucggguagaccccagguccuccaggccacugcagaggcucugaucucugcc

SEQ ID NO: 4163544 - RNA, 104 nt, Human
ggcuucaaggguguagacagauguacauucuaaguauguguaguuuauuguacuuuaauuauauguuaaugaagguauaauuguuuuaaaaauccuuauuagcu

SEQ ID NO: 4163545 - RNA, 57 nt, Human
ggcuucacagagcaucucggagcaacgccuaaugcagccugggaaaucugggaagcc

SEQ ID NO: 4163546 - RNA, 77 nt, Human
ggcuucacauauaaauacagaggggucacaauucacuccauaauggguggauuugcuaccuucugauaugaagggcc

SEQ ID NO: 4163547 - RNA, 129 nt, Human
ggcuucacccccagggaggcugccagacuuuugguuaaggaccauggcucuggggacaguaagucccacauccgaaucugaggugagcuccccaggccagucacuuggccccuuggaaccuccuugucc

SEQ ID NO: 4163548 - RNA, 56 nt, Human
ggcuucacuccucaagccuggguguuagaggcaaccacaggugggucagugaggcc

SEQ ID NO: 4163549 - RNA, 63 nt, Human
ggcuucacuuccgcaugcuggccuuucucccccggcugaggccacagccugggaggugacguu

SEQ ID NO: 4163550 - RNA, 111 nt, Human
gggauuagugagaaggccuuguucaccaugggaugacaacaguuguacaacucgaaaacuguuggcuucugguagugaccaugcauggcgccaagcucacccccuaauccc

SEQ ID NO: 4163551 - RNA, 95 nt, Human
gggauuccucaggccggagauggccagccagaaagaagccuuugacccagaggcugcucagcugucuggcccacuacuggcccuguggugcuccc

SEQ ID NO: 4163552 - RNA, 89 nt, Human
gggauucgcucuuuugugcccaggcuggagugcagaggcgagaucucggcccacugcaaccuccgccuccccggguucaggcgagucuc

SEQ ID NO: 4163553 - RNA, 66 nt, Human
gggauucugaggcuuucccguccccuccucacucaacaggccaggggaaucuaacuucggaacccc

SEQ ID NO: 4163554 - RNA, 76 nt, Human
gggauugcuauauuucuuggcuuuaaacacugaugagagugaaauguuuaaggaagaaauaauuccaguuuuaccc

SEQ ID NO: 4163555 - RNA, 96 nt, Human
gggauugguauuuuauggcuuugucuuaaaauucucagcaauguuuuguuuucuuuuaaaagccugaagauuauaaacagacauaagagcaagccc

SEQ ID NO: 4163556 - RNA, 89 nt, Human
gggauugucuccauccugccuuuagggaaaagcaagcuacccaucuagggucuggguagagcaccccgggaagagcaaggagacauccc

SEQ ID NO: 4163557 - RNA, 77 nt, Human
gggauugugguggugauggugccaguaguuuguuuaguauccugagacaaugcaccagcaucuucaccagcuguucc

SEQ ID NO: 4163558 - RNA, 77 nt, Human
gggauuguguuaggaugcagauucugauucaauaggucuuggguaggccugagaaucugcauuucuaauaagcuccc

SEQ ID NO: 4163559 - RNA, 61 nt, Human
gggauuuguguaguuuuguccgugcuguuauauggugcacugggcagagccagccaguccc

SEQ ID NO: 4163560 - RNA, 93 nt, Human
gggcaaacacguuuauuccauguauauauacugaauuccuacuaugcaccuucaacaauaaaggcuuuugguauauaggaguauacugagccc

SEQ ID NO: 4163561 - RNA, 67 nt, Human
gggcaacacauagcucaguaucacuuacuuugaugccaaaaugugaggaagaggggcuugguugccc

SEQ ID NO: 4163562 - RNA, 71 nt, Human
gggcaacagugucaagggguggcccaggcccuggagccaacccuggaagcaucacuucuugccuguugccc

SEQ ID NO: 4163563 - RNA, 60 nt, Human
gggcaacuauguaaauuaggccuucccuugcguucuugggagggucugaugugguggccc

SEQ ID NO: 4163564 - RNA, 59 nt, Human
gggcaagcuggcuccugcccucaagggcugucgagcagggaggaaggcggcggcugccc

SEQ ID NO: 4163565 - RNA, 60 nt, Human
gggcaagcuuaugaggcucugguauaagcuauguuggguuucaggcuggugggcuuuccc

SEQ ID NO: 4163566 - RNA, 90 nt, Human
gggcaagucuggucacugugcagguagaugccugggcucagaacgcgaaccucaguccagucaucucccuucacauugcucaugaaaccc

SEQ ID NO: 4163567 - RNA, 91 nt, Human
gggcaaguggagugagaagggaaguauuucugacagcuugccagcaggaaucuucuggcaaacuggaggaagcccugugcugagcuugccu

SEQ ID NO: 4163568 - RNA, 63 nt, Human
gggcaaguugagaagaaugcuaccaacccuaaaccccaguuaagucacuccucucgacugucc

SEQ ID NO: 4163569 - RNA, 58 nt, Human
gggcaauaaucuucaaagugugguaugugaucuauuaccauauggaaagauauuguuc

SEQ ID NO: 4163570 - RNA, 106 nt, Human
gggcacacagcucgcaaaugucaacccagggcucaagcguaggcagcacggcaccagagcugcugcucagaaccccugggcugcaggugcacagcacacugugccc

SEQ ID NO: 4163571 - RNA, 106 nt, Human
gggcacagugugcugugcaccugcagcccagggguucugagcagcagcucuggugccgugcugccuacgcuugagcccuggguugacauuugcgagcugugugccc

SEQ ID NO: 4163572 - RNA, 62 nt, Human
gggcaccuagcugaggagugugaguggcagaagccacuggugucugagcagggugagggccc

SEQ ID NO: 4163573 - RNA, 60 nt, Human
gggcaccugggagggggcaauaauguguuggagccagcccaugccagcucacaggagcuc

SEQ ID NO: 4163574 - RNA, 85 nt, Human
gggcacgggcagggcucagccgcucccaccuccccacagaagcccaggaguguguggacgucugagcccagcuuucugcgugccc

SEQ ID NO: 4163575 - RNA, 85 nt, Human
gggcacucagucaauuuuccugccuuugcucagggaaauaccagguuuuugugcagguauaggcggagagaggaccaauaugccc

SEQ ID NO: 4163576 - RNA, 58 nt, Human
gggcacugagaauuuuccacuuuguugcuugugcaagugacaguguucuggguugccc

SEQ ID NO: 4163577 - RNA, 61 nt, Human
gggcacuggcggggcagcucuggcuucucaggagcugaggagaucagccucccugcaaccc

SEQ ID NO: 4163578 - RNA, 59 nt, Human
gggcacugggcugugggguggagggacaguaucguaaaucagagauggcuccagugcuc

SEQ ID NO: 4163579 - RNA, 75 nt, Human
gggcagaaccugggccuaaacaaacaagagccagggcagccagggucucugcguggcugggcccagggcuugccc

SEQ ID NO: 4163580 - RNA, 55 nt, Human
gggcagaacuagggcaaacugcugagagcaucaggaagcccauuuuagucuaccu

SEQ ID NO: 4163581 - RNA, 66 nt, Human
gggcagagggcaugugaaguaaccuaggaccugcuggucacccugggugaugugcugcccucguuc

SEQ ID NO: 4163582 - RNA, 71 nt, Human
gggcagagggccaacuagcaccacuuuguacccacaagaggguauaugguagugccaguuggccuucuccc

SEQ ID NO: 4163583 - RNA, 69 nt, Human
gggcagaggucagguuggacauuauagggucuucuguuucuagucuccccagucuuggcuucuacuccc

SEQ ID NO: 4163584 - RNA, 55 nt, Human
gggcagaugucuuuugcaagggaaacagacuguuuucugccacugcacucugccc

SEQ ID NO: 4163585 - RNA, 88 nt, Human
gggcagcagagaggggucagaaggagggagcuuaagccaggcaggguuacuugucucugugacuccuuccgccuggcacaugcugccc

SEQ ID NO: 4163586 - RNA, 71 nt, Human
gggcagcagggugcaaggagaaaacggcuucugaaggcacagcuucagagacuuucuccuccuggcugccu

SEQ ID NO: 4163587 - RNA, 82 nt, Human
gggcagcagguggagacugugagugauuuccuucuggggcccacugcccaggaaggugggagcugaugacuucccucuggcu

SEQ ID NO: 4163588 - RNA, 87 nt, Human
gggcagcauguaagccuugcagcauuaggcucugugaccuaagcuugcacaagaaccugauucuggcaacugagcaaacauuugccc

SEQ ID NO: 4163589 - RNA, 93 nt, Human
gggcagccagccccucgaccaaggccucaggaagguaaagaagccggguccacccgugcucaacaccugacuucaguccaggguaggcggccc

SEQ ID NO: 4163590 - RNA, 79 nt, Human
gggcagcugcuggagggaggcaggacacaaugcuggaguguagcagaggccacagcccugcucccuccuagccuugccc

SEQ ID NO: 4163591 - RNA, 70 nt, Human
gggcagcuggauaguuuuaaauaagagggaaccgagaucauuauuuuugaaacugucagcuuuuacgccu

SEQ ID NO: 4163592 - RNA, 75 nt, Human
gggcaggaaguuaagaaggucaacgagggaaaaggccagaggccugagaaugucccuguccuucaacuucugucc

SEQ ID NO: 4163593 - RNA, 71 nt, Human
gggcaggagaaggaaaagcuaugccagaaucccaggcuuauuuauuugcauaguucuccuuccuccuccuc

SEQ ID NO: 4163594 - RNA, 69 nt, Human
gggcaggagaggaggcuacuucuuacccugggcuacugaggaggcaaguaggaagucuuccucccuccc

SEQ ID NO: 4163595 - RNA, 61 nt, Human
gggcaggagaugcaugucccuggaggcugauccagacucucuuccaugcaucaccaggccc

SEQ ID NO: 4163596 - RNA, 66 nt, Human
gggcaggaugucccccugggcacacggccuaggacauggcuucucccaggaggacauuccauaccc

SEQ ID NO: 4163597 - RNA, 77 nt, Human
gggcaggcaguguggugugaaacagagaguucaaguucauagggacucgggaguuaaguugggcuauaccccugccc

SEQ ID NO: 4163598 - RNA, 83 nt, Human
gggcaggccugccagaggcucuguuugcugugguaccaagcaacaggcggcaaggguggcauucagaagagcuggcucugccc

SEQ ID NO: 4163599 - RNA, 63 nt, Human
gggcagggaacaggagcuggugugggggagcccucagguccuccagcuguauccugccugucc

SEQ ID NO: 4163600 - RNA, 56 nt, Human
gggcagggacuccuaaggaggagguuucagggucuuccuccuucaaguccuggccu

SEQ ID NO: 4163601 - RNA, 81 nt, Human
gggcagggcaucccugagcgggugcaggugccccaccaccaccguggcccuccgccuccgcuccucccugugcuucugcuc

SEQ ID NO: 4163602 - RNA, 98 nt, Human
gggcagggcuguguuccccucuggaggcugcaggggagaaucccuuuccuugccuuucccagcuucuagaggcugccugcauuccuuggcuccuggcc

SEQ ID NO: 4163603 - RNA, 61 nt, Human
gggcagggcuuaucuuuuuuugccaccauauuaugagguaaggaacuuggugcccgugccc

SEQ ID NO: 4163604 - RNA, 80 nt, Human
gggcagguauuaggaaagcaguagagccaggauugaaacucugguuucucucgagccuaugcuuuuccuuauaucugguc

SEQ ID NO: 4163605 - RNA, 58 nt, Human
gggcagguauuuaucuucuauuucauagauaaggagauuaauaauaaauaacuugccc

SEQ ID NO: 4163606 - RNA, 84 nt, Human
gggcaggucauccugcaggagggggcggacgccggucaucccugccgcguccagggcgggcuccccucagcugcaggucugucc

SEQ ID NO: 4163607 - RNA, 113 nt, Human
gggcaggugagaggugugacugggaggcugguaggaaaggaaacauuaagaauccugaaauugcuguacucauugccuacaggccucugggucuauuacagcugaccaagccc

SEQ ID NO: 4163608 - RNA, 56 nt, Human
gggcagguggagggcccagccaggaggcacaggccuaggugagcccucgccugccu

SEQ ID NO: 4163609 - RNA, 64 nt, Human
gggcagguuccuugacuucucugcuacucaaggcucuucaguagauguuuggggaacuuugccc

SEQ ID NO: 4163610 - RNA, 66 nt, Human
gggcagguuuguguuuucaguccuucccuuuccugugggagaaaugaaaccaaagccuagagcacc

SEQ ID NO: 4163611 - RNA, 56 nt, Human
gggcagugauuuuccuuagaggggagcaagaaggucaccaggaaagucugcugucc

SEQ ID NO: 4163612 - RNA, 63 nt, Human
gggcaguggauuagccagagcuggauucaaaaacugguuccuagcuaaguuaauuaacuuccc

SEQ ID NO: 4163613 - RNA, 59 nt, Human
gggcaguggcaccgcuggcucuggccacacuggacccgccauugcucgugccaucaccc

SEQ ID NO: 4163614 - RNA, 85 nt, Human
gggcaguggcucgguccagggguaccggccaggcagccucugcagccccccacggcugugccucuggccuauuagagcccagccc

SEQ ID NO: 4163615 - RNA, 121 nt, Human
gggcagugggauugaguaggggagcaggaaauaggcguuuguccucucucuuuuaagaugaguccugggaggcgugcuugucacuuuccuucacauucuguuggucaguacucaguugccc

SEQ ID NO: 4163616 - RNA, 64 nt, Human
gggagggcagggacuauguuucauggagcacugcuuccaugggauucagccuugagcccauccc

SEQ ID NO: 4163617 - RNA, 115 nt, Human
gggagggcgcugugaccagcgcacucaggcaccaagugucggcauggcucacugugcugggugaaggccuccccgagcauuagguccuccacggggcugugucaaaugcccuccc

SEQ ID NO: 4163618 - RNA, 81 nt, Human
gggagggcugugcugugcaugguaagaugcuucacaguaucugugaccucugcauaccaugagccagcggcacccccuccu

SEQ ID NO: 4163619 - RNA, 103 nt, Human
gggaggggauagggaggucugaaggacagaauagucagcuguaggcccaggucucuaagcuucugggucagugacuuuuuucuguggccccuuuugcccuccu

SEQ ID NO: 4163620 - RNA, 76 nt, Human
gggaggggauagggccagacugagggucccugagcuugugcauggucaggaacuuacucgguuuggauuuccugcc

SEQ ID NO: 4163621 - RNA, 70 nt, Human
gggaggggcagagguagagaacaagaauacagaggaaaggcccucgcacuugcugccuccuguuccuccc

SEQ ID NO: 4163622 - RNA, 106 nt, Human
gggagggggacaagagauggcgcugcagaggugagaagggccucccaggggucuuaccaucccagggagucucauucuccucucccaggauauccucacccacccc

SEQ ID NO: 4163623 - RNA, 68 nt, Human
gggagggggccuuguuaguggauggaguguggauugauaacacucugaggauaagaugcucccgaccc

SEQ ID NO: 4163624 - RNA, 66 nt, Human
gggaggguccugccaucuauuuucagucuccagcccggucuucugucaaguauagcaggcccuccc

SEQ ID NO: 4163625 - RNA, 71 nt, Human
gggagggugcugccggacagguggguccccggguacucacugcugcccgcccggccgcggcgccccguccc

SEQ ID NO: 4163626 - RNA, 56 nt, Human
gggagguagacuucuuggaaguagacccuccagucccagcucuucaagucaccccc

SEQ ID NO: 4163627 - RNA, 129 nt, Human
gggaggucaccugggacugguagagggaacacaaagcuuaagguagguacagaggccagcagucacauuaguguuucucagcuuucuuugcgcauuuuguucucccaaccuuuuacuuuccugccuucc

SEQ ID NO: 4163628 - RNA, 98 nt, Human
gggaggucaggggcuucuuucugggguugguacccagggcaucauggcucugggcagccgccccauaggauuguugcgugaggcucuugacacagacc

SEQ ID NO: 4163629 - RNA, 82 nt, Human
gggagguccuguccuuggucucugauaggugcaauccauauaccagucucagugaaggccaugugauauaggaaggacaccc

SEQ ID NO: 4163630 - RNA, 86 nt, Human
gggaggucugcuaugugucugacagugugcaagaaaugggggauaugucccuaggauuccuccacuuagcgccacugggcccuccc

SEQ ID NO: 4163631 - RNA, 79 nt, Human
gggaggugacugggauguggagcaggugggaugucgugaccgauugguacaagcauaaggcuugcuucagucuucucuc

SEQ ID NO: 4163632 - RNA, 68 nt, Human
gggaggugcuugcgauacacagccauucuguuuuuccuuaguggaaggcacugcuuugcugcgccccc

SEQ ID NO: 4163633 - RNA, 64 nt, Human
gggagguuaauuggagcagcaggccuggagccacugcagggcuccuggcuccaaucaaccuccc

SEQ ID NO: 4163634 - RNA, 59 nt, Human
gggagguugugaggaauucaccuagaucauaugaccagugugggccucacaaugcuccc

SEQ ID NO: 4163635 - RNA, 60 nt, Human
gggaguagaaguauuuguaaaaaggcagcaauguuuccauaggaucugcuucauacugcu

SEQ ID NO: 4163636 - RNA, 71 nt, Human
gggagucaugaaguuagaacuaugaggauaaaugaguaaguuuguaaaccagaaucuggcugcaaauuccc

SEQ ID NO: 4163637 - RNA, 128 nt, Human
gggagucuugcccacccucaagcucguggguuaggaaggggcuucccuacauggcccuacgucugugcuagucucaggguggccucugugcuccugccuacuucagcgacugugggaacccaucuucu

SEQ ID NO: 4163638 - RNA, 94 nt, Human
gggagugaggacugggaagugugggcggcgucccagucccauccgucccaucuaggaugggcccgggacggcgcugcucuccuguccuccucuc

SEQ ID NO: 4163639 - RNA, 56 nt, Human
gggagugcugaagacuggcuagggagauaucugcucuccuuucuuggcgcuggccc

SEQ ID NO: 4163640 - RNA, 61 nt, Human
gggagugcuggaggugugagugggacccuaacccccaccucuacccaccccaguggauccc

SEQ ID NO: 4163641 - RNA, 99 nt, Human
gggaguuacaaccauaaauacgugggaugguagguagguaauaaggcugauuauucacaaauauguugguucuuaugcacccacauggaugugauuccu

SEQ ID NO: 4163642 - RNA, 71 nt, Human
gggaguugaagaguuuccaguuguggcucagucacuaacuagugcugagacugcgaggcacuucagcucuc

SEQ ID NO: 4163643 - RNA, 89 nt, Human
gggaguuggggcccaggaaaugaggcugaagggugugaugaugaauuuccaguuccccaccuuccccagacucaguccugccagcuucc

SEQ ID NO: 4163644 - RNA, 83 nt, Human
gggaguuucucugugagaaaugcagaaucuugagaaaaauuccagacauacuggaucaggaucugcaucauaagaagauucuc

SEQ ID NO: 4163645 - RNA, 55 nt, Human
gggaguuugagguccaggugugggcaggguugguucuguuggaggccucucuucc

SEQ ID NO: 4163646 - RNA, 91 nt, Human
gggaguuuuguguuggcuggagucuggugcuagccagagaauagaaacucaggcagcgcugaaaggcccaucugugcuagcaaggucugcc

SEQ ID NO: 4163647 - RNA, 81 nt, Human
gggauacucggugaacaagacaaacuuggcccugcugucucugggcagcaaaguccagucuguguacaccagguguggccc

SEQ ID NO: 4163648 - RNA, 57 nt, Human
gggauacuugucucaaggucaaauauauaugaacuuggcaaugaggucagaugucuu

SEQ ID NO: 4163649 - RNA, 88 nt, Human
gggauagcugguguuuuggcugcugcucuugugcauuagugagcagucauaggucacagagacagcagagucaccucugagcucuccc

SEQ ID NO: 4163650 - RNA, 84 nt, Human
gggaucaggaagcuuguguguauuggucacauguucacggacuggcguggcccaaggaucauugcucauaaguccacagauccc

SEQ ID NO: 4163651 - RNA, 59 nt, Human
gggaucaggugaagucacugagugggucuuuaccugaggucacaacuucgcuugauucc

SEQ ID NO: 4163652 - RNA, 63 nt, Human
gggauccgcagaggaggaguugcugucagcuggugcucacggggugccucucucuacggaccc

SEQ ID NO: 4163653 - RNA, 93 nt, Human
gggauccuuuccuuagauuaucuuuuuaaggguuggccugggcauagauaggucaacuuuaagaugaucuuuuuucaauugagggcauauccc

SEQ ID NO: 4163654 - RNA, 80 nt, Human
gggaucuggaacuauggaagggaugcaaagaaaggaaguggccucucucugucuuaccacccuccaucauuccuugucuu

SEQ ID NO: 4163655 - RNA, 76 nt, Human
gggaucuucuuugcauguagaauacucaacuuucuugaaaacagagcaguagagauggccuauaguggaagaaacc

SEQ ID NO: 4163656 - RNA, 55 nt, Human
gggaucuugaaacagcuggauucuuaaugcauauucauauuguuucaaugaucuu

SEQ ID NO: 4163657 - RNA, 78 nt, Human
gggaucuuguuaaagugcagauucugacuuacugggucugggguggggccugagagucugcauuucuaacaagcuccc

SEQ ID NO: 4163658 - RNA, 67 nt, Human
gggaugaaguggcagguuauaagcaucucaacagauaauugaaaauguugaauuuccgcuuuggccc

SEQ ID NO: 4163659 - RNA, 73 nt, Human
gggaugaauguugcaaguuaaaucuuacugaguuuagagcacuuagaugauuuuaugucuugucauuuuuccc

SEQ ID NO: 4163660 - RNA, 58 nt, Human
gggaugagguagaugaacaagggccucaggccaggcccaucaucccuaccuccguccc

SEQ ID NO: 4163661 - RNA, 78 nt, Human
gggaugcacuuuaccuuguggugacuugagcuuccuaagggccucaccaaguucugagcaccaggcaccacagcuccc

SEQ ID NO: 4163662 - RNA, 62 nt, Human
gggaugcagacuacagggcuuaggggccaguucauucucuuuccucuggagucauugcuccc

SEQ ID NO: 4163663 - RNA, 58 nt, Human
gggaugcaggggagauggagagguuccuuuucacuacaaaagucucccuuucuuucuc

SEQ ID NO: 4163664 - RNA, 130 nt, Human
gggaugcgggugagugucuggcucugggcaggacacagaugcaaggccaggggaauggacagggggcucucacucagccuguggucuuugcccugggauuuugccucuagauucuccccaacggcugccc

SEQ ID NO: 4163665 - RNA, 72 nt, Human
gggauggcugggucuguaaucggccagggauccucuacccccacgaccccugguggcaucacucagccuccc

SEQ ID NO: 4163666 - RNA, 130 nt, Human
gggaugggacugugagggaggagggccucagguucuggagaagggccagguauuuccaugucaacccugcuuuuuauaaccagagagaacauaugagguagcaccaaugaccuccgccaccaauccuucc

SEQ ID NO: 4163667 - RNA, 55 nt, Human
gggaugggacuugccucaggccaaauaggaacucccggcugagcaaauuccuccc

SEQ ID NO: 4163668 - RNA, 99 nt, Human
gggauggggccaggagcugggcaggaguguggguggaggggccuggaaccugccucagcagcugcuccacuugcuuaaucccaccuggaaccuuguccc

SEQ ID NO: 4163669 - RNA, 83 nt, Human
gggauggugacaguaguguuagaacugauucuuuccauugagucauagaagaacuccguuaaaaucuacuguccugccuaccc

SEQ ID NO: 4163670 - RNA, 103 nt, Human
gggaugguuuaugucugcuccucggcccugggagggaacccgcacaagaguugcuaagcagcugguggagccuuucuguuuuaagccaggacacuauugucuc

SEQ ID NO: 4163671 - RNA, 63 nt, Human
gggauguauaugugaaugcguguauguguguuuaggguacgcaugcauguuacaguauaugcc

SEQ ID NO: 4163672 - RNA, 58 nt, Human
gggauguauguuuguguggagauguuuuuuucugucuguaggcacauguauauauccc

SEQ ID NO: 4163673 - RNA, 55 nt, Human
gggaugugggagugaaggucaaaucccaagagagaccagcauuccacacuguccc

SEQ ID NO: 4163674 - RNA, 91 nt, Human
gggauguguuuaaaaugugggagacaggagcuguauggaaaucauuauuuucaaaugcggucauggcuuuuagguugugaauuuuuguucc

SEQ ID NO: 4163675 - RNA, 77 nt, Human
gggauguuuuaugugcuggacuggcagugcccugcuuggagacuuuggggaacaaguggguccuacauaaagcuacc

SEQ ID NO: 4163676 - RNA, 81 nt, Human
ggcagcccuucccagggacucgggauucuaggaaccucucagucaggucaccugaguccaaaagucuuuagcaggguaguc

SEQ ID NO: 4163677 - RNA, 63 nt, Human
ggcagccucugccauggcuucagccuccauggacaauccuggcacuggggcuuugguacugcc

SEQ ID NO: 4163678 - RNA, 62 nt, Human
ggcagcuaggccauuuguucagugaguaaucaugucucauccugugcacagggccuggagcc

SEQ ID NO: 4163679 - RNA, 64 nt, Human
ggcagcugggugccuaauaaugauaaaaaccauaauacuucauaauuacgcacugcccuuugcc

SEQ ID NO: 4163680 - RNA, 60 nt, Human
ggcagcuguuggcucucuaggaugggucgccaucccuagagcugcagaccacucacugcc

SEQ ID NO: 4163681 - RNA, 70 nt, Human
ggcagcuuacguuuugcuagugacagucuccuguaaaaauaacucucuuauuagcgaugacauaagagcc

SEQ ID NO: 4163682 - RNA, 62 nt, Human
ggcagcuuggcuuccgcuuuacuguccuucuggauaaguuguucugugggaagccagcugcc

SEQ ID NO: 4163683 - RNA, 80 nt, Human
ggcaggaagagcagcauguggggugugugggacaggaggugcaugcacugcugccagcuggcccagcugugcucccugcc

SEQ ID NO: 4163684 - RNA, 76 nt, Human
ggcaggaaguacaaagugaaauaauucugagacuauuaaaguccagggccuugucacauugauuacauucuuagcu

SEQ ID NO: 4163685 - RNA, 87 nt, Human
ggcaggaaucuguuugugauuagcaguggguuuuaguguugccgaggaauguacccaacguuaccguuacccccgcagguugcugcc

SEQ ID NO: 4163686 - RNA, 96 nt, Human
ggcaggagaaucacuugaacccaggaguuagagguuguggugagccaagaucauaccauugcacucuagccugggcaagaagagcaaaacucuguc

SEQ ID NO: 4163687 - RNA, 130 nt, Human
ggcaggagaucccugggggugucaggaggaacauggcagagccugcaggugggugagcaguauucuccauggauugguugguccaggcugcagucuugcccucucucucggauucucccacucuggaaac

SEQ ID NO: 4163688 - RNA, 57 nt, Human
ggccugagcuugggcagcguauucugugcaaagcauguggggcaccaaacucagguc

SEQ ID NO: 4163689 - RNA, 61 nt, Human
ggccugaggcccugcccuuucuggccacuugcagggcucagcacagggcccagccuaggcc

SEQ ID NO: 4163690 - RNA, 80 nt, Human
ggccugagggaugggcugggccgccagggagaugggaagggagcauccaaggugaccaggguggucagcucauucaggcc

SEQ ID NO: 4163691 - RNA, 63 nt, Human
ggccugagucucccauaggcuaaguauuugcccugagucauaaagccagugggaggcagugcu

SEQ ID NO: 4163692 - RNA, 65 nt, Human
ggccugagugugcuaggugucucgguaggauugucagugccaggcaguucaaguacaccagcguc

SEQ ID NO: 4163693 - RNA, 61 nt, Human
ggccugcacagagguggcucuaggagaaaugaccaucacaauagccucccugugccaggcc

SEQ ID NO: 4163694 - RNA, 129 nt, Human
ggccugcccugaggucacagcccuugugcccagcuccuagagccagaggaggcuggggucaguagggccugugaaugaugccaccuccuaggccuggagaagccagggcaggggauggacauggaggcc

SEQ ID NO: 4163695 - RNA, 62 nt, Human
ggccugcggccuguggacuucauuuagcagccucgguccugcuguccaggggaucguuggcc

SEQ ID NO: 4163696 - RNA, 63 nt, Human
ggggaggguuguguaccuguugucucaaaaagaugagcacgacagcacaacagcauccuccuu

SEQ ID NO: 4163697 - RNA, 92 nt, Human
ggggagguggcccagggagcuggcuucaaagggcggcugucggagggugacucaugguacucuucacuuccccugccagcgguuuccucccc

SEQ ID NO: 4163698 - RNA, 65 nt, Human
ggggagguguccaagagucaagaagggggcggagggacaccccauggccucauuuccaccucccc

SEQ ID NO: 4163699 - RNA, 100 nt, Human
ggggagucagggagcuagagcaagggcugggcuuggggcuggcagaacagccaagaacccagagcuccgguccugcccaugccccugagaaauucucccc

SEQ ID NO: 4163700 - RNA, 58 nt, Human
ggggaguggugucacugagaggaaggcccaagcacuuuccccuucugcaccucuuccc

SEQ ID NO: 4163701 - RNA, 73 nt, Human
ggggaguguaacuugguuggugggcaggagaauuuaaggucucuccauggauucccacucaagucagcucccu

SEQ ID NO: 4163702 - RNA, 86 nt, Human
ggggagugucaggaggagucagacccugcugagcuauagacaggcccagcuguaacgggucugcaccucucuuccugcccuucccc

SEQ ID NO: 4163703 - RNA, 67 nt, Human
ggggaguguuuucaugggcuugaaaugcaguucaaaaucuguuaaaggguaaggaaaaugauucuuc

SEQ ID NO: 4163704 - RNA, 80 nt, Human
ggggauccucucauuucuguuugcacugauuucagcaccugucaccugcaaggcgcugaguaggcaaggagggaaucccc

SEQ ID NO: 4163705 - RNA, 116 nt, Human
ggggaucuaaggggcucuggccaauguggcagccucagugauccuggugggacagaaaaccucaccaugcguggggccuccagcacuaggcagccacccugacucugaccuuccuc

SEQ ID NO: 4163706 - RNA, 70 nt, Human
ggggaugaagccugacuucucggugguucucauucaugcaucauugggaagaaaugcuucacaagacccc

SEQ ID NO: 4163707 - RNA, 64 nt, Human
ggggauggaggcgugugguccucauuccccuggucauccccagaggcaccacaucucccucccc

SEQ ID NO: 4163708 - RNA, 77 nt, Human
ggggauggaucaccugaggucaggaguucaagcuggucaagagacuagacuggccaaaauggugaaacuccaucucu

SEQ ID NO: 4163709 - RNA, 71 nt, Human
ggggaugggacccacucuuuuuucaccuccggucguaccuacugggugugcccagauggugucccuucccu

SEQ ID NO: 4163710 - RNA, 56 nt, Human
ggggaugggggguguuagugauggccauuauaucauuuguucucauucucuacuuc

SEQ ID NO: 4163711 - RNA, 59 nt, Human
ggggaugggggugaugaggguacacagcacauacucacccuucaggacccauccucccc

SEQ ID NO: 4163712 - RNA, 64 nt, Human
ggggaugguagaccggugacgugcacuucauuuacgauguaggucacccguuugacuauccacc

SEQ ID NO: 4163713 - RNA, 64 nt, Human
ggggauucccgagauagucacccccagcaacccuggcugagaggcacuaucuccggaccgcccc

SEQ ID NO: 4163714 - RNA, 83 nt, Human
ggggcaaauggauguggggaugacugucaaucaggcaauggagcagaugucugaggaagucagcccuuuauuuaucuucuccc

SEQ ID NO: 4163715 - RNA, 82 nt, Human
ggggcaacagugauaccaucccugcacuccuggguccugcucuuccaaugcccaaggcauggcaugguggcagcugugcccc

SEQ ID NO: 4163716 - RNA, 90 nt, Human
ggggcaagcaaggagacacaguggguaguggggauuagcagggcagccaggucaugcuuucaguuguugccuuuguucuuugagugcuuu

SEQ ID NO: 4163717 - RNA, 104 nt, Human
ggggcacauuuucuccucauuguuccucuuuuuucaccguggaucuucaugaaauuccacuguaagcaaaugaaucucaggaagaucucugcaggagcugcucc

SEQ ID NO: 4163718 - RNA, 57 nt, Human
ggggcaccauauguauauauccugauuacauagugcuguggucuaaaugugugcccc

SEQ ID NO: 4163719 - RNA, 85 nt, Human
ggggcaccauguaaaaaugggaugguaugcuuccaagacugaugcuguuuuaaaguuuuugcacauucugacuacauuaugccuu

SEQ ID NO: 4163720 - RNA, 78 nt, Human
ggggcaccugcauucuauuucuuaagaguuauuuagcaaaaagcaaggugcagugaaggaaaaggaaauagcugccuc

SEQ ID NO: 4163721 - RNA, 60 nt, Human
ggggcagagaaggauugaaaccagagcccaucacuacucuccucucugccuuucugcccu

SEQ ID NO: 4163722 - RNA, 55 nt, Human
ggggcagcaguugcccuaaucaagaauucacacucuggagguggucugcuguccu

SEQ ID NO: 4163723 - RNA, 76 nt, Human
ggggcagcccuacccucuggaauauacaaaauguuacacagacacaguauguacaccggggaaggugggccacccc

SEQ ID NO: 4163724 - RNA, 101 nt, Human
ggggcagcugcuguggcugcggggccaggaagagagcgcagccuccacagagccauuccggaccgcugccuccgccggcuccacagcccacgcgcgcacuc

SEQ ID NO: 4163725 - RNA, 64 nt, Human
ggggcagggaugaagguuggagucuccaggcugggcagggucuucccaccauuccugcagaccc

SEQ ID NO: 4163726 - RNA, 85 nt, Human
ggggcagggcucugacgccucuucccugcugcacugugccugauggugggggaaggagacagggaagggcgggauguucugcucc

SEQ ID NO: 4163727 - RNA, 60 nt, Human
ggggcagggucugggggcugcuucugcagcuucagcgcagaaaacccagagcucaguccc

SEQ ID NO: 4163728 - RNA, 85 nt, Human
ggggcaguuaccgaaggcccuguuuucccuauuuuucaugugaauaaacgggggcuccggggcuuuauucauuuaaccugacucc

SEQ ID NO: 4163729 - RNA, 130 nt, Human
ggggcauggggucugcuguccugaguacggagaauccucugcuugggguuaggguguccugacgcuagagggccuggucccaggacaguggcaauccuagacucagauuguaggaagaaacauguaaccc

SEQ ID NO: 4163730 - RNA, 57 nt, Human
ggggccacggaaggaccaguggguagcccucuccccaccgugccuugcugucgcccc

SEQ ID NO: 4163731 - RNA, 84 nt, Human
ggggccagccaggggccucugggggaggauggccuagaaaacagggcucugcuucagaaggcucauucuuguuggcggggcccc

SEQ ID NO: 4163732 - RNA, 66 nt, Human
ggggccagcugguucagugucuggugagggccuguuccucacugauggcacuggauagguauccuc

SEQ ID NO: 4163733 - RNA, 76 nt, Human
ggggccaggguucagggcgggcgucccggcuccacucuggagccccgagcaugcagcccccuggugcccgggcccc

SEQ ID NO: 4163734 - RNA, 81 nt, Human
ggggccccggguggugggagugaucagaagaaccugccgaagagcacacccccucuggucugauggucccaccaccgcccc

SEQ ID NO: 4163735 - RNA, 72 nt, Human
ggggcccucucaccuuauagacucuuguuguuagaagaaauucacagaauagcacuguaagcgcagggcucc

SEQ ID NO: 4163736 - RNA, 69 nt, Human
ggggcccuggcgagcuuuguucuccaggacaauggccacuguccauugaggaaggacuugccuggcuuu

SEQ ID NO: 4163737 - RNA, 113 nt, Human
ggggccgcagcaucccucgccagcccaugccccagcugcaggugacaucacguggcugacaucaggccugcagucuggguuagcugugcugggggcccagaagcuguggcucc

SEQ ID NO: 4163738 - RNA, 70 nt, Human
ggggccggcucugagcagcaacccagagccucccugugggaugggaccugcugcugcucugcuguguccc

SEQ ID NO: 4163739 - RNA, 66 nt, Human
ggggccgggaaggggaauuggcaaagaaggcaacaaacugccuccuggguggcucugcccggcucc

SEQ ID NO: 4163740 - RNA, 59 nt, Human
ggggccggugcucagguucccaugagugcccgguggcaccaggcagcugagcaggcccu

SEQ ID NO: 4163741 - RNA, 78 nt, Human
ggggccgguuccauagccaucuuuagcuuccagguuaaagaaccugguuaguuuggugauuggcucuguaauggcucc

SEQ ID NO: 4163742 - RNA, 68 nt, Human
ggggccucauuucuguugugcaucacugcauuucuagugccuagcaccaugccugacagagaagcucc

SEQ ID NO: 4163743 - RNA, 114 nt, Human
ggggccucugaaugggaggaaaucaggacaacaauaugcugaguuuuucaccacuggcugcugggcaauucaggauauugagcccugugugaccuucccaacagaaaaaucacc

SEQ ID NO: 4163744 - RNA, 59 nt, Human
ggggccucugcagucacgcugggucacgugcuccagucagccaagcugcagcggccacc

SEQ ID NO: 4163745 - RNA, 56 nt, Human
ggggccugacacugcagguguagacccgucacaggugucucugccgaucagggccc

SEQ ID NO: 4163746 - RNA, 60 nt, Human
ggggccuggggggcagguggagggccgcugcuguuuucucucacucauuuccuaggucuu

SEQ ID NO: 4163747 - RNA, 69 nt, Human
ggggccuuguccagggagacaacugugagggcuggaguaaucagggagggcuuccuggaggagagccuc

SEQ ID NO: 4163748 - RNA, 92 nt, Human
ggggccuugugcaauaaaguggaggcccgggcugugccacagccacagcucuucucauggggccucagcuuccugauuguuuaauggguccc

SEQ ID NO: 4163749 - RNA, 61 nt, Human
ggggccuuugagaggagaguaauacaggucaauucucaagaucuguuauugucagagcucc

SEQ ID NO: 4163750 - RNA, 57 nt, Human
ggggcgaggaagcaauugaguuauaugccccuuaaaauucacagguauccucucccu

SEQ ID NO: 4163751 - RNA, 61 nt, Human
ggggcgccgguaggagccggggauggcugcgucccucaggcugucuuccuucuggugucuc

SEQ ID NO: 4163752 - RNA, 79 nt, Human
ggggcggaggccagcgggaagcaccugcaccucuucaggguacauccgagccugggccuggcuucccgcccuccaccuc

SEQ ID NO: 4163753 - RNA, 78 nt, Human
ggggcgggcuccggcuggggcuccgcggcccccugcggaagcuggugcugcagagucucgugccgcugcugcugcgcc

SEQ ID NO: 4163754 - RNA, 109 nt, Human
ggggcgggcuggggcggggcugcgcaguggugcugcgcgcggagcucuguugccggaacugguccgagucgugcgccgggccgcgcgcagccccgccccgccccgcccc

SEQ ID NO: 4163755 - RNA, 73 nt, Human
ggggcguaggaacuggccacaacuagcccaggaccgcagguccucuacuugccguugggccucccugggcccc

SEQ ID NO: 4163756 - RNA, 86 nt, Human
ggggcgugccuguggcccgucuugcagguuccgcggcugugcagugagugcgcuucugggcugcaggaguggggcaaggacgcccc

SEQ ID NO: 4163757 - RNA, 122 nt, Human
ggggcuaaaguagauguggaaguugaaucaaccugagucuggaauguguucauacucugcucaguugcagaguaugaaucuuucagaccguaauacaauuuuauuuccagucuuauaauccu

SEQ ID NO: 4163758 - RNA, 96 nt, Human
ggggcuaagguugacuugagcccaggagguugaggcugcagugagccaaaaucaugucacugcacuccagccugggcaagaguaagauccugucuc

SEQ ID NO: 4163759 - RNA, 59 nt, Human
ggggcuccccggcugcuugucuggaaacggagugcaugugaccgcugggugagcgaccc

SEQ ID NO: 4163760 - RNA, 114 nt, Human
ggggcuccggaggugucagggcgccuccuugcucucaggguugcaugcaucuguggggaggaagacauccgugagaugcugacggccaggaccgcccucgcuucccgcagcccc

SEQ ID NO: 4163761 - RNA, 76 nt, Human
ggccuggcuuccauauggcacauaguggcuuuucuaagacuguucacaugucugccaaugaggaauggcccuggcc

SEQ ID NO: 4163762 - RNA, 63 nt, Human
ggccugggaagguaagccuugccugagaaaaggcugcugggccugcagggcugccucccagcu

SEQ ID NO: 4163763 - RNA, 75 nt, Human
ggccugggagggcagauggggcacaggcugagcucgggguccucugcuuagccugcccucguggccuucccugcc

SEQ ID NO: 4163764 - RNA, 83 nt, Human
ggccuggggugggaaacacuggcugugcagagggcaguaggaacggcuguggcucuccggcauggccagagcuguucuaggcu

SEQ ID NO: 4163765 - RNA, 59 nt, Human
ggccuguacccuggcuguuaugagaaccagagggguucucaggucaccagggugccacc

SEQ ID NO: 4163766 - RNA, 63 nt, Human
ggccugugcuugcggguguggagccggccuccccgggcucugccugcccagcagcaccuugcc

SEQ ID NO: 4163767 - RNA, 58 nt, Human
ggccuguguggaugggccccuggcucuccugugcuccagccuccucuccacacaugcc

SEQ ID NO: 4163768 - RNA, 60 nt, Human
ggccuguuuccaagcacucugugugauucuuaugaugucugaggcuggagacaccaggcc

SEQ ID NO: 4163769 - RNA, 89 nt, Human
ggccuguuugccuuggccccgggccagggccgccccgccagugaguaaugcgugaggaccgccuggcuccgguucaagggaaacgggcu

SEQ ID NO: 4163770 - RNA, 56 nt, Human
ggccuuagagaccaccuagucugauuaucacacuucacugacagggaacuaaggcu

SEQ ID NO: 4163771 - RNA, 79 nt, Human
ggccuucaaagcaaagguccagaguugagauacagaagcaaugaggcauuugugaaagucuuugaccuuagcgagggcc

SEQ ID NO: 4163772 - RNA, 75 nt, Human
ggccuucaauaauuaggaguguaagggggccagguggaguggcucacgccuguauucccagcacuuugggaggcc

SEQ ID NO: 4163773 - RNA, 94 nt, Human
ggccuuccuggagguuggcugccacugucauacccuggcaauggcauucauaccauuggcaggcaauggcaugucauacagcuucaugaggguu

SEQ ID NO: 4163774 - RNA, 86 nt, Human
ggccuucggcagcagcagaggcugucggggcacugaagaguccucuugugccuucucaguccugcucacacccugagaccgaggcc

SEQ ID NO: 4163775 - RNA, 61 nt, Human
ggccuucggggugggacucaggggcaggcagaaccuguccaggaauugacccugcaagguc

SEQ ID NO: 4163776 - RNA, 64 nt, Human
ggccuucuguuuuccugggugaagaaggaggggugcugagugcaccaggaugggcagguagguc

SEQ ID NO: 4163777 - RNA, 56 nt, Human
ggccuugagcagggagaaaccagcacucuucucagcugggccuuucuggcagggcu

SEQ ID NO: 4163778 - RNA, 67 nt, Human
ggccuugauuccggucauugaacacacuuuauucauuucugugucuggcacuguccuagucgaggcc

SEQ ID NO: 4163779 - RNA, 80 nt, Human
ggccuugcuauuuaagcaggaugaacuaacaccugcagaauaauaucugcaucugucacugcuuaguuggauuucaggcc

SEQ ID NO: 4163780 - RNA, 71 nt, Human
ggccuuggaaauaguugugagucaggcaguaugcuuuuguugcuucucacccuuacuaucucuuugaugcc

SEQ ID NO: 4163781 - RNA, 73 nt, Human
ggccuuggagucagccuugagcgggcaggagaccacaaugaagccgacgaacuugaggcugcacuccagggcc

SEQ ID NO: 4163782 - RNA, 59 nt, Human
ggccuuggauccaagcugcggcuccagcuggagacuaaccagcuaugugaccuuaggcc

SEQ ID NO: 4163783 - RNA, 63 nt, Human
ggccuuggcuccugcagggaguuggagagaagaaugugcucagugcucaggggagccgaggcu

SEQ ID NO: 4163784 - RNA, 89 nt, Human
ggccuugggcaagucagcuugccucugagucucuacaaaaaugaagagcuucagcuugcagcugugaucugugauuugcccccguagcu

SEQ ID NO: 4163785 - RNA, 67 nt, Human
ggccuugugggucaaagaaagcauguuuguuccugaagacaaaugccaucuggugauguauuaggcu

SEQ ID NO: 4163786 - RNA, 84 nt, Human
ggccuuugaggucccuucaauucucauagucuaguuuuuggugagaaguaggacuagggguugaggcaucuuauuuugcuggcc

SEQ ID NO: 4163787 - RNA, 69 nt, Human
ggcgacagcagguguccuuuugguggagaaucuccaggucugugagcuaaaugguacacuugcugggcu

SEQ ID NO: 4163788 - RNA, 129 nt, Human
ggcgacaggaggcagcugccagcaugacuuugaaaacccuuggagauccuagaagacuugccacauguaacguggagcagcugcugggaucauuuaggagaaaugcagaacuuggcacccacccacgcc

SEQ ID NO: 4163789 - RNA, 65 nt, Human
ggcgaggaaauagacacuuucuaugaauuaaaaauggguucaugauucuguuuuuuucacuugcc

SEQ ID NO: 4163790 - RNA, 82 nt, Human
ggcgaggcuuaguagagcaguuguggguaccaguucucccaggaauuagugcccaggcugccucuucacacccccaccuccc

SEQ ID NO: 4163791 - RNA, 61 nt, Human
ggcgagggaggggacuaugcggaccaaguugucuucaaagugcaccugcuucuucuuggcc

SEQ ID NO: 4163792 - RNA, 98 nt, Human
ggcgaugccgcgcgcccccucgccuuuguuccagcccgagggcgcugaugagcaaacucaaggcgaccugggugggggugacuggagccgggcucgcc

SEQ ID NO: 4163793 - RNA, 81 nt, Human
ggcgauguucaagcucuucuuuccaucccuagccacuagcucaguaucagguguuuaggagaugcagaaugaauguuugcc

SEQ ID NO: 4163794 - RNA, 58 nt, Human
ggcgcacuggccgcacgcguagggcuucucgccuguguggaugcgccggugcucggcc

SEQ ID NO: 4163795 - RNA, 59 nt, Human
ggcgcagcuggccaaucagggcgcccuggacuccgggaggccugcgagccacgcgcacc

SEQ ID NO: 4163796 - RNA, 60 nt, Human
ggcgcaguagcggggcccagagcauacaagggauugggcuuuggcuucucugcugcagcc

SEQ ID NO: 4163797 - RNA, 103 nt, Human
ggcgcccagaauauuuaauacccggcccuuuaugaaaagcucuguguaccuauguuuagaggggacagaaaaaugagggagcuggauuaauuuucuaaggccc

SEQ ID NO: 4163798 - RNA, 94 nt, Human
ggcgcccuggcagacacagucuccuuccgggagcaggcaggugcaaggcaggcaccggggcuuuggaaggggcugguggagaugcuugggugcc

SEQ ID NO: 4163799 - RNA, 86 nt, Human
ggcgccuccucaagcuacagggcggcgcgaucuuggcuacgccuuggccugaacguccucaccuguaacuugggacgagaaccgcc

SEQ ID NO: 4163800 - RNA, 100 nt, Human
ggcgccucuccccuccccgcgcgaguucccuggcccgcacguagcgcagcaccugcucgccgcugugcacccugccugccugcggguccucgggggcgcc

SEQ ID NO: 4163801 - RNA, 76 nt, Human
ggcgcggagagccuccggcuggggagcuaaaccgcuggggacuccgcggcugcugccugagucgcuguccgcugcc

SEQ ID NO: 4163802 - RNA, 60 nt, Human
ggcgcggcggucagcgugggagaggcugcaggcccugcacgccucugcagcugccgggcc

SEQ ID NO: 4163803 - RNA, 120 nt, Human
ggcgcgggcgugcugccacacuccuggagcuggcuuugugaacacugcgcagaacuuucagaguugguggggucuuucgucaucagugggaaacaggacguggugcaggucaugggugcc

SEQ ID NO: 4163804 - RNA, 108 nt, Human
ggcgcuagucacacacacuaacuagaaaucucuguuuacaucaugcagacacaaugggcugaaagugaaccaagcaacgagaucucugugugugugugucucucuguc

SEQ ID NO: 4163805 - RNA, 57 nt, Human
ggcgcucccgaggcggccucuugugcgauccagggcgcacaaggcugggagagcgcc

SEQ ID NO: 4163806 - RNA, 75 nt, Human
ggcgcugcugggugguggagccgcugcaguggccucuggugcugcuucugcagaggccucgccuccucuggcgcc

SEQ ID NO: 4163807 - RNA, 86 nt, Human
ggcgcuggacccggccccucaccuccgcggaccccgaggaacaagccggcaggugagggagccgcggucuccucgacgaucacgcc

SEQ ID NO: 4163808 - RNA, 58 nt, Human
ggcgcuggccacgguggcucuguccccucccucaacaggugcuccuggggccaacgcc

SEQ ID NO: 4163809 - RNA, 76 nt, Human
ggcgcuucaaguacauuguguuuuccugaaagccugggcugaggcauugagaaggaagguaaugaacugaggagcu

SEQ ID NO: 4163810 - RNA, 121 nt, Human
ggcggcaauagaacuaagauuaaaaucaacagcuggaguguuggugagguaucuguguuucuuggcaccaauuuuguuauucauuuaggaauguuguuuuaagggguguucauuagcuacu

SEQ ID NO: 4163811 - RNA, 74 nt, Human
ggcggcaggggugugggggccgugcaggucuucugcccgcauuggggcugcauuccuccaccuccugcacagcc

SEQ ID NO: 4163812 - RNA, 128 nt, Human
ggcggccgcccuucuccgcuuacuguucccggcuccccgcaggccgggugcucgcagccgggcuggcuaugccucgccuggcagcccagagcgccgcuccccgggaacagcacacaaaggcagccucc

SEQ ID NO: 4163813 - RNA, 123 nt, Human
ggcggccgggaagaggcgcuccucacuuccuagaugggauggcggccgggcggagacgcuccucacuuuccagacuaggcagccaggcagaggggcuccucacaucccagacgaugggcggcc

SEQ ID NO: 4163814 - RNA, 60 nt, Human
ggcggcggcccgggaccgagcaccagcacguaagccagcuccaggcccacggccgcggcc

SEQ ID NO: 4163815 - RNA, 106 nt, Human
ggcggcggggagcccccggcgcgccgcgcaccauccuccgccgggcaccgcggcggcgccucugccaagggggcugcgggucugggccgggggcgccgccgccgcc

SEQ ID NO: 4163816 - RNA, 78 nt, Human
ggcgggaagcacagccagguuaggggcugccugggagaguaguuuuggcuucagucuuggcuaugcgcaguaucugcc

SEQ ID NO: 4163817 - RNA, 58 nt, Human
ggcgggaggcuugugguguaagagcggugcacugugcauccacuagggcucucccguc

SEQ ID NO: 4163818 - RNA, 109 nt, Human
ggcgggcgggaggucacuguccugcauaccaggcuaauuggggucuggcagagugcacucucagacagcaggccuggauguguagcccugcaugcugaccucccccgcc

SEQ ID NO: 4163819 - RNA, 60 nt, Human
ggcgggcuccucagcgcaagagugggagaguucuccaccccugggugcagggagcgagcc

SEQ ID NO: 4163820 - RNA, 103 nt, Human
ggcgggcugagcuccugggcagggcaguuuggcaggauggaggggugugcaggccaaccccgggacaaucgccgcacugugcccagugguggggccccaagcc

SEQ ID NO: 4163821 - RNA, 64 nt, Human
ggggagcagaagcagcaacaacugcaaccaccaauuuucagcagcuguguugugccuucucccc

SEQ ID NO: 4163822 - RNA, 77 nt, Human
ggggagcagcagaagugcgugggaacagaguugaacaggauguggacuuggaccugagccuggcccugccgcucccc

SEQ ID NO: 4163823 - RNA, 56 nt, Human
ggggagcaggcugggcugucugggaacauuugcccuguaauaucaguuugcuucuu

SEQ ID NO: 4163824 - RNA, 58 nt, Human
ggggagcaugcuggccuguuggugugucugauuuucacggaaggccuagucccucucu

SEQ ID NO: 4163825 - RNA, 58 nt, Human
ggggagccagcagccggcaccaccaucagcugaugauggauugcccacgcgguuccuc

SEQ ID NO: 4163826 - RNA, 76 nt, Human
ggggagccagcucccuccuugugauccgaaccuuucauuuccgggcgugauaaagauggggcuguguuuaauuucc

SEQ ID NO: 4163827 - RNA, 62 nt, Human
ggggagccugcaagacuggagggaggagcagggacccauuccuccuuuugcuugugcuuccc

SEQ ID NO: 4163828 - RNA, 58 nt, Human
ggggagcgccagcauggacaggaaguagcacaugggcuggugcaggcugggguuccuc

SEQ ID NO: 4163829 - RNA, 56 nt, Human
ggggaggaaggaacaggaaaguucuugcacaaacuguuacuguuaauucauuuccc

SEQ ID NO: 4163830 - RNA, 59 nt, Human
ggggaggagaauggcgauauaagagaagcaugagcuaguuucuagucaaucuucuuucc

SEQ ID NO: 4163831 - RNA, 69 nt, Human
ggggaggagaggugggaccugcccuaggcccuggcaccuuugggcccucaccaggaaccucuccuuuuu

SEQ ID NO: 4163832 - RNA, 75 nt, Human
ggggaggcacaaccugggagagccuuuccugaguccagcuggagccagagauaaaggaggccucccugcuucccc

SEQ ID NO: 4163833 - RNA, 104 nt, Human
ggggagggagagagcagucuuguugggucgugaauucuguuuugguuccagggaaauaggguuuccauuacauauggugcaacaggauauuuccuccacgcucc

SEQ ID NO: 4163834 - RNA, 94 nt, Human
ggcuacaaagguuauuuucauuuguucuauguaacuugucaauaacaacaagguacaaaguuauacagcgugggaauauauaacuaggguaguu

SEQ ID NO: 4163835 - RNA, 82 nt, Human
ggcuacacauaugagaauguaucauugcacuggaggguuauguacucucagagcuucaccuguuacauucgcauggacagcc

SEQ ID NO: 4163836 - RNA, 56 nt, Human
ggcuacagacugcauaagggcagggaucauauucaccuuauuuugcugcuguagcc

SEQ ID NO: 4163837 - RNA, 57 nt, Human
ggcuacagaggccgugagccuggcuuucguccaugcugggcucuggcggcuguagcc

SEQ ID NO: 4163838 - RNA, 70 nt, Human
ggcuaccagcgcuggguguaaaggagaggaagaaaaaaucuuccuuuucuauccuucuagguucuuggcu

SEQ ID NO: 4163839 - RNA, 77 nt, Human
ggcuaccuucccagcaccugugugagcuagaugugggucauuuuauagaugagcaaacagaguccuguugaguaguu

SEQ ID NO: 4163840 - RNA, 76 nt, Human
ggcuacuaagcugguuuccuuaucuauaaagugggcuaauacuguggauuaaaugagauuauguggaaaaguagcu

SEQ ID NO: 4163841 - RNA, 87 nt, Human
ggcuacuaggucaggaacuucuaggaaagcugcggaugggcugcugcuauuccacugagggguucaaaucagcugagucuaggaguc

SEQ ID NO: 4163842 - RNA, 58 nt, Human
ggcuacugaaaaagaauccagaccucugaaaggguuugugacaaauuuuuuagaaguu

SEQ ID NO: 4163843 - RNA, 78 nt, Human
ggcuagaaauccaagaucuaggugucaacagguuugauuucucccaaggccucucucuuacuuaggcuuguuuuggcc

SEQ ID NO: 4163844 - RNA, 92 nt, Human
ggcuagaauauaagcaggcagaaaaaugugaaaugagagacuggccuagucucccagccuacaucuuucuccugugcuggaugcuucuugcc

SEQ ID NO: 4163845 - RNA, 79 nt, Human
ggcuagagggguccugggaaggaagccagggaaggccacaccaucugccucuuucaucaggaaucuaauaucuuuuccc

SEQ ID NO: 4163846 - RNA, 59 nt, Human
ggcuagcacuguaaaggccaaaguagacaauuugcaggcucugguuuauagugccuucu

SEQ ID NO: 4163847 - RNA, 90 nt, Human
ggcuagcuaugaaggugggcaggaaaaacuaagggugauaacuuuaccugaauugauuugaccuguagggccauuaacuuuaugccuccc

SEQ ID NO: 4163848 - RNA, 65 nt, Human
ggcuaggagccgcugcacuaggugcuagggacccacugaauuuucaccagagcaguggcuugguc

SEQ ID NO: 4163849 - RNA, 68 nt, Human
ggcuaggcaggcucagagccuauaaaggauuaugccaucugaggaaaggacucuaguguguucuagcu

SEQ ID NO: 4163850 - RNA, 70 nt, Human
ggcuagggacacagauaaucacacagauaaauguaagucaucgucaguguucuaguuucugucuuugguc

SEQ ID NO: 4163851 - RNA, 106 nt, Human
ggcuagggaggagggcaggcuccccagcuggggcaacgcaccagcuccuugaagcuguucuguggcucggccagcugcugaagccucuccuccugcucuggaagcc

SEQ ID NO: 4163852 - RNA, 76 nt, Human
ggcuaggggcaaagggguaggguagggagcaaauccagagaaacaugccauuuucccuccuuuccuccccucagcu

SEQ ID NO: 4163853 - RNA, 95 nt, Human
ggcuagguuggagccagccugcauuuguaucuguaucuuggaagcaaacuuagaaugcagagacagauguggcauggacgcugucagcucuagcc

SEQ ID NO: 4163854 - RNA, 92 nt, Human
ggcuaguauuuuuaauuuugaugagguucaguuuauuaauuuuuuccuuuuauggauuuugcuuuuggugucaagucuuacaaauauuugcc

SEQ ID NO: 4163855 - RNA, 58 nt, Human
ggcuagugggacugugcaagaaguucccaggaacugcuugaugaagcucccacuggcc

SEQ ID NO: 4163856 - RNA, 60 nt, Human
ggcuaguucugugcugugauuccaggaguugcuucuggaaauggguauagagcacaugcc

SEQ ID NO: 4163857 - RNA, 90 nt, Human
ggcuaguuuaauggagaagggcaugguaguuuuaaaguuucuguugcuugaauugcugaagcugaguguuccucugcgugugugcuaguu

SEQ ID NO: 4163858 - RNA, 94 nt, Human
ggcuauaaagucagccagagaacaucucugagaccucagcuggggagaagcuauccccugaccgcugagauucaagacccucuggagaacugcc

SEQ ID NO: 4163859 - RNA, 64 nt, Human
ggcuauaacugcaaaaaugguagucuuaacaaugcuguuuucacacuugauuugcaguuaaguu

SEQ ID NO: 4163860 - RNA, 60 nt, Human
ggcuauacuucuuugauguucacagggaggaccucucugaggaauaagaaggaaguggcc

SEQ ID NO: 4163861 - RNA, 64 nt, Human
ggcuauagugucucuagaucaaagacagaggauuuccuccucacucuggaguccgcuaccagcu

SEQ ID NO: 4163862 - RNA, 55 nt, Human
ggcuaugaauggcugcauuuguaucuacauacaaacuucaguagugucaucagcc

SEQ ID NO: 4163863 - RNA, 79 nt, Human
ggcuauggaugguucugggcggcagcaggugcuagagacaaaggcauaugcuggggcagaagagccaagaucaggagcc

SEQ ID NO: 4163864 - RNA, 57 nt, Human
ggcuauugaugagaucucugcacuccuauuuuuauugcagcacuguucacaauagcc

SEQ ID NO: 4163865 - RNA, 100 nt, Human
ggcuauuucaggagcugcuugccuguggcuaguuggcucuguuggauggagcagugaguuaaugaggccaagggcaggaggcugacuuucugcaaaagcc

SEQ ID NO: 4163866 - RNA, 66 nt, Human
ggcuauuugaugguucuaaaacagcuuguaguuaagcuguggggagagaacacacaagcaguagcc

SEQ ID NO: 4163867 - RNA, 55 nt, Human
ggcucacaaaauguugcuuaauaaucaugcguugguucuguaacauucuguagcc

SEQ ID NO: 4163868 - RNA, 69 nt, Human
ggcucacagcacagagugguauggcugccagacuaaauuaugugcuugucauuuuucucuguguugucc

SEQ ID NO: 4163869 - RNA, 76 nt, Human
ggcucaccaagcagagacucugggaagaggcccaguggccucccagacagaccagagguccugcucacuggugucc

SEQ ID NO: 4163870 - RNA, 88 nt, Human
ggcucaccccacucguuuagguagcuuuggcguuucuuggcuguuggacccaaguagaacagagcuaccuugcccaugggauggagcc

SEQ ID NO: 4163871 - RNA, 64 nt, Human
ggcucacgccuguaaucccaacacuuugggaguccaagguggguggaucacgaggucaggaguu

SEQ ID NO: 4163872 - RNA, 60 nt, Human
ggcucacgccugucaucucaacuacucaggaggcugagaggugaaaggauaguuugagcc

SEQ ID NO: 4163873 - RNA, 71 nt, Human
ggcucagagagguuugugucuugcuuaagguuguacagccaggaagucagccaagcccaccuucugguucc

SEQ ID NO: 4163874 - RNA, 79 nt, Human
ggcucagauccucagccggcgggaaguucuugcccacuuucauaaagagggcugcaaucuuauugcugcguaggaagcc

SEQ ID NO: 4163875 - RNA, 95 nt, Human
ggcucagcugggcaguuuuucugcuggucucacuagucacuugugcugcuguauucagcuggugggucggcugggagagcugcaaugacugggcu

SEQ ID NO: 4163876 - RNA, 60 nt, Human
ggcucaggcuggagugcaguggggcaaucuuggcucacugcauucucagccuucuggguu

SEQ ID NO: 4163877 - RNA, 56 nt, Human
ggcucagggaaugaggaagaauucugucuuuugacuucugucuccuucuccuagcc

SEQ ID NO: 4163878 - RNA, 109 nt, Human
ggcucagggccuccagcggcugcacagcucagggccuggcugcggacucuggcgugcauggggucugggucugggcuguggagagugagaugcauggaccucucgagcc

SEQ ID NO: 4163879 - RNA, 80 nt, Human
ggcucaggucugugguggccgcgggagagccagcuccacgcuguguggcuggugacauuuccggcugccagggcccagcc

SEQ ID NO: 4163880 - RNA, 105 nt, Human
ggcucaucaugcuguucuucugggguuccggguuggaagcgggggcgggauaagcugagcuuugcuggaagccuggggacuucccgcgaagggugcgguggagcc

SEQ ID NO: 4163881 - RNA, 68 nt, Human
gggauagcuuggcuucugauguauuccugauuugugugucgugaacagcagguugccagaaagguucu

SEQ ID NO: 4163882 - RNA, 56 nt, Human
gggauaucauugagcccaggaguuugaaaccagccugggcaacauagugagauccc

SEQ ID NO: 4163883 - RNA, 77 nt, Human
gggaucaagcauauauaaaacugcaggggagaagagcagcucuuaccuuaauuuuuacauguuugaguuauugcccc

SEQ ID NO: 4163884 - RNA, 58 nt, Human
gggaucaagcugaacacugucuucaaggaugaaaucauauccuuguugagcucguucc

SEQ ID NO: 4163885 - RNA, 68 nt, Human
gggaucaauggcucugggugaauggcagauugcagcagcaauugcuuucuuaccaagagaauuaucuu

SEQ ID NO: 4163886 - RNA, 78 nt, Human
gggaucagacucgaaggggcuaucacgggacaugcccagguacagggccugcuucucagugagcuuggucagcuucuc

SEQ ID NO: 4163887 - RNA, 63 nt, Human
gggaucagcagacacagauaugcauauggcuuuuggagcccugugugaucugcuguuagcccc

SEQ ID NO: 4163888 - RNA, 77 nt, Human
gggaucagucuguguuuauagguuuggaaacuauaacaaggaagcauacuagucuaacuugugaguauagaugaccu

SEQ ID NO: 4163889 - RNA, 105 nt, Human
gggaucauucacacuuucuguauuccauuuggaauuccauuucugcauuuaaauuuauuuaagcagaugaaucccagauaaaguagaagccuuuggaugcagccc

SEQ ID NO: 4163890 - RNA, 65 nt, Human
gggaucugucuuuaguacaaaaaaugucauguuuauaauaauacagacauuuaaauucagaucuc

SEQ ID NO: 4163891 - RNA, 77 nt, Human
gggaucuuguuaaaaugcagaaacugauccuguaugucuggaggagaacuaagacucugcauuucuaauaagcuccc

SEQ ID NO: 4163892 - RNA, 62 nt, Human
gggaugagcucauccgagucacacugggccagggcucagccuauuccaggaugagcucaccc

SEQ ID NO: 4163893 - RNA, 72 nt, Human
gggaugauaguguuggcacugcgguaguguccucuccuaucucuuucuaccaucuguaaacacuuucauucu

SEQ ID NO: 4163894 - RNA, 67 nt, Human
gggaugcauccaucuuuccugcugaacugugagcccauggucaacaggcagggaugaaaugcaucuu

SEQ ID NO: 4163895 - RNA, 60 nt, Human
gggaugcgggguuccagguagcagcugagaacacggcuggugccuccucccugugcuucc

SEQ ID NO: 4163896 - RNA, 83 nt, Human
gggaugcucucuggaggccacuguacagauuguauggaugcaggccacguaaccuguuaagggcugacccaggauuucauccc

SEQ ID NO: 4163897 - RNA, 58 nt, Human
gggauggaucuuggcugaggcuggguuuuucuugcuagcuucuuucauuuuccauccc

SEQ ID NO: 4163898 - RNA, 63 nt, Human
gggaugggagugaugguguucuuagaccuucgcacgguuucugagcacguucauuuaaauccc

SEQ ID NO: 4163899 - RNA, 58 nt, Human
gggaugggcagagguucaacuucaacaauaugguuuguuuucugggcuguugcccccu

SEQ ID NO: 4163900 - RNA, 64 nt, Human
gggauggggagcuggaaaggggaaggaauaggaagauaaucuuccccuggaguuugacuauucc

SEQ ID NO: 4163901 - RNA, 65 nt, Human
gggauggggggaagcguccaugcgccauggugggcgcccaccgcucugguuguuccccucaucuc

SEQ ID NO: 4163902 - RNA, 60 nt, Human
gggauggguggguucugugagaggggcuggggagcuccucuggcaccccccaccuguccc

SEQ ID NO: 4163903 - RNA, 71 nt, Human
gggauguccaggaggcuuugggauccaagucuuggaguuuagaagacggauuugggccuccugcccagccc

SEQ ID NO: 4163904 - RNA, 75 nt, Human
gggauguuauaaagcguugugcccugguagcagaacaauuacugcuucaaauggguaugcuuuauaauaaaugcc

SEQ ID NO: 4163905 - RNA, 56 nt, Human
gggauguuuugaacugaaggccucaguaccuugcuggcuguuaguugggggcuccc

SEQ ID NO: 4163906 - RNA, 80 nt, Human
gggauuaaugaguacccagggaaugugggaugacucuaggcuggagcuggggucauuaaauuccgcuggucauuaauccc

SEQ ID NO: 4163907 - RNA, 91 nt, Human
gggauuacaggcgugagccacugagcccggccauuguuuguuuauaugcucugcuaauaaugguuuggcucugugucuccacccagaucuc

SEQ ID NO: 4163908 - RNA, 60 nt, Human
gggauuagcuuucuuggagaauuacauggucaugauuuucacccagaauagcugcuaccc

SEQ ID NO: 4163909 - RNA, 120 nt, Human
gggauuauuugguauucaugugagcaguuagguuuugugucagaguagaaugaccacucuaucaaaagcuccauacuauuuugacaugaaauugaucugcaaacaccuauccagaauccc

SEQ ID NO: 4163910 - RNA, 55 nt, Human
gggcucuguucuccuuugcaucucgggacaccccgaggucucagagcaagagccc

SEQ ID NO: 4163911 - RNA, 61 nt, Human
gggcucuucucucaggcuugauggaugggggaccggggcccggaggucugaggaagagccu

SEQ ID NO: 4163912 - RNA, 104 nt, Human
gggcugaaaggacugucugaggaucuucugaaauuuuguguacuuacauuuuucuaggaaaaggguacaaagauuucauaagauuuauaaggaggucuaugccc

SEQ ID NO: 4163913 - RNA, 67 nt, Human
gggcugaaaugccuuguaaauauuauucuguuuagaagauaguuuuaaaauguggcguuuuaugucc

SEQ ID NO: 4163914 - RNA, 69 nt, Human
gggcugacucaaccuugcaaaggcuauugaaucucaggaaguagaauuuugcuuuauugaguuagaccu

SEQ ID NO: 4163915 - RNA, 65 nt, Human
gggcugagugggccucuuacuugaaaagauucauguucccuucuagagagaaggccauauggucc

SEQ ID NO: 4163916 - RNA, 103 nt, Human
gggcugcaggcuggacacccaggagagucaagggugcagaggaaguccgaaggcagacugcuggaggauucacucuugcucaggguggccagacuuuugguuc

SEQ ID NO: 4163917 - RNA, 82 nt, Human
gggcugccuggaaagaggaaggaagccuggcaucucuggacacaugacccccaggcucuuuuuuggugcuuuccgugcuccu

SEQ ID NO: 4163918 - RNA, 99 nt, Human
gggcugcuuuccugcuggcauucuugcucccuggacagauucuugcaauacccagguagcaguagccugccagcgugguuuugauaaaagcacaugccc

SEQ ID NO: 4163919 - RNA, 79 nt, Human
gggcugcuuuggaaagcauggaaaccugaacuugaauccgccaguuaagugcuguuucccagccucagcucagcagcuc

SEQ ID NO: 4163920 - RNA, 64 nt, Human
gggcuggaacucaggaugguuaggaugcagcucaagccuuguggcaucucuggguucucugucc

SEQ ID NO: 4163921 - RNA, 76 nt, Human
gggcuggaccaccagaggccccgaccagcuuguccgaaagggugggcugcucggagccuccugugaguaccaggcc

SEQ ID NO: 4163922 - RNA, 99 nt, Human
gggcuggagccaggcaaaacugugagguuagcugggauuucaugagucacccuuuuagaccucccagcaaucucaugccaugaauuugcaucugagccc

SEQ ID NO: 4163923 - RNA, 70 nt, Human
gggcuggaguuggcaaggcauguacagcaggacaaggugauaccaaacuuuauaugcagccaacacuccc

SEQ ID NO: 4163924 - RNA, 56 nt, Human
gggcuggaguugggaagacaaacuguuucugcugcguuuguguucugacccagccc

SEQ ID NO: 4163925 - RNA, 57 nt, Human
gggcuggaucucacgugagaccuuaaaguuccuccugucucauuuggauucuagcuu

SEQ ID NO: 4163926 - RNA, 90 nt, Human
gggcuggaucuggugauaccucagcccaacccagcacuguggucuccauggcugccuguccugaggaguccgggccggagcuccaugccc

SEQ ID NO: 4163927 - RNA, 82 nt, Human
gggcuggaucuuuucugcacaaauuaaucaguuaaugcauagaaagcauucaacuagugauuguguuauaagagaucugcuc

SEQ ID NO: 4163928 - RNA, 64 nt, Human
gggcuggcccugucugcacacaggauuagggucaccagucuggugggcaggcacgggcugaccc

SEQ ID NO: 4163929 - RNA, 75 nt, Human
gggcuggcucaugcaucugggcuggcuggugaggauggcacuggccagcuguaagcuggggugaugagccugccc

SEQ ID NO: 4163930 - RNA, 60 nt, Human
gggcuggcugguagaauugugaccucugaaugacagauccaguuagaccacaguuacccc

SEQ ID NO: 4163931 - RNA, 66 nt, Human
gggcuggcuugggccaagagcagcuggcacugcagaucuguuggaauagcucugcccaggcugccc

SEQ ID NO: 4163932 - RNA, 57 nt, Human
gggcugggaggugagucuggggugaaggccccaaucacccccacaccuccuuaguuc

SEQ ID NO: 4163933 - RNA, 75 nt, Human
gggcugggcaggccucaugguguguccuuccuccugagggugaagggcaagauacgugagcauggccucagaccc

SEQ ID NO: 4163934 - RNA, 61 nt, Human
gggcugggccucucccucagcugugugggccaaggccucggcccagggggaggcugagccc

SEQ ID NO: 4163935 - RNA, 87 nt, Human
gggcugggggaaggauuguuuagcacuuacuguuuucugugacaguaucaggaguuuagccaauuugguccccauuugaaucaguuc

SEQ ID NO: 4163936 - RNA, 68 nt, Human
gggcuggugcugcuuucagcaucuauucagagguuucugaaucuggcauuugagaguaggacugggcc

SEQ ID NO: 4163937 - RNA, 69 nt, Human
gggcugguuaccuuauucauuugagccaguaaauauuaccuggccucacucugcaggaaggagcagccc

SEQ ID NO: 4163938 - RNA, 78 nt, Human
gggcugguuucuaccugcaucuccaggagguggcugucccuucagugagcaggcugggagcagcugggaacacagccc

SEQ ID NO: 4163939 - RNA, 55 nt, Human
gggcuguaccaagugcccgcugccgaggucgcugugacgggcgcggguagagccc

SEQ ID NO: 4163940 - RNA, 58 nt, Human
gggcugugucaaggauguugcuucucagcaggggcacagaagucuaagacaucagucc

SEQ ID NO: 4163941 - RNA, 66 nt, Human
gggcugugugcaguacggguccccugaccaguaugcaggucauuaaaccaaaccgcaugcuagcuc

SEQ ID NO: 4163942 - RNA, 55 nt, Human
gggcuguuccuuccacccagaggcaacuggagccuuccuggggaaggagcugccu

SEQ ID NO: 4163943 - RNA, 57 nt, Human
gggcuguuugcaggaggcgucaguguuuagcaacguggccucucuaccaggcagccu

SEQ ID NO: 4163944 - RNA, 64 nt, Human
gggcuuauugauuaaaacacagauugcugggcccugcaaaaaaaguuucugauucaguaggucu

SEQ ID NO: 4163945 - RNA, 74 nt, Human
gggcuucccggcgcugggaggugggucugcuuuuacagagaccuccguguacaccucccagcgccauuugcacc

SEQ ID NO: 4163946 - RNA, 61 nt, Human
gggcuucuacuugcaaaggauagggagagcuucuguucauccuugugaaguaggcuggcuc

SEQ ID NO: 4163947 - RNA, 88 nt, Human
gggcuucugggauaugggugcucuaggggucagugguuagaggccauaugacuggugccugugggguagcuuuuguuccauguggucu

SEQ ID NO: 4163948 - RNA, 64 nt, Human
gggcuucuugagcugccggcccuggggcauugagccucaggaggcccucgggcucaaggggccc

SEQ ID NO: 4163949 - RNA, 59 nt, Human
gggcuucuugccauggggacggggcuaccaugagccuagucacaacauucaggaguccc

SEQ ID NO: 4163950 - RNA, 62 nt, Human
gggcuugagguagaaaaagcuuguaguguuugagacaugaaaagccugucuagcuggaguuu

SEQ ID NO: 4163951 - RNA, 69 nt, Human
gggcuugcuuuuauuucuucacaaaaguagaagauaacucuauuuccuggaggaauggaagcaucuccc

SEQ ID NO: 4163952 - RNA, 57 nt, Human
gggcuuguuugugccucugcagaaccaauccaguuuuacaggaacaaaaacaaaccc

SEQ ID NO: 4163953 - RNA, 67 nt, Human
gggcuuucugagucaaacacugaaaagcugaacauuuucagucuuuaaaagcucaggaacugggccc

SEQ ID NO: 4163954 - RNA, 78 nt, Human
gggcuuugagaccagccugcuauguccccucagaucuggccucugaggccccugggcaggauggcauuuucacugccu

SEQ ID NO: 4163955 - RNA, 82 nt, Human
gggcuuuggagauggaggcagguggaggagugaaggcccaaggauggcucuucagcccuucccuguuuucaucagccagccu

SEQ ID NO: 4163956 - RNA, 84 nt, Human
gggcuuuuuaaaacuugcugaagcugccaaaccaguguuguguucucacaucccagaauccuagcauuguugggggcaaagccc

SEQ ID NO: 4163957 - RNA, 66 nt, Human
ggggaaaaccuguuuccugucuucucacuaugucuccacaugguguaauggacaagggaacucucc

SEQ ID NO: 4163958 - RNA, 75 nt, Human
ggggaaaaguaauugaugcaaucguauaguucaaaugcuuaacaggauuuaggauaguuuaaauugguucuccuc

SEQ ID NO: 4163959 - RNA, 69 nt, Human
ggggaaaggauagggaaugggucugagggcaaagaggccuagaacagcacaucuucugaucuuuugccc

SEQ ID NO: 4163960 - RNA, 90 nt, Human
ggggaaaggcagccagagaauggaugguuccucugaguagguucauuuauuaaaucuaccaugugcugugcauuggcugggcguuucccc

SEQ ID NO: 4163961 - RNA, 73 nt, Human
ggggaaaugucgucuucccugcccaaggcuguguugugacggcggcaugucugggcaagggagauggcgccuc

SEQ ID NO: 4163962 - RNA, 58 nt, Human
ggggaacagugacugugagggaccuguguccagcccugcucucuaguccugccucccc

SEQ ID NO: 4163963 - RNA, 72 nt, Human
ggggaagaggcgugauggauccaagacaggacguugaccucacccuggagaucucccucaugcccauucccu

SEQ ID NO: 4163964 - RNA, 107 nt, Human
ggggaagaugucccagcucuggacucagcacugauccucaugaagagcugcucgaccccaucguguauguuuacagaggaagugccuccauggcccacuucuucccu

SEQ ID NO: 4163965 - RNA, 65 nt, Human
ggggaagcugggaacuagcgggggaaaguggucuccugccacucugccccgaguucugggaaccc

SEQ ID NO: 4163966 - RNA, 58 nt, Human
ggggaaggagggccagggggacccuugggcaaagccgggggcugggcccuguuucucc

SEQ ID NO: 4163967 - RNA, 76 nt, Human
ggggaaggaguaguucuuauuuuggaacugaggcuucagugcaguuguagcucaaggguaaggacaccuccucccc

SEQ ID NO: 4163968 - RNA, 73 nt, Human
ggggaaggcagugagaucuuggagggugagagcacgcucuacacccagguaccgugauuucaucagcacccuc

SEQ ID NO: 4163969 - RNA, 85 nt, Human
ggggaaggcucagaagggcaccuucagucggaggguggagaaccaggucugggagccuucugcacugaccuuuugucccuucuuc

SEQ ID NO: 4163970 - RNA, 68 nt, Human
ggggaagguuugaaauagguauagaagaagcuaagugcaauauucuguuuauauuucaaaccuucuuu

SEQ ID NO: 4163971 - RNA, 85 nt, Human
ggggaaguccagguagcauugcuuauuucagcuaaaguugagaauaaauacaauuaaaugagcuguggcacugcccuuggccccc

SEQ ID NO: 4163972 - RNA, 59 nt, Human
ggggaagucugagauucccuuuaccugagaaggaaagucaguuggccagaucacucccc

SEQ ID NO: 4163973 - RNA, 88 nt, Human
ggggaagugaguuaaguggauuuagauaaugcuuuuuguucuggcugaaaguauucucccugaauuuucuuccuugaaucccuucucc

SEQ ID NO: 4163974 - RNA, 76 nt, Human
ggggaagugcagauuaacaaauuucauauccaauaauauuuauugaguguuugcuuuguuaaacugaaaauucucc

SEQ ID NO: 4163975 - RNA, 93 nt, Human
ggcugggaagucauauaguacagccauugagagccaggguucuagaaucugccccugcucugcugcuuacuagauggugacuuuaaaccugcc

SEQ ID NO: 4163976 - RNA, 76 nt, Human
ggcugggacugacuuaggcgagcagcugcucuuaccaggggccacugggcaugcuugccaugggccagugcuggcu

SEQ ID NO: 4163977 - RNA, 77 nt, Human
ggcugggacuugggcuaugcucuggacaaggcuggcuggugcaaugaugcccucuagaggauggaucaggcccaguc

SEQ ID NO: 4163978 - RNA, 69 nt, Human
ggcugggaggguagguaauuucucaugaccacauagccacacagagaaaguccugaucucucuaaugcc

SEQ ID NO: 4163979 - RNA, 66 nt, Human
ggcugggagugagugggcauguugcacauugagaaccucuuuacacaauugcccauccuccuagcc

SEQ ID NO: 4163980 - RNA, 80 nt, Human
ggcugggaguguaaggugcucacgggcucagggagggcuuggaaccucccuuuguacucaccagcaccacgcucugagcc

SEQ ID NO: 4163981 - RNA, 129 nt, Human
ggcugggcacaaggucgggaccagcgucgugcccagccuuugggucagaagauuccacaggaguagggcuggggguggaucuggagccggggagggguuuggagcugggauccggcagagugcccggcc

SEQ ID NO: 4163982 - RNA, 90 nt, Human
ggcugggcacaguggcucaugccuggaaucucaccacuuugggaggccuaggugggaggacuguuugaggcauggaguuugagaccagcc

SEQ ID NO: 4163983 - RNA, 67 nt, Human
ggcugggcacauggauagacucacugcugugaaaaauaugagugaaguaaaagaugugcauccaguc

SEQ ID NO: 4163984 - RNA, 75 nt, Human
ggcugggcuccugugggugggccagaucagguuggguauuggaaaaggccuccccauaggaauugcauuucagcu

SEQ ID NO: 4163985 - RNA, 69 nt, Human
ggcuggggaagcugaugacgcuccccuggcagcccuggggcggcggcuccaccagcuucuucaccagcu

SEQ ID NO: 4163986 - RNA, 60 nt, Human
ggggagaugauaagugcauuuguuucaccaagagugguuuaagaacauuaucuucuuccu

SEQ ID NO: 4163987 - RNA, 61 nt, Human
ggggagaugcucacgguucccucacuugcugcuccuguagaggagcuggcagcgucuccgc

SEQ ID NO: 4163988 - RNA, 121 nt, Human
ggggagcaacaugaaugaugccaggaaaggcuuucacggcacccagggaaucugcauuacguauuugcaaauuaaauuggacgcugggggaagauccugguguggugagcaacagcucccc

SEQ ID NO: 4163989 - RNA, 59 nt, Human
ggggagcaggggcucugcugccguccccuggugaguuacgguagcagcugcugucaucc

SEQ ID NO: 4163990 - RNA, 77 nt, Human
ggggagcggcagcaucuguacauagacgcucaauaaauaucugucgaaggagugagugaacaaugucugucaacccc

SEQ ID NO: 4163991 - RNA, 72 nt, Human
ggggagcucuaagaccucuucuaugaacgcaaaaaauacggcuucaagaagaggugauugguaaguggcccc

SEQ ID NO: 4163992 - RNA, 61 nt, Human
ggggagcucugaggcauaaccuguucugcuuugaaaucaguggcaggcuucuuugcucccu

SEQ ID NO: 4163993 - RNA, 123 nt, Human
ggggagcuguugacucuauuagaaacuaguuguagagaaagaucuuucauuaggcacugucagcuaugugucugaguuagcucuucucaguaauuaacuaauuaaauuaaguugucagccccu

SEQ ID NO: 4163994 - RNA, 70 nt, Human
ggggagcuuagggucucugaaugcugcagcuuccccugucaagcagagaaaagcuuagguucaguucccc

SEQ ID NO: 4163995 - RNA, 77 nt, Human
ggggaggaacaaugccugaugaccuccuggggccucagauggcccccaccaugagccuacaggugauuggacccccu

SEQ ID NO: 4163996 - RNA, 55 nt, Human
ggggaggagcccacagcaggcuccuaugucacaugagccuggggaauuccacccc

SEQ ID NO: 4163997 - RNA, 88 nt, Human
ggggaggcaggcacaaaaggaccccagcaugcagguucccccauucaggcagcagguucuguuuggcuccuuacuguccuguaucccc

SEQ ID NO: 4163998 - RNA, 57 nt, Human
ggggaggccagaaucuguguuggacuggccagagucuagccugucaucagccucucc

SEQ ID NO: 4163999 - RNA, 77 nt, Human
ggggaggcccaagggacugagggugcacaggcaggcagacgggcuggagcugccuggcaccuacaggggguucaccc

SEQ ID NO: 4164000 - RNA, 59 nt, Human
ggggaggguucaggcgagugugauucuagaagacaaugcagccuauggauccagcaccc

SEQ ID NO: 4164001 - RNA, 71 nt, Human
ggggagguacaagcuuuuagugauauuguuugagucuuggauaaagauucacuugaagcuagaaucugccc

SEQ ID NO: 4164002 - RNA, 61 nt, Human
ggggaggucagcuggaggggaggcuggcaccuuccaagccccucuccuugugcaccugcuc

SEQ ID NO: 4164003 - RNA, 104 nt, Human
ggggaguacuguugguauagcagaggacaguucuuuguugugugggaguugucaggcuugugcauugcaguuaacucaguauucuugcccuccacaacaccccc

SEQ ID NO: 4164004 - RNA, 73 nt, Human
ggggagucuaugggaacaguagcugcugagcucugugccagauccggcggcuucuguaucagaaagacagccc

SEQ ID NO: 4164005 - RNA, 87 nt, Human
ggggaguggaaccugagcccagguggcauuugguggcccuguaguuucagagagugagugccaaccugagcugguucccccugcccc

SEQ ID NO: 4164006 - RNA, 73 nt, Human
ggggaguggaucagauauucucuaagaacaauucuugcucugagaacucuuugauuguaucugggcauuccuu

SEQ ID NO: 4164007 - RNA, 72 nt, Human
ggggaguggcaggagggcaucacuuggaagccgacauuaccugucccuagagccgcaccuccuccacacccc

SEQ ID NO: 4164008 - RNA, 92 nt, Human
ggggauagugaugaugggggaugcuauguuugugugagggcagauauuauauaggacauguuuguaucuuccuuucaauuuugcuauaaacc

SEQ ID NO: 4164009 - RNA, 66 nt, Human
ggggauauauaaccuggauaaggcuuucaauuuuuauauuuaagcuguuacucaguuguuuucccc

SEQ ID NO: 4164010 - RNA, 73 nt, Human
ggggauauaucguguuccuggguugagaggauucuuucaacacaggaacaugauauaaaugucaguccucccc

SEQ ID NO: 4164011 - RNA, 87 nt, Human
ggggaucacuucagcccaggaguuggaggcuacgguaagcugugaucacaguacugcacuccagccugggugacagagugagacccc

SEQ ID NO: 4164012 - RNA, 62 nt, Human
ggggaucauuuaaaacaagucucuauuuuacaggugaagaggaagaugguugaguggucccc

SEQ ID NO: 4164013 - RNA, 81 nt, Human
ggggaucugccggcaucuucguggucgcaggcugcucugugccacugugccacugggggccggcaauacugcuggauuccc

SEQ ID NO: 4164014 - RNA, 72 nt, Human
ggggaugcacagggagggggccagcuccauucugccuugagaggccugugcuuucuucccuccugccacccc

SEQ ID NO: 4164015 - RNA, 78 nt, Human
ggggauggggggaaggguuguuaaugaucugaguuuauuaaaugucagaauuauguaggccugguucuuuccucugcc

SEQ ID NO: 4164016 - RNA, 60 nt, Human
ggggauggugggaaggcaaucuggccaggagaagcugcgcgggagacucccgccaucccc

SEQ ID NO: 4164017 - RNA, 107 nt, Human
ggggauugggcacuuccuguuuccaggcagcuggaaaacuccaggcucugaaaacgcucuuuauucuaagucuggcagaucgagcagcccagggaagccgauucccc

SEQ ID NO: 4164018 - RNA, 92 nt, Human
ggggauuuuugacaucguaaagcccuauggcuucaugugacagaugguacaauugaggccuagggucuugguuaugugugaauugagucccu

SEQ ID NO: 4164019 - RNA, 56 nt, Human
ggggcaaaaaaagggaguuauuuaauacuuccccuaauaacucuuuccuuuucccc

SEQ ID NO: 4164020 - RNA, 81 nt, Human
ggggcaaagcuugguuuugggauguacaaaggggucagagaugccucauuuucugcuuucaaggcuucauaguuuugccuc

SEQ ID NO: 4164021 - RNA, 72 nt, Human
ggggcaccauaaugucuguuugcugagcccggcaggcucuggagccgcuggugagcgcacagacacagcccc

SEQ ID NO: 4164022 - RNA, 74 nt, Human
ggggcacuuaggcauuuugcugcaggauuuuugauuuaaacaauuuuucaugcuaguaugugcuguucugucuc

SEQ ID NO: 4164023 - RNA, 76 nt, Human
ggggcagagccccugggaguagcugcugccugggauggaagaaggggagcagucagggccccgggggcccugugcc

SEQ ID NO: 4164024 - RNA, 82 nt, Human
ggggcagauuacuaaguuuuaugcaacuuagaagcaaauuuucaaauauucuauggguuuguauacuuaguauauuaguuuc

SEQ ID NO: 4164025 - RNA, 57 nt, Human
ggggcagcaugcaggaaccacauggcaaggauugccauguugugcugcuguggcucu

SEQ ID NO: 4164026 - RNA, 82 nt, Human
ggggcagccguguggcggggagccggccgggccuuccugcucaucgaggaccugacuggcuccugcuucgagccacugcccc

SEQ ID NO: 4164027 - RNA, 62 nt, Human
ggggcaggacagacauggcggagccugggccagacccccaggugcagcccuggaccugcccc

SEQ ID NO: 4164028 - RNA, 89 nt, Human
ggggcaggauuaaggugaggggaguaaagucauguuacacagaaaaaaacauucaguaaucaacaugcuucccucacuucaccuggccc

SEQ ID NO: 4164029 - RNA, 68 nt, Human
ggggcaggcagagaaggaacauuuacucaguaucuacuuuguaagugacacauuuugcuaagugcuuu

SEQ ID NO: 4164030 - RNA, 72 nt, Human
ggggcaggccucacagcauggaauuuucuggccccaaaugucaguagggcuguguuugagaaacgcugcccu

SEQ ID NO: 4164031 - RNA, 79 nt, Human
ggggcagggacaaagugagaaaggaauaucaguggggcagauccagaguucauuucuuugcuuauuuuauucuuuuucc

SEQ ID NO: 4164032 - RNA, 101 nt, Human
ggggcagggacaagucacagugguggaacgucguaauguugguuaaucaguuaaggcaggaacuggcuguuuuacuucuuuugugguuuuucggcugcccc

SEQ ID NO: 4164033 - RNA, 62 nt, Human
ggguuagguucuagaggcacaaugaugaauaagguuacuugaucugucuuagagcuugaccc

SEQ ID NO: 4164034 - RNA, 83 nt, Human
ggguuaguuuguagagcuccuggcuucugaaaucgugguuuugaaggacgauuaugacuuuggauaggcaggaaagguaaucc

SEQ ID NO: 4164035 - RNA, 76 nt, Human
ggguuauaaccaauuuaaauauaaagacuacaacuaaauauguauuucuagauauggagagugguacuguuaaccu

SEQ ID NO: 4164036 - RNA, 74 nt, Human
ggguucaaauucuugcucagaugcuugaaaucuaagugaauuuagauacaggcucucugagccucaguggacuc

SEQ ID NO: 4164037 - RNA, 58 nt, Human
ggguucagagucaggugugauacuauugauauacuaucaguuccccuccucuguaccu

SEQ ID NO: 4164038 - RNA, 95 nt, Human
ggguucccagccgccucgcaagucgcuccgguuacugggcucaaccgaugugcucccccauaaaguggcugagugacugugacuccuuggagccc

SEQ ID NO: 4164039 - RNA, 61 nt, Human
ggguucccaggaugccucugcugcuaauuaggaaugaggcagugagaggucuccugguccc

SEQ ID NO: 4164040 - RNA, 60 nt, Human
ggguuccuggagccaugucuugacugcucccgagcagauccauaaugguuucuggaagcc

SEQ ID NO: 4164041 - RNA, 101 nt, Human
ggguuccuggcgggggaguugcagccuggccguuuccuggagggcugggacugcccagcccagccgagggccuggcugcagcgccaccuucuaggcagccc

SEQ ID NO: 4164042 - RNA, 81 nt, Human
ggguucguauguaguucccgggcagcacagagugguggaaacaccaugugcauuggggccagggaggcaggcauggagccu

SEQ ID NO: 4164043 - RNA, 81 nt, Human
ggguucucuagagccagcugaguuacucugaggucuuggcaagugcagagauugagagcacagacugguguuggacagccc

SEQ ID NO: 4164044 - RNA, 70 nt, Human
ggguucugagcuguacuccuccccagggcaagauucugcuucugcugggaggcgcugcuucuaggagcuc

SEQ ID NO: 4164045 - RNA, 60 nt, Human
ggguucuguuauggaaguuuccuuuuuuggagggaaaggguuacuuucuuaacauaaucc

SEQ ID NO: 4164046 - RNA, 72 nt, Human
ggguucuuuuggggaagaggguuggccaguggcauuuucugcagauuugcuuucccuucccugacagauucc

SEQ ID NO: 4164047 - RNA, 59 nt, Human
ggguugagauggagaaggaagcuguuuaauaaaauuucuaauuucucucucucucucuc

SEQ ID NO: 4164048 - RNA, 88 nt, Human
ggguugagccugccugcaggugugcuuaaccugggccacagauuaaggcagguaagggagaaacaccugcagagguagguuuugaccc

SEQ ID NO: 4164049 - RNA, 73 nt, Human
ggguugaguggucauuagcuauuucaguaagacucccaagacuggaagcaaagcgcugagggccacccagccc

SEQ ID NO: 4164050 - RNA, 62 nt, Human
ggguugauguuauuuacauuguaguauuguugcgauuaagugaaauagcauuuaugaagccc

SEQ ID NO: 4164051 - RNA, 69 nt, Human
ggguugcgguaaaauaguguggagguggcuucuaaagauccuuauugccacuuuacugagcuguaauuc

SEQ ID NO: 4164052 - RNA, 75 nt, Human
ggguugcugugucugauggcugagacuuguguaugcuccagguagugacauuucuggccuuagagacggcuuuuc

SEQ ID NO: 4164053 - RNA, 65 nt, Human
ggguuggcuggaggcuauuccuugggagucagccccucccauuccagagcugccucugcuauucc

SEQ ID NO: 4164054 - RNA, 74 nt, Human
ggguugggaagaugauaauucacagugcccagaagauaguaaauauaguaagugaauuauuuucuccuccuccc

SEQ ID NO: 4164055 - RNA, 100 nt, Human
ggguugggagccuccgccugagaugcucuggggaguggagaugggcugaucagagcagggcccagcucuuccugggagcuaagccagcggccucccuccc

SEQ ID NO: 4164056 - RNA, 65 nt, Human
ggguugggggaaggagcuuggcgugccucuccacguagcagagcucuguucuuaucuccuugccu

SEQ ID NO: 4164057 - RNA, 79 nt, Human
ggguugguacacugguugaauuguauaacuggugauaucacugcugugguugaauaacucaugccaguauuugccacuc

SEQ ID NO: 4164058 - RNA, 88 nt, Human
ggguugguuccaagucuuugcuauugugaauagugccacaauaaacaugugugugcaugugucuuuauaguagcaugauuuauaaccc

SEQ ID NO: 4164059 - RNA, 64 nt, Human
ggguugugaggaggacccggggaagcccccuggacucgggcucccuggcucugccucagagccc

SEQ ID NO: 4164060 - RNA, 69 nt, Human
ggguuggccuagaauucucugguugaaaaguggugucagcuguggggagcuugggccaucaaucaaucc

SEQ ID NO: 4164061 - RNA, 90 nt, Human
ggguuggcggggagaggggcccuuuuucaggagacaguuuuccuuuuuaccuccuggaccugggguggccuccucuccacuggcaggccc

SEQ ID NO: 4164062 - RNA, 60 nt, Human
ggguugggacauguaagcuggaaguggcugcugucaguuuucuucauucucccacaaucc

SEQ ID NO: 4164063 - RNA, 94 nt, Human
ggguugggaugaacaagugcacuugaguacgcgcugcacaguguaggcaucaggccacgucagugugucucugcauuugggcagaugccaggcc

SEQ ID NO: 4164064 - RNA, 77 nt, Human
ggguugggcccugcugucccaggaaccugugauagugaaacuacacacuaaagcaacugagacacauaguucagccc

SEQ ID NO: 4164065 - RNA, 76 nt, Human
ggguuggggcaaacugagacacgaacuaugauuuggccaaaagucauuuugccagucuucagggaaugcuccgcuc

SEQ ID NO: 4164066 - RNA, 81 nt, Human
ggguuggucuggauaguucacaauggcuuuaccuaaguggguggcaugauggugaggauugcuggaagacugggcuaagcu

SEQ ID NO: 4164067 - RNA, 63 nt, Human
ggguugucagccaaaugagucauaaaugucaguaaagaaugugauuuuacacguuuggcuccc

SEQ ID NO: 4164068 - RNA, 59 nt, Human
ggguugugacccucgggacaguuugcaauaucuacagacaugcuuguuuuucacaaccu

SEQ ID NO: 4164069 - RNA, 79 nt, Human
ggguugugauaaugauacaaaucugaaaugcguuccaaaacauccuauguccauugagcuguuucauuauuacaacacc

SEQ ID NO: 4164070 - RNA, 64 nt, Human
ggguugugguagagcuuaaaugagguaaugcaugcacggaccccagcucugagccacaccacuc

SEQ ID NO: 4164071 - RNA, 56 nt, Human
ggguuuagauugcaagugcuagaagcauuuugcugaagcugcucucauccagaccu

SEQ ID NO: 4164072 - RNA, 90 nt, Human
ggguuuaggcuaaucugacuugucucuuugggagacauuuauuuuauuuucuuuuauauuuccuugagacggagucucgcucuguagccc

SEQ ID NO: 4164073 - RNA, 70 nt, Human
ggguuucaccaugauggcuaggcugguuuugaacucccgacuucaaaugaucugccugccucagccuccc

SEQ ID NO: 4164074 - RNA, 82 nt, Human
ggguuuccacugcuuauucacaugugaucucaugacauuguguugucugauacccucacuguaaacuaggucaguccuaccc

SEQ ID NO: 4164075 - RNA, 56 nt, Human
ggguuuccugggacaugagacuuucauuacgaaaacugggacagucccagggaccc

SEQ ID NO: 4164076 - RNA, 74 nt, Human
ggguuugcacaaggcuccuggcgugcgucugccccauggggugggugcuggaugccaggcugccuggccagccu

SEQ ID NO: 4164077 - RNA, 70 nt, Human
ggguuugcauaauguuuuaaaacaaauuuauagaaauauagaugauggaaaaaagcaauaggguaaaccu

SEQ ID NO: 4164078 - RNA, 77 nt, Human
ggguuugccagcgguuccccuaccccugacguggucuucucagcuccauagugcagaggaggagccucugcaggccc

SEQ ID NO: 4164079 - RNA, 84 nt, Human
ggguuugggaauaacacauagauauuuuaacuuuucgagagaggaaaaggaaaaaauggcuugugauagacauuuuuuggaccc

SEQ ID NO: 4164080 - RNA, 55 nt, Human
ggguuugguggaggggaagggcagugguucuugcccuugggcuuccacccagccc

SEQ ID NO: 4164081 - RNA, 62 nt, Human
ggguuuuauuaacuuuaacaucacugggcuuccagaggucuucugugugguuggugaaacuc

SEQ ID NO: 4164082 - RNA, 70 nt, Human
ggguuuucuuuuauauucuugucaaugugaugauuccaagaaucuuacaaguacugaauaugauuugccc

SEQ ID NO: 4164083 - RNA, 100 nt, Human
ggguuuugagcaguugucugaucaugaggcagggcugggguguggaguaaaucuuguuuucaauaaccuguugagugacauuuuauauugccauuggccc

SEQ ID NO: 4164084 - RNA, 60 nt, Human
ggguuuugaggcuucugagacugagugaaucauuugcuuaaacugaaagcuacaagauuc

SEQ ID NO: 4164085 - RNA, 106 nt, Human
ggguuuugagggaguugggguagaaaacuguaucuucuugggacuugaaucaaauguuuuaagucugccaagccagaucauguuagaccuucaccucuuagauccu

SEQ ID NO: 4164086 - RNA, 82 nt, Human
ggguuuugauauuguaggcauauuaaggcuagccagcuuaauuggcuccugcauuugugcuaacaacuauuagucuuuaccc

SEQ ID NO: 4164087 - RNA, 89 nt, Human
ggguuuuggaagggcucugucuuaguuugggguggggauaguuggagcugauuauguguaccucaaucugaggccuuuccucaaaaucc

SEQ ID NO: 4164088 - RNA, 56 nt, Human
ggguuuugggcaaugaccuaaacaccuuuaucagugccugggaaugcucaaggccc

SEQ ID NO: 4164089 - RNA, 72 nt, Human
ggguuuugguuuuuugguguaucuuauuccuucaaagcaggaaugugucauuauccagaauaaccauaacuu

SEQ ID NO: 4164090 - RNA, 83 nt, Human
ggguuuuucucugacaguggcaucauuuugugauugucuuauccaaacauuuaugguagucauugcaauuucagggauagccu

SEQ ID NO: 4164091 - RNA, 130 nt, Human
gguaaaaaaaucuaguacuaaagagauagcaagguaugacuggagcccaggccaucuaacucaguccaggucucuuacauuagguuuuaguuuuuguaacuuuguucuauuaucuauacuccucauuauc

SEQ ID NO: 4164092 - RNA, 92 nt, Human
gguaaaaaauaauuagaugcaaaaguaucauuuuaaugcuaucuuuaaauuuggacauaaauugugcuuuugacaucucaggaguuuauacc

SEQ ID NO: 4164093 - RNA, 68 nt, Human
gguaaacacaagauggccucuucugugauugcuuauacuuccaggaaacggcuauucuuuuguauauc

SEQ ID NO: 4164094 - RNA, 89 nt, Human
gguaaacaugugucaugggguuuguuauacagauuauuucauugcccccaaaauuuguuaacaauaaguccaggcauuuuccagcuacc

SEQ ID NO: 4164095 - RNA, 130 nt, Human
gguaaagaaaaagaaaaucuaauuauguggcauguuucagccagguguuccugguuccaaugacucagacccuauuggagcccugaggaucuggauaauugggccugcauagacagagaugaaggaugcc

SEQ ID NO: 4164096 - RNA, 70 nt, Human
gguaaagacagagcuguaggggaaagccuaaaauguuaacucuaucuucuaaagcucucucuaccauacc

SEQ ID NO: 4164097 - RNA, 66 nt, Human
ggcuucuauauguugguguaugggugaguuccauuuguaaaaugaaucaaacuguacacugaggcu

SEQ ID NO: 4164098 - RNA, 57 nt, Human
ggcuucucagaucucagcuuugaggucucaucuuggagguuuccgcuucugagaacc

SEQ ID NO: 4164099 - RNA, 125 nt, Human
ggcuucuccagucgcgucuuucucacucacuggggagcccggcgguggcggcaccuuucgagguagacccgcugagcugcuagcccgccggccagcgagugagaggucggacagacuguggagcc

SEQ ID NO: 4164100 - RNA, 55 nt, Human
ggcuucucccauucuucagggggucugauguggaaacuguguugaagggagaguc

SEQ ID NO: 4164101 - RNA, 57 nt, Human
ggcuucucgugccgaagcaagaucugcaugauuaugcugccaagcacgaguugaguu

SEQ ID NO: 4164102 - RNA, 63 nt, Human
ggcuucucucuucacauggcuuuccaugugguuuauccacauagucuuuguagcaggggagcc

SEQ ID NO: 4164103 - RNA, 65 nt, Human
ggcuucugaagaaguguaagucuguuucaccagaacauucgguggaggaaacacaucagaagacc

SEQ ID NO: 4164104 - RNA, 91 nt, Human
ggcuucugccccacucaaucuggcucgcuaggcucugggguccaucuggccagcucuccugggcuuaguggcuaggucuggggugggagcc

SEQ ID NO: 4164105 - RNA, 74 nt, Human
ggcuucugccucucuaacccaugcccaagccaccuccugaccccuggcugcaaaagaugggaggggcagaagcc

SEQ ID NO: 4164106 - RNA, 80 nt, Human
ggcuucuggggacggcuggggcaggcgaagcgcagcuggccccagacgcaagcccugcuccuccgucccacgacauggcu

SEQ ID NO: 4164107 - RNA, 58 nt, Human
ggcuucugucucaagcaccagcauaaucuggugccauguacugagauaugaaacugcu

SEQ ID NO: 4164108 - RNA, 83 nt, Human
ggcuucuucuuuaugucauaugccagcuguuaaggguggauucugauaaugcugcugacaggugauaaggaagaaaaguggcc

SEQ ID NO: 4164109 - RNA, 65 nt, Human
ggcuucuugauuaguguagucuucucuccugcuacuccugaggacacuaacauuugcaaggggcu

SEQ ID NO: 4164110 - RNA, 99 nt, Human
ggcuugcaacaauguuggugugaaauauaaucauugaauugcuuuguucuuuuuuccaauaaaagguggaagcuauugaguguuguuauuaggcaagcu

SEQ ID NO: 4164111 - RNA, 80 nt, Human
ggcuugcccgaaggaggggaggauuaaugacaaagacggccccgcucuuucccauucaaucccgcucugcgaggcgcgcc

SEQ ID NO: 4164112 - RNA, 59 nt, Human
ggcuugccuggaugguccccagagauaaagcaucuuauauucauggggguccagguacc

SEQ ID NO: 4164113 - RNA, 102 nt, Human
ggcuugccuuguaggcucauucauuuauuugcuccuuaggcauauuuugacacuugggacccugggaguagaagaaaaccaugaaugagacugagacaggcc

SEQ ID NO: 4164114 - RNA, 62 nt, Human
ggcuuggaaaugguaaugagcuagcugugugacaucagcaaauuacuugccauuucugagcc

SEQ ID NO: 4164115 - RNA, 56 nt, Human
ggcuuggccagacagggagcuccagugagcuggggcuucuccuguaggcucaugcc

SEQ ID NO: 4164116 - RNA, 69 nt, Human
ggcuuggcggaggaaacugaggcaagagggaagugucccagauaugcagccgguuuccccugagggguc

SEQ ID NO: 4164117 - RNA, 72 nt, Human
ggcuugggaacugagguaucuucgcccccaggaauccagcuccuuccccugccagaagcccagaucccagcc

SEQ ID NO: 4164118 - RNA, 120 nt, Human
ggcuuggguuuggaagggcugggaggucugugaccccugcccuguguuuggggacuagguaggcaggccugugacuguaggaggaggggguucaggucuugguccugcugagcccgaguc

SEQ ID NO: 4164119 - RNA, 82 nt, Human
ggcuuguauuuguguacaggaugacuguacuuauuuugguaaauagauacucguacauuguguacacaugugcuuuugagcc

SEQ ID NO: 4164120 - RNA, 80 nt, Human
ggcuugucucacagugcacuaagcuccggggcccggccagcccugggugcuggggacagggugagacugggggagcagcu

SEQ ID NO: 4164121 - RNA, 61 nt, Human
ggcuuucagaagccggaagggcaggcagguguuccaacuccccacuggcucucugguuacc

SEQ ID NO: 4164122 - RNA, 60 nt, Human
ggcuuucucacagcauggcagcuggcuuccaagugcgggaauguccugauugagagagcc

SEQ ID NO: 4164123 - RNA, 79 nt, Human
ggcuuugaaugcaucagggaacaaaguggcaaaaaugguauuugcagauucugucaguguuuccuagagcauauaaacu

SEQ ID NO: 4164124 - RNA, 75 nt, Human
ggcuuugagggagcaggucuuugguaaugcuuacgaucgguggagagcuuuagcugagaccugcuuuuacagacc

SEQ ID NO: 4164125 - RNA, 67 nt, Human
ggcuuugcagggauuaccuuauuuuuuccuuucucacagaaaucagaaauggguauuccucagggcu

SEQ ID NO: 4164126 - RNA, 68 nt, Human
ggcuuuggcuagaaucugauggcccgucugggcucaggcugagcccgucgguuccaggaagccaaguc

SEQ ID NO: 4164127 - RNA, 55 nt, Human
ggcuuuguauuccauuuagauguaauucaacaucuucagugagaccagcaaggcc

SEQ ID NO: 4164128 - RNA, 85 nt, Human
ggcuuugucuucucuauauguguuuuucugcagacaagccauugaguuuagaagggaaugcaucacauauaaccuagacaaggcc

SEQ ID NO: 4164129 - RNA, 55 nt, Human
ggcuuuuaaacaccuggggagugggggaggugcccacuccucagucccagagguc

SEQ ID NO: 4164130 - RNA, 82 nt, Human
ggcuuuuacuuuaauccacaauagagauuaucugcacuuuaaguccuuguuagaguauuugauugugaaucgaaugagaguc

SEQ ID NO: 4164131 - RNA, 61 nt, Human
ggcuuuuccucaggaggagacgcguccgcgccggcgucgccucgccgcucugggggcggcc

SEQ ID NO: 4164132 - RNA, 87 nt, Human
ggcuuuugaauauuuaauaguaucacucucucuccucugcucaugcagaaggcagggaauguggugcuagaugaguauauuaacgcu

SEQ ID NO: 4164133 - RNA, 64 nt, Human
ggcuuuugccuaggguugacccguuuccgccacugaucagcugaaugacccugggacaaguccc

SEQ ID NO: 4164134 - RNA, 60 nt, Human
ggucaucauaagggccaaaggugugaaaguaaaagacaacauuuggaacuuuuugaugcc

SEQ ID NO: 4164135 - RNA, 61 nt, Human
ggucaugaaaccagcaaggaugagacacaaaauuuuaacccaugcuucuggaaccaugauc

SEQ ID NO: 4164136 - RNA, 82 nt, Human
ggucaugcagcuaguuagugguagaaucaggaugaggacccaagucuucugaccccuggucuacagcugucucugcuagauc

SEQ ID NO: 4164137 - RNA, 59 nt, Human
ggucaugccuggcuucuuagacaaaagacauagaaguagaugugugaggccaggugacc

SEQ ID NO: 4164138 - RNA, 68 nt, Human
ggucauggccuuuuuaucucaccaaguguggugccugcuccuucacaugcuuggagaaggcuaugacc

SEQ ID NO: 4164139 - RNA, 56 nt, Human
ggucauggcuauuaggcagucacacaagucauaaauggcuacugaggcccaggacc

SEQ ID NO: 4164140 - RNA, 70 nt, Human
ggucauggucugcugagcagcaagaagcugcccuaagcaagcccucuuccagccagcacagacauggacc

SEQ ID NO: 4164141 - RNA, 108 nt, Human
ggucaugugugugcaugugcuuaugugugcauguaugugcgugugugcaugccuguguauuaauaugugugugcauguaugugugugcauaugugugugugugugguc

SEQ ID NO: 4164142 - RNA, 60 nt, Human
ggucauguuggcugaggcuguauuuguuuuugacauguagaggucauggccaguaugauc

SEQ ID NO: 4164143 - RNA, 89 nt, Human
ggucauuguguguccaaggguuuguagguguucaccaguccacugggaagccagugacagcaccugugcccugauggagaccaccaacc

SEQ ID NO: 4164144 - RNA, 106 nt, Human
ggucauuuggccaaaugccuggguuuuguuguuguuucuuauugacgagugaugaaggagaaaccaauagaagcaagaacagaauggaggugugugccuagaaacc

SEQ ID NO: 4164145 - RNA, 83 nt, Human
gguccaauagaaaggguggaauuguuggcaucggagauaucuugguucaaauucaugcacuauuucuucuagcuauugugacc

SEQ ID NO: 4164146 - RNA, 85 nt, Human
gguccacagaccccaugaugcggaggggauggcagugccccagucugaacgcagccucucucugcaucuggagggcacggggacu

SEQ ID NO: 4164147 - RNA, 57 nt, Human
gguccacaugccuauuaaccaaacgagcagcucaggcuuggcuggauggcuggggcu

SEQ ID NO: 4164148 - RNA, 80 nt, Human
gguccagaaagacuccucguguggacuuugcuucuuuauuugccaggaagcaguuuggcccgagcaguucuuuuuugacu

SEQ ID NO: 4164149 - RNA, 60 nt, Human
gguccagaaaugcaagccagguguagaggacaauagaacuacccuaccagcuucuggacc

SEQ ID NO: 4164150 - RNA, 87 nt, Human
gguccagaacugggcucgcucugguuuggcucuguuaaaacgucgaugcaggcccugggcaguuggagugaggcgguucuugugauc

SEQ ID NO: 4164151 - RNA, 60 nt, Human
gguccagaagcugguaggguaguucuauuguccucuacaccuggcuugcauuucuggacc

SEQ ID NO: 4164152 - RNA, 65 nt, Human
gguccagcucccuagaaaacagacucagauguagauugcaugcaggaaguuuuuugggaaguacc

SEQ ID NO: 4164153 - RNA, 56 nt, Human
gguccagcugaucuugacccagccuggagaacaagcggucaaaucaccagcggacc

SEQ ID NO: 4164154 - RNA, 76 nt, Human
gguccaggaagcacauuuggaaaacauggacuuagacuaauucuccuucauuguucuggccaaaguuuucuguucc

SEQ ID NO: 4164155 - RNA, 71 nt, Human
gguccaggaaggaaaggguguggagacagaacuauccuuuccaaucagucccuuucuuuuccuaccagacc

SEQ ID NO: 4164156 - RNA, 70 nt, Human
gguccagggucagagaucggccaugugagcaucccugcuccagcucaguggccuccuccacugacccgcc

SEQ ID NO: 4164157 - RNA, 78 nt, Human
gguccagucaacuaaagacagaagccucuagaaaugaaauucuucagaggaagucagucuuuaucugcaaacuggauu

SEQ ID NO: 4164158 - RNA, 75 nt, Human
gguccagucacuucauuuuacagauggggacucuaagccccagagauuugucuacaugaugugauuauaugggcc

SEQ ID NO: 4164159 - RNA, 57 nt, Human
gguccaugagacagcaacugaaaguauaaagaaugcuucacaguguggucaugagcc

SEQ ID NO: 4164160 - RNA, 83 nt, Human
gguccaugugaugugcauucacuuuaggagcacugacaaauguauuuuuuucagucuguaaaggugaggacagaucacagacc

SEQ ID NO: 4164161 - RNA, 76 nt, Human
gguccauuucuuccaccacucuguguacaacuacuacaugucagguaccauggacacaguggugaagguacagacu

SEQ ID NO: 4164162 - RNA, 65 nt, Human
ggucccaaggaggaugaggcuagacagugaaugguucaucacaacucauuccuauccuggagacc

SEQ ID NO: 4164163 - RNA, 65 nt, Human
ggucccaaucuaaucacaugaguccuuagaagaaacuuaagagggaaaugugacuauggaagacu

SEQ ID NO: 4164164 - RNA, 73 nt, Human
ggucccacagaggaugcccaagcgaucuccaagcccagacuuuguuucgguugccuguggcucccuguuaacc

SEQ ID NO: 4164165 - RNA, 88 nt, Human
ggucccacuguucuucccaaaccugggcauuccucugcucucuccuccccaaccagaaaggcaggugcccagagagcacgaugggucu

SEQ ID NO: 4164166 - RNA, 64 nt, Human
ggucccagaacccugccagguccugggcuguggggcguggguuggcaucaggguucugugggcc

SEQ ID NO: 4164167 - RNA, 97 nt, Human
ggucccauguuucauguaaaagauuauuuuccuguuuagucuuaggugauauugggugaguauauggaagauaaucuugaacuagagggaagggacu

SEQ ID NO: 4164168 - RNA, 65 nt, Human
ggucccucugaugaacuguuuuaacagcauauuuuuauguuccugaggcaugugucaaugguucu

SEQ ID NO: 4164169 - RNA, 58 nt, Human
ggucccugcccuaaaacucgucagugccucauaaccagcaaggacaaguggaggggcc

SEQ ID NO: 4164170 - RNA, 55 nt, Human
ggucccugcugaagccuugguguuuggguccugauaccuuuggcccaaggggucc

SEQ ID NO: 4164171 - RNA, 68 nt, Human
ggucccugggaaaggagagggcagccugauccucgcgacagcgucucuacccucuuucuuccuuggcc

SEQ ID NO: 4164172 - RNA, 72 nt, Human
ggucccuuaauccaggaggcuucguccguggaguuggcugacucaacagacucugccaucccuuaggggucc

SEQ ID NO: 4164173 - RNA, 81 nt, Human
ggucccuuacuggcuuccauaaucuuguuuauuuacgggacacccauaugaaaugccauuacuggaagaagucuugggacc

SEQ ID NO: 4164174 - RNA, 90 nt, Human
gguccgcccuugucucugccuguccugaggaugagggucaucaacugagucggggccacagggcagccaugggugcgcgagugcagggcc

SEQ ID NO: 4164175 - RNA, 73 nt, Human
gguccgugguguuuucauuuucacauuugcccuuuugucuagacaguggcaauguagagagugaucccguucc

SEQ ID NO: 4164176 - RNA, 79 nt, Human
gguccuaauggaggacaaugucaccuucagauggugugugcaucucuggaggacguguccaccaugaaagauuuggacu

SEQ ID NO: 4164177 - RNA, 55 nt, Human
gguccucaaucccaacaaggcacccagaaagcuagccugucugguccugggggcc

SEQ ID NO: 4164178 - RNA, 62 nt, Human
gguccucacccgagugugcugccuuguuugguuccacuuuugcagcagcucagggaggcacc

SEQ ID NO: 4164179 - RNA, 63 nt, Human
gguccuggcucugugggaccuggccuaggauggaaacuuaggucuggaggcggagucaggacc

SEQ ID NO: 4164180 - RNA, 56 nt, Human
gguccuucauaucauggauuauauuccugugcauauuuuccaguuugucaaggauc

SEQ ID NO: 4164181 - RNA, 94 nt, Human
gguccuuccucagguccgaaucagaaacuuuggagaauggcacuacuguuuaacgagaccuucaaguaauucugauggcuagaguuugaggacc

SEQ ID NO: 4164182 - RNA, 77 nt, Human
gguccuucucgggguagacgccagcucggaggaacgaggccuuccagcuguccacgucuuccugggagucacaggcc

SEQ ID NO: 4164183 - RNA, 100 nt, Human
gguccuuguugaaauccacuguaauagacagugaacuccuagcaagugguauugguucucggucaucuguguauccucagugggauaucuugaaagggcc

SEQ ID NO: 4164184 - RNA, 56 nt, Human
gguccuuuaaaguagaccuguuuguaagacacuaagcauguuuacacucaggggcu

SEQ ID NO: 4164185 - RNA, 66 nt, Human
gguccuuuggcugccaauggcuuggaaaggcuacagccccaggcuugagggggcuagugagagacc

SEQ ID NO: 4164186 - RNA, 106 nt, Human
gguccuuuuggaaccauugccuuuuuggugauaauuuguuacuguuccaaacagucauuagaaacaguacaaaugcagccagaguaguugggagcuaaauaugacu

SEQ ID NO: 4164187 - RNA, 76 nt, Human
gggggcaggaggccuggcuggggagauccagaggccuauggccggcucuccucuucaguucaaggccuccgucucc

SEQ ID NO: 4164188 - RNA, 60 nt, Human
gggggcaggguaggguagguuaaagccagugauggggccucagcucugcucugcaaaacc

SEQ ID NO: 4164189 - RNA, 63 nt, Human
gggggccacuacauauuuaggaccacuuuaaacuacuggugucauuuuauguauguggucugc

SEQ ID NO: 4164190 - RNA, 59 nt, Human
gggggccauaaugcuauuguagaaccacauuauuuuacaaugcacuuuaaaugguuccc

SEQ ID NO: 4164191 - RNA, 81 nt, Human
gggggccgcagaggggcuugaggcccugauggccaaggaagacggagccaggggcagggccaugggccucguguggccccc

SEQ ID NO: 4164192 - RNA, 63 nt, Human
gggggcucacaccucccuaagggcucgcuaauugaaccccuugggccugagguugagaaaccu

SEQ ID NO: 4164193 - RNA, 74 nt, Human
gggggcucagcaggcucugguucaucaugauggcugugaugcugcccauuaccacuggcccugcuauagccucc

SEQ ID NO: 4164194 - RNA, 75 nt, Human
gggggcuccaggcgagaauguguucccgccuuucccagcgucuagaggcacccacaucccuugcucggggccccu

SEQ ID NO: 4164195 - RNA, 71 nt, Human
gggggcuggaauauccaucaaccaacgcccaccuauaguugguugaggucuccaaguguucuagccagccc

SEQ ID NO: 4164196 - RNA, 59 nt, Human
gggggcugggaggaagaagagacugacuucagucugagccugcugcccugucagccucu

SEQ ID NO: 4164197 - RNA, 68 nt, Human
gggggcugucucucaccacagacacacaggauggcuaaguccuuaaccucugggagggacaagucucc

SEQ ID NO: 4164198 - RNA, 77 nt, Human
gggggcuugggcuucaaugugugaauuuuguggggacauaauucaguccauagcacguggaaugcucaugagccucc

SEQ ID NO: 4164199 - RNA, 81 nt, Human
ggggggaagaguguuuauuucauguuuuacuaaggaaaaaacuguucaagaaccuuauagaacuuaaauauguuuucccuc

SEQ ID NO: 4164200 - RNA, 56 nt, Human
ggggggaucaacugagauggcuuaggauuuaccuggaugccugcucugcucucccc

SEQ ID NO: 4164201 - RNA, 114 nt, Human
ggggggcagagaaacgcuugaaaagggaaguugcacauguuccccucucucugaucugaugggaaugcacuagacugugaaacuuccuccuccaccucuucucccgagucccuc

SEQ ID NO: 4164202 - RNA, 78 nt, Human
ggggggcaguuuuccacuggacagcuacuccaugucaucuugagucagcuggugccacucagucaaagaccgucccuu

SEQ ID NO: 4164203 - RNA, 60 nt, Human
ggggggcuguucuggacaggaagaugaacaaaugccuuccucuucucuucacugcccccc

SEQ ID NO: 4164204 - RNA, 85 nt, Human
gggggggacccagagacccgcagccucggagcugggccuagagcaaggcagagcaccaggucgcuggcacgcucgcauccucccc

SEQ ID NO: 4164205 - RNA, 109 nt, Human
gggggggagaggggagcauuuuuaauguuaauguuuuaaguuauagagaauauucaauuacauuuuacuaaaaugggcuuaaaauuagauaugguugucucuucccuuu

SEQ ID NO: 4164206 - RNA, 74 nt, Human
ggggguagcuuaagggcacguugggcuacuugaauggaaaaugcgguagcuugguggcccuccuggcuggaccc

SEQ ID NO: 4164207 - RNA, 81 nt, Human
gggggucgcugcugaaaacaauaaugaugagacuguaaaauguauaagaaaaucacauuauaauuucuaguuguuuccccc

SEQ ID NO: 4164208 - RNA, 71 nt, Human
gggggucucuuuuggcucaucucaguccuaggaggggacaugugccuccugacccuuugaggcggaucccc

SEQ ID NO: 4164209 - RNA, 57 nt, Human
gggggugaaggccacggucucucagcaagcucgugguggggaugggcccucacccuc

SEQ ID NO: 4164210 - RNA, 109 nt, Human
ggugaggcgacagcugcuucugcaugaagugcuucauuacaggcgugggcaaccauccgccccaagaggcugcuuugaugacaggagcaaaauuacugaaggcgucacu

SEQ ID NO: 4164211 - RNA, 59 nt, Human
ggugaggcuuggcaaaagagugguauagccauggcuuaaucacagaucuucccagcccc

SEQ ID NO: 4164212 - RNA, 85 nt, Human
ggugaggggcagucacagacaguaugguggggcugagaaacauauggcuuccucacuuaauauugcugcacaguugucccacacc

SEQ ID NO: 4164213 - RNA, 56 nt, Human
ggugaggggcuccucugcccggccgcccccacugggaagugaggagccccucugcc

SEQ ID NO: 4164214 - RNA, 56 nt, Human
ggugaggugguaagucagguugaccuucucgucucccacucaugacuccacucacc

SEQ ID NO: 4164215 - RNA, 62 nt, Human
ggugaguagaggucaggggugcugcuaaauaucuuaccaugcacaggacagccucuacuccc

SEQ ID NO: 4164216 - RNA, 55 nt, Human
ggugaguagguuucauuuugcaaugaaauaagauuugcaaacugaaaaauucacu

SEQ ID NO: 4164217 - RNA, 75 nt, Human
ggugagucgcugcagcugcaggcccccagguccucgugagaggcagucagcaccugcagcugcuggggcuccacc

SEQ ID NO: 4164218 - RNA, 77 nt, Human
ggugagugggccaaagguaaagaucugcugugggcaugcaauugccucucagcuagcuauaccucaccucucucauu

SEQ ID NO: 4164219 - RNA, 86 nt, Human
ggugaguugcaucuaccauaucaaagaugggaagucugaguuacagauagacucaacaucuuucgauguaauagguguauuuuauu

SEQ ID NO: 4164220 - RNA, 58 nt, Human
ggugauaagagcauggccccggggcccggcgccuuggcccccggaacgcucugugacc

SEQ ID NO: 4164221 - RNA, 55 nt, Human
ggugauagugguggugauucuuugcaaaggacaaaguacuuccacagcuaugauc

SEQ ID NO: 4164222 - RNA, 56 nt, Human
ggugaugauuucccugcucacuguauacagaacacagugacuaugacauuauuacc

SEQ ID NO: 4164223 - RNA, 80 nt, Human
ggugaugcagagggcggggugccuaccuucauggagcuugcacuccacaagugaaguacaccugccauacgagcguuauc

SEQ ID NO: 4164224 - RNA, 68 nt, Human
ggugauggauggauuaaugaguggaggguuggaugaaaugaucacaauucagugucuacuccauugcc

SEQ ID NO: 4164225 - RNA, 61 nt, Human
ggugauggggagauuguggaauggggcauugccugagucccauaauguugccaauguuauc

SEQ ID NO: 4164226 - RNA, 63 nt, Human
ggugauguacauuuuccuaauguuuugggacucuugaaaaccaguggaaaguuuacaaacauc

SEQ ID NO: 4164227 - RNA, 56 nt, Human
ggugaugugaccguggaggcagagauuggagugaugugcccacaauucacaaugcc

SEQ ID NO: 4164228 - RNA, 129 nt, Human
ggugaugugcuuaugaaauacccucacuaaaugacugaggaagagguaccauuuguagcacuaggcuacaaauggacucucaucuuuugcauuuacauguuccuauccguacuucuaaguacuagcacc

SEQ ID NO: 4164229 - RNA, 68 nt, Human
ggugauguuuaugaccuccauaaggauuuccauuaaucccuaauuucugucggucaugacacucuacc

SEQ ID NO: 4164230 - RNA, 61 nt, Human
ggugauuagcugaggcagcgauucuccaggugugguccuggacagcagcagcagugucacc

SEQ ID NO: 4164231 - RNA, 72 nt, Human
ggugauuaggaggugaaugagguuggugccuuuauaaaagagacuugaaggagcuuguucgccuuccucacc

SEQ ID NO: 4164232 - RNA, 71 nt, Human
ggugauucugccccacuguuugguauugaguaagaaaguaagaggaucucagagaacucgggcagaugacc

SEQ ID NO: 4164233 - RNA, 56 nt, Human
ggugauuuucgaguuucauguuucuuccugccucggggcucugaccggaaaucauc

SEQ ID NO: 4164234 - RNA, 63 nt, Human
ggugcaaaaaucuaucaccagcaacagaaggugcagacuguguugguggcgguaauuuugucc

SEQ ID NO: 4164235 - RNA, 71 nt, Human
ggugcaaagaugcugauguuggaucaaccgaggaaauacaguuuuggucacaaaagugguauuuaugcacu

SEQ ID NO: 4164236 - RNA, 74 nt, Human
ggugcacagagcacagaaguuauauguuacuuuucuaagguaauggcguguuucuuuugagcugaaacuguacc

SEQ ID NO: 4164237 - RNA, 59 nt, Human
ggugcacugguguguuaguaagggaugccagaaaugcgugccuucucuuaucagucacc

SEQ ID NO: 4164238 - RNA, 57 nt, Human
ggugcagaguccacagaaagcugucuaaauacaugcuuggggugggucucugauacc

SEQ ID NO: 4164239 - RNA, 85 nt, Human
ggugcagcaauuuuaacccagugcuuuuaaaacaacaucaguaacugauuaugcaugagacaguacuaggguuacagucugcucc

SEQ ID NO: 4164240 - RNA, 91 nt, Human
ggugcagcuucuauagcaggacugaagggcacagggaaugucucuaaacaaccgucccauucauauguuucugaguccucuggcagccacc

SEQ ID NO: 4164241 - RNA, 75 nt, Human
ggugcagguuauagggcacuccagauucuugcucuggcguguucuggcaagagugaggagugucucuagccuacc

SEQ ID NO: 4164242 - RNA, 59 nt, Human
ggugcagugaaggaaguuugucuugggcugccuccaagcaccccuuccucccugacucc

SEQ ID NO: 4164243 - RNA, 55 nt, Human
ggugcagugugauuuucuggcugaguggugucugccucagucauauaucugcacc

SEQ ID NO: 4164244 - RNA, 63 nt, Human
ggugcaugcaccaguucaaaugggaaauaaaaagcacuuacaucuugagcagugcuuagcacc

SEQ ID NO: 4164245 - RNA, 59 nt, Human
ggugcauggaaagaguaaguaaguaauaaaugcuacuuauuauuaauauuccaugaacu

SEQ ID NO: 4164246 - RNA, 59 nt, Human
ggugcauggggagcacucucagggccucucaugcgcauccugagcccuuccugugaacc

SEQ ID NO: 4164247 - RNA, 91 nt, Human
ggugcauuaacuuccuggaaccacuaggcuaccaauuaguaacagacugcuucuuugugccuauuggugacccacaggagauaaugucacc

SEQ ID NO: 4164248 - RNA, 87 nt, Human
ggugccaaacuuaauauucugccuguagucccacaccuccaucuggcucugacuugggguggcugguuauuacaggcaaguggcauc

SEQ ID NO: 4164249 - RNA, 107 nt, Human
ggggugguauaugggucaugaaggcaagggugguauugggagcauaccuccuagccccacaccugguugccccuuuaccacuuugcauugucauucauugccaccuu

SEQ ID NO: 4164250 - RNA, 71 nt, Human
gggguggugccuuaggugauggcucagcuggcacugccuccuggggugccaucaucuucaggugcagcucc

SEQ ID NO: 4164251 - RNA, 67 nt, Human
ggggugugucuuuugcuccuggagcccagacaacucaagauaaggcuuugagagccaagaacauccc

SEQ ID NO: 4164252 - RNA, 55 nt, Human
gggguguuucauugcaucguguccgugcuggcugacugauggaauuugacauucc

SEQ ID NO: 4164253 - RNA, 64 nt, Human
gggguguuuuauuaacugaucuuuuugguuucuugacuuuuuaaauucagcagugaaaugcccc

SEQ ID NO: 4164254 - RNA, 68 nt, Human
gggguuaaggagcaggagagucuucauuguuucccuucagaacugacagacuuuacuucuccuauucc

SEQ ID NO: 4164255 - RNA, 95 nt, Human
gggguuagacuuuccuucucagagaugguauaauuaaguuagaugucuuuuuuuagacaaucacacaugcaauuauacagaugggaaguagcuuu

SEQ ID NO: 4164256 - RNA, 79 nt, Human
gggguuaguagguaauugguagaaggaaaagggaggucuggaaaguccucagccucacacaguuaucucuucauaccuc

SEQ ID NO: 4164257 - RNA, 58 nt, Human
gggguuaucagcugucgcuggagcccaggcagggaauauguuggcagcugaaagcucu

SEQ ID NO: 4164258 - RNA, 68 nt, Human
gggguuaucuguuaaaacaagcuuuaaacuauuaauagagugaaauuacagcuucagcagcuaacccc

SEQ ID NO: 4164259 - RNA, 67 nt, Human
gggguucuucccagucccaagaaaagccaguuucucucugcagcuaauugggauuggggaggagcuu

SEQ ID NO: 4164260 - RNA, 68 nt, Human
gggguugggugugggcccugaugucagcauguuggggaaucugucuggcauaguugcucccugacucu

SEQ ID NO: 4164261 - RNA, 56 nt, Human
gggguuggugccuuuauaaagaacacaacacguaucugcugaauggagccaaccuc

SEQ ID NO: 4164262 - RNA, 72 nt, Human
gggguuugcagagccccagauuggagaguggaaggcuggacaccacucuccaaauaugggccuguguguccu

SEQ ID NO: 4164263 - RNA, 116 nt, Human
gggguuuuguuuuuuuggcccaggaauaugcuguuuuucuugacguugcugugaaaauccugagggguuuugaauagaacaagguagacagcuuuggauguaagcagcagaagcuc

SEQ ID NO: 4164264 - RNA, 83 nt, Human
ggguaaaauauuuauuuccaucuucauuuuagucuagugauaacuauacaaauguggacauggauaaugaacagguuuuaccc

SEQ ID NO: 4164265 - RNA, 73 nt, Human
ggguaaagacuggcccagcuucacggagagcaggaaguaauuguccucuguagggcugggccacaaguuagcc

SEQ ID NO: 4164266 - RNA, 70 nt, Human
ggguaacauaucucuuuccuauucaaguuaggaccuuguccuguauuugaaagaaaagauuuaauagcuc

SEQ ID NO: 4164267 - RNA, 114 nt, Human
ggguaacaugaguuuucacucucucuuucucaguuuuauuaaaauuaaauggcaaugaagguuugugcaggaauauugaugaacuuagagagauaaguuuaccuuaaguuaccc

SEQ ID NO: 4164268 - RNA, 89 nt, Human
ggguaacguuugauaacuucuguucuuuggagggacaagagaucccuucuagaccaccaguuaauuuuuguauguuuagacuguuaucu

SEQ ID NO: 4164269 - RNA, 94 nt, Human
ggguaagagggggcugaacuuacucuuucauaauggugcuaauuccacuugugaggauggaguucuacaggccuaauaaccucuuaaaacuccc

SEQ ID NO: 4164270 - RNA, 66 nt, Human
ggguaaguguaguucaagcaaaagccuggauuuggaaugucccaggguagcugagcuggcaggccu

SEQ ID NO: 4164271 - RNA, 99 nt, Human
ggguaaugauuuauucgggugauuaugcuuagucugcugaaccucuguacuuaauuucuuuugcugcagcaggcugaguauuacccuaguccacugccc

SEQ ID NO: 4164272 - RNA, 74 nt, Human
ggguacacaugcuccagucuccaggaucugucccugaccaaucuccugagauguggagcuccaugugaucaccc

SEQ ID NO: 4164273 - RNA, 59 nt, Human
ggguacaccaauggaugccagggcacaucagugcacaccugugcaugccaggguacacc

SEQ ID NO: 4164274 - RNA, 69 nt, Human
ggguacagaaacugaggcuuagaaacaauggagcauuugaaccuuaccuuggcuucagugucuguacuc

SEQ ID NO: 4164275 - RNA, 56 nt, Human
ggguacaggccugaucauccacagacacuaguggacacaugaggaaggccucaccc

SEQ ID NO: 4164276 - RNA, 82 nt, Human
ggguaccaagguuucuuugccaggcaguugucccugaggaaauuuccagugcccagucucccugguccauaccuuggcaucc

SEQ ID NO: 4164277 - RNA, 85 nt, Human
ggguaccuggcauuaaacaaccuugaaucaauccuggugggauuaacuggacugaguuucuguauacugcacaugcuauggaucu

SEQ ID NO: 4164278 - RNA, 86 nt, Human
ggguacuaggaaagggugacucuguggcucuuaggugugcuacacaucccugaagccacagagcaucugccucccuuaaaccaccc

SEQ ID NO: 4164279 - RNA, 70 nt, Human
ggguacuuuucugaagaauuuuaauaaaggcaaauaaaugccuuuucuaggaugcuuuauaguagagccc

SEQ ID NO: 4164280 - RNA, 64 nt, Human
ggguagaaagagcuuugcuuccuuucagaaaccacugagggugugcuguugggucuuucagcuc

SEQ ID NO: 4164281 - RNA, 92 nt, Human
ggguagaagccguuuauuuauucauucagcaagcaugugcuuaguguaaggugugucugaaguugaguagacauuuaguggaggguaagccc

SEQ ID NO: 4164282 - RNA, 76 nt, Human
ggguagagguggccaggaaguggggagcaggggcuaaaauucagcccgugcuucgcccccuggugcagcuguaucc

SEQ ID NO: 4164283 - RNA, 97 nt, Human
ggguagauacuuucacuaacuggguaguagcauuuccaugccuuacagagaaguccucugagguaguaaagguguuaguuaaugaaauuauuccccc

SEQ ID NO: 4164284 - RNA, 62 nt, Human
ggguagcaaauggcugucaaguagccaagagggcugagaguugacaaggagccauugcaucu

SEQ ID NO: 4164285 - RNA, 68 nt, Human
ggguagcaagaugaugaauuauucagccugcaauuuguuagcagugagcaacuugccaucuguuuccc

SEQ ID NO: 4164286 - RNA, 80 nt, Human
ggggaagagauaaaugcagcagcuaauugaaaaggaucuguuugccauuuucccauuuugcuuuuguaauauuucucccc

SEQ ID NO: 4164287 - RNA, 58 nt, Human
ggggaagauuuuuaauuaguaacuuugcauauuuuuaugggaauuaaaaauuuucccc

SEQ ID NO: 4164288 - RNA, 55 nt, Human
ggggaagcagaagggagcgggcauggagccugugcuuaauuccucugcuucaccu

SEQ ID NO: 4164289 - RNA, 65 nt, Human
ggggaagcagaccuccaaggugagagaggauggcaaaguagccgaucuucagaccuuggggcccc

SEQ ID NO: 4164290 - RNA, 74 nt, Human
ggggaagccggccucugguucacagggaggaugccacugggcuuuuccuccucuaucagacagugcccuccccc

SEQ ID NO: 4164291 - RNA, 61 nt, Human
ggggaaggaaaguuauuagcagagaucucccagaaguccucuguaacugucccuuuugccc

SEQ ID NO: 4164292 - RNA, 75 nt, Human
ggggaaggacagccagugcgauggauucacacuccucucacugugaccuuggagacccucgcucuggcccacccc

SEQ ID NO: 4164293 - RNA, 73 nt, Human
ggggaaggacuggggccaacaccucccuuggccuucauaguacaccagagggaggugguuccccaguggaccc

SEQ ID NO: 4164294 - RNA, 60 nt, Human
ggggaaguacuauuuuucuauacuugagaaaagugagguggagagauuaguaauucaccc

SEQ ID NO: 4164295 - RNA, 79 nt, Human
ggggaagugacaggagucaagggccugacuguuucuauaaccuguucccugguccuugacacccuccuccagcgucccc

SEQ ID NO: 4164296 - RNA, 88 nt, Human
ggggaagugggaacauauaaaauaagguaugaagguggagguuaaaaaggauagccacuuuacuuucauauuuuaauucugccucccc

SEQ ID NO: 4164297 - RNA, 62 nt, Human
ggggaauucccuauccaguguccuguggggacacccagaaaggagcaccgugggggaucccc

SEQ ID NO: 4164298 - RNA, 79 nt, Human
ggggacacaugcuuuaagucacagaguuggaagucagauccaagucugauuccuaaacuguggauaaaguuguguuucc

SEQ ID NO: 4164299 - RNA, 57 nt, Human
ggggacaccccaccuugugcucaucuuuguagaaucugggcaaguuuggggguccuc

SEQ ID NO: 4164300 - RNA, 70 nt, Human
ggggacagacagugauggacaggcagacucugaaaguggagcugagucuugagcacugagcaugucaucc

SEQ ID NO: 4164301 - RNA, 71 nt, Human
ggggacaggaagugccugugguggaaggugugcagacuuugcucccguauuauaaguuuuuccuucucccc

SEQ ID NO: 4164302 - RNA, 74 nt, Human
ggggacaggacugauuuacuaacucuuuguacugguuaggccaggcugggucugaaauuaugucacugcucucc

SEQ ID NO: 4164303 - RNA, 60 nt, Human
ggggaccuucccagagcaguugaaaauaauauacagaaucucagaaauggaaaggucccc

SEQ ID NO: 4164304 - RNA, 61 nt, Human
ggggacgggacuuagcaugaguugggaaggccuuucacaucccacugaggagcuuguuccc

SEQ ID NO: 4164305 - RNA, 78 nt, Human
ggggacuuucuugcauaauuugaaaccagauaaaguagagaaaguuuucagguuccgucaagauguaagguaguuuuc

SEQ ID NO: 4164306 - RNA, 69 nt, Human
ggggagaaaguuguuuuagccaaaccuccugggggaguccaucugguccaggcuguaacaacuuacccc

SEQ ID NO: 4164307 - RNA, 66 nt, Human
ggggagaaaugucuggccugcugugagcuugguuucugcaguaggacccaggauauuuucuucccc

SEQ ID NO: 4164308 - RNA, 75 nt, Human
ggggagaaguacaguagaauuuuuaguaacuuucuuaaucacagcaguucacuuucucuguacaaaauucuuuuc

SEQ ID NO: 4164309 - RNA, 82 nt, Human
ggggagaauagagagaaaaggcaauaucaagagaauucgucaccacaguugucuggaugcuguugccuucuuugcucacccu

SEQ ID NO: 4164310 - RNA, 82 nt, Human
ggggagaauucuauagacagaaggucaauguuguccccauccauagggguugaauuaccuugcuguuaaguggucuuccccc

SEQ ID NO: 4164311 - RNA, 72 nt, Human
ggggagacagauggaacacagaaaggagagcaaugaguuuuauccugcuguguuuccaaucagauuuucccc

SEQ ID NO: 4164312 - RNA, 60 nt, Human
ggggagagaaauuauagcaaugagucacccaauucugcugcaucugcuguaucucuuuuc

SEQ ID NO: 4164313 - RNA, 76 nt, Human
ggggagaggcaggcagcagaggagugugggaagcuuuuugccacugcuauucuguugacugacuuuuaauuaaccc

SEQ ID NO: 4164314 - RNA, 78 nt, Human
ggggagaggggaggaggggcagggccacuggggagcaccugggacgcugcaucuccccacauuucucccugucucccc

SEQ ID NO: 4164315 - RNA, 70 nt, Human
ggggagauguuucagcauuugcuccuugagcuugcucaagcaggagccaaaagcugaacaagaucuuccu

SEQ ID NO: 4164316 - RNA, 70 nt, Human
ggggagcgagcggcuugcguacacacacagcgucugucacucuggguguggcagggcguuugcagacccc

SEQ ID NO: 4164317 - RNA, 68 nt, Human
ggggagcgcgggcugaucugcuccacgugcuggcaacagagccugugggagaugcagcuccugccccc

SEQ ID NO: 4164318 - RNA, 92 nt, Human
ggggagcguggaguggguuagaaaggcaagaagaugaguuuugguucuggaucacaaucucaacugccuuuuagacucugucacugcugucu

SEQ ID NO: 4164319 - RNA, 58 nt, Human
ggggagcugcggugagcgcggccgagagauggccgugagcucccagccugcagucccc

SEQ ID NO: 4164320 - RNA, 80 nt, Human
ggggagcugguuaaaaugcagauuucugggucaaaaucaaagguguguggcacaggaaucugcauuuugaccgguacccu

SEQ ID NO: 4164321 - RNA, 80 nt, Human
ggggagcugugcuguacacugcaggaugcauugcaagauccuuggccugaauucaauagcugucaguagcacuguucccc

SEQ ID NO: 4164322 - RNA, 80 nt, Human
ggggagcuugguuauucaugcacccaucuuaugacaagaagaccaugcaugguaguaaccuacauuugagagcuuacccc

SEQ ID NO: 4164323 - RNA, 71 nt, Human
ggggaggagagagcuggcuggacucaggaaaaacccccuuuaauucucugaaugucuuuucucccuuccuc

SEQ ID NO: 4164324 - RNA, 91 nt, Human
ggggaggcauguguuaaauaacagagucuucaagauagugaaaacuaugcaucauuucuaggguccucuuuuguguagcuccugucucccc

SEQ ID NO: 4164325 - RNA, 95 nt, Human
ggggaggcccucgguuccuggagagugggcgagcacagcuuggccugggguuggccgcuggcucccggggaugcuucugcgaggguguuuucccc

SEQ ID NO: 4164326 - RNA, 64 nt, Human
ggggaggcuugugccaaggggaaagucgaaucuaaagaguguuuccuccuggccaggcggcccc

SEQ ID NO: 4164327 - RNA, 56 nt, Human
gguagaucugaaucucauccgaggaguggagguuccucaagaaugauggaucugcc

SEQ ID NO: 4164328 - RNA, 66 nt, Human
gguagaucugccuuaaccugggaguggcgagggagugaugcaucugccaaaacgaggagggucacu

SEQ ID NO: 4164329 - RNA, 98 nt, Human
gguagaugagggcuuagcuuucuccuuuccugaagcaagccuauuggagaaguguggcuggcucaugcaaagggugauggaggggcaacugaucugcu

SEQ ID NO: 4164330 - RNA, 56 nt, Human
gguagcaagcgcuugcccugcggcugcugcauggggcuaacuaacgcuuccucacc

SEQ ID NO: 4164331 - RNA, 107 nt, Human
gguagcacauacaaauagaaagagcauuuaagaaguugguaaggaaugauaaugacacacuuugucagggccugcuuccuucuuguucauugcuccuaguauuugcc

SEQ ID NO: 4164332 - RNA, 76 nt, Human
gguagcaggagaugcaaaguuccuacuuuacuggaugcuggaauuucagguccagaggaaaguuugcaaagcuacc

SEQ ID NO: 4164333 - RNA, 83 nt, Human
gguagcaggcaggcagaggagaaugaucuucccauuucauggcauggaagaaggaagaaaugcucuucuaugcgccagcugcc

SEQ ID NO: 4164334 - RNA, 56 nt, Human
gguagcagggcugugagucagauauaacccagauacugauaucaccacucuguucc

SEQ ID NO: 4164335 - RNA, 65 nt, Human
gguagccaucauaauaacccagacacagaugagaaguauuggucuggaguaugaugauaacuacu

SEQ ID NO: 4164336 - RNA, 79 nt, Human
gguagccccggugcacucuguccucuccuggcuugcccacacuccugggaugccugaagaacagcugugaggagcugcc

SEQ ID NO: 4164337 - RNA, 55 nt, Human
gguagcuacuagucauaugugccuauucagcacuugaaaugugucuagugcaacc

SEQ ID NO: 4164338 - RNA, 69 nt, Human
gguagcucaggcucuggguacaccugacaaguaugcacacacuugacagguauuugagagcugggaucc

SEQ ID NO: 4164339 - RNA, 110 nt, Human
gguagcucagggcgugcacugugagacaggaccuguugacuccguggugagcaucuauuuagcuucagguggucuuguuucuguauagagugacauagcauucugcugcc

SEQ ID NO: 4164340 - RNA, 68 nt, Human
gguagcuuccuagaguccugugugcucugugguacggcaacccaggaauucagggcucaagggcagcc

SEQ ID NO: 4164341 - RNA, 68 nt, Human
gguagcuugcaguuccugcuccaugcucugcccugggcaaugagcuguggaaggcagggaccaggucc

SEQ ID NO: 4164342 - RNA, 77 nt, Human
gguaggaaagaaaugaguagugauauucaaaaucuuguaaaauuucagaagcauaucacuuauucauuuuacuuacc

SEQ ID NO: 4164343 - RNA, 77 nt, Human
gguaggagguugaguguugugcaugcaccagaugcugccuugauuguuuggcugugucacaauaucaauuaauugcc

SEQ ID NO: 4164344 - RNA, 102 nt, Human
gguaggaguggggauagccucaaaggcagcuggaggcagagacuacaauagcaucaguguuguuucugcuucuucugugggucagcuucauucucucaagcc

SEQ ID NO: 4164345 - RNA, 60 nt, Human
gguaggcuggaaauccaaggaagagcugauguugcagcugaagucugaagccagucugcu

SEQ ID NO: 4164346 - RNA, 71 nt, Human
gguagggaugcuuugcugacagauucgggcguccuccccugaacgaauguccuggcggggcgugcccagcc

SEQ ID NO: 4164347 - RNA, 73 nt, Human
gguagguaggagaggacuguucuauuucuuuguaccuuugagacauggauaacccaguucauuucucccugcu

SEQ ID NO: 4164348 - RNA, 82 nt, Human
gguaggugugguugcaggagcuggaaagugauguugauucaggggugaagaaaccaucauacccacuguuguacacgccacu

SEQ ID NO: 4164349 - RNA, 63 nt, Human
gguagguucucacauuuuaaaaggacauaaaguuaugccugucuaaaagcugaguacaugacc

SEQ ID NO: 4164350 - RNA, 72 nt, Human
gguaguagaaagaugacuauuuaucuguaagugaagucacauacauacagaaaauauauuuugauuccugcc

SEQ ID NO: 4164351 - RNA, 73 nt, Human
gguagugucccaucacagaggagacuagaugcaauuuuuuccugccccuggucccuagugugggagcuuggcc

SEQ ID NO: 4164352 - RNA, 84 nt, Human
gguaguugcugggggcuucucuugcugggcugguuuagugcuucccugaguaacuggcccgggagcagaggccugaguaaugcc

SEQ ID NO: 4164353 - RNA, 68 nt, Human
gguaguuuaagaaauaauuguugauugggugaauaaauauaggucauaaaguuauuucuaaauuuacc

SEQ ID NO: 4164354 - RNA, 95 nt, Human
gguauaacaacuugggguguuguguguuucugguggcccugagguccugucugaaguguccagaagcagugcacaucacagggauugauuucacc

SEQ ID NO: 4164355 - RNA, 97 nt, Human
gguauaaccaguugaauguagaauuggagaagaacaugaauuagcguggauauugcuguauauggcuuacuuuauauuacugcauuuucaucuuacc

SEQ ID NO: 4164356 - RNA, 74 nt, Human
gguauaagaaugcuuguuuggggugggcaagagauguaguaaaguagcagaccccacuguucaggcauucaacc

SEQ ID NO: 4164357 - RNA, 75 nt, Human
gguauaaugaaagaaugaaacagcccacagacaagcucaauuuugggucuuuggaugcuuuuuguucuguucacc

SEQ ID NO: 4164358 - RNA, 76 nt, Human
gguauagcagcugggacugccauucacagccaguggagaccagugggaugggaggggcagcugagccagcaggacc

SEQ ID NO: 4164359 - RNA, 73 nt, Human
gguauauauguguuuuggccauggaagaacccaacugauaccucucaggcuccugacauauauguucaaggcc

SEQ ID NO: 4164360 - RNA, 82 nt, Human
gguauccauugggccuucugaaaccuuaauuguagcucgggagucucaguugcagccuucaggagaccccagguggaauucc

SEQ ID NO: 4164361 - RNA, 82 nt, Human
gguucucuccaccgguaaacucaugccauuaauccuuuugauguguacaacaaaggccauggcauguuuaucuggcaauucc

SEQ ID NO: 4164362 - RNA, 114 nt, Human
gguucucuuuggcugcuccucaggccucuuggcgucucugggcugacccaggucuccggugguaaagggacuggagcccguggaggcgcaggcuccagaguagcuagcuuugcc

SEQ ID NO: 4164363 - RNA, 75 nt, Human
gguucugcaaagggcucugggcuacgcacuggagaaggcccuguuagugcuauggccagagcccuugcauucacc

SEQ ID NO: 4164364 - RNA, 65 nt, Human
gguucugcuggccuuagcaggucuaggcuuauccuagaccaauugguucuaggccaguagcuucc

SEQ ID NO: 4164365 - RNA, 68 nt, Human
gguucuggauccucucuggggggccaggguuguguucuucuccagacaacagagggugauccaguacc

SEQ ID NO: 4164366 - RNA, 55 nt, Human
gguucuggcuguggauuaucacaggcuguggccugagagcagccauggugaggcc

SEQ ID NO: 4164367 - RNA, 70 nt, Human
gguucugugucuccggaggaaucagcccugacugcuggguccuaagcuguacuucuggauccgcagggcc

SEQ ID NO: 4164368 - RNA, 74 nt, Human
gguucuuacugauagcacaaaugacauuaggaggaaauguugguucuaaaugugcugugcuauaagcugaaacu

SEQ ID NO: 4164369 - RNA, 74 nt, Human
gguucuucaguguagcaacuguauuuucaaauauaaaucugauuuaugcaguuagcacuacagaagaaaacgcc

SEQ ID NO: 4164370 - RNA, 79 nt, Human
gguucuuccuauaguuuuggcuacugaggggucaguuaaaggaaaaaccagcucagaagccagaaagaugggacagacu

SEQ ID NO: 4164371 - RNA, 129 nt, Human
gguucuucuuaguuggcuaaugaacuccugacuaguuacagaugaaagggauuaaaaugacuuuacugagcacucacuuuagucuguuucauuaucugaacuaaggaagucuaagacaauuaggauucc

SEQ ID NO: 4164372 - RNA, 88 nt, Human
gguucuugcaauaaggaaaauuggagaaauuggauucccgaaauggguucugaagauuuccaccaaaucacauuuuuuuacaggaacc

SEQ ID NO: 4164373 - RNA, 77 nt, Human
gguucuuggccaaauucaguuccaugccauccuuguguugaagucuccauuuccuuacuggcugguggcuaagaauc

SEQ ID NO: 4164374 - RNA, 58 nt, Human
gguucuuuggcagucugauugauaacugcuuuaucaaauaggccggaccacaagaccc

SEQ ID NO: 4164375 - RNA, 115 nt, Human
gguugaaaaugggggauagggaaagagcguggggugccgugacuguccuuugcaugugucugcucaggcucugcaguccaucccgugucucuucuucuuguccaaaaauucuacc

SEQ ID NO: 4164376 - RNA, 63 nt, Human
gguugaacaucucuggcaccaaacucccuucuucucuuucagucacuuggcagagguucagcc

SEQ ID NO: 4164377 - RNA, 81 nt, Human
gguugaaucucuugaaucucuguuuucucaucaguuaaagaggcuuaaaggggcauaacagggauucaaugaggucaugcc

SEQ ID NO: 4164378 - RNA, 89 nt, Human
gguugacauucgcuggcagcugauuagauggugcccaccagaugaagggugggucugccuuccgcagcccacugacucuaguguuaauc

SEQ ID NO: 4164379 - RNA, 71 nt, Human
gguugaccgugugaggggugaucaggccccgccauccgcagacgggggcuggcuuucucuccgcaccugcc

SEQ ID NO: 4164380 - RNA, 89 nt, Human
gguugagaugggcaaggaacaaaugcucugcuucucgucugcucucugcucguggagcagaacguugguuccuuuuuacauccacagcc

SEQ ID NO: 4164381 - RNA, 76 nt, Human
gguugagcucauggaaaaguacugaaauacauuggaggggaaguuggucagugugauuaggcuaucugaguucacu

SEQ ID NO: 4164382 - RNA, 68 nt, Human
gguugaggagcaagcaugugucucccucccagcauccaauggguaaggauaugacuugucugccaacc

SEQ ID NO: 4164383 - RNA, 120 nt, Human
gguugaucaaagacaugauuuauuaaaacugauaauguuaaagggagugcgaaugacuaaaacaaaucuuuaagaguaauuauuuuggaguuuuagugcuuuaugucuauguacccuccc

SEQ ID NO: 4164384 - RNA, 55 nt, Human
ggucagaggaaaggucagauggcuuagaguaugggccaucagcuugcuucugguu

SEQ ID NO: 4164385 - RNA, 67 nt, Human
ggucagagggugggcugccugucauuucugcagccacagccugggugcugggcagcucccucugucc

SEQ ID NO: 4164386 - RNA, 86 nt, Human
ggucagagguuugcuugcacagugguuuagagccuggacuggccacucagccaaggcucaaauuuugugucuggcacuuucuggcu

SEQ ID NO: 4164387 - RNA, 69 nt, Human
ggucagaucuagaaguggcaugaauuacuucugcccauguuucauuggccaguacucagucaccugacc

SEQ ID NO: 4164388 - RNA, 55 nt, Human
ggucagcaucugguugagggcaguauaaccacgccgccugugcuaggagcugacc

SEQ ID NO: 4164389 - RNA, 130 nt, Human
ggucagccacuuuggaggacaggugggacacuagcaagguagagaugucauuggucagcagggaaaccauacauaaaauaauuucuucuuucaaugagcauucuuucccccacuugccccgcugcuggcu

SEQ ID NO: 4164390 - RNA, 61 nt, Human
ggucagccuggcaggauggccugggucagcucauggggccacagcugccagccccgcugcc

SEQ ID NO: 4164391 - RNA, 84 nt, Human
ggucagcuccuuuccugggaagauuugccaaucgggggagggaggacaaagcucuccugggagucuuccuggauggggucggcc

SEQ ID NO: 4164392 - RNA, 87 nt, Human
ggucagcugugcuauucuuccaguuuugacuguguuuacucauuuguccacgguuagccacaggcuggaaauuugucucagcugauc

SEQ ID NO: 4164393 - RNA, 65 nt, Human
ggucaggagguuaugucccaggugcugaccaugauuauacugcuuugggagaugaucuccuugcu

SEQ ID NO: 4164394 - RNA, 66 nt, Human
ggucaggauguuaauauagcauuaaggaagcaaauguguauuaaacuuuauuagcagcuccugggc

SEQ ID NO: 4164395 - RNA, 130 nt, Human
ggucaggccaaaaugugcaugcuggcugaccccccugaagcuaggucaaaaaagggccuggggaaaugaagcagucuuugaugaccuacuucaggcagccagugugcagagccaaacaacaggccagauu

SEQ ID NO: 4164396 - RNA, 77 nt, Human
ggucagggaagggcaaagauuugaaauuaggcaucacuggguucucagcugggccuccaaguuccccuccucucacu

SEQ ID NO: 4164397 - RNA, 68 nt, Human
ggucagggcuccacagugggcugaagccacacuuuacuaaaaagaggccucaccucacugcccccacc

SEQ ID NO: 4164398 - RNA, 102 nt, Human
ggucagggucccugcugacaucuggcuugugcccugccacaaaggugcugugaguccuaagagcggggcacagugauggagcacggauccuagagucugacc

SEQ ID NO: 4164399 - RNA, 59 nt, Human
ggucaggucauuuccuugauuugaagagaccagaaugguaucaggaagagagacugacc

SEQ ID NO: 4164400 - RNA, 68 nt, Human
ggucaguaagcaugaaaggcgugccaacuucagugaaauggaaagcuggcagcuuucaugaucugucc

SEQ ID NO: 4164401 - RNA, 57 nt, Human
ggucagucuugcuucucuugggucagcaugcugccugggagugcagaggcuuuugcc

SEQ ID NO: 4164402 - RNA, 57 nt, Human
ggucagugccuaucaugugggccuuccaguccgggcagcccgugagggcaucugacc

SEQ ID NO: 4164403 - RNA, 87 nt, Human
ggucagugguauuugagagaauggauaacuugaaguuguccaaauuccacagauuucucuauuuccauucuugaggucccacuuucc

SEQ ID NO: 4164404 - RNA, 68 nt, Human
ggucaguuacagccacggcgggugcuggccaagccgguaugcagggcuugccugguguguggcugacc

SEQ ID NO: 4164405 - RNA, 56 nt, Human
ggucaucggaaauaccagcugccgaucacaugcagucuucauuguauuuccagacc

SEQ ID NO: 4164406 - RNA, 62 nt, Human
ggucaucugguggcauguucaaagucaugcuccuaggcaguggcagagacagcaccaagacc

SEQ ID NO: 4164407 - RNA, 65 nt, Human
ggucaugaauguuauucaggggaauucaaauugaauucucuccaggguaacaucaccauaaaacc

SEQ ID NO: 4164408 - RNA, 81 nt, Human
ggucaugagggagcagugcaggcgugaagcugaaaccccccauuucuagucuuuguucugcugcuagcucacucugugacc

SEQ ID NO: 4164409 - RNA, 61 nt, Human
ggucaugcagcuagauuuuccagugucaugacgcugaugcugagcagagcugacaugcacu

SEQ ID NO: 4164410 - RNA, 62 nt, Human
ggucauuccagucagugugaguuuauugcaauucaguaauaauuuccagccaacuggaaacc

SEQ ID NO: 4164411 - RNA, 86 nt, Human
ggucauugacugcgucuacacaggguauggcuugaggauugguuagguucuccaagaugaagcuguguaggaugugguaaugcacc

SEQ ID NO: 4164412 - RNA, 57 nt, Human
ggucauuuuagcuccugaagcuccuauugucaucugagcgcaggagccgaggugacc

SEQ ID NO: 4164413 - RNA, 59 nt, Human
gguccaaggugagacugaagauaaguagaaucuccacacuuauuuguuuacuuuggucc

SEQ ID NO: 4164414 - RNA, 79 nt, Human
gguccacaauaugggauauacauuuuacuaagauucucaucaaaaugaacauaugaaaugucaguguuuuauaaggacc

SEQ ID NO: 4164415 - RNA, 120 nt, Human
gguccacgugggcagggaaguuggugaagucaauggggauguucugcagcugccccucuccugccagccugcccccgucugcccgacuguucuucaccacuuuguuguccagcagggacc

SEQ ID NO: 4164416 - RNA, 129 nt, Human
gguccacuuccuguuuuacucaauaaaguuuuauuggaacacagccaugcucauucuuuauggauugucuauggcugcauucccauaacaacagcagaguuaaguaguugcgacagagacuguauggcc

SEQ ID NO: 4164417 - RNA, 58 nt, Human
gguccaggaucaaggcaucaccacauuugaugucuggugagggccugccuucugguuc

SEQ ID NO: 4164418 - RNA, 58 nt, Human
gguccagguauguggugugaaugaauacuugaccaggucccacaauauaacuuggacu

SEQ ID NO: 4164419 - RNA, 122 nt, Human
gguccaggugagggcagggcgaggcugggggcaggcaaguggggagagugggcuggggcguccaggaccugacugggccugccugccuugagacccuguuucucccuacagcgccaggggcu

SEQ ID NO: 4164420 - RNA, 87 nt, Human
gguccaguccuggcauggaguggauggccccagagagcggagaggaccccgugccuggggccaucucacccacuguugagacaggcc

SEQ ID NO: 4164421 - RNA, 73 nt, Human
gguccaguuuugggcauguuguggccagcugguuauccagguggaacguucaggugcuagccaguccuggacc

SEQ ID NO: 4164422 - RNA, 77 nt, Human
gguccaugaguaaguggguaagcaugggguauauugguucuauuccuaauuugcucugcuuuccucuuacacacucc

SEQ ID NO: 4164423 - RNA, 63 nt, Human
gguccauugacuagagucacaguugcaguugcugaacuggauaauuagcucaaagcuuggacu

SEQ ID NO: 4164424 - RNA, 59 nt, Human
ggucccaaguacuaccaaucuaaucuaauuuuauaggcuuagcaagauaguacugggcc

SEQ ID NO: 4164425 - RNA, 62 nt, Human
ggucccaagugcuuuuccugcaggugcuccugaucuuugcauggaaucgaggcauuugggcc

SEQ ID NO: 4164426 - RNA, 69 nt, Human
ggucccacagccaguaaggaaagacccagaccucccaggcucccuuccuuuauuggcugccuguggacu

SEQ ID NO: 4164427 - RNA, 89 nt, Human
ggucccaccaggaaggaggccccaucaggaaggaggccccaacaggaaggaggccccaucaggaaggaggucccaccaggaaggagacc

SEQ ID NO: 4164428 - RNA, 70 nt, Human
ggucccacugcucacaaagccaaggucaauacccuagaacagccccuggcccuuuugugaaguggccacc

SEQ ID NO: 4164429 - RNA, 74 nt, Human
gguccccagcaccagcuguguccuggcugcagccuucuccugugccauccuagggcugcugaaaucugggggcu

SEQ ID NO: 4164430 - RNA, 63 nt, Human
gguccccagugccuccuaauuugucaauaaucaagaagcgauggaaaaaggcacugugggacc

SEQ ID NO: 4164431 - RNA, 83 nt, Human
ggucccccaggagccuuugacaaggauguaaaggacacauuaaaaagauguggccuuagguucuaguggcucuggugugggcc

SEQ ID NO: 4164432 - RNA, 59 nt, Human
gguccccccauggugagcacuguaggcucuaggaggcugaaguccuggccugggggacc

SEQ ID NO: 4164433 - RNA, 62 nt, Human
ggucccgggcgcuccucucuucugagaaguagucgaggcggcggaagugcccguacggcacc

SEQ ID NO: 4164434 - RNA, 55 nt, Human
ggggccuguaugagggaggccugucucugcaaaaaggcuguccuuugccagcccu

SEQ ID NO: 4164435 - RNA, 119 nt, Human
ggggccuugcccacuuacacuugucugucagcuggguugacaagauggaaagagagccucccccaccuuucccugcccaucagcucugcugacaggugcaagcaggcaagggacucccc

SEQ ID NO: 4164436 - RNA, 128 nt, Human
ggggcgauuacauagggguugagacgccgugcucuaaggcaccacugagcgcccucuuuugcuggguaguucaacaguggcugucuuggggauuggcuuuucuucagcuuccuggcauagcugcaccc

SEQ ID NO: 4164437 - RNA, 67 nt, Human
ggggcgcacgggaagagcacgaauauggagaccugaaggucuucuggaaguuuucuccugugguccu

SEQ ID NO: 4164438 - RNA, 74 nt, Human
ggggcggggcagugcaggcugggggcccugcggggcuguuucugaugggguccuugaccuggccaucccgcccc

SEQ ID NO: 4164439 - RNA, 58 nt, Human
ggggcgucaccggggcaccugggaccgggcuuucugcuguaggacccugguggccccc

SEQ ID NO: 4164440 - RNA, 75 nt, Human
ggggcuacucuuccaauuuuugcugcuauuguuauauauuaauauucacuggguacuaaaaagaugggcagcccc

SEQ ID NO: 4164441 - RNA, 79 nt, Human
ggggcuagguauugcuuagguucgugaaugcuguucuuacagacacagaugguaccugagccccucagacaccugcccu

SEQ ID NO: 4164442 - RNA, 55 nt, Human
ggggcuaggucugaucagagaagcaaguccuaccuguguuuaccugccuggcccc

SEQ ID NO: 4164443 - RNA, 85 nt, Human
gguccuuuaagaaaugaggagaacagggcuuagaaaucuguugccuagcaacaugguacuaacuuugccuuccauuuuccaaacc

SEQ ID NO: 4164444 - RNA, 108 nt, Human
gguccuuucugauacuuauuuuaacguauccucauaaacaauucuuugagguaagcaggucuuaugaggaaugagucuuaugaggaaugaguuaccagauuaaggauc

SEQ ID NO: 4164445 - RNA, 72 nt, Human
ggucgaggguauuuguaguuuacucaagcuuucacugcuaugaaguucaagggcuacauuugcacuuagguc

SEQ ID NO: 4164446 - RNA, 88 nt, Human
ggucgauggggaggugaggaggacagagcagcacgugcuuaagugcgugcuccgagugcccugucgcucacucccaccuccauuguuc

SEQ ID NO: 4164447 - RNA, 89 nt, Human
ggucgcauggcuaacuuguggcccagcccuacagaggacaauuacuuccugcucuccgugaagcugggccagucuuuacccuguggauc

SEQ ID NO: 4164448 - RNA, 56 nt, Human
ggucgccucccugagucacccaagcacuggccugagugcugcacaguggggugacc

SEQ ID NO: 4164449 - RNA, 103 nt, Human
ggucgcuaaagcccuucccacagacuaggcacuuguaaggccgcucgcccgugugugugcgcuggugcuuggucaagugggacgucuugcugaagccuuugcc

SEQ ID NO: 4164450 - RNA, 75 nt, Human
ggucgcuuggcaacucugcuccuguccugugcccccgucagggugcugggagcccaagggagcugccgggagacc

SEQ ID NO: 4164451 - RNA, 84 nt, Human
ggucggaggcuggcagcuggaggcuagaggccccgaggcauuccccucgcuguggcucucaaggcucagauucagcuacuggcc

SEQ ID NO: 4164452 - RNA, 75 nt, Human
ggucggggauggccaggcucccaagguccagcucaagaagagacugagcaaagggugccggcccuucucccggcu

SEQ ID NO: 4164453 - RNA, 58 nt, Human
ggucggguggagcuggcucuuuugacccacaugcuccaggggagcuuuccaucugucc

SEQ ID NO: 4164454 - RNA, 76 nt, Human
ggucuaaggcuuguagauuugggcuuuaauucccuguagaaggaaagggagcuuaauuucuacgaggccuaggacu

SEQ ID NO: 4164455 - RNA, 63 nt, Human
ggucuaaggucaggggaaaguuugggcacagaggccugaagcgugaccccucaccucugcgcc

SEQ ID NO: 4164456 - RNA, 55 nt, Human
ggucuacaguguuugguuugaggauuccauccucaaucggccagcacaguagucc

SEQ ID NO: 4164457 - RNA, 63 nt, Human
ggucuagcucacggccugcaccugggauguuggggcugugcagaggcgccguggguggggacc

SEQ ID NO: 4164458 - RNA, 78 nt, Human
ggucuagggguccaggcggcauaguuguaggcccugggugggguaugcaaagguuugugcuuggaaaaaacuggagcc

SEQ ID NO: 4164459 - RNA, 108 nt, Human
ggucuauuugauuugcgagcccauaucuguaaucacuaugccuuccucuggcccacuguguaggcuggcaugaggccugguuugcaugagaauggguaucagaaggcc

SEQ ID NO: 4164460 - RNA, 85 nt, Human
ggucucagcuugagccugugcuguguuugcuccaugauucagccuuggcacgucuggaggaugacagagaugggcuguugggacu

SEQ ID NO: 4164461 - RNA, 59 nt, Human
ggucuccaaagcugcauugauguggagaaaacaccuuucccuucuaguuuugagagacu

SEQ ID NO: 4164462 - RNA, 84 nt, Human
ggucucccuaaccgcuccccuaccucccuucaaguuaauguuggagcuucuccagggcugacuugggagaggagccggcagacc

SEQ ID NO: 4164463 - RNA, 121 nt, Human
ggucucucagcccggcgggccgcggccggagagggggcucccugcuuggcgguccagggccgccagcgcgcccaggagccuggccauuuccgcagagaaagcuccgugccucugagagacc

SEQ ID NO: 4164464 - RNA, 55 nt, Human
ggucucugaagcuuuuagucccuuggauucuuuaggccugagggcaacagaggcu

SEQ ID NO: 4164465 - RNA, 67 nt, Human
ggucucugugugaccauaagccagcuuuccucaucaaugagaguaaauguuuaucacacagauggcc

SEQ ID NO: 4164466 - RNA, 58 nt, Human
ggucucuugugguuuauaaagauauauuuuaugucuuuuaugauuacgggaugaugcc

SEQ ID NO: 4164467 - RNA, 75 nt, Human
ggucucuuuugaaugcuagugugauauguaagggccugauuucugccuuaauuucacugguguuucuuuggggcu

SEQ ID NO: 4164468 - RNA, 64 nt, Human
ggucugaaaccagcacacggcgggugugggcacuugcauccauugucuuguuggcuucuaugcc

SEQ ID NO: 4164469 - RNA, 64 nt, Human
ggucugcagggcugcagagggcacuguugcuaccaaacauacacugccguaguccuagucuacc

SEQ ID NO: 4164470 - RNA, 77 nt, Human
ggucugcaguaaacaguuacuaagaagauucucuaacuacaugagaugggucucuaccuuucuguguacuguuugcc

SEQ ID NO: 4164471 - RNA, 59 nt, Human
ggucugccaguagcucgcagaguugggcaccaucagauguucccagagcuacugagacu

SEQ ID NO: 4164472 - RNA, 130 nt, Human
ggucugccuccccaaccccugccugaaacagugcagggagaagguggaagugcagagugggcucaccucucgcccacacuguccccuucuccccagcgagcugaggcugcccagcgggagguggaaaguc

SEQ ID NO: 4164473 - RNA, 94 nt, Human
ggucugccuuagcuugccugcccuuggcaccaggcucugucccagugccaggagcccugggcaaguucauacaucaaacgaggaggcaguggcu

SEQ ID NO: 4164474 - RNA, 129 nt, Human
ggucugcuccacuccucuguucugugccgcucgguucugccuguggcuucuguggcauuccucugcagucuuuucugccauaggacccagguugaacaccagagguggaggccagaggcggggcacgcu

SEQ ID NO: 4164475 - RNA, 87 nt, Human
ggucuggaacuccugggcucaagccuucugcccaccucagccucccaaagugcugggauuacagaugugagccauugagcccagacu

SEQ ID NO: 4164476 - RNA, 56 nt, Human
ggucuggcacgaggccuagagaggggccaaagccaagggaggccucugccggugcc

SEQ ID NO: 4164477 - RNA, 63 nt, Human
ggucuggcugggccgccuauuuugggagcaggaguggccagcccgaggcuucccaggcaggcc

SEQ ID NO: 4164478 - RNA, 69 nt, Human
ggucuggcuucugcagaaaccaauucaaguaaguguuuccauuucuaugaaaggggcucugaccagacc

SEQ ID NO: 4164479 - RNA, 72 nt, Human
ggucugggcccaggugcucuugccagggcugcuuucuaggguagaauggaggaagagccuugggcaagggcc

SEQ ID NO: 4164480 - RNA, 82 nt, Human
ggucuggggguggaccaggggaugguuggcacugugggauuagggcugagugccuuccccaugcuuugggauuccccagucc

SEQ ID NO: 4164481 - RNA, 80 nt, Human
ggucugguggaggugcauuucggagcuuggagacugccccacccacccccgucugcucuaggagugcaccuccccccacc

SEQ ID NO: 4164482 - RNA, 61 nt, Human
ggucugguggcgacaggcuaacguagagcuggcugcuuuuaugagaaugcgccacuugacc

SEQ ID NO: 4164483 - RNA, 56 nt, Human
ggucuguccugcccuugaggauuuugauuacaugaagaggccuuacaggauagacc

SEQ ID NO: 4164484 - RNA, 57 nt, Human
ggucugugaccucagugucucagaaccuuuguuauuaugcacccugaggucauggcc

SEQ ID NO: 4164485 - RNA, 67 nt, Human
ggucugugaucuuauggauucuuucuguaugauuugauuuugaugaucccauaggauucuucaggcu

SEQ ID NO: 4164486 - RNA, 124 nt, Human
ggucuuaaaauauuugagaauccgguccguacaaacucugcuguguugaaugauuggugaguuuguuugcucauugauugaaucacugcagaguuuguacggaccggauucuccaauauaggcc

SEQ ID NO: 4164487 - RNA, 72 nt, Human
ggucuuaaguuuguucagggcuuacauuauaauuugcccaaauuuaauguaacuuuaagcaaauucaaggcu

SEQ ID NO: 4164488 - RNA, 95 nt, Human
ggucuuagagcuaagaccaaggggcaacagagcucccuuccuucugcaagcuguagggaaggcucuguuccuugacuuuucuggcuucuaaggcc

SEQ ID NO: 4164489 - RNA, 55 nt, Human
ggucuuagugacucauaaguggaggagaaauccacauauagcagccacuaagguc

SEQ ID NO: 4164490 - RNA, 63 nt, Human
ggucuucucaacaauugugugagauguauuacgauacccauuuuaucaaucagaaagaagacu

SEQ ID NO: 4164491 - RNA, 64 nt, Human
ggucuucucccagaguuugcugcacauuggccauggauacaaaugugcagaggguaggaaggcc

SEQ ID NO: 4164492 - RNA, 55 nt, Human
ggucuugcccuagaggucugggggccugcaaagucccucaccccuaggcaaugcc

SEQ ID NO: 4164493 - RNA, 125 nt, Human
ggucuugggcugcugguggcucucuccacggagcuaagcagccaccucaucuccacucagcauggcugcagugggugucuuggcugugagcggccccugggagggugcccaccacgccccaugcc

SEQ ID NO: 4164494 - RNA, 68 nt, Human
ggucuuuaaagggggcuggcauugggcauugguguuuuaaguccagaccugaggcccucacuaaggcc

SEQ ID NO: 4164495 - RNA, 92 nt, Human
ggucuuugauggugcugagaguaaggaaaugggagaucuccaccauccucauggaguccuucacguccugcuuauuggcaaauaucaggacu

SEQ ID NO: 4164496 - RNA, 76 nt, Human
ggugaaacugcugacuuugagggauacaaacauuuugaaagaaagugucuuuuaaaaaguuuauaacauuuucucc

SEQ ID NO: 4164497 - RNA, 79 nt, Human
ggugaaaucccuggauagcaaagcuccugguucucaacuucauucauauaagaaagguucuugguguccagauuucggc

SEQ ID NO: 4164498 - RNA, 89 nt, Human
ggugaacaaagcccucggagagcucacagcuguggcccagggaacacauuccaccuggcucagcugugaguucuuccuugcacugugcc

SEQ ID NO: 4164499 - RNA, 72 nt, Human
ggugaacagagggucucucgucugagcgugugguccgugggccguguggcagccucagacaaggaccucacc

SEQ ID NO: 4164500 - RNA, 62 nt, Human
ggugaacagauaauagaaaugaacucucucucccagccauguucuugcuuuaucuguuccuc

SEQ ID NO: 4164501 - RNA, 70 nt, Human
ggugaacagaucaccugaggucaggaguucgagaccagccugaccaacguggugaaacccugugucuacc

SEQ ID NO: 4164502 - RNA, 88 nt, Human
ggugaagagguucaggaugugaggugguaaacagggacagaaagccucccagaugugccccaaccccucauaucuucccaucaucacu

SEQ ID NO: 4164503 - RNA, 55 nt, Human
ggugaagcguauuuguggagcuuuuaaaauaggcccauagacucuuuaguuuccc

SEQ ID NO: 4164504 - RNA, 64 nt, Human
ggugaaggagggguaggaaaggguuacuugggaaagguaacaagaugucacuccuguccauacu

SEQ ID NO: 4164505 - RNA, 61 nt, Human
ggugaaggcacuugccuaggggcacauagucugugcaccuguagugagcugugccuuugcu

SEQ ID NO: 4164506 - RNA, 57 nt, Human
ggugaaggggcucucacagggcaguauguuugagacccuuagagggcucuccuuacu

SEQ ID NO: 4164507 - RNA, 80 nt, Human
gggucugcccacccagagugacaggaccaccucaaaacaugcaaagaggguccuggcagcucuguguccaugggcaacuc

SEQ ID NO: 4164508 - RNA, 56 nt, Human
gggucuggagauccgggugaaggucucagacuauguacaagaccggauucgggccc

SEQ ID NO: 4164509 - RNA, 55 nt, Human
gggucuggagggcagcccuucuguguuacugaauccucggggccacuucaggcuc

SEQ ID NO: 4164510 - RNA, 94 nt, Human
gggucuggccagcugcggcccugaugaggcucagugagcccugcagagugcagccuguuggggguccugggccuugggccagcuccccagaccu

SEQ ID NO: 4164511 - RNA, 69 nt, Human
gggucugucacuucaggaaugcagggagugggauuuauuuguugucuugauccccccugaagcagaccc

SEQ ID NO: 4164512 - RNA, 56 nt, Human
gggucuuauggcuauuuucauuucuagggacauggaagaaagauaauuaaggaccc

SEQ ID NO: 4164513 - RNA, 69 nt, Human
gggucuugcuuuguuacccagguuguagugcaguggugcauucauagcucaguacagacucaacuuccc

SEQ ID NO: 4164514 - RNA, 81 nt, Human
gggucuuggauuuauguuugaguauaugacucagaugcaauuuugaauuauauucacgagcaaauucuuuaucucagauuu

SEQ ID NO: 4164515 - RNA, 78 nt, Human
gggucuuggguguggggcaugauaggagcccaucuguggauuaggacacugagcagccccaccagccauuaaagacuc

SEQ ID NO: 4164516 - RNA, 76 nt, Human
gggucuuuggcuguggguuugcucaggccucuucugaauccagggugauccccucuggcaacuucacagcccaccc

SEQ ID NO: 4164517 - RNA, 84 nt, Human
gggugaaaagggggauuuaauaucuguuacuggaaguaucuggcuucagaagugguauuaauuagauuucagucuuuuucacuc

SEQ ID NO: 4164518 - RNA, 76 nt, Human
gggugaagcagggcugcuauguugauucagaccaugguacuccagaguugugcagaauacagccuugugaccaccu

SEQ ID NO: 4164519 - RNA, 79 nt, Human
gggugaagggaggggccaugcuugcaggggccagugaccgaggcccgccguuggaacugauggccuucaucccgagccc

SEQ ID NO: 4164520 - RNA, 113 nt, Human
gggugaaggggcagaggugagugggagggaaggcugggggcuggggagaacuucaugaccagagugggccagcucccugccccuggggcugccucccacgugcccccucaccc

SEQ ID NO: 4164521 - RNA, 60 nt, Human
gggugaauaagcugaacacuuggguaaauaaaaauaccuagggauuguucuuauucauuc

SEQ ID NO: 4164522 - RNA, 129 nt, Human
gggugaauauuggccuuguuccuuuagcccagcucaaggacuuauucaugccuguagucuaccaccaugaauuaggucugguauugagucuuggaagcaugggguuuggguuaauaaggcauauucccc

SEQ ID NO: 4164523 - RNA, 126 nt, Human
gguggggcugggggacaaggaccuucccucccucucagauuuggggcucaccagggcugagauggcgucuccccucagacucugggcucccugggguaggggcagggucccgcccucagaaucagc

SEQ ID NO: 4164524 - RNA, 60 nt, Human
gguggggcuuaccucugaagcuggcaucucaccucugucagcauucuuggccaguccacc

SEQ ID NO: 4164525 - RNA, 73 nt, Human
gguggggggcugcaaacccaggucccuuuaaacagauagcauagauccuggcucauuaugugcccccagcacu

SEQ ID NO: 4164526 - RNA, 102 nt, Human
gguggggguggggcugugugcugagagugggugcagugcuucaccaagaggccccugcaggugcuguucucuuuuuuaacauguggaccuccauccucagcc

SEQ ID NO: 4164527 - RNA, 70 nt, Human
gguggggguggguagaagugacaaaaauuaaaaaaccaagaaguuuagagucccuuucucaccacccucc

SEQ ID NO: 4164528 - RNA, 58 nt, Human
ggugggucaguagccuugcagaacuguccugagaaguuauugcuggugcuggccagcc

SEQ ID NO: 4164529 - RNA, 81 nt, Human
gguggguccuggguuggcucugcagcagugugcgugcucauuauagguaagaccugccugcagggcuggaggggauuugcu

SEQ ID NO: 4164530 - RNA, 65 nt, Human
gguggguggauggagagaggcccccagccuaaggacccaggcuccugccuucccaccacccgucc

SEQ ID NO: 4164531 - RNA, 86 nt, Human
gguggguguaaaugagguuaaggaaaguacauguuuugacuccacagcagaaagaagucauuuauaugucuuuccuucaucccacc

SEQ ID NO: 4164532 - RNA, 79 nt, Human
ggugguaagaggggcuguguguggaguuucuguacauguguuucugcuaugguuccuacagcccugaaucucuaucacc

SEQ ID NO: 4164533 - RNA, 64 nt, Human
ggugguagaauugcacgaacugcuggggaaggaaaacauauccuagcuggccaauucuauuacu

SEQ ID NO: 4164534 - RNA, 66 nt, Human
ggugguccugggccaucacugggacagacugaaaaggguggucuggcaggugaggacucagccacc

SEQ ID NO: 4164535 - RNA, 68 nt, Human
ggugguggaagagauagugagaagcuguaacuuaugcaauggucgccuggcugacucuuccuaucauu

SEQ ID NO: 4164536 - RNA, 56 nt, Human
ggugguggucccgacuugggagauccugggagguccuguggugggggcuggccucc

SEQ ID NO: 4164537 - RNA, 84 nt, Human
ggugguggugcaauguggagcugggggagagaagcccagaaaucgggugggcugagcucagucccagcucuacagccacugacc

SEQ ID NO: 4164538 - RNA, 55 nt, Human
ggugguguaugccugcaguccuagcuauucgagaggcugagauggcagaaucacc

SEQ ID NO: 4164539 - RNA, 64 nt, Human
gguggugugggcguggcaggcaagcccagcacccuaggguuucuagccagguucugcauuuucc

SEQ ID NO: 4164540 - RNA, 55 nt, Human
ggugguucacgccuauaaucccagcacuuugggaggccaagguggguggaucacu

SEQ ID NO: 4164541 - RNA, 55 nt, Human
ggugguucacgccuauaaucccagcacuuugggaggccgaggcagguggaucacc

SEQ ID NO: 4164542 - RNA, 55 nt, Human
ggugguucacgccuauaaucccagcacuuugggaggcugaggcggguggaucacc

SEQ ID NO: 4164543 - RNA, 55 nt, Human
ggugguucaugccuguaaucccagcauuuugggaggcugaggcaggcggaucacc

SEQ ID NO: 4164544 - RNA, 72 nt, Human
ggugguucgaguguaguaggccauaugaacuucauaugauugguuuuuugugauggcauuacauuuaucauc

SEQ ID NO: 4164545 - RNA, 88 nt, Human
ggugguucugggucugggauccucuauggggugucaggucuaaguccuggagccuucaccaggggaaaggucccugacccacacuccc

SEQ ID NO: 4164546 - RNA, 86 nt, Human
ggugguugucuccgugagccacagcugcugucaucgucugugcccccaaccgagugcagggacugugaucucacagaaaagccacu

SEQ ID NO: 4164547 - RNA, 68 nt, Human
ggugguuucauuuaauuuguauaauguaauuuuuguaaauguauuauacauuuuguguagagaucauu

SEQ ID NO: 4164548 - RNA, 85 nt, Human
ggugguuuguggaagauggcuucucucuagcuugguguuacaugcuuacaugaccaggucccuagggauaggcccacccagcccc

SEQ ID NO: 4164549 - RNA, 71 nt, Human
ggugguuuugcuuuauuauuauuauuguuauuauuauuaguagcaguauauuuuaaggaagcuuuuuuauc

SEQ ID NO: 4164550 - RNA, 61 nt, Human
gguguaaaaacauacuauuucuagccaacugagggacuaccuaggaaauauguuuuuaccc

SEQ ID NO: 4164551 - RNA, 70 nt, Human
gguguaacgcagagccucucagaggucagacaauuuuguugugaccucagcaggcuacuaugauuagacu

SEQ ID NO: 4164552 - RNA, 74 nt, Human
gguguagcugucugaguuuuuacuuacucaauucucacauuguccugagauaaggaacagaccuuuucugcacu

SEQ ID NO: 4164553 - RNA, 61 nt, Human
gguguaugugagugcaugcaugcacaugugugaguguguguguuucugcucauacagagcc

SEQ ID NO: 4164554 - RNA, 70 nt, Human
gguguauuacugcuguuaggauauuuuuuaguacuggaaaaaugacacuaacagcuguaugaaauaaacc

SEQ ID NO: 4164555 - RNA, 86 nt, Human
gguguauuuuuuaaauuccauaucugugauuauuagcauuucauugagcuaaugagauacuccagaaugggacuuggauugagacc

SEQ ID NO: 4164556 - RNA, 90 nt, Human
ggugucagaagaacagcucgcagagggcaggcagugcugguggguacccagccacuauuuuauccugucccuugguucucucugaacacc

SEQ ID NO: 4164557 - RNA, 124 nt, Human
ggugucccagcauccagcccggggguuucaucuccugagcccugucaugaaugugcugcugccuuucaguagacucucuugcuagagugaagggucuugaggcuccugaaggaaaggggacacc

SEQ ID NO: 4164558 - RNA, 72 nt, Human
gguguccccagugcccagcugcccaggcacugaggggcaguucugggcagagcuggagcugcuggugaugcc

SEQ ID NO: 4164559 - RNA, 58 nt, Human
gguguccucaaggagccaagcagccuccauuucucugcuuuucucuccgcaggacauu

SEQ ID NO: 4164560 - RNA, 86 nt, Human
gguguccuccugcugugaagccaggccuguaggagccugcaagccucggggggcacaggggacaggccugacacacagagggcucc

SEQ ID NO: 4164561 - RNA, 123 nt, Human
ggugucuaucugcuguccagggaggaggggcgaagagaggcugggcguagggcuuccccgcacucugcgaaguccucccggccuccuuccggagaauuccuugaugacgauucagcagacauc

SEQ ID NO: 4164562 - RNA, 68 nt, Human
ggugucucuguggcuggcuccuuccagcgguuccacccucugggcaggaggcgcagccacggauagcc

SEQ ID NO: 4164563 - RNA, 55 nt, Human
ggugucuguggggacucuguaguaugaauuucuacuucagggcuuuggggacacc

SEQ ID NO: 4164564 - RNA, 60 nt, Human
ggugucuuggggucugcuuaagugagaaaacacgguagcagcagacagcccaagaaaauc

SEQ ID NO: 4164565 - RNA, 84 nt, Human
ggugucuugucaaacaugcagugagccgaugagggaacugccgccucuuucgaggaaacugccaugguaagcaagcaggacgcc

SEQ ID NO: 4164566 - RNA, 72 nt, Human
ggugucuuuuuccuuuaagagaaugguauauuuugaauaugcauuggucuuaaucuucaggggaaaagcauu

SEQ ID NO: 4164567 - RNA, 74 nt, Human
ggugugaaggcacacaggcuggcugagcccugaccccagugccaagcuaucccagccucuguggcugccacacc

SEQ ID NO: 4164568 - RNA, 65 nt, Human
ggugugaaggcgacaggaccacguggcacggggccccuggccuaaaguccuggcgccgccacacc

SEQ ID NO: 4164569 - RNA, 85 nt, Human
ggugugagaaaugagguuguagauguucucuugaaaaauauaccuuucuguuucuuaagaaaccaucacauuccuuuuucacuuc

SEQ ID NO: 4164570 - RNA, 66 nt, Human
ggugugcaacuuucauuaauauuugguaaugccuuuucuuauaucccagguauugaaguugacacc

SEQ ID NO: 4164571 - RNA, 60 nt, Human
ggugugcaguucagaguggucuuggggaagcgguggugcuagacccucuggacugggccc

SEQ ID NO: 4164572 - RNA, 61 nt, Human
ggugugcaucucacccuuccccgucggcuuuuugaggaugguccugguugaggugggcccc

SEQ ID NO: 4164573 - RNA, 68 nt, Human
ggugugcauguuuagggaaacaaacauuuucuuccugcuguggauaagugucauguuucuuugucacc

SEQ ID NO: 4164574 - RNA, 86 nt, Human
ggugugcauugcaaguaucuucaaguuucuucuagacuuuaaagaaauuaaaacuggaaauuggagaugauguuuuaugugucgcu

SEQ ID NO: 4164575 - RNA, 69 nt, Human
ggugugcgccaccuugugauccacccgccuuggccucccagaguguugggauuacaggcauaagccacc

SEQ ID NO: 4164576 - RNA, 100 nt, Human
ggugugcugugacacacugggauucugaaaauggauuacaaauacgccaagguauugguucuucagcccucagguccuaggccagucaccccuggcagcc

SEQ ID NO: 4164577 - RNA, 77 nt, Human
gguguggaugucucagagacaucagguuguagcagugucugaaauuuguuuccuaagugucucugaaguccagcgcu

SEQ ID NO: 4164578 - RNA, 67 nt, Human
gguguggcugugaguuuuugauuugcucaaugauauaggacuucagcauuuuaaauacagucauauu

SEQ ID NO: 4164579 - RNA, 108 nt, Human
gguguggugauggugaguacauccuguaucagaauguuaaaagccucaguugacggacugagaguugugcauucaugccaaggacugacucuccucugagacuaugcc

SEQ ID NO: 4164580 - RNA, 68 nt, Human
gguguguagcauguuuaagaccguuaucucuugccucaucuuaaagguccaggaaaggcagcagcacc

SEQ ID NO: 4164581 - RNA, 78 nt, Human
guaucacaguggguggcagagauagaacuggaauuaauaguaaccucauuuuaaauuucuguuauauccacuuugaac

SEQ ID NO: 4164582 - RNA, 94 nt, Human
gguuaacuguuuuuguguguguguguuuuauacagugaaacauuuuuaaugugaaauucuugaaaugcacacaaaaguacagaaaaugcuaacu

SEQ ID NO: 4164583 - RNA, 77 nt, Human
gguuaagaacuuguugaaggucucagagcuaggacuucaaaccaggcagacuggcaccagguucuguguacuuaacc

SEQ ID NO: 4164584 - RNA, 64 nt, Human
gguuaagaauuuggcagucagcagcucagacucugucuucaggcuccuggauucaaauccugcc

SEQ ID NO: 4164585 - RNA, 61 nt, Human
gguuaaguggcuggucuaaggucacagagcaagucaguggcagagccguugccaucugacc

SEQ ID NO: 4164586 - RNA, 57 nt, Human
gguuacacagugcacaagcagagugauuauugucuacucggcguugugcuguguacc

SEQ ID NO: 4164587 - RNA, 68 nt, Human
gguuacaguuugugcugagaauaggcugcacguggcugcagcccuuuuuugguacaaccguuguuccc

SEQ ID NO: 4164588 - RNA, 75 nt, Human
gguuaccuuaacgaugucaugaauacuucaugaaauaugauguuucuaauuuucugagauuguuaggcacuaacu

SEQ ID NO: 4164589 - RNA, 97 nt, Human
gguuacuagagccugguuauuggagccugguuacuagagccugguuauuggagccugguuacuagagccugguuauuggagccucguuacuggagcc

SEQ ID NO: 4164590 - RNA, 71 nt, Human
gguuagacauuggguguacaauuggcaaugucugccaaagauacugccaguaauagcucuuuguacuugcc

SEQ ID NO: 4164591 - RNA, 55 nt, Human
gguuagagggcaugcgaucuuuucuuacaugauuaugaucucaugugcugugacu

SEQ ID NO: 4164592 - RNA, 66 nt, Human
gguuagagguggagccuggacuagaauccugcucucuugacuuccaguccaggagucacccaagcc

SEQ ID NO: 4164593 - RNA, 71 nt, Human
gguuagcuagggggcuuugguugucucaaagcucauuaugagucauugaacgaagagcuccauuccucacc

SEQ ID NO: 4164594 - RNA, 74 nt, Human
gguuaggagugggguccauccacacgugcuuccagcccuggagaccagcagcauggaugggccucagccuagcu

SEQ ID NO: 4164595 - RNA, 63 nt, Human
gguuaggauuauauaucccaugaugcccuacaguggggaucagaggauagaaauacuuauucc

SEQ ID NO: 4164596 - RNA, 67 nt, Human
gguuaggcuggggcaaaauaggguuuccuuucuuggacgugcuuuaucuguguccucuugccuggcc

SEQ ID NO: 4164597 - RNA, 81 nt, Human
gguuaguauaagcugaaggacuuggugauaguugagacaguuauaaccucaacuaucugguaaguucuuuggaaaauaacc

SEQ ID NO: 4164598 - RNA, 83 nt, Human
gguuaguaugauuuguaauucaauuagaauagugccuggcauauaauaggcacuugauuaaugugaauucauuaugacuagcu

SEQ ID NO: 4164599 - RNA, 74 nt, Human
gguuagugcagggcaggcaggagcccaacugccugggccacuuccgggcucugguacuuccuggcucugugacc

SEQ ID NO: 4164600 - RNA, 78 nt, Human
gguuaguuggcuccccuguucaggucacaggcuccaaggcuugguucugucaucuguaacaggaggguugaaauaacu

SEQ ID NO: 4164601 - RNA, 120 nt, Human
gguuauacuccuccucuuauugaacccuauuguuucuggucucuguauucuuccuggauacagagccaaaaggacauaguagcauaaaguaugguguagcuagaaggaagggugauaacc

SEQ ID NO: 4164602 - RNA, 64 nt, Human
gguuauagucagggaugcaauuaugugugggcuauacaugauuuugucaucugaauucuuagcc

SEQ ID NO: 4164603 - RNA, 57 nt, Human
gguuaucgaagcuggacauucuaaauguugugcgucaagugucuggauuuuguaacc

SEQ ID NO: 4164604 - RNA, 64 nt, Human
gguuaugggugguugaauauccucauauccagcugauuggaguaugaauggaaacuaccuaucc

SEQ ID NO: 4164605 - RNA, 75 nt, Human
gguuaugguugacucaucugaaaaaugaggagaauacacuucuuuucaccuucagauguagacaggacuaggacc

SEQ ID NO: 4164606 - RNA, 80 nt, Human
gguuauuuugaaacugcauuugcauaaguccaucugagcaaacauuuuuauggaguuaugaggugugguuugcaucagcc

SEQ ID NO: 4164607 - RNA, 62 nt, Human
gguucaagccuccccuggggcagguggcuucaaacccaccugggucccagccaggcuuugcc

SEQ ID NO: 4164608 - RNA, 65 nt, Human
gguucaaggcauacuccuuucucagccuccugaguagcugggacuauagaaugugccacugugcc

SEQ ID NO: 4164609 - RNA, 55 nt, Human
gguucacauauugagaguauucucaaaugugaagaguacaucucaaauguaaauc

SEQ ID NO: 4164610 - RNA, 75 nt, Human
gguucagauaguuuagguaacugucuugaguuccuacagauagauaauaaguaacagaucuacauugucugaccc

SEQ ID NO: 4164611 - RNA, 107 nt, Human
gguucagcauuagauuguugcccuguuaagaaugucuaaugugcauuuaaaaguauuggaaagcaggcauuuuugacaaagagcaaugucacuauaacauaugaacu

SEQ ID NO: 4164612 - RNA, 59 nt, Human
gguucaguaacuuggccgaggucauacagcuaacaaguuuaagagucaagaucugaacc

SEQ ID NO: 4164613 - RNA, 121 nt, Human
gguucaguccuuaacuugccauucucuuguuuuaaagauucuccuuuagauaacucacuugcuuaugaauuauuagcaauucucugugggggugucuuaaccuagagcucuaggcugggcc

SEQ ID NO: 4164614 - RNA, 129 nt, Human
gguucagucuuucaugggaaagcucugaggaagcuuugucuugucuccuggacuaucuccugagagaaaguauugucagccaggagucaaauaaagccaggccuggagauucagaggagacgaugagcu

SEQ ID NO: 4164615 - RNA, 88 nt, Human
gguucagugacugugcuuuucucugcuccuggacacugcagcucgcaagcugcuuucccucggaacagaaaagucacagcuaugagcu

SEQ ID NO: 4164616 - RNA, 114 nt, Human
gguucaucaagaggcugagggauccaguuguggcuccgauguuugggugcccuugggauacccgggaggcaggagucauagauuuggagcgucccgaguggccagacgagagcc

SEQ ID NO: 4164617 - RNA, 78 nt, Human
gguucauccaugucagagcauguaucagccucuucuucuuuuuaaaggcugaaugauauuccauuguauggauagacc

SEQ ID NO: 4164618 - RNA, 92 nt, Human
gguuccaagagggucuggaagcuucugagaugcucucagaccucaccugagggcugccugguuuagugcugacuccagaaccccugggggcc

SEQ ID NO: 4164619 - RNA, 82 nt, Human
gguuccaagucuuugcuacugugaauagugccacaauaaacauacgugugcaugugucuuuauagcagcaugauuuauaauc

SEQ ID NO: 4164620 - RNA, 82 nt, Human
gguuccaagucuuugcuacugugaauagugccgcaauaaacauacgugugcaugugucuuuauagcagcaugauuuauaauc

SEQ ID NO: 4164621 - RNA, 80 nt, Human
gguuccaucucuguggacagauuccagugggggagccuguaggaggcuaguuccuggucugugccauucagagagaagcc

SEQ ID NO: 4164622 - RNA, 73 nt, Human
gguucccaauguggggaaauguccugccuucccucccauuccagguaaaguaguaaauuucccauuggucacu

SEQ ID NO: 4164623 - RNA, 77 nt, Human
gguucccauggcuagugucgggaacgcaggccuguccacuccccaagccccuuccuguccgcaauggccugggagcc

SEQ ID NO: 4164624 - RNA, 67 nt, Human
gguuccgucuuugaagauuugaugcugugaauuuggaccuggccuggcagcagaucuuaaagugacc

SEQ ID NO: 4164625 - RNA, 56 nt, Human
gguuccuggcagauguagggcugauguuccugcuuccuuacugucagccaggaauc

SEQ ID NO: 4164626 - RNA, 58 nt, Human
gguucguauuguggagucacuuaaggagcuaucccaaaguacuuuaggauauguaacu

SEQ ID NO: 4164627 - RNA, 64 nt, Human
gguucuaaauguuuuuuguacauauuuguuguaagcauaacacauauuugcaguaagcagaacc

SEQ ID NO: 4164628 - RNA, 63 nt, Human
gguucuaggagucugguuccugccuuggugcaggagucuugggggagcuggacuccuagaucc

SEQ ID NO: 4164629 - RNA, 78 nt, Human
gguucuauaagcaaauucuggaggugaggugcaguuguuucaaauacauccuccuccuucagaguauuuaucugaauc

SEQ ID NO: 4164630 - RNA, 71 nt, Human
gguucuaugguaauaugauuuguuguaauacagcaauuccuguaucacaucuugugauguuuucaugaacc

SEQ ID NO: 4164631 - RNA, 73 nt, Human
gguucucaagaauagcugcaaacagggcaauuggccuaaaaacaauuuucugaaagccaauucauugaaagcc

SEQ ID NO: 4164632 - RNA, 63 nt, Human
gguucugaaguggucccauuccgggcugugcugaccuuuuuuccgggaccaaagaucagaacu

SEQ ID NO: 4164633 - RNA, 80 nt, Human
gguucugagccuguaccgcgaucugcugcgcgccgggcgugggaagccgggcgccgaggcgcgagugcgggcagaguucc

SEQ ID NO: 4164634 - RNA, 62 nt, Human
gguucugcacaucacacaggugcuggaagaaaugaagacaugcacucagagguagcagaacc

SEQ ID NO: 4164635 - RNA, 59 nt, Human
gguucuguggcuuuucucuuuggguuccuuccuagagaugcgguuccaugguuaugacc

SEQ ID NO: 4164636 - RNA, 69 nt, Human
gguucuuccuuuccacauucacagcuacuucuggaaucagaggucaaugggacuuggaucugaagaacu

SEQ ID NO: 4164637 - RNA, 57 nt, Human
gguucuugacaaucuuggucuuugcuuucagaggagacuguauuguuuucaaggauc

SEQ ID NO: 4164638 - RNA, 120 nt, Human
gguucuuuggaaggauguauagugucuguaucuuugucuucauguuggauggguguggagguaagauauacaauagauguggauacagauguacaaauauauacacaagaaaagagaucc

SEQ ID NO: 4164639 - RNA, 80 nt, Human
gguugaacauuuugauacugagaaaaacaaauggaauccauguuuucauuguccuuuuccugaguguuguauuguucucc

SEQ ID NO: 4164640 - RNA, 73 nt, Human
gguugaaccauaugaaauugacaauuugugggucaaaaauacuugaacauuggcaauuucauauuuuucaacc

SEQ ID NO: 4164641 - RNA, 59 nt, Human
gguugaagcuacuuucuggaugccuaguuacugcugaugucuagacauuagcuucagcu

SEQ ID NO: 4164642 - RNA, 66 nt, Human
gguugaggacaggagccaagaaccucaggccaggcugccuggcuggacuugguccuguuuugagcu

SEQ ID NO: 4164643 - RNA, 109 nt, Human
gguugaggagacagucucuagguagauaacuuguccaaggucaguggcuaaaaaguggcagaugugguuugagacaggucuuccugcucuagagccuguauucuuuuuc

SEQ ID NO: 4164644 - RNA, 71 nt, Human
gguugaguggagugagcaccggacuaggaguccucaggagaaaggagucuggugcucgcucugcuucuacc

SEQ ID NO: 4164645 - RNA, 75 nt, Human
gguugauaacagaaguuuguuauguaaacaaaugcuaucaaccauuuguucaccuagcaaacuuuuguuaagacc

SEQ ID NO: 4164646 - RNA, 99 nt, Human
gguugauucauaauucuugguauaaaaccaaguuuuccuuagucuugaggaauuugaagaaagguaaaauguuggauuuuaagcaaaguaggauugacc

SEQ ID NO: 4164647 - RNA, 82 nt, Human
gguugcaagucuuugcuguugugaacagugccgcaauaaacauacgugugcaugugucuuuauaguagaaugauuuauaauc

SEQ ID NO: 4164648 - RNA, 55 nt, Human
gguugcacuagacacauuucaagugcugaauaggcacauaugacuaguagcuacc

SEQ ID NO: 4164649 - RNA, 73 nt, Human
gguugcagcagggaggucuagcacgugggucuugagaucagcauaccaguggacuucucccuguggugcagcc

SEQ ID NO: 4164650 - RNA, 119 nt, Human
gguugcaggggaugugugcccagcaucaggagcaccccugcaggccucgcagcuauagaugguggaaguccagugcuggaggcugaguugggucuccugugaggcagucccccguggcc

SEQ ID NO: 4164651 - RNA, 94 nt, Human
gggugacaaaaacaauauaaacaaguuguugaaaauaauuaucuuugggugauuggguuaugaugauuuuauuuuauuguuuugcuguuuucuc

SEQ ID NO: 4164652 - RNA, 62 nt, Human
gggugacauagugauggggcauaaagcacuucccaccaagcuagcaaaucacuguuucaguc

SEQ ID NO: 4164653 - RNA, 61 nt, Human
gggugaccucacaucccagugagccccucaauucagggccagggagguugauugguuaccc

SEQ ID NO: 4164654 - RNA, 64 nt, Human
gggugagcacauuaaugguuucauccauuaaaucuuuuggugcugagaauugauguccuugucc

SEQ ID NO: 4164655 - RNA, 60 nt, Human
guggcaaggcauggcauggggcagaugugggaucacaucccagccuuccugcuuacccgc

SEQ ID NO: 4164656 - RNA, 92 nt, Human
guggcaauauguacgugcuaggaagaagggugcuugaaagaacauauguccuggauauuucauagcuuuuucuuuguaauaugugaagcuac

SEQ ID NO: 4164657 - RNA, 85 nt, Human
guggcaaugcagauuccugggccugccucuagugauucccauucaguagguuugggguggggcccaggaaaucuauauuuuucac

SEQ ID NO: 4164658 - RNA, 61 nt, Human
guggcacauaggauccuguggcuagagugcuuacucaugugacaugaaacuguguugcuac

SEQ ID NO: 4164659 - RNA, 72 nt, Human
guggcacuguugagucaaaagaaaaccagguuugaaaucagaaaaccuggcuucuaaucauggcucugccac

SEQ ID NO: 4164660 - RNA, 98 nt, Human
guggcagaaagugugguacuuagaaguuaugauaauaauagugucuuacuaaagucaucaaagaacuuucguauguauuacuauuaaauuuucucuac

SEQ ID NO: 4164661 - RNA, 62 nt, Human
guggcagaaauauucuugcucugggucuuagcaaucaugagagcauaagcauuauuugccac

SEQ ID NO: 4164662 - RNA, 57 nt, Human
guggcagaaguacacaagcaugcagcugucugugcugugagcugauacauucucuac

SEQ ID NO: 4164663 - RNA, 59 nt, Human
uacaguuucccagcagaugcaagccuucaggacuuguuauuuuggugaggaaauuagug

SEQ ID NO: 4164664 - RNA, 55 nt, Human
uacaguuucuguccuuguggagaugacagucuacucuggaaaacagaaaguugua

SEQ ID NO: 4164665 - RNA, 83 nt, Human
uacauaauuucuaccagggccauauuagcagugaaacauuuuaaacugcagaaauugugguuuugguucagaaacaaguugua

SEQ ID NO: 4164666 - RNA, 129 nt, Human
uacauacaaaccauaguagccuggagggcaggagggaguaacguacuacagugcagccuuagaaacuggucgcuucagcugauauuacucccacugcugccaccacugccucuaucauuacugucucua

SEQ ID NO: 4164667 - RNA, 57 nt, Human
uacauacauauguggaugucauauuuaauauuugaguguggugagugugugugugua

SEQ ID NO: 4164668 - RNA, 76 nt, Human
uacauaccugacagaggcucaccagccuuucacuggacauuuuccagcgaccagggaagcuucuucauagguagua

SEQ ID NO: 4164669 - RNA, 64 nt, Human
uacauagaaggaggcuggcagcucuagcugagagguagcaggagcuggugccugcuuuugugug

SEQ ID NO: 4164670 - RNA, 83 nt, Human
uacauagagguuaguuuuucagaucuggaaucaguuaaauuauuuacuaagggcgccagugucagaaagauuauccucuggua

SEQ ID NO: 4164671 - RNA, 88 nt, Human
uacauauuagucauuuaaacacucacuucauagccauuauugucaaaacaacaugugugcuuuggguguggguguguacagguaugua

SEQ ID NO: 4164672 - RNA, 55 nt, Human
uacaucacucaaaaccuagugccuggccuugguuggugcagguaaugaugauaua

SEQ ID NO: 4164673 - RNA, 60 nt, Human
uacaucauggugagcaggaggcucacuacugagcacaguucuaacugccuaccagaugug

SEQ ID NO: 4164674 - RNA, 110 nt, Human
uacaucccuuuagccacucaucaaacuaaaguugauaagguaucguaguuauucagacugaugauacuuuucuacuuucauauggggugauuaauucaauagagaaugua

SEQ ID NO: 4164675 - RNA, 61 nt, Human
uacaucugucuggcuuuccauuccuuggguggaauuaccuuggcaaggccagcuugaugug

SEQ ID NO: 4164676 - RNA, 55 nt, Human
uacaugaguccugaaggcacuauaaaguaguuucuccuuuagaaacucauaugua

SEQ ID NO: 4164677 - RNA, 106 nt, Human
uacaugaucauuuguaacucaauuagguauaaagcuaagacuuacaugaaacuuauacaaguucaugaaguuugguuuauaguuuauacaaacagaagucagagua

SEQ ID NO: 4164678 - RNA, 129 nt, Human
uacaugauuaugugcauuugcuaaaaucccuagaccuacacauggaaguugcaguuuucguaggucgaaaacaguccaagagcugcaauuucaugugguguaaccuaugcauaucacaugaaggugaua

SEQ ID NO: 4164679 - RNA, 77 nt, Human
uacaugcagaguugcguccaugcagaguugcaugcaguuacaugcagagcugcaccuaugcagaccucucugcugua

SEQ ID NO: 4164680 - RNA, 69 nt, Human
uacauuaggauaaaauauguggccuuuaguuccccuggaaggugccugaguguuuuuuccacuggugug

SEQ ID NO: 4164681 - RNA, 93 nt, Human
uacauucauuuuguguuuguuuuguagaaguauuauagaaggugcuuuauaaauauuuucuuuaauucucacagcaaucauaaaaggaaggua

SEQ ID NO: 4164682 - RNA, 57 nt, Human
uacauuccucagcaggccuuuuguugguugcacuaacugcaagguugcugggaagua

SEQ ID NO: 4164683 - RNA, 63 nt, Human
uacauucugcuagaggaagaaauugaggcccacugagagucuguuccucuugcagguuuugua

SEQ ID NO: 4164684 - RNA, 57 nt, Human
uacauugacucucugucccuaaaugaacugagauuuuggaggggagagaauugugua

SEQ ID NO: 4164685 - RNA, 129 nt, Human
uacauugauagaauuaaacaggcuuuggaaaugcauuuguuauuaucuggcuacuuuuguuaguuccucagaugcuaaucaaacuuucugcagguauuuucaauuacuauuuaauuauuuuacagugua

SEQ ID NO: 4164686 - RNA, 63 nt, Human
uacauugcucauuauauugcuucagauugaggauaaaacauagaagcaaccugggccaaugua

SEQ ID NO: 4164687 - RNA, 77 nt, Human
uacauuguugguggcacccagaauaaggacaggacuuggagugucaggaagccugugagcuggguccuuacagugug

SEQ ID NO: 4164688 - RNA, 61 nt, Human
uacauuucacaaggugauaugguuuggcuguguccccacucaaaucucaucuugaauugua

SEQ ID NO: 4164689 - RNA, 60 nt, Human
uacauuucacuauucacuaaaaggacauuuagucacuuugauuugugaugugagacugug

SEQ ID NO: 4164690 - RNA, 73 nt, Human
uacauuuccaggcagagugagaagcccuugucaagccccaacagggagcuggcuggcugugccaaggacagua

SEQ ID NO: 4164691 - RNA, 77 nt, Human
uaccaagaugcagcuagauuccgauuuacaagaaauuccaaguuaauugggugcaacagcugaauaucaggauggua

SEQ ID NO: 4164692 - RNA, 55 nt, Human
uaccaaguagcugggacuacaggugcccgccaccacgcccggcuaauuuuuggua

SEQ ID NO: 4164693 - RNA, 74 nt, Human
uaccaaucagagaucugucuacuauuuaagacucagcuaucuugcuuuuuauaauaguuggacucucauaggua

SEQ ID NO: 4164694 - RNA, 73 nt, Human
uaccaauggagaagaggggauucagacacuucuuuaggaucuuuaaguucuuuuccauuucuuaacuuuggug

SEQ ID NO: 4164695 - RNA, 65 nt, Human
uaccacagccuccuucagagagcaucaugacguuaaugacgugaacagguggauggcugauggug

SEQ ID NO: 4164696 - RNA, 121 nt, Human
uaccacauucugaauuuauaagaauuuauuuuaguccugggcuuuggaacaguacuugcuuauaagaaguauuagcuuuaaaacccagacauguaaauuaauaagaaaaagagauggggua

SEQ ID NO: 4164697 - RNA, 97 nt, Human
uaccaccuacagccuccccagaccuccaccgcuauguuaggucccagggcugggucccagcugcccuguggggaggguugucagggcuguagaggug

SEQ ID NO: 4164698 - RNA, 88 nt, Human
uaccacucuauaacucuuuacuauacauuuauuuucaacaguuuagccagaaggguugguguaauuaaagaguguuacagggucggua

SEQ ID NO: 4164699 - RNA, 84 nt, Human
uaccagaaggagagaaauugagguagcaagcaguacacauuuacuauucuguuucccugccugccuauuuuuuaaaacuuggua

SEQ ID NO: 4164700 - RNA, 56 nt, Human
uaccagagcaccuccaccuuuccugugcacuuaggccucugugcagcugccuggua

SEQ ID NO: 4164701 - RNA, 62 nt, Human
uaccagaucuaucuguugauggugcuuucagaagagccaccaauauuugguagaucacugua

SEQ ID NO: 4164702 - RNA, 63 nt, Human
uaccagcaccaugaccuugccauugaagaauguguuucaguugguuugggaaugguacuagug

SEQ ID NO: 4164703 - RNA, 79 nt, Human
uaccaguaugcuuaauaaugaacauuuaaaaccuguuuccuacagccaaacaggucauaguugagugauaccaguggua

SEQ ID NO: 4164704 - RNA, 62 nt, Human
uaccaucaguuugagauuuuccucuuucccacccuucucagaggggcaucaaagugcuggug

SEQ ID NO: 4164705 - RNA, 74 nt, Human
uaccauccaucugcaucugaauaucccaggcauaucuauagcagauuguaacauguucagaucacugggaggua

SEQ ID NO: 4164706 - RNA, 126 nt, Human
uaccauuauauuugguauguuguggaauaguucggacaguagauaacauuuuugcauguuaauacauaaaaaaaguuucaacugccaacucuuugucacacaccaaaccugauuauuuaccuggua

SEQ ID NO: 4164707 - RNA, 72 nt, Human
uacccaggagcccugcaggaugagggaggucucuggagaggccauugagaacucagggcucagcacugggug

SEQ ID NO: 4164708 - RNA, 128 nt, Human
uacccgugggcuuuuucagcauuccuaguauuguauauccucacauaaaaagugauaauauuauguuggaaauuacuuuaugugauggauuagugugaacauauuugggguguuugaauaauucagug

SEQ ID NO: 4164709 - RNA, 70 nt, Human
uacccucagagaacuccacaccuuagggcuagcagagcuuguccagggaugauaguuuuccuguugggug

SEQ ID NO: 4164710 - RNA, 69 nt, Human
uacccucaugaagcuggccuggacuuauauauuuaauucuaaauacuccaagugggguucaugacugua

SEQ ID NO: 4164711 - RNA, 120 nt, Human
uacccucgaugccacuggauacucacaagcaggguuaugcuccuucaucuugggcuuguuugccuaaaugaaaggguuuaauuuauuuuguaccuccuaugcgugggauaguccagggug

SEQ ID NO: 4164712 - RNA, 86 nt, Human
uacccucuaggguaccagggaaggcuguugauggggaggugugucaguggagacacccugcuacaaagccuccuggugagggggug

SEQ ID NO: 4164713 - RNA, 69 nt, Human
uacccuucaauuauucccuccuguugcuucccaucuuauugacuugugugcaggcagggaaugggggug

SEQ ID NO: 4164714 - RNA, 56 nt, Human
uacccuuuccuagaaauauauacuuacugcacucugaguacuugcugggaagggug

SEQ ID NO: 4164715 - RNA, 82 nt, Human
uaccgaaaugccuggcuaaguucauaagcuuauucuuaugaguguuaauaaguuaauguacuaugaauuuccacaugcggug

SEQ ID NO: 4164716 - RNA, 79 nt, Human
uaccgagaccugagaauguuuaacagagaaaauaaagagcauauuuuaaauucucaaguaaaauacucucugauuggua

SEQ ID NO: 4164717 - RNA, 76 nt, Human
uaccuaugaaugugaccuuauuugaaaauagagauuuuguagaucuaaucaguuuaagaugaggucauacugggua

SEQ ID NO: 4164718 - RNA, 60 nt, Human
uaccugacaggggagcuuauuugugaauucagcaaccauguuuugagcuucaaucaggug

SEQ ID NO: 4164719 - RNA, 86 nt, Human
uaccugcagcacagagagcagugggggacacccuccugucccagcguugagcacccuguuccccacuggcuucguguagcagagug

SEQ ID NO: 4164720 - RNA, 74 nt, Human
uaccugccucaggucccacugcuaguaagugacacuggagguggaacucaugggugggccugaaagaacaggug

SEQ ID NO: 4164721 - RNA, 62 nt, Human
uaccuggaugugaaggugguaugacugagaccuuagucauaugacccuucacaaacuuugua

SEQ ID NO: 4164722 - RNA, 87 nt, Human
uaccuguuucaggguguggaggagagggaacuagaauccacaaaaggauucaguucuggcugccuuccuucaccuguucagcaggug

SEQ ID NO: 4164723 - RNA, 81 nt, Human
uaccuuccagucuacacaaugauuugguucaaaaauaggccucccauuucugauauaccacauuagauguguuggauggua

SEQ ID NO: 4164724 - RNA, 69 nt, Human
uacgaagcugccuuugcaucacuuuaaaacuguaaauaugcccuugaaacaugcaaagaggcuuuugug

SEQ ID NO: 4164725 - RNA, 55 nt, Human
uacgacuguacaaggcauauugaaaaccuucaguauuagugucuuugcuguugug

SEQ ID NO: 4164726 - RNA, 82 nt, Human
uacgagugugguagguaguaucaucuccauuucacugaugaugaaacuuaucagugauugguggacugccuagcccaaagua

SEQ ID NO: 4164727 - RNA, 84 nt, Human
uacgcacuugcauuuugguguaugaggccucagcaaacuauauaaggcaucaaccauuuauuaugccaaaauggaaaguguaua

SEQ ID NO: 4164728 - RNA, 75 nt, Human
guuuucauguaguuucuguauaaaaauuagcuucucuguaaacuacguuaguuucuauguaagcuacgugaaaac

SEQ ID NO: 4164729 - RNA, 73 nt, Human
guuuuccaagcugaaaugguuuucucaugagguuagagauucagaggaacacuguuucaugccuggccaagac

SEQ ID NO: 4164730 - RNA, 64 nt, Human
guuuucccucucuuuuuuccagggaacuuacauuguuccagggcauggggagagaguggggaac

SEQ ID NO: 4164731 - RNA, 66 nt, Human
guuuuccuugguauuauuagacauggguguuauaaccaaucuguuucaacaaugcuuagagaaaac

SEQ ID NO: 4164732 - RNA, 70 nt, Human
guuuucuacugauggaugcuacguaagaggccgacccaggccucuucuggguaagcuauuggaacgaggc

SEQ ID NO: 4164733 - RNA, 59 nt, Human
guuuucucaaauauaagcuaaaugugguugacagaccacugauggugauuugaggccac

SEQ ID NO: 4164734 - RNA, 66 nt, Human
guuuucucaucuccucaaugguacgaguaauauuaaauaguaucuguccaggauucuugagagaac

SEQ ID NO: 4164735 - RNA, 97 nt, Human
guuuucucuuuuuggaagcucuucuguauucagcuuugucaguugaagaguuaguucuucaggacagguucggguggguacagaaaguagggaaaac

SEQ ID NO: 4164736 - RNA, 69 nt, Human
guuuucugcucagaaaagugaggcucaguaucaucuauauugaaaacuaguuuuucucagcagaccuac

SEQ ID NO: 4164737 - RNA, 62 nt, Human
guuuucuggcuuggacacaaucuucccugaaacccaaucugggaaaccuuccaagcagagac

SEQ ID NO: 4164738 - RNA, 57 nt, Human
guuuucuggguaagaucagagaaagaaaaucauuaucuuuaucuggcucagagacac

SEQ ID NO: 4164739 - RNA, 95 nt, Human
guuuucuucauuguuguuaauguucuuucagccagugcaucaauucauccuauuugaaugcugagacuaaagagcuugagggcauguuugaaaac

SEQ ID NO: 4164740 - RNA, 83 nt, Human
guuuucuugccuagugacaaaacggaacauacagaacacagaacauguuccguauguucagauuugucaauaggcaaaagaau

SEQ ID NO: 4164741 - RNA, 76 nt, Human
guuuucuuguagugccagguuucugugauaaagguauaaacacagucuaacagaaauucugacaaaaugagaagau

SEQ ID NO: 4164742 - RNA, 80 nt, Human
guuuugaaauuuaguucuucucuggccugagauggucucaauucuuaacucuuagccuuagaaaaauaagauuuuaaagc

SEQ ID NO: 4164743 - RNA, 55 nt, Human
guuuugaauacuacuagaacuugggcagguccuacaaacuuggugguguugagac

SEQ ID NO: 4164744 - RNA, 92 nt, Human
guuuugaauuuacaucgccuguuucaagcaauagcauuucaccacagguugccuuaugaacuuuuauuugaugacaggagauguuccaaaac

SEQ ID NO: 4164745 - RNA, 72 nt, Human
guuuugagugcuuuagagaaauggugcuccaaauauuugaagcauuacuauucucaaaaacaguaucaagac

SEQ ID NO: 4164746 - RNA, 89 nt, Human
guuuugcuguugucggguggaucacgaugcaauuuugaugaguaucauaggagaaaaauugcacgguauccaucuguaaaccgcaggac

SEQ ID NO: 4164747 - RNA, 79 nt, Human
guuuuggguacauguggaguuuucuagucaaagcaaagagagauuuggaauuggcugaguucuccaggaguagucaugc

SEQ ID NO: 4164748 - RNA, 60 nt, Human
guuuugguaagaauagucauccuucccuguaaaggguccacuggcuaauuuuauagaggc

SEQ ID NO: 4164749 - RNA, 69 nt, Human
guuuugucacugguaaauuaugcgacuuuggacaaauuauucagucucagauguuuaccaguguuguac

SEQ ID NO: 4164750 - RNA, 66 nt, Human
guuuuguguauugcuguauuucuggcaccuaguagagugccuggcauauaguaguugugcaauaac

SEQ ID NO: 4164751 - RNA, 75 nt, Human
guuuugugucaucuccauguagacagcucuccuggacacucucccugguggcuuugcccuggacugaggcaaaac

SEQ ID NO: 4164752 - RNA, 90 nt, Human
guuuuuacucagaccuuccacauagugaauaacauuuuuuccuuuacagguuuaccuuagauuguagcuaugugggaggugagauuaaac

SEQ ID NO: 4164753 - RNA, 100 nt, Human
guuuuuacuggaauauagagguauugauuguaaauugcgucuugguggucaaaccacaaaggcaugauguaaucaaugauaaaacuauauauaguacuac

SEQ ID NO: 4164754 - RNA, 82 nt, Human
guuuuuagacuguuaauugugaauuuuacauuugggucaucacuguuguguagauuuguucaccuauuaaaauaaugaaaac

SEQ ID NO: 4164755 - RNA, 62 nt, Human
guuuuuagccaagccauaggucugauuaaguacagucagauuccuugagcagguuacaaagc

SEQ ID NO: 4164756 - RNA, 59 nt, Human
guuuuuagugaagcuuugcauuucacauaagguaugugaagugaaauuucacaagggac

SEQ ID NO: 4164757 - RNA, 90 nt, Human
guuuuuaguuuuguucuggcaucuuugucccagaagcugaaucuaccaucagaucccacaguugcaagggugccaugaacaggauggaac

SEQ ID NO: 4164758 - RNA, 78 nt, Human
guuuuucagacgauguugcauuugucagugguuucuuccuuucuauuacugaauagugcugcauuguacagauagaac

SEQ ID NO: 4164759 - RNA, 81 nt, Human
guuuuucauuuggugcuuaaccuaguuucuaguacagaaaaagaagucuuugcuggcguuaguuaaguauaauugaacaac

SEQ ID NO: 4164760 - RNA, 78 nt, Human
guuuuucauuuguaaaagaaccucuuuaaagaacagaauggaaacaagcaguucuucaaaggguuucaaaugagaaau

SEQ ID NO: 4164761 - RNA, 77 nt, Human
guuuuuccaaaacaauauucugugaaagcuucagauuuuucaaaaugcuuucaauuuagugauguuguuggaaaaau

SEQ ID NO: 4164762 - RNA, 72 nt, Human
guuuuuccugaugcaugugggugcagagaugacacuggccaaaucaaguaccaaaucuguauuaggaaacac

SEQ ID NO: 4164763 - RNA, 55 nt, Human
guuuuucuaaaguuggugacaguuuccguaaggaaauacacauucauagaaaaau

SEQ ID NO: 4164764 - RNA, 78 nt, Human
guuuuucuauccaauucuaauauuguguuuucagauuauaaggcugagacuauggugugcagaaauugguuggugaac

SEQ ID NO: 4164765 - RNA, 84 nt, Human
guuuuucuuugcuuuguuucuuuuucuugcaggacuaaacaaugucauccaaggccauaagagauacaaaacccaaggaaaaau

SEQ ID NO: 4164766 - RNA, 63 nt, Human
guuuuugguucauaauuugcacuacugugagaaacacggaggacacaaucaugagccaaauac

SEQ ID NO: 4164767 - RNA, 69 nt, Human
guuuuuguccauggaggcaaaccaagaggacaggggaugcugacuccaggcuggcuccacacauaaagc

SEQ ID NO: 4164768 - RNA, 76 nt, Human
guuuuuuauaauaauggugauagggaggggucccagggauuccauuuccagacuguucacauuggcauuaaagaac

SEQ ID NO: 4164769 - RNA, 81 nt, Human
guuuuuucaauuccaccaaagcgcccuagaaaccacaugcagaacaaagucgauggggcgcugccuggaaggcgagaggau

SEQ ID NO: 4164770 - RNA, 78 nt, Human
guuuuuuccuuucauuccuuugcucugaacacuuggccguaugcugugugcagcagagacaggacucagggaagagac

SEQ ID NO: 4164771 - RNA, 62 nt, Human
guuuuuuuaaguucagaaaggauaaaaggaucuuggcccuuuuaauuuggacauaagaagau

SEQ ID NO: 4164772 - RNA, 78 nt, Human
uaaaaaagugacuaugauugaugaagauguuggauguuugugaaauaagcaucuaaacuaucaguuugaauuuuuuua

SEQ ID NO: 4164773 - RNA, 104 nt, Human
uaaaaacagauuuagcaaugcuccaaguaguuaguccgccugcucuguaaugguuuaucauagucauaaagcugacuguuggggucagcugaucucugcuuuua

SEQ ID NO: 4164774 - RNA, 76 nt, Human
uaaaaagagggccucuaccauccaagguuagggaaucaacucuggccuuuacacuaauggagggcuuuaauuuuua

SEQ ID NO: 4164775 - RNA, 129 nt, Human
uaaaaagagugaagaguugagaggcuccauuugguuucaguuuguaccauuguuugaaguacucaguugguugaauacuccaaauaaugguucaaauucaaaccaaauggagccucuccacucuuuuua

SEQ ID NO: 4164776 - RNA, 83 nt, Human
uaaaaagccugaugcccagguuauaccccagaccaauaacagcagacuuucuggggaugaaacccaggcaucugaccuuuuua

SEQ ID NO: 4164777 - RNA, 93 nt, Human
uaaaaaugccccaguuguaacuuacacauuuacuacacuucuuauuacauuuugaggucauuaaguuuaagucauguuugaugggcauuuuua

SEQ ID NO: 4164778 - RNA, 72 nt, Human
uaaaaauucauccaugaacaauuccacauuucaucacugcccuuggaacugacacugugggugugauuuuua

SEQ ID NO: 4164779 - RNA, 56 nt, Human
uagaaaccaggcugugggccuccaauaaauguaauaggcccagccucuccuuucua

SEQ ID NO: 4164780 - RNA, 55 nt, Human
uagaaacccugccuuaguagcuacuccuugaaguggucuaggauggggcuuucug

SEQ ID NO: 4164781 - RNA, 66 nt, Human
uagaaagcaggauugccaccacuccucgaagcaccccacgauuagagugucugagcgcugcuucug

SEQ ID NO: 4164782 - RNA, 73 nt, Human
uagaaagcaugcaaguuugaugguuuauauguaacaaaaugguuuuguuguuaaacuuguuuauuguauucug

SEQ ID NO: 4164783 - RNA, 58 nt, Human
uagaaagugguugagaguuuagguucuggagccagacugaguuuuaaucacuuuucua

SEQ ID NO: 4164784 - RNA, 58 nt, Human
uagaaaugcagugacuaggcugaaacgacacagaauguuucucuacacuacauuucua

SEQ ID NO: 4164785 - RNA, 79 nt, Human
uagaaccauuguguuuggcuugaauaucugacaggaccuauauagcuuuccucuggauauaagccucaccaugccucug

SEQ ID NO: 4164786 - RNA, 90 nt, Human
uagaagaaguuucugaaaugggguugugaucagggaugggagaguccuccucuaggcauuguuauuacaacucuuuuauaaacucuuuua

SEQ ID NO: 4164787 - RNA, 103 nt, Human
uagaagcaugacuuucuacauauguaugaagguaauuuagagaccaaauggagaaaauagcugaaucuaaggccuucaugucaguaucaaagacccucuucua

SEQ ID NO: 4164788 - RNA, 64 nt, Human
uagaagggccuucacugucuaagcaacucaaucagcugcuucagcacuuugagagccuccuuua

SEQ ID NO: 4164789 - RNA, 70 nt, Human
uagaaggguuuggggugaaauagacuuacucaaucagaguaugucuuguuaaucugaagcaaguuuucua

SEQ ID NO: 4164790 - RNA, 58 nt, Human
uagaaguggggcaggaaagauugcauaggcucacuccaguccccuguccuuacuucua

SEQ ID NO: 4164791 - RNA, 56 nt, Human
uagaaguuucaaaagacuucauuuuaucaugauggguucuauuuugcaaacuucug

SEQ ID NO: 4164792 - RNA, 62 nt, Human
uagaaguuucauuguucauguaacaauauuggccaguuguucagguuugcaaugaagcucug

SEQ ID NO: 4164793 - RNA, 61 nt, Human
uagaauaggggugacggugccauagucucagggacccaggugcacccagcuucuuguucua

SEQ ID NO: 4164794 - RNA, 64 nt, Human
uagaauagucaggaguaggaguuuuggagucuaccugcccaggguuuaaauucugacuaugcug

SEQ ID NO: 4164795 - RNA, 80 nt, Human
uagaauauaucuuccauauuuugaagcaggaaaauuucuauuuuuaaaguggucauuucuguuucaguagguguauucua

SEQ ID NO: 4164796 - RNA, 67 nt, Human
uagaauaugucagauguuuaucugauuuuuuaauauuagcaaaucagauuauuugauuggcagucua

SEQ ID NO: 4164797 - RNA, 72 nt, Human
uagaaucacaaguugagaauuccaugcuguugaaacuaucaaaaguaauagugaaucgacuaugaugaucug

SEQ ID NO: 4164798 - RNA, 70 nt, Human
uagaaucuaaauaugcaauuugaagagccuguaacaggcucaagguauuaauuuguuuauuucagaucua

SEQ ID NO: 4164799 - RNA, 61 nt, Human
uagaaucugcccuuuuugagcauucagaaaucacucuaaaaugucaaacagagcagagcua

SEQ ID NO: 4164800 - RNA, 63 nt, Human
uagaaucuuagcaucgaugugauugucugaguggauuucaaaugcaauggcgugcuaguucug

SEQ ID NO: 4164801 - RNA, 105 nt, Human
uagaaugagaauacaaaaguaucaacugcaaucuggauccuagaagacaaugaaaaaaugucuucuuggguucugagauuacauuauuuugaaccaagaauucua

SEQ ID NO: 4164802 - RNA, 55 nt, Human
uagaaugaggccugcaugccugcucugcagaguccgggcagcuccccucauucug

SEQ ID NO: 4164803 - RNA, 79 nt, Human
uaauuauauggugaaguucuaccucccaguaucucagaaugugaaguauuuggagauaagggcuuuaaagagguaauua

SEQ ID NO: 4164804 - RNA, 89 nt, Human
uaauugaagaagagucuuaggcaaaaauaauggaguagaaauauuugguagcauaacuuauuuuccuuaucugggacuuacuucaauua

SEQ ID NO: 4164805 - RNA, 91 nt, Human
uaauugcaugugcuuuauuugguaguaccugacaguuuauuaaagcaaaaagaaacuguugugguuuaucauuaaacucccacuguaauua

SEQ ID NO: 4164806 - RNA, 100 nt, Human
uaauugccauugcguuuugaugaucugggcuggacacacuuaaccucuuguuuuguaaucugaguugcaugguaccgguccauuauuuucauggcaauug

SEQ ID NO: 4164807 - RNA, 58 nt, Human
uaauuguaguagcuguuuaauauuugcacagccuucauuagaaagcucacuacaguua

SEQ ID NO: 4164808 - RNA, 57 nt, Human
uaauugucagguuuuaguaucaagguuauauucaccuggugaaagacuugagaguua

SEQ ID NO: 4164809 - RNA, 61 nt, Human
uaauuuaauuccauggauucuaaugguggaaauauuaaagagggaucuugggguugaauug

SEQ ID NO: 4164810 - RNA, 82 nt, Human
uaauuuacuaaugcccagucucuuaaaguggaguccauuucacuccacuuuagcaaugauugaauguuggcuuuuuaaauua

SEQ ID NO: 4164811 - RNA, 121 nt, Human
uaauuuaucuccauggcuuucuguucuucuagggugacaguuugucaguuugacuucccauuuaaaggucaaagcagugcaccuuaauugaugguggguggaaaaugucuugagaagauua

SEQ ID NO: 4164812 - RNA, 60 nt, Human
uaauuuauguagggaacucagcucugugccuggcacauaaugagcucuuuauaaauguua

SEQ ID NO: 4164813 - RNA, 108 nt, Human
uaauuugaauuucagauuaacaguguaucauuuuuugauauaaguaugucacaaauauugcauagacauacugaaaaaugauuugcuguuuaccugagauucauauua

SEQ ID NO: 4164814 - RNA, 63 nt, Human
uaauuuggugccuagaauguuaaugccucgauugagaugcucugaaguucgcgggcaagauua

SEQ ID NO: 4164815 - RNA, 87 nt, Human
uaauuuguuggaaauggucuucucaagcaacacugggaauaguuuguuuucuccagugcugccaaagggaccuuggucaggagguua

SEQ ID NO: 4164816 - RNA, 61 nt, Human
uacaaaacagugcucugguccuuguugaucauaaagaagagguuaagagugcuauuuugua

SEQ ID NO: 4164817 - RNA, 74 nt, Human
uacaaacagauguugcuugucauucucuuguuguuaagcaggcaccagauuggaucaagcagcaguugugugug

SEQ ID NO: 4164818 - RNA, 124 nt, Human
uacaaagagaauaauauggcaguuugauggcgaaugucuaaacauagcuuuuauuauauaaagagaaaaguugaggcucuuagaaauuuggaaaucauaucgacuucaacacauuuuuuuugua

SEQ ID NO: 4164819 - RNA, 68 nt, Human
uacaaagcugggcuggccaacccagguccucgagaggggagguuggguguccccggccgaguuuggua

SEQ ID NO: 4164820 - RNA, 76 nt, Human
uacaaauaauugcucugauauaaaagugacauucauuugaaaauauugaagaucaguuuugugucugauauuugug

SEQ ID NO: 4164821 - RNA, 79 nt, Human
uacaaaugaagagggcaacuucugagcugaacuuugucucucucuaguucagaaagcacaggauccucaaucauuugua

SEQ ID NO: 4164822 - RNA, 79 nt, Human
uacaaauucauguuugccuauuugacuuugcaggugaacuuaguaucaguaaguugaaugcguacgugacauacuugua

SEQ ID NO: 4164823 - RNA, 71 nt, Human
uacaacaugugguccuuuaugacuggcuucuuucacuuagcguaaugcugucaggauucauccauguugua

SEQ ID NO: 4164824 - RNA, 64 nt, Human
uacaagcucacaaauuuuuaagagggaaaggaaauacucuuuugauagauucaagugagcugug

SEQ ID NO: 4164825 - RNA, 56 nt, Human
uacaaggcuucagcucagcuauuucagagauaucuggguuucaaagaagccuuuua

SEQ ID NO: 4164826 - RNA, 57 nt, Human
uacaagucaguugcgcuacuaacaggauuuggcugugagcaagagaaacugacugua

SEQ ID NO: 4164827 - RNA, 96 nt, Human
uacaaguucauuuuaaugcauuuugauauuauagagaaaugucagauccacaguuggacuacaauacucuuaguaaaagugaauucugagccugua

SEQ ID NO: 4164828 - RNA, 59 nt, Human
uacaauacuuaaccuauuuugcaaaugaagaacaugagucaggaagguuaaguaaugug

SEQ ID NO: 4164829 - RNA, 62 nt, Human
uacaaugucaccucucauguuuuagacacaaagagguccagaaaugaaagauggcuauugua

SEQ ID NO: 4164830 - RNA, 55 nt, Human
uacaauuuuaagccagaguggguugaccugucacccaagcaugguuaaaauugua

SEQ ID NO: 4164831 - RNA, 62 nt, Human
uacacaaaugcaccccagaagcugcagugacaaauggccuucugggaagaugucaugcugua

SEQ ID NO: 4164832 - RNA, 58 nt, Human
uacacaauucuggaugcaugucuauuugggagaauuaaaugcagcuggaguuggggug

SEQ ID NO: 4164833 - RNA, 65 nt, Human
uacacagauggguagaaaacagaaguccacagccuaugaauucucuuuuuacugucugucuggua

SEQ ID NO: 4164834 - RNA, 56 nt, Human
uacacaggcugccucuuugcauguuccuugaaguugugcaggacagagccugugug

SEQ ID NO: 4164835 - RNA, 61 nt, Human
uacacaggggagcaugguugacugggcucuguuaaauaucuguuucccauaacucugugua

SEQ ID NO: 4164836 - RNA, 109 nt, Human
uacacauaaaacacugccuacauaacacugccaaacuguacacuuagagaucuuaaccaucucuaaguguacaguuuggcaguguuauguagguucacauuguugugua

SEQ ID NO: 4164837 - RNA, 67 nt, Human
uacacaugacaguggacugagaugcuuugucugaguuaguucuuacaucucaauuccaauaugugug

SEQ ID NO: 4164838 - RNA, 61 nt, Human
uacacaugaucauuuaguagcaaagucuguucaucagaaaacucuaauugcuuuaugugug

SEQ ID NO: 4164839 - RNA, 63 nt, Human
uacacauucacaagccuacaagguugucagaggcaacccgguggaagcauuguggaaagugug

SEQ ID NO: 4164840 - RNA, 60 nt, Human
uacacccacaugccuaggagggagaaccauuuuccuccacgugagggcauacagggugug

SEQ ID NO: 4164841 - RNA, 77 nt, Human
uacaccuaccuggcucagcaaggcauucuguggauuaucuuauuaguaauuauaacaugcuuucuggcuauagugua

SEQ ID NO: 4164842 - RNA, 66 nt, Human
uacacguaucuggacacugcagagguuguagaugcauggacguuuacaacaguguccauauuugua

SEQ ID NO: 4164843 - RNA, 61 nt, Human
uacacuaauguuuuugcaaagccuauacguaugacaggcuuugcaaaaacauuagucagug

SEQ ID NO: 4164844 - RNA, 111 nt, Human
uacacuaauuuuccuuaaugccuucaaaaguuguuauauuacuuuuagaauagcuauguagaugucagaaaagguagcugugacaaaaugucauuaaggugacauagugua

SEQ ID NO: 4164845 - RNA, 81 nt, Human
uacacugaagucugacaguagcagaacucaaaacaagaucaucuuguacuagaaugccacuguuaguguugauuucuugua

SEQ ID NO: 4164846 - RNA, 98 nt, Human
uacacuucaaaauguugguaaaauguauauauuuuggugugacauugugacaguuaagguauacauucagccuuuucucaggcauauugaaaauggua

SEQ ID NO: 4164847 - RNA, 67 nt, Human
uacacuuuauggauccuacuuuauauguaauaucaaaaaaucauaauagugagauacgugaagugua

SEQ ID NO: 4164848 - RNA, 79 nt, Human
uacacuuuccauuacagaauuuaggauauuuuagagaaacucuguugccuauaauccuggugaguuugaaaaaagugua

SEQ ID NO: 4164849 - RNA, 83 nt, Human
uacacuuucccuucugugccagcagccuccuggagauagcuguggucucuccuugggaggguguuuggccaugggucagugua

SEQ ID NO: 4164850 - RNA, 60 nt, Human
uacagaaguuaacacuauugcuaugacacagaacuuagggacaaguguguaacuugugua

SEQ ID NO: 4164851 - RNA, 72 nt, Human
uacagaauccacauaguugaugcucaguuuuauuaauaaaugaauaagcaagccugugugcaagacuuugua

SEQ ID NO: 4164852 - RNA, 62 nt, Human
uacagaaugauguguuuaaauaaauuguccuguugacugaauuuugaucacauuauugggua

SEQ ID NO: 4164853 - RNA, 70 nt, Human
uacagaauuauauguagucagucagaguaaacauuauguauuacuuucaaaaacuacgugggcuucugug

SEQ ID NO: 4164854 - RNA, 69 nt, Human
uacagacacagauuuuggaaaagauccauauauggaaaaucuuuauggccaaaaauuuucuuugcugua

SEQ ID NO: 4164855 - RNA, 87 nt, Human
uacagacgcguucuucuuuuuguguuuugcuuuuugucuuuccagauaaauagugugucauaaagucugaguuuuuuugugugugua

SEQ ID NO: 4164856 - RNA, 60 nt, Human
uacagaggcugacaaaauauugcuucaguuaggcaagcauaaccuguacagccuucugug

SEQ ID NO: 4164857 - RNA, 77 nt, Human
uacagagggcaaggagaaggguaaucaacacagaagacugaaauuauccuuuccuugcauuacuuuucccucuugug

SEQ ID NO: 4164858 - RNA, 92 nt, Human
uacagagugucuuuugaaauuauguucuugagaaagguaaguucccuaaaaaucccaccaccucaggaacagaauuuucuaaaacuguugua

SEQ ID NO: 4164859 - RNA, 72 nt, Human
uacagauauauagugugugccuccuuccucuggacgaagagaguuggucuaaauacacauuguauucuagug

SEQ ID NO: 4164860 - RNA, 70 nt, Human
uacagcaucuucuagauccaggcuaucgagcacuugaaaugcggcuaagucugaauugagaugugcugug

SEQ ID NO: 4164861 - RNA, 58 nt, Human
uacagccaugguuaauuuaccuauguugccuaagcguaggcugcauuuauauggugug

SEQ ID NO: 4164862 - RNA, 76 nt, Human
uacagcugaagcucagcccaguaguuuucucuuacucaccaucaaucagaaaauuaauacugugcuugggcuagua

SEQ ID NO: 4164863 - RNA, 60 nt, Human
uacagcugcuggugcuccaugcuggcaggaauagaauuauuauggggccucagcagggug

SEQ ID NO: 4164864 - RNA, 77 nt, Human
uacaggaaaagagguccaggcucaaaagguuguuauuuguccaaggucacacagcugacagagccuuuuucacugua

SEQ ID NO: 4164865 - RNA, 68 nt, Human
uacaggaaaguuugcugaugaagaaaauuucagaaagggggagauuuugggguuggcaggcuccugug

SEQ ID NO: 4164866 - RNA, 63 nt, Human
uacaggaggcuacaggagacgccaggaguaaaacgaccuauucugaguccuguagucucugua

SEQ ID NO: 4164867 - RNA, 86 nt, Human
uacaggccagggcaggaucgugcauuuuuauuaacccugaaagaguuugaggaaaggagaugacaugaucagauuguauguuugua

SEQ ID NO: 4164868 - RNA, 60 nt, Human
uacaggcccauagucccugcuuugaaaaccaggggugaugacaggggccauggguuucua

SEQ ID NO: 4164869 - RNA, 63 nt, Human
uacaggccucaaauagggugccuccucccccaaauagggagacaucugaauuugaagccagua

SEQ ID NO: 4164870 - RNA, 72 nt, Human
uagcaaugacacagacaugcagugucaucuacaccucucuaucucugauucuuguguggucuggucuugcua

SEQ ID NO: 4164871 - RNA, 74 nt, Human
uagcaauuaccagcagcuuugcauacacuaaauugaaccccuccguuuguggggugaagcuguugcuguugcua

SEQ ID NO: 4164872 - RNA, 106 nt, Human
uagcacacacuuacaguguaguccaugccugagcaggauuuugaagugcaaguagaaucauugguugccaagagucuucucaguuauaaacacugcaggauugcua

SEQ ID NO: 4164873 - RNA, 62 nt, Human
uagcacagcuuuuuaaaauggcauucucagaguucuagagaguggcagcaaaaagugugcug

SEQ ID NO: 4164874 - RNA, 130 nt, Human
uagcacaucagagaggcucaagaaauccucggugaacuacucuugaguuaaugaauaggcuuauuuguuuguucauccaacacaagguuguugauuaccucugauauguuggccccucugcaaugugcug

SEQ ID NO: 4164875 - RNA, 69 nt, Human
uagcacauuuaggcuggugccaggaaaucuguauuuuugaacaagaaccuuggugagucuaaccugcua

SEQ ID NO: 4164876 - RNA, 55 nt, Human
uagcacuacuuagguacagccaaggcccagagcagacuguccuugaguagaguug

SEQ ID NO: 4164877 - RNA, 60 nt, Human
uagcacuuuagcauugguuuacacccaugcucuuggggucuuaccauaccuacaguacua

SEQ ID NO: 4164878 - RNA, 90 nt, Human
gugucuaauacgauguuuucaauaugcccuccucuuuuucuucucuaaaauagaacacaaaaaagaggagggcagauucaaggcaggcac

SEQ ID NO: 4164879 - RNA, 89 nt, Human
gugucuacccuucauguagcguuccauagagaucuaugaaaaugucggucuggaagaacuagggauguugacauauuugggucagauac

SEQ ID NO: 4164880 - RNA, 99 nt, Human
gugucucaauagccaagacauuuagaaaagcuggguauccacaugcacaaagugcauuugucugcauuugggagccaguaaaauguggaaugggaucac

SEQ ID NO: 4164881 - RNA, 64 nt, Human
gugucucagcugggagcuccauuagauagugaaauugucuccugaggaucccagcugggagcac

SEQ ID NO: 4164882 - RNA, 93 nt, Human
gugucuccagagcuuaaaacaguguguacacaucauaggcgcucagaugucugugcaugaaugaauaaacuggcuuugacagguuuggggagc

SEQ ID NO: 4164883 - RNA, 73 nt, Human
gugucucccagaaaccggcugcuuuggcgucccugaggaucacucacuggccaggcacagcugugggagguac

SEQ ID NO: 4164884 - RNA, 79 nt, Human
gugucucucuaccugaggauguuuucugccacagggugaacuagaagugcccaggagauaacguucccaagagugacac

SEQ ID NO: 4164885 - RNA, 78 nt, Human
gugucucuguuguggcuuccaaauuaucccuagaauagauuaagaaauucuaggaaauaucaagucaggaagagacac

SEQ ID NO: 4164886 - RNA, 88 nt, Human
gugucugaggcagcaugguaccuuggagaacacaugaaagcuauagauaaauugugaggcuucaaguuccaguguuguccauagggac

SEQ ID NO: 4164887 - RNA, 83 nt, Human
gugucugcaggagcagagauggcuggaaggggccucugcacacggaagauggcuuguucagccgauucaccuccugaggaugc

SEQ ID NO: 4164888 - RNA, 70 nt, Human
gugucuggagcaauauaaauguuggguagaugcguuuaaauaucuacagucaaguuauauugcuagacac

SEQ ID NO: 4164889 - RNA, 65 nt, Human
gugucuguaagccagauguggcuuguuaacuuuguuaauugguaaccucuggacuagacagaggc

SEQ ID NO: 4164890 - RNA, 63 nt, Human
gugucuguauaucacuuuuguccuuucuguggaagaauuagaacaacaguggucuacagaggc

SEQ ID NO: 4164891 - RNA, 78 nt, Human
gugucugucaguucacaguggcuuaggcuaugguuguuagugaaaguuguggugaggcuuugcuggagaugaggacac

SEQ ID NO: 4164892 - RNA, 62 nt, Human
gugucugugucacuugauucuuccugguugaguuaucaacacucagagcagcggcaucacac

SEQ ID NO: 4164893 - RNA, 107 nt, Human
gugucuguuucacaaacaaggaaaucugccaaaaucaugccaaaaaauuucucuguuucaggccugcaaaugaaugguagaaucuauguguguguguauauagauau

SEQ ID NO: 4164894 - RNA, 83 nt, Human
gugucuuaacuggauuauuguaagacaaaguaugcacuuuucaugucguauuaguauuuuguuaauaauccaguccaugauau

SEQ ID NO: 4164895 - RNA, 55 nt, Human
gugucuuagaaagacugaaugcuuuuuguuagaguucucauucuacuaaguacac

SEQ ID NO: 4164896 - RNA, 55 nt, Human
gugucuuuauuccucuauguuucccaacucugguuccaaagaauagugaagacac

SEQ ID NO: 4164897 - RNA, 77 nt, Human
gugucuuuuauucaacaaauauaacuuuugagcacuuacugcaugccagguauuaugcugcugaaugcuggagauac

SEQ ID NO: 4164898 - RNA, 56 nt, Human
gugucuuuugaggcugaccaguuguacgguaggacuacugggccuaggggaggcau

SEQ ID NO: 4164899 - RNA, 65 nt, Human
gugugaaaucaucaaaagagccauuggaggggacaccagagagucguguggcugagguuucacau

SEQ ID NO: 4164900 - RNA, 95 nt, Human
gugugaaaugagauaacagaaauaguacagcauaguucuugauauaugguaagagcucaggaaauguucauuauuaaauguuaguuauuuuccac

SEQ ID NO: 4164901 - RNA, 66 nt, Human
gugugaagacucauaauuuuagcccagauuguacugaggaucuaauuauugggucuguuaucacau

SEQ ID NO: 4164902 - RNA, 70 nt, Human
gugugaauuucugcuuaagcaagaaagcagcaaguuguugcugcugaggcuaaaguauaggaaaauccau

SEQ ID NO: 4164903 - RNA, 66 nt, Human
gugugacagaaacaagaaauaaacauugucugugccacagaaauguuguggguuuuguuaccacac

SEQ ID NO: 4164904 - RNA, 60 nt, Human
gugugacuuuauuuggaaauaguguuauugccgauguaauugauuaagaugaggucacac

SEQ ID NO: 4164905 - RNA, 55 nt, Human
gugugagagacugaagaaagccaugcuagcaaugacugggcucagucacuuaugc

SEQ ID NO: 4164906 - RNA, 84 nt, Human
gugugagaggauacucuguugucuggccuuccugucugccuauggccaguccugcccaggcugacagaaucaucugccucacau

SEQ ID NO: 4164907 - RNA, 75 nt, Human
gugugagagggggugcauguguggcagauuugagcccaguguaaacugcuucugcccacagccuccuguccacgc

SEQ ID NO: 4164908 - RNA, 81 nt, Human
gugugagcagacuugaugaggcagccucaugcuggcccgcccaggugaucuguguggcugucucuccuucugcuccugcac

SEQ ID NO: 4164909 - RNA, 55 nt, Human
gugugaggcagagaugccaaaacuguccugggaaauagugccucugcgccuccac

SEQ ID NO: 4164910 - RNA, 129 nt, Human
gugugagguagguuuacguaugaaauuccugggccgucaugucauuuugcauuaaaccaucaauuucuuggucugagaugacaagcauaugacacguccaaauaauuuuucugucaagucuauucagac

SEQ ID NO: 4164911 - RNA, 67 nt, Human
gugugaguguaccuauuuucaaaagugcuguuaacauaaacagagcaguaaaucuggggcaccaugc

SEQ ID NO: 4164912 - RNA, 80 nt, Human
gugugaugaaaagucauugugguauguucuuuuaauaggaauaagagagauaauaguuacaaagacuuuuuaaacaacau

SEQ ID NO: 4164913 - RNA, 70 nt, Human
gugugauuagagguauauauguauguaugugugucugcauauguguguguuccuccucagcuaauuccau

SEQ ID NO: 4164914 - RNA, 79 nt, Human
gugugcacaugacaguaaguagagcagagcaggagcaacaauauagaagcugaaguguucugaagcugcagaugcagau

SEQ ID NO: 4164915 - RNA, 64 nt, Human
gugugcagcagcagacgaaauugcaagccucucucugaaacuucaucaguugcuguugcagaac

SEQ ID NO: 4164916 - RNA, 64 nt, Human
gugugcagugagcaaaagaucuuaaauuugauuucaaguugcauaucucagcaugcugacacac

SEQ ID NO: 4164917 - RNA, 92 nt, Human
gugugcaucuguauuuauauauaaacaucuguauaugugcauauaugugugcauauacacauuugcuuauguguauauaugugggugcauau

SEQ ID NO: 4164918 - RNA, 119 nt, Human
gugugcaugcaauaaauacauuauauauuuuuucuggcaauaggcagugucccaauaguaacacccuguugugcucuuauugugcagggaauauauuauuugguuaauuauuagcacac

SEQ ID NO: 4164919 - RNA, 116 nt, Human
gugugcaugggggagcugcugccaggcugcccuccagucugcuccugugguuacuggcuccacagcaccucagagagggcggcccuggcuucagaaaugccagccauagugcucac

SEQ ID NO: 4164920 - RNA, 62 nt, Human
gugugcaugugcuugcacagauguaucuuuguccacaugugucugugcgucugcgugugugc

SEQ ID NO: 4164921 - RNA, 58 nt, Human
gugugccugagaggauggggccccucugcagagggccugggauguccuccuaggccac

SEQ ID NO: 4164922 - RNA, 127 nt, Human
gugugccuggccaauauaauguguggcagguuccucacauccuucuugggccaggcggggugccuucgcuagggcacugcagccucagauggugguagcaccugcccccauguauggaucaggccac

SEQ ID NO: 4164923 - RNA, 63 nt, Human
gugugccuucaugucauuggacaccuugaugucgccaucagagauagccacacugaaggccau

SEQ ID NO: 4164924 - RNA, 99 nt, Human
gugugcgggcugccaguccauauuuauacugccgggacauggcucucccugucuggagggcacuauggaguguggauauggggguggcucucugcagac

SEQ ID NO: 4164925 - RNA, 67 nt, Human
gugugcucagccaggggcaggccauaucacaggcuuggcauuggucucccuugcugguuggcugcac

SEQ ID NO: 4164926 - RNA, 101 nt, Human
gugugcugagaacuugacuccugaguuucaucguagaguacuucugagggucagaaacacucuacgugcagcuccuaacacagucgaggcacacagcaggc

SEQ ID NO: 4164927 - RNA, 63 nt, Human
gugugcuggguuggucaauaaauuauauagucauucuacuaauuaucagccgucccacuacau

SEQ ID NO: 4164928 - RNA, 56 nt, Human
gugugcuuuuuaugugagggaagccagauaaaggaucuggcuuuggaaggguagac

SEQ ID NO: 4164929 - RNA, 65 nt, Human
guguggaauggaguuuuugcccgggcuggagccagcaggacaguacagagauuuuacuuccucac

SEQ ID NO: 4164930 - RNA, 73 nt, Human
guguggaguagagauaagccaugagaacuguaauacugaacaguuccaggaagacaucucaggaacugcagau

SEQ ID NO: 4164931 - RNA, 62 nt, Human
guguggcaaagaccauuucuuucacccaauaugauuguaggaagaauaagucuuuguaccac

SEQ ID NO: 4164932 - RNA, 82 nt, Human
guguggccuggaugagcuucgacaucuggucaacaucagccacagaugcugucgagaccucucaccguguuccaggccacac

SEQ ID NO: 4164933 - RNA, 94 nt, Human
uaggcuucaucauaugguugaauucuggccaauggaaugugagaagaaguaauguaugccacuuccagaauuagaauuuaagaugguaggccug

SEQ ID NO: 4164934 - RNA, 91 nt, Human
uaggcuuccggggacacugcaguguucccacugggcuaagacuggaaccucucuagccauguguggaacacagccugguuccuggucccug

SEQ ID NO: 4164935 - RNA, 77 nt, Human
uaggcuuccuuccucuauguucagguagaauaaguacugcucagagcauuuccauuugcgcauaaagaggaagccug

SEQ ID NO: 4164936 - RNA, 64 nt, Human
uagggaaaagugacaguuuacaauucuuaaugggagcccuaagaaacaugauacuuuuccucua

SEQ ID NO: 4164937 - RNA, 58 nt, Human
uagggaaauauagauuuagggcugaaaacugaucccagcuuuuuucauuauuuccuug

SEQ ID NO: 4164938 - RNA, 71 nt, Human
uagggaacauuuugcuugaugagaaaauccgccagcaaggauguugggcucuaagcagaacugaagcucug

SEQ ID NO: 4164939 - RNA, 76 nt, Human
uagggaagaugaggcccuuccccaaggucacgggcuccuaaguggaggcugugggaugggaccucagcugccccug

SEQ ID NO: 4164940 - RNA, 58 nt, Human
uagggaagcuccugauuccccugcucuauucacaccagggagucaugauguuuccuug

SEQ ID NO: 4164941 - RNA, 79 nt, Human
uagggaaguuccuuauugugagaugcgauaauuuuauauaauugcagcagcuucagcaguuuugaaggagguuucccug

SEQ ID NO: 4164942 - RNA, 77 nt, Human
uagggacauguggaagagcuucuaggagacaguguggaccuuuccaucccuagaggucuucacaagauaaauuccua

SEQ ID NO: 4164943 - RNA, 82 nt, Human
uagggagucgacggggugauggcugaugaggccuucaacccuaauaacugcuuuaucaucacuguaauccguugaguucuua

SEQ ID NO: 4164944 - RNA, 88 nt, Human
uagggaguuuacauccacccauuauugaugcaacagcccuuaauagcaccuuuguugucagaggguguuguguugcuuaauaucccua

SEQ ID NO: 4164945 - RNA, 57 nt, Human
uagggaugauggagccuauguaccugguaacuacguggaacugccaagccaucccua

SEQ ID NO: 4164946 - RNA, 81 nt, Human
uagggauggccuugggccaacuguccccauagcccugaaggaagcaaggagcugaggaagucagguggcccagcaacccua

SEQ ID NO: 4164947 - RNA, 70 nt, Human
uagggcaagaucagcuuaacauccuacacuguugucuuuaagaggagcacaacauugggguguuacccua

SEQ ID NO: 4164948 - RNA, 59 nt, Human
uagggcaguuucauguuaucuuggcucauuccuucucccgagaugaagagauuguuuua

SEQ ID NO: 4164949 - RNA, 69 nt, Human
uaggggaacugcugaccucaggucauccuaaaaccugaggaugucagaugaugucagcaggacacucua

SEQ ID NO: 4164950 - RNA, 76 nt, Human
uagggguacagguuuggggaucaaagagaccuagauuaaaaucuuugcucugccauuuaucagaacugugaucuua

SEQ ID NO: 4164951 - RNA, 74 nt, Human
uaggggucuggcgaugcacuuugugccagaauuggaaugccauacucugcccugagucaugccagauggaacug

SEQ ID NO: 4164952 - RNA, 61 nt, Human
uacauguacauugggcauuaauuugcuaggccagcacugcucaacagauauguaacaugug

SEQ ID NO: 4164953 - RNA, 70 nt, Human
uacaugugcauguguauauguguguacaugugcauauguauauguacauacaugugcauacguauaugua

SEQ ID NO: 4164954 - RNA, 57 nt, Human
uacauguggguuaaaaacacucuugucuucccuaggggugcgaauacucauaaugua

SEQ ID NO: 4164955 - RNA, 93 nt, Human
uacaugugucuuuuucuccuuuuuccacuugggacccauuaguuaucauggaaauaaugauucuggugagaaugaggaauaaagacauaagua

SEQ ID NO: 4164956 - RNA, 76 nt, Human
uacauuauuaggcugugaguuacuugagaaagggaccuccuuuuuuaucuacagauucucagcuauuaguaaugug

SEQ ID NO: 4164957 - RNA, 62 nt, Human
uacauucagaagaauggacacgcuaaaaaacaacugcgucuuauguuucuuaacugagugua

SEQ ID NO: 4164958 - RNA, 57 nt, Human
uacauuccccagcaggccuuuuguugguugcacuaacugcaagguugcugggaagua

SEQ ID NO: 4164959 - RNA, 130 nt, Human
uacauuggcaucacuugggagaacuuuaaaacauacuggugccaggcucccagcucaggcauuguaguuuaugguguggccugagggagcacuggcacuuaaaauuugauucccgaaugauucuaauaug

SEQ ID NO: 4164960 - RNA, 56 nt, Human
uacauuuaucgaaacuuguucuguggcccaacauagaguuuguaguggugaaugua

SEQ ID NO: 4164961 - RNA, 85 nt, Human
uacauuuauuuuauucaugaagugugauuuuguuuugaccauuauaaaaugguaggaaugauuacgacuuuauaauauugaugua

SEQ ID NO: 4164962 - RNA, 88 nt, Human
uacauuuggcuuauauucacccaauaauacugaauaacaauuuaacacaaaguuacuuggaugauggguugaugugaagggggaugua

SEQ ID NO: 4164963 - RNA, 60 nt, Human
uacauuuuaaaugcagauggagaugucagguuucacugaauauaugugcauaugugugua

SEQ ID NO: 4164964 - RNA, 57 nt, Human
uacauuuuaugaucugaacaauacacuuugcaagaggugucagauacauaggaagua

SEQ ID NO: 4164965 - RNA, 129 nt, Human
uacauuuuccuucauaacuuaucuguguauuuguuuauuuauauucugccuucugcugaggaugacuuugagcagccugcaaaggcacauauauuugagauuacaauguguuuaaaauaagaaaaauga

SEQ ID NO: 4164966 - RNA, 130 nt, Human
uacauuuugacaaacaauacaaagagcauagaugguggauaguuaaggguuuagagacaaaugucuuucaaacaucuaaacuacccacuuuagaagcaucuuuaacauauuguugaugugaauauuugug

SEQ ID NO: 4164967 - RNA, 130 nt, Human
uaccaaaacuguaaacugcccaguauguuagaggacuugaaagggugaacaacuucucauauuaucuucucaauucaaaaggugucacuguuucuggccuucauacuguaagaaucauagagucaaggua

SEQ ID NO: 4164968 - RNA, 55 nt, Human
uaccaaaagcuuguuucauacaaaauuuuaguuuguaugaaguguucuucuggua

SEQ ID NO: 4164969 - RNA, 100 nt, Human
uaccaagaccugaguaccuuauguggguuaacaguuuauaccagagcagacacagaaugcuuggugcagguuguggccuguagguagucaguaaauggua

SEQ ID NO: 4164970 - RNA, 87 nt, Human
uaccaccaaacgaggauauauuugugacuguuauuaugcugagugauauugcaucauauauuucuacaagugccucauuuguuggua

SEQ ID NO: 4164971 - RNA, 68 nt, Human
uaccacggaaagagcauuuuuguggcauaucgacuaagaaaauaaccaggcugcucuuucuuguggua

SEQ ID NO: 4164972 - RNA, 55 nt, Human
uaccacugcucugugccaccgugcgaagaacacaggaugggaaucggagcuggua

SEQ ID NO: 4164973 - RNA, 100 nt, Human
uaccagagacaccacaugggaacaggcaugaucauaggaguuuauacuguacuccaauuaguugaaaauuaugaacaugcauguuacaugguagcuggua

SEQ ID NO: 4164974 - RNA, 71 nt, Human
uaccagauggcgcccgugagcagugccgcccuucccuauggcuuuuauuuccacucuucgggcgcuaggua

SEQ ID NO: 4164975 - RNA, 61 nt, Human
uaccagcaucuaacgcuccugggacuccugucgguucuaugauucauuuagaaguuuggug

SEQ ID NO: 4164976 - RNA, 57 nt, Human
uaccaggcauuuguaaugcugugccaguaugucugguucuuagcacagugccuggua

SEQ ID NO: 4164977 - RNA, 70 nt, Human
uaccaguauggccaugccaguuuacagccaauaccuguucuaaaugguuggugcccaggccauacuggug

SEQ ID NO: 4164978 - RNA, 97 nt, Human
uaccauccauuauugugaacucucucuaggcaucuauuuucaggggguaguuaauguagucuuuuccugguagugauuuagggagcauuaggaggua

SEQ ID NO: 4164979 - RNA, 102 nt, Human
uaccauccccucucccagaguuguggugaguucuuugucaucucuggaguaccgcuugcccaggaguugaagggcugacuuuuacuggagguggagauggua

SEQ ID NO: 4164980 - RNA, 75 nt, Human
uaccauggcaauguuagcaaagcauuuccugccaaauccaaaaggagauacauuguucuaagcauugcauuugua

SEQ ID NO: 4164981 - RNA, 79 nt, Human
uaccauuuaugguuucucauuccauuacaugugcuccaucacugugcaggggaagagagaaaaacauggagaauuggua

SEQ ID NO: 4164982 - RNA, 55 nt, Human
uacccacaacuaauuagugaauuucagaauuaaggaaaaucuuaguuguguggua

SEQ ID NO: 4164983 - RNA, 58 nt, Human
uacccagcuucaagucaggacuuaaauacuacuuccuaaguaaaggcuuaacugggug

SEQ ID NO: 4164984 - RNA, 84 nt, Human
uacccagggaaucuugguaagcugacauugcuuugaagagauugauuccaagagcagccuuagguauugugauuccuugaugua

SEQ ID NO: 4164985 - RNA, 61 nt, Human
uacccugcaucccccacauucacaaaguaacuguggccuaaaugggaugaugcagaaggua

SEQ ID NO: 4164986 - RNA, 100 nt, Human
uacccuggcauuauguagcagggagcacuaaucucauuuucaguugagaaaacuggagcugaaaugggugcacuuccuuaccugccuaagcuauuaggua

SEQ ID NO: 4164987 - RNA, 79 nt, Human
uacccuguuuuucaguuccaucucugcucuguccuauagcuuuauaaaaccagaguguguggggcugaggucaggagua

SEQ ID NO: 4164988 - RNA, 63 nt, Human
uaccguacacauuaacuacaguuauaacaaacuacggaauaagcgguagugguguaaacggug

SEQ ID NO: 4164989 - RNA, 62 nt, Human
uaccuaccaugagucaggaacuguuuccauacauuauaaaauaacacugugcgugguaggug

SEQ ID NO: 4164990 - RNA, 87 nt, Human
uaccuagcauauagaagcuguuccauaagugauagccuguuguugacauugacuaacauuuauugagcacuuaguauaugccaggug

SEQ ID NO: 4164991 - RNA, 73 nt, Human
uaccuagucuucacaucagucuaaagaguugguguuacuaucuccauucuuuaggaagauggagggccacgua

SEQ ID NO: 4164992 - RNA, 100 nt, Human
uaccucagugagacuccuggccaguaagagauaggaggcagaaagaagccaacaggaaaacucugcuccuauccuccugcugacagguaguucugaggug

SEQ ID NO: 4164993 - RNA, 62 nt, Human
uaccucauagggcuguugugaggauuaaaugaguuaauucaaguagcacaccuagaauggua

SEQ ID NO: 4164994 - RNA, 60 nt, Human
uaccugcaggagcuuucuucccaaacuuuacauguaaaguucgaaaaagcuccccaggug

SEQ ID NO: 4164995 - RNA, 76 nt, Human
uaccuggccagcggucggucacaccugagugcccagagugagcgggcggcagaggcauuucugacgcugccaggua

SEQ ID NO: 4164996 - RNA, 68 nt, Human
uagucuccagccagaagcugcucccccacucaacucccccggagcuucugcuugcuggcgggggucug

SEQ ID NO: 4164997 - RNA, 87 nt, Human
uagucugcugguaaggcucagauucacauuugguuuggggaagacccaggaucuagccaacugugaucugaguaccagggaagucua

SEQ ID NO: 4164998 - RNA, 64 nt, Human
uagucuuccuggaagaaguguucuagacuuugaaacacuaguaggauucaguuagagagggcua

SEQ ID NO: 4164999 - RNA, 104 nt, Human
uagucuuugggagguaggugagauuuguuuuauaaaauagcggcuuauuaauccacaguguauuuuauuuauaaauuuuugaaugauuuauuuuucuaggacua

SEQ ID NO: 4165000 - RNA, 65 nt, Human
uagugaaagcauguguaaucucaauaccuccauuggggguuguaggaauauauguagucucacug

SEQ ID NO: 4165001 - RNA, 99 nt, Human
uagugacaagggcaucccaaggcacuugcccagagcugcagaguugugugugccauaccugcggcucaaagggaaggccuucuauccccugaguuucua

SEQ ID NO: 4165002 - RNA, 69 nt, Human
uagugaccuuugaacagcccagggaugcuucacagugucuuauucuugaugcuuguuuaaagguuucua

SEQ ID NO: 4165003 - RNA, 119 nt, Human
uagugagaaggcccuggauuagggaucaugcuaccugaguuauauuaauaauuacauuucugcuaugaauuuggguauucucaggccaaagccucucggaaucccuguuuucucuucug

SEQ ID NO: 4165004 - RNA, 57 nt, Human
uagugcaaaggucuugcaccaggcuacuuuuuagacuaugggccaaccuaugcacua

SEQ ID NO: 4165005 - RNA, 87 nt, Human
uagugcaggaggaacaagcugcuuuaucuuccucuccaggcagaugccuguguguggaagauggaugcacagcaucugccugcauug

SEQ ID NO: 4165006 - RNA, 57 nt, Human
uagugcaggguuuuaagcacugagaaaaucaauuccaaagucuuuuacccuccauua

SEQ ID NO: 4165007 - RNA, 60 nt, Human
uagugccauagauaggaccauuugccccuaccuugaaggcauaguccuacccauggucua

SEQ ID NO: 4165008 - RNA, 60 nt, Human
uagugcccaguuagguuggagcacaguucuuuuggaaccuguucagaccaacuuggacug

SEQ ID NO: 4165009 - RNA, 57 nt, Human
uagugcucuccaaauggcucuauguaccccaauuguucaagaguccaggagagucug

SEQ ID NO: 4165010 - RNA, 59 nt, Human
uagugcuugcaaauuucugugguaaacauacuccuaccauggccaaugucaagcuacua

SEQ ID NO: 4165011 - RNA, 58 nt, Human
uaguggaacugugucauacaaaugcagccuguuguauugaauguacuuguucucacua

SEQ ID NO: 4165012 - RNA, 68 nt, Human
uaguggcugccaagagcaaugcugugaauaacugagguuucacugggccuucuuagggcagaguacua

SEQ ID NO: 4165013 - RNA, 62 nt, Human
uaguggguguuucagauuuuaguuuagugguaguuauauaugcagaaucccaggccccacug

SEQ ID NO: 4165014 - RNA, 55 nt, Human
uaguguaauuccccuucauguauuuucauaugcuugaaugggauggaauucacug

SEQ ID NO: 4165015 - RNA, 73 nt, Human
uaguguccuuagagucuccagaggcaucccuaacccagaaucuuuugacuguccucuggagagaaaggcagua

SEQ ID NO: 4165016 - RNA, 124 nt, Human
uaguguccuuugacuuacuuaggcugcugaggucuaguuaacucuggagaguuggaagacauucuuucuuaaauagguggauugguuugagccuugguuaggucuggguugguuugcuuuacug

SEQ ID NO: 4165017 - RNA, 92 nt, Human
uagugugcaaaauugagaggcgcucacucucagguuccugaagugcagggccggcaccugacagugaaugccucuguaaauuuugcacccua

SEQ ID NO: 4165018 - RNA, 77 nt, Human
uagugugcucaguuugauuccagggauaucucaggcuuauuuaacaaugcuacccuuagaacaacauuagcauacua

SEQ ID NO: 4165019 - RNA, 80 nt, Human
uaguuaaaaauuuuaaauuaguuuccuggucacacugggcacauuuuaagugcucaaaagacacaggaggcuagugacua

SEQ ID NO: 4165020 - RNA, 61 nt, Human
uaguuaaauguguuagccaggguucucuggagaaacagaaccaauaagacacauugagcua

SEQ ID NO: 4165021 - RNA, 125 nt, Human
uaguuaaauuuaaauuucagauaaauaaugaauaauguuuuuguauaagcaugucccaaaauuauaaggggcauuuaguuauacuaaaacauuuuugcuguuuagcugaaauucaaauuuaauug

SEQ ID NO: 4165022 - RNA, 108 nt, Human
uaguuaccaaauuagaaugugggcuuggaugcugucuaagcugaggacuuccuuucaccuucucagaucccaguuugauguauucuuucauuuucaauuuggaaucua

SEQ ID NO: 4165023 - RNA, 64 nt, Human
uaguuaccugggguacaugguuaauuugauuuagcagauucuuuggcuaaacccuaguaaauua

SEQ ID NO: 4165024 - RNA, 84 nt, Human
uaguuacucuuaucuuuugaguucucaagauguaugaagacauaacaccuguaucuaagaauuccagagaaaggaggaagacua

SEQ ID NO: 4165025 - RNA, 58 nt, Human
guauuauguaguaugaguguauauguguguaugcauguauacacaugcagacagaugc

SEQ ID NO: 4165026 - RNA, 77 nt, Human
guauuauuuaccugguguuuaugguccaucugcucucaaacuagaaugguuucaguaagcaccagguacacccuuac

SEQ ID NO: 4165027 - RNA, 129 nt, Human
guauuauuuuauugucacauauauaucucaguuaaugccgacaugauuguucuugcuguuguaaccugaauuaggaauuuucacaguuggguauugaucauucauguaauuguaugaugaaggaaauac

SEQ ID NO: 4165028 - RNA, 97 nt, Human
guauucacucauuagcauuacuucaaagaguauuuaaugauuuuggaauuuucuauguagaaugauuuuuuuaaguagucuuacaugauguggguau

SEQ ID NO: 4165029 - RNA, 57 nt, Human
guauucaucauuuuuuggaugaugauucaaaaaaucgucauccuuuggaugaaucac

SEQ ID NO: 4165030 - RNA, 80 nt, Human
guauuccacaacauucuuaaauacacugaauuugcaguaugucugucucuucaguaaguauaagaaguguugguccaugc

SEQ ID NO: 4165031 - RNA, 71 nt, Human
guauucugguggugugaaaagugauaugguugagauacccagcacauaauacauguuccacuuaugaauac

SEQ ID NO: 4165032 - RNA, 58 nt, Human
guauugaugcaauauauugauacaauauauuaauugugucaguguauacauacaguau

SEQ ID NO: 4165033 - RNA, 67 nt, Human
guauugcauagaccugggaugaguuacuaauucacaauuuacucucuaccaggcuuuaugcaaauac

SEQ ID NO: 4165034 - RNA, 80 nt, Human
guauugcauucuaaaaauaagcuaggugcuagucagaaaagugaaucaggcucaagcccugcuuauauaaagaugcuggc

SEQ ID NO: 4165035 - RNA, 71 nt, Human
guauugcuguagggggaaaauacuuauuagauuuauucauaaaauuaaguacauuuuuaacuuacagcugc

SEQ ID NO: 4165036 - RNA, 91 nt, Human
guauuggacuaagugaauuuacauuuguaauggaaaauggaauagggaacaauuauuuagcauuacuaaaaugaaaacuuggauuugguac

SEQ ID NO: 4165037 - RNA, 79 nt, Human
guauuggcaaugaucucaaucuucucaucuugaaagacacccacuuaggaaaggauggugaaggaucagugccaguugc

SEQ ID NO: 4165038 - RNA, 55 nt, Human
guauuuacagcugugccucuggagugcuuucuaaacgacagugcaguuguaguac

SEQ ID NO: 4165039 - RNA, 68 nt, Human
guauuuagacacaaaagugccauggagaccaaugauuuauaaggggaccauucacuggugucaaauac

SEQ ID NO: 4165040 - RNA, 58 nt, Human
guauuuaguccauugcacaguguaaccucauuauaacacugucucauggauagacugc

SEQ ID NO: 4165041 - RNA, 82 nt, Human
guauuuagugauuuuuuagcccuguacugugauacuaagaaguagggcuuaaauagggccuaaaaaguauugcuaaaauuac

SEQ ID NO: 4165042 - RNA, 66 nt, Human
guauuuaucaacugguguguguggccucaguccuucagaggugaccugucacauuuugaugaaugc

SEQ ID NO: 4165043 - RNA, 89 nt, Human
guauuucaccccugggaagcaagucagggcacaauggcauaaaauugagaacucuguauguccagcuugcuuuccaaucugauaaaugc

SEQ ID NO: 4165044 - RNA, 112 nt, Human
guauuugaauaucuuucauugggcaaaaagaagaugguauucaugaugcuuuuaaaaguuuaaaggauuagagauaccaugccuuacuuucugccuaggaugucuuuaauac

SEQ ID NO: 4165045 - RNA, 64 nt, Human
guauuugagcuuuauguauauuuuuaaaaauaauccauugaugugcauaaagaaauacaaauac

SEQ ID NO: 4165046 - RNA, 85 nt, Human
guauuugauuggugugaaaguaauugcgguuuugccauuauuuuugaaggcaaaaaucacaauuauuuucgcaccaaucuaauac

SEQ ID NO: 4165047 - RNA, 76 nt, Human
guauuugcucaacacauugaagcuaugaugauucacugaaacauggaucucaauuaguacaagugugagcaggcac

SEQ ID NO: 4165048 - RNA, 126 nt, Human
guauuuggaaagagggcugggcuggagaugaggaaacuugggguccagaagcugcucugccacacuccagcucacugacccuggucaaguugccucacccacuugggccucucuuuccucauuugc

SEQ ID NO: 4165049 - RNA, 68 nt, Human
guauuuguguucucuccuaaauuggcaacaucuuccggaauuguuuuguuuaugagagcacagcauau

SEQ ID NO: 4165050 - RNA, 84 nt, Human
guauuuguuuagaaaugugcagaauguguuagauaaaccaaucaauaucuaauuacuagucugcagccuucucuauuuuaaugc

SEQ ID NO: 4165051 - RNA, 86 nt, Human
guauuuuauauuguauucucucaauauuucauaauguuggauugguugaaauauugaguggaaauaacuacagagguauaaaacac

SEQ ID NO: 4165052 - RNA, 66 nt, Human
guauuuucaaagacagacaucagucaaaggucagacacuuauuagcugguguuuuucuuugcauac

SEQ ID NO: 4165053 - RNA, 59 nt, Human
guggaaaaggcuggaaacugaagauaagugucuuauucuuagccauccggccuaaccac

SEQ ID NO: 4165054 - RNA, 103 nt, Human
guggaaagcacugcauugcagagcucuagggggcgccuuucacaaagacuacaaaguaaauggugccugcugcagcugagcaguguacaaccugcacaaccau

SEQ ID NO: 4165055 - RNA, 120 nt, Human
guggaaauuauuuuaauguuguuguuauaauagaucaaugagcaauuuaauaguucaugggguugcuaguuuguuuaaauuuuaauucaacuuuuccaaaagauuagaacuauuucucac

SEQ ID NO: 4165056 - RNA, 65 nt, Human
guggaacacucagaaaugcucguccuugaaauaaugucauugggagcauucccugagggucccau

SEQ ID NO: 4165057 - RNA, 65 nt, Human
guggaacacuguggaugagaagagacaugagaaguccaccaucuucugcaggcaguguagaccau

SEQ ID NO: 4165058 - RNA, 62 nt, Human
guggaaccaaggaaaggcauuugcucccagcccgggcagcacuuaugcucaccuuguucuac

SEQ ID NO: 4165059 - RNA, 107 nt, Human
guggaaccagcuaccggagauaauuuaaaacuccaggcugugguuuuucugacccaacauugaccugauuuugaagacagucuuauuuccuugguggugaguuucau

SEQ ID NO: 4165060 - RNA, 68 nt, Human
guggaacccaggcuagaagugaauuaugauagugcaguuaauuaaaguuuaucauagccggggaccac

SEQ ID NO: 4165061 - RNA, 61 nt, Human
guggaaccggggugccccacaguaaguccccuuuguuaggcauccugucccuggauucgac

SEQ ID NO: 4165062 - RNA, 89 nt, Human
guggaacugcucccaccagauuaguccugggcuuuugucaggccaggccuggcagguccagcuggacucaacuccaggguguguuuggc

SEQ ID NO: 4165063 - RNA, 70 nt, Human
guggaagacaguggcuuuuuaguggcagauguucacucaucucacuucugaaaggcccuccauugaccac

SEQ ID NO: 4165064 - RNA, 58 nt, Human
guggaagaggcaagauagcucucuggggccucuuccuaagggcacuaaucuuuuucau

SEQ ID NO: 4165065 - RNA, 76 nt, Human
guggaagauguaugaucguaugugugauuuccucagugacaggaaauaucagauuuaugaauauacuaugcuccau

SEQ ID NO: 4165066 - RNA, 66 nt, Human
guggaagcaguaaggcaaguuuagaagauggaauauucuauaaacaaaugaccugauuucuuccac

SEQ ID NO: 4165067 - RNA, 79 nt, Human
guggaagcuagcccauuaccuuuggauuggaggcuuuccuuucuucauaaagugaaggaugaugggcauuucuuuguac

SEQ ID NO: 4165068 - RNA, 94 nt, Human
guggaagcucauuaccaguaacguuuucgaggacuuuaaaaccaacuuuucugugcugagcugucuggaaguuccucaugauaccggugaccac

SEQ ID NO: 4165069 - RNA, 55 nt, Human
guggaagggucacagccccuaccugaagacacuggccuggguauggcccuuccau

SEQ ID NO: 4165070 - RNA, 78 nt, Human
guggaagguuaagagcuccaauauuuguggcaacuauuugagaugccaaaaauuagaaggggcucagagcaccucuac

SEQ ID NO: 4165071 - RNA, 60 nt, Human
guggaagugauggugugcuaguggucagccugugccuccagagcucuuucaugcuuccau

SEQ ID NO: 4165072 - RNA, 65 nt, Human
guggaauguaguguccauggaauuuuuuuucagcaaaaaauuauugaguguccacaauauuucac

SEQ ID NO: 4165073 - RNA, 58 nt, Human
guggaaugugagaauaccguuuugagcaccuaccaugugccaggacucacuacuucac

SEQ ID NO: 4165074 - RNA, 73 nt, Human
guggacaggccaggacaucgucaucauggggaguggcucccugucuccuuguguguccugcccgcgugucugc

SEQ ID NO: 4165075 - RNA, 73 nt, Human
guggacaguuaggggcuggaugccaggcacagaggagccagccuggaagaccacaagcccuuaacuguguugc

SEQ ID NO: 4165076 - RNA, 86 nt, Human
guggaccugccuugucuagcucugcuuaucauggcucccaccauccuuggagcugagaagagagcucagaucacugugaauuccac

SEQ ID NO: 4165077 - RNA, 63 nt, Human
guggaccugcuggaugggcagguaguauagacaggguggaucugcuagacaggcagguaguau

SEQ ID NO: 4165078 - RNA, 111 nt, Human
guggaccuuccaaacagauccaaaauuugucccucugaggcuucccugguacuacaugcuguuucagucaagaucaagggggauagaauuuggcagcugauauaaagccac

SEQ ID NO: 4165079 - RNA, 59 nt, Human
guggacggcggugccaggacagggagggcggccuuucaccagcuuggcaccucugccau

SEQ ID NO: 4165080 - RNA, 86 nt, Human
guggacuaucuuggagaauguuucauguguauguuagaagaauauguauucugcugcuuuagguggaauguucuauagaugucuau

SEQ ID NO: 4165081 - RNA, 69 nt, Human
guggacuccugaccuugugacccacccaccuuggccucccaaagugcugggauuacaagugugagccac

SEQ ID NO: 4165082 - RNA, 74 nt, Human
guggacuguuucuugcccucaguagcaguugcucuaagaucaaggcugguucuggguaacagcucuggguucac

SEQ ID NO: 4165083 - RNA, 55 nt, Human
guggagacaaaggcugagugaggacuuggauuuuggcucagaaggcugccuucac

SEQ ID NO: 4165084 - RNA, 89 nt, Human
guggagagaccuugaaacauuaggaaaucauuauuucucccgucuuuuuguaagagaugagguauucguaauauuuccaaguccugcau

SEQ ID NO: 4165085 - RNA, 68 nt, Human
guggagagcggagcuaguuuuuguccuccauagauccccacuucugaggcuugaucagcuuccuccac

SEQ ID NO: 4165086 - RNA, 72 nt, Human
guggagagggccaggagaaugggauuacccuaugaccaaggagacaugggaagaagcccuccuuccuuccac

SEQ ID NO: 4165087 - RNA, 102 nt, Human
guggagaguugaaaauaugcgaagcuguaagacuuucuuguuuauuucugugucgaaggcaaggcagcuuaauagaauuugaauauaacuaaauccauccac

SEQ ID NO: 4165088 - RNA, 69 nt, Human
guggagcaaucagagggucaguugaauuguuuccugauucucagagaucacuggccuuuguugcuucau

SEQ ID NO: 4165089 - RNA, 80 nt, Human
guggagcacggcaaggauagguacuauguaauaaagcuuuugauucauguuuuauauauguuuguuuuugugugggccac

SEQ ID NO: 4165090 - RNA, 89 nt, Human
guggaggagccuucuuggggcagccuaagcugagccucuaccccuaugagcugcuccuggccgggcugcuccuggaugagguacuccac

SEQ ID NO: 4165091 - RNA, 78 nt, Human
guggaggaggagacagcgggggcucccaagacccaggccugccucuugcuccugagcccugcugggaccuccugcuac

SEQ ID NO: 4165092 - RNA, 61 nt, Human
guggaggcugcuggcaggcguggacgucucagaugucugauccuucaggagcccccuccac

SEQ ID NO: 4165093 - RNA, 59 nt, Human
guggaggcuguguuucagugaggccuuggaaguucggggcugguacuacagccugcuau

SEQ ID NO: 4165094 - RNA, 57 nt, Human
guggaggguuugcaaugugcaggguaauccuaucuccuagcacuguauccucuucau

SEQ ID NO: 4165095 - RNA, 88 nt, Human
guggaggucccaccacaauguccuggagggcggccgcuggcucagugagaagcgacaccgccugcaggccauccaggaugggcuccac

SEQ ID NO: 4165096 - RNA, 103 nt, Human
guggagguggugguaauagacuuguauuaugguucgcuuaguuccugaguacgugauuaauacuaauuguaacuacaaacaaguacugaagcuacuccucugc

SEQ ID NO: 4165097 - RNA, 56 nt, Human
guggaggugguuuguauuccuggcucuuaucaaggcacuauuacauucauuuccac

SEQ ID NO: 4165098 - RNA, 114 nt, Human
uccugggggggucuucccagcaagcucuacagaagcagcgcggcucuucucucguggguguggaucuugagaugggcgcgcugcucugaugcggugcugcgucucccuucagga

SEQ ID NO: 4165099 - RNA, 92 nt, Human
uccuggguagcugcggugauuucguacugugaagugcacauguguacuccauacagcccucacaaugaaaaacacuacauauuauccaguga

SEQ ID NO: 4165100 - RNA, 66 nt, Human
uccugggugaaagaacaggcagucgaagauuccauggccuaaauuaauucuauuucauccccagga

SEQ ID NO: 4165101 - RNA, 82 nt, Human
uccugggugacagucaauagcugggauuaauuuuauuuguucuugcacagauauuuguaucuugcuauuguaaaccucagga

SEQ ID NO: 4165102 - RNA, 90 nt, Human
uccugguaaggaccuggguugccaggcuugggagguagggagcaugccaggugcucuccugcuccucagcccaacucaccuuggccggga

SEQ ID NO: 4165103 - RNA, 66 nt, Human
uccuggugauuauaagccacuguaucagcccugaauugcuuaucuccagauugugaucaucagaga

SEQ ID NO: 4165104 - RNA, 101 nt, Human
uccuggugggggucaucucucugggucucucugcuuucccccagacccugaaccgaccagagguccuggcacauugcaggggcucaggaaaugcucaugga

SEQ ID NO: 4165105 - RNA, 72 nt, Human
uccuggugucuggggguucugaaagcugacuuuucaccuuuggcaggaacuuuuaacccucagagcucagga

SEQ ID NO: 4165106 - RNA, 81 nt, Human
uccuguaccccaguccaguguguucuggcagcagggacaccugggccaaggggccaucuggaccaaagguggggugugggg

SEQ ID NO: 4165107 - RNA, 72 nt, Human
uccuguccauugcaaggaaaacagaugaucaacaugagaagcucagcuguugauuaauuuucccaaacaggg

SEQ ID NO: 4165108 - RNA, 67 nt, Human
uccugucugucugugcccugcuggcccggugacccuuccuccuccagcuccagguagaugggcaggg

SEQ ID NO: 4165109 - RNA, 76 nt, Human
uccugucugucuuuugugaauggaauccacagacugaccucauccagucuuaggaugcuauuagcaagaaacagga

SEQ ID NO: 4165110 - RNA, 61 nt, Human
uccugugaccagcuuccaugcugaguccugcuuuuagcauaaggucaggugugguccaaga

SEQ ID NO: 4165111 - RNA, 59 nt, Human
uccugugauggcuugcgauguguaaaauuuuccuacaacguguugcagaaaucacugga

SEQ ID NO: 4165112 - RNA, 66 nt, Human
uccuguggcucuguggaaccuuagaccucuucuagcucagagaguugcaaacagauaccuacaggg

SEQ ID NO: 4165113 - RNA, 90 nt, Human
uccuguucauaugaaacucuagagcagacacaacuaaucuaccgauaccgaaguaagaauaguguuugccuuugggagauauugacuaga

SEQ ID NO: 4165114 - RNA, 84 nt, Human
uccuguuccagcagcguuccaagguggcuucguagaugaagggcauuugagcuguaaggugggaugugaaagguggagcuaggg

SEQ ID NO: 4165115 - RNA, 60 nt, Human
uccuguucucccucagauaagacucagaucucuuacaugguccaguggaggaggacagga

SEQ ID NO: 4165116 - RNA, 99 nt, Human
uccuguuguguauucuagguugcuuugagucacugucuuggagauuuuuuaauccuccagagauuugaguuauuuaggccacuucauauaugcguggga

SEQ ID NO: 4165117 - RNA, 76 nt, Human
uauagaacgguucagugugcuucaggacguuagccuuaaaggagcuauucaguggacauauugaaagauuucugua

SEQ ID NO: 4165118 - RNA, 57 nt, Human
uauagacuuggcaugcauguucucauucaccucacaggcaugcugguaagaucugua

SEQ ID NO: 4165119 - RNA, 58 nt, Human
uauagauagacugacgauacagguucccuaacauugccgucuucucauucugucugug

SEQ ID NO: 4165120 - RNA, 58 nt, Human
uauagccauguaagaacuccauuuucaguuucacguagacaguccuuacgaggcuaua

SEQ ID NO: 4165121 - RNA, 75 nt, Human
uauagcugugcaaauuccacuggaaagcuugggguuauauccacaguaaaccacagggaugcugcacugacugug

SEQ ID NO: 4165122 - RNA, 66 nt, Human
uauaggaaagcgugugugaugggcaaugccuuagggcaagaugauucacuacaauguucucuuaua

SEQ ID NO: 4165123 - RNA, 80 nt, Human
uauagguuucaaaguucuauauaugcauguguugaaaauaaaacacaugguaaauugguaaaggacuuuagaaacaagua

SEQ ID NO: 4165124 - RNA, 82 nt, Human
uauaguaccagauuaaugaaugagaauauaacagaggauuuggacuucuguuaagcccauucucuuuaaaauaaggacuaug

SEQ ID NO: 4165125 - RNA, 59 nt, Human
uauagucuuuauuuuggguggccauggauccaggucaaaacaaaguuaagaauucugua

SEQ ID NO: 4165126 - RNA, 69 nt, Human
uauaguguuuuuacauuaucuuguuaucuuucaaccuugguugaauuaggcaagguagguaucauugua

SEQ ID NO: 4165127 - RNA, 59 nt, Human
uauauacaguagugccucuguuuuauauuuuuaauaaccagaggcaggcucugugugug

SEQ ID NO: 4165128 - RNA, 74 nt, Human
uauauagcaugauuacuaauuucuugggaacaaaggugaaaaccuugacagucccaggaaaauagaacuauaua

SEQ ID NO: 4165129 - RNA, 80 nt, Human
uauauauaauacuugcugugggccuguuaugcuuaaguuuaguugccaauaauaauaaaguucauggcugauuguauaua

SEQ ID NO: 4165130 - RNA, 64 nt, Human
uauauauaauccugaaaauugaauggaagguauaucuuccuuuauuguuuucagauaauguaug

SEQ ID NO: 4165131 - RNA, 106 nt, Human
uauauaugcuaaagggggauuuagacuauuuuuaauccauaagcuguacaauuauuguuguaguauauugcucuuaaucauagaaacuucuuguuuaguguauaua

SEQ ID NO: 4165132 - RNA, 58 nt, Human
uauauccauaggcugugccuagccuaguccuucagguuguugcagggcccaggauaua

SEQ ID NO: 4165133 - RNA, 78 nt, Human
uauaucccagaaacagaugacaagcccugaacccucuugacucaagugaaaaagauuugucucuguuuccugaauaug

SEQ ID NO: 4165134 - RNA, 104 nt, Human
uauauccugagugcuuucugaucagaaacagaguuugguaaauagcccuugcuuauuguauggcugcuauauaaaugcuguuuuuaauaagcaccaaaaauaua

SEQ ID NO: 4165135 - RNA, 62 nt, Human
uauaugguagguacaacagcaggcagagucacauuuuugccaucugugcauuuuaaaauaug

SEQ ID NO: 4165136 - RNA, 106 nt, Human
uauauguagauguacuugguugguacaaaaguuauugcgguuuuugccauggaauguaauggcaaaaccacaguuacuuuugcaccaaccuauacauguagauaua

SEQ ID NO: 4165137 - RNA, 82 nt, Human
uauauguguauauguguuuauguguguguguguauauauguuuauguacauacauauguuuaaaugcauguuucugcaugua

SEQ ID NO: 4165138 - RNA, 86 nt, Human
uauauguuguuuuuauaagauuaagggaaugauaauuaugccuauguaagcauuagucuacugucuaauaaaugagauuacaugug

SEQ ID NO: 4165139 - RNA, 57 nt, Human
uauauuagugagauuuauccauguuaugcauaguugaaguucauucucacugaugua

SEQ ID NO: 4165140 - RNA, 129 nt, Human
uauauucagugaagagagaauaauaaaagugcauugagaugugggugucaggcagugagcuagaauuacccauuagcuacaugauuuguucccacacaucagcuugucugugugcucaauuugaaugug

SEQ ID NO: 4165141 - RNA, 58 nt, Human
uauauucauauuguugucucucacucugagagguccuggagauauaguuaugagugug

SEQ ID NO: 4165142 - RNA, 78 nt, Human
uauauucuggauuaucaguccaccaagaaagcaguagcauuaagcugugauaguugaaggacugagugucugaauaua

SEQ ID NO: 4165143 - RNA, 83 nt, Human
uauauuuagacuacuaguggcuacaauaaugaaauuacuguggauuguaaacaugagguauugcuacuguggucuaccaugua

SEQ ID NO: 4165144 - RNA, 75 nt, Human
uauauuuugacauuaaggaacauauauugagggcuucucaaaaacucaaaugugugaacacuaaugcaacaugua

SEQ ID NO: 4165145 - RNA, 87 nt, Human
uaucaaguguucugaggucucuuuccauagugacagacuuuuaguguuguuucauugggaaugggagguucucaaaauuauuugaua

SEQ ID NO: 4165146 - RNA, 60 nt, Human
uaucacacucggaaaucuaggaugguaccuguaauuccauccuggacaaugggguggaua

SEQ ID NO: 4165147 - RNA, 79 nt, Human
uaucacauucugcuagaauuucaagugugacaacagugaacucuguggcuccaugauaguucuuacaggagaguggaua

SEQ ID NO: 4165148 - RNA, 74 nt, Human
uaucaccagaauucuugguccuaguguauaagaauauccuuauggacucgagacaaagaaagcuaucagugaua

SEQ ID NO: 4165149 - RNA, 65 nt, Human
uaucagaaacucuggggcaggggcacaguaaucugcuuuaauaaauucuccagguaauucugaua

SEQ ID NO: 4165150 - RNA, 105 nt, Human
uaucagaacugauaguauaaagucaugaguuuuuuaguucaugcagaauguggaucaugucugagauaaaaauucauaagauuuuugaauauccuggggcugaug

SEQ ID NO: 4165151 - RNA, 90 nt, Human
uaucagauacuggguugagcacuguggauacagaaauuaguaacauacaauacugauucuaguaauauaguauaaugugggugucagaua

SEQ ID NO: 4165152 - RNA, 82 nt, Human
uaucagcaaaggcucacuaaugcuuccauugcacaguuccugaugugaggcacaucacuuggugcauuagucucaguugaug

SEQ ID NO: 4165153 - RNA, 62 nt, Human
uaucagcagcaguggcugcagaacagcagauauugguguaccgcaaaugcugcugccugaua

SEQ ID NO: 4165154 - RNA, 55 nt, Human
uaucagcuuaauucucaacaggucccagccuguguugacagaauuacagcuguua

SEQ ID NO: 4165155 - RNA, 55 nt, Human
uaucagcuucauaaaguuggucaguauaucaacugagucuuucaggaagcagaug

SEQ ID NO: 4165156 - RNA, 57 nt, Human
uaucaggaucugggagccugaaacaaagagaauguauuccaggcacagauguugaug

SEQ ID NO: 4165157 - RNA, 97 nt, Human
uaucaggccccacaccagaccauuugaaucaggaucucgggggaaccugaccuccaaguggcucugguguuccaaagcuucccaggggcuucugaug

SEQ ID NO: 4165158 - RNA, 57 nt, Human
uaucaguuuauucuauaaauagugaaccaucacuuuauuauuaggaguaaaguggua

SEQ ID NO: 4165159 - RNA, 92 nt, Human
uaucauaagguuaauuugauuuuauagcaaagaucacuuccuugauaaaagucaaaaagcacaaucuuucuaugacagguugacuuaugaua

SEQ ID NO: 4165160 - RNA, 64 nt, Human
uaucauagauuuaucaacauguaccauuggcaggcccucugcugguacuagagauauuguggua

SEQ ID NO: 4165161 - RNA, 69 nt, Human
uaucauggacaccuuccaggucgguacaaaaggaucaauuuuuaaauggccacagggugcuccauugua

SEQ ID NO: 4165162 - RNA, 81 nt, Human
uaucauguuaauuacaagaugcauccauauuucagaguuguuagaaugcagagauaugugcgucuuagauugaaugugaua

SEQ ID NO: 4165163 - RNA, 84 nt, Human
uaucauuugcaacuaaaauggaaguugucuggcaugugaugcuauggcaugcaaauagucaugcuuccauagaaacauaugaug

SEQ ID NO: 4165164 - RNA, 65 nt, Human
uaucauuuguuauuauuaguggagaugggacgccaagucccuggaaugcuaaaauaaggaagaug

SEQ ID NO: 4165165 - RNA, 71 nt, Human
uauccagaaaauuucuccaagaaugcuuagagaguccauaugucauggcacucaagcucuugucuaggaua

SEQ ID NO: 4165166 - RNA, 56 nt, Human
uauccaguucacuccuuaguaugcgagccaacgcacacucugaagaguccuggcua

SEQ ID NO: 4165167 - RNA, 72 nt, Human
uauccccaagauccugaaccaucucuguucuguauuaggaaaguaaaguuucucagugauguucuggggaug

SEQ ID NO: 4165168 - RNA, 81 nt, Human
uaucccgcaucucaggcugaggcuggcagcuccaggaaguccucugggagcucuuuccggcuugagucagguguagugaug

SEQ ID NO: 4165169 - RNA, 69 nt, Human
uaucccucaauggcaucuggcccugggcuuacuuuuauucuccccauuuuucagcuucauugaggcaua

SEQ ID NO: 4165170 - RNA, 56 nt, Human
uaucccucccaccuggaaaugcuguauucccuggcuccaggccucaggaagggaug

SEQ ID NO: 4165171 - RNA, 123 nt, Human
uauccuagucucugauggugcugcuccacagguacagacaaguaguucagacaagauccucucacuacccaaacucuugccuacuugucaaccagcaguauaugugugcaagaugucuggaua

SEQ ID NO: 4165172 - RNA, 57 nt, Human
uauccucauuuguugaaaauguaauagugaaauucucguacauugcugguggggaug

SEQ ID NO: 4165173 - RNA, 106 nt, Human
uauccugaaagauuuuuaacaugcuaggaagagugauugaauugaauaaggucaaguuuaaaaauccuuuuuuugguccauuuugauuauuuugcuuucagguaua

SEQ ID NO: 4165174 - RNA, 79 nt, Human
uauccuuugagguaggcagaccaguggaugggucuccuuggauucauggugccaguggauuugucugagacccagggua

SEQ ID NO: 4165175 - RNA, 81 nt, Human
uaucgagggugcuugugcuuuuaccagcuccaccuggggaaguaaaucucgcugagcuagaaaaggaccacacucuucaua

SEQ ID NO: 4165176 - RNA, 130 nt, Human
uaucgucauaaccuggaagcuggugagaaacgcagauucucaggucacaccccagacagacugaaucaggaacucuggaggugaggcccagugaucuguguuucaacaagcccuccagaugauucugaug

SEQ ID NO: 4165177 - RNA, 60 nt, Human
uaucguuuguuugauuuuucuaaagcaugaaaaagguacagaaauaucagagagaugaua

SEQ ID NO: 4165178 - RNA, 66 nt, Human
uaucuaagagagucaauauuuauaccggccaaggauuaaguauauuagguggcuuuuguuuagaua

SEQ ID NO: 4165179 - RNA, 77 nt, Human
uaucuacacgcagcaucauauauaugguucauggaaagccagggagccacagucugaugccugagauuuuguaggua

SEQ ID NO: 4165180 - RNA, 81 nt, Human
uaucucauguuuguuuggguccacaaacaucagauauugacccaaaguuugugagauguggacccaaacgugauugagaua

SEQ ID NO: 4165181 - RNA, 65 nt, Human
uaucuccagagcgggagccagacgccgacccaagcggaagugacguuagguguccgccggaggug

SEQ ID NO: 4165182 - RNA, 103 nt, Human
uaucugaaugauucaucugccagaguugcuagaacuacaucuuuuaauagaccaauuauugugguuaggauuuggcuuuagucaggugaugagaaauuagaua

SEQ ID NO: 4165183 - RNA, 75 nt, Human
uaucugcgaaccacagugcuuugucaaagcaguccaguaaugcagugcuuuaucaaagcuauagugagcauggug

SEQ ID NO: 4165184 - RNA, 60 nt, Human
uaucuggucuguaaaaugggugauguaagggccucaucuacuuuaaggauucuggggaua

SEQ ID NO: 4165185 - RNA, 72 nt, Human
uaucugugaccauggcuuuugagucucaagacccaaauuaaaagguguuuugaggagcacauggcagagaug

SEQ ID NO: 4165186 - RNA, 63 nt, Human
uccuuaaaggacuagaagucaagugaucaaaaugugaagaccuuuguucuaguucucuagggg

SEQ ID NO: 4165187 - RNA, 98 nt, Human
uccuuaacugguaucucuucccugguucucucugguuugucaccuucucuuucucacuguaugguggccaagaggggacuggauaccuaaggcaagga

SEQ ID NO: 4165188 - RNA, 66 nt, Human
uccuuaagaugagagcauccuggaaaauauuuauuuuucuaagacauuugucaucuuuuuaaagga

SEQ ID NO: 4165189 - RNA, 91 nt, Human
uccuuaaugaaagccugaugauaaaguucauuggagauuuuuguuaucuuugguacuauucuuaucauccaaggcuagccuuugugaagga

SEQ ID NO: 4165190 - RNA, 112 nt, Human
uccuuaauuuggcugaggcuccuuuucuauaaugcaagccacugcaugcacagguaucauuuggccuucuuugcauuguguugggaauagggguucagaaaacuagugagga

SEQ ID NO: 4165191 - RNA, 108 nt, Human
uccuuaucgcaagaagguugaugagcuagggaucugauuugcuguuuaaggauugcucuaauguaacauaaaagaucgucuaaucauggcaucuaauugcugagagga

SEQ ID NO: 4165192 - RNA, 106 nt, Human
uccuuaugcacggaaaaguuugagaaccauuaauaugggcuauugaucaauaaaucauaaauugucagagaauuguuuaauggaauucucauuuuguagguaagga

SEQ ID NO: 4165193 - RNA, 118 nt, Human
uccuuauggcccagucugcuuccccuucauagaagggaguuuuuccuacugcugcuagguuaugucaugaccagggaccacauccccucuguggagagggucccaggcccagagagga

SEQ ID NO: 4165194 - RNA, 66 nt, Human
uccuuauguuuuaaguguguaucuuagccucucaauuauuauaagguaaauaugaagacagaagga

SEQ ID NO: 4165195 - RNA, 62 nt, Human
uccuucaaucacccaguggggaaaauguguuauaaaacacugcccccuggaguauucuggga

SEQ ID NO: 4165196 - RNA, 72 nt, Human
uccuucacccaggcuggagugcaguggcauggucucgguucacugcaaccuccaccucccggguucaagcga

SEQ ID NO: 4165197 - RNA, 63 nt, Human
uccuucaccucaagcuuuugaagugaaugcugaacuaugucggagggaauggggaaaggagga

SEQ ID NO: 4165198 - RNA, 79 nt, Human
uccuucacuaggcugggggucaaugacgaacagcaauuccaguucccugcccucaaggagcccacagucuaaugagggg

SEQ ID NO: 4165199 - RNA, 69 nt, Human
uccuucagccuuuguuuaucagaauuccugugcuuaccaguguuugguggucugugagcaacgugagga

SEQ ID NO: 4165200 - RNA, 59 nt, Human
uccuucagggcugaccacaggcgaucacaaagacuuugccuggcaggccucaugagggg

SEQ ID NO: 4165201 - RNA, 74 nt, Human
uccuucauucaguuuuuauuggaccagcuauucuaugccagauaguaugcugagcuuguaagaagaauaaagga

SEQ ID NO: 4165202 - RNA, 56 nt, Human
uccuucccauagaucuugagugccaaugagaggcaccuguguaagaucuggaacga

SEQ ID NO: 4165203 - RNA, 59 nt, Human
uccuucggucaggauauuaggcuaaggucccuucuugauucuggugacugauggaagga

SEQ ID NO: 4165204 - RNA, 56 nt, Human
uccuucuaucacuggaagugaguuuaaaaguauucacacuucaguuuuuaaaggga

SEQ ID NO: 4165205 - RNA, 75 nt, Human
uccuucucagccccagcucccgcucaccccugccacgucaaaggaggcagaaggggaguugggagcagagagggg

SEQ ID NO: 4165206 - RNA, 71 nt, Human
uccuucugccuuugaaaguucuguugagaaguugcacauaaugacguuagcagucuucgcuaggcauagga

SEQ ID NO: 4165207 - RNA, 83 nt, Human
uccuucugggaaauguuuggguuugugugaagguuuuaacuuaugagagaguucacacuaagacaaaauaauuuuaguaagga

SEQ ID NO: 4165208 - RNA, 90 nt, Human
uccuucugucccuuggaggacugcugcuucuucuguaagguaucuagugugugccugaaaaagauuaagaugguccccagggguggggga

SEQ ID NO: 4165209 - RNA, 55 nt, Human
uccuucuuguuuuauccaucugggacucccuccccaguuuaauaacaaagaagga

SEQ ID NO: 4165210 - RNA, 86 nt, Human
uccuugacaaauggcauuggaagacauaucaugcuagaaaauguuuaucugguauuuuuccuucuuugaaguuaugaggucaagga

SEQ ID NO: 4165211 - RNA, 56 nt, Human
uccuugcauuuaaaggcguagggccccacagcagaggguaagccggaaagcgagga

SEQ ID NO: 4165212 - RNA, 81 nt, Human
uccuuggagaagacauuaaugaggugaugacacauuuuuauuuaaaugccuuauguagauuauuaauccauuucuccugga

SEQ ID NO: 4165213 - RNA, 60 nt, Human
uccuuggaggucaacgggacggacaucccuccuuguacuguauuguuauucuuugaagga

SEQ ID NO: 4165214 - RNA, 61 nt, Human
uccuuggcaagacacagcacagcucacuaagcucugcugcacacuauuguuuagcuaagga

SEQ ID NO: 4165215 - RNA, 82 nt, Human
uccuugggaaaagauguuuuacauagcaccuuuggguuugcaaucuugaauugcucaucuguaaagcacuuuuguugaugga

SEQ ID NO: 4165216 - RNA, 83 nt, Human
uccuugggugauccuacucaguuuaugauuucaaguuggcaggacuugcuuuguuuauggaugaguggccugucagucaagga

SEQ ID NO: 4165217 - RNA, 66 nt, Human
uccuuggguuaagagggaguaaggaacaguugucaaagcacccuucuuucuuuugaucacagguga

SEQ ID NO: 4165218 - RNA, 109 nt, Human
uccuugucugcgugacgugagagugacugugggugagagcguuccagcaagacaaugaugaucucugcugucugauucccacuucccagauucucacaguagacgagga

SEQ ID NO: 4165219 - RNA, 62 nt, Human
uccuugugucuagaaggugggcuugcuuaagcuggagcuagggcuuucguagacaguuugga

SEQ ID NO: 4165220 - RNA, 81 nt, Human
uccuuguucaggcagcagggcacugugagauguggcuccuuggcccuuuccagccaccaccuugauugccugcuacaagga

SEQ ID NO: 4165221 - RNA, 73 nt, Human
uccuuguucucuuggaacacuugcucuuagaacccagccacucuaaugcaaggaauuccaaguagcccgugga

SEQ ID NO: 4165222 - RNA, 56 nt, Human
uccuuguugucuuagguagcauucccuagaagcagagccuaaggcagacauuugga

SEQ ID NO: 4165223 - RNA, 70 nt, Human
uccuuuauucacaguugauuuacaguugucuuaggaauugacaacugugagauauacuugaccuaaggga

SEQ ID NO: 4165224 - RNA, 64 nt, Human
uccuuuccaccugaaccucaguggcugacuuuaccccaggcccugaaggcagagguggagcuga

SEQ ID NO: 4165225 - RNA, 69 nt, Human
uccuuuccugccccauccuugccacggagggccagggcccugccuggcaagaggggcuggcucuaagga

SEQ ID NO: 4165226 - RNA, 111 nt, Human
uccuuucuacuccuauacuguauuuaaaugacgggacuggguuuuguugcaaauaaaucauuucacuguugaagaaaaucuugacuguuuuuagaauugggagagauugga

SEQ ID NO: 4165227 - RNA, 56 nt, Human
uccuuucucccagguuaguugucaaccugcuggagcucaacccugcagagaaagga

SEQ ID NO: 4165228 - RNA, 71 nt, Human
uccuuugagaaaaauggggcucccugugccaacuuuucaagagcuugauggcagggcagccucucagaggg

SEQ ID NO: 4165229 - RNA, 85 nt, Human
uccuuugagauaugguuucuucuuucauuuaagagcuguuauuuugcuugguuucaaagaugauaggaaaucauaguuuagagga

SEQ ID NO: 4165230 - RNA, 61 nt, Human
uccuuugcugcuuguuccugcugcugcucaguggcagcugccaaguuggaguagcaaaggg

SEQ ID NO: 4165231 - RNA, 76 nt, Human
uccuuuggugguauaauguuugugugauuauuuguuaucuguguagcuuugcauugaugucuauacgcugaaagga

SEQ ID NO: 4165232 - RNA, 62 nt, Human
uccuuuuaaaaugaaccugcagaagugcagaguggcaguuucugcaaaucauuuuuauggga

SEQ ID NO: 4165233 - RNA, 63 nt, Human
uccuuuuccccucaguacuaaacauauauauauauauuuuuuguaaauugaggugggagauga

SEQ ID NO: 4165234 - RNA, 76 nt, Human
uccuuuucuuuccugagccagaguuucauugucaauaaaauuagaccaaugcuaacucccauagggguugaaggga

SEQ ID NO: 4165235 - RNA, 71 nt, Human
uccuuuugccguuuucauaucguugccugucaaaagcacacaaguuacagauuugaucugagaacaaagga

SEQ ID NO: 4165236 - RNA, 81 nt, Human
uccuuuugcuccucuuucucuuucuugucagucacauuuugcguauuguucugcugacaaugagaaagagcaaaagaaggg

SEQ ID NO: 4165237 - RNA, 80 nt, Human
uccuuuugucucuucaguaaaugacacuguuggggaaaugauuguccaguuaugucaaagucacugaggcaauaaaauga

SEQ ID NO: 4165238 - RNA, 76 nt, Human
uccuuuuucaucuuuggacuuuuuauauucugcuuuuuuaagauggguuuuggaaguauaaagaugucugaaugga

SEQ ID NO: 4165239 - RNA, 64 nt, Human
uccuuuuugguccaaggugaccauauucuuuugacuuugacaucguuuguggaucaggaaaggg

SEQ ID NO: 4165240 - RNA, 78 nt, Human
uccuuuuuucccagauaaaugucaaaaugugaaauuucuggcucacagucuacauguauguuuaucuugagaaacgga

SEQ ID NO: 4165241 - RNA, 74 nt, Human
ucgaacacuugcacugucguggaaaugauuuucugguaucaaaacguuuucagugacugugcuucgggguucgg

SEQ ID NO: 4165242 - RNA, 99 nt, Human
ucgaacuuuauauaggcaaacaguuuucucauuuaguguuuguuaaugcuuguucuaaauaacauuuugaaagggaaauuguuugguuaucuauuuuga

SEQ ID NO: 4165243 - RNA, 67 nt, Human
ucgaauucuuuucuaaguagagauuacauugcauguguuaucuuggacuacagaagagagggaaagg

SEQ ID NO: 4165244 - RNA, 66 nt, Human
ucgacuucaaauuguauugucgaguauuuuauacaaagaaaaccaauaugcauuguuugaaguuga

SEQ ID NO: 4165245 - RNA, 83 nt, Human
ucgacuucuugucuuguguguagaauagaacaugggaaagaacaaaaacgcuuauggcaagaaacacauagauaagaagcuga

SEQ ID NO: 4165246 - RNA, 66 nt, Human
ucgaggaguugcagagccaguauggguaacuauucuaaaauccuuaaaucgcuccugggcccucga

SEQ ID NO: 4165247 - RNA, 82 nt, Human
ucgauaauaguaaaaugcaguaaaauaggagguaaugugccuugaguauuuauuaccuuggauuuugauguaacuaauuuga

SEQ ID NO: 4165248 - RNA, 100 nt, Human
ucgauccaggggugcugaagaaccugaugagcuguguagcgcuuuuuggggucuaccaccagcaaccggcucaccagaucuuuagcagcuguuggaauga

SEQ ID NO: 4165249 - RNA, 69 nt, Human
ucgaugccaggccagucguggcauuaacuccuggcaaaguauccgaugccaggcuggccaugguauuga

SEQ ID NO: 4165250 - RNA, 55 nt, Human
ucgauggcaguggugucugcacaggccagggccagcaaggguccacugucacaga

SEQ ID NO: 4165251 - RNA, 57 nt, Human
ucgauggcuuuacuugucaacagacggcaucuuuacugcuuggcauaggccacuuga

SEQ ID NO: 4165252 - RNA, 100 nt, Human
ucgaugugaaugacucuucaaagauauucaaagauuuauuagaaccuaacaugguaguuaauaaaguaugaauuggaaaaaaagucacuuuuuacauugg

SEQ ID NO: 4165253 - RNA, 66 nt, Human
ucgcacucaggacucucaucaguaagaugggaauacuaaugcuaccacaugagagaucugagguga

SEQ ID NO: 4165254 - RNA, 68 nt, Human
ucgcagaccgcggugcacguggcccugaccaggggcagagccaccacacgcugcaccacguucugcgg

SEQ ID NO: 4165255 - RNA, 59 nt, Human
ucccaucgucuccuggaugauaugcaauguccugcagucacagggagauggugacagga

SEQ ID NO: 4165256 - RNA, 88 nt, Human
ucccaugcugugacccuccaaagggaagcgcuuucuguuuguuuucucuuaaacaaagugccucccuuuagaguguuaccguuuggga

SEQ ID NO: 4165257 - RNA, 58 nt, Human
ucccauguguuccucuagucuacguacaacacauaauauguagauaacgcaguaggga

SEQ ID NO: 4165258 - RNA, 79 nt, Human
ucccauugagccacugaaaguaccagcaaauccuuugauguugcugauucuguauuuaaggugaugucuucauuuggga

SEQ ID NO: 4165259 - RNA, 64 nt, Human
ucccauuucacaacaaaacuggccagauuccacacccacaugccuggucagauguggaauggga

SEQ ID NO: 4165260 - RNA, 86 nt, Human
ucccauuucaucugcuucuuccuuucugaccauuucuaagugaccucaggcucaugccacacagaugguaagggagggagcuggga

SEQ ID NO: 4165261 - RNA, 56 nt, Human
uccccaaagcuuuguggucaggguauccagagcugcucaccacacaacuaugggga

SEQ ID NO: 4165262 - RNA, 57 nt, Human
uccccaacucccugacacccuagacccaagaaucuggagguuuuacugaguugagga

SEQ ID NO: 4165263 - RNA, 72 nt, Human
uccccaagggcauuuggcucaaccuaaguaagagaggauaagcuugagggagaaagcugaggugucugggga

SEQ ID NO: 4165264 - RNA, 88 nt, Human
uccccacacccacccucucccccacagcagccuucucccccacagaggcugggauaggaugaggggggcggaguuggggacugaggga

SEQ ID NO: 4165265 - RNA, 79 nt, Human
uccccacagaaaaccuguaucaauuuguacucagauaagcagaguacaaauugauacagauuugaacucugugcaggga

SEQ ID NO: 4165266 - RNA, 94 nt, Human
uccccacauaggcugccuuguuacagaagcuuuugaaaagaugaggaaccuuuggaucugggaauggaagccuucuguggggccgcauggggga

SEQ ID NO: 4165267 - RNA, 55 nt, Human
uccccacuccugggcagaugcguacccagugcagcgagaaugucugcgaggggga

SEQ ID NO: 4165268 - RNA, 60 nt, Human
uccccagccccucagcagcguccccccacaaggugggcuggcugauaaaggguugaggga

SEQ ID NO: 4165269 - RNA, 64 nt, Human
uccccagcugcucucccaccccaccccagcugcccggcggcugggcccacgagggcucugggga

SEQ ID NO: 4165270 - RNA, 72 nt, Human
uccccaggaaucaggugguugcuuucagcggguuagcuucaugcauuuuaugcugauuugauuuccuggaga

SEQ ID NO: 4165271 - RNA, 99 nt, Human
uccccaggggagaggccccguucccgccagccacauucccacgccggccugggaggcugccagagaguggcugggugucgggggcugccucccagggga

SEQ ID NO: 4165272 - RNA, 55 nt, Human
uccccagguguggcauugggaggagcacuggccucuccagugccggcgcugggga

SEQ ID NO: 4165273 - RNA, 58 nt, Human
uccccagucgugacaaccaaaaauaucuccagauauugccaaaugucugcuggaagga

SEQ ID NO: 4165274 - RNA, 62 nt, Human
uccccaguuuugauaacuucuggcuggaaaguuuuccaggcuagcuguuucagggcuaggga

SEQ ID NO: 4165275 - RNA, 128 nt, Human
uccccauugaacgggacugggaggcaguauagugguuaaaugcuccgaucuuggugccagacuaauuuggauucaagccuggcauuuagcucucugagaaucuguuuucucuucugcaaaauggagga

SEQ ID NO: 4165276 - RNA, 66 nt, Human
ucccccagucugggcguggucaacuuugcuguauguucagggagacccagccacagcauugaggga

SEQ ID NO: 4165277 - RNA, 80 nt, Human
ucccccucucuaauccuugcuaucugggugcuagugcuggcucaaugcaaugcaccugggcaaggauucagagaggggga

SEQ ID NO: 4165278 - RNA, 67 nt, Human
uccccgcaguggaagccucuuuaagcaagucucucuucucugcauauguaggcuuuagcucugggga

SEQ ID NO: 4165279 - RNA, 77 nt, Human
uccccgcguuggccaggcuggucucaaacuccugaccucaggugauccaccagccucggccucccaaagugcuggga

SEQ ID NO: 4165280 - RNA, 56 nt, Human
uccccuaggccgaagugagguaccuugucuaagguccuguuucuucccuggggaga

SEQ ID NO: 4165281 - RNA, 67 nt, Human
uccccucucccagcucaucccugccagcagggucagggagaagguuuagcugugaggguccucggga

SEQ ID NO: 4165282 - RNA, 67 nt, Human
uccccucucccucccugcccugcuugucagccugggagucagacagcuugcagggaggugggcggga

SEQ ID NO: 4165283 - RNA, 58 nt, Human
uccccucuuucuggaaacacaagcagucuccucaugucaguuuugcaggcagagggga

SEQ ID NO: 4165284 - RNA, 78 nt, Human
uccccugagcaggcgguggagcggcucgccgccccaggccgcggccgagucuaggccccgccgcuguucacccuggga

SEQ ID NO: 4165285 - RNA, 59 nt, Human
uccccugcuccuuugaauguccaggcugcuggaauugauauacagaggggaacaggaga

SEQ ID NO: 4165286 - RNA, 65 nt, Human
uccccuggagauaugcuucacauuuaucuaaauuuuugcaaaagugugauaaacuccaaguggga

SEQ ID NO: 4165287 - RNA, 130 nt, Human
uccccuggccgucgccucaacaggccggccgcugucagggagccuggccccucgcccagcucaggguuggccgagaagcugggcgcaguggcuggugagauguggcugccugcaaucagagggccuggga

SEQ ID NO: 4165288 - RNA, 75 nt, Human
uccccuuccaagaggaagugccuuuacgcauuugaaacuugacaugccaugaagguauuuuuggagggcagggga

SEQ ID NO: 4165289 - RNA, 81 nt, Human
uccccuuuacccaacacagauggauuuuguaggcugaucaugguaaggucaaaugcacagaaccauuaaggguugggggga

SEQ ID NO: 4165290 - RNA, 95 nt, Human
uccccuuuuucucccugucauuuaggucugucagaaauguuuguauauauuuggugacaccuuucuaaauauuagggaaugcagagcuaggggga

SEQ ID NO: 4165291 - RNA, 68 nt, Human
ucccgaacucuucaccuaugucaagggcacauaaaacauugaugagaguagggacagagaguugguga

SEQ ID NO: 4165292 - RNA, 59 nt, Human
ucccgauaggcagggcucuggcucucaucugggagcacggcagaagcuguugucuggga

SEQ ID NO: 4165293 - RNA, 74 nt, Human
ucccgcagcucuucagagugagcaaugccaguuucuugaaugcuauugcugaugcugaagggaagucacaggga

SEQ ID NO: 4165294 - RNA, 70 nt, Human
ucccggagugugucggucagcguggcgcugaacagcagugucugccugcgggccggcacagccgccagga

SEQ ID NO: 4165295 - RNA, 78 nt, Human
ucccggcagugucuccugggucuggccuaacuaagcugggcuucggccaagcuggccggccuccagguggauuuggga

SEQ ID NO: 4165296 - RNA, 65 nt, Human
ucccggcgcgcaggccgcggcuccucggaguugaggugcuggggcuuggccugcuugcgccgcga

SEQ ID NO: 4165297 - RNA, 83 nt, Human
ucccggcuucuucagagcuauuuguagauggcacacuuggcacccucagugggagugugugccagccuacgaggagcccagga

SEQ ID NO: 4165298 - RNA, 56 nt, Human
ucccgggagcuuccugcugcgcacgcggcgcgcaccaggagaaaagcuuugcggga

SEQ ID NO: 4165299 - RNA, 87 nt, Human
ucccgggagugggaagagguggcaggaaggggaucugaggaggagaacagggguccugguggucugugcuucuucccagacacggga

SEQ ID NO: 4165300 - RNA, 98 nt, Human
ucccguccccucgaggcagucguggaaaggcuggguuugggaugugauggggguagcccugggguccucucagucccacggaggccacggggaaggga

SEQ ID NO: 4165301 - RNA, 70 nt, Human
ucccuaacugucaucuuuucuaucauauaauuguauacuuuuauugacagaaaagauguuggauuaggga

SEQ ID NO: 4165302 - RNA, 96 nt, Human
ucccuacccuguaauuguuuugggcccaguguauggcagcgugccuguuucuaagcuuguuuugccacuggacccagaacucuuuuagggcuugga

SEQ ID NO: 4165303 - RNA, 61 nt, Human
ucccuacuguuagggacucagcuagcauccaguguucuuaaggucuuuaggcagauagaga

SEQ ID NO: 4165304 - RNA, 65 nt, Human
ucccuagaauaucugcugcagcuuuagaugccaguacacguaacucucuggcagguaauuaggga

SEQ ID NO: 4165305 - RNA, 73 nt, Human
ucccuaggagcaauagcaccaauuaacucucacccguggaggaagaauugguuauuggagagacccuaaggga

SEQ ID NO: 4165306 - RNA, 106 nt, Human
ucccuaguaggggaggaaagguuguccuggaguggcauggcauggacaguaguaaaaagacuccuucacagccccacacaggagcacugccuguguucucugggga

SEQ ID NO: 4165307 - RNA, 83 nt, Human
ucccuaguaggggcugaggucaggagcuguggggucagucaaggcuccuccgacuuucugacuucaccacuuuggcucaggga

SEQ ID NO: 4165308 - RNA, 88 nt, Human
ucccuaguaucaugccagguacauauuaaaggucuauaaauaaaugauuguuuauuagugcauaauguguaaggcauugugcuaaaga

SEQ ID NO: 4165309 - RNA, 101 nt, Human
ucccuaucauuacucucccugcaccccuuacaucagcucugguauccuggaguugggugaaggagcugauguaagggguacagggagaguaaggauaggga

SEQ ID NO: 4165310 - RNA, 66 nt, Human
ucccuaucccccaggagcuuguuuuagagacgguugucuuaugagccacucccuggauggaaggga

SEQ ID NO: 4165311 - RNA, 89 nt, Human
ucccuauguuaauguaaacugauuuaggccuaguuaaaucucuaaaaucccuuuauagcagugccuagauauuguuugaaccauuggga

SEQ ID NO: 4165312 - RNA, 84 nt, Human
ucccuauuuuaauauaucuuauguuuaaauuccaaugaucauauauuagggcuguuuaaaagugaggugcauucauaccaggga

SEQ ID NO: 4165313 - RNA, 74 nt, Human
ucccucagaaucugugaucuuuccucaggagcagggugugcuccuuggccguuaaugucacaaacacugggggg

SEQ ID NO: 4165314 - RNA, 61 nt, Human
ucccucagcuucucccugcagcucuugucgacaagacccaggccagaugagaggucaggga

SEQ ID NO: 4165315 - RNA, 58 nt, Human
ucccucccuacgugugugacccauugugaggugggaagcauuaaugauagggggugga

SEQ ID NO: 4165316 - RNA, 87 nt, Human
ucccucccucaggugaaaggaaaaauuuuggaaaaguaaaacacugaagagucauaguauucuccuguaacuuggaacuggagagga

SEQ ID NO: 4165317 - RNA, 69 nt, Human
ucccuccugcaugaggcucggcccgaggcagggcucccuccugcaugagucuguggccuccaggaggga

SEQ ID NO: 4165318 - RNA, 61 nt, Human
ucccuccuuaaagggagcagcagcuuggcagugaguaugcuggcaccuuugagugguggga

SEQ ID NO: 4165319 - RNA, 63 nt, Human
ucccucguggagcuuguauucaguugucaauuuccccuuacuagaugcaagcuccaugaggga

SEQ ID NO: 4165320 - RNA, 78 nt, Human
ucccucuaaaagcaccucuaaaaguuuucuguggcugcugacagaagaggaagucagaguuuugaggugugacaggga

SEQ ID NO: 4165321 - RNA, 62 nt, Human
ucccucuaugggggcucaaauggcaaaaaccauaugccagccuucugggccaguagaaggga

SEQ ID NO: 4165322 - RNA, 59 nt, Human
ucccucucuagccuguucaguaggagguauaguuuacuuggaugugauuagagagagga

SEQ ID NO: 4165323 - RNA, 86 nt, Human
ucccucuucuccugugauaccguuuggaagcuauccuacuauccccuggaagggggagcucuuccuaauuccugggaggugaggga

SEQ ID NO: 4165324 - RNA, 78 nt, Human
ucccucuugcugaugggaugguaacuucuuugaauguauuauaugacacagaccaucuuagcagacugcagugaggga

SEQ ID NO: 4165325 - RNA, 57 nt, Human
uccugguguaaugguaagcaugucaugaugaaggcagguuuugucaagacagcagga

SEQ ID NO: 4165326 - RNA, 63 nt, Human
uccugguguugaaccucagcaggggcugucccuggccugcugaaacaguucagcugaccagga

SEQ ID NO: 4165327 - RNA, 58 nt, Human
uccugguuagagcucucugggguaugaggauuccaguaaagaguugucugagauggga

SEQ ID NO: 4165328 - RNA, 111 nt, Human
uccugucaacauauuccaugaacauccuauccguguucagcuguuaaguauauuaacuauuucagggagugaugucagcaagaauaggaauaggaguuugucagaacagga

SEQ ID NO: 4165329 - RNA, 130 nt, Human
uccugucagaucagcagagguauuagauuugcauaggagcaugaacgcuauugugaacugugcaugcgagggauguagguugugugcuccuuaugagaaccuaagaauuacccugaugaucugaagugga

SEQ ID NO: 4165330 - RNA, 92 nt, Human
uccugucccucauccacaucagaaccaaggagcugagaaugauucuguucaugggucuccaguguucaggugacuggauuugagugacggga

SEQ ID NO: 4165331 - RNA, 79 nt, Human
uccuguccugaggaucccuaacuaaauuuuguuagaaaaucuugcaguuugcuuuuaaugggagaucuuucuggcagga

SEQ ID NO: 4165332 - RNA, 63 nt, Human
uccugugcccuuuguccucgucucacugacagguugccuuggagauggggcagagggguggga

SEQ ID NO: 4165333 - RNA, 59 nt, Human
uccugugcugaggaugcaguuucuggacaguucagggcucuguuggggucagcacuggg

SEQ ID NO: 4165334 - RNA, 56 nt, Human
uccuguggcguuaucaugugauuaguucacaugaccuaaauacuaauuuuguagga

SEQ ID NO: 4165335 - RNA, 70 nt, Human
uccugugggggcaggaugacacuuugauccucaaacucugcugucucuucugccuccagcuguuucagga

SEQ ID NO: 4165336 - RNA, 79 nt, Human
uccuguuauaacuguuuuugaaauauaucuagguagcgguuaccgaaagaaagguuucauaaagcaggcuuaaacguga

SEQ ID NO: 4165337 - RNA, 106 nt, Human
uccuguuaugcgcugguccuccauguggaucaggcagugcuucuggcaagcuuagggaugcucuucacagcuguuuuguccauuaauuggaggcucagccacaggg

SEQ ID NO: 4165338 - RNA, 89 nt, Human
uccuguucauugguuuuuuaguuaggucagaaugugcuugaggagaguaagagaauauguggauguggugaagguuaaaaugagaagga

SEQ ID NO: 4165339 - RNA, 76 nt, Human
uccuguucucugcgugugagcacacucgggccagcccuugcuggaccaggugugcacaggcagcaucugaauggga

SEQ ID NO: 4165340 - RNA, 70 nt, Human
uccuguuugccacuggccuaguccagggaagagaagcugauggccuggacugggcuaauggcagacagga

SEQ ID NO: 4165341 - RNA, 59 nt, Human
uccuguuuuagucuuccacgccuggcucuugauaugccaaguggagaagaaaagcugga

SEQ ID NO: 4165342 - RNA, 76 nt, Human
uccuguuuuugucauauagacuauugugaugaacuauuauauuacagauacuuuguaggcaagauaaacaacagga

SEQ ID NO: 4165343 - RNA, 58 nt, Human
uccuuaagacacaaagcuucccuuuucgcuuccuggaguguggacgugugcuggagga

SEQ ID NO: 4165344 - RNA, 70 nt, Human
uccuuaagguuuuauucuccaugaucaaaugacuuugaaaaauuaaagaguuuggaaaaugagacaagga

SEQ ID NO: 4165345 - RNA, 66 nt, Human
uccuuaauaccuccguaacacuugcuaaccucugaaagagaaaggaaggaagcagggcgggaagga

SEQ ID NO: 4165346 - RNA, 80 nt, Human
uccuuaauuuucccuuacccaguauucacucauccuuugccucuccugugauuuggguucuuaaagggcuagguuaggga

SEQ ID NO: 4165347 - RNA, 94 nt, Human
uccuuacaauugaguuucuguuucuggaaaguagauguacuaaggauuagaacauuuuuucuguauuuucuccuuuucccagguacucagagga

SEQ ID NO: 4165348 - RNA, 67 nt, Human
uccuuagcuuuuuugaguagugcuauauugucucccacauuuaacacugcuccaaaaaaggcuuuga

SEQ ID NO: 4165349 - RNA, 82 nt, Human
uccuuaggcugggaacucugcuugcagaugagaaauaaaccuaccucucuccagggcaugaguuccacagugaaacugagga

SEQ ID NO: 4165350 - RNA, 77 nt, Human
uccuuaugacuaccugcuggcaauauucaguccagcgcauggacaaagcugaccuggaagagcagggagucaaggga

SEQ ID NO: 4165351 - RNA, 55 nt, Human
uccuucaaagaguauuuccugagcacuuugugccaggcaguagcuauugaaguga

SEQ ID NO: 4165352 - RNA, 57 nt, Human
uccuucaagaugccacagcuuucccuuuacuuaggaaucuuggcaucugugaaguga

SEQ ID NO: 4165353 - RNA, 59 nt, Human
uccuucaccuuagcccuccuagaccugacaucacuuacagcgggacuaaggugcaggga

SEQ ID NO: 4165354 - RNA, 73 nt, Human
uccuucauggaccugccagcuccucacuuuucgaaggaugaaggugaaacuggaagcuggccaggguggagga

SEQ ID NO: 4165355 - RNA, 78 nt, Human
uccuucauucaacaagcauugauugagugccuaugguguuucagggccugcaucaggagcuugggauagaaagaagga

SEQ ID NO: 4165356 - RNA, 76 nt, Human
uccuuccccagcuugcuaauuuugacuucaggccuguccgcgguuagagugaagggaaagaguaagggggaaagga

SEQ ID NO: 4165357 - RNA, 61 nt, Human
uccuuccucggggacccagaucuguggccuccguggggagaucugggcccccgaguaagga

SEQ ID NO: 4165358 - RNA, 59 nt, Human
uccuuccugcaggccaaguccuaacaucucagucaggcuaucaacgcacuagggaagga

SEQ ID NO: 4165359 - RNA, 66 nt, Human
uccuuccugugaagccgguggucucaccuuucccguucagguggcguugcuggucaugggaaugga

SEQ ID NO: 4165360 - RNA, 81 nt, Human
uccuucucuggccuggucuggccucuccacuccugagcugggcuaccugaguugaggguccagcccccggucauggcagga

SEQ ID NO: 4165361 - RNA, 117 nt, Human
uccuugagugaguacugcuauaaaaugcauuauuauugcuagugucauuucacaagagccuauaauuucagugugauagagcuacaauauaaguauaguauugcaaaaccaucagga

SEQ ID NO: 4165362 - RNA, 61 nt, Human
uccuugccuuuuucaucuccuccaggaagcccaugagccuccagaggcaaaaagguaugga

SEQ ID NO: 4165363 - RNA, 57 nt, Human
uccuuggaagcugguuuuucauauacacgaauaugaccacauuccagcuguccagga

SEQ ID NO: 4165364 - RNA, 129 nt, Human
uccuuggaccuagccaggaaugcucucaugggaauggcagaggcaaagaugguaagcucagccaugcaaguacuuucaagccucuguugcgucuccucugcugacaucucauuggccaaagcacagcaa

SEQ ID NO: 4165365 - RNA, 60 nt, Human
uccuuggagcaacacaugacaucuagaacucuacaugguccaaggucugucucacaagga

SEQ ID NO: 4165366 - RNA, 126 nt, Human
uccuuggaucugaagacuaaaaugugcucagcugcagaccaauuaugauauucaaguauuuucaagacugcugaaugggauauguugagcugugcuugugugauuagcuucauugauuucuauaga

SEQ ID NO: 4165367 - RNA, 55 nt, Human
uccuuggcacacucggaucugauucauuccagggucagcaccacagugcccagga

SEQ ID NO: 4165368 - RNA, 116 nt, Human
uccuuggcgcgguguaggaaaggugaggaugccugccgcgcggugccccucguggugacagagacacugcggaggucggguggcucucggagaaccuugucucagugccaaaagga

SEQ ID NO: 4165369 - RNA, 57 nt, Human
uccuuggucugugccugacucccucugggacagggagauccaggcaaggccgcaggg

SEQ ID NO: 4165370 - RNA, 62 nt, Human
uccuuguauccugugguacaugcacuugugcagugucaccaguuccaggaaauaaauaagga

SEQ ID NO: 4165371 - RNA, 117 nt, Human
uccuugucucagucuuuucaucuauaaaaugggacccuaaugcaucuaguuccuagaauuuaaauauuccuggcagguguauuggcuguuguguggaaucugagcagcgaacaagga

SEQ ID NO: 4165372 - RNA, 80 nt, Human
uccuuuagcaguccucauccuuuagcagucuccaugccccacagaagauggaacuuaaugaucuaugacaacuuagagga

SEQ ID NO: 4165373 - RNA, 61 nt, Human
uccuuuaguuugugauacgaagauuguuaguuucucuauuauuuuuucauagacuauugga

SEQ ID NO: 4165374 - RNA, 77 nt, Human
uccuuuauuuagaaagcuggaggaauucuuucggguaacucauuuucagaguuuaauauccuucaacuuuccaagga

SEQ ID NO: 4165375 - RNA, 69 nt, Human
uccuuucaaucaaaguuucuaguggaacaaaagcauuugguuaaccauauagaacuugguggaaaugga

SEQ ID NO: 4165376 - RNA, 88 nt, Human
uccuuucacuggaauuuucuugguuaggggaaauaggcaguguaaucauuuuuccugucugaccucaaccagggguaaacuaaaagga

SEQ ID NO: 4165377 - RNA, 84 nt, Human
uccuuucagcaguuuagguucuuggaaucagucucccagugacagaugugaggacauugagcugucaagaacuuaaugaaggga

SEQ ID NO: 4165378 - RNA, 67 nt, Human
uccuuucuagauuguguugaccagcaccaaauuaucucaguuuggugacacauaguuugauaaagga

SEQ ID NO: 4165379 - RNA, 58 nt, Human
uccuuucuguuguucaucuuccuuagugcacuaauuaggaagacagcaaaagaaugga

SEQ ID NO: 4165380 - RNA, 69 nt, Human
uccuuugagauuagcucucucugauagccuaauaaauaaauguauguaucagagaggcugugugaggga

SEQ ID NO: 4165381 - RNA, 57 nt, Human
uccuuugcagaagaaaacaugaacaaguguggccuuguucagcaaaauuuuguagga

SEQ ID NO: 4165382 - RNA, 55 nt, Human
uccuuugucuucauuccuccuucccgugagggugggguggucugcugaagaggga

SEQ ID NO: 4165383 - RNA, 106 nt, Human
uccuuuguuaaguuuucuucuuagcaaauacuacuuagaaugcauuugaucaaaaugauauucuguuuucuacauggucauaggcugagucaagagagacaaagga

SEQ ID NO: 4165384 - RNA, 76 nt, Human
uccuuuucugacuuaccucaagcauacaaaucuggaacaggaguguugcuucagggaagccagcaucagaauggga

SEQ ID NO: 4165385 - RNA, 93 nt, Human
ucgaagagaucuaguguaaacuuaugcugagcccgacagccuagugucauugugcuacuggccgagcaaagauugcguaaucuauggcuuuga

SEQ ID NO: 4165386 - RNA, 65 nt, Human
ucgaagccuucaguccguugcagaggagcgaguuggacgccacuguggggcucugaggguccuga

SEQ ID NO: 4165387 - RNA, 55 nt, Human
ucgaaugugacugcagggggagugagaccacaagccagaccugcacccacuucga

SEQ ID NO: 4165388 - RNA, 58 nt, Human
ucgacugaaugucagcccagguuguagguggcagugagcagcugggcugucacaguga

SEQ ID NO: 4165389 - RNA, 55 nt, Human
ucgaggaucugggaaucuugacagaauaaaugucuuaaagaacugagguccuaga

SEQ ID NO: 4165390 - RNA, 55 nt, Human
ucgaucaucuuuuauaugucaaguacauauguacuggguauacaaagaugaauga

SEQ ID NO: 4165391 - RNA, 105 nt, Human
ucgcagggugccaccgccguuuccaggcacuuuuucugcuagacgcucaagacaagagaagggcaugugaagggccaggaagccggggcaggggccgccgugaga

SEQ ID NO: 4165392 - RNA, 81 nt, Human
ucgcccugccuaucgccaccaugucaggacacggugcaccugcuugcgggaugucacugugccuggcacagcaccggguga

SEQ ID NO: 4165393 - RNA, 78 nt, Human
ucgcccuuaggggcaaauuggcagguuguccccugcuccuccuggcccacacagccuugcuuauuugucucuguguga

SEQ ID NO: 4165394 - RNA, 73 nt, Human
ucccugaagccagggaaggaagauacaaagcagaguccauccccuguggcuccuugacccuaggcuuuuggga

SEQ ID NO: 4165395 - RNA, 84 nt, Human
ucccugaagcuucauuccagccacugugaugccagagauuaaucaggagaagcaucacaucacuagcugguaaugagaagggga

SEQ ID NO: 4165396 - RNA, 69 nt, Human
ucccugaaugauucuauuugcagcuuggauugagauucacuagcauuguugaaggacuuggggcagggg

SEQ ID NO: 4165397 - RNA, 117 nt, Human
ucccugacgugagccccuugaacuuccaguugucuccacaggugucagcucacuaagugucuggcauuuucugagcagcuacuguguucagggacugggacaaggcacguguaggga

SEQ ID NO: 4165398 - RNA, 64 nt, Human
ucccugagagguaggaaaugaacaaggugaucuggacaauuugcccagcaucugccuuagggga

SEQ ID NO: 4165399 - RNA, 93 nt, Human
ucccugcccaaacacuaagguuugcccuuuugagggcuaauagugccaucugugugccuagaggguggccgacaagugguuguuuggcaggga

SEQ ID NO: 4165400 - RNA, 61 nt, Human
ucccugccuccugcaccuucugcagauggcgccggccauggccagguagaggagguaguga

SEQ ID NO: 4165401 - RNA, 63 nt, Human
ucccuggacccaaugacaaugggacugcuaagccuauucuagucugucauguccaaaauggga

SEQ ID NO: 4165402 - RNA, 68 nt, Human
ucccuggacgggaacauuguuggugggaacagccccagccagcaagcucccaguucucaaaaaaggga

SEQ ID NO: 4165403 - RNA, 55 nt, Human
ucccuggagauaacuucugggagaaaccaccucaccagaauuuucuuccagguga

SEQ ID NO: 4165404 - RNA, 57 nt, Human
ucccuggcucucgcugggaguacuugacccugagagcuuaacucagagagcugugga

SEQ ID NO: 4165405 - RNA, 66 nt, Human
ucccugguggcgaauggugguagguggagaaaccagcuguaucuaccucugaauuccuauccugga

SEQ ID NO: 4165406 - RNA, 56 nt, Human
ucccuguagggugagaugucucuguugucacaggcaguuaguccacuuugcagaga

SEQ ID NO: 4165407 - RNA, 64 nt, Human
ucccuguaugguccuuccugaccagccagguccaacagugcaucugggucggaagccccaggga

SEQ ID NO: 4165408 - RNA, 55 nt, Human
ucccuguccugggcaaucccagcaacacacccucugggagcagcccccuugggga

SEQ ID NO: 4165409 - RNA, 56 nt, Human
ucccugucuaguacaaugagggcuaacacaccuucagagaaguuguaggcugggga

SEQ ID NO: 4165410 - RNA, 57 nt, Human
ucccugucucccuugagacuagaacaagaaaauuggaccuaauuugaggagaaggga

SEQ ID NO: 4165411 - RNA, 93 nt, Human
ucccugucuuggggcagagggcaguagccucguacccugaggauucuugaaggucugggguccgagcagcuccaucagaagccccaucgggga

SEQ ID NO: 4165412 - RNA, 72 nt, Human
ucccugugauuuaaaaggcguugacuauccguuuuuaaaaggguaggauaugugaaaucauauuaaauggga

SEQ ID NO: 4165413 - RNA, 67 nt, Human
ucccuguggcaggguacaccuuaacaccaccugucagggaugcuguagaaggacccuggcacuggga

SEQ ID NO: 4165414 - RNA, 56 nt, Human
ucccugugucuuccucuugcccccuggaacccagauggcagguccugaagacagga

SEQ ID NO: 4165415 - RNA, 71 nt, Human
ucccuguuggaagucuuggcaacuuuuccucuuaaaaacaagaacagcuugcaauggcuuucaacucugga

SEQ ID NO: 4165416 - RNA, 98 nt, Human
ucccuuauggcaucuugaguguucagugauugucaaccgugaguaacucauuguuuuagagaccacaugaacaaaacauuuuucaaagcaugagguga

SEQ ID NO: 4165417 - RNA, 97 nt, Human
ucccuucaaagaugagacugggaaaagcgggugguaagggaauuccacggucugaauaccuuauuguguguauuuucuaguacucauuaucagggga

SEQ ID NO: 4165418 - RNA, 91 nt, Human
ucccuuccccuccccuucuccugucuucucagcacccccaggguuacauggcggucaggcugagaggcaggggugacaggaugggguggga

SEQ ID NO: 4165419 - RNA, 69 nt, Human
ucccuuccuuuggauuuuuagcagcuuugguagaauaguucaaauggcugacuaaauuaaauuugggga

SEQ ID NO: 4165420 - RNA, 65 nt, Human
ucccuucuuccugaaagcuggcucuuccuucaggcaggagcaucugaacagggagaaguauagga

SEQ ID NO: 4165421 - RNA, 71 nt, Human
ucccuugcccucuaauuucugguuggauuuggcuagugugaaaccuuggcuagagauugaagggugaggga

SEQ ID NO: 4165422 - RNA, 112 nt, Human
ucccuuggagcugcauucucuaguccaaaaacaggcuuagggcuugggcccggagcucaggccugggauccaggggcugagaugauggggcuggugggugcuaucaggggga

SEQ ID NO: 4165423 - RNA, 60 nt, Human
ucccuuggcagcucuugauggcaccccuuccuggggggcuggucaugaaugccucaugga

SEQ ID NO: 4165424 - RNA, 66 nt, Human
ucccuuguuuccuguacaaauuugcucuuauuuugccugauaccugagcaugccaggagaguggga

SEQ ID NO: 4165425 - RNA, 60 nt, Human
ucccuuuaccgaguuugcuggccccuucucgaauauauucagcaagaacguucugaggga

SEQ ID NO: 4165426 - RNA, 78 nt, Human
ucccuuuuuaauccacaguaggaacaaguugucgauuccuagauuggguuuuugcucucugcugugcacagauuggga

SEQ ID NO: 4165427 - RNA, 79 nt, Human
ucccuuuuuauccccuggcuuuuaguuuuucaucauccuuucuacagaugaccugcagucaagaggggaaaguugggga

SEQ ID NO: 4165428 - RNA, 58 nt, Human
uccgacugucuuguuucuaagaugagggagacuuuauuugaaccuugcaaggagcgga

SEQ ID NO: 4165429 - RNA, 78 nt, Human
uccgagaagaauagcuuggacccauugcuuuaauugcuucuuuuuggagaauggaccauccaagcugaucugccugga

SEQ ID NO: 4165430 - RNA, 88 nt, Human
uccgagacagagucaagugcauaagugggguugaagguugguaucugucugcuucacuugcauuuuucaagcaugauuguguugagga

SEQ ID NO: 4165431 - RNA, 95 nt, Human
uccgagaccccaaguucugggcccuggguugcuuuauucccaagaacugcugugagcugagagugucgggggccccaggaugaugggguacaggg

SEQ ID NO: 4165432 - RNA, 130 nt, Human
uccgagcaacuaccacugacugggaagggcacuuugacccugagggguauagcagaagaguguacacauuuucauuauacagcuucauaaacagggugucuuuccuauagguaugugguaaucaguugug

SEQ ID NO: 4165433 - RNA, 60 nt, Human
uccgcacaggucaugcccacugaauaucagccgagguucucucugggaggacuugugaga

SEQ ID NO: 4165434 - RNA, 71 nt, Human
uccgcccuguaaacuuucuguucuuuaaaugcacugacaguaucuugcagaugaaguuuacaggaaacgga

SEQ ID NO: 4165435 - RNA, 94 nt, Human
uccgccucuucucuccaccuuaagagucuuucuguguuuauacguauauaaaacauuuaagauuuuuguugugcuuagugggaagaaaagggga

SEQ ID NO: 4165436 - RNA, 70 nt, Human
uccgggaaacagcugugagaacaagaaugcuuugauagguuccaucaaagcuuccuucacgucuccuggg

SEQ ID NO: 4165437 - RNA, 55 nt, Human
uccgguccggguacuccucucuaaucuuguucaugagcagagugcccaucccgga

SEQ ID NO: 4165438 - RNA, 56 nt, Human
uccgucucuaaaaagggcagugggagggaauugcgcugcucuuuucagagaugaga

SEQ ID NO: 4165439 - RNA, 80 nt, Human
uccgugaaaccccaucaucuuugaggucauuauaaauaauuaguugcagacgcagagauguugaggcuucgucacuagga

SEQ ID NO: 4165440 - RNA, 61 nt, Human
uccgugcuuuaaaccacugugcuguacugccgaguacaguauaaugcuguagggagaagga

SEQ ID NO: 4165441 - RNA, 80 nt, Human
uccgugggagugcacggccaugcacuuuagagauaaugagagccagggcucuggaguggguggccgggagcccccuugga

SEQ ID NO: 4165442 - RNA, 63 nt, Human
uccuaaaaguuccccacuggccucacacaggacucugggcagagugaggaagagcuuccaggg

SEQ ID NO: 4165443 - RNA, 72 nt, Human
uccuaaaaucuagaaguuuaaaaggauaaucuuuguuuauuuguuuagaauuuucugggucagaaauuagga

SEQ ID NO: 4165444 - RNA, 62 nt, Human
uccuaaagauugcaaaucauuacaaaggaaaguuuccaguucuuuucuuuguuugcuuagga

SEQ ID NO: 4165445 - RNA, 130 nt, Human
uccuaaaucucaauaucucagaagguuacuguauuuggagggucuuuaaauaguuaauuuauuuaaauuaggucauggggaggcccuaauccaauaugacuagugucuuuauaagaagagaagauuagga

SEQ ID NO: 4165446 - RNA, 55 nt, Human
uccuaaaugggagacggcauggucacaugugaaccaaaugcuguaauguuuggga

SEQ ID NO: 4165447 - RNA, 84 nt, Human
uccuaacuuauuccauaggcucacugauagaauuauauaccauuauuaguugaauuauccuaugaggaaaguugaacuguagga

SEQ ID NO: 4165448 - RNA, 58 nt, Human
uccuaagaaauguugugaaugccauguuaaaaaccuggcauuucuaagauuuuuguga

SEQ ID NO: 4165449 - RNA, 56 nt, Human
uccuaagauuuccuauucucauuucaaaagaaauggagaauuuagagucucuagga

SEQ ID NO: 4165450 - RNA, 56 nt, Human
uccuaaggaagugacagugggauugacuaggacaagccccaaggaacuuccuggga

SEQ ID NO: 4165451 - RNA, 67 nt, Human
uccuacagaaugauauuauuucgugcuggcacauuaauguuuccagcacgauacugucauuccugga

SEQ ID NO: 4165452 - RNA, 65 nt, Human
uccuacagauacuaaggagaucuuauaaaugguuguuugcuuggcccuugguuuuuguugcagga

SEQ ID NO: 4165453 - RNA, 59 nt, Human
uccuacaugaauggguguauuacuucauuaauaacugaaguuggacuguuucaugggga

SEQ ID NO: 4165454 - RNA, 82 nt, Human
uccuacccagcuacacugccagcagcacuuucuccuuccucaggcaaguaugguaaagugcugugggcuguaagugggagga

SEQ ID NO: 4165455 - RNA, 80 nt, Human
uccuacuuccuugauaauaauccauuuaugaaauguucaaaaucacauucugaguagaaauuauucuucgaggguaagga

SEQ ID NO: 4165456 - RNA, 64 nt, Human
uccuagaaacuuaacugucauucuuaguauuucauuucuauuaagugauuccaaguuucaggga

SEQ ID NO: 4165457 - RNA, 66 nt, Human
uccuagacgaaagcacuggguggccuucuucacaaauugguccacacuggcugagcuucucuaggg

SEQ ID NO: 4165458 - RNA, 85 nt, Human
uccuagacugugcagagcuucuccaucugcccagagagggugcuuagcucaucagggacugcagagggaagcucagccaagagga

SEQ ID NO: 4165459 - RNA, 119 nt, Human
uccuagagcccacagagcaggccugcccagaagugacucagcacugucugccagccucagcacggguugaguggacacucugcuugcagguaacaaucuucucauggcggcugcuggga

SEQ ID NO: 4165460 - RNA, 59 nt, Human
uccuagagucucauaacaagucaacugaauguuuauuguguuugaaugaggcuccagga

SEQ ID NO: 4165461 - RNA, 64 nt, Human
uccuagccagggagacacuguggagcucaguggaacuagcuccucagaacagccuuggcuggga

SEQ ID NO: 4165462 - RNA, 75 nt, Human
uccuaggcaggccugucuugcucgcccuugcaucugggaagcagugggcagggugggcuagacucuuccccagga

SEQ ID NO: 4165463 - RNA, 61 nt, Human
uccuagggcuucccugggaggugggcugggcccagcauccaccuuuggaaagacccuggga

SEQ ID NO: 4165464 - RNA, 72 nt, Human
uccuagguagugacacaguagaaagaugaugagccaguaggacugguucugccacuagugguuaccuuagga

SEQ ID NO: 4165465 - RNA, 68 nt, Human
uaucuucugggcagugaaaauuggauugagaacagugaauaucaacaugauugaacucucagaaggug

SEQ ID NO: 4165466 - RNA, 58 nt, Human
uaucuucuugccaggcugguguguuggcuauacauaguuggaccuggguaagaaaaug

SEQ ID NO: 4165467 - RNA, 81 nt, Human
uaucuugggagaucgaaguauuucugaguugcccagugggcaaaauccuuacagggcaucucugaaucuucacccaaggug

SEQ ID NO: 4165468 - RNA, 70 nt, Human
uaucuugguccuggaugagacagguaguuuuaaccgagacuuuuguauaaaucuagggcuguaaaggaug

SEQ ID NO: 4165469 - RNA, 63 nt, Human
uaucuuuaucuuuuuauucuccuaauaaccaccugugagugggagaaucaggaaggauugaug

SEQ ID NO: 4165470 - RNA, 95 nt, Human
uaucuuuuguauaaaccuguacaggucaaugauaagauaguuuaaauauucucuaucuuucagggccauuuguauuugguuuagacuuagugaua

SEQ ID NO: 4165471 - RNA, 129 nt, Human
uaucuuuuuuuugagcagugagauuaacauuuuacaguuuaccaagaauauuguauauuuauuuauuuaauaucuuggcaagguguuggugauuuuacacaagaggauacagaaguucagaaucaguua

SEQ ID NO: 4165472 - RNA, 88 nt, Human
uaugaaacuuaaaauacauaugguaauucuugaaaaguguuucacacagugcuuugcaaacgauuaccacaugauaaaguguuucaug

SEQ ID NO: 4165473 - RNA, 129 nt, Human
uaugaacaaggggccacgcuuuuuuuaguuugcacuggacccugcaaaucaggugucugguucuggaugggaguaauacuuaccuugcagagucuaugagaacucaaugagauaaugucuaaaagucua

SEQ ID NO: 4165474 - RNA, 56 nt, Human
uaugaacuguacuguacuaagcuacgguaaaauuguuugguacaauuuagggcaua

SEQ ID NO: 4165475 - RNA, 129 nt, Human
uaugaagagugaauaggaaaaugaugaaauuguugcugcuuuuuacagaggcuuagaaucauggaaaucauuugcuuucagguauaaaagggaauaauuucauuuucuacuuuuuacuuuaaauuucug

SEQ ID NO: 4165476 - RNA, 91 nt, Human
uaugaccucuauuccagaacagggagaugggugaaagcggaaacauuuaggucaccuuccucauccauuucucuugguuuaucggguuaua

SEQ ID NO: 4165477 - RNA, 71 nt, Human
uaugaccuggcaauauuaacaguacuuaucucauagaaauguaguacuggguauguuucuggccagucaua

SEQ ID NO: 4165478 - RNA, 73 nt, Human
uaugagaaaggagaaugacuuucaggaaaagcucuuugcuauaaugaugaauaaggguucucuuugacucgug

SEQ ID NO: 4165479 - RNA, 75 nt, Human
uaugaggucuaaagaauauagaggucucuaggauugaacuuaauuuacugucuguacuucuugcaaggcuucaug

SEQ ID NO: 4165480 - RNA, 73 nt, Human
uaugaguucucuccggggcauccaaaccaaggaaguugcuauucucugguaguggcuuuggagggagguucua

SEQ ID NO: 4165481 - RNA, 56 nt, Human
uaugaguuuuaaaaaggccuucugcaccucaagggaggcuuggauagauauucaua

SEQ ID NO: 4165482 - RNA, 63 nt, Human
uaugauauuuuugaaagucuuuuuucaccucuguggugaaaugaaaguucuuaaaaugucaug

SEQ ID NO: 4165483 - RNA, 76 nt, Human
uaugaucaaucuaauaaaacugaugccuuuaaaacauuucuuuugaacauuugauggaguuaguagguugaacaug

SEQ ID NO: 4165484 - RNA, 61 nt, Human
uaugaucccuuuugaaauaagcuuuuacacauuucuaaugcuuucuucagagcggcucaua

SEQ ID NO: 4165485 - RNA, 77 nt, Human
uaugaugcaaaagaggauuguuacugauuagcucuuguaacuacgaagcuggauuaaauauagcuuucuguauuaug

SEQ ID NO: 4165486 - RNA, 92 nt, Human
uaugaugguggcauuacaagcuggcgcaguuaagauccuggaagucagguuugccuauguuguaacugcacuaugcugugccaugcaccgua

SEQ ID NO: 4165487 - RNA, 85 nt, Human
uaugauguugaacugaucugcagaaagcugagaugauuaaucggcuuaauucacaaaguuuucuguuuaucuguccaauuucaua

SEQ ID NO: 4165488 - RNA, 72 nt, Human
uaugauguuuagcuucacuuuuguugaugcggucacacagauuuugcacagagggaggcauaaaauuuuaua

SEQ ID NO: 4165489 - RNA, 79 nt, Human
uaugauucuuuuugucccuucacauuucaauaauucacauuuguuaaaacuagugguugggacuaaagaaaaggucaua

SEQ ID NO: 4165490 - RNA, 83 nt, Human
uaugcaaaguccuaagaaagaaaugcaagagggaaggccagaaaaaugcauauauucuuuauuaguuuagugagcuuugugua

SEQ ID NO: 4165491 - RNA, 72 nt, Human
uaugcaacacuguggucuuuucaguaaaggaucauucacccuuugcuuucuuuuagacuuaguguuuucaua

SEQ ID NO: 4165492 - RNA, 79 nt, Human
uaugcacauugaugcaauaauuaugaaaggaaaacaaaucuuuccuuucaccaaaaaguguuguguuaaagcgugcaua

SEQ ID NO: 4165493 - RNA, 66 nt, Human
uaugcagauaguuugccauucauacugacaguucugccaggucagauggugcaauuaucgugcaug

SEQ ID NO: 4165494 - RNA, 87 nt, Human
uaugcagcagccauaauagcagauaggacauuucauucucagccaccuucuggcaaagauggaauucaguccugggcuuuuugcaug

SEQ ID NO: 4165495 - RNA, 69 nt, Human
uaugcaucuauugauugccuggcuaguuuaauucuugacugaccaaaugaaaggauggauggaugggug

SEQ ID NO: 4165496 - RNA, 105 nt, Human
uaugcauuuguacaagcuuguuuaucugcacucucuuguaguguauuuacuuaacaagccaaguuagauuguaaucgaaagcaggugcugucauaucacugcaug

SEQ ID NO: 4165497 - RNA, 56 nt, Human
uaugccaaaauguuacauuucuuucggaaaaugggaagaggaagcauuauggcaua

SEQ ID NO: 4165498 - RNA, 70 nt, Human
uaugccacauguuguguuaagcucugagcauucaauggucaaugagaaagacacagucuuauggggcaua

SEQ ID NO: 4165499 - RNA, 79 nt, Human
uaugccagaaggcagaauuuaucuuccauggacuaacauuuugucagaaaaagaaauugauaaucugguuucuggcaua

SEQ ID NO: 4165500 - RNA, 62 nt, Human
uaugccuccucaauacuuucguugaaauccuaucccuuaaggugaugguauuaggaggugug

SEQ ID NO: 4165501 - RNA, 64 nt, Human
uaugcuaaaugaccuuagaccacuuauaaaaugcauaugagugcuuuaaauguuauuuugugug

SEQ ID NO: 4165502 - RNA, 62 nt, Human
uaugcuaguguccuugugcuucuucuguaugcauagacacaaaucucagugacaccggcaua

SEQ ID NO: 4165503 - RNA, 94 nt, Human
uaugcucuacauacccuugcugugggagaugaccuggcuuagcuaucccuuccugggccacgucaucucccacaacaaggauauauagagcaug

SEQ ID NO: 4165504 - RNA, 65 nt, Human
uaugcuggauuggagcaauagagucuuggggcacuuuuagagauccguugcaaccaauuagcaug

SEQ ID NO: 4165505 - RNA, 62 nt, Human
uaugcuguguauucaguguugaagaaggacguagugcuuguccucagggaguuuacagcaug

SEQ ID NO: 4165506 - RNA, 61 nt, Human
uaugcuuuacuuuucauugugaaucauugugaauauauacaaaggugaaaagugaagcaua

SEQ ID NO: 4165507 - RNA, 55 nt, Human
uaugcuuugaaaaugugcugaaaucauuuauuccuuagcauguguagaaagcaug

SEQ ID NO: 4165508 - RNA, 72 nt, Human
uauggaaaacagaaguaaggaacagaaacagcuggauggguucuagcuuggcguuugccuucuuugaacaug

SEQ ID NO: 4165509 - RNA, 55 nt, Human
uauggagauucaaaagcaucuugaaugauggcauuuauuaugcuucaucugcaug

SEQ ID NO: 4165510 - RNA, 90 nt, Human
uauggaguuagugagaauguugucaguugcagggagaauggauaagggcauugcauuaagguaauuguauaauauugcauuuccuccaua

SEQ ID NO: 4165511 - RNA, 74 nt, Human
uauggaucugaagauaugagcuuuaugauuaauuccuauaaauaaguuaugaaguuccuguuacaguggucaua

SEQ ID NO: 4165512 - RNA, 83 nt, Human
uauggcaucuguugagaguuucauaauuuccaugacaggcuuaucuuuaguauguagaaaucucugaacuuaauaaugccaua

SEQ ID NO: 4165513 - RNA, 98 nt, Human
uauggcauuguggcuucacugcauuuguuuguuuguuuuucugggauaaucaacaggauggugagaaagauacauagcugugagcacacacaaccaua

SEQ ID NO: 4165514 - RNA, 60 nt, Human
uauggcuuugggccaaaucuacugucuguucuuauaaaguuuuauuggaacaaagccaug

SEQ ID NO: 4165515 - RNA, 126 nt, Human
uaugggaguaguaggccacuaaaguugaaaguuauucaaaagaggaacuucaucucuaugccauuuuucuaaguguguugaagccauuccacugguggcaaacuuucacuugguccuggccccaua

SEQ ID NO: 4165516 - RNA, 59 nt, Human
uaugggguuuuuuuuaagcucuggaagcccacagccuucagaaaagagaaaaucuuaua

SEQ ID NO: 4165517 - RNA, 83 nt, Human
uauggucuucugaugagucuucugccuaaagaaguaggacuacacagcuaauuuuucuaggaagaauuucuuggccagccaug

SEQ ID NO: 4165518 - RNA, 89 nt, Human
uauggugguaacaaacacaaugccuacuaguacuauuuuguggcacugcuucaauuugugcuaaggcaccgguagucuuauccacugua

SEQ ID NO: 4165519 - RNA, 110 nt, Human
uaugguucuuauauaugauaaauauuuucuauacugaaacuauauguugacaaaugaacaacauguacuguuggugaagaggcuguaagugucaaauacuaauuaccaug

SEQ ID NO: 4165520 - RNA, 80 nt, Human
uaugguugcagaacuuaaagacagagugcuuacuccaccuccaucugugagagcuuaacaagucaugacuucuguccaug

SEQ ID NO: 4165521 - RNA, 91 nt, Human
uaugguugccagacuuaggcagggccaguggguugaaaggcaguaauacuuugcuaggcaauaauugguuuaggggugcugguuagcugua

SEQ ID NO: 4165522 - RNA, 69 nt, Human
uauguaaaaaugcacaguaaugagcugguuguuucaaaauuccagcuuuaauuguguguuacauucaua

SEQ ID NO: 4165523 - RNA, 55 nt, Human
uauguaaugcucuacccacaugaagcuuccucucuagugggacagacauuacaua

SEQ ID NO: 4165524 - RNA, 77 nt, Human
uauguaauguugucucaaguuauuuguguuuucaugcuuuacaauuaauuccaaguugagacaugcaaagauacaua

SEQ ID NO: 4165525 - RNA, 112 nt, Human
uauguacaaaugccaaguagacaugggcagaaguggcaucauuaacaucuacuguaucauaguuaaccauccacucauguucauucuucacugccauugguucuuuaaagua

SEQ ID NO: 4165526 - RNA, 112 nt, Human
uauguaccagucacgugcaggauauguauuaacauuaauaaaauggcauucauaggauaccauuaauauuaguguuaauauuaguuagcaugaauaggaugacauggacaua

SEQ ID NO: 4165527 - RNA, 64 nt, Human
uauguagcagauauuugugcacacgaguacaugcaaguaugagugugcauguguguguugcaug

SEQ ID NO: 4165528 - RNA, 89 nt, Human
uauguaggaaaguuuuugauguuggaggagagauguguuuugaaauguuggaaauauaauuucugccucaauaaugcccucccugcgua

SEQ ID NO: 4165529 - RNA, 71 nt, Human
uauguauaaagcacuaggucacacaaguuauguuauuuaauucacauaaccgugugacaugggcaugcaua

SEQ ID NO: 4165530 - RNA, 58 nt, Human
uauguauaugguagaaguaugugucuauggguacauauauaucuuacacauauaugug

SEQ ID NO: 4165531 - RNA, 77 nt, Human
uaugucauggcugaaauucuucgcuugcaauagauugugacccucucuaggauaagcauauuccagucauguccaua

SEQ ID NO: 4165532 - RNA, 74 nt, Human
ucgccucuuugaagaccuuaucucuaaauagcacuacagucugugcuacuggggauugguucuucaacauguga

SEQ ID NO: 4165533 - RNA, 68 nt, Human
ucgccugaggcugggaagguaaaguuguagugagccgugauuacuucauugcauuccagccuggguga

SEQ ID NO: 4165534 - RNA, 69 nt, Human
ucgccuuucugagaugugaaucugucaaauguaaaacauuagaagaaaagcacuuagagauuuggauga

SEQ ID NO: 4165535 - RNA, 125 nt, Human
ucgcgcgccgcguacgugcagcaaccgacuccgcccagcgaggcggagccuagggaagccgcgggcggcccgccgcuguccuggagcugcugcugcugcugcggcggcugcaccggcggcgccga

SEQ ID NO: 4165536 - RNA, 61 nt, Human
ucgcgcggcggaacgcuccgcgcugcgccgguggcggcaggauacagcggcuucugcgcga

SEQ ID NO: 4165537 - RNA, 106 nt, Human
ucgcggguguuuguucuggaaacguugacuuagggcuugaccgcguccugaaaccguggcacucaggcccagagucacggauccauguaaaggauuuuucccguga

SEQ ID NO: 4165538 - RNA, 78 nt, Human
ucgcucccugcaggaccugggcauggcgcagcacaguuccucgauguuugcccucagcagcagcuccugccacaguga

SEQ ID NO: 4165539 - RNA, 75 nt, Human
ucgcucugccacugaggcuggagugcagcagcaugaucucggcucacugcagcuccgccucccggguuuaagcga

SEQ ID NO: 4165540 - RNA, 76 nt, Human
ucgcucugucgcccaggcuggaaugcaguggcgcaaucucagcucacugcaaccuccgccugcugggaucaagcga

SEQ ID NO: 4165541 - RNA, 102 nt, Human
ucgcugggcuggggaaaguccagguccucauuccauccuucuuuagccccagccucgggaugggaaccagcagagggccuagacuauccagaaacccccuga

SEQ ID NO: 4165542 - RNA, 77 nt, Human
ucgcuugaacccaggaggcggagguuguggugagccgcgauugcaccauugcacuccagccugggcaacaagagcga

SEQ ID NO: 4165543 - RNA, 76 nt, Human
ucgcuugaacccccgaggcagaguuugcagugagccaagaucgugccacugcacuccagccugggcgacagaguga

SEQ ID NO: 4165544 - RNA, 75 nt, Human
ucgcuugaacccggcaggcugagguugcagugagcugagaucgcgccacugcacuccagccuggcgacagagcga

SEQ ID NO: 4165545 - RNA, 72 nt, Human
ucgcuugaacccggguggagguuguggugagccaagaucgcaucauugcacuccagccugggcagcaagaga

SEQ ID NO: 4165546 - RNA, 77 nt, Human
ucgcuugaacccuugggguggagguugcagugagccgagagugcgccacugcacuccagccuggggugacagaguga

SEQ ID NO: 4165547 - RNA, 76 nt, Human
ucgcuugaaucugggauguggagguugcaaugagccgagaucaugccauugcacuccaggcugggugacagaguga

SEQ ID NO: 4165548 - RNA, 57 nt, Human
ucgcuuuaauggucuucacagcacgucguguuuaugagucagaggacccuagagcga

SEQ ID NO: 4165549 - RNA, 56 nt, Human
ucggccacuguugcuagacagagcugucacugaguacgcuguugagauguggcuga

SEQ ID NO: 4165550 - RNA, 95 nt, Human
ucggccuccugacgucagugaagcuuuuacuggccuagacacuuuggccuugggcccagaaagcaucauuguggacagcccagaccugaggcuga

SEQ ID NO: 4165551 - RNA, 64 nt, Human
ucggcgcagucgggaggcggggucggucuccgacuucccaacgugggccucccagcugcgcugg

SEQ ID NO: 4165552 - RNA, 65 nt, Human
ucggcggcuucagccgggcacuuaaugaucccuuucuggggauuguuaccagcuggagguggcgg

SEQ ID NO: 4165553 - RNA, 68 nt, Human
ucggcuuugagggguuuugaaucgggggaaggaaacccgaucgcuagaccaaacccacucagcgcuga

SEQ ID NO: 4165554 - RNA, 130 nt, Human
ucgggagucaucgcugggcuggggaaaguccagguccucauuccauccuucuuuagccccagccucgggaugggaaccagcagagggccuagacuauccagaaacccccugaccccagaagcuccguuga

SEQ ID NO: 4165555 - RNA, 63 nt, Human
ucgggcgccgcggcucucaggcgggccccucugggccggcugcuucugagccccggcgcugga

SEQ ID NO: 4165556 - RNA, 69 nt, Human
ucggggaucucuguauucugauauucacuuuugcacaaggaguguguucagcuugcagaaagugccugg

SEQ ID NO: 4165557 - RNA, 63 nt, Human
ucgguguuguacaguauauuucaaagccaggaaauuggcacugggaugcuacuguuaacuaga

SEQ ID NO: 4165558 - RNA, 81 nt, Human
ucguagcuacuuagagccguucuuaauguuugccuuacacauuaaaauuagagggggagagaaugugcguuaauaauacga

SEQ ID NO: 4165559 - RNA, 57 nt, Human
ucguagcugugccuuaaggucaucaucucacagaggaggggacaggcucagugacga

SEQ ID NO: 4165560 - RNA, 79 nt, Human
ucguagucacuggugugagaggagcaaagccaccauucccuuuacagguuguugcucuucauacaucaaugaauuaaga

SEQ ID NO: 4165561 - RNA, 120 nt, Human
ucguauacugaaguucuaagccccaguaccccagaaugugaccuucuuuggaaauagggucauugcagauaugauuaguuaagaggagaucauacuggagugggcuuuaauccaauauga

SEQ ID NO: 4165562 - RNA, 64 nt, Human
ucgucauccagaacuucaaugcacacacuacugaaucgcauugagaauccauuugagaugagga

SEQ ID NO: 4165563 - RNA, 63 nt, Human
ucgucgggggucgggggucgggggucggggguugggggcuccugucccggggaccgccgagga

SEQ ID NO: 4165564 - RNA, 75 nt, Human
ucgugaaacuguuuuucugugcacaguagcuuuagauuacuaccagacugugcacacaaaaauagauuuuaguga

SEQ ID NO: 4165565 - RNA, 56 nt, Human
ucgugcaaaggcccaugugggucaaagucuagaaacaacugugggcuggugcauga

SEQ ID NO: 4165566 - RNA, 115 nt, Human
ucguguagugcuaagaagauaguaugugcccaggaaauaaaagugggcuugucaagccuggaagccaugcucaguuccuggagcauccucaguaccuguuuuguuaucuauguga

SEQ ID NO: 4165567 - RNA, 74 nt, Human
ucguugaagggggauuugugcuuguaacuccuauuaauaggacuugcauguguaaaucuuccuccugucaauga

SEQ ID NO: 4165568 - RNA, 75 nt, Human
ucguuuuagcugugaagagcuaaaaaauggaaaaugcauauuucauguaaaguucaguacaguuuuuuaagauga

SEQ ID NO: 4165569 - RNA, 86 nt, Human
ucuaaaaucccaugaugcugagucuugauauguagaucuguuuucuuccauuauguugagcauucagugaucucuuuggauuugga

SEQ ID NO: 4165570 - RNA, 61 nt, Human
ucuaaacaguacuggacaaggagucaggggaucuggguucugauaccagcacugugacaga

SEQ ID NO: 4165571 - RNA, 77 nt, Human
ucuaaagaucaagugggccuuggaucgcuaagcuggcugugaugcuauuuaugcaaguuagggucuauguauuuaga

SEQ ID NO: 4165572 - RNA, 103 nt, Human
ucuaaauaaaguuuguagguuagauaacaguagaauaucaacaucaauuuccugauuuugauaaucauauugugguuauguaggagaauguucuuuuuuuagg

SEQ ID NO: 4165573 - RNA, 96 nt, Human
ucuaaaugaugcaaacauuuuaaguauuuuuggaaaauaaaaucauaaacuuauugauagaaagcuugggguguuuaaaaauaacaucagauugga

SEQ ID NO: 4165574 - RNA, 70 nt, Human
ucuaacagaaucaaggcugcuucagacuagugacaucuuugucgaagguaacgcagcuugacccugugga

SEQ ID NO: 4165575 - RNA, 75 nt, Human
ucuaacagccaggggacacuccugcuugggcugagacuugugcagcucuaguaggaaugucccucugugcuuaga

SEQ ID NO: 4165576 - RNA, 79 nt, Human
ucuaagcgcuuucgaugcauucuugcuuuacuucauuauuuuauugaauucuccaggaauguaugauacagugguuagg

SEQ ID NO: 4165577 - RNA, 79 nt, Human
ucuaagcuccaucuauuggcaacauggcuuggaucaaccuuuucuugcccaaauguuucaagagaaaaagagacuugga

SEQ ID NO: 4165578 - RNA, 70 nt, Human
ucuaaggauacaagguggagucaggaaaaggaugucccuuucuccguugccuccuugagcuuccauuaga

SEQ ID NO: 4165579 - RNA, 66 nt, Human
ucuaaggauguuaucugugcaggugggacugaauugguuucuugccacuaauaaauauucuuaaga

SEQ ID NO: 4165580 - RNA, 58 nt, Human
ucuaagucccaagauuagguuggaaaggguauuucuuguuggcuuaguuuggguugga

SEQ ID NO: 4165581 - RNA, 86 nt, Human
ucuaaguugaaguaugcugagucguauuauuuuuuaaaugcugaaacuuuuugaagcuauuuugcauucaguuauuucaauuaaga

SEQ ID NO: 4165582 - RNA, 61 nt, Human
ucuaaguuuggugauuaccaauuaggcagcuagagaaagucgaugggacaguaaacuugga

SEQ ID NO: 4165583 - RNA, 68 nt, Human
ucuaaguuuuuccucaggaucugugacuaguggucucaugguccagacauuucugagguaaaaguggg

SEQ ID NO: 4165584 - RNA, 82 nt, Human
ucuaauaaauuuuguuggcauugcccuuuuuuugaaguccaaaucuuucaaauuugguaugcaagccaucaaguuuaaaaga

SEQ ID NO: 4165585 - RNA, 60 nt, Human
ucuaauauguauuuuaacguguaagggcuuggauacaacuacccuagaauacauaguaga

SEQ ID NO: 4165586 - RNA, 64 nt, Human
ucuaauccacugucaacuuugaauaacaccaaaaaauucacaguaaguaggauaguugauuaga

SEQ ID NO: 4165587 - RNA, 87 nt, Human
ucuaaugcaauuaucacuaaggggcgagcaagauguuuauaugaucuuaaaaugucugucugcacguugcuuauuaguugcaaaaga

SEQ ID NO: 4165588 - RNA, 130 nt, Human
ucuaauggcaguucuguuuucuuccacauaaggauuuuuagagaggcucuguaaaauguccccuuucgacagugguuauuuuaaaugucuucuuugcccuuuugugcuggagucaaggauucucacagga

SEQ ID NO: 4165589 - RNA, 87 nt, Human
ucuaauggcauugcuuccagacaaggucaaauuaaauguucaauuuagacauucuucagcuuugucaggcaagcaaugugaauuaga

SEQ ID NO: 4165590 - RNA, 90 nt, Human
ucuaaugugcuaucaaugauaggauucaccauuauuuuaugcaccauggaagaugaauaaagauucuaagaccaagauguguauauuaga

SEQ ID NO: 4165591 - RNA, 57 nt, Human
ucuaaugugugcuucuuugccccaaacagucauagggcagaaggucuaagcuuuaga

SEQ ID NO: 4165592 - RNA, 61 nt, Human
ucuaauguucugggagagaagcuguugggucuuuccuaccuaaucugguagaaauguuaga

SEQ ID NO: 4165593 - RNA, 72 nt, Human
ucuaauugagguaguacuuauuauuggaagccuaugcaaagguauuggaauggggauuauuuugcaauugga

SEQ ID NO: 4165594 - RNA, 87 nt, Human
ucuaauuuguaaaagaauaccauaauauagaaagauguguccacuguuugcucuuuuguuucuauaguauacuugguaugaauuaga

SEQ ID NO: 4165595 - RNA, 57 nt, Human
ucuacacaucuggagaagcccugugguaggaccacagcaugcuguccagggugcaga

SEQ ID NO: 4165596 - RNA, 92 nt, Human
ucuacauuagacauuuauuucugcucauccuaguggagcaugcccaaauaucugcuggcuuuaaggaugaccagauggagguacuaucuaga

SEQ ID NO: 4165597 - RNA, 76 nt, Human
ucuacccaaaagguaagaaggaacucaccaauuccuaauuuacaaaggugguuuaaaguagcuuccuuuugguaga

SEQ ID NO: 4165598 - RNA, 56 nt, Human
ucuaccuuguuuuagcauuuuggaagauaaauaacaauaugcugagugaaggcaga

SEQ ID NO: 4165599 - RNA, 125 nt, Human
ucuacgugaauauuuauuuaugcaguuguguuauuuccuugggguacaguucuuccagugucauuggcaucaaugaauaugugacuuugauuucaaguguaaacaaaccacugguucacggcagg

SEQ ID NO: 4165600 - RNA, 56 nt, Human
ucuacguuuugaaauaagguggcaaauaaauaugccaccuuauagauaaaauuaga

SEQ ID NO: 4165601 - RNA, 57 nt, Human
ucuacuagguguacuacugcaggaauaucaugcucagguaguuaacagucaaguaga

SEQ ID NO: 4165602 - RNA, 77 nt, Human
ucuacugaaaucugaacaacagcugucagcugaaaguguaagcucucugacuuccucguuuuucauguuucucugga

SEQ ID NO: 4165603 - RNA, 55 nt, Human
ucuacugagugcugagauuuuggcugaaauugcccggauccuucggccuagugga

SEQ ID NO: 4165604 - RNA, 55 nt, Human
ucuacuggacaugauuuuuuugucccuauaugggaucuggaaauucugccagaga

SEQ ID NO: 4165605 - RNA, 80 nt, Human
ucuacuggcuggguuccuucgccaugagcauccugguguuccuuacaggaaacauucuugguaaggacaaggcuuuggga

SEQ ID NO: 4165606 - RNA, 76 nt, Human
ucuacuguuucccaaauguuuuuagguacacaggaguuauuugauuaagucugguaaacugaaaaauauuaguaga

SEQ ID NO: 4165607 - RNA, 88 nt, Human
ucuacuuauauucaauuuccagaauagggaaauucaugaagacagaaaauagauuggugauuuccuaggucuggagaagauggggaga

SEQ ID NO: 4165608 - RNA, 61 nt, Human
ucuacuuccuuauccucaaggcacacaccagaguuccacugggugaggacagggaaguagg

SEQ ID NO: 4165609 - RNA, 60 nt, Human
ucuacuucuagaaguuuaggcaucaucacucugucuaagugccaccucucuagcaguaga

SEQ ID NO: 4165610 - RNA, 99 nt, Human
ucuacuuuggccugauugucuuaaaagcuggcucugauauuaacggacggauguucacaucuuuaauuuggaucagggccacugacacaauagaguaga

SEQ ID NO: 4165611 - RNA, 127 nt, Human
ucuagaaacgauuucuagaaacagguuucuagaaacgauuucuagaaacagguuucuagaaacgauuucuagaaacagguuucuagaaacgauuucuagaaacagguuucuagaaacgauuucuaga

SEQ ID NO: 4165612 - RNA, 76 nt, Human
ucuagaaaggcagucuaaguuaauuuccacaauuuucauuguauuggcaaagaacuugaggcuuuguuguucaaga

SEQ ID NO: 4165613 - RNA, 57 nt, Human
ucuagaacuucucuaaaaugaaaaguuuuuuaagcacuucagggugagaguucuagg

SEQ ID NO: 4165614 - RNA, 66 nt, Human
ucuagaauucccuuuugacaauccucgaaauggcaguuggucucaugaaagggaaugaacuuugga

SEQ ID NO: 4165615 - RNA, 57 nt, Human
ucuagaauuugcguagguuagaugcuuucagcagaaagagcuauguaaauaucuaga

SEQ ID NO: 4165616 - RNA, 73 nt, Human
ucuagagaaguuuccuuuugaaaaauuauaguauuucagcugaaguaaggggaaaaaaggaauauucuuuggg

SEQ ID NO: 4165617 - RNA, 58 nt, Human
ucuagagauacauuggucauuuaacuuaaugucacagguuaccagcuguaucacuaga

SEQ ID NO: 4165618 - RNA, 74 nt, Human
ucuagagccacuguugggcacuuuccuuacuggccuugaccugucugggauaucgccuaccaguagucuccaga

SEQ ID NO: 4165619 - RNA, 82 nt, Human
ucuagagcuugaaguuuuguaacuuaauaaugguguaucuaccugucuucuacacugaauugcaauuuucuuaaggucuagg

SEQ ID NO: 4165620 - RNA, 93 nt, Human
ucuagauaaacccauuguuaaauugaaaauauuguagaccauaaaugcacauaugguguaugauguuuucaauuuaugauggguuuauuugga

SEQ ID NO: 4165621 - RNA, 57 nt, Human
ucuagauccugguguuaacugggaaaacacuuaaauaacauuccauggaucugcaga

SEQ ID NO: 4165622 - RNA, 63 nt, Human
ucuagcagggaaagcagagaauaaacaaacaaauauauuuucagugugugauaccugcuguga

SEQ ID NO: 4165623 - RNA, 61 nt, Human
ucuagcuacaaaucugauaaguggguagacuaauuggccacuauuauauuuguugugcaga

SEQ ID NO: 4165624 - RNA, 64 nt, Human
ucuagcuaguuccuggguauggaagggauacuaaggcaggcccauuucugggagacaugcuaga

SEQ ID NO: 4165625 - RNA, 130 nt, Human
ucuagcuaugucuuuuaaacugcugccagauauguucuuccuuuuguaccuucugaaaucuguauaaccugggguucaacaaggcugucaaaaguuucaagaacugaucugaugaacuacauuaaagcua

SEQ ID NO: 4165626 - RNA, 72 nt, Human
ucuagcugcuugaaauaccauagugaauaaggcagacacaguuuuacucuuauggaaauuuuaacuagcaga

SEQ ID NO: 4165627 - RNA, 67 nt, Human
ucuagcugggucucuguuuucucaucucuacaaggggguugagaaucgaaugagacacuggauuaga

SEQ ID NO: 4165628 - RNA, 85 nt, Human
ucuaggaaauggguaauaacuugugauuaaaugcagauguuaaccugaaaaauucaguuaaucacagauauuaaacaugccugga

SEQ ID NO: 4165629 - RNA, 64 nt, Human
ucuaggaagaacaucuaauuacagguaguaauuacagguaguaauuagauguugauuccugaga

SEQ ID NO: 4165630 - RNA, 62 nt, Human
ucuaggaugaaaauccagcuuauaaucuaucuucaauuuuuaugagcuuauuuauccugaga

SEQ ID NO: 4165631 - RNA, 66 nt, Human
ucuaggauucuuccucuggcuccaaccuugcucuagaugaguggagccaaaaagggaaggagaaga

SEQ ID NO: 4165632 - RNA, 62 nt, Human
ucuaggccuggcaccuggcucccucguuccuucuucaccagugagcagcuguagggcaagga

SEQ ID NO: 4165633 - RNA, 85 nt, Human
ucuaggcugccugcccccaaagcccucgcauuuacaaaucagccagccagaggggcuucagcuggggauggagcagguugccagg

SEQ ID NO: 4165634 - RNA, 75 nt, Human
ucuaggggcaucagugugugcacacagcauggcuugugaaugcggaagugccugugugcauaguugugcucaaga

SEQ ID NO: 4165635 - RNA, 70 nt, Human
ucuagguauaaugaaugagguggcagaaaguuuuucgguuaaaaggacuaaaauccauuuaaugccugga

SEQ ID NO: 4165636 - RNA, 69 nt, Human
ucuaggucuguguccuggaaaucuaguucugacuuuuaugaagugaauauuuuuagacacccaacuaga

SEQ ID NO: 4165637 - RNA, 62 nt, Human
ucuaggucuucagacacuauuaaugcagauuguagccucuagguccugaagauuuuacuaga

SEQ ID NO: 4165638 - RNA, 63 nt, Human
ucuagguuagaacccagaaaagugcuaaguuagaggguagcuagcucuagguuagaaccuaga

SEQ ID NO: 4165639 - RNA, 56 nt, Human
ucuagguuucuuuugcuccuggaccuucauacuaguuccaguggccugaaucugga

SEQ ID NO: 4165640 - RNA, 106 nt, Human
ucuaguauaaucuucaugaaguuauggauuucucugcaccuagaacagugccuguuagugcacaguagauguuugagaaguuuauguucaaugaaagaauaauaga

SEQ ID NO: 4165641 - RNA, 57 nt, Human
ucuagucagugcacagacacuugugagcacccacugugugccaggcgcuggucuagg

SEQ ID NO: 4165642 - RNA, 57 nt, Human
ucuagugccuuccuucacccuugcugcuuccuucuagagcugaaguuaggcugcaga

SEQ ID NO: 4165643 - RNA, 95 nt, Human
ucuaguguuacauuccacugucccauuaaguauuucaguuacuguucuucccagggcaaauuguguguuaaugguguuuuauauguaauauuuga

SEQ ID NO: 4165644 - RNA, 57 nt, Human
ucuaguuaauuccuuugguguuacuuauaauuuggguagagaggguaguagacuaga

SEQ ID NO: 4165645 - RNA, 64 nt, Human
ucuauaccaaaaaaauucuugucugccuaaauuuaggaagauggauuuagauuuuuuuggaaga

SEQ ID NO: 4165646 - RNA, 79 nt, Human
ucuauagaaggcgaauuagagaucgcaauaacgggccagcuuccaugaugaccccagguuguagugaugucuauguaga

SEQ ID NO: 4165647 - RNA, 63 nt, Human
ucuauagcaaauucuuuaggugcuuuccaugcauguguuguaagcuuuaaggaauuuuaugga

SEQ ID NO: 4165648 - RNA, 110 nt, Human
ucuauauauaccuuuccauuauaacaugacacaaaguuugucagaaauuacuuggcacacugggaguucuugauaauuuugauggaauaugauguaaugguauauaugga

SEQ ID NO: 4165649 - RNA, 60 nt, Human
ucuauaucuuggcugcugugaauaaugcugcaaugaacauggcagcucagauaucucaga

SEQ ID NO: 4165650 - RNA, 84 nt, Human
ucuauccagcacagaacuggagucaugacgguuggagguagguaaucucacagcuguuuucuccaggcagugugaccaaguaga

SEQ ID NO: 4165651 - RNA, 63 nt, Human
ucuaucuccuuccugccccagugauaaggccucagcuuacuccgcccugcaggaaggcauaga

SEQ ID NO: 4165652 - RNA, 67 nt, Human
ucuaucugcuugggaggcaagcauuccauuaaugaugcggauaguuagccucucaguucagaaaaga

SEQ ID NO: 4165653 - RNA, 123 nt, Human
ucuaucuuugaaaaugcuuugucauguguggauucaucucaaagagauaaaccuuuuucuaauucagcauguuggaaaugcucuuuggauagaauuacaaagggaaaguuuggagcauauaga

SEQ ID NO: 4165654 - RNA, 56 nt, Human
ucuaugcacuggauuacaaagcaaguaccaaaaagcucugcauuuguguguaugga

SEQ ID NO: 4165655 - RNA, 74 nt, Human
ucuaugggggcucacagcagaccacuacuaguaggaggcuugccucuuaccucugccugguccuuuuuuguaga

SEQ ID NO: 4165656 - RNA, 56 nt, Human
ucuaugucucgacccaagacaacuaugucacacuaugucuugggucgagacauaga

SEQ ID NO: 4165657 - RNA, 60 nt, Human
ucuauguuucucugcagugccucucacuauggaaguuaggcacucgacagaaauauugga

SEQ ID NO: 4165658 - RNA, 57 nt, Human
ucuauguuucuuggcuaauuguucagugaugccaaaggaaaguugagaaacaaugga

SEQ ID NO: 4165659 - RNA, 108 nt, Human
ucuauuauaggaggaucaggaauuguuucuucagggaagcuuguuaauucuguaaucgcucaauuucauauguaucaccuagcccagugccugauuugaugagauggg

SEQ ID NO: 4165660 - RNA, 62 nt, Human
ucuauuccuggauuuauucugaguggguaucucucuuguucuuaaugaguuccaugaaaaga

SEQ ID NO: 4165661 - RNA, 55 nt, Human
ucuauucuagaggguagauggcgaaugauaagauuuguuuacucuagaggguaga

SEQ ID NO: 4165662 - RNA, 57 nt, Human
ucuauucucagguaagaauguguaagcuguagcugccagaguuacaugagggucaga

SEQ ID NO: 4165663 - RNA, 104 nt, Human
ucuauucucugagcacaaaguacaccaacaccaguagaaaaaaaccuguuugcuuccuguguguugguggcagaaugucagagccuguaaaaaauucgaaugga

SEQ ID NO: 4165664 - RNA, 85 nt, Human
ucuauucuguucuauuggucuaugugucugcuuuuaugacagcaccaugcuguuuuaguuacuauagcuuuguaguagauuuuga

SEQ ID NO: 4165665 - RNA, 58 nt, Human
ucuauugccauguggaagggggagcagaugcauucugcauuccucacagggcagaaga

SEQ ID NO: 4165666 - RNA, 60 nt, Human
ucuauugccauuuuccagaauaguguguaaaggaauauaauuuggggaaagugguguaga

SEQ ID NO: 4165667 - RNA, 62 nt, Human
ucuauugccugaugcaauuugagaauagaacuugugccaacucucugugcauuaucaauaga

SEQ ID NO: 4165668 - RNA, 65 nt, Human
ucuauuguaggcauguagcuuggugccaccaguugauggagauugggcuaguuugccauuuuagg

SEQ ID NO: 4165669 - RNA, 61 nt, Human
ucuauugucuucaacucuacuuuugagccagaccucaaaauagagccugugagauaaaaga

SEQ ID NO: 4165670 - RNA, 73 nt, Human
ucuauuuagcagcaggacuggcccacaggugcuuuuacagcggcuggcaagugucugcucaugaaugaaugga

SEQ ID NO: 4165671 - RNA, 89 nt, Human
ucuauuucaagcuaggaaauguggacuuaauucuaaaagcuaugagacaccucucacaagcucaaggauuaguagacuugaauuauaga

SEQ ID NO: 4165672 - RNA, 108 nt, Human
uaugucauuaauacuuaugcucuuuuacguaccaaauuauaauacuggggcuuugaauacauauuuucugagacaacaucuaguuugguggauggaggggauggcaua

SEQ ID NO: 4165673 - RNA, 78 nt, Human
uauguccaugacagugauucccaaaguguuguccccaaaccagcagcaucagcaucaccugggaacuuguuagacaug

SEQ ID NO: 4165674 - RNA, 72 nt, Human
uaugucuacauguguacaguacauguguagugauguguguaugucuacauguguacaguacaugugugcaug

SEQ ID NO: 4165675 - RNA, 65 nt, Human
uaugucuaggaaagacacagagaguuucugugacaaagagaguuucugugucuuuccuagauaug

SEQ ID NO: 4165676 - RNA, 66 nt, Human
uaugucuggaaguguacuugucacuucugcucacaauacaugggcaaaacaagucacauggacaua

SEQ ID NO: 4165677 - RNA, 60 nt, Human
uaugucuggaccacugcagcccaauuucagaugggaugcaauaaaaguaggucuugcaua

SEQ ID NO: 4165678 - RNA, 82 nt, Human
uaugucugucagcauuuaggagaauuugagaaauguuuuucccuuugauauuccuuaaaugugaucuagauuugaguacgua

SEQ ID NO: 4165679 - RNA, 64 nt, Human
uaugugauagcuguagaauguauacacauauuuuucuguguguguaauaccuauguuuuacaua

SEQ ID NO: 4165680 - RNA, 86 nt, Human
uaugugcuggaaaauuaucuauuccaaauaucagcguguuuuacagccaaaagcagcuaaggaaucagaagagguuucaacauaug

SEQ ID NO: 4165681 - RNA, 63 nt, Human
uauguggcagaguucaggcguuuggcuccguaaucaugguuucaaacacaaguuugucaugua

SEQ ID NO: 4165682 - RNA, 120 nt, Human
uauguguauauccauguauacacgcauacacuuauacacauguguguauucauauguuuguguauauguguacauauuuguguauguguaugcaugugugugugcuugcauauauauaua

SEQ ID NO: 4165683 - RNA, 55 nt, Human
uauguguauguguguguguguguagauagauagacagacagacagauugcauaug

SEQ ID NO: 4165684 - RNA, 87 nt, Human
uaugugucaacuugacuggcucaugggaugcccagauaacugguuaaauacuguuucugggugugucucaccuucagugugagcgug

SEQ ID NO: 4165685 - RNA, 99 nt, Human
uaugugucgccacugguucuaagagcugugcuuauaccaauucauuggguccuggcaacucuaugaaauguacaagugcuuuuuucuaugugacacaug

SEQ ID NO: 4165686 - RNA, 71 nt, Human
uaugugugagacauaaaccuugagauauuaaaacugugugucuugauguggugggguuauggguacauuua

SEQ ID NO: 4165687 - RNA, 87 nt, Human
uauguuaaauuacuuguuuguucuuuauauuuagggauucauguagaagauaaugaccugaaauuugugguagaacaggcagacaua

SEQ ID NO: 4165688 - RNA, 95 nt, Human
uauguuauauauauguacaguuugguaaaaucauagugguaacugagagguugugucuauuguuauauuuacugagcauauacaugcaucacaua

SEQ ID NO: 4165689 - RNA, 60 nt, Human
uauguugucguggcuucucaacucugcuacuguaaugugaaagcagccauagacaauaug

SEQ ID NO: 4165690 - RNA, 56 nt, Human
uauguuguuuuucuuuaguggagcuacuauugagccucacagaugauugacacaua

SEQ ID NO: 4165691 - RNA, 78 nt, Human
uauuaaaaaaucaguaaaguaccaaagugugaguaugauuucauacacacccugaaggcuauugcucauuaacuagug

SEQ ID NO: 4165692 - RNA, 76 nt, Human
ucaaggacuucucacaggauuucuuuuaguaaauuuugauagguaugcuugaggagacuuuugggggagacuuuga

SEQ ID NO: 4165693 - RNA, 62 nt, Human
ucaaggaggaugagauuccagggucaauuguuaucauuaacaagaccaucuugucguucuga

SEQ ID NO: 4165694 - RNA, 90 nt, Human
ucaaggggaggagaguacccagaggcaugaucccagaaggugggugucuuugggggucacuuugggucuuuccacuacauucuccauuga

SEQ ID NO: 4165695 - RNA, 69 nt, Human
ucaagguaaggaucauuggcuuccccgaaacauuguaucugggaauacacacugauuuaucuauuuugg

SEQ ID NO: 4165696 - RNA, 84 nt, Human
ucaagguggucuguucaagguggcugauuaaauuucuugcuuuggaacauucgacagugauuuuuucgagcagaacuucucaga

SEQ ID NO: 4165697 - RNA, 98 nt, Human
ucaagguuuaaaggguauggcucuugaaaauuggaacacagaagaaaaccagccucaucugagugaaauauuucaagaauugccuucucagaccauga

SEQ ID NO: 4165698 - RNA, 86 nt, Human
ucaaguaauuccuagcaagucaaagacuagaacuaguuagccauuaauuauaaaaacuauuuuagauuauugacuggaaugacuga

SEQ ID NO: 4165699 - RNA, 60 nt, Human
ucaaguagaaaagugagaagagagcugaggaaauuguucuguucaaggcuuucuccuuga

SEQ ID NO: 4165700 - RNA, 84 nt, Human
ucaaguaguucauguuaucacagaagcaaaugaaaagucucccaaccuuuucauuuacuucuaugacaacaugcucugagagga

SEQ ID NO: 4165701 - RNA, 72 nt, Human
ucaaguaugaugauauuucuuguauuaaaggacagagaugccuaagucuuauuuaaggacaagaagacuuga

SEQ ID NO: 4165702 - RNA, 69 nt, Human
ucaaguucucagggcccuggggugcacugacaccaucaagguaguucauccugggaagucccagcuuga

SEQ ID NO: 4165703 - RNA, 78 nt, Human
ucaaguugaaggaggucugcauucuacaguucagugcuaggaugaaauagaaaaacaggcuucuauauuggacuuuga

SEQ ID NO: 4165704 - RNA, 58 nt, Human
ucaaguuguagguauuccugggucaucagggcagcacucauaccuauauuuacuuaga

SEQ ID NO: 4165705 - RNA, 63 nt, Human
ucaaguuuguuauuuuaaagcuucuuucaaggguuuaccuggaagcuacagaaaauaauuuga

SEQ ID NO: 4165706 - RNA, 90 nt, Human
ucaaguuuuacaauggcauuuugggguuccuguucuugguaguauugguaauauuagcagaaccagucagugagccauugaaugacuuga

SEQ ID NO: 4165707 - RNA, 90 nt, Human
ucaauaaauaguggaaaaaaggguauucuggcaugaagacuguuuauauguuauacuggauuugugcucauuuuccauuaaacucauuga

SEQ ID NO: 4165708 - RNA, 129 nt, Human
ucaauaagaaggcagguguguguuguuuauuaccuccaaacauuugggacccucucuucacugcauaggggccgugaguacuggaguuccaaaaggagagugggacacacaugaaacccauuuuaauga

SEQ ID NO: 4165709 - RNA, 95 nt, Human
ucaauaugccaaguauugggaguagguguuuaaaaguauggugguccuuuuuaaauaaaugauuuaaaucacuguacuuuauuccugggcaguga

SEQ ID NO: 4165710 - RNA, 70 nt, Human
ucaauauucuucuuuaguaggauuucauuuuuauuacuaaaugcaucuuucuguuagagcggguuauuga

SEQ ID NO: 4165711 - RNA, 60 nt, Human
ucaaucauuaacccuugaugcugggaagagcuuggucucagucucuugggcugugaagga

SEQ ID NO: 4165712 - RNA, 84 nt, Human
ucaauccaagcaacaauccugagguacugcagggccgaacaccaucuuucugggacuggguccucaggacaagcaaggaguuga

SEQ ID NO: 4165713 - RNA, 87 nt, Human
ucaaucuacauggggagaagcagcagaccugauuuugaaauugaagaagggcaauuugaggacaggcugauuguauaucuugguuga

SEQ ID NO: 4165714 - RNA, 55 nt, Human
ucaaucugcuuuugucauuuaugauuuaucaggaucagugugacuggcaaauuga

SEQ ID NO: 4165715 - RNA, 83 nt, Human
ucaaugcaucugaaauauuuguuaguguuuuaaugaccucagcagucuuuaaucaagauaaguauacuuuagaaauguguuga

SEQ ID NO: 4165716 - RNA, 87 nt, Human
ucaaugcccaggauuuaaaguagaccuuuguuuaaaaaacuuuuguauaaagacaaauaaagguccacuuuagggcuugggcauugg

SEQ ID NO: 4165717 - RNA, 59 nt, Human
ucaaugggaguccaacaucaaggacuuugaauaaagucuucuguucagcuccuaucuga

SEQ ID NO: 4165718 - RNA, 81 nt, Human
ucaaugugcagcuauaaacagggccucagcugauucuggagggagcccuggagcagagauggccccuuggagcugccauga

SEQ ID NO: 4165719 - RNA, 69 nt, Human
ucaauguugaaagaacaauucugugaugacuucuggugucauauuaugcauguuguucuuucuauuugg

SEQ ID NO: 4165720 - RNA, 58 nt, Human
ucaauucaauugaacaguuacugucugccuuuuagggacugcuucuugauugaguuga

SEQ ID NO: 4165721 - RNA, 87 nt, Human
ucaauuuaaacucuucaugucuugccugauauauccuagguauaagccuaagaaaauugccuuaaguaagacugaacagugccuugg

SEQ ID NO: 4165722 - RNA, 58 nt, Human
ucaauuucagaccuuuccuuggauguccucgaagcuucccaggaaugucugaaaguga

SEQ ID NO: 4165723 - RNA, 77 nt, Human
ucaauuucucaccaguuccugaacauuucuaaguugaaauuauuuuagaguaguuauucauggggcuugcaaauuga

SEQ ID NO: 4165724 - RNA, 74 nt, Human
ucacaaaagcacugcagaguaagcacugaaaaaacacuguuaggagcuauuacuuuuggagugugggauugugg

SEQ ID NO: 4165725 - RNA, 100 nt, Human
ucacaauuauuugcucuaacuuuagcuuagauuaucaauauguuuaacauuaaucugcauguuagaugucuuccuaaaguuagggaugaaauaaauauga

SEQ ID NO: 4165726 - RNA, 76 nt, Human
ucacaauuuguauuaacaauuuagcuagcuagcauuuaagccugugggcauggcuuuguucauauaauuucuguga

SEQ ID NO: 4165727 - RNA, 56 nt, Human
ucacacagugagaaagugcggauuuaagcccaauugucuguggaucucagguguga

SEQ ID NO: 4165728 - RNA, 105 nt, Human
ucacacauaagaagugaaauacaaauucaaauuacaauaguuguuuucuaauuuaucaguuuggcaaagauaaaaugauuugauuuguguugcuaaggguguaga

SEQ ID NO: 4165729 - RNA, 60 nt, Human
ucacacauguaagggcuuuggaguaagauggaccuugguuauccaacgcuuacuguguga

SEQ ID NO: 4165730 - RNA, 82 nt, Human
ucacacccguuuccagcaacgagaagcacaaaauaaauucacuaagaaauuuagcuguguuucuuguuguuuuuguaugugg

SEQ ID NO: 4165731 - RNA, 69 nt, Human
ucacaccuggaguagcaagguaauuggauacacacucccaccauuaccuccauuaccucacagugguga

SEQ ID NO: 4165732 - RNA, 67 nt, Human
ucacacugaugagucugcguuccggggaagguugcguuucucuggcagugagcaacuugacaggugg

SEQ ID NO: 4165733 - RNA, 62 nt, Human
ucacacuuagagcgaauuguuucauaaguccaauauuuuuggaaguucgacuuuaacuguga

SEQ ID NO: 4165734 - RNA, 70 nt, Human
ucacacuugauuuugaaccuuucuacuaaggugcucugguuugguggaaagaacacaaaauuaggaauga

SEQ ID NO: 4165735 - RNA, 55 nt, Human
ucacacuuuccauggcuguuaaaauccucauaugacagcaauauucaaaguguga

SEQ ID NO: 4165736 - RNA, 83 nt, Human
ucacagaacuacagugggcagaggcaauauuuaaaccaauuucuuuccagaaacucauugucuuuccacugagaaguucauga

SEQ ID NO: 4165737 - RNA, 59 nt, Human
ucacagaaugucuagcauaauuguuugcauacaauaggugcucaaugaccauuugguga

SEQ ID NO: 4165738 - RNA, 55 nt, Human
ucacagacauggugagguaacaaacacauguuguuuuaaacagccaagucuguga

SEQ ID NO: 4165739 - RNA, 88 nt, Human
ucacagagaagcaauggcaaaggggcuguggaugggccugacugucuggacauggccaaaucugcugcccagccacuugcucuuguga

SEQ ID NO: 4165740 - RNA, 70 nt, Human
ucacagagccuagaaggugaaugagggcuguggaaugcaagcaucacaucucucauugccucugcuguga

SEQ ID NO: 4165741 - RNA, 55 nt, Human
ucacagcaacacuggggcagacacuugugugcuccuguuccuucaauugcuguga

SEQ ID NO: 4165742 - RNA, 67 nt, Human
ucacagcacauggaccgaguccuguggauuuguuuugcaaauggguuuucgcauguguuaacuguga

SEQ ID NO: 4165743 - RNA, 60 nt, Human
ucacagcaguaaagaaaacacugacugauucuacaguuuuuguuucuguaauuguuauga

SEQ ID NO: 4165744 - RNA, 71 nt, Human
ucacagcaguuacuagcaauuugugaaguaccaggcaaacuuuuuguaauuguaagugauugcaacuguga

SEQ ID NO: 4165745 - RNA, 61 nt, Human
ucacagcccuggcccuguggggacaggucugucucccccacuccuggagcuagggcucuga

SEQ ID NO: 4165746 - RNA, 82 nt, Human
ucacagccuauuugccuuuauaucccugauaucuaguauguuguuagcuagguaauggauaaugaagugagugagugaauga

SEQ ID NO: 4165747 - RNA, 56 nt, Human
ucacagcugaguuuccauuucuucaacaccauuguugcugaagaaaucagguguga

SEQ ID NO: 4165748 - RNA, 61 nt, Human
ucacaggccugaugccuuggcugggacgauugaacucagcucugguucauguggucucugg

SEQ ID NO: 4165749 - RNA, 83 nt, Human
ucacagggccuguucguaguggcagaacuugggucccuggaauuccaggguccauguuuccaguuaauuccaggcaucaguga

SEQ ID NO: 4165750 - RNA, 55 nt, Human
ucacaguaacuuuguugcuuuuuauaagaaugcauaggcaaugggguuguugugg

SEQ ID NO: 4165751 - RNA, 60 nt, Human
ucacagugcaccccucacaggguuucacaugacuuagugaguuauuaugugcacugguga

SEQ ID NO: 4165752 - RNA, 78 nt, Human
ucacagugcuugagaaaguguagauccaacauccaaacauaguugccauugggaaggaacugccuuuagcuucuguga

SEQ ID NO: 4165753 - RNA, 64 nt, Human
ucacauacugaaaguccagugauccaucaaacacacucaggacaagacuuuuuauuguauguga

SEQ ID NO: 4165754 - RNA, 81 nt, Human
ucacauaugguuuauccuuuaccagucgagaggcauuuggauuguuugcacuuuuggcuguuacggauaauaccgcuguga

SEQ ID NO: 4165755 - RNA, 86 nt, Human
ucacaucaauugauuguacaugugcuauuuguuuuguauuccccucagugcauaguacaucagcauauaacaguuaauaguagugg

SEQ ID NO: 4165756 - RNA, 60 nt, Human
ucacaugaagaucccucaauuuaugcucaacuugggccugaggaauuucuuuaugaauga

SEQ ID NO: 4165757 - RNA, 76 nt, Human
ucacaugcacaacagagauaggagcauaguccuggucuucagaacccaugugcucuuuuguacccagcagacguga

SEQ ID NO: 4165758 - RNA, 68 nt, Human
ucacauggacacugguggauauggaauggcuuuuuucugcgcaauucacauccgaccaggucaaguga

SEQ ID NO: 4165759 - RNA, 69 nt, Human
ucacaugguaauguguugaauauuuguacaagucagaggaauguaugaguaguggcacaagcaauguga

SEQ ID NO: 4165760 - RNA, 70 nt, Human
ucacaugugacaugugugagcauguaugugugugugauuguguaugcauguauucaugugugacauguga

SEQ ID NO: 4165761 - RNA, 92 nt, Human
ucacauguggcuuucagauguugaaaaggaaaaguauucauauauaacaaugggaacuuuuuuaguacaauucuugaugugagccacuugga

SEQ ID NO: 4165762 - RNA, 104 nt, Human
ucacauucuuaugcagucacugaggcuaguauaaagagcaugauccauuuggcgaaucagaucaaguucucuaaaguccagugucacagcacaagauaauguga

SEQ ID NO: 4165763 - RNA, 82 nt, Human
ucacauugauguucaucagggauauuggccugaaguuuucuuucuuuucuugggucuguuccugguuuugguaucaggauga

SEQ ID NO: 4165764 - RNA, 72 nt, Human
ucacauugauuacauuccauguauauguuugucuuugacauuucuuuaaacagggaaaagucaucaguguga

SEQ ID NO: 4165765 - RNA, 76 nt, Human
ucacauugugauaaaaugcugacuccacugacggauccugcuggucagugauuucaucauuuuaucaagcauguga

SEQ ID NO: 4165766 - RNA, 61 nt, Human
ucaccaaaaguaauccacugugauacaggaagagcaaacuuacagaaucuacucgugguga

SEQ ID NO: 4165767 - RNA, 100 nt, Human
ucaccaaagaucuccaacugucaaaugcaaugaacucauucucagucuucauuuuccuugaugaguuugcagcauuugacaucauuggcaauuucaguga

SEQ ID NO: 4165768 - RNA, 71 nt, Human
ucaccaaggguuggagguagccagggagggcccacuuucuggguuuaugucacagcuuugcaccuuggagg

SEQ ID NO: 4165769 - RNA, 104 nt, Human
ucaccaagucaucucgccaagcugagaaagcugcccuugugaaacaaggaugguagaauucaugaaacgaggcagcuuugaauacugugagauaauucagguga

SEQ ID NO: 4165770 - RNA, 109 nt, Human
ucucuggccuguaauagauggugaccugaauuuuauuacuagucaacugccaucagagagguaugacaguuucguagggguugggcagcuauuucaagaagggucagga

SEQ ID NO: 4165771 - RNA, 87 nt, Human
ucucuggcuuucgagauaaauuuuugauaaauauguuagccaguuucccucauguuuuaaggaaauguaucaugaaagaugcggaga

SEQ ID NO: 4165772 - RNA, 58 nt, Human
ucucugggacuaggaaauuauguagccuuuuacauaauuaaucuuuaaguuccauugg

SEQ ID NO: 4165773 - RNA, 61 nt, Human
ucucugggacuugaugaaaugacugucagaucuuuuguuaguauucuacaggucccugagg

SEQ ID NO: 4165774 - RNA, 93 nt, Human
ucucugggccuuucccuuccaaauucuagggccuugguucucacuuuauaaggaaaacaggugauaagaagaaugggaggcuggccuggcagg

SEQ ID NO: 4165775 - RNA, 82 nt, Human
ucucugggcuugggaaguguuuaaagcugacuuguucucaucuguauccugugggguuuuaggacauucccaucaccagaga

SEQ ID NO: 4165776 - RNA, 58 nt, Human
ucucuggggccuuucuacaucacucccugguucuguaauuaaguuagguaccuagaga

SEQ ID NO: 4165777 - RNA, 59 nt, Human
ucucuggguauucacugccuuccugauauuagcccuuggaauuguugacuccccagaga

SEQ ID NO: 4165778 - RNA, 58 nt, Human
ucucuguaaaauguggaugauaccugacucccaggcauuuugccaggauuacauggga

SEQ ID NO: 4165779 - RNA, 63 nt, Human
ucucuguagaccugaccagcacgcugucugucuccuugcgguccauggcaaggucugcggggg

SEQ ID NO: 4165780 - RNA, 55 nt, Human
ucucuguauugcccacagcuagauuccuuaacaucucauguguguccuacagaga

SEQ ID NO: 4165781 - RNA, 59 nt, Human
ucucuguccccaucuucuagcuggaauccagaguuccuuguuaggagguuggacaugga

SEQ ID NO: 4165782 - RNA, 63 nt, Human
ucucugugagucuuaagcaccaccuuucuugguccaaagaaaggcaaacugagacacaagaga

SEQ ID NO: 4165783 - RNA, 71 nt, Human
ucucugugggaaguuuggagggaaagguuauccaaccuucaaaagccaaucccuuguccuucccuacagga

SEQ ID NO: 4165784 - RNA, 58 nt, Human
ucucugugugucauggacaagugucauacauagugauuugcacagaaaaccauagaga

SEQ ID NO: 4165785 - RNA, 109 nt, Human
ucucuuacuaacaguaugaaaaauguagauuuuagugucuuauucucuguuaaccaaaaggagauauaguaaaugcuaaagcuuugcuuucauuauuauaaggaagaga

SEQ ID NO: 4165786 - RNA, 59 nt, Human
ucucuucaaugccaacagccagcauucuucaaggugagggcaugagggcagugagcaga

SEQ ID NO: 4165787 - RNA, 59 nt, Human
ucucuuccugacuugcagacagccaccuucuagcugugucucugcauggcaggaagaga

SEQ ID NO: 4165788 - RNA, 63 nt, Human
ucucuucuguccaggugggauuucaaagccugcuggagaagggaauccugggacagaggcagg

SEQ ID NO: 4165789 - RNA, 69 nt, Human
ucucuuggaaagcuugcccacuucucucuuauuugcaacccugaacgaggcacugaagguuccagggga

SEQ ID NO: 4165790 - RNA, 62 nt, Human
ucucuuuaaaguuggagcuugcaaggaaaugaauauaccaccuucaagaaggcuuaaaggga

SEQ ID NO: 4165791 - RNA, 65 nt, Human
ucucuuucuauugcaccaugcuauggccugaucaaagacucaagcaucuaggacagagaaagagg

SEQ ID NO: 4165792 - RNA, 56 nt, Human
ucucuuuuagcuggcagcaucugugaacuggccuugccugccaugcagaaagcuga

SEQ ID NO: 4165793 - RNA, 67 nt, Human
ucucuuuuuugauuucccuuugauaguaaauauaaucagaacuucaaaggguagcccagggaagaga

SEQ ID NO: 4165794 - RNA, 90 nt, Human
ucugaaaacucuugaaaguaucuuauuuugucccuaugaaagaccuagauguacaugaagacagaaagugagcuacaggaguugaaaaga

SEQ ID NO: 4165795 - RNA, 71 nt, Human
ucugaaacuuccaggucaagcuccccuguggucagucaugcuuaccgaggagcacugacgcuuguuuuaga

SEQ ID NO: 4165796 - RNA, 81 nt, Human
ucugaaagauuggcuuuauacauaagaauaaggacuauauccaucaauuucuuuuucuuauggugaagcacaaaugucaga

SEQ ID NO: 4165797 - RNA, 69 nt, Human
ucugaaagcuuugggacagugugaccuuucaggaggaaaauuuaaucugcugucaaaagggcuaacaga

SEQ ID NO: 4165798 - RNA, 93 nt, Human
ucugaaaguagguuuccuucuuuccaagaaugcagauaccuuguuggaaagcaaaguuguaugucuuagaaaguagaaacacggcugaucaga

SEQ ID NO: 4165799 - RNA, 57 nt, Human
ucugaaaugcuugggaccagaagucuuuuagacuuugguuuuuuuguguguuuugga

SEQ ID NO: 4165800 - RNA, 72 nt, Human
ucugaacaucuaguuccuauauaauaacagaaaugucuuaaauauuuauuaauaugggacuggauuaguagg

SEQ ID NO: 4165801 - RNA, 74 nt, Human
ucugaaccugaggccagcuucagcaguggacaaaguugcagcuccauuccaggcacagaguuggucaguucaga

SEQ ID NO: 4165802 - RNA, 69 nt, Human
ucugaagaacuuuaaagcacuuaugaaaaguaugaugauacucauggggucacuuuagaguacacaaga

SEQ ID NO: 4165803 - RNA, 59 nt, Human
ucugaagcacagaaguucaauuuuccacugccagaaaguugaguuuuauguguuacagg

SEQ ID NO: 4165804 - RNA, 85 nt, Human
ucugaagcugcaagaagccaaucgugugaacuuaguaaucaauuugauuaaugugaauaaaguuggcauuuugccuccuuuauga

SEQ ID NO: 4165805 - RNA, 57 nt, Human
ucugaaggaaaaggguagauauuccaaaagugguuuaaaaccuuuagauccuucaga

SEQ ID NO: 4165806 - RNA, 67 nt, Human
ucugaagggcaggucagaaguagaauaguguuuguucugaugccuuugaaguugacugccuuccaga

SEQ ID NO: 4165807 - RNA, 71 nt, Human
ucugaaguuacauuuuggucuaauugcuagauugaaaauaucuguuaaugugucugaaaugucauuuuuga

SEQ ID NO: 4165808 - RNA, 79 nt, Human
ucugaauaccugaggcaaaaacacugauuaggcugugucccccuguuagcuuuguggggucuuuccucaaauccucaga

SEQ ID NO: 4165809 - RNA, 71 nt, Human
ucugaauagagagagguccuuuaaaaaugucguucuggaauuuggcaaauuaguaccucucuccauugagg

SEQ ID NO: 4165810 - RNA, 59 nt, Human
ucugaaugagaacaacagcauugcucuuuucguaguguuguaauaaauaucaucuuaga

SEQ ID NO: 4165811 - RNA, 81 nt, Human
ucugaauuaaaacaaaacacagcuaacuuaaacuaaccuaaacucguuuagagagguuugaauuggcugccuaauuacgga

SEQ ID NO: 4165812 - RNA, 73 nt, Human
ucugaauugggaauaacguaauaacaugcagcuggggagcuaggcuguguuucuugcguuuuccucuuucaga

SEQ ID NO: 4165813 - RNA, 80 nt, Human
ucugaauuguuuuaaguagagucgucuggcuucuggggacuuucuccagugaucagcuagaucuacuuguccaauccaga

SEQ ID NO: 4165814 - RNA, 57 nt, Human
ucugacaauaacugaguuuaacugaguuuagacaguuuaauuuaguucuuguuuaga

SEQ ID NO: 4165815 - RNA, 60 nt, Human
ucugaccaggcuggcucagggcuuccuggagugggcagcucuggagcugggccuggcagg

SEQ ID NO: 4165816 - RNA, 66 nt, Human
ucugacccuuuaggguauguuuauacuaacacuauuaguucuuggauaaaaucuguaaggcucaga

SEQ ID NO: 4165817 - RNA, 129 nt, Human
ucugaccuuuucuuuuaaaauguuuuucaagggaagucagugcuggcagcagggucuagauugauggcaucagaugcugagaaguggagccucugccucacgucgcuucaauugguacuuugggucgga

SEQ ID NO: 4165818 - RNA, 55 nt, Human
ucugacucuuggaaauagccuaacaauacuuugaacgguuauuugaggguuaaga

SEQ ID NO: 4165819 - RNA, 67 nt, Human
ucugacugacuuuggacuuuauucuuuaaacaaauugcagagaauagagaaaaagguuauuuacaga

SEQ ID NO: 4165820 - RNA, 75 nt, Human
ucugacugcugguuagucuuagugggauuuguuuggcuuuuaugaaugccauuaaauuuuaaugugcagaucaga

SEQ ID NO: 4165821 - RNA, 68 nt, Human
ucugacugggaggguucagcuggguugcaucuguucuguguaccucuuuucccccuccuagcaucaga

SEQ ID NO: 4165822 - RNA, 56 nt, Human
ucugacuuaugcuaaaggggagggguacauaaucucuguccuaauagacaagcaga

SEQ ID NO: 4165823 - RNA, 55 nt, Human
ucugacuuccuccacaucuguuccaaauuuaaagaacucaugugaugaaguuagg

SEQ ID NO: 4165824 - RNA, 90 nt, Human
ucugacuuggaaguccauuuggagaagucuucagcuuguucacacaauaggcaaggguaaaggcauucaagauggaaguugaaguacaga

SEQ ID NO: 4165825 - RNA, 77 nt, Human
ucugagaacaucauucagauauuuuauaguggacuuuucuuaauuucuucccauaauaucaaggugauguucccaga

SEQ ID NO: 4165826 - RNA, 62 nt, Human
ucugagaagcuagaggacaaaguaaggagacuuuccacugaauauccuuugcuaucuuuuga

SEQ ID NO: 4165827 - RNA, 56 nt, Human
ucugagaaggagaaaacagagagccugggaggguucuuuguuugccuuuaucaaga

SEQ ID NO: 4165828 - RNA, 58 nt, Human
ucugagaagugcaggacuuggccuccucacagugagugcagagaccugucuucacaga

SEQ ID NO: 4165829 - RNA, 98 nt, Human
ucugagaggggaaaauuggcagguggguggaggugcguugagcugcacauggggcccagcugcagcugccuccuucccuuguacuuccucuacugaga

SEQ ID NO: 4165830 - RNA, 98 nt, Human
ucugagauuagagagccagaguucuuuggaguauuuucuagcugaauuggaaaaccuugauucugcauguguuucaaauacugaggcuuuuuaacaga

SEQ ID NO: 4165831 - RNA, 70 nt, Human
ucugagcacccuuugcacaucagucguuucuugucuaucacuugcaguggugugcuggagcuugcuuaga

SEQ ID NO: 4165832 - RNA, 65 nt, Human
ucugagcacuuuagaauuuagaguugcaauugaaugccagcuguggagauggggugcauaucaga

SEQ ID NO: 4165833 - RNA, 56 nt, Human
ucugagccacagauguccuguuuccucuaugagggacuauaggccagguggccagg

SEQ ID NO: 4165834 - RNA, 62 nt, Human
ucugagccaguauagaauaguuaaggacaagggagcccugcuugcuucuguuugggcuuaga

SEQ ID NO: 4165835 - RNA, 83 nt, Human
ucugaggcaggcacuuugcugggggcgcacacaggauuccaaaacccacugugaaaaugcacaccccagggagugcauucaga

SEQ ID NO: 4165836 - RNA, 64 nt, Human
ucugaggccucuguucaccagaauuaugccugcuuccuaacacuucugccuccagagcuuuaga

SEQ ID NO: 4165837 - RNA, 56 nt, Human
ucugaggcugcaucuaugugacucaguugagagucugagguccaccaguuugcaga

SEQ ID NO: 4165838 - RNA, 60 nt, Human
ucugaggggcuggaagggcugcuuucuugugaaaaagaguccuuuuugagucccuugaga

SEQ ID NO: 4165839 - RNA, 69 nt, Human
ucugaguaaugucugccucuauucaguucaacagcccacaaagagaguaauagacaaagacaugccaga

SEQ ID NO: 4165840 - RNA, 57 nt, Human
ucugagucagauuggcaugcuugcagaaguaaaacacuuccauguauuugaaacaga

SEQ ID NO: 4165841 - RNA, 64 nt, Human
ucugagugacuuaauucuggcuguuugaaaagauaugaucaaacacuagcaggaagcacugaga

SEQ ID NO: 4165842 - RNA, 74 nt, Human
ucugaguggcccugagcccuuugacagaguccccuuugggacuacacgcugucagacgugcagggcuggacgga

SEQ ID NO: 4165843 - RNA, 95 nt, Human
uccugugucucucccuuccuuagugccucuuccgcugcacaugcuggguccugggcgagguacuggggcuguaacggggaacgaaacaaacaggg

SEQ ID NO: 4165844 - RNA, 58 nt, Human
uccugugugccuuaagcucuauagacaaagaugcuauggaaacagagggcauuuggga

SEQ ID NO: 4165845 - RNA, 67 nt, Human
uccuguuaagagcuuggacacucuucaguaguaauggggaaugagaauuacuguuuuuauaacagga

SEQ ID NO: 4165846 - RNA, 62 nt, Human
uccuguuauugacucucuuguggcuucuuucuucaucagagaagcaaguggcucaaccaggg

SEQ ID NO: 4165847 - RNA, 63 nt, Human
uccuguuauuugcacaacaugaguaaaccugguggacauuauguuaagugaaauaggccagga

SEQ ID NO: 4165848 - RNA, 66 nt, Human
uccuguucugauguguuuuaguuugguaauagcagcuguuaaagagucuacugcacaucccaagga

SEQ ID NO: 4165849 - RNA, 68 nt, Human
uccuguugcuguagugguuaaggggaaacauaguuuauuauuuccuagggcaaugccagaugacagga

SEQ ID NO: 4165850 - RNA, 99 nt, Human
uccuguuguaauuuuauaguauaauagggaugggaaguagggauguugauacauuaaaauauacuuucaauucacugagauauaugaaauagcagagga

SEQ ID NO: 4165851 - RNA, 87 nt, Human
uccuguuucuacuaaaaauacaaaaauuagccgggaguaguggcucaugcccguaauccuagcuacuucuccuaggcugaggcggga

SEQ ID NO: 4165852 - RNA, 124 nt, Human
uccuguuuguuucuuaucaucacacagacucagaaucugccaaguucaggaauccacuucggcugucuggguugucuuggugaggaugaugauggucauguuaaaggugaaagagacagcugga

SEQ ID NO: 4165853 - RNA, 92 nt, Human
uccuuacaaauuaucuugcagugaaacaaaaugguaauguugcucaagaagcugggucuugagucacacauuucuucauacaauauagaggg

SEQ ID NO: 4165854 - RNA, 75 nt, Human
uccuuacccuucaggaaugaggauaaacauugcucccccaggauagcauugcgucauuucuggagugucuuagga

SEQ ID NO: 4165855 - RNA, 69 nt, Human
uccuuacgucuugugacuugauaggguagaguagaaaauguauuucuuuuaagacacacagauuaagga

SEQ ID NO: 4165856 - RNA, 58 nt, Human
uccuuagagauacugucuugaauucaguaccauugcucuauuacaguuucuuucagga

SEQ ID NO: 4165857 - RNA, 63 nt, Human
uccuuagcagcucugauucugggcccaauuuguagauuugggggguuucugagcagcuaauga

SEQ ID NO: 4165858 - RNA, 70 nt, Human
uccuuagcuucuuacuuaaugcgauucugcgaagcagccaacuuugugggaugcaggaguugaagaagga

SEQ ID NO: 4165859 - RNA, 56 nt, Human
uccuuauaacaacaggaguggaaugcaucuaccaccuuuguuggauuuguagguga

SEQ ID NO: 4165860 - RNA, 56 nt, Human
uccuuauagcccaagugauggagucagccucccucagagcacauggguuuugugga

SEQ ID NO: 4165861 - RNA, 57 nt, Human
uccuuaugccaggauggcugcuauaaaguaagcuaagccuugaucuugguaacagga

SEQ ID NO: 4165862 - RNA, 62 nt, Human
uccuucagcuuauuucuuaggaaauuaccuccagaucuacccaagaaacaaaggcugcagga

SEQ ID NO: 4165863 - RNA, 80 nt, Human
uccuucaggagaauauauuugagaauauucaugagacuuggcaacagcucuugcacuucaugaauauguuuuccuguuga

SEQ ID NO: 4165864 - RNA, 60 nt, Human
uccuucaucaucaagguaugguuccuggaguagcaggacaggaugcugaagaugaaguga

SEQ ID NO: 4165865 - RNA, 57 nt, Human
uccuucauuaagcaugaggcagccacuggaggcuuugcugccucagggcuuugagga

SEQ ID NO: 4165866 - RNA, 55 nt, Human
uccuucauuucuccugauuuguauguuuuauuuucaggucuauagaagaggaggg

SEQ ID NO: 4165867 - RNA, 69 nt, Human
uccuuccaagugcugcuuuuuccuugacuguuguaauuauaucuaugaggagagggaggauugugagga

SEQ ID NO: 4165868 - RNA, 58 nt, Human
uccuuccaggugcaggcaagccugaggcgucagggcagcaggcggccgccaggaagga

SEQ ID NO: 4165869 - RNA, 119 nt, Human
uccuuccccucuauaacauugaacuaguuuagcuuuuuaagacguuuauccuuaccuuccuuucauuuuagucauauguguuuuagaugagugcuguuccaauugucuaugguuaagga

SEQ ID NO: 4165870 - RNA, 125 nt, Human
uccuuccugccuuguaucuuaugacccaggguuggcccugugggagcccaggcagauauguaagccuuaauugacucauuucugucuccuacaggcucccuggccaugaaggucugcaggaagga

SEQ ID NO: 4165871 - RNA, 55 nt, Human
uccuuccuucauucaacaaauaguaauuaacugugauucucagaagagggaagga

SEQ ID NO: 4165872 - RNA, 79 nt, Human
uccuucuacaguaaccuuauuugucauuagaaugcaacucaauccucuaagauugucaggcuugcuguauugccuugga

SEQ ID NO: 4165873 - RNA, 64 nt, Human
uccuugcuggccauucucuuugagaugaaaggacugcagaucaagcuguauggucagagaagga

SEQ ID NO: 4165874 - RNA, 88 nt, Human
uccuuggagcauagauguuuagaggucaggugaggaauuaagauuuauaucuuaacaguuuccugagccugaguuguaauucuaaggg

SEQ ID NO: 4165875 - RNA, 56 nt, Human
uccuuggcaagcugcaaugggauugaaaaagaugaaucacaaaaguagcucaggga

SEQ ID NO: 4165876 - RNA, 113 nt, Human
uccuuggccuggcugcccuuccugggaggcuguguacuugcagcaauaacgaugacucgaacaacgucagcaacugcagcugccucccggggagggccugcgccagccagggg

SEQ ID NO: 4165877 - RNA, 102 nt, Human
uccuuggcuccuuuuccuccugggaaaugaaggggcaguggcccagccucucguagcauuucucccuccuucuauuuacucgguuggaauggcugccaaaga

SEQ ID NO: 4165878 - RNA, 79 nt, Human
uccuugggcaguuuggucucgcucaauucuggccccgcuggucagggaugagcagauggagcaacacuuugcaaaggga

SEQ ID NO: 4165879 - RNA, 104 nt, Human
uccuugguggugugagaccuguuggguuauguccugguggguuaaccaauccucccgaaccucgccaggacucuuccuagaaggugcucaagaauuuaucugga

SEQ ID NO: 4165880 - RNA, 56 nt, Human
uccuugugccaucagcagugagggaaagaacauuucugccuugaaugguacuggga

SEQ ID NO: 4165881 - RNA, 81 nt, Human
uccuugugucugcaggacuuagggccuugacuucuugccggcucucagccggaggcugcccucagcuccuggacacauggg

SEQ ID NO: 4165882 - RNA, 115 nt, Human
uccuuguuaagggauuauuuuuaccacagacaccuaauagaugaauucacauaaacgcauguuuguugcaggauuauguguaggggugaaaagccuaaguguacuaugacaggga

SEQ ID NO: 4165883 - RNA, 59 nt, Human
uccuuguucuagucagaaauuucuaggugcuuaccuaggccacagaugagacauaagga

SEQ ID NO: 4165884 - RNA, 129 nt, Human
uccuuguucuuuucuuaguugaacuucauuacuuguaccaauccuuuaaaacaacaaaacuuacugauuugguuuagaagggcuggucagaaauggcagucucugauuaaagaccuaagccaacuugga

SEQ ID NO: 4165885 - RNA, 97 nt, Human
uccuuuaaguccuuggcaaugauuucagagcuggugucuacagcugcaucugacaugguggggcacgccggugaucugaugcaggggauuaaaaaga

SEQ ID NO: 4165886 - RNA, 70 nt, Human
uccuuuacaaacaauuuaacaugcaaauuguuugcaucaaaguaugagugugagugaguuuguggcagga

SEQ ID NO: 4165887 - RNA, 74 nt, Human
uccuuuagcuuuuuauaaccagaaaugauccagaguauuuguaaucacaugagguuaugacaaagcaaaagaga

SEQ ID NO: 4165888 - RNA, 82 nt, Human
uccuuuauuuuugagaauagcaugaugucuuuuggugguguuuggaagauauaauaacuguugucaucccaagauagggaga

SEQ ID NO: 4165889 - RNA, 80 nt, Human
uccuuucaagcauggcucaggucuuacccaugccugagaagauuuucuuagcugggaauuaucugguugcauggaagaga

SEQ ID NO: 4165890 - RNA, 67 nt, Human
uccuuuccacuuuucucucucaugccuuuugcucuucccuggagguggaggagagaaguggaguaga

SEQ ID NO: 4165891 - RNA, 56 nt, Human
uccuuucugacuccugauauuaugaauagagaugaugcagcagaguaagcagggga

SEQ ID NO: 4165892 - RNA, 61 nt, Human
uccuuucugggccucagugacuccucugcaaaggggcgagaaagucacagcccaggaggga

SEQ ID NO: 4165893 - RNA, 56 nt, Human
uccuuucuucuucugcccauggccuccuuccugcuaugcugggcuuggagaaaaga

SEQ ID NO: 4165894 - RNA, 118 nt, Human
uccuuucuuggggaauauugcaaagugucuucaauucaauugcauuucuguggucgugggguuuuauauaauuacagaaguucuguaguugauuugaauguuauaucccuguugugga

SEQ ID NO: 4165895 - RNA, 85 nt, Human
uccuuugacaacaauaauguggagcugaacacucaugacugcauuagugacuuuuaauuaacuccaccuuaagugugucugagga

SEQ ID NO: 4165896 - RNA, 74 nt, Human
uccuuugaccuuuuuacuguguacgcugugcuuggugcuuuacuucagcuacuugcaguggaaaagaagaaggg

SEQ ID NO: 4165897 - RNA, 64 nt, Human
uccuuugagggugugaucaaugccauagcgacaugaaguaaauauggcucaggccaucaaugga

SEQ ID NO: 4165898 - RNA, 55 nt, Human
uccuuuggaacugacuccguuaacucuuugagggacagcaguagguuuuagagga

SEQ ID NO: 4165899 - RNA, 129 nt, Human
uccuuuggaccugaagcuccucgaagguagauacuuugcuuuauucacaucuauauucucugucuaggagaguauaugcacauaacagggacuauccuuugauggcuggcuauuguuguauacaaggga

SEQ ID NO: 4165900 - RNA, 72 nt, Human
uccuuugucagagcacugaguugugggccuuuuccgguaaggcccuuauaaaauguguucuguuuugaagga

SEQ ID NO: 4165901 - RNA, 56 nt, Human
uccuuuguuacugcugaccuucuccucccugggccuuucucagcaaagacaaagga

SEQ ID NO: 4165902 - RNA, 85 nt, Human
uccuuuuagcauauuuugauguauguaauccuuuuuucccccaaauuugauggguaacacuuuggauuaaaauucuguuugagga

SEQ ID NO: 4165903 - RNA, 94 nt, Human
uccuuuucagccucuuuggucuccgucaucaaucaccgggaaugguuuuuaccugaaacugaucuugcuggagaauuaacuggguuugagggga

SEQ ID NO: 4165904 - RNA, 65 nt, Human
uccuuuucuccuuuagcagauggaguacucucccaaucagaucaugcaagaauaauaggaaggga

SEQ ID NO: 4165905 - RNA, 65 nt, Human
uccuuuucugcaccuugcgaugugaacuuugauauucuguaaugucuggggcgccagaagagaga

SEQ ID NO: 4165906 - RNA, 58 nt, Human
uccuuuugcugggaucaucagggaaaguccuucucauggugauagcacaguuaaggga

SEQ ID NO: 4165907 - RNA, 72 nt, Human
uccuuuuucacagacugugagugauuucaauaguauaugaaaacuaugacucagaggcuggaaaucaaaggg

SEQ ID NO: 4165908 - RNA, 62 nt, Human
ucgaaucuugguuaacuaugugauuugcggcauuagcaaaugcaaagcaagcagagauuuga

SEQ ID NO: 4165909 - RNA, 90 nt, Human
ucgaauuaaggcuucuguaguucuuacaagucacccgcuuucuuucaggaggaauguuaaagauuaagagcggcaagaagucagagucgg

SEQ ID NO: 4165910 - RNA, 85 nt, Human
ucgacagcauuguacacuggagcccuuggggucuggcaucagcccagagaccuuaguagcuuuuaaugguugcauucucuguuga

SEQ ID NO: 4165911 - RNA, 79 nt, Human
ucuauuugaaauaugaggcauuaugagaagacuguuaaguuuugaaaucacucacugucuuauuuuugcaaguuuugga

SEQ ID NO: 4165912 - RNA, 83 nt, Human
ucuauuugaucucauuugaucaugugcuaugagguaggcacuauuaacucuauuauauaggugaauaaaugaguuuagacaga

SEQ ID NO: 4165913 - RNA, 84 nt, Human
ucuauuuuucucaaucacaaagguucugucaaguaauacaaagucaucugguggcuuuacaaggcagaacugauuaaaaaugga

SEQ ID NO: 4165914 - RNA, 59 nt, Human
ucucaaaauaucacuuguguuuagauuuguuagagaucaaugaaguggcuauuuugagg

SEQ ID NO: 4165915 - RNA, 71 nt, Human
ucucaaauaaugaauggguuuaauauuuuagguggaugccaacauaaaaugccagaccaguucacgugaga

SEQ ID NO: 4165916 - RNA, 70 nt, Human
ucucaaauaggccuugguccugaccuaacugaacaggauagguuaggucaggaccaaggccuguuugaga

SEQ ID NO: 4165917 - RNA, 73 nt, Human
ucucaaauggguuaaaaguugaaugaauugacacccugauguuaugauguuggaauuuuaacuuaaacuggga

SEQ ID NO: 4165918 - RNA, 68 nt, Human
ucucaaauucucaucuuucuggucaaaaaaugguuggaagauuuuguccaacuagaaagguuuugaga

SEQ ID NO: 4165919 - RNA, 84 nt, Human
ucucaagacuccuaaauaaagcauuuccccugugugggcgaccccugggucccauguggggucaguguuugggucucucugaga

SEQ ID NO: 4165920 - RNA, 70 nt, Human
ucucaagacuuagagcaucuugaaaauagggaucaugucuuacuuauuucuuuggucuccaagucuaaga

SEQ ID NO: 4165921 - RNA, 59 nt, Human
ucucaagauauagaggguucuagaguugguugauucaguggcccaaugucaucaugaga

SEQ ID NO: 4165922 - RNA, 82 nt, Human
ucucaagucuuuuuuguagauguaguuuuuauuuagauaugaguugaggcagcaaaauauaucauaagagggcaucuugggg

SEQ ID NO: 4165923 - RNA, 79 nt, Human
ucucaaugcuuugacaugggaagugcuugauugaugucuauuaaaaugaaucaacauuguuuuaagucaagcaaugagg

SEQ ID NO: 4165924 - RNA, 66 nt, Human
ucucacagaagagcauuaagaugacauagugccauacacaacucgcuuauuagcucuuuagugaga

SEQ ID NO: 4165925 - RNA, 57 nt, Human
ucucaccaaagccuugaccauaggcagaggguaccaguggaaaagguggggugaaga

SEQ ID NO: 4165926 - RNA, 79 nt, Human
ucucaccuccagauggugcaggugaagugcugguggucuucgcugguccccagacucaucugccauugcuggggagaga

SEQ ID NO: 4165927 - RNA, 65 nt, Human
ucucacuccugguuuguguccuggcuccacuagacagagugagcucccagaagccagagucgggg

SEQ ID NO: 4165928 - RNA, 92 nt, Human
ucucacucuugaaauauaaugcaauaccuuuuuaugcugcuuucuguuaucacggcagcaugaaaaguguugcuaucuuucuuugggagagg

SEQ ID NO: 4165929 - RNA, 87 nt, Human
ucucacuguucucucugcucacgccaccguucaucagacucuaguccauggucagaacucagcgugcuuguagaugagauaauggga

SEQ ID NO: 4165930 - RNA, 88 nt, Human
ucucacuuacgugaccugccugggcucgguagccaucgaguuugcauugcuugaugccacggagcccaggcaagucacauaaaugaga

SEQ ID NO: 4165931 - RNA, 119 nt, Human
ucucacuuccauuguggccuuuugaguuucagauuaagccugacauccaauuacguggauuucguacaggccugauacacugaacucugcguguucuuggccucauggaacauuuggga

SEQ ID NO: 4165932 - RNA, 105 nt, Human
ucucacuugauuuccacaauuguugcuguaacgauggacuacugaggagagaaacuuaauuucucuggcagaucuucccacguuuaagcaacauguucauggaga

SEQ ID NO: 4165933 - RNA, 56 nt, Human
ucucagaaauuacaaaagggacauuuaggaauuguucacaaggugaugcuuugaga

SEQ ID NO: 4165934 - RNA, 64 nt, Human
ucucagaaggguggugcuggagccccaagaagcagacaagaaggggagcccagauccuuuggga

SEQ ID NO: 4165935 - RNA, 82 nt, Human
ucucagaaguauuaugcuaaaggaaagagacagaauuaaagcacuacauacugcaugaguccauuuacaugauauuuugaga

SEQ ID NO: 4165936 - RNA, 92 nt, Human
ucucagaaucuagaauugucacuggaaguucuaaauacccaggacuugugugcuaaauuuagacuucccagcacugugacuggcauuuugga

SEQ ID NO: 4165937 - RNA, 61 nt, Human
ucucagagaccugaacucccugaaacccacuuucagagaacaguaaggcagguuucugagg

SEQ ID NO: 4165938 - RNA, 57 nt, Human
ucucagagcuucaguuauuuucuuuguagaacaagagagguuggacucaacucugga

SEQ ID NO: 4165939 - RNA, 56 nt, Human
ucucagaggcccgacguucuccaucuggcugauccugggagccucguccucugugg

SEQ ID NO: 4165940 - RNA, 106 nt, Human
ucucagauuucuaaaacaaugaucaacugccccaaauguauuugagcauauagaaaauauugaaagauaucauugagguuguugacauguguuauggagaaugaga

SEQ ID NO: 4165941 - RNA, 58 nt, Human
ucucagcaacgauccggaguaagucacuggacuucguaccacuggauguuggugauga

SEQ ID NO: 4165942 - RNA, 95 nt, Human
ucucagcaccagguauuaaguguuuuacauacauuauuauguugugauaauuaaaugagguaaugcacauagaaguacuuaguacagugucugga

SEQ ID NO: 4165943 - RNA, 75 nt, Human
ucucagcuuccccuuuguaagauggaaacgcaguacuaauaugugcacuguuuaauuucacaaaguugacugaga

SEQ ID NO: 4165944 - RNA, 57 nt, Human
ucucaggaagauuagggcuaaggaugcuauuguccacagcccuguaaauccccugga

SEQ ID NO: 4165945 - RNA, 58 nt, Human
ucucaggaggaggguacaccaucaguuuacacauugauugcagccacucuuccagagg

SEQ ID NO: 4165946 - RNA, 70 nt, Human
ucucagggcucagagcucaggcagaccuaaguccaaaucccaucucuagcuuuagcucuauguccugagg

SEQ ID NO: 4165947 - RNA, 61 nt, Human
ucucaggggcccuucccucagcaggucaagagacauucucugcugggcaggaccccucaga

SEQ ID NO: 4165948 - RNA, 126 nt, Human
ucucaguaaaaaugucaauggcugugauuuguaaauagcaaagccuggcacaaugauaauaaacaacuaugaagcucaucagugcuguuuuacuuuugcagauuacuccaucgauuauuacuguga

SEQ ID NO: 4165949 - RNA, 66 nt, Human
ucucaguacugcuugugggagcagaaauuaauguccuguuuuuagcuagccuguguguacuuggga

SEQ ID NO: 4165950 - RNA, 76 nt, Human
ucucaguaguuuacacugugaaacagguaucuugaacacacccauuggaucccuuguccacgguguauaugcugga

SEQ ID NO: 4165951 - RNA, 97 nt, Human
ucucagucaagcuaguaguguauuaaugcuccaggaguuguaucccacccccagugcacccuggcugauuuacugaauucuggcuuugaaucagaga

SEQ ID NO: 4165952 - RNA, 92 nt, Human
ucucagucuguuucccuaugcgugccucugucugucugugggugucucuaagucucuguagauagacagguagguagggagagagaaagaga

SEQ ID NO: 4165953 - RNA, 70 nt, Human
ucucagugucuguuuuccuccugguuucugccccugagagugaaguugggggcagggagggauacugagg

SEQ ID NO: 4165954 - RNA, 83 nt, Human
ucucaguuucugccuuggaucagaugauaucuuuguugguccuuuucugacaugaggugcuauaggucuacaguuuacugaga

SEQ ID NO: 4165955 - RNA, 59 nt, Human
ucucaguuuuguauguuguaagucugguaggcucagcuuagcaucuuacaaugcugagg

SEQ ID NO: 4165956 - RNA, 97 nt, Human
ucucauaauuggguugcacuuugcuguuaguaaaggagcuguuucguagucaaaaggaacaugcauucucuaaaagcaaauuuuaagcuacuggaga

SEQ ID NO: 4165957 - RNA, 62 nt, Human
ucucauagcuguaguggugaaugauuuuggcuucacaaaagaccauguuuacagcuaggagg

SEQ ID NO: 4165958 - RNA, 74 nt, Human
ucucauaguccaggaugacccccacuuuccuaggaggcucaggaaguuucagguugguucugggcucagugaga

SEQ ID NO: 4165959 - RNA, 73 nt, Human
ucucauauccaguguuuuucuucacagguuuugcacacuagggaccaagaagcccucggggacacugcugaga

SEQ ID NO: 4165960 - RNA, 59 nt, Human
ucucauaugugcaaaugugaguggcaugaaaauagcaugccagcauguacacaugugga

SEQ ID NO: 4165961 - RNA, 85 nt, Human
ucucauccuggccucugagucaagaacccagugaacugacuuucuaguucuagaaguuccgcugcaaggccaggaaagcuugaga

SEQ ID NO: 4165962 - RNA, 65 nt, Human
ucucaucuagaaugaccuccucuuagcuugauuauaucggggguaggacuugucuuucuagggga

SEQ ID NO: 4165963 - RNA, 61 nt, Human
ucucaucuccucccacagccccagcccuaauguagacagagagcucugaugggaggugaga

SEQ ID NO: 4165964 - RNA, 77 nt, Human
ucucaucuucuucaucuguaaaacuuggauaauaauaggaccuacaucacaggguuguugauggggauuacaugaga

SEQ ID NO: 4165965 - RNA, 86 nt, Human
ucucaugauuugcuuagugucaaauagccugagcuugcuuuaccagaacuaucugcaacaucaggaucuuguuacaguaaaugaga

SEQ ID NO: 4165966 - RNA, 84 nt, Human
ucucaugcagucauucuccaaaagggagcacuuucuguuugaaagaaaacaaagugccuccuuuuagaguguuacuguuugaga

SEQ ID NO: 4165967 - RNA, 61 nt, Human
ucucauggucuugauuuuccauagguucuugugacuucagaguuaguuauagaccaugaga

SEQ ID NO: 4165968 - RNA, 59 nt, Human
ucucauguguguguguguguauaugugugggcacauguucaugcaugcacaggugcaga

SEQ ID NO: 4165969 - RNA, 66 nt, Human
ucucauguguuguuaguaccagcaguccuuaggggcuguggggaccaacaggacuaaaucaugaga

SEQ ID NO: 4165970 - RNA, 70 nt, Human
ucucauguuuuucaaaagaagaaugcuugcacacaaauaacacaggcaacucaucaugaaagacuugaga

SEQ ID NO: 4165971 - RNA, 56 nt, Human
ucucauucaaacagcccuuuaugugugguggguacagaugaaggcacugaguggga

SEQ ID NO: 4165972 - RNA, 73 nt, Human
ucucauuccaugcuuccaacaguucugugaaguaaaguuaucuacauucuacagauaggaauaugaaugcaga

SEQ ID NO: 4165973 - RNA, 106 nt, Human
ucucauugauguaacaggcacacaccaaucaaaugucagaagaacacagaaaauuaucugacuagggacuugguguaugcuuguguguaugugugcaugugugaga

SEQ ID NO: 4165974 - RNA, 68 nt, Human
ucucauugcagcggcuauuccauuauuaucuucaauauacugaugaagaguaccacuguuagaugagg

SEQ ID NO: 4165975 - RNA, 55 nt, Human
ucucauuguccaauugaauuuaaauaguuuucuagauuuaauguggaaaaugaga

SEQ ID NO: 4165976 - RNA, 77 nt, Human
ucucauugugcaucacagaacucauacaggagagaaaccuuaugaaugcagagacugugggaaagcauucaguggga

SEQ ID NO: 4165977 - RNA, 69 nt, Human
ucucauuuacuuccacaggcugguucauccucaaagcccuccuuacguagaucugugggaucagugagg

SEQ ID NO: 4165978 - RNA, 106 nt, Human
ucucauuugauuuuuguauguuugguucaacuguucacacugaugugacgucucaggcaucacaucagugugaacaguugaaccaaacauacaaaaugcccugaga

SEQ ID NO: 4165979 - RNA, 88 nt, Human
ucucauuuuagaccugcugcuaauuucaaaauccuacaggcauuaaagaugcuaaggagggucuugcaaauuagccucuauuauguga

SEQ ID NO: 4165980 - RNA, 65 nt, Human
ucugaguugcuccuccugucugugggcccugggggaauuagguacagaaggaguagucacuaaga

SEQ ID NO: 4165981 - RNA, 87 nt, Human
ucugaguugugacucucuggagaugguucucaauugguucucuugccaguucugacaauaucuccauggcccauuccacaacucaga

SEQ ID NO: 4165982 - RNA, 76 nt, Human
ucugaucugggguggcagaauguuuaagaacauaagcugcacucagacagcaguucauaaacauuuugaggucagg

SEQ ID NO: 4165983 - RNA, 59 nt, Human
ucugaugauaaagcauccuuuaaaaauucugaauaauuuauuggaugcuugcuuacaga

SEQ ID NO: 4165984 - RNA, 80 nt, Human
ucugauuaaaaucucaguguucuaagcauuggaaguaauacuuuuuccaagcagcaacaaacuggauaaaaauuaucaga

SEQ ID NO: 4165985 - RNA, 82 nt, Human
ucugauuauguauccgugguuuuauucaugaaauuuguuuuuagcuaauacagcuuuuuucggaauaaauacgaacaucaga

SEQ ID NO: 4165986 - RNA, 66 nt, Human
ucugauuuauaauuuuaaaagaucacuacggaaaaugacguguaggcaucugagauuauaaacaga

SEQ ID NO: 4165987 - RNA, 77 nt, Human
ucugauuucugcacccuucuggguuggaacaagcccuuuugcuuccuuuuucccucccagggugcugguaggucaga

SEQ ID NO: 4165988 - RNA, 64 nt, Human
ucugcaaauuuugcugcuggaauuuuuggaauuuaccaggagguguugauagaagguuugcaga

SEQ ID NO: 4165989 - RNA, 69 nt, Human
ucugcaaccugaauucugcuuuggcaugugucauaccauauucuuagguuccagagauuagggugugga

SEQ ID NO: 4165990 - RNA, 62 nt, Human
ucugcaagugacccgggcccagccccugggauuauuuggcaagcgccuguugucacugcaga

SEQ ID NO: 4165991 - RNA, 82 nt, Human
ucugcaaucagcaucaacaaugaacauaaauaaguacacuuccuuuuuauuaauaguuacauaguugaaaugcaguugagga

SEQ ID NO: 4165992 - RNA, 84 nt, Human
ucugcaaucugugauaguuuguuacuuuuuccuugucuuucaugaucuggaaacuagaagaauacuagucaguuguuuuguaga

SEQ ID NO: 4165993 - RNA, 69 nt, Human
ucugcacacagccagcugagggcuacaccuuguagggccagguaucuagauccuauggcugugugcaga

SEQ ID NO: 4165994 - RNA, 60 nt, Human
ucugcagagccucaggagaacaagaccuagcccuuccccuuuuucugcaggcacuccaga

SEQ ID NO: 4165995 - RNA, 77 nt, Human
ucugcagaggacagguuuuccaugggcuuuuccccugggugagaccaguggcaugccuggaaagcccucccugcaga

SEQ ID NO: 4165996 - RNA, 63 nt, Human
ucugcagggcuggggcugcuccugaguuucugguaaggccuucgggagucccagcucugcgga

SEQ ID NO: 4165997 - RNA, 100 nt, Human
ucugcagggggcaggagagucagguggccccucgaggccucagggagucaccccuuggcccagccaccucggcuuucucugcucaccuacaacuugcagg

SEQ ID NO: 4165998 - RNA, 62 nt, Human
ucugcaggucagugugcagcuguuucagcaucaccuccagcugguacaccuugccugucaga

SEQ ID NO: 4165999 - RNA, 59 nt, Human
ucugcaggucucugugugcauuccggguggcgggaggugacaugaggaggcacugugga

SEQ ID NO: 4166000 - RNA, 75 nt, Human
ucugcagucucauauuuaggacucugccuuggcuagacaggcagacacuuuuauucugcauaugagagaggcggg

SEQ ID NO: 4166001 - RNA, 61 nt, Human
ucugcaguuagauccagagauuucaauaucugaauuauuguucuaaggguuuaauuaaaga

SEQ ID NO: 4166002 - RNA, 91 nt, Human
ucugcauccauuaacacuaucugucauaauuaaaggugaaauaaagacauucccagguaaaugaaagaugugugaauuuguugcuagcaga

SEQ ID NO: 4166003 - RNA, 73 nt, Human
ucugcaucccgcuucuggagucuuuacagacaaaacucauuuuugucuguaaagacuccaaaagccauguaga

SEQ ID NO: 4166004 - RNA, 100 nt, Human
ucugcauguuuaugaaagaggugguuucacggagugccuugcuaaucgagugugguguuuagaccagcagcggcacccgggaacuuauuagaaaugcaga

SEQ ID NO: 4166005 - RNA, 64 nt, Human
ucugccagagaagacccagucacucauccuguagcucugagagucauauugcuuuucugguagg

SEQ ID NO: 4166006 - RNA, 71 nt, Human
ucugccaggagccaugagcaagaauccagccaaucaccaccuucuuuguugcuugccaguucccuggcaga

SEQ ID NO: 4166007 - RNA, 65 nt, Human
ucugccagguggggagaggccaggcccgccucugcccccaggccugccugccccgcccuggcaga

SEQ ID NO: 4166008 - RNA, 69 nt, Human
ucugccaucuuaauucucuuuugucuuguaacauaacacauucgcagguucuggggauuaggauguaga

SEQ ID NO: 4166009 - RNA, 57 nt, Human
ucugcccaaggcugucacuagauguuacacgucccagugcaccccuggccuggcaga

SEQ ID NO: 4166010 - RNA, 122 nt, Human
ucugccccuauauuuugcuugaacuauuucaaacuguguaauuuauaaaauguaaggagcuaucaugccuaguuuguaagucagcuaguuacagaguggacaaacaaucauccagguccaga

SEQ ID NO: 4166011 - RNA, 99 nt, Human
ucugcccucucuccuuccuuugccaaacuucucaggcguuaagauucaacacgggcaauuuaggauuuuuggccaggggaaugagagaaugcaggcaga

SEQ ID NO: 4166012 - RNA, 76 nt, Human
ucugccgcaauacugcucaugguacaugugggucucuuuuauuggagcagauguuucagagcaggcuuguaucaga

SEQ ID NO: 4166013 - RNA, 55 nt, Human
ucugccggcuaaguaggaaccugggcagagggagcccagccugcaggcccgcaga

SEQ ID NO: 4166014 - RNA, 83 nt, Human
ucugccucacuuucuggcuuucauuuguuuaaaguuauaaaauuguccaaccuugaacuauaaguaaagcuacuuggggcaga

SEQ ID NO: 4166015 - RNA, 109 nt, Human
ucugccuccgauaguuggcucagaguuuaugaagcuugaggugagagcugccgaggaauaaaggcacugcucaggucucagcuuaauuuauccuggucugucugacaga

SEQ ID NO: 4166016 - RNA, 59 nt, Human
ucugccugagggagcugaggaaggcauccugaaggaugaucaggcauuugucaggcaga

SEQ ID NO: 4166017 - RNA, 69 nt, Human
ucugccugcccuguaucuucucccaaucccccaaaucagggggaagugagcuuugaaauagggcaggga

SEQ ID NO: 4166018 - RNA, 67 nt, Human
ucugccuggacccuggugagcugggaaccugucacacagugcccuacacgccaugguucucggcagg

SEQ ID NO: 4166019 - RNA, 108 nt, Human
ucugccuggguuuugaggaugccagugguacucuuuaaucuggcuuugccucuagccccauccuagucccagcugguguuccuuaggacccaagagacuguuggcaga

SEQ ID NO: 4166020 - RNA, 116 nt, Human
ucugccuuaauuuucagucacuucuuuggcuuacugaggagcauaucugagucaguuuuguguaagcauucaugauaguuucugaguaauuugaaaugaaucagaguuaacuaaga

SEQ ID NO: 4166021 - RNA, 65 nt, Human
ucugccuuauuuaugucugaccuggugcaguacugcugaccuuggaaaguuuaauugaggcuaga

SEQ ID NO: 4166022 - RNA, 84 nt, Human
ucugccuucuauuuucaugccugggucuggggucucugaggagggggaaggggacagaggauguggcauaagagugaacacaga

SEQ ID NO: 4166023 - RNA, 57 nt, Human
ucugccuuguugcaggcgcuauguaggcacaaaggucacagcucugaacacagcaga

SEQ ID NO: 4166024 - RNA, 58 nt, Human
ucugcguccaucugccugcuuggcacagcugcaucuguagggcaccauggacagcaga

SEQ ID NO: 4166025 - RNA, 56 nt, Human
ucugcguggcgugguucugugccuugggaagagaugaaugggaagcggccagcgga

SEQ ID NO: 4166026 - RNA, 61 nt, Human
ucugcguguuuuuguuuguaaugagauggauaaguacaucagacuagauacaacaugcaga

SEQ ID NO: 4166027 - RNA, 55 nt, Human
ucugcuaccucucugccuggggaauaagggucuucuagcaagcaggaggugcaga

SEQ ID NO: 4166028 - RNA, 75 nt, Human
ucugcuaccugugcaaucuugagcaauuuauuuaaccuuuaugagaaugaauugaauguuguacagauuagcuga

SEQ ID NO: 4166029 - RNA, 69 nt, Human
ucugcuacuuuaauuccccuuugccauguaacaugauuuguucacaggcucuagggauuaagauguaga

SEQ ID NO: 4166030 - RNA, 93 nt, Human
ucugcuaucaguggggaaaauggaggcccaagauucuacagcauauuccuggcggggcugaaauuggaaccugggccuccugacuuuggcaga

SEQ ID NO: 4166031 - RNA, 96 nt, Human
ucugcuaugaugcaagacccaccaccuccccuggggucagggacucuggcucagagagggaguguggauugaacucugagcuaaagucauggcaga

SEQ ID NO: 4166032 - RNA, 76 nt, Human
ucugcucaaagugugugagccugucaggcucugcccaguaugccaagucugcaggaccgcgucacauuugaccaga

SEQ ID NO: 4166033 - RNA, 62 nt, Human
ucugcucacuaguauucgaaggcacaugcuuugagaaaggcugauggaagcuggugagcaga

SEQ ID NO: 4166034 - RNA, 55 nt, Human
ucugcuccuaguuuagcuuacauuuuucuuacuuggagcuuuuacuaacagcaga

SEQ ID NO: 4166035 - RNA, 87 nt, Human
ucugcuccuaucccacuauucuagauuacaguauaaaggauuuaacuccuuaauacuagccuggaguacugggugcgucaggauaga

SEQ ID NO: 4166036 - RNA, 69 nt, Human
ucugcucuagguauugaggcuaaagcauaagauaggauguggucuuugaccucuaguacugggagcagg

SEQ ID NO: 4166037 - RNA, 63 nt, Human
ucugcucucuggguggugggcaacagggaggcuccuaaguaagucaguggcccagaguuugga

SEQ ID NO: 4166038 - RNA, 62 nt, Human
ucugcucuguggcuucagcuaaaaugcuguccucagcuccuccucugaacuauggaagcagg

SEQ ID NO: 4166039 - RNA, 130 nt, Human
ucugcugcuccugccucuaaccucaccccuucucccucuccaacaagccuugcugcuuucugucauucauaagugccuuggcugugauggggaccaguggauggugaggcaugugagaaaaggggaauga

SEQ ID NO: 4166040 - RNA, 93 nt, Human
ucugcugcugaaggcuuuuaauucuuuggacaauaaguggugcuacacugggcacaauuuggugcuaaagaaagaaaguuauuuguaggcaga

SEQ ID NO: 4166041 - RNA, 91 nt, Human
ucugcugcugcagcuguagaggacaguggccacuugucuccuggaaccaccauugugcuucaauagcuaccacagaaugagcaucagcaga

SEQ ID NO: 4166042 - RNA, 87 nt, Human
ucugcugucacugucuggaggacaggggcugcagcacacugggguaaccaugagcagcaccucuguucuuugguaguuguuuucaga

SEQ ID NO: 4166043 - RNA, 60 nt, Human
ucugcugugagggagagggcgaaaaugaaaugauuauugcaagccuaggcucucacaaga

SEQ ID NO: 4166044 - RNA, 109 nt, Human
ucugcuuaugugaaauacggaggguguauaaugucaagagugauguuaagagcuuaauauaauguucaguuuugaaaacauugaaugcaauuugucaacucagggcagg

SEQ ID NO: 4166045 - RNA, 76 nt, Human
ucugcuuccuugguauuuuggcugggcccucgcaacucauugaauuauuuugcagggcugaaugcagagaagcaga

SEQ ID NO: 4166046 - RNA, 72 nt, Human
ucugcuugagaaucaaagaaaacccgggaaaaguguuuuuuuccuguguccuauuucgacuuucuaaguaga

SEQ ID NO: 4166047 - RNA, 65 nt, Human
ucugcuugcuuaguccccaagagagaccacagccccucuguggcuccucaguggacugggccaga

SEQ ID NO: 4166048 - RNA, 63 nt, Human
ucugcuuuagugcaaagucuuagguguguggcuccaccuaagacuuugcacuaaaguccaaga

SEQ ID NO: 4166049 - RNA, 91 nt, Human
ucuccaagaaugauaggugugagcagaacuugucaagaguuuuauuguuugaaagcaccuacauuuuucuauuuucaacuucuuuuggaga

SEQ ID NO: 4166050 - RNA, 62 nt, Human
ucuccacaaguguugagaguacacagcuucaaauaugcauacauuucaagacuugugagaga

SEQ ID NO: 4166051 - RNA, 56 nt, Human
ucuccacucugagugccuuucagcgagagcccgccugagguucuuugagauggaga

SEQ ID NO: 4166052 - RNA, 60 nt, Human
ucuccagagaagaaaagcaccuuuuuugguucaugcgagaggagcaauucuuucugggga

SEQ ID NO: 4166053 - RNA, 129 nt, Human
ucuccagcaguuauagcuguuuuacaucuuauuugcaacaaaagggaacucuaauuaucuucaaaaagagcauaaaauggugugucuugcugcugauguaauguugauuccugaaugcugcugauagga

SEQ ID NO: 4166054 - RNA, 57 nt, Human
ucuccagcaucagucagauuuugcuucuuuuccaagaaggaucauggugcuggcaga

SEQ ID NO: 4166055 - RNA, 60 nt, Human
ucuccagccacaaguggccgugucaagucccagagacacagcagcugccucagcugggga

SEQ ID NO: 4166056 - RNA, 60 nt, Human
ucuccagguacacuuuggccagcaccagcauguagaacugugccucauguaucuggauga

SEQ ID NO: 4166057 - RNA, 55 nt, Human
ucuccagucccuucucuguuaguaauuaaucugcaacuguagagguucuggauga

SEQ ID NO: 4166058 - RNA, 82 nt, Human
ucuccauauggacuauuuucauuuuauuauuuugcugccuugggagaaucuagaugaaugugaggauauccugggcuggaga

SEQ ID NO: 4166059 - RNA, 64 nt, Human
ucuccaucacugacaaacuuaauuuucugaagccaaauucagggcagagaguucagggaagaga

SEQ ID NO: 4166060 - RNA, 129 nt, Human
ucuccaucuucugcucagagccacugcucucagucccacucccaggcaggccucugggucuggcuuuggggcuucagagggacugcucugguaguugugacacaacagugccucuggcggagacagaga

SEQ ID NO: 4166061 - RNA, 84 nt, Human
ucucccaagagcugccacugagggugcacagugcaacagauagcucuuuccuguguccuuuuaguugcuguggcccuggugaga

SEQ ID NO: 4166062 - RNA, 84 nt, Human
ucucccaaggggagcugguuccugcccuccaugugcaccuugaucaggggguuuuggagaacagggucaucacccuuccggaga

SEQ ID NO: 4166063 - RNA, 57 nt, Human
ucucccaaucagcugcuaaguguguuuuccuccucaaguagcagcugccaaaggaga

SEQ ID NO: 4166064 - RNA, 63 nt, Human
ucucccauagugucugcugagcuggauagucccucuccagggagcuuugcaggggauggguga

SEQ ID NO: 4166065 - RNA, 55 nt, Human
ucucccccagucucuacagcagcauccagcauguguguaaggaaaggggaugaga

SEQ ID NO: 4166066 - RNA, 67 nt, Human
ucuccccuuuuucauucauccauuucuuccuuauguugaaauucugaugagucagagaaaggaaaga

SEQ ID NO: 4166067 - RNA, 57 nt, Human
ucucccucaauucuuugccucacuuuuuuugacaggugcagcagauuugggggaaga

SEQ ID NO: 4166068 - RNA, 78 nt, Human
ucucccucuuaggaaacugugaggaucuuaacuuuccaggugggaaggccaaagacaccuacacagcacugugggaga

SEQ ID NO: 4166069 - RNA, 60 nt, Human
ucucccugcaaccucaggacugaugaucauaaggugucuguggagcccuuuguugggaga

SEQ ID NO: 4166070 - RNA, 67 nt, Human
ucucccugguuuauuugcuagcuuugccaguuggugaagagaggacauggugaaccuguaagggaga

SEQ ID NO: 4166071 - RNA, 62 nt, Human
ucucccuuuuuuuccuucacaaggagguuugauaggacuuuuuuauaaggaagaagauaaga

SEQ ID NO: 4166072 - RNA, 55 nt, Human
ucuccgaagucaacauucugaagaugacuucggagaaugaagaugacuucggaga

SEQ ID NO: 4166073 - RNA, 129 nt, Human
ucuccgcaguugaaaugaguuuuuaaaugggccuugcacaggcucgugcgcgcacgugugucugugaugaaugggacggugccgguggugaugagccuggccuguugauuccuuucacaacguaaaaga

SEQ ID NO: 4166074 - RNA, 95 nt, Human
ucuccggauggauggaaaccaaaaguagugaaguuguacauaaucuuauaagaaaugaacgucauuguuuuuaagcuuucuguauuaucugcuga

SEQ ID NO: 4166075 - RNA, 61 nt, Human
ucuccguaucuacuuucauacuguccccuuuucaaggauaauuggaggcaagacauggagg

SEQ ID NO: 4166076 - RNA, 77 nt, Human
ucuccuagaugaccuauauaaaguuauuuuacaaucccaaugaaaguaaccuaguaauagugucaaagacaaggaga

SEQ ID NO: 4166077 - RNA, 105 nt, Human
ucuccucauuuuccaaggguaagaacuagucuuacagccucacccagauggaauggggugggguggaaaaauguagucuaguuauaugccaggaaaaagaggaga

SEQ ID NO: 4166078 - RNA, 57 nt, Human
ucuccuccaaugguucucuguccccucuccuccaguggaacaggcuauugcaggaga

SEQ ID NO: 4166079 - RNA, 60 nt, Human
ucuccucuccuuucauguuguuugacccaaguuuuuuaacaauugaagggaacaaggaga

SEQ ID NO: 4166080 - RNA, 127 nt, Human
ucuccucuuuuuuccuuuuuucuacccuuaaguuucuguggggccuuaaauucugugagcugcagaaggacucucuccacagcuguaaauauaggggacgugggagagagaaagaaaaaaggagaga

SEQ ID NO: 4166081 - RNA, 76 nt, Human
ucuccugagcucaaagggugccuggugauauuuaagcuuuauugccuaagcuccuggcaucuucaguuuagguaga

SEQ ID NO: 4166082 - RNA, 55 nt, Human
ucuccugauagcucccauaugauacacccugauuagcaaggcagcaucaggcaga

SEQ ID NO: 4166083 - RNA, 82 nt, Human
ucuccugcaauuuggaaaacacugaaaauuuuggucaucuuaucugggacagucuuaauucagugauuuuucaaccagggga

SEQ ID NO: 4166084 - RNA, 87 nt, Human
ucuccugcugugacccucaagauggaagcaguuucuguugucugaaaggaaagaaagugcuuccuuuuugaggguuacuguuugaga

SEQ ID NO: 4166085 - RNA, 67 nt, Human
ucuccuggacaguuuguaaauauauaucaaaauguuaaaugugcaugugcguugacuguccauggga

SEQ ID NO: 4166086 - RNA, 57 nt, Human
ucuccugggugcuuuaucagaacaggcuuucaccagcuuuaugaggcucucaggaga

SEQ ID NO: 4166087 - RNA, 63 nt, Human
ucuccugguagccccaaccacugaccugugggcugcacccgggcucagggggcugauaggagg

SEQ ID NO: 4166088 - RNA, 58 nt, Human
ucuccuggucaccucagaaguccagggaaccuuagggcauacuguauggaucaguagg

SEQ ID NO: 4166089 - RNA, 110 nt, Human
ucuccuucccauucccuggcccccggcucugcccugggccguuguaaaucggagagauucugcggagcggagggcagagguggcggccgcggggacucgggaggcggaga

SEQ ID NO: 4166090 - RNA, 60 nt, Human
ucuccuuccccuacucagcauccagucugccuagaaggaaaucugaaugcggggaggaga

SEQ ID NO: 4166091 - RNA, 68 nt, Human
ucuccuuccuccaaauggaccagaccaguauuuguaagucaccagguccaugauaggaaguuccgaga

SEQ ID NO: 4166092 - RNA, 55 nt, Human
ucuccuugcucuuaaccacuaugcauauuauuuauagcaaauggagaguaagaga

SEQ ID NO: 4166093 - RNA, 68 nt, Human
ucuccuugugcuggguccuuccagugccaugaguugggauucuugaugggcuuagaaagcaaguggga

SEQ ID NO: 4166094 - RNA, 78 nt, Human
ucuccuuguucucuucucauugaacauguuuugcucauuagcaucaucauugcacaaugaggaaaggcagaauggaga

SEQ ID NO: 4166095 - RNA, 62 nt, Human
ucuccuuuccucugaugcugacuuggaccagaaggcuguuccuauggacaggaggaaggaga

SEQ ID NO: 4166096 - RNA, 68 nt, Human
ucuccuuucuccuuccgacuucaugcccagcaggagcuuuucagaauacaaggagggggaagagggga

SEQ ID NO: 4166097 - RNA, 122 nt, Human
ucuccuuucugccuuuuauuaccugcgugaccugagauauuuuacuuguuauuuuucucaucuuuaaaaugaagauaagaacagugucugucucacagggcuagugugaugcagcagggaga

SEQ ID NO: 4166098 - RNA, 55 nt, Human
ucuccuuuucuaucuggauugagggccaccaacccaaaugcauggaaguuggaga

SEQ ID NO: 4166099 - RNA, 89 nt, Human
ucucgguuuauccugaugcguaaacagaagcugugucaaguggagggcggggaggucccucuccauucccuacaguuuucauccugagg

SEQ ID NO: 4166100 - RNA, 74 nt, Human
ucucuaaagaggcagacaaggcuggcuuccauaaagagcaagggaagaggccuuggucugaccugaggaagagg

SEQ ID NO: 4166101 - RNA, 61 nt, Human
ucucuacagacacuguugacuucugcuucuaauugggggaccucauaguuaacuguaaaga

SEQ ID NO: 4166102 - RNA, 74 nt, Human
ucucuacuucacugaguuucauccaggugcaaaaaugaaaaauuauaaccugccaagcaucaguggcagaguga

SEQ ID NO: 4166103 - RNA, 76 nt, Human
ucucuagaaucgaucccccagcucagguccugaggacaucuggcaggauccugggaaugggagggucaugaggaga

SEQ ID NO: 4166104 - RNA, 105 nt, Human
ucucuagacccgaaaauguccucugugguuuggcugacaaauggaaucucuuuagaaaacaugcaaaaggguaucucagcuauccaugaacgauucggucuagga

SEQ ID NO: 4166105 - RNA, 64 nt, Human
ucucuaggaauagcaaaguaggacagaaauaaggcuuucugucucccaggcaauuccuaggaga

SEQ ID NO: 4166106 - RNA, 84 nt, Human
ucucuaguuucacaacuuguuguauggaaaacugaaaugggcccuagaaucagccuaucaucuuguugucaugcagccuggaga

SEQ ID NO: 4166107 - RNA, 113 nt, Human
ucucuauaugugauagcccauuuaagcaggccccacuuaacuugaaagccaaauaacaagcucgguuucaaguuaaauggggucuuucuucaauaggccaccccauauagaga

SEQ ID NO: 4166108 - RNA, 99 nt, Human
ucucuauccagaugcuauauuguugauugauauacuauaauacacuuccucaggacagauguuacaguaugaucucuauaauguuaacagaaauggaga

SEQ ID NO: 4166109 - RNA, 55 nt, Human
ucucucaaggcugcuggauggugucaucugcagcacugucauuugcuuagggagg

SEQ ID NO: 4166110 - RNA, 63 nt, Human
ucucucagauggagugugaaugguaaccaguauaguuugcuaguccauaaauaucugggauga

SEQ ID NO: 4166111 - RNA, 66 nt, Human
ucucuccccaggacuaaguugcaaucuguuggauuucuuugaguuuuguucuuguccagggaaaga

SEQ ID NO: 4166112 - RNA, 60 nt, Human
ucucuccucucuuggccucaguuacccucacugcaaaaugggugcaaaggugaggagaga

SEQ ID NO: 4166113 - RNA, 80 nt, Human
ucucuccugcauucaggcugacucagggucaugaguaucucucaggaacauggcagugauucagccuuugucggugggga

SEQ ID NO: 4166114 - RNA, 74 nt, Human
ucucuccuuauugcacagaaucauuuucagcuguuuuaugaacugcuggaagauuauuuuguauuuagggugga

SEQ ID NO: 4166115 - RNA, 84 nt, Human
ucucucucuuucuccuuaccuugccuauuguucuuacauguucuuuuagcaacaggaauauuauggcaauuuugaagagagugg

SEQ ID NO: 4166116 - RNA, 55 nt, Human
ucucucugcgaauuagguuugcauuaaguuuucuaucuuuauuacgcagagaaga

SEQ ID NO: 4166117 - RNA, 66 nt, Human
ucucucuuaacaucugucucuaguuggguucagucaguggggagcccuggcagaugacaggagaga

SEQ ID NO: 4166118 - RNA, 58 nt, Human
ucucucuucuuuguuaagaauguugcuuuuacaguuuucugauacuuaggagaggaga

SEQ ID NO: 4166119 - RNA, 115 nt, Human
ucgaccacugcccuucuuucccagcauaggucagcuaagggcgugugggcggagcuuaugugucucuguccaugguccuuauuaccagggcaaaacgaaggaggcagaaggaaga

SEQ ID NO: 4166120 - RNA, 120 nt, Human
ucgacugucauggauuuggagcuuuccuugccaguggcugaguuacgaacagagcaaacauagagcccgcuaugcuuuguaguaauauggcggauaaagagcuuuuguccugguagcuga

SEQ ID NO: 4166121 - RNA, 86 nt, Human
ucgaggacucugugggugguagccaugggcaaaugcagagcugcugcuguugcuuugcagugccuguaggacuuagagggccugga

SEQ ID NO: 4166122 - RNA, 80 nt, Human
ucgaucguuuagaaaucuuauuagcuugcuuugggcuuucuuuuagaguuggagaaauuaaaauuuagagaccagguugg

SEQ ID NO: 4166123 - RNA, 93 nt, Human
ucgauggaaucuuauagaauuagagagauuuugaucacagugauguaguccccuagagaaucucuccaauaucugccugccugauaccaugga

SEQ ID NO: 4166124 - RNA, 55 nt, Human
ucgauguuacaaugggcagauuaaaguggagacuuguuuugcaugguaacauuga

SEQ ID NO: 4166125 - RNA, 71 nt, Human
ucgauuucuaguccagugaucuuuccaggcugccucuugguugugucacuuagauuagaaccuuaaauuga

SEQ ID NO: 4166126 - RNA, 62 nt, Human
ucgcaccuguccucugauuauggugucucucaaaaauuccaucagguucugguaggcuguga

SEQ ID NO: 4166127 - RNA, 55 nt, Human
ucgcaugggucccccagagacgguguaacccugcaagcauuuuggugacccugga

SEQ ID NO: 4166128 - RNA, 129 nt, Human
ucgcauucucucagagacacuuugcucauguacaccauuuggcaagaaagagucauuggcauguccuuggaugaccccuugucuaaguggacuuuuuggaugguacuguugaucaaugggggcuuugua

SEQ ID NO: 4166129 - RNA, 58 nt, Human
ucgccaucgucggacacagugacuuguuuuugagaugcucacagucugaugguggaga

SEQ ID NO: 4166130 - RNA, 69 nt, Human
ucgcccucgguggucccagccccggagcgcgaggccgagcgcgucugaguugcgggggcucacgggcga

SEQ ID NO: 4166131 - RNA, 55 nt, Human
ucgcccugccagcccucugaacacaggccuuucugggagagggaaagcaggcuga

SEQ ID NO: 4166132 - RNA, 68 nt, Human
ucgccugaacccaggaggcagagguugcagugagccgagaucuugccacugcacuccagccuaggcga

SEQ ID NO: 4166133 - RNA, 84 nt, Human
ucgccugucuuaaguacaggguuagugacggucagggggguucuuggauccuguagugaaccacuguacacugggacucuguga

SEQ ID NO: 4166134 - RNA, 121 nt, Human
ucgccuuccuuggcaggucugucuggugcugacucugucgugagcaguaguugcuccagaguuuguuccuuccuguuccucuggucagagucucaccaugagaugccuucagcucaggcga

SEQ ID NO: 4166135 - RNA, 87 nt, Human
ucgcgguggccccuggggguuguaguuucugucgcaaacaaaacgcgccggcagcaucgaaacuacauuccccacaagucaacgcga

SEQ ID NO: 4166136 - RNA, 70 nt, Human
ucgcucccagcugaggcagccacacaggagcaggaggcaccugacaggagaagcgcagcauggagagugg

SEQ ID NO: 4166137 - RNA, 71 nt, Human
ucgcuccuguccuccggagcgggcugugcggaggcagccgggagaacagucggcuccgaggacaagaguga

SEQ ID NO: 4166138 - RNA, 73 nt, Human
ucgcucuaccuugggcugcugucugcacaugcucguaacgacacccccagcaggggcccagcggcacgggcga

SEQ ID NO: 4166139 - RNA, 76 nt, Human
ucgcuugaacccaggaggcagaaguugcagugagcugagaucaugccacugcacuccauccugggaaacagaguga

SEQ ID NO: 4166140 - RNA, 76 nt, Human
ucgcuugaacccuggaggcggagguugcagugagccgagauggcaccacugcacuccagccugggcaacaaaguga

SEQ ID NO: 4166141 - RNA, 68 nt, Human
ucgcuugaaccugggaggcagagguugcagugagccgagaucgcaccacugaauuccagccugggcga

SEQ ID NO: 4166142 - RNA, 77 nt, Human
ucgcuugagaccaggagguuggaggcugcagugagcugagaucaugccacugcacuccagccugggugacagaguga

SEQ ID NO: 4166143 - RNA, 76 nt, Human
ucgcuugagcccaggaggagaggcugcagugagcugagaucaugccacugcacuccagccugggugacaaaagcga

SEQ ID NO: 4166144 - RNA, 76 nt, Human
ucgcuugagccugggaggcggagguugcagugagccgauguggccccacugcaccucagccugggcgacagaguga

SEQ ID NO: 4166145 - RNA, 63 nt, Human
ucggauggcaaauuuuggcagagcaguuccaacagcacugcuggcuacauuauugcugucugg

SEQ ID NO: 4166146 - RNA, 76 nt, Human
ucggauguacagagacuaccauuaauauugcagugugugucuuuuguauuaaguugguuucugaaaauaucucuga

SEQ ID NO: 4166147 - RNA, 85 nt, Human
ucggcagccagcgcugcgggggaggacguggcuccugggauuuugccugucggagcuguccgccccugggccgagcgccugcuga

SEQ ID NO: 4166148 - RNA, 56 nt, Human
ucggcagggccgugagcggugucugugcuugaggaccagcuccaggccccugcuga

SEQ ID NO: 4166149 - RNA, 88 nt, Human
ucggcauugguugaucugacaaguuguguguauagaaacuagccuauauggagacacgaaugucaaaagaaguuuuaccgaugauaga

SEQ ID NO: 4166150 - RNA, 74 nt, Human
ucggcucuauccugagaaggcacagcuugcacgugaccuccugggcccggcggcugugucuucacaggagccga

SEQ ID NO: 4166151 - RNA, 56 nt, Human
ucgggacgguggcauuugugcccccugggaaggggaugagcacugcugccuccugg

SEQ ID NO: 4166152 - RNA, 60 nt, Human
ucgggcagagccuaaagcaugugauaaaugaaaugcuaucacaauacagguugugucuga

SEQ ID NO: 4166153 - RNA, 77 nt, Human
ucgggccagcgccgggcugagguguccagaggcggcggcagcuggcagugcccucagcccccaaguguccagccugg

SEQ ID NO: 4166154 - RNA, 66 nt, Human
ucgggccugguugugugugguuguauguggacuuggacaugucugcaccgaacccacagcucccga

SEQ ID NO: 4166155 - RNA, 61 nt, Human
ucggggcacuuccaggcugaggcugggcggaauuggcccggcuuucccuguggaguuccga

SEQ ID NO: 4166156 - RNA, 96 nt, Human
ucggggucagcuaggcccucugggcagccucaggccaggguggggaaggaugcuccccccugcuccccacaggcugcccgcaggccaccugcccga

SEQ ID NO: 4166157 - RNA, 87 nt, Human
ucggucauguguuuuucaucuuuguaucccuaacacauaacaguacuuggcauuuguuaguaaucaauaaguguaccacaugacuga

SEQ ID NO: 4166158 - RNA, 60 nt, Human
ucggugucccuuagagauaugggguuuauuuccccuccccaugauucugggcuacacugg

SEQ ID NO: 4166159 - RNA, 70 nt, Human
ucgguguucacugugaacuuugcuuucuccucccaggugagcaggagccagcuguaagcagugauucuga

SEQ ID NO: 4166160 - RNA, 87 nt, Human
ucgguucgcauaugauuaaauguuuaaguguaggagcaacagaaacaugucaauguuuaggcauuauaaacaucaggagguggaaga

SEQ ID NO: 4166161 - RNA, 69 nt, Human
ucgguugcauuucucaguggaauaaaaugcaauaaauugggcuuguuuugcugagacugaugugaggga

SEQ ID NO: 4166162 - RNA, 80 nt, Human
ucguaaauuauuuuucaugucuuacaugguuaaagauacguuucacuugagcuuguaacagacauaaaaaugacccaugg

SEQ ID NO: 4166163 - RNA, 94 nt, Human
ucgucuuaaggagauauaauuauagccgcuauuuugcuggcuuuuaauugaagacaaagcaaacagugugcuaagaaauuauauucaaugauga

SEQ ID NO: 4166164 - RNA, 65 nt, Human
ucgugaaaggcaugugcaacuacaaauacuucauagcuguuuggguugcucauucuacaucacga

SEQ ID NO: 4166165 - RNA, 77 nt, Human
ucgugauccaccagaggauggaaaauuucuggcuuggacgucuggucaauauauucugucucuuugagagaaaacga

SEQ ID NO: 4166166 - RNA, 57 nt, Human
ucguggcucacgucugucaucucagcacuuugggaggcugaggcaggcggaucacga

SEQ ID NO: 4166167 - RNA, 87 nt, Human
ucguguuucccuucauugcuauuucauguuccuauggccggguucuccuugcugucuaccacaugaaaucugcagaagggaagaaga

SEQ ID NO: 4166168 - RNA, 74 nt, Human
ucguucaaucaaccaauaucuauucagcagcuacuuggugccaggcacugaaguggguguuggguacacaauga

SEQ ID NO: 4166169 - RNA, 72 nt, Human
ucguuucuccauaccagcuucagacacaccuuggguuuaaaaaggugguuguaggcuggucugagagcccga

SEQ ID NO: 4166170 - RNA, 64 nt, Human
ucguuuuuauugcugauaguguuuauaaaaauguuuuauaguuuauggucggcugugagaaaga

SEQ ID NO: 4166171 - RNA, 71 nt, Human
ucuaaaauguaucacagcaauguagucacucagugccugcccugacuguaugaacugugucucauuaugga

SEQ ID NO: 4166172 - RNA, 55 nt, Human
ucuaaacauugugauagaccuuggguccuuuuagggaaauacugcaauuuuugga

SEQ ID NO: 4166173 - RNA, 63 nt, Human
ucuaaacuugaauaucaacgaccgguguugaguuagucagcacugccuguguucaggguaaga

SEQ ID NO: 4166174 - RNA, 102 nt, Human
ucuaaagacugaugggcaugaaaauaacauuguugugaauaagugagaaaguaacuaacauacuagucauauaauauguuauucguaauuauugguccaaga

SEQ ID NO: 4166175 - RNA, 68 nt, Human
ucuaaaggcugggaaaccugaaguugugauguccaagggcagcagaagaagggugucccagcucuaga

SEQ ID NO: 4166176 - RNA, 77 nt, Human
ucuaaaguuaguugcagucacacucuaaaguaguaacccagcuggcaacugugaguuuggcugcauggauuaguaga

SEQ ID NO: 4166177 - RNA, 69 nt, Human
ucuaaauggugaaaugaugggcuuagaaggaagaaaccaaauuuuaguaccaucauuugccucuuuagg

SEQ ID NO: 4166178 - RNA, 82 nt, Human
ucuaaauuuggcaaguuucacuaaacaaauguuucuguaagaauuucauagaaaagugcucuagugagagcuuaucuuuaga

SEQ ID NO: 4166179 - RNA, 58 nt, Human
ucuaacucugccaggacacagauccacagggucagcccugcauccugagcagcuuaga

SEQ ID NO: 4166180 - RNA, 72 nt, Human
ucuaagguccagaagggcaugggaugaaaaguagggcucucuucugcucucuccuaucucucaggccccaga

SEQ ID NO: 4166181 - RNA, 76 nt, Human
ucuaaucugucuucuugccuucuguuauaccugucucuauacuaaagccagggugaaguucaaaagacagauuuga

SEQ ID NO: 4166182 - RNA, 79 nt, Human
ucuaaugaaaaggagaauuaaaaaaggagagcuugcuuuguuaggagcuugcggucaguuuugaccuucuugaauugga

SEQ ID NO: 4166183 - RNA, 78 nt, Human
ucuaauuacucaucuuuucauuaauucuuuggauaaaaacuuauuggccaaagugugggagaagagguaggaauaaga

SEQ ID NO: 4166184 - RNA, 119 nt, Human
ucuacaaauggggcugugcccuggaggaaacagugaacuuggcaggccauggggaacgcuuggccucaacgccucuucucuucauuuuuuccucccaggguguguacucauugaacaga

SEQ ID NO: 4166185 - RNA, 56 nt, Human
ucuacaacaagucaauugccugggucuucgaucaggauucaguugaaauguuugga

SEQ ID NO: 4166186 - RNA, 84 nt, Human
ucuacaauuuauaguuauucugauuaucuguguuugaaaguugauagacacagauuucacuggaauagaugaaagaauuuuaga

SEQ ID NO: 4166187 - RNA, 70 nt, Human
ucuacacaagugaguggcacaaacaggaaggcauaaauucaauuuugccuuugccauucaccauguuaga

SEQ ID NO: 4166188 - RNA, 75 nt, Human
ucaccaccaccuccccugcucccugcuucugaggugauagccuuggggaaaggaucagugggaggcuggcuguga

SEQ ID NO: 4166189 - RNA, 59 nt, Human
ucaccacuaggaauuguguaguuuacaaaacacauaaaaagcccuuuccugagagguga

SEQ ID NO: 4166190 - RNA, 55 nt, Human
ucaccacugaacagaccuuuggcaaagagucuacaaagguaaguuuucagaguga

SEQ ID NO: 4166191 - RNA, 63 nt, Human
ucaccagacaguagcccagcaguugucucuuauuagaagagcucagggcgaucugucucggga

SEQ ID NO: 4166192 - RNA, 62 nt, Human
ucaccaggacugagaccuugggguagucacaucauucuagaccucaugucucucaucuguga

SEQ ID NO: 4166193 - RNA, 69 nt, Human
ucaccaugucaugugucuuuaggucacagcuucuuccccuugauguuguacuaucaccaugucauguga

SEQ ID NO: 4166194 - RNA, 69 nt, Human
ucaccauuaaggacuuucagcugagguuuucaaacuguguuucucaaagucugagguucuguguggugg

SEQ ID NO: 4166195 - RNA, 72 nt, Human
ucaccauucuuuacaucagcacagcauuuuauccauuuugaggaagcugcaguugaggucaggaguggauga

SEQ ID NO: 4166196 - RNA, 65 nt, Human
ucacccaugcauguuuugcaacaagugaccccuguuuggggucaugcuugugcagcgucagguga

SEQ ID NO: 4166197 - RNA, 88 nt, Human
ucacccgggguucguguuaaaugcagauucugacucagcaggucugaguggguccaggauucuguguuucucauauguuccuggguga

SEQ ID NO: 4166198 - RNA, 55 nt, Human
ucacccucaguuuguuucagcagugugagcuggcugagguccugcugaguggugg

SEQ ID NO: 4166199 - RNA, 60 nt, Human
ucacccucauuccuaagguucuagggaaaguauuuuuaacacaggaacucugagaggugg

SEQ ID NO: 4166200 - RNA, 64 nt, Human
ucacccugcuccuauccaguugccugguccaagcucagauccaggcugucuaaugggagaguga

SEQ ID NO: 4166201 - RNA, 62 nt, Human
ucacccuucacccucacauucccucccucccuugaguguccagagccgggcugaaugggugg

SEQ ID NO: 4166202 - RNA, 130 nt, Human
ucacccuuuccccaggaaaucccucuuaacuuuuccggauuacagccaggcugagcacaauguuucccgcaacccagcagggcuggauuuggcaagagugacuaaugggaccuggccaggagucagguga

SEQ ID NO: 4166203 - RNA, 68 nt, Human
ucaccucagauuacaguuaauuuaccuucuuuacauauuuagagaaaaucacugacugugcuugguga

SEQ ID NO: 4166204 - RNA, 63 nt, Human
ucaccuccgcuuguguauaccuccaacugucgguugauguuggauuugucuaccagggaauga

SEQ ID NO: 4166205 - RNA, 88 nt, Human
ucaccucuaaacuccaugaagauagcugcacaggaaguaagauuuaacuagggguugaaucagugacaguuggaugggguggagguga

SEQ ID NO: 4166206 - RNA, 72 nt, Human
ucaccucugccuaauuucugacucacauacugacugguuucauguacugucgaaguugauggauggagguga

SEQ ID NO: 4166207 - RNA, 76 nt, Human
ucaccucuuuuacaccaaaaggccuacaggguguggucacuguuucuuuugggucauuuugggguggaaauggugg

SEQ ID NO: 4166208 - RNA, 59 nt, Human
ucaccucuuuuuuaacaggcuuccauccuuaucucagugaccagccugggaaggaguga

SEQ ID NO: 4166209 - RNA, 63 nt, Human
ucaccugcacccagucaccugcaggguuugaugcugccuccagggcagacggggagcaucuga

SEQ ID NO: 4166210 - RNA, 75 nt, Human
ucaccuggaagcuuguuagaaacgcagaguauuacauuguaacaagcaguccauuguaacaaguucccuagguga

SEQ ID NO: 4166211 - RNA, 72 nt, Human
ucaccugggggcaggggugcagugggggcugcuggccacaggcucccaagcacugaccccacaucccuguga

SEQ ID NO: 4166212 - RNA, 113 nt, Human
ucaccugggggugcucguuaaaacagacugcugggcuccauccccacaguuucucauugaguaggucugggguggggccaggcaauuugcauuucuaacacauucccgaguga

SEQ ID NO: 4166213 - RNA, 64 nt, Human
ucaccuuaacaaucugaccaucucauuuaaccuccucauguagcugucucagauguuagggugg

SEQ ID NO: 4166214 - RNA, 112 nt, Human
ucaccuuggagcuuguuaaaauucaaauuccugggcuccuucccggguuccuguuucaguagguccagggugggguccaggaaccacugcguuuaacaagcuccccagguga

SEQ ID NO: 4166215 - RNA, 100 nt, Human
ucaccuuuuccuggggaagaugaauucuuguuauguugguuucuuaucgcauccuggauuagggaggaaaugugcagcgaauucagacuagggaugguga

SEQ ID NO: 4166216 - RNA, 73 nt, Human
ucacggacaaaccaggacuuuguauucagcuucaaggaagaggugagagaagaaucuugguaauaguaaguga

SEQ ID NO: 4166217 - RNA, 100 nt, Human
ucacgggguaggcucgggaugggcuuagcaaaagcaggcugucucuguuuggugcugccugcugccuguggaggguucccccaucucgggcccuguguga

SEQ ID NO: 4166218 - RNA, 86 nt, Human
ucacgugcucugcuccaccuggucagagacccuugaccuuuagaagacuggaccugagggcguggcugguggaccugagggcgugg

SEQ ID NO: 4166219 - RNA, 70 nt, Human
ucacuaucaccugagagcuauaagguuuuacuagaauuuuguuuuaaguaggaagcuaugggagauguga

SEQ ID NO: 4166220 - RNA, 130 nt, Human
ucacuccagaaauacuauaauagucaaaaguacgaauaaagcuauuccucucuuuuuauggcaguaaaauagaaagagaugaaugcuuuaaguguaauucugccugugguuucaguaguuuuggacagga

SEQ ID NO: 4166221 - RNA, 76 nt, Human
ucacuccaucacccaagcuggagugcaguggcucuaucuuggcccacugcaaacuccaccuccuggguucaagugg

SEQ ID NO: 4166222 - RNA, 70 nt, Human
ucacucccacagaucucaagcaggccaggagcugugauaccgccuggaagugugucgugggaauuuguga

SEQ ID NO: 4166223 - RNA, 66 nt, Human
ucacuccuucccuaccaucaauguuucucuacugcaugaugaacaaagaugggugggaaagagaga

SEQ ID NO: 4166224 - RNA, 62 nt, Human
ucacucucaaauauuaaucuuuggcaugucuuuauuugcuugggguauauuuugagaaguga

SEQ ID NO: 4166225 - RNA, 92 nt, Human
ucacucucagagcccacucugagcuuugcagccccugggcaacagaagguuacaggaggauuaucaaaggauuagggggcucugcugaguga

SEQ ID NO: 4166226 - RNA, 77 nt, Human
ucacucuuguugccuaggcuggaaugcagugguaugaucgcagcucacugcaaccuccgccucucagguucaaguga

SEQ ID NO: 4166227 - RNA, 99 nt, Human
ucacugaaaaauuaagagcaccuuagaaaucgaacucagguuagaaucauuuaagcaaucugacacuuugauuugauuuuugacuuggaauuugaguga

SEQ ID NO: 4166228 - RNA, 74 nt, Human
ucacugagcugauagauucugaaugcuagauaaaauuuauaacaguauuucugaauauuaucauaaggcagugg

SEQ ID NO: 4166229 - RNA, 69 nt, Human
ucacugaggaugaacaacuguuuuguuuuccagguuuuuuggaguuaacacauuaguucuccuagauga

SEQ ID NO: 4166230 - RNA, 72 nt, Human
ucacugaggccagcagaaagcuuauuuugacugucuaugaagcaguuaauucuguuuuuucuccuucaguga

SEQ ID NO: 4166231 - RNA, 67 nt, Human
ucacugauacuauagagaccucaaaaagaaugaaugaccuucagugagaucuuuguaguaucaauga

SEQ ID NO: 4166232 - RNA, 101 nt, Human
ucacuggaguaacaucugugucauuggaguaaugucugugucacuggaguaacaucugugucacuggaauacugucugugucacuggaguaacaucugugg

SEQ ID NO: 4166233 - RNA, 68 nt, Human
ucacugggccuucucacuuccugcuagaauuauuacaaaauauaucuggaagacagugagcccgcuga

SEQ ID NO: 4166234 - RNA, 75 nt, Human
ucacugucuccauuuucaaguagcagaauaucuguagaaacagaggguugcugucagauaaaugaaugauaauga

SEQ ID NO: 4166235 - RNA, 70 nt, Human
ucacugugagcaauucaaaggcaggaauuaagucuuauuaauuucucucuuccguugcccagcauaguga

SEQ ID NO: 4166236 - RNA, 82 nt, Human
ucacuguggcucuuacuugaggucuucagcugacaccuucuccagggaggcuggcagccaccucagcagaaagccaccuuga

SEQ ID NO: 4166237 - RNA, 100 nt, Human
ucacuguguuguccguucucacaauaucucugugagccagguccuagugcugccccacuuuauagauuaggaggcuacagaggggcgaggugaucugugg

SEQ ID NO: 4166238 - RNA, 60 nt, Human
ucacuguuucuucccagcagagcuaagagacuucuagagccucuuguggauggucagcga

SEQ ID NO: 4166239 - RNA, 93 nt, Human
ucacuguuugaagccaagucauuucucauggaacauagcuccuccauaaccacuuauucuuggaggcgcugcaugugaaggaguuugcaguga

SEQ ID NO: 4166240 - RNA, 71 nt, Human
ucacuguuuugccugcacuuccuggguuuucuauacuuagcuccgggcuucaguuuuagguaacgcacuga

SEQ ID NO: 4166241 - RNA, 85 nt, Human
ucacuguuuuuggaauaucuuggaagugcguaaaacugcuucaguuuauuauguagaagugcauuuccagauuucuggagugugg

SEQ ID NO: 4166242 - RNA, 76 nt, Human
ucacuuaaacccaggaggccaagguugcagugagcagagauaaugccacugcacuccauccugggcaacaaaguga

SEQ ID NO: 4166243 - RNA, 75 nt, Human
ucacuucaaggaauaucuagaaaaauugggaguccauguugcaggaguucucuaguuuccagauuucuugaagga

SEQ ID NO: 4166244 - RNA, 95 nt, Human
ucacuucauacuuguugauggcaaccgaugacugaguccagaugagagcuuaacugaagcuucaguggacuguagugugucaucuaauugaguga

SEQ ID NO: 4166245 - RNA, 58 nt, Human
ucacuuccaggccccccacgcuaauggcuggugaaaccuuagccagguggggcuguga

SEQ ID NO: 4166246 - RNA, 59 nt, Human
ucacuucccucuucagcucccacaccuccaucuggagcccaguuggggcagggaagaga

SEQ ID NO: 4166247 - RNA, 59 nt, Human
ucacuucuaaauaacuguucaucuguaaccucuaacagagacaggucagggagagguga

SEQ ID NO: 4166248 - RNA, 75 nt, Human
ucacuugaacccaggagacggaggugcagugagccgugaucgugccacugaacuccagccuggguggcugaguga

SEQ ID NO: 4166249 - RNA, 76 nt, Human
ucacuugaacccaggagcugaagguugcagugagcugagaucacaccacugcacuccagcccgggcaacagagugg

SEQ ID NO: 4166250 - RNA, 76 nt, Human
ucacuugaacccaggaggcagaaguugcagugagccgaguuugcgccauugcacuccugccugggcaacaagagga

SEQ ID NO: 4166251 - RNA, 77 nt, Human
ucacuugaacccgggaggaggaaguugcagugagccaagaucgcgccauugcacuccagccugggcaacaagaguga

SEQ ID NO: 4166252 - RNA, 68 nt, Human
ucacuugaaccugggaggcagagguugcagugagcugagaucgugccucugcaccccagccugaguga

SEQ ID NO: 4166253 - RNA, 77 nt, Human
ucacuugagcccaggaggcagauguugcagugagcggagauggggcuacugcacuccagccugggacacaagaguga

SEQ ID NO: 4166254 - RNA, 69 nt, Human
ucacuuggcccagaacagugucacaugucagcuagauuaguagacauggaaauguuuuacccauugugg

SEQ ID NO: 4166255 - RNA, 88 nt, Human
ucacuugggggcuuguuagagaugcagagucucaggccccaccccagaccugaaucacacacugcauuucaacaaggcccacagguga

SEQ ID NO: 4166256 - RNA, 90 nt, Human
ucacuuuccacuucccaccuguccaggggugcccuguguugaccucggcaugagcuucccagacaggauggguugcaguggguggaguga

SEQ ID NO: 4166257 - RNA, 72 nt, Human
ucugcuuucagcaaaagccagcauaagcucauuuacccaggugugacugaagcgguugguuuugcaaucaga

SEQ ID NO: 4166258 - RNA, 111 nt, Human
ucugcuuugcagcaaauaugguuauagcaagauuccaguuuauuuccaagaugacaaaaaugaauuugauauguuaggaagacugauuugaacaaauguagcagagacaga

SEQ ID NO: 4166259 - RNA, 77 nt, Human
ucugcuuuuucauugacugaaaaauaaugaacuugaaaucuagccuuaauuuuucagccagugaugcugaagacaga

SEQ ID NO: 4166260 - RNA, 66 nt, Human
ucuggaaacagaucauaacuaagccaaucacggaaaccucauccgcuuaugagugauuuguucaga

SEQ ID NO: 4166261 - RNA, 58 nt, Human
ucuggaaggaagagcugagucccuggcuauacccugccauagccugcuuucuccuaga

SEQ ID NO: 4166262 - RNA, 68 nt, Human
ucuggaaguacuuuuguugccugcagcacuagcucaccuggcacugugacagcaagagugagguuaga

SEQ ID NO: 4166263 - RNA, 67 nt, Human
ucuggaaugcggagaguuggagaaucagauaaaagucgagguaucucucucuucagcagcuuccaga

SEQ ID NO: 4166264 - RNA, 111 nt, Human
ucuggaauguuugucugugccugggccugugcugggugugagggacauaacaagugugucacuguccuccagggcuccagccuaggacaaggaacaggcucacaagccaga

SEQ ID NO: 4166265 - RNA, 82 nt, Human
ucuggaccaaucagcgugcugucaugauguaguggaccauuauguugaucugcaggauguuaggaugaucaggauuucuaga

SEQ ID NO: 4166266 - RNA, 93 nt, Human
ucuggacccauggacugccuuccaaccccagacuccacacaacccacaacccuugagugggaguagaagcgggugagggcccugggguccagg

SEQ ID NO: 4166267 - RNA, 105 nt, Human
ucuggagagaccugugaucgucaugccacagcuucccagaggggcuauccaaagucuucuggcuggcagugauggugugcaccaugaucacgaguccuuccacga

SEQ ID NO: 4166268 - RNA, 60 nt, Human
ucuggagauaagacagacagaugacaaagauucaugacauucagacuguuccucucuaga

SEQ ID NO: 4166269 - RNA, 76 nt, Human
ucuggagcuaggaaguccaagaucagagugcuggcaaauucaauaucugguaaggaucugcuuucuaguucauaga

SEQ ID NO: 4166270 - RNA, 66 nt, Human
ucuggaguugcuguuaggucugauugaaugauugacacaccacaagcagaaaucuagaacuccaga

SEQ ID NO: 4166271 - RNA, 83 nt, Human
ucuggaguuuuggaaagaggucuaugcuaggggaacuuguggaaguucucuuuggauagcuuugguauucucagaaaaauaga

SEQ ID NO: 4166272 - RNA, 69 nt, Human
ucuggaucugcaguagcaccuguggcuuuugagcaccuuaaauguggcuagcgcaacugaggaaccaga

SEQ ID NO: 4166273 - RNA, 110 nt, Human
ucuggaugacuucacugguguuggggacuuugcaaagccuagccuuguccaaguuggucaacagcugaucuuugaugaagcaaccaucacuugugaaagguuauuucagg

SEQ ID NO: 4166274 - RNA, 58 nt, Human
ucuggaugagcuagauccaaugcuaccuccuccaggaagcccucauugguucuccaga

SEQ ID NO: 4166275 - RNA, 67 nt, Human
ucuggaugagguuaugcaucaugguaauggaauuaugccauguccuucucauugccucauaccaugg

SEQ ID NO: 4166276 - RNA, 59 nt, Human
ucuggauggucagcucuuccugcucugugacaggcagaaaggcagggcagggccccggg

SEQ ID NO: 4166277 - RNA, 91 nt, Human
ucuggauuccuagcugagagacuacaucagcacuuuguucccgaagccacagggaaccguggauuuguagucauuucuaauggaguccaga

SEQ ID NO: 4166278 - RNA, 61 nt, Human
ucuggcaaggcacaggguuugcaauuugauucacagucacugucugccccuguuuaccaga

SEQ ID NO: 4166279 - RNA, 56 nt, Human
ucuggcagcacagcaugccccaggauggagcuggcucagacagcugugcagugggg

SEQ ID NO: 4166280 - RNA, 59 nt, Human
ucuggcagggguucugcacuugaccuaagagguaaggcaccagcacuucugaaaccaga

SEQ ID NO: 4166281 - RNA, 69 nt, Human
ucuggcaguaaagagccuucauuaaauuauuuuuaauaguaagcauuuauugaagcuuauuacguuaga

SEQ ID NO: 4166282 - RNA, 97 nt, Human
ucuggcaugucauagggcucagggacuaggugcugccugaaacucuuguggccgagucaggucccccauuagcucugaguucuggaaauugaccaga

SEQ ID NO: 4166283 - RNA, 72 nt, Human
ucuggccaacagucuugaaaacagugacccaguaguugggaaacugaauucaggacucuuuuagcaaguaga

SEQ ID NO: 4166284 - RNA, 77 nt, Human
ucuggccagcaugguuuugauuguauguuggguugucagccagcuacacaccagaacuauuauuuuaggcggcugga

SEQ ID NO: 4166285 - RNA, 86 nt, Human
ucuggccccacugaaagcuugaaaccuaagucaggauguuaacagacaaggcuucccaauuaacagguaucaggcaucaggcuaga

SEQ ID NO: 4166286 - RNA, 61 nt, Human
ucuggccccuccccuuucugggucagagcacccaaggcaggucugaggagguugggccaga

SEQ ID NO: 4166287 - RNA, 75 nt, Human
ucuggccccugacuucugauuucucccaaaucuuucuuagggaggcagugggagcuuaggcagugcuggggcuga

SEQ ID NO: 4166288 - RNA, 55 nt, Human
ucuccauuuuauagauaaugaaacuaagccucaguuucauguacaggaaaggaga

SEQ ID NO: 4166289 - RNA, 68 nt, Human
ucucccaguggugcagaaagcagugaauuacaaagucaguguucuggggaagcuaccaacuugggaga

SEQ ID NO: 4166290 - RNA, 74 nt, Human
ucucccauuaugucaggacucuucuuggaaugcugacuguguuuuguagagugcagcccuaggaagaugggaga

SEQ ID NO: 4166291 - RNA, 57 nt, Human
ucuccccaggccccacauugucuacugaagcagauaggccagggugaccuggggaga

SEQ ID NO: 4166292 - RNA, 64 nt, Human
ucuccccuggccuuuuguacucacucucccuuuugaaggaagugagggacuagugcuggggaga

SEQ ID NO: 4166293 - RNA, 72 nt, Human
ucucccuacccagggcuuuucugaugcauuacggagaugaggugcagccaggagguccagggcgaggugaga

SEQ ID NO: 4166294 - RNA, 69 nt, Human
ucucccugagcauucaugugagcuugcuuucaauaauuaaguuaggcuagcugauugccuuagaagaga

SEQ ID NO: 4166295 - RNA, 112 nt, Human
ucucccugucuaucauuuauaaauuuauccugccauuauugagcuccuaucccauacagaggacaauuucagguggauagguuuucagagagugauuguuuuuacagggaga

SEQ ID NO: 4166296 - RNA, 72 nt, Human
ucucccuucccuccgaaccucagugcugccugucaaauaggccacgcugcggcuuugcaggguuguuggaga

SEQ ID NO: 4166297 - RNA, 109 nt, Human
ucuccgcgccauggcagugauggagaugggucccuggccgcccucggggcacagguggcccgcagggcccggcgggcucagcagagcacgggcacgccguccguggaga

SEQ ID NO: 4166298 - RNA, 76 nt, Human
ucuccuauuucuugacugcuuaggaaugcagcaacucauacuggugcauucugagcaauuaagaaguuaugggaga

SEQ ID NO: 4166299 - RNA, 55 nt, Human
ucuccucuacugggucugcagaucauucaggcuuuguguucccagaggaaggaga

SEQ ID NO: 4166300 - RNA, 63 nt, Human
ucuccucugugccacagcuugggaaagccagaucuaguccaauaucuuuguuacagaugggga

SEQ ID NO: 4166301 - RNA, 56 nt, Human
ucuccugccacugcuucccauugacugaacuugucaggaagccagggugcagggga

SEQ ID NO: 4166302 - RNA, 58 nt, Human
ucuccuggaagugauuccccugagucacaccucagauaugggucuccccuuucagaga

SEQ ID NO: 4166303 - RNA, 65 nt, Human
ucuccuggcuuucugcacagaauugguugggugccauccuccucugcagcagagagccagagaga

SEQ ID NO: 4166304 - RNA, 55 nt, Human
ucuccugggagaguuugauucauuaggucuauaauuuaacagacuccccagguga

SEQ ID NO: 4166305 - RNA, 64 nt, Human
ucuccugguuuguuaaauaauucuugauugaguaccugccauuauauuugaugaauuagagaga

SEQ ID NO: 4166306 - RNA, 113 nt, Human
ucuccuuauuuucagaaugaugauaguaaugguauuuaauuauagaguugcuggcaaauuaaaugagaguaacacaugguuaguacacaauauaguuauuauuuauaagggga

SEQ ID NO: 4166307 - RNA, 56 nt, Human
ucuccuucuauguuccauuuuugucaucaguaggcuagggacagaaagaggguaga

SEQ ID NO: 4166308 - RNA, 75 nt, Human
ucuccuugacuucugaaucuauuuggcaauccugguacagguugagaccagacuuuuaguagugaguuagagaga

SEQ ID NO: 4166309 - RNA, 71 nt, Human
ucuccuuggagccagcccugucccccacauccaggggucugggcgaggcccagggcugcguuccugggaga

SEQ ID NO: 4166310 - RNA, 90 nt, Human
ucuccuuggcagagcugcaugagcacucagagccauuccuuaaccagcuguccugggcccugccauguaguuccuuccuugccagccuga

SEQ ID NO: 4166311 - RNA, 126 nt, Human
ucuccuuguucagagucagggcucagacucaagacuuuccaggacgaugagccuucucaggggauauggacuuccugacaguuaauuguccuguaaacuguuuucugaagcuuguagcuugggaga

SEQ ID NO: 4166312 - RNA, 63 nt, Human
ucucgcaaucaugcagcaacaagcaaggcagagcuggcauguuguugacugauaacaucgaga

SEQ ID NO: 4166313 - RNA, 61 nt, Human
ucucgcggcgacgccugcgagggacccgggccgcgggucgaggcgggcggcgccugcgagg

SEQ ID NO: 4166314 - RNA, 84 nt, Human
ucucuacacacucaggcuagggaaaaagugggcacauuucaaaacucaaugcuuaaacuauagcuugaugugaaaaaguagaga

SEQ ID NO: 4166315 - RNA, 60 nt, Human
ucucuacauguuugaauugugugugaccaagaauuguguuucauuacaaauuuguaggga

SEQ ID NO: 4166316 - RNA, 78 nt, Human
ucucuacuaaaaaauacaaaaauuagccaggcauggugaugggcgccugucccaggcuguuuuuauguuaugugggga

SEQ ID NO: 4166317 - RNA, 65 nt, Human
ucucuagaacccuaggcugguaaugaacuuaauaauauuaaguccuaacagacugggggcaggga

SEQ ID NO: 4166318 - RNA, 124 nt, Human
ucucuagacugcuaauggguuuugcauguuggcaaggauacagcagaauaaauaauaacuaaaaauccauguugaccuguugucuucauugucauaucaaaauaagauuuuaguuuuuuaaaga

SEQ ID NO: 4166319 - RNA, 72 nt, Human
ucucuagaguaugccacagggcccuuagauccuuuuacccuuaaaaauuagaagggccuuggggucugggga

SEQ ID NO: 4166320 - RNA, 66 nt, Human
ucucuaggaucccuuauggggccccucaggguccucucugacaacuccuucuuggguccuggcuga

SEQ ID NO: 4166321 - RNA, 64 nt, Human
ucucuaggcagugucagaaucauucucaaugaagauaauaauguugaauccaucugccaagaga

SEQ ID NO: 4166322 - RNA, 73 nt, Human
ucucuagguaaauauaaaucuuacucuaauagcaacauuuggagaaguaauguuauuugcccugauuuagaga

SEQ ID NO: 4166323 - RNA, 80 nt, Human
ucucuagugcccgagguagggaagacaaauaugcaguaggcuugcugcaaaauuuacacuccuucuuccugcaacuggga

SEQ ID NO: 4166324 - RNA, 81 nt, Human
ucucuaguggcaucccugcuugcuuguugugccaugugaacauaggccauuugagggccagguuugggcugcagcugugga

SEQ ID NO: 4166325 - RNA, 67 nt, Human
ucucucaacauucugguucuaaaaaccuccagugacucaggggagcuauaauuagaauguugucuga

SEQ ID NO: 4166326 - RNA, 88 nt, Human
ucucucaaccuccuuaaguuauguuuaccauuauuaaaauuaagugacauucacuuggaagaagugguaauacaaacagguugugaga

SEQ ID NO: 4166327 - RNA, 77 nt, Human
ucucucaauugcuggcugccaucuugcccccaugaagggagguccugucugagaauggaguaagucagucugagaga

SEQ ID NO: 4166328 - RNA, 80 nt, Human
ucucucacaucuuuuucucaauacaccuaucacccagcacauacuggguuucugauaaacaugggagaaaggaauggagg

SEQ ID NO: 4166329 - RNA, 58 nt, Human
ucucucacucucucucaauauacaaauguguguguauauuggugggggcagagagaga

SEQ ID NO: 4166330 - RNA, 59 nt, Human
ucucucagaggaagaggcagugagaaaacaauuuuacauugucuuuaaccucugagggg

SEQ ID NO: 4166331 - RNA, 69 nt, Human
ucucuccauucaccuucaucucaguuuucuauucuagucucugaacuggacaugaagcaaaaugggagg

SEQ ID NO: 4166332 - RNA, 68 nt, Human
ucucuccucugccaucuucacucuuugccaaaauaggaaacaaaucagaaaauauggagaggaugggg

SEQ ID NO: 4166333 - RNA, 57 nt, Human
ucucuccuuaucauuguguuuagugucuuagaaauaagccaguuacugagugagaga

SEQ ID NO: 4166334 - RNA, 57 nt, Human
ucucucuagaugguaaauauugcauguaaacuaugcugcuuuuguauaucagagaga

SEQ ID NO: 4166335 - RNA, 63 nt, Human
ucucucuauaugucaacagggggaaaaagacuuaaauaaucaaaacugaugacucuagaggga

SEQ ID NO: 4166336 - RNA, 92 nt, Human
ucucucucucucucucucuuuucugaacagaaagucugguuacccugagguagcuguuuagaaagacagcguggagggaacagacagagaga

SEQ ID NO: 4166337 - RNA, 103 nt, Human
ucucucucuuacccaccuucacuuuggaguccaugcuguccuguggaugggugugugggucuuccaaagaagggcuucgaggguaacaucuacagcagggaga

SEQ ID NO: 4166338 - RNA, 130 nt, Human
ucucucugaaggugaacucugggugcacagcuagaggauacaguggcugugagcugggcccuccaggugaggucuggccugcccauugccacagugggcuugcuggcauccaggggggcuuucuggguga

SEQ ID NO: 4166339 - RNA, 71 nt, Human
ucucucugccagcuucucuucuauuugcaggaugagcacaaucagacugucuagggaauccggcugaggga

SEQ ID NO: 4166340 - RNA, 62 nt, Human
ucucucugcccuggguuccaggcuccuggucccaaaggcuggugcuuccuagggcaggaaga

SEQ ID NO: 4166341 - RNA, 66 nt, Human
ucucucuucaugcuuuuagaauagccuaagauugaccuaggggaugaaagaccacauggagagaga

SEQ ID NO: 4166342 - RNA, 63 nt, Human
ucucucuuuaggcauacuuuugggagaaaaaauauuucuucucauuuguguucuaauuugaga

SEQ ID NO: 4166343 - RNA, 58 nt, Human
ucucucuuucucccacucuugcuuuguauugaggcagagguguuggugaauggagaga

SEQ ID NO: 4166344 - RNA, 75 nt, Human
ucucucuuugucgcuuuucauuuuggaaacaucaauaaaaauguccaguuugaggaagaaguagauagcccgaga

SEQ ID NO: 4166345 - RNA, 57 nt, Human
ucucugagcuggauuuguucuuauuauuuuacagaugaggacagagggucucagaga

SEQ ID NO: 4166346 - RNA, 55 nt, Human
ucucugaguuuuaaggaugaugucucuggugacuccauucuugcuuacuuauaga

SEQ ID NO: 4166347 - RNA, 103 nt, Human
ucucugauuugguccugucugacaucacugcuauaugcuuugcuccucucaauuuccucugcccucaugccagcaggagucaugccagagaucauaucugaga

SEQ ID NO: 4166348 - RNA, 61 nt, Human
ucucugcccagggacccacagggagagagauggugcuuccuagugguuucccaggcaguga

SEQ ID NO: 4166349 - RNA, 76 nt, Human
ucucugccugggaauguuugcucccuucagggcaccccgccugcuggaccucaacacauuucauacuagguugaga

SEQ ID NO: 4166350 - RNA, 78 nt, Human
ucucugcugcggcaccaccuggccuuggguuuuacucuguuccaaaaagccccaggccuguuggauggcgcucagaga

SEQ ID NO: 4166351 - RNA, 56 nt, Human
ucucuggaugacgaauccagaaagauggagcuucuuucugauauucauuuagaaga

SEQ ID NO: 4166352 - RNA, 67 nt, Human
ucucuggccaauguccucuuccagaacucuuccuuccagcccuccuggccuccgacacuggccaaga

SEQ ID NO: 4166353 - RNA, 64 nt, Human
ucucugggcucaggagcccggcaaaaugaguaccacgagcagccagggcaaccaaguccagaga

SEQ ID NO: 4166354 - RNA, 64 nt, Human
ucucuguaucccagaaccaaaaaggagcccacuaaauauuccguuuugacucaaugaacagaga

SEQ ID NO: 4166355 - RNA, 89 nt, Human
ucucuguccugguuuauacuggcccugcugcuuuccacagcauccagaugccaggaugacuauacaacagccgagaaagaugacagagg

SEQ ID NO: 4166356 - RNA, 81 nt, Human
ucucugugccuccagggcagaaaaagagggaaugagggaagccucauuaccuggaaugcucugucugcggcacgccaggga

SEQ ID NO: 4166357 - RNA, 63 nt, Human
ucugcucggcucaggguagggguccggguucggcuucccuguggauaucugcagcugagcagg

SEQ ID NO: 4166358 - RNA, 68 nt, Human
ucugcucuaguugcuuccugccugaaggcaaaaagacaggcugugacucuugcaauuaccugaguaga

SEQ ID NO: 4166359 - RNA, 76 nt, Human
ucugcucuggacacucggcagacuucuuucucuggaagacucagggacagaugaaugacugagugaaagagccaga

SEQ ID NO: 4166360 - RNA, 64 nt, Human
ucugcugacauuuaugaauagaccaucgccaauugugacauuucuauguugugugucacacaga

SEQ ID NO: 4166361 - RNA, 67 nt, Human
ucugcugaucuaccugcaguuaugugauaaaugcuuguuguagauauggcuguugguagccaacaga

SEQ ID NO: 4166362 - RNA, 66 nt, Human
ucugcugccuauggcuaauucuuuacugaccaaaccuuggugaugugguggugccaaugcagcaga

SEQ ID NO: 4166363 - RNA, 82 nt, Human
ucugcugcuuucauuucaguuuugagaugaccuggcuggcagugggcugagccagucucucagaacccuuugaagcacugga

SEQ ID NO: 4166364 - RNA, 68 nt, Human
ucugcugggagcucugagccugcugugggucuucuccaugggccuuacucuaagggcuucuggcuagg

SEQ ID NO: 4166365 - RNA, 90 nt, Human
ucugcugggucuguugucaucugcucugcucuccagccuuucuucagcacugaggaguggucagcagcagugggaguguaacucagugga

SEQ ID NO: 4166366 - RNA, 57 nt, Human
ucugcuguaaagaauuucugcccagggucugggcuccccugaggaguuuccagcaga

SEQ ID NO: 4166367 - RNA, 62 nt, Human
ucugcuguacuuuuggucuguuuuccuugguuaaaaaaggcuguaucaaaaguaguggcaga

SEQ ID NO: 4166368 - RNA, 71 nt, Human
ucugcugucccuagcacagggucuugcucacaggggagcauucuuccugggcugggggcucugugggcgga

SEQ ID NO: 4166369 - RNA, 83 nt, Human
ucugcugugaauaagaugcuuuccaagaaauccucagcaagcguucuuacaaguugagauuuuacuugaaggcauucaguuga

SEQ ID NO: 4166370 - RNA, 80 nt, Human
ucugcuguguuugcaacaaacguccuucauaauacaaggaguuccuugucugugacagaccuuugcuaagacacuggaga

SEQ ID NO: 4166371 - RNA, 64 nt, Human
ucugcuucacggucucuggcugaugccaucaagcugugucaguccaggggcugugaugucaugg

SEQ ID NO: 4166372 - RNA, 77 nt, Human
ucugcuucugaccccaucuuugagccaaaccuugccagaauaagccuggucucugggguuggguacugauaggcaga

SEQ ID NO: 4166373 - RNA, 56 nt, Human
ucugcuucugugaaggcagucugagaccacacugacugcuggcuuuuacagacaga

SEQ ID NO: 4166374 - RNA, 77 nt, Human
ucugcuucuuuuuccuagugcuuucugguaaguuaucucagccuauuauuauaguuauugggaagauuuugaucgga

SEQ ID NO: 4166375 - RNA, 64 nt, Human
ucugcuuuuccccuacuaacacugaguuaugucuucuaauucucugaugcagguggaagauaga

SEQ ID NO: 4166376 - RNA, 90 nt, Human
ucuggaagcaucaacaauguggaaaugcaguuuuaccaugugagccacaagcaguuaaauggcugcguuuuccgauguauuugucccaga

SEQ ID NO: 4166377 - RNA, 82 nt, Human
ucuggaaggagguuuaggauuauagagcugucauugcugccugaaggacaccaugggaguuggguaaggaucauucuucuga

SEQ ID NO: 4166378 - RNA, 57 nt, Human
ucuggaaggcuucaaggucuaagagcagaaacacagcagggaccuggguguucuaga

SEQ ID NO: 4166379 - RNA, 55 nt, Human
ucuggaaggggaucuguggucauuccauccaggacaggccaccucucuucccagg

SEQ ID NO: 4166380 - RNA, 61 nt, Human
ucuggaaugauuuccuuccccuucuagaucggcaggauugggagaaggguauuuuucuaga

SEQ ID NO: 4166381 - RNA, 72 nt, Human
ucuggacaucugcuccuggcccccacccucaguggucagcuaggcacguggcgccaggagugaguuugcagg

SEQ ID NO: 4166382 - RNA, 55 nt, Human
ucuggacuuucggugcaagagucuuggaauugauucuaaaacuuguagguccaga

SEQ ID NO: 4166383 - RNA, 56 nt, Human
ucuggagcaacagagcaggacagauagagaguuuuacauuugcucauaguuccaga

SEQ ID NO: 4166384 - RNA, 65 nt, Human
ucuggagcacaccgggagcuugccuacugugauggaaggcgccucucccuuggugggguuagaga

SEQ ID NO: 4166385 - RNA, 64 nt, Human
ucuggagccucuaucaguuuuaggaugucagaacuuugaaucuguggcuggugagaggcaggga

SEQ ID NO: 4166386 - RNA, 75 nt, Human
ucuggaggcugggaagugcaagaucaaggugcuggcagguggugucugguguggaacuacuuccuggccuccaga

SEQ ID NO: 4166387 - RNA, 58 nt, Human
ucuggagugcccugcucugcccuccuccuuucccugggggcuccugccacacuucagg

SEQ ID NO: 4166388 - RNA, 72 nt, Human
ucuggauucuugcuagaacugggcuauggagguccagggagaaugggggccaaagucgaagucuaguccaga

SEQ ID NO: 4166389 - RNA, 81 nt, Human
ucuggcaauaucuggagaugcuuuuuguugucacaaugggggagagagugugcuacuggcaucuaguggguagaggucagg

SEQ ID NO: 4166390 - RNA, 78 nt, Human
ucuggcauugggacaaaggguggagccucugacuuuccaaucaguuuuuuaguuccuuuagucuuaaucaugaccaga

SEQ ID NO: 4166391 - RNA, 65 nt, Human
ucuggccaaugccuggggaauaguuaagauagaugacauuggaauagugcccagcauuagucgga

SEQ ID NO: 4166392 - RNA, 63 nt, Human
ucuggcguugguaucaaaauauagcagccuuuuuuggcucuagcuuuugauaccaguguggga

SEQ ID NO: 4166393 - RNA, 59 nt, Human
ucuggcucagggcucugagggaacaccuacaauccuuccuaucaccuaccugagucaga

SEQ ID NO: 4166394 - RNA, 96 nt, Human
ucuggcucucuggguuugugggcugcagcggauuggggauugcgaaaaugauguucuucgcaggcgcugcagggcgcggagacaggagaggccuga

SEQ ID NO: 4166395 - RNA, 69 nt, Human
ucuggcugaggucugcucaagucccugguaaacggcugggaaguccagggguuggcugcuucucucaga

SEQ ID NO: 4166396 - RNA, 89 nt, Human
ucuggcuggauagaauaagccugacgaaaccuagcuauuguaagcuaguuucuucaguuauucuuuucccuaucccugucuaagcuaga

SEQ ID NO: 4166397 - RNA, 57 nt, Human
ucuggcuugaacaauuagguaaauguugguaucauuuacugaaugggacaggcuaga

SEQ ID NO: 4166398 - RNA, 55 nt, Human
ucuggcuuuccuggagcaagaaaaccagugguuuucuuggccgaagaagugaaga

SEQ ID NO: 4166399 - RNA, 59 nt, Human
ucugggaaccauugguggggaugggagagggggagcgugcccaccucuggguccacaga

SEQ ID NO: 4166400 - RNA, 63 nt, Human
ucugggaaugaauaagaccugugggcucuagaaaacucagaacagguuuuaaaucuuuccaga

SEQ ID NO: 4166401 - RNA, 62 nt, Human
ucugggacgccuggggacauuuccacuuugcugggaggggaguguccuccgggccccucgga

SEQ ID NO: 4166402 - RNA, 97 nt, Human
ucugggccaggaagcaucagcucagggccaucggcccuuuuccuggugccccuugggagcaaagggccagaugcccuagagguguaccuggccuggg

SEQ ID NO: 4166403 - RNA, 84 nt, Human
ucugggcccuuaugaagcucaagacagaagggacacauauagauaguauugaaaguuucaauucuugaacuucauaggucuaga

SEQ ID NO: 4166404 - RNA, 87 nt, Human
ucugggccgaggaaagccaugcucugcagcagaccugugcgcccccagggcugcaggcugcuggcaguagcuuccugaucagccaga

SEQ ID NO: 4166405 - RNA, 60 nt, Human
ucugggccucaguuucuucaucuguaaaaugggacuuugaugaggauuggaggagucaga

SEQ ID NO: 4166406 - RNA, 69 nt, Human
ucugggcugaaaugaaggccuugggaguuugacuucuucaauuaggcuguuuguuuuucugaguccaga

SEQ ID NO: 4166407 - RNA, 68 nt, Human
ucugggcuggcccaccacaccucgagcuuucccagccauaaguaauaucgagggcguggccacucagg

SEQ ID NO: 4166408 - RNA, 68 nt, Human
ucugggcugguggucacucuguucuucuggaucaggcaucagaugcuuagugacuacacaggaccagg

SEQ ID NO: 4166409 - RNA, 65 nt, Human
ucugggcugguugugcuugcuuugacuggcagaauacagcagaagcaaugcugagccaguucuga

SEQ ID NO: 4166410 - RNA, 85 nt, Human
ucuggggaauuucuucuuuauugagacuucauuguuagaguccuugacacagugaucuuuuaguuggaacagagauucacucaga

SEQ ID NO: 4166411 - RNA, 85 nt, Human
ucuggggauaaauugcgcaugcaggagagaaagacggcuaggaaauccgguccuuaguuacuuuucauguccuuuuauuuccaga

SEQ ID NO: 4166412 - RNA, 129 nt, Human
ucuggggcaucugugagaagggagcuccugggagggugaggacaaggugauuuauaggaaggagcaacuucgagucauguucucccauuaaucucaucaacugguagcuccaaaacauagcugucaaca

SEQ ID NO: 4166413 - RNA, 84 nt, Human
ucuggggugcgcuucuggaggccugagcucagggcccguauucuccuuggggaugcccugcugcuggggcagugcagcugcagg

SEQ ID NO: 4166414 - RNA, 115 nt, Human
ucuggguauccaggccucaucccaccaaggcagaagccagccagggucccagggcagguugugagggccccuugcugcucugcugguuuggggagggagcaaggccuggcccaga

SEQ ID NO: 4166415 - RNA, 79 nt, Human
ucugggucuucuggcaaauggaggcuugauuuaagcuauuacaauaggaaaucauagcccccauccgauuguucccaga

SEQ ID NO: 4166416 - RNA, 55 nt, Human
ucugggugcauaagucccagcaugcugaagcagcucuggggagcugcucccacga

SEQ ID NO: 4166417 - RNA, 65 nt, Human
ucugggugcccagcgaaguggcugugcugaccuuggccagucucacagcugucagcugaccuagg

SEQ ID NO: 4166418 - RNA, 86 nt, Human
ucuggguuaucugcuccuauguccuccaccacagaguguucacagcgagugcucugucauuggugggaugagacagauuucccaga

SEQ ID NO: 4166419 - RNA, 76 nt, Human
ucuggguuuuaauaagcucuccaggugaucaugaugcacauuagaaccaccuggagagcuuuuaacaaaaccuagg

SEQ ID NO: 4166420 - RNA, 56 nt, Human
ucugguacagcacagagcaggugcuuggcuugacccagcaucuggcugcuucuaga

SEQ ID NO: 4166421 - RNA, 67 nt, Human
ucuggucccuuuuccugcagucugagugugcucuguacucagcagaugccacggugggggacauaga

SEQ ID NO: 4166422 - RNA, 71 nt, Human
ucuggucuagagucaccagauaaagcauggaccauaugccuccauuuauuauuugcugaaucugauucaga

SEQ ID NO: 4166423 - RNA, 55 nt, Human
ucuggugaggaggggcuggacagggccuccugguacuucaguuuccucaucugga

SEQ ID NO: 4166424 - RNA, 78 nt, Human
ucuggugaugucccugacaaugguggcucaucagcucaaugcuggcaaccuugagccuguggggugacaaccauuaga

SEQ ID NO: 4166425 - RNA, 75 nt, Human
ucuggugauuaauguaacaaggaaagccagcaaacaucauccuuggccuaaucugaaugcacuuaguuaccaaga

SEQ ID NO: 4166426 - RNA, 74 nt, Human
ucugguggaccaugauguguagauucuguuauguuuuaugauuuuuucuaacacagucgucgucauuuuccagg

SEQ ID NO: 4166427 - RNA, 59 nt, Human
ucugguggauuaaaggucuguucccuucccuuuccuauggaggaggccaugccacuaga

SEQ ID NO: 4166428 - RNA, 60 nt, Human
ucugguguguagagaaauagccugaaggcacuuugugcuugccuggccucucugcccaga

SEQ ID NO: 4166429 - RNA, 57 nt, Human
ucuuccugcuuggugugucuggcuuaguguucagccagguucauaccuuuggggaga

SEQ ID NO: 4166430 - RNA, 63 nt, Human
ucuuccuggcagugucugagaacauaccaaacugaaagcaucucaggauugugccuagggaga

SEQ ID NO: 4166431 - RNA, 72 nt, Human
ucuuccuggccaggcauggagucacagcagaggagggggcugugacugaggaucuuccuggccaggcaugga

SEQ ID NO: 4166432 - RNA, 66 nt, Human
ucuucggugagcugcgggcgaggacuggggugcggcuccuuagccagggcagcucaaaauccagga

SEQ ID NO: 4166433 - RNA, 60 nt, Human
ucuucggugcuauugugcuagaguucuauccuggcccucuuuccucagcacacaccaaga

SEQ ID NO: 4166434 - RNA, 59 nt, Human
ucuucuacagugacugcagccauagcauugaugcugguggaugcugugcugugugagga

SEQ ID NO: 4166435 - RNA, 67 nt, Human
ucuucucagugucuuauuguacacaucuuaucuccuaggaugaguuuuccgacauuggcucaggaga

SEQ ID NO: 4166436 - RNA, 68 nt, Human
ucuucucauuccaggacuaaaggaacagccuccuacugggacaugcuguucuccaggaagaaaggaga

SEQ ID NO: 4166437 - RNA, 87 nt, Human
ucuucuccauuaguuuagugaaugguuaaagaaauaaaugaaaauuagcucgguuuucuaaacuacgucaaaacuaguuagagaaga

SEQ ID NO: 4166438 - RNA, 57 nt, Human
ucuucucccuguccuaucaagacuuacagcaaggucccagguugacagggagacaga

SEQ ID NO: 4166439 - RNA, 85 nt, Human
ucuucucccuucccuuucucccccacucaacaccuaggccaucucuggcccuugaguguagugggugaggaaggaaggaaggaga

SEQ ID NO: 4166440 - RNA, 62 nt, Human
ucuucucccuuuuuggguagcaacuguaaaaguaacuuacaggaagcagaugggguagaaga

SEQ ID NO: 4166441 - RNA, 69 nt, Human
ucuucuccugguauguaugcaccuggugagagaucauggaacaggaaacauaugugcuugaggaucgga

SEQ ID NO: 4166442 - RNA, 61 nt, Human
ucuucucugcagcuuaggcccaguucuuuaguaugaggacugggucuaucuccagagaaga

SEQ ID NO: 4166443 - RNA, 83 nt, Human
ucuucucugucagcaugaacccugaauuacuuacuguuuuucuaaacacauuaauaggugguuaaugcaugguuugagaauga

SEQ ID NO: 4166444 - RNA, 129 nt, Human
ucuucucuucccugugcuccccuacacagcagccucccucccgggcucuggggcagccagccgcaggagggauagucugggaggggcugccauugcuguucacuuggggaggacgucagaggacucaga

SEQ ID NO: 4166445 - RNA, 88 nt, Human
ucuucugaggcaaaggguaauggaauggaacaucauaguugagguauuggcaagugguggccaauucacagggcucauuggcagagga

SEQ ID NO: 4166446 - RNA, 55 nt, Human
ucuucuggaucgaucacauuguucuaaaugaaugaugcugucagaguccugaaga

SEQ ID NO: 4166447 - RNA, 103 nt, Human
ucuucugggucagaccagugcagggccagguacaagaagcaggggcucuccuuccccaguugcugcugacauuuggggcuugcuuuggucuucucccaggaga

SEQ ID NO: 4166448 - RNA, 80 nt, Human
ucuucuguccuaguuaggacuuguagauauuucauugcaacuguucuuggaauguugcauaagaucugagugauagagga

SEQ ID NO: 4166449 - RNA, 58 nt, Human
ucuucuguggcuuguaaaguggcucugaaggaaagucaugucuuaggaaagcagagga

SEQ ID NO: 4166450 - RNA, 62 nt, Human
ucuucuuaaaguauguucucuuuuucucuuaauacccuaaggagcacaauauuggaagaaga

SEQ ID NO: 4166451 - RNA, 76 nt, Human
ucuucuuaagugacuuucugaaggucucgcagugucagaucugaggcauugugcugccucauggaagcagagaagg

SEQ ID NO: 4166452 - RNA, 78 nt, Human
ucuucuuccacccuaucucuguccaccucaaagccguccauucccuuuggcuguaggaagacagaaugcagaagaaga

SEQ ID NO: 4166453 - RNA, 69 nt, Human
ucuucuucuuucccagaagauauguuuaaauugcagaguaaaagccuuucucucugggaaggagaguga

SEQ ID NO: 4166454 - RNA, 78 nt, Human
ucuucuugcuuguauucugccuaaccuucaaaaacaggaauuggguuuauggaggaaggauugggugcugguugaugg

SEQ ID NO: 4166455 - RNA, 100 nt, Human
ucuugaacuuaaguacacuuaaacuuacguaguguguguauggugaagggugugccuaugcauaccugcccacauauauauguauucuuaaauucugaga

SEQ ID NO: 4166456 - RNA, 110 nt, Human
ucuugaauucuuaaaauauccuuccagcuggcuuugaaggucuuuccuauaagaaagccuuuuagaaaacgccuucaaaauuacacagaaggagauuuuauuauucuaga

SEQ ID NO: 4166457 - RNA, 120 nt, Human
ucuugaccuccagaaauuguguguuggacaauaaauguuuauuguuuuaagcugcuaacuauugggguagcguguuauguagcaauagauaacuaauacauaauuuaauggauuaaauga

SEQ ID NO: 4166458 - RNA, 65 nt, Human
ucuugagaauguguuuugcuaaguuugguggguauuuuuuagcuuggcauugaccauuaucauga

SEQ ID NO: 4166459 - RNA, 60 nt, Human
ucuugagucagcaaggaaaaugugucacguuguuggugagacaagauuuguaggcagaga

SEQ ID NO: 4166460 - RNA, 81 nt, Human
ucuugaugguugagcuucauuguuaugaaugucaaagacuaauuugcauuuaagaaaacaugagucuacaauaacucagga

SEQ ID NO: 4166461 - RNA, 82 nt, Human
ucuugauuuaaauguagauuuuggagucuacaaguagcuuugaauauuugaaauggauuuugaaacuaauuuuuaaggagga

SEQ ID NO: 4166462 - RNA, 105 nt, Human
ucuugcacagcauuuaguacagugcuugguaucuaguaagcucucaauagacauugcuaccauugauaccagcacugccucuacuaauaauucugcuacaaaaga

SEQ ID NO: 4166463 - RNA, 84 nt, Human
ucuugcacuucagguaggaagggccacaaugucuguauacacagugugcuaugguagaacagaaggcaccuucucuaggcagga

SEQ ID NO: 4166464 - RNA, 60 nt, Human
ucuugcaucuaauaacaugguacauuguaaaugcucaauaaauguuuguuggauguuuga

SEQ ID NO: 4166465 - RNA, 64 nt, Human
ucuugcaugauauucuguauuuacuggcuuuuuguugaguuagauacagaacauugauccaaga

SEQ ID NO: 4166466 - RNA, 66 nt, Human
ucuugccucuuccccuuuccaugccuugaggccuuuuuuccagaauggaaugggaagaguguguga

SEQ ID NO: 4166467 - RNA, 106 nt, Human
ucuugccugaaguugucaccaggguugaguguguguuuuugaguguguguuuggcacacagagggcagaagauacauguuucuuagucucacaacucauggcaagg

SEQ ID NO: 4166468 - RNA, 62 nt, Human
ucuugccugcccugugucauaaaaggggagucccuuacugcauuaucaaggggaagguaaga

SEQ ID NO: 4166469 - RNA, 62 nt, Human
ucuugccugcccugugucguaaaaugggggucccuuacugcauuaucaaggggaaggcaaga

SEQ ID NO: 4166470 - RNA, 62 nt, Human
ucuugccuuccccuugauaaugcaguaagggacccccauuuuacgacauagggcaggcaaga

SEQ ID NO: 4166471 - RNA, 83 nt, Human
ucuuggagcuucaaagcuaggaagaucuagauucuugugaucuaguauuuguuuauuccguuucuuuaaaguuaaugcuaaga

SEQ ID NO: 4166472 - RNA, 73 nt, Human
ucuuggaggagaguaaguaccugauucuuagaagauuauguguagaugaaaugacuuaguuuuucucacagga

SEQ ID NO: 4166473 - RNA, 64 nt, Human
ucuuggcagggcuuugagcagagacuugugugucaacaggaucaugcuggcugcccuguugaga

SEQ ID NO: 4166474 - RNA, 96 nt, Human
ucuuggccaucugguagaaguauucugcauguacugagauuucugacuuauuuuggaaaaucaaaaagcagaauaauuuuugccacauugucaggg

SEQ ID NO: 4166475 - RNA, 64 nt, Human
ucuugggaccauuuacacauacacauucacugugaugucuguguuuaaaagauauguccugaga

SEQ ID NO: 4166476 - RNA, 73 nt, Human
ucuugggagacuaaaggaggaguuaaugagacucuagaguuauuuuauuuccucuuuucacagcauaccaggg

SEQ ID NO: 4166477 - RNA, 56 nt, Human
ucuugggccucaccccagacauccuggaucagaaacucuggggaugaggucuagga

SEQ ID NO: 4166478 - RNA, 79 nt, Human
ucuuggguuauuaucaguguagauuccugagccccacccuugacuuacuaaaucacaucacugagaaugaggcccaaga

SEQ ID NO: 4166479 - RNA, 58 nt, Human
ucuuggucagcacugauguuucagagcccagcacugaucuagaaagggcuggccaagg

SEQ ID NO: 4166480 - RNA, 69 nt, Human
ucuuggugccaaaaggagcauuguauuuacauagaaugcauuguuuagaacucuuuggccugccaguga

SEQ ID NO: 4166481 - RNA, 71 nt, Human
ucuugguggaauuucuucccuuccuucuuaggguuaacaaggcuaauuuggaagauacauuccaugcaaga

SEQ ID NO: 4166482 - RNA, 65 nt, Human
ucuugguugagggugugcggcccagacaggccgaaugcuuguuuugucuguugccuuucuccaga

SEQ ID NO: 4166483 - RNA, 60 nt, Human
ucuuguaaaagguacauuaugcuuguagguaaacugauaaucauaauagccuuuucgaga

SEQ ID NO: 4166484 - RNA, 81 nt, Human
ucuuguaaaauguucuacauaaucuggauuugucugauuacuuccucuugauuagauucagguuaaacauuuuuggcaaga

SEQ ID NO: 4166485 - RNA, 83 nt, Human
ucuuguaugccugcaauaucagauucaacacauuggucuugauaaagaauuauguuuauuuauuuguguuguaugggccaaga

SEQ ID NO: 4166486 - RNA, 91 nt, Human
ucuugucugauuuuuuucucuugguuauucuuuguaugguuuggcuaauauuuuugauugcuguacacuaagaacaaagaucuguauagga

SEQ ID NO: 4166487 - RNA, 113 nt, Human
ucuugucuuuacauucagccuucagccuucauccuuccuucacugguuuaggaaauaaaguagggaaggagacuaaggccagauaugcaagaauugugaauguauggauaaga

SEQ ID NO: 4166488 - RNA, 69 nt, Human
ucuugugaaacaagauguuucagguucaucuuauccuuucuuugccuggaaucagccuuuuuuccaagg

SEQ ID NO: 4166489 - RNA, 55 nt, Human
ucuugugagcugagauaaagccuugucuuuggucuauugucuuagcugcauaaga

SEQ ID NO: 4166490 - RNA, 105 nt, Human
ucuuguuccccugccaccuuauacagagaguacagcauccacaugagugucccucuuguggaggcuuuggcuuucuuccaugcuccgugugccaugggagcaaga

SEQ ID NO: 4166491 - RNA, 90 nt, Human
ucuuuaaaagucuaacacugucagcuuagcacuuauuggccauuuacuuugugugaggcuccaugcuaagcgauaugggggaaauaaaga

SEQ ID NO: 4166492 - RNA, 82 nt, Human
ucuuuaagccucaguuuucuccucuguaaaauggagaugaaucucauuuacuguaggagugaaccaagaugaggaaugagga

SEQ ID NO: 4166493 - RNA, 63 nt, Human
ucuuuaaucucuuggcguugaauacuuaauccaguucagauucuuggcaaggagauuuaaaga

SEQ ID NO: 4166494 - RNA, 68 nt, Human
ucuuuaaugcauugcucaacagaauacagauaaguucucauaucugcuucugcauucaauguuggaga

SEQ ID NO: 4166495 - RNA, 55 nt, Human
ucuuuaauucagcaugaugcggauaaggcucaaaaacaucaugcugaauuaaaga

SEQ ID NO: 4166496 - RNA, 96 nt, Human
ucuuuacuuagagaacauaaugaauggcauugucagccuuuaugcuguguaaagugaugaagguuuggccaauguuacauaaacauuaagugaaga

SEQ ID NO: 4166497 - RNA, 57 nt, Human
ucuuuagaguuaacaauaaugaaauaugguaacagauaguuuuggggacucuaaaga

SEQ ID NO: 4166498 - RNA, 67 nt, Human
ucucugugggcauuuauaaucugguccagaaggcucucaagccuccuccaauaaagcucuauaggga

SEQ ID NO: 4166499 - RNA, 61 nt, Human
ucucuguguguuggcuguauauccuuccuggaaauugcagaguuacagcuucauauagaga

SEQ ID NO: 4166500 - RNA, 65 nt, Human
ucucuguucucugugggaucugaaucccucaguuaugaaggaagcacaccaaacaggaacaggga

SEQ ID NO: 4166501 - RNA, 60 nt, Human
ucucuuaaaagaguaauagagaaggaaauggaagcccacuucuauucaucaguuaagaga

SEQ ID NO: 4166502 - RNA, 104 nt, Human
ucucuuaaucgacuaaagggaauccacaggaggauguucagacaagccagggcacaccuuugacuguguuuuauugugguuucuguggcuuugggacugagggg

SEQ ID NO: 4166503 - RNA, 74 nt, Human
ucucuuaggccaagcugcugccauaauuaacugcucacugggcacuugagccaaugcuaguagauaguuagaga

SEQ ID NO: 4166504 - RNA, 63 nt, Human
ucucuucacauuccuggcaaaccacaucagcacccaaauuagguuucugaguuaugggagaga

SEQ ID NO: 4166505 - RNA, 88 nt, Human
ucucuucacuuuaaguccuucuuuauaugagaguaaggucaaaugaaaacuugucauggaaaagauaauaguaugaaaaguuaaggga

SEQ ID NO: 4166506 - RNA, 81 nt, Human
ucucuucccacugcaggaagauugcagaaggcuguggauuaauuguagcauuucacugaucuucacuccagucacuaggga

SEQ ID NO: 4166507 - RNA, 85 nt, Human
ucucuucuguucaccagucagucaauacucuuugagcacauacucugugccaggcugugggcuacugcugaagauacagaaccga

SEQ ID NO: 4166508 - RNA, 85 nt, Human
ucucuucuuggguguguuuucuugacauauuuggaaugagugcucgugcaaauggagcauguauaagaaaaccucaaacuggaga

SEQ ID NO: 4166509 - RNA, 88 nt, Human
ucucuucuuucaguucuuucaguuuuugcucgauguauuuugaucuuuuguuaugugcauggacuagaauugguuuaggaggaagaga

SEQ ID NO: 4166510 - RNA, 86 nt, Human
ucucuuggaagcgauggugucugagcaaaaacccggaggguaggaaagaauggggagcucucuggguucagaacagcaagcagaga

SEQ ID NO: 4166511 - RNA, 104 nt, Human
ucucuuggaaggcauuuagggcacccaauuugaaccugcaucuuuuucuuuagagaaguguuaggguaaaguugguaggaugugcuauugcccuuucaaucaga

SEQ ID NO: 4166512 - RNA, 130 nt, Human
ucucuuggagcagccaaucaagaauugaccucaguguuuuguuacuugggcacagaugugauucacugugcccugagucaugcaaauguggcaguuacugaauuaacgagaagcuuggcaggcuccauga

SEQ ID NO: 4166513 - RNA, 124 nt, Human
ucucuugggcagagaugcuaauuuaagaauguugucgguuuaaauguuccuaagaggauuaagcaaauucuacagcauauaaauggacauauuuggaagauuuuuuuccccaagcaauuucaga

SEQ ID NO: 4166514 - RNA, 62 nt, Human
ucucuugugguuuuguaguugaaugaauuaauucauguauaaccugcagaaucacuaaaaga

SEQ ID NO: 4166515 - RNA, 62 nt, Human
ucucuuuaagaugcuggaggcuuaauaggacucaaagccuuaaauucuccauuugaaagaga

SEQ ID NO: 4166516 - RNA, 83 nt, Human
ucucuuuaggcaucauguagacauagucaaacacucaucuccaguuuucucuguguuuggaugauuuaaaaaccuaacagaga

SEQ ID NO: 4166517 - RNA, 56 nt, Human
ucucuuucauguauaugcaaccuaaauuuacaauuagugcuuaaaaguggaagaga

SEQ ID NO: 4166518 - RNA, 90 nt, Human
ucucuuuccccuuuguucucccuggagucuguggcuuaggcuuaaugaagcuaacagacugggguggggaauagggguuggggaaagaga

SEQ ID NO: 4166519 - RNA, 75 nt, Human
ucucuuucugguagggagacaucuuuacaaaugaaaauuuccuuuguaaaugugaauuuccuuuucaaaagaaga

SEQ ID NO: 4166520 - RNA, 67 nt, Human
ucucuuugacugacagaauuguauuaacuuucaucuauagguaguacacucuguaaguuuaaagugg

SEQ ID NO: 4166521 - RNA, 80 nt, Human
ucucuuugauuaggacugguuucaacucagaugguucaaaugaagggauaauuuacagagauacagucaggguaaaggga

SEQ ID NO: 4166522 - RNA, 84 nt, Human
ucucuuuuauuuuauauaguuugauacuuagcauguuacuucagaacaacauagcucuuaagucugugauagaaaagaaagaga

SEQ ID NO: 4166523 - RNA, 75 nt, Human
ucucuuuucccaagaccgaacacagagaacucaugagagauaaggcauguacguugaguucaaggucaagagaga

SEQ ID NO: 4166524 - RNA, 72 nt, Human
ucugaaaggagcagcauagaagcugggaggaugaggccugucuuccuggcauugaugcugcaggacuacagg

SEQ ID NO: 4166525 - RNA, 69 nt, Human
ucugaaauagccaggagaugaugggggaauuguagacacuaucacccacaucuuuuaggcacuuucaga

SEQ ID NO: 4166526 - RNA, 76 nt, Human
ucugaaaugcauccuauuuuccaaggcugugugcuucgcagcagagcacuucagcccagaggaagggauguccaga

SEQ ID NO: 4166527 - RNA, 55 nt, Human
ucugaaauggcgauggccguugugggagcguggaugggccuuugccuuuuacaga

SEQ ID NO: 4166528 - RNA, 99 nt, Human
ucugaacccuggagaggcugacaccgaggugucuugaaggaagcaggcacacucucaugcuuccccaccuaggguuucgccuuucuucuaauauuuagg

SEQ ID NO: 4166529 - RNA, 91 nt, Human
ucugaacucaguucuugcaguucccaaauucacagcuaucuugggauauguugauuugugggcugcaaaauaugagaaauucuaccucaga

SEQ ID NO: 4166530 - RNA, 65 nt, Human
ucugaacuuaaaagcaaaauucuuaggaagagccuuuugaaaucuaagacuuuuguaaguugaga

SEQ ID NO: 4166531 - RNA, 74 nt, Human
ucugaagacuuuagggccaugguagguaauaaucguuggaaacauacuacccaagguuuuaauaggcuucuaga

SEQ ID NO: 4166532 - RNA, 80 nt, Human
ucugaagaguaugaauuaaguucacuguuuggacuugugcaggaaugcuuagucccacagugaaguucaugauauuccga

SEQ ID NO: 4166533 - RNA, 79 nt, Human
ucugaaggguuccaacacuugacacuugaacaccaggaaaaucacuguguuuaacugggagugugggaaaggacgcaga

SEQ ID NO: 4166534 - RNA, 77 nt, Human
ucugaagugauaaggucaguguuugaacccaggguuaucugauuccauagcuaugcucuuaaacaugauccuucaga

SEQ ID NO: 4166535 - RNA, 125 nt, Human
ucugaaugucacauucaacauuucaccuuuaggggauucucaguugggaugauuuggauuuauuugaauaaguucaaaucaucccaacuuagaauccccuaaagcugaaaaguaacauuaacaga

SEQ ID NO: 4166536 - RNA, 73 nt, Human
ucugacaaggguauauucaacaggcuaaugucagccuuccaggugguaguggccuguggguauugucuucaga

SEQ ID NO: 4166537 - RNA, 72 nt, Human
ucugacaaugaacaaucuauaguuauauccuggauaagccuagucaaacucaaagauugguuagaugucaga

SEQ ID NO: 4166538 - RNA, 90 nt, Human
ucugacauggcugauuuggguugacauugacuguuuuaucuucgugacacucuguaaugucacacuccuacaaagauccuccuugucaga

SEQ ID NO: 4166539 - RNA, 58 nt, Human
ucugacccacaagcauccuggaccaccucaagauggaccaggggaaagcuagguccgg

SEQ ID NO: 4166540 - RNA, 105 nt, Human
ucugacgaaaaacuuuuuaggauguauuuguugcuuuggcuuugaucuuaauguuugcaaacuaauacauuaauacaugugaagccuuaaggaguuuuucuaaga

SEQ ID NO: 4166541 - RNA, 68 nt, Human
ucugacgacagaggcuggagcaccuccugaggucacagcacugcucucagccucugcuaugcaucaga

SEQ ID NO: 4166542 - RNA, 73 nt, Human
ucugacuaugauguguaguccacaauucuggcaacauagcuugccuagaaauauuuuacagucaagguuuuga

SEQ ID NO: 4166543 - RNA, 60 nt, Human
ucugacuccugcccccaucuggccaagcguugguguggauaggaugggagcaagagaaga

SEQ ID NO: 4166544 - RNA, 88 nt, Human
ucugacuuggcugucgugcucugaguuugcaugucaggaaguaaacaccuuucacguuuuuaugccuagagcacugcuccaacucuga

SEQ ID NO: 4166545 - RNA, 59 nt, Human
ucugacuuuggacaguggcgaagaugacuacaugauucauugcaacuguaagaagcagg

SEQ ID NO: 4166546 - RNA, 62 nt, Human
ucugacuuuggacuggucugggugaugcaggacccauaggccacggucagcccacagucaga

SEQ ID NO: 4166547 - RNA, 76 nt, Human
ucugacuuuuuaauuuuagcccuucugguggguagauaguagccaccagaauuugguggguaggaauuugguuuga

SEQ ID NO: 4166548 - RNA, 71 nt, Human
ucugagaaaauaggaaacuugagucuguuggccaauuugucucacauugaguuucuugauuuuuaauuaga

SEQ ID NO: 4166549 - RNA, 69 nt, Human
ucugagacuucuguagcuucaagacugagucuuuaauggcugaguauggucaagcacagguguuucagg

SEQ ID NO: 4166550 - RNA, 59 nt, Human
ucugagagccucuagccuaagucuaaauguaacgcuugagucagcuggaggcugucuga

SEQ ID NO: 4166551 - RNA, 92 nt, Human
ucugagcaggagggagacuuggcuuggaugcuucuuucucuuccaucuaaggcgaguggaaagcauucaugugucuuugacuguaucucaga

SEQ ID NO: 4166552 - RNA, 64 nt, Human
ucugagcugcuauugcaugccaggcuccaugcuuggaccugggaguaugcaguggugagaaaga

SEQ ID NO: 4166553 - RNA, 75 nt, Human
ucugagcuggguauuuuaagaaaggaaacaauagguuuccacaagauguuucuuagaaauccaaaugagccuaga

SEQ ID NO: 4166554 - RNA, 55 nt, Human
ucugagcuguaaguagacaaggucuaaagacuggaggguuugagagcagcugaga

SEQ ID NO: 4166555 - RNA, 110 nt, Human
ucugaggauaccauggcacguuugcccacaggugcaaguuuuuugaggaagugggcaaacucauuccccagaggccugcacagaggcaagcucuucaggggguccucaga

SEQ ID NO: 4166556 - RNA, 74 nt, Human
ucugaggauggucucuggagaccaugacuguguacaguucacaugguaaccagaagacuaugacauacuucaga

SEQ ID NO: 4166557 - RNA, 77 nt, Human
ucugagggguuugaucaacaugucauaaagugaaaagaaucaugucuguuuugcaaugagaugcuugucacccuuga

SEQ ID NO: 4166558 - RNA, 74 nt, Human
ucugaggguguggggggaagcaugggucugcccggacugaagcugggcaggugggaacccuccccacccugaga

SEQ ID NO: 4166559 - RNA, 55 nt, Human
ucugaggucugaguggggacaggggcccagagguuucuggaccuggaggcccgga

SEQ ID NO: 4166560 - RNA, 103 nt, Human
ucugaggugugauacauccuugccuggucucugcccuccugacauugcugcuucuggugcugcuguguccugggcugguagagcugcgauguguuuucuugga

SEQ ID NO: 4166561 - RNA, 57 nt, Human
ucugaguuuuugcagcugcuguuggaaucucucuaacacagagcuucucaacuggga

SEQ ID NO: 4166562 - RNA, 57 nt, Human
ucugauauuuugugaaaauuuuccuguaauuugcaggugauuucuacaaaugucaga

SEQ ID NO: 4166563 - RNA, 107 nt, Human
ucugaucgggucagcugcacaggguguuucuaugccuuaauuacuuaucugcggccagggcacaggauggcagaugaagggugucccugugagcauccugcaucaga

SEQ ID NO: 4166564 - RNA, 118 nt, Human
ucugaucucuggacuuugaaaauuagguuaguuuccuaugccagguccccaagccagggaacuuggcuuaaaguagugaucgcuauauaauaauuuuaagcggaguaugauguucaga

SEQ ID NO: 4166565 - RNA, 72 nt, Human
ucaguagauuccucuucgggguucagccucaggcaugucagaaggcugcucugagaguggguuuuacacuga

SEQ ID NO: 4166566 - RNA, 64 nt, Human
ucaguagccucugacagugcaaauuuuauugccucccaaauuuguagacgucagaaguuacuga

SEQ ID NO: 4166567 - RNA, 67 nt, Human
ucaguauggagaagacaugauuggggauuaauuaagguacuuguuaucaucuuuuccuuauaacuga

SEQ ID NO: 4166568 - RNA, 84 nt, Human
ucaguauuucuggaugcucugaagccccaaauaguccggaaauccucugagauugugugcuucagaaauucagcaggcugcuga

SEQ ID NO: 4166569 - RNA, 55 nt, Human
ucagucccaagguccugagguggucccguaggaccucagaaccaucuuuggguga

SEQ ID NO: 4166570 - RNA, 70 nt, Human
ucagucuaacagggcaugugcaagagacaucauggaaaugccagaaaugucaugggcaugcacucacuga

SEQ ID NO: 4166571 - RNA, 76 nt, Human
ucagucucccaaagugcugggauuauaggcaugagccacugugccuagccaaguccaguauuuauaggagauguga

SEQ ID NO: 4166572 - RNA, 83 nt, Human
ucagucugugaggccaccaggguacuauucacugcuuugcagcagcaauuuaccaaaugguacccuggugacuuagagaguga

SEQ ID NO: 4166573 - RNA, 57 nt, Human
ucagucuucaaaucugagucgugccuacuccaggcugaugcagcccugagcggcuga

SEQ ID NO: 4166574 - RNA, 129 nt, Human
ucagucuucauggagcauacugaagcacauguuuguaagcagucugcuugugacaauaucauaauauuggauacaguaaccagucuacuuagaaaaagugugcccuucgguuaacuggaagauaacugg

SEQ ID NO: 4166575 - RNA, 91 nt, Human
ucagugaacagaauacaucuagugcugcaugagggagcuucuuuuuuagugaaggaggacauuagacacagauguauaaaugagucauuga

SEQ ID NO: 4166576 - RNA, 66 nt, Human
ucagugaauaacacaaucuuccaguuugcuguaugcauuguugcacugauggucuggaagaacuga

SEQ ID NO: 4166577 - RNA, 68 nt, Human
ucagugaauugggccuagaaugaacaggacuuggcagcaguccuggacucaggaccacaggacaccga

SEQ ID NO: 4166578 - RNA, 66 nt, Human
ucagugauaccucuggcacucaagacuuaucccuggugaguccaguguuuaccaggggugaauuga

SEQ ID NO: 4166579 - RNA, 127 nt, Human
ucagugaucaugagaaacgggagggcccaaugaaagagacuggggcauuuuggccaggggaguagagagacccuccacagcuccucagccucuuucacugauuucuuucaccuuuuaugaaugcugg

SEQ ID NO: 4166580 - RNA, 87 nt, Human
ucagugauccuuuugcuuuuggaaauuguaaugaacuucaccaucguagagcuuuaauauuucuuuccugaagcagaaagcauguga

SEQ ID NO: 4166581 - RNA, 67 nt, Human
ucagugauuguugcuguuuuaagccacgcaauuuuggaguagcuuguuacacagcaauguuauguga

SEQ ID NO: 4166582 - RNA, 56 nt, Human
ucagugcaaucaagguauguuuuugcuaaccuacacagacauauugauagcauuga

SEQ ID NO: 4166583 - RNA, 61 nt, Human
ucagugcaggaaucucuagccaaaucuuaagaaacaccauggcuggcaaaacugcaacuga

SEQ ID NO: 4166584 - RNA, 86 nt, Human
ucagugccaguccaugcucauuucuucucgaaaagacccacugauuuuuauaggguaaggagggggaaugauuggcaaggcacuga

SEQ ID NO: 4166585 - RNA, 70 nt, Human
ucagugcuuacccucuauuagaagaaaaauauaccacacauuuccauagugaauggguaaugcaaacuga

SEQ ID NO: 4166586 - RNA, 59 nt, Human
ucaguggaagcugcauauaauugucuucagaagcaggauuuagcagacacuucuauuga

SEQ ID NO: 4166587 - RNA, 62 nt, Human
ucaguggaguauggaugaagucagugccagaacaaaaucauuuuguauuuauauuccauuga

SEQ ID NO: 4166588 - RNA, 63 nt, Human
ucaguggccagcagccuagccuaggcccuucuuuuggucagugccagcugcuuggccuacuga

SEQ ID NO: 4166589 - RNA, 85 nt, Human
ucagugggcguggcgcccgagguggcccugguggaugucaacguguaccugaucaucgccaucugcgcgguguccagcuugcugg

SEQ ID NO: 4166590 - RNA, 63 nt, Human
ucagugggcuauugagaaugaagaaaugauucacuguucuuuuuguaguccaaguucagcuga

SEQ ID NO: 4166591 - RNA, 56 nt, Human
ucagugggcucagaacuggcaggcggugcaagcucugcuucccugggccacacuga

SEQ ID NO: 4166592 - RNA, 55 nt, Human
ucagugguucccuuguuggaauaaauucauggcauuccagaagggcagcuaugga

SEQ ID NO: 4166593 - RNA, 61 nt, Human
ucagugucagucuuuuagauauguguuagaaaagaggcauauuuaaauuguacuaugcuga

SEQ ID NO: 4166594 - RNA, 65 nt, Human
ucagugugccugaaucaaguguuaugcuuucuuuaccaaauaacgaaacuugccaggcauagugg

SEQ ID NO: 4166595 - RNA, 68 nt, Human
ucaguguuacagucauuguuuucugacucaagaguucuuugcuuagaggaaagugacuccgauguuga

SEQ ID NO: 4166596 - RNA, 60 nt, Human
ucaguguucagcggugugugcagagaaaagucgucugguacaugcggugugaugcucugg

SEQ ID NO: 4166597 - RNA, 66 nt, Human
ucaguuauuagagucaaaauggcauguuaccugaaccugguaggcugaaauagcucugacaauugg

SEQ ID NO: 4166598 - RNA, 122 nt, Human
ucaguuccaagacagacuaaauuagaauccccaggagagaggccaguuggccuguguauauuuaacgcuagcccuggcugauucuucucaggcaauuuugggaaauuauagcuuuaaauuga

SEQ ID NO: 4166599 - RNA, 70 nt, Human
ucaguuccugguggucauggcagcucaaaacaaauguagggcagugcaaaaugaacacuauggaagauga

SEQ ID NO: 4166600 - RNA, 98 nt, Human
ucaguucugggugaguauaggaaagggacuaggacaagugucgaaguuuguggaaagacgcuuucccuuuuuauugcuggcuuuaacagaaacacuga

SEQ ID NO: 4166601 - RNA, 129 nt, Human
ucaguugaauuuaaauuucagauaagcaaggaauacuuuuuuuuaguauaaguauguaccaaauauuacaugagacauacuuaugcuaaaaauauauuuguggcuuaccugaaauucaaauauaacugg

SEQ ID NO: 4166602 - RNA, 82 nt, Human
ucaguugagaaaagaaccuagcuccucagucuccuuucuaaagguguccgaauguuggagcaggaucucagauuacagcuga

SEQ ID NO: 4166603 - RNA, 76 nt, Human
ucaguugcuaauguacauacugcauuuucaaagaauuauauauucuauguguuguggauguauaaaaugcaauuga

SEQ ID NO: 4166604 - RNA, 59 nt, Human
ucaguugggguaacuucagagcaccguacaaccucugaaugauuaaaacccggacuaga

SEQ ID NO: 4166605 - RNA, 81 nt, Human
ucaguugugucaggggcccauacucaggaaccuacagaaaaagauuuacuuccugaggccaaugacccugggcaggacuga

SEQ ID NO: 4166606 - RNA, 84 nt, Human
ucaguuuagagaaaaggagugggaguggggugaggacagggcuuauuuuucacuccauagcuuaacucuuuggcucugagauga

SEQ ID NO: 4166607 - RNA, 78 nt, Human
ucaguuucccagauaaagaaaaguagcugugagugugcgugcgugcauguauguggcuacuuuucuugcuaucacuga

SEQ ID NO: 4166608 - RNA, 60 nt, Human
ucaguuuccucaucugugaaaugagaucaaugccuacuuauugccacagauaaaaacuga

SEQ ID NO: 4166609 - RNA, 61 nt, Human
ucaguuuccugguugugauauuguacuacaguuugcaaauguuaccaauggaggaaauugg

SEQ ID NO: 4166610 - RNA, 83 nt, Human
ucaguuuuauagacauguugacaauaaagucuaccaugugugucucccugccauggugauuauuuugcucaauaugugauuga

SEQ ID NO: 4166611 - RNA, 56 nt, Human
ucaguuuucucaucugugaaaugggucugucagcccuuccaaugaauuaaggcuga

SEQ ID NO: 4166612 - RNA, 59 nt, Human
ucaguuuuguaugaaguuauauugcauagaauaugcacuuaugcuuuuuauaagauuga

SEQ ID NO: 4166613 - RNA, 76 nt, Human
ucauaaaacaaggaugcuuucuggugauacaguacaagaaugcucuguacacaguaugaggcaucuuuaaauguga

SEQ ID NO: 4166614 - RNA, 96 nt, Human
ucauaaagcagccaccaccccuucucauaauagcauuucucaccaggggaauuuuugguagcuguugggggagggauuugaguagguuguggauga

SEQ ID NO: 4166615 - RNA, 93 nt, Human
ucauaaagcucuuccaaauguaaguucauauuuuguucucacacacaagaagugagaacaaaauaugaacuugcauuuggaagagcuuuauga

SEQ ID NO: 4166616 - RNA, 56 nt, Human
ucauaaauuagcugucuuugaacucaaauauuagucuaaaguaugcuaauauguga

SEQ ID NO: 4166617 - RNA, 74 nt, Human
ucauaacaauuacauuaacauaauauuauuggcuaaauauuucccuugccaaguagaaggaugugauuguaugg

SEQ ID NO: 4166618 - RNA, 62 nt, Human
ucauaagucucauauauguccauacaagaucaugaaaauggacaugucucuggguauuuuga

SEQ ID NO: 4166619 - RNA, 59 nt, Human
ucauacucagcuggaugcaaagcacaggcaucugucacuuaaauucaggcugaaaauga

SEQ ID NO: 4166620 - RNA, 82 nt, Human
ucauacugaggagccaacuuagaagaaauuugauuguuauucuuacuaugucaauguguuuaugucuggcuuaaaaguauga

SEQ ID NO: 4166621 - RNA, 75 nt, Human
ucauacuggaucucuuuuauggucuaccucuuuauuuuaaaauagacacuuuagaaguaaggguucuccagauga

SEQ ID NO: 4166622 - RNA, 83 nt, Human
ucauagaaagauguuugugaccugcguaggugguuucugcauaucguugcugauuucacuuagcuagguuuuuguugauauga

SEQ ID NO: 4166623 - RNA, 115 nt, Human
ucauagaaucucaggacucuuuguaugauccuuccacuucccuccagcaggacaauuuuucuguuuauacgacagguggaggcaucaagcacaaagauucuacugaauaaaauga

SEQ ID NO: 4166624 - RNA, 85 nt, Human
ucauagcagugauggugagcaggauucgccucuugcagaaggacugccacagagcaauucugcugaauuuucauugagaaguuga

SEQ ID NO: 4166625 - RNA, 82 nt, Human
ucauaguuauuuaguaauaugaauuauuguuacaagucauugucuuguacgaguaacaugaauucaugaagaugaugcuugg

SEQ ID NO: 4166626 - RNA, 78 nt, Human
ucauauaauuguguugcuguucuuuaaauggaaucuauguuucucguauuguagaacaugcagcacaauguauauaga

SEQ ID NO: 4166627 - RNA, 57 nt, Human
ucauauaccagagaguuuauauuguuucugcaguuucaaauuuuuguguguguguga

SEQ ID NO: 4166628 - RNA, 67 nt, Human
ucauaucagaagguagcaaauccacccauuauggagugaauugugaccccucuguauuuauauguga

SEQ ID NO: 4166629 - RNA, 63 nt, Human
ucauauccccuucaagaaagccuaaagauuuggagagucaggccugugcuggaggagauauga

SEQ ID NO: 4166630 - RNA, 60 nt, Human
ucauauccucuucugguucucaccccacuacugagaaccugagauaauaggagaguauga

SEQ ID NO: 4166631 - RNA, 77 nt, Human
ucauaucuuggaaucaaguuuuuggagaaagaaaaaucucuuagauuucuuugguucucuauuccauuuagauauga

SEQ ID NO: 4166632 - RNA, 69 nt, Human
ucauaugcuaugcugaagaaauaguucauacauacaaaaaacaacuagcagucagcgguuggcaauuga

SEQ ID NO: 4166633 - RNA, 66 nt, Human
ucauauucaagggguaaggcaaaaccgccuaugaauuggcauauuuguuuauuucucuguuuguga

SEQ ID NO: 4166634 - RNA, 62 nt, Human
ucauauuucuguguugacugugugucacagaggacugacccacagucaauguagaaauauga

SEQ ID NO: 4166635 - RNA, 68 nt, Human
ucugguuccuauauagccuuaaggauuaauuuuagugauccucaaggaauuaaauagggaauuucaga

SEQ ID NO: 4166636 - RNA, 82 nt, Human
ucuguaaacccaaucucauaaucgucauugcuuucauagucacuauagagagaaaugguguuuguagaacuaggaaaauaga

SEQ ID NO: 4166637 - RNA, 69 nt, Human
ucuguaaauguguuuaguuaaugaguugcuaugaagcauagugaacuuauauuuagauauauuagaaga

SEQ ID NO: 4166638 - RNA, 82 nt, Human
ucuguacauuccucagcauuagcacagacauucaaaaaaaugggugcaaugugugauaaugguggcaaacaggaaagacaga

SEQ ID NO: 4166639 - RNA, 89 nt, Human
ucuguacuaggcaucaaagcagugcgcucaucuaaggguucuguuugaaugacaccuuuagguauuacugcagccccccuuaguacaga

SEQ ID NO: 4166640 - RNA, 85 nt, Human
ucuguaggaaauuauauugagaaauccagaugugcaguugugcaagagcaagcugguguggauuuuugaauggauauucugaaga

SEQ ID NO: 4166641 - RNA, 130 nt, Human
ucuguagguacaaaugaagcugucaaauuugaucaggcgcuugauaugacaggcugugggagucaggaccccuugaacagagugggccuugucugucacaguccgccugacacuucccauaaugcccaga

SEQ ID NO: 4166642 - RNA, 58 nt, Human
ucuguauaaaguaccgguggcauguguauuaguggagaugcagccugugcucugcaga

SEQ ID NO: 4166643 - RNA, 58 nt, Human
ucuguauaaggacaaacauuuaguccagucaagguaugaaugugcuucacuugacaga

SEQ ID NO: 4166644 - RNA, 97 nt, Human
ucuguaugcacacacauauaccacuguaaaugacuuuuucuguaccugugugcuugccucuuucaauugcaugugugugugucuguguguguacaga

SEQ ID NO: 4166645 - RNA, 56 nt, Human
ucuguauugagaaagccggacaugguuugcuuuugcuggcuuuuugcuagugcaga

SEQ ID NO: 4166646 - RNA, 78 nt, Human
ucugucaauguagacagcaaccaaaccagguggcuguuuaagcuagaaugaccuggguuggcuucuacauugaugaga

SEQ ID NO: 4166647 - RNA, 59 nt, Human
ucugucacucuagagauggcagccuagaugaggugcuuauauuuuaagaagucgauaga

SEQ ID NO: 4166648 - RNA, 130 nt, Human
ucugucagacucuuacuaacucuuuuggguuggaacgugguugaggaagauccgggcaggguccucggacagccugucagcagaucuccugcagccacagucccacuugcuggggauggcgagggcuggg

SEQ ID NO: 4166649 - RNA, 94 nt, Human
ucugucagauauguggcucagaaguuaauauauaaauuuucaaagaaaguuauaaccgaugacuucugugaugucauauuuacauuauggcaga

SEQ ID NO: 4166650 - RNA, 68 nt, Human
ucugucagauggcacugauaauuaauccuuuggaaagaucccaagggcuuucaggcucucuggcuaga

SEQ ID NO: 4166651 - RNA, 61 nt, Human
ucugucagccccucagcugucacucugcucccaaaaauagcaaugguugaggggagggaga

SEQ ID NO: 4166652 - RNA, 62 nt, Human
ucugucaucucuaaaauagaaauguuauaguauccauuucuaacggucauagagaugauuga

SEQ ID NO: 4166653 - RNA, 57 nt, Human
ucuguccaacacucucuagacauauaauuacauugucuucuuuggagugggaguaga

SEQ ID NO: 4166654 - RNA, 82 nt, Human
ucuguccaaugggagaugaacaacugugaauguaaaacuguuugaauuuacauuucuaguuguucaucucccagugccuaga

SEQ ID NO: 4166655 - RNA, 67 nt, Human
ucuguccaggucagccuacauucuguaaaacucuuaauauauucagauggauggcugaauggacaga

SEQ ID NO: 4166656 - RNA, 57 nt, Human
ucuguccaguggcucucagggaaggguuggaugccucuccagggucuccuggccagg

SEQ ID NO: 4166657 - RNA, 58 nt, Human
ucuguccccacagagaaggcuggggcuggaguccgacagcuggcgccuggggaccaga

SEQ ID NO: 4166658 - RNA, 61 nt, Human
ucuguccucagcauuuggauuggauuuggcuuacuuccacccacucugaguguugaacaga

SEQ ID NO: 4166659 - RNA, 83 nt, Human
ucugucuaguacugucagcaggguguugaagucucccacuauuauugugugggaguguuaagucucuuugaagugcucuaaga

SEQ ID NO: 4166660 - RNA, 71 nt, Human
ucugucugagugguguuagaguuguccagagcaauuauccugagggaccacacagacaucagauagacaga

SEQ ID NO: 4166661 - RNA, 62 nt, Human
ucugucugcgcuugcccuggugaaaaaccccaccguucaggcugcagggugcgagacccagg

SEQ ID NO: 4166662 - RNA, 58 nt, Human
ucugucugggauguaauuccugccugagcuccauggggcagcuuuuaucccugacaga

SEQ ID NO: 4166663 - RNA, 111 nt, Human
ucugucuguaacauccugcucccccaggcucagcugucaugugacaagaugcuguccuuggagauggacagauuuuaaaugacacucccuaagcaggcuugcggaaacaga

SEQ ID NO: 4166664 - RNA, 57 nt, Human
ucugucuguccagggcccccgcuccaggaggacauggcaggagcacugggcaggagg

SEQ ID NO: 4166665 - RNA, 120 nt, Human
ucugucuuaacuaaaaacguuggcauuuucugggaaguuggcuguaugcuuauugagaaagagagacuucucuucaguacagugugacauuucuacaaaaaucaaugauuuagaaacagg

SEQ ID NO: 4166666 - RNA, 63 nt, Human
ucugucuuagccaucucaggcugcucuaacaaaauaccauguccagguggcugaaacuacaga

SEQ ID NO: 4166667 - RNA, 80 nt, Human
ucugucuucauaacacuggugauuaagaaaauguauacccuaauuuguuuacuauucaucuaucagguuagaagacauga

SEQ ID NO: 4166668 - RNA, 78 nt, Human
ucugugaacugcugccaccuguuggucauagauuacaauacaucagaucauggcuccagcugguagagauuuuucaga

SEQ ID NO: 4166669 - RNA, 72 nt, Human
ucugugaguugauggcccaguuuagacuagaaucuuggucaccuugagccaaggccucaagaauuucaugga

SEQ ID NO: 4166670 - RNA, 101 nt, Human
ucugugaugguggguuugagaaguggugaacaggagaaagugauggaagggagacuuuccaaugugugccuguuuauauuuuuaggcuuugagucacauga

SEQ ID NO: 4166671 - RNA, 67 nt, Human
ucugugauuccguggcauuuuauuuguucauuuaugacagcacuuuaaauguucacggaaauaauga

SEQ ID NO: 4166672 - RNA, 65 nt, Human
ucugugcacugugucauuagguuaaaggcaugggaaaacaaaugcacuuggacacaggccacaga

SEQ ID NO: 4166673 - RNA, 66 nt, Human
ucugugcaggauuugaggaacccagcaguuuuaaguaccuguauuuaauuuagauccugagacaga

SEQ ID NO: 4166674 - RNA, 98 nt, Human
ucugugccuucccugaccugugagcccugugaggaaagagggugugggaacccucuuugugucucugcagucuaguucaaggucuagaacgcagcaga

SEQ ID NO: 4166675 - RNA, 55 nt, Human
ucugugcugugaggcucuuccaguucagucacuggauaaagcugugcugcauagg

SEQ ID NO: 4166676 - RNA, 60 nt, Human
ucuguggacuagagaauucuguugauguaauccauguaaaugaagcucaugggccacaga

SEQ ID NO: 4166677 - RNA, 60 nt, Human
ucuguggauucaggcuuuugccuaauaaauaugggaaagaggcaggugugaauccguaga

SEQ ID NO: 4166678 - RNA, 80 nt, Human
ucuguggcccuaauguguuggacagcuucuacugugaccuuccucggcuucucagacuagccuguaccgacaccuacaga

SEQ ID NO: 4166679 - RNA, 65 nt, Human
ucuguggccuguguccaagugcauuuguuuucccaugccuuuaaccuaaugacacagugcacaga

SEQ ID NO: 4166680 - RNA, 88 nt, Human
ucuguggcuugugaccacggcagacgcgcggcaccgccuccuccguccuuggcccacgcuucgcuuugcccguugucauuugccagga

SEQ ID NO: 4166681 - RNA, 68 nt, Human
ucugugggaucagcuucuccaagugacauggaugugauucauggaacacucugaagcugaccaguaga

SEQ ID NO: 4166682 - RNA, 58 nt, Human
ucuguggguauuucccagggaaacuucuuccagcuggggcccuggagaauacccugga

SEQ ID NO: 4166683 - RNA, 66 nt, Human
ucuguguagugcugcaaaacuugccuaauccucauagucacacggaaagcuuugcagaaauacaga

SEQ ID NO: 4166684 - RNA, 79 nt, Human
ucugugucaucguggagcaguggugcucuaagggcucugcccacauggacacaucacugcagccacugcugggcacaga

SEQ ID NO: 4166685 - RNA, 57 nt, Human
ucugugucugcagaaguucagcggugaaggcuacaccaggaaaucucaagagacaga

SEQ ID NO: 4166686 - RNA, 71 nt, Human
ucugugucuguuacuucacugcagguagguaggcguuacaggcauuggcggaaggggaaacagaccacaga

SEQ ID NO: 4166687 - RNA, 58 nt, Human
ucugugucuugaguaauucggugagcaguggggugcacacuuagcuuaggagcacggg

SEQ ID NO: 4166688 - RNA, 60 nt, Human
ucugugugauugaaacuuaggguacaguguagucccuauuagugaccacaucauaugaga

SEQ ID NO: 4166689 - RNA, 103 nt, Human
ucugugugcugaccuugggcgggcguccugagcuccucgcaggugcuguuguagcagcugugcaguaggucagggcuggcccccagugcagcuuugcacauga

SEQ ID NO: 4166690 - RNA, 121 nt, Human
ucugugugucacucgagaugaugcucgcacaggugcccuguaaaagccaugcaugucuuaaacguguuggcuguggcucagguaaacaaaugugggagcaaaucgucccguggcucagaga

SEQ ID NO: 4166691 - RNA, 75 nt, Human
ucuguguguguguguacaugcaugcauguuuguguguuguguaugcuugcaugcaugugugcagacagucacaga

SEQ ID NO: 4166692 - RNA, 64 nt, Human
ucugugugugugugugugugugugugugugugugugugugaucacucaagugggcaugcgcaga

SEQ ID NO: 4166693 - RNA, 68 nt, Human
ucuguguucuguggguguuguggccuaaacuauuauaggaaagccuauugcacacauagaaacauaga

SEQ ID NO: 4166694 - RNA, 72 nt, Human
ucuguguugauucucaaagaaaacugugauuaugauuuuuuaaaauaacagaaacuugagcaucaauucaga

SEQ ID NO: 4166695 - RNA, 61 nt, Human
ucuguguuuugguuuuaggaucagugcaaauucacaugacauaauaauccaaacauacaga

SEQ ID NO: 4166696 - RNA, 85 nt, Human
ucuguuaacccucggcuucccuuaaaguuuucuguguucauuggucaguuuggaauuagaggcauaagagggaagcagggauaga

SEQ ID NO: 4166697 - RNA, 55 nt, Human
ucuguuaaccuggucuuggcuuuuuuuggagugccuggaguaaaccaguaacaga

SEQ ID NO: 4166698 - RNA, 71 nt, Human
ucuguuaauggagcagagcauuucacagccugguucccuaccccuagguguuccugcucugcuucugcagg

SEQ ID NO: 4166699 - RNA, 75 nt, Human
ucuguuacuugacccucugcagaucuucuucauguauuuuucagugucugagauuucuguaggcaaguuagcagg

SEQ ID NO: 4166700 - RNA, 87 nt, Human
ucuguuaguagaaugcuaucggcucuaagcaugauccaauuucagauuuugugaguaagcuugguaaaagucauucuuuguaauaga

SEQ ID NO: 4166701 - RNA, 61 nt, Human
ucuguucagaaauggaagugccaugcuaaugcuuguggcagugccauugucucauagcagg

SEQ ID NO: 4166702 - RNA, 67 nt, Human
ucuguucccaggagcauauuacaugggcucagggcuuagggcauuagaauuucuccuggguaacaga

SEQ ID NO: 4166703 - RNA, 87 nt, Human
ucuguucucauggaacuugaacucuaguagaccucagcggacuccacuccaggcugggaagaacaggagagaauucaaggaggcaga

SEQ ID NO: 4166704 - RNA, 76 nt, Human
ucuguugaguaugagaucugggucccccgugggcuaguggauggccaggggggcguagaugcuggguucagcugga

SEQ ID NO: 4166705 - RNA, 61 nt, Human
ucugauguugaugcuucugccucucucuuccacagucaaggccccuggguauuacaucgga

SEQ ID NO: 4166706 - RNA, 90 nt, Human
ucugauuaagccguucuggaguggugccaggccugagccagccccaggaaaggcaggaaagaggcugguggcacaggaugggaaaucaga

SEQ ID NO: 4166707 - RNA, 58 nt, Human
ucugauucaccagauuugccaugggacuuaagcaugugcauucuucaugugauucaga

SEQ ID NO: 4166708 - RNA, 85 nt, Human
ucugauucaucuguaagacauugggaguugggugacuuugcaagucuaucugacugugcccaucucccagcuugacaugggcaga

SEQ ID NO: 4166709 - RNA, 55 nt, Human
ucugauuccagugacccuaggaugggcaagagccgcagucaagacuguagucaga

SEQ ID NO: 4166710 - RNA, 62 nt, Human
ucugauucucuccaguuauuuaugggaaaaauagucucuauuuguaccugugggaauacaga

SEQ ID NO: 4166711 - RNA, 83 nt, Human
ucugcaacuuugugcuuuuaauucuggugaguacuccuuuaaagcuaaagugcucaugaugccuuuuaaaagaagacuguaga

SEQ ID NO: 4166712 - RNA, 57 nt, Human
ucugcaagggcacagccaaccccauggagggcucuggagcuggaaugcccuuuuaga

SEQ ID NO: 4166713 - RNA, 80 nt, Human
ucugcaaguuccccugcagagcaggagaggcaucgggagcucguggucccccuccacucucgcaaaccuggggaaccaga

SEQ ID NO: 4166714 - RNA, 61 nt, Human
ucugcacauagguaggcuggaagcguggguccgccuaaggcaagccagaucucuguguagg

SEQ ID NO: 4166715 - RNA, 63 nt, Human
ucugcacccuggcccuuaggaaaacaaaguugaagaaaauucguuuuccuaagggccaccaga

SEQ ID NO: 4166716 - RNA, 55 nt, Human
ucugcaccuccugcuugcuagaagacccuuauuccccaggcagagagguagcaga

SEQ ID NO: 4166717 - RNA, 85 nt, Human
ucugcaccuugcuauugaagcucagaccugcuuauguauuuauuacccaugacagucuugcacuucuaucagcauucagugggga

SEQ ID NO: 4166718 - RNA, 67 nt, Human
ucugcacugagcaucuaaccuuauaggcauaucuuccuuucuugugaauguuuauucucggugcaga

SEQ ID NO: 4166719 - RNA, 110 nt, Human
ucugcacuggcuucugagguugcugccugaggagcaacacugacauaucuggaggacaaaaguggcuuccuuggcagcaagaaucucagacccuuuaagucuaguggaga

SEQ ID NO: 4166720 - RNA, 113 nt, Human
ucugcagaacuggaaauggaggacaaagauucaguugauguguuccagaagcagacaggagggucuacugagaacauacucacugcuuuacuccagaacucuguuucuacaga

SEQ ID NO: 4166721 - RNA, 66 nt, Human
ucugcagcucgggcuuagggugggcaggugggcucugaggcccccacccucaggcuugaauggaga

SEQ ID NO: 4166722 - RNA, 58 nt, Human
ucugcaggcucuagaugagguuggaggcagacagacccaucccacccagccuuguaga

SEQ ID NO: 4166723 - RNA, 91 nt, Human
ucugcauaguucugugugccuuucacacacugggaugccuugguuuaagaggagauucccagcuguguggaggagaugacaacagugcaga

SEQ ID NO: 4166724 - RNA, 57 nt, Human
ucugcaucuguguugagugccccuccaacugugagaggugguggugcagggugcagg

SEQ ID NO: 4166725 - RNA, 96 nt, Human
ucugcauggcuaaccagcuccuaggugaugccagugaggcugguccaugaccaccaggaccagcuucaugggcaugcaccagugcaguugugcaga

SEQ ID NO: 4166726 - RNA, 63 nt, Human
ucugcauuacacugauaaagacaaaauuauguacauguuuaguccuuuaauaguuaaugugga

SEQ ID NO: 4166727 - RNA, 91 nt, Human
ucugccaacagauuguccgugauguccccucaccaggacugcagaccugacucagcuccucaugcaggggauacaugggacaccaggcaga

SEQ ID NO: 4166728 - RNA, 67 nt, Human
ucugccacaucuaucuuuaguaugaacacccagugucuguacuaucuauagauauaguagugggaga

SEQ ID NO: 4166729 - RNA, 63 nt, Human
ucugccacuuaccuccauguacauguauacucuauuauggaaugcauggaggaaaguuauaga

SEQ ID NO: 4166730 - RNA, 66 nt, Human
ucugccaggcauugugcugcucauuaaagaucaagagacacaaagcacagucccugacuuugcaga

SEQ ID NO: 4166731 - RNA, 57 nt, Human
ucugccaguuuauagacaagccagcauauaggcuuugacauauauaagcugucauga

SEQ ID NO: 4166732 - RNA, 88 nt, Human
ucugccauauacuuaccaaugugcuuuugcuacaguuucuugacccaucugcuuuagacagcaucuggugacuucuuuguaugguaga

SEQ ID NO: 4166733 - RNA, 73 nt, Human
ucugccaugccaggcuguuuggccucagggaagcagcuucccugaccaguccuuagcaccuggcacgugguga

SEQ ID NO: 4166734 - RNA, 56 nt, Human
ucugccccacaguccuuaugaaaauauuaaaaaugcucaaaauaggugugggcgga

SEQ ID NO: 4166735 - RNA, 72 nt, Human
ucugccccugcucauggcuguccccugcaaucagccccuucacugugggacggccacccacgcagggucuga

SEQ ID NO: 4166736 - RNA, 82 nt, Human
ucugcccggcugccccccagggagcagcucagagccaagaaccugggcagggcccugauuccuggggcacagacuggguaga

SEQ ID NO: 4166737 - RNA, 58 nt, Human
ucugcccuuggcauguuugcucugcgugucccaaaaugccagcugagccaaggggaga

SEQ ID NO: 4166738 - RNA, 67 nt, Human
ucugccuaaggcuuggggaaaagugaggcccagucgcugcccucaaauagcccccagucuaguuaga

SEQ ID NO: 4166739 - RNA, 73 nt, Human
ucugccucccuuagagauucugucagagucuagucaggaaaacugaaaccacuccaguauuucaaagagcaga

SEQ ID NO: 4166740 - RNA, 63 nt, Human
ucugccugucuccuugaauuguggccaguuucacaugggaagcaacgucgagggacagggaga

SEQ ID NO: 4166741 - RNA, 72 nt, Human
ucugccugucucugacugccauuagcaaaagacauuauuccuguccucaauggaccaguuagagaggcaaga

SEQ ID NO: 4166742 - RNA, 63 nt, Human
ucugccuuggagaaaaaggaauugauaacauucucguuaccauucaaguucucuccuuacaga

SEQ ID NO: 4166743 - RNA, 59 nt, Human
ucugccuuucacacagacggccaaccucuggaaggaccgggccucugaggacaaggaga

SEQ ID NO: 4166744 - RNA, 64 nt, Human
ucugcgaggaacugagaagcagcuaugccaucuaaaugaggcaggagcucuccaguuugccaga

SEQ ID NO: 4166745 - RNA, 66 nt, Human
ucugcgaguccaggguuaggaguccgagcacagcucacuugguccucuacucaggggcucaccaga

SEQ ID NO: 4166746 - RNA, 56 nt, Human
ucugcgccgcauguguucuuucagggucucaggccaaaaggacauuuguugccagg

SEQ ID NO: 4166747 - RNA, 63 nt, Human
ucugcgcuccaggccccagcaccuugggagcuuaugcugucaauuacuugcgcuuaguucaga

SEQ ID NO: 4166748 - RNA, 58 nt, Human
ucugcggccucccaggcgucggcgcccauucucggggcgcccaagcgccggccgcaga

SEQ ID NO: 4166749 - RNA, 83 nt, Human
ucugcuauucuguguauuuacuggcuggacguucaccuguuccucuugguguaguaaagcuauaaauaggaagaagaagcaga

SEQ ID NO: 4166750 - RNA, 79 nt, Human
ucugcucaaaggugugggugacauacagccugcaagugaccuugagaaguaggcuguuucucucccaccccuucccagg

SEQ ID NO: 4166751 - RNA, 59 nt, Human
ucugcuccagaggcuucccuagagugaagagcucuacuauguaugcuuuaugcggcaga

SEQ ID NO: 4166752 - RNA, 93 nt, Human
ucugcuccucuccuuuguaauuuauauggaauuguugcucagaaaggcaguuaucugaaguaccauuagauuaggaugacaaggaagagcaga

SEQ ID NO: 4166753 - RNA, 105 nt, Human
ucugcugaaugguaaauaacagucauuugcccaguacuugggggguucuaaguguacggcugcccacugccugccuuccagguacugagugaccuagaaagcaga

SEQ ID NO: 4166754 - RNA, 72 nt, Human
ucugcugaccuuucucugacacuacuuacuauauuuuagugucggaaucaauugaacgguggguucuaaaga

SEQ ID NO: 4166755 - RNA, 94 nt, Human
ucugcugacuuuuugcugaggugcuacuuucaagguuuuaaaauucaguaaauccuugauaguuugcccuaauuuggagagaaggucaaucaga

SEQ ID NO: 4166756 - RNA, 56 nt, Human
ucugcuggaaaaccagggaauugguccaaaccaacucucagguucuuuccagcagg

SEQ ID NO: 4166757 - RNA, 72 nt, Human
ucugcuggacugggagaucuguugggacugggcagagucugucuuggucacuguggauccccagugcacaga

SEQ ID NO: 4166758 - RNA, 81 nt, Human
ucugcuggcaccugucucagugcccaaugccauaaggagccuggugcaucagagggccugaaagaccaggugugaggcaga

SEQ ID NO: 4166759 - RNA, 72 nt, Human
ucugcuggcagccaagugggauacucuggggucagcaacuugcugaagugaguaacccccucugccagcagg

SEQ ID NO: 4166760 - RNA, 66 nt, Human
ucugcuguucauagaaauggucucauuggaauaauuccuuuuggaacguuacuaaggacaccaaga

SEQ ID NO: 4166761 - RNA, 59 nt, Human
ucugcuuacuggauuguggggagguuccagggugggggccgggcagccagugcagcagg

SEQ ID NO: 4166762 - RNA, 89 nt, Human
ucugcuucugugucuucucucuccaggcgagguccuacugagguuguugccagcgauaguccucuccuggagcuugaauuggaagcaga

SEQ ID NO: 4166763 - RNA, 84 nt, Human
ucugcuuguuaauuuaauuucaugccagccuguuggucccugaaaguaacugcuguaaaaggcuggggaauugaauuugcuaga

SEQ ID NO: 4166764 - RNA, 115 nt, Human
ucugcuuuauuuauucugacaugcugacuuguuagugacagucugauuucucaaaacuagaauuuucaggauuuaagagguuacucgaugucagcaaguaauaaaugagcgcuga

SEQ ID NO: 4166765 - RNA, 71 nt, Human
ucugcuuugaccuucuugaugcuaaacuuuccuuuucggauacauguaguagagagggaaauuagggcaga

SEQ ID NO: 4166766 - RNA, 56 nt, Human
ucugcuuugcugccuccugaucuagaagauuuagacuaggaauucaaguagacaga

SEQ ID NO: 4166767 - RNA, 56 nt, Human
ucuggaagagcauguguuuacaaaugcagaauagcaugcaauacugcuuauccagg

SEQ ID NO: 4166768 - RNA, 74 nt, Human
ucuggaagguccugcccacccaccccaucccagcccggccaccauggucugggauaguggccaggacccccagg

SEQ ID NO: 4166769 - RNA, 70 nt, Human
ucuggacaaccaagaacagagggaaagaggcagagcacucuuuggagaaaaguucuugggcuuguccaga

SEQ ID NO: 4166770 - RNA, 66 nt, Human
ucuggacagggacacagccagugagguggaugaccuggagccugacagcgugucccuggcccugga

SEQ ID NO: 4166771 - RNA, 62 nt, Human
ucuggagaagcagugagagucagguuacaaaucacaaagcauuugguaacugcaucuccaga

SEQ ID NO: 4166772 - RNA, 64 nt, Human
ucuggagagguaagaagauaggguguguguauuucaggcucuguguuuugugccuacugcuaga

SEQ ID NO: 4166773 - RNA, 57 nt, Human
ucuggagauuuuacaucuaaucauuuauuuauaaaucuguagauggcagucugcaga

SEQ ID NO: 4166774 - RNA, 83 nt, Human
ucuggaggacauuuauuuauggaggacauuuauucuggauguggaaggccagaaaaugcucuccaaaaugaaagucauuugga

SEQ ID NO: 4166775 - RNA, 97 nt, Human
ucuggaggacccgaccgaauuugcuuucgugacagggucaagcgcccuuuccucgccggccgcagcccucaccaaaggggauuugggggccuccgga

SEQ ID NO: 4166776 - RNA, 110 nt, Human
ucauauuuuaaagcccuaacccccaaugucacuguguuuggcaauagggccuuaaaggaggucauuaaaguuaaaugagguaauagggguggggccuuaauccaauauga

SEQ ID NO: 4166777 - RNA, 79 nt, Human
ucaucaggaagugagucuugugaaaaauggcacuguaagaaaauacuuucccuuccauuuuucauaaacuauccaauga

SEQ ID NO: 4166778 - RNA, 66 nt, Human
ucaucaucugcaagcucaugucagauauuuaaugcucagcaugaguauaugaugcagcguugauga

SEQ ID NO: 4166779 - RNA, 112 nt, Human
ucaucaugguacccuagagcuuaagcugcucaguggaagacucagcucucccaauuuccuccauggggggcugcugacuguuacauagccaggcgagggguugcccugaaga

SEQ ID NO: 4166780 - RNA, 68 nt, Human
ucauccagauagcaggucagaagugccucgugagcaggagguguuccugcaagcuguucugaucauga

SEQ ID NO: 4166781 - RNA, 72 nt, Human
ucauccaggcugcuuucuaugccccuuguuagucugcuugggcugccauaacagaguaccacagauggguga

SEQ ID NO: 4166782 - RNA, 129 nt, Human
ucauccaucuuugucuaccauggacuuauaguuuuuaaagcugaacuccagaaagcuacaauccuacuuucauggaguccuaguauuggaaacauaagaggaggccucgcauggcuaggagauggaaga

SEQ ID NO: 4166783 - RNA, 66 nt, Human
ucaucccaugcuacauacaauuugucuguaaaauucuuacagugcaaugugauguagauuaaauga

SEQ ID NO: 4166784 - RNA, 59 nt, Human
ucaucccucagccaccuuugaggaaguaaacauggacuuccucccugagcuguggggga

SEQ ID NO: 4166785 - RNA, 60 nt, Human
ucaucccuuccuugaauccuuuagggucuacaguuacuugcaaaguugaggaaggcaugg

SEQ ID NO: 4166786 - RNA, 83 nt, Human
ucauccgguuucagucucugucucugguauuaggugaaaagacaucuuuuucccugcugcugagacuguauguaauuagauga

SEQ ID NO: 4166787 - RNA, 97 nt, Human
ucauccuaguagacugcagguuaggagcacuccuuuagagcaaaacguuuuagcauuuaacccagugacauccuuuaccuguuuuuuguuuuuuuga

SEQ ID NO: 4166788 - RNA, 56 nt, Human
ucauccucuugccccuugauuuucuccugagagucugacuuggccaggagcuguga

SEQ ID NO: 4166789 - RNA, 80 nt, Human
ucaucuagguuuuucuguauuauugugcuucagcucagagagugaauauuuaacaaaaugcagaguaugaauuucaguga

SEQ ID NO: 4166790 - RNA, 59 nt, Human
ucaucucucucuaugcguuguuccuacuugacagggaugggaacuaugguagaggauga

SEQ ID NO: 4166791 - RNA, 81 nt, Human
ucaucucugacaacaucagaaguagaagacucaggccauaauugauucuuugguuuuucugagguaucuguuuuagucuga

SEQ ID NO: 4166792 - RNA, 59 nt, Human
ucaucucugccuaugcuguaccuuuguuaauucuuuaauagacauuuggcuagggaugg

SEQ ID NO: 4166793 - RNA, 57 nt, Human
ucaucucuuuuguauugggguuugaauucuagauccugggagcaugaagagggauga

SEQ ID NO: 4166794 - RNA, 57 nt, Human
ucaucugcaucccccaggaaaugcuggguugccuugacccccugggaggaguuauga

SEQ ID NO: 4166795 - RNA, 89 nt, Human
ucaucugggacauguuagaaaugcagaaucucaggccucacccagaccuacuaaaucagaauuugcauuuuaacaagaucuccagauga

SEQ ID NO: 4166796 - RNA, 61 nt, Human
ucaucugggccaucagaggggcuggaaguguucagcuuguaugauauguggccugagauga

SEQ ID NO: 4166797 - RNA, 61 nt, Human
ucaucuguaucuagaccuaauguggauuaugagauuaacagcuuugggucugauaucauga

SEQ ID NO: 4166798 - RNA, 60 nt, Human
ucaucugucauccacaaagcuguuugcauucuucuggagucuugaugggucuacagaugg

SEQ ID NO: 4166799 - RNA, 59 nt, Human
ucaucugucugagagacuucuguccaaguuggauggagaaacagcucuaagacacgugg

SEQ ID NO: 4166800 - RNA, 58 nt, Human
ucaucugugcaggacucagaaggaagcagcuguuuguuguguccuaagcaccagaugg

SEQ ID NO: 4166801 - RNA, 87 nt, Human
ucaucuucagugcuguuucccaagguuucaaccuccccagccuaaccaggauacuugaaacuuuucuuggagaaacagucacuauga

SEQ ID NO: 4166802 - RNA, 74 nt, Human
ucaucuuuaugauucaccucuaugauuaggaacaaguuccaaucagcaguuggaauuagauaaauuagagauga

SEQ ID NO: 4166803 - RNA, 75 nt, Human
ucaucuuuuuacuaacacugcuuauaauuucaacuggaucauuugugaugcuuaaugcagugcuguagaaaaugg

SEQ ID NO: 4166804 - RNA, 85 nt, Human
ucaugaaauuugcagauuuaggaauguuaaaaaaucagaaauagagaaaaaaguccucuggucaagacauccuaacaucucaugg

SEQ ID NO: 4166805 - RNA, 62 nt, Human
ucaugaacacauguccuccuuggauugccacagcagcagggaaugaugccuguguuucuuga

SEQ ID NO: 4166806 - RNA, 60 nt, Human
ucaugaauauugaaugcuucaugaauacugaaugccucaugaauauugaaugucuuauga

SEQ ID NO: 4166807 - RNA, 90 nt, Human
ucaugaauguucuuaauggcaucuacaauagugaauccuuuccagaaguuuuccaauuuacuuugcugagauccaucaaaggaaucauga

SEQ ID NO: 4166808 - RNA, 58 nt, Human
ucaugacaacuugcacaguuuugagguugagacuuuugauauguguaaguugcauaga

SEQ ID NO: 4166809 - RNA, 70 nt, Human
ucaugagagaaguucaggucagguccacaaaugucugauaugugccuuugaaagccuggcuuuucucuga

SEQ ID NO: 4166810 - RNA, 66 nt, Human
ucaugagagagaggcccaagaauacagauggacuugcacuugaguccacugggcuuguccucgugg

SEQ ID NO: 4166811 - RNA, 56 nt, Human
ucaugagagugcucuuaaacaaacucgcaagcccgagaauuuuguucacuccaugg

SEQ ID NO: 4166812 - RNA, 84 nt, Human
ucaugaguuuguaaaaguucauugaugacugaggugaagcauugucauucuugucacuaaugaauuaucuuaaauaaauuguga

SEQ ID NO: 4166813 - RNA, 55 nt, Human
ucaugauaauacaggccuucuacccauucuguuaaagguuugcuguauaucaugg

SEQ ID NO: 4166814 - RNA, 93 nt, Human
ucaugaucagcuauagugaaauaugugcugauagcauuuuuggggacaagaagaguuagcuagacauucuuucacuguuuguuguucucaugg

SEQ ID NO: 4166815 - RNA, 83 nt, Human
ucaugauccugguuccaugacuuccacagcauuuucauuucccagcccuucugugguggggacagucgaucuagugauuguga

SEQ ID NO: 4166816 - RNA, 68 nt, Human
ucaugauucaguguagggcagaccccuggugcauaggcuaccacuuucuuaucccauacugcauuaga

SEQ ID NO: 4166817 - RNA, 84 nt, Human
ucaugcaauugucucuuuauucaggcaaaugguuucauuucucucuucuuuccucuccuuagugaaacagaggcaauuuauuga

SEQ ID NO: 4166818 - RNA, 65 nt, Human
ucaugcaggccuauggagcaguguagacacuagggagcagagcacugcagcguggucuggcagga

SEQ ID NO: 4166819 - RNA, 68 nt, Human
ucaugcaguuacuguuaugcaaacccucugccaggugagcugugagugcaucugcauacugcacauga

SEQ ID NO: 4166820 - RNA, 77 nt, Human
ucaugcaguuguagucaggcaggggcuggggcgagagucaucuccaaggcuuccugaccuacaugucugcugccugg

SEQ ID NO: 4166821 - RNA, 76 nt, Human
ucaugcauuucagacaagggaauagguaauauuuaaacauuaauauacaucuaugccuuucugacacaugcauuga

SEQ ID NO: 4166822 - RNA, 58 nt, Human
ucaugcugaguccuggcuuuguaaaaugacuuauaaagguccaaggauuuagagauga

SEQ ID NO: 4166823 - RNA, 57 nt, Human
ucaugcuugccagcagagcugucccaucacuuuaaauuauggcuggcagagcaguga

SEQ ID NO: 4166824 - RNA, 70 nt, Human
ucaugcuuucuuaguaauuuguucuuaaaugcuucaaucagagauuuacugagaacugauuacagcauga

SEQ ID NO: 4166825 - RNA, 84 nt, Human
ucauggcauguugucauuugaucuuucuuuguugauaaauuaauauuuaauacagauacaaaggaggacagugaaauugccugg

SEQ ID NO: 4166826 - RNA, 60 nt, Human
ucauggcugugauguacacuggggugacccacaugcugaaccccuucaucuacagccuga

SEQ ID NO: 4166827 - RNA, 74 nt, Human
ucauggcuuuuguuuucaguaauuugauuuccauuacauauugagaucagagaugcuaaaagagcugccaguga

SEQ ID NO: 4166828 - RNA, 59 nt, Human
ucauggggcguaggggauggauccauucuauguguggcuugccucuaccuaccccuaga

SEQ ID NO: 4166829 - RNA, 56 nt, Human
ucauggggugacagaagggaggagaaguccugcuucccugugucagugcccccuga

SEQ ID NO: 4166830 - RNA, 84 nt, Human
ucauggucccuuccuugugucuggauuucagcuuuccuaucucugcggaggggguuggaccagauuacacgugggugacucaga

SEQ ID NO: 4166831 - RNA, 104 nt, Human
ucaugguugaaaauuuuguccaugugcuuccucaggggaacgaugacuuucuaauuuauuauucccuuggcuaauacaugguaaacaaauucuaauaacaguga

SEQ ID NO: 4166832 - RNA, 74 nt, Human
ucauguaguauuuaucuguauuguagaacuguugcucaaugguaauaauuaacagugaugggucuauugcaugg

SEQ ID NO: 4166833 - RNA, 60 nt, Human
ucaugucagauguuuucucauuaagacagauucuguuuuuugugauaugacacuguaugg

SEQ ID NO: 4166834 - RNA, 101 nt, Human
ucaugugguuuuugucuuugguuccguuuauaugcuggauuacguuuauugauuuguauaugucaaaccagccuugcaucccagggaugaagcccacuuga

SEQ ID NO: 4166835 - RNA, 60 nt, Human
ucaugugugucaugaauaucucaguauacaucucuaacucagaaauacaugcaugcauga

SEQ ID NO: 4166836 - RNA, 59 nt, Human
ucauguguguguguuuguguguguaaacuccuucaauguguaaugcacuuaacacaugg

SEQ ID NO: 4166837 - RNA, 56 nt, Human
ucauguugccagagcuuuucaauauuccucaacuuuggaaaugcuaggcuacauga

SEQ ID NO: 4166838 - RNA, 81 nt, Human
ucauguuguugucauuauucugggauucuauaacuuggcauagaaagaccuguagguuccauagugcgaaaugcagcauga

SEQ ID NO: 4166839 - RNA, 88 nt, Human
ucauguuuacugauuaccuuugcuggucugcugugagggcaagggucuucagaaccagccagaagaggaucuaguuagauuuccauga

SEQ ID NO: 4166840 - RNA, 56 nt, Human
ucauguuugcccuaagaaaaaguaaaaaaaaguacuuuugauuuggggcaagcuga

SEQ ID NO: 4166841 - RNA, 55 nt, Human
ucauguuuguuggaaauguggccucuuaauggggcucacugaaccagagacguga

SEQ ID NO: 4166842 - RNA, 76 nt, Human
ucauuaauccaacaauucugugcaggcagagcuauacuuacaggaauagaaaugucuugcauauaauauuaaauga

SEQ ID NO: 4166843 - RNA, 65 nt, Human
ucauuaaucccgggguccagggacuuaaggacugaucccgauucagugaccccgggaucugucga

SEQ ID NO: 4166844 - RNA, 92 nt, Human
ucauuauauaagaacuagaacaaauuaggaggcauaaugaguguggcaaagcaaaaauucaauauccuugcuauuuucuaucuuacaaauga

SEQ ID NO: 4166845 - RNA, 128 nt, Human
ucauuauccaggcuacuuuuccuucuugaugcuccuguuaguuuaugcuuaagaaugcaaagaaugcaucuuaaugcuagccaauagagaacauaauaaagaugguaaaugucccauaagaauaauga

SEQ ID NO: 4166846 - RNA, 57 nt, Human
ucauucacugaugccuuaaugugaaugaguuuuacauuagaagguagaguggaauga

SEQ ID NO: 4166847 - RNA, 84 nt, Human
ucuuuagcuuucagucucugaaggaacaaaaucaaaacugcuugaacaaguaucccggcuggaggaaaaacuggaggcugugga

SEQ ID NO: 4166848 - RNA, 64 nt, Human
ucuuuaggaugaauuuguuuuauucucauuggccauugaucauggaaugaauauguuuuaagga

SEQ ID NO: 4166849 - RNA, 70 nt, Human
ucuuuaggcuaggugcuuagacauugaacugcugaggcgaacagugucugccuauuuuucaagccucuga

SEQ ID NO: 4166850 - RNA, 62 nt, Human
ucuuuaucacaguuuugugccuuguggacggauaguggguccaucccaugggagcuguagga

SEQ ID NO: 4166851 - RNA, 85 nt, Human
ucuuuauccuuaagcuauuuuuuaaauuuugaguaucuuuuauuugcuugagaaguugagaauaagagauaguuuauuuuccaga

SEQ ID NO: 4166852 - RNA, 76 nt, Human
ucuuucaaauaggccuugauaaauuaguaagccauuggguaaauaggcuugcuucuuguccaggaauccugagaga

SEQ ID NO: 4166853 - RNA, 70 nt, Human
ucuuucaccugggcuuucucugggacucaccuaggaguuccccagugugguagguccacagguguaaagg

SEQ ID NO: 4166854 - RNA, 128 nt, Human
ucuuucagaaugcuaauaccgauacuuuaaugagaaugaggauuuuuagaucacuuuucuugcaacagaaaagagaacaucugaggaucugaggucuuaaagcaacgaacauaaagcaaaguggaggg

SEQ ID NO: 4166855 - RNA, 87 nt, Human
ucuuucaggaaaacuaaaggccauuauucugauauauucacuguauugaacuauaaaccagugaugcccucuagugguacugaugga

SEQ ID NO: 4166856 - RNA, 91 nt, Human
ucuuucagucauucacucauucagcaagaauuuacugagcuuauuuagugagaccaguucccuucuuggcugacggaaugucacugaaaga

SEQ ID NO: 4166857 - RNA, 77 nt, Human
ucuuucauucuccuccugcccccuguaugacaaaauaggcaaaaugaguacaucagagggugagauggagaaaaaga

SEQ ID NO: 4166858 - RNA, 61 nt, Human
ucuuuccaugauagacuggugcuuuuuaaggaauaucucaagugccaguagguauggagga

SEQ ID NO: 4166859 - RNA, 77 nt, Human
ucuuucccgacuugaacccaaaaagauauugcuuccuugugggaggagcuugucugauaauggggccaacggaaaga

SEQ ID NO: 4166860 - RNA, 74 nt, Human
ucuuucccuuuuuucugugcccugcuagcuggaaaucuuccauuugguuauguaucgaaacuaccagcggaaga

SEQ ID NO: 4166861 - RNA, 130 nt, Human
ucuuuccuucguuuuauaacaggcuuugucuucuguugcucugugcaaauagcaccccuugacaagucauaaggccgugauaugugcacgguacaucgcagugaaagagcagcuuuaugcgaggggagga

SEQ ID NO: 4166862 - RNA, 70 nt, Human
ucuuuccuuguaggcucugucaccuaugagcugacacagucacccucagcgucaguggccccaggacaga

SEQ ID NO: 4166863 - RNA, 78 nt, Human
ucuuuccuuuccuguccugguacuuggcaccuuguagacaguugcauguccccugcccagggaugggaugaggagagg

SEQ ID NO: 4166864 - RNA, 56 nt, Human
ucuuucuagggcucuugucuucugcugggaggcagagcaucucuagcccaggaaga

SEQ ID NO: 4166865 - RNA, 67 nt, Human
ucuuucucuaucuguucaucuggaaacauacuuuguuuucucucuauuuagacagguauggauaagg

SEQ ID NO: 4166866 - RNA, 63 nt, Human
ucuuucucuucagcacccagccccggggccagcaccguggguggagcaguguggggugaaaga

SEQ ID NO: 4166867 - RNA, 68 nt, Human
ucuuucuuauuaugcucaauguuugcaaguuucacaugaagccugaaugcaagcaugaagaguagaga

SEQ ID NO: 4166868 - RNA, 62 nt, Human
ucuuucuuuaucaccugauaugggucccuaaaagggggggaacaugcagggaagaagagggg

SEQ ID NO: 4166869 - RNA, 60 nt, Human
ucuuugaaguaucuuaaauggugaggaaacuccaaaagacuucuauuugagauuuaaaga

SEQ ID NO: 4166870 - RNA, 68 nt, Human
ucuuugaauguuuuagguacuuaagaaaauggagcauuucuuauaguaugaaggaaaacauuuguggg

SEQ ID NO: 4166871 - RNA, 60 nt, Human
ucuuugaggccagucucaucacaggcugagaggccuaggaguacagaaugguuuuggggg

SEQ ID NO: 4166872 - RNA, 78 nt, Human
ucuuugagugaguaggugguuaagcauggaugccucucagcucuccucugauuugauuaccuaguuuaaacuuccaga

SEQ ID NO: 4166873 - RNA, 79 nt, Human
ucuuugaugcuccuuccagucuuuucaguggagucagaagcagagacuugacugccugagaugggaaaggcauuggaga

SEQ ID NO: 4166874 - RNA, 122 nt, Human
ucuuugauuuucaaauuauuauuuauacuuacuuagcauuauguaauuacuaggacugagaauucagaauuaggagcuauaaugugaagucuaaaguuucuggaucugauuaaaaucaaaga

SEQ ID NO: 4166875 - RNA, 63 nt, Human
ucuuugccccuucuacccgucucuguaugaccccaaugggguaggguacgaaggggagccaga

SEQ ID NO: 4166876 - RNA, 90 nt, Human
ucuuugcccuaaaaguguagacuauuuuuaugguucugaauacagcccuccuuucagauccguggauuauaauuuagauaucagcacaga

SEQ ID NO: 4166877 - RNA, 60 nt, Human
ucuuugcccugaauaauagaguggggaaggcuuuugagccauucucaguucaggagaaga

SEQ ID NO: 4166878 - RNA, 80 nt, Human
ucuuugcuauugugaauagugcugcaauaaacauaugugugcaugugucuuuauagcagcaugauuuauaguccuuuagg

SEQ ID NO: 4166879 - RNA, 68 nt, Human
ucuuugcucuuacacaguuagugaauuaaaugagauuuuacagagaagagacugugaagagcaaauga

SEQ ID NO: 4166880 - RNA, 59 nt, Human
ucuuugcucuuauguuacuauggcuuuuggcaguuagcuuugguugaggggagugugga

SEQ ID NO: 4166881 - RNA, 59 nt, Human
ucuuuggaacccagcccaucggaacucuguaaaguaugaacaugcugugguuauaaaga

SEQ ID NO: 4166882 - RNA, 58 nt, Human
ucuuuggaauaauuuccuggaguauucaaaucaaagugcuaggggaacauuucagaga

SEQ ID NO: 4166883 - RNA, 71 nt, Human
ucuuuggagauggcucugcaaggucuaaggcccucccagagccuuagaccuuggaaagccgucuccaaagg

SEQ ID NO: 4166884 - RNA, 64 nt, Human
ucuuuggccuuaggagcccuugggaggaagcugcuacugccuuggggguugggagagucaggga

SEQ ID NO: 4166885 - RNA, 67 nt, Human
ucuuugggaacacuccagggcuuggaagacauaauuuuuccaggugauggucggaguucagugaagg

SEQ ID NO: 4166886 - RNA, 80 nt, Human
ucuuugucuggccaggcugggcuacaaguugaguggaggguaauccuacaugcacacagcugggccuggcugggagcuga

SEQ ID NO: 4166887 - RNA, 101 nt, Human
ucuuugucuuaguuggaguucucucaaauggauuucuggccccuccugugaggugggacuggcagauaccuuuuguuggaauuucccaugagcuuagaaga

SEQ ID NO: 4166888 - RNA, 61 nt, Human
uccagugccucacugaggauucagcucugcucaagucugccuguuuccuggggauacugga

SEQ ID NO: 4166889 - RNA, 67 nt, Human
uccaguggagugugggggugaauauggcuccacuucuaaaucccuuccuucaucuccauccacugga

SEQ ID NO: 4166890 - RNA, 67 nt, Human
uccaguguuucagguagauaaauuuucauuaagaaauaagggaagaaucaacauugaaagagcugga

SEQ ID NO: 4166891 - RNA, 55 nt, Human
uccaguugcccaucucucuucuucaggaugcggaaggugaggggugggugcugga

SEQ ID NO: 4166892 - RNA, 81 nt, Human
uccaguugccuugaauuuuugcuaauccccagccacugccccuuuuggggcacuugucguuacagaaugcaggaaaugaga

SEQ ID NO: 4166893 - RNA, 64 nt, Human
uccauacagaucacaguccuaggccacagaaaagggugggaaacuggggacugaaucugaagga

SEQ ID NO: 4166894 - RNA, 59 nt, Human
uccauacauacauaugcagaaaagaaugaggaacuucucuuuggauauguauggauaga

SEQ ID NO: 4166895 - RNA, 75 nt, Human
uccauaccgauuuguaucaaaaccucagcgucagaaacaaacucugcagaauggguauuuagauucaaguaugga

SEQ ID NO: 4166896 - RNA, 92 nt, Human
uccauagaaccuugaagcagcuuucuggugaggaggugagcuacuuccugcaaaacuacuaguagcugcuauugauuaauguauucuuccaa

SEQ ID NO: 4166897 - RNA, 58 nt, Human
uccauaguuauagcaaaugaguugguacucauuccaaaugacacuuuguugcuguggg

SEQ ID NO: 4166898 - RNA, 79 nt, Human
uccauauaaugauacuguuggaucagugucuucagcugcaguauguaagcacacaggacuugauucaugaucauauggg

SEQ ID NO: 4166899 - RNA, 60 nt, Human
uccauauuucuuguuaaccagacuuaaaaggaggcucuggucaguaauaagaagugggga

SEQ ID NO: 4166900 - RNA, 72 nt, Human
uccaucaauuaugugauugauaguuaagagauaacaaauuuaucucuuaacugguucagcaauuugauagga

SEQ ID NO: 4166901 - RNA, 103 nt, Human
uccaucacaccccaucccagcaguggcagaggcugugaggaugccgcugggucaggugguguccuacuuaaccacugucagcuugggauauggcauucuugga

SEQ ID NO: 4166902 - RNA, 76 nt, Human
uccaucaggcuagcucauguaagagagcauuaguuuguuccaaaacaagggcauuuuuacagagcccuaggauggg

SEQ ID NO: 4166903 - RNA, 61 nt, Human
uccaucaggcucgugggcucuccaaucacucagccagccaggagcacccugggccagugga

SEQ ID NO: 4166904 - RNA, 61 nt, Human
uccaucaguaaauauucauugugcacauacuauguccacaccucauguauugugcugggga

SEQ ID NO: 4166905 - RNA, 82 nt, Human
uccaucaugggugagcagguggccuccugucuguccuccuggagggcuggacacuggccaucugcuuguuucccaugaagga

SEQ ID NO: 4166906 - RNA, 60 nt, Human
uccaucauuuguuugcaugcaggauuuuauuugacaguccuguauuguuuuagauguaga

SEQ ID NO: 4166907 - RNA, 65 nt, Human
uccaucuuuaaagaaauuccucaucuuuugauauuucgagcaggaaggcuuuggggguuccugga

SEQ ID NO: 4166908 - RNA, 61 nt, Human
uccaugacagcgugagaguuugcagccaaagacuaguauggcggguccauggugucaagga

SEQ ID NO: 4166909 - RNA, 57 nt, Human
uccaugagaacccuuggagauaagcagaauaaaucuuauccccauuauuuucauggg

SEQ ID NO: 4166910 - RNA, 61 nt, Human
uccaugagagguaacuuuacaaugaaauauguuuucuuugugcauggcuacuuuuuaugga

SEQ ID NO: 4166911 - RNA, 67 nt, Human
uccaugaugcugugagaccauuuguugaggaagguguccuucuuaaaguugucacagcugcuaagga

SEQ ID NO: 4166912 - RNA, 66 nt, Human
uccaugcagaguccaggccucauuccucauuugaagcucacgugguaaaaccugggcucuguugga

SEQ ID NO: 4166913 - RNA, 80 nt, Human
uccaugcagguuaagaagcuagagaugaacacgcagaguuuauauacuuuggaagaaucgugucacuggcucuguaggga

SEQ ID NO: 4166914 - RNA, 57 nt, Human
uccaugcaguagaggcgcugggcagagagucaaggcccagcagccaucgaccaugga

SEQ ID NO: 4166915 - RNA, 61 nt, Human
uccauggagcauucagguuucccuuuugacugacaagaacuaaaaagaaugcuccaguggg

SEQ ID NO: 4166916 - RNA, 79 nt, Human
uccauggcuguuucuccugcccagaugccugggguaccgcugccccauggagcuaaaggaggagcaaacugccaugaga

SEQ ID NO: 4166917 - RNA, 62 nt, Human
uccauggcuuucuuucauuguaaugucuuuuuuugauaucagagaaaugcugagcucaugga

SEQ ID NO: 4166918 - RNA, 57 nt, Human
uccauggucucuuccagauaaccgagacauaaacaaggggcuggagaagccugugga

SEQ ID NO: 4166919 - RNA, 59 nt, Human
uccaugucuagacacuacuaguaaccggugccuucuguaccugcugugcuuuccaugga

SEQ ID NO: 4166920 - RNA, 71 nt, Human
uccauuaauugucauuuaaugccuuugccauccagguuacuuggagaggaaagaaauuaaauuugaacgga

SEQ ID NO: 4166921 - RNA, 89 nt, Human
uccauuagccauugugauguucucuuccuggucagugaguaaugacugugauccaggccaggagagcgagguuuauguuuuuugaugga

SEQ ID NO: 4166922 - RNA, 69 nt, Human
uccauuaugauucaggauugaaccauuucuuuugaggagguaaaugaacucuuccugcaucccccugga

SEQ ID NO: 4166923 - RNA, 73 nt, Human
uccauuauggauuagccuuaauguuucuugaauuucuguuagggaacaucaaggucugugucuaguucuuggg

SEQ ID NO: 4166924 - RNA, 60 nt, Human
uccauucagcauuggcaccauggauugccacaggagguuuauacacaguguugauaugga

SEQ ID NO: 4166925 - RNA, 58 nt, Human
uccauucuuuugcugucuuccuaauuagugcacuaaggaagaugaacaacagaaagga

SEQ ID NO: 4166926 - RNA, 56 nt, Human
uccauugauagcuuucuggaagcagccaaugaguuguuucaaguuugcucaaagga

SEQ ID NO: 4166927 - RNA, 68 nt, Human
uccauugccuggaaagcacugacaaugugguagcuuucaucacugcugcaguuuugccaggcaaugga

SEQ ID NO: 4166928 - RNA, 55 nt, Human
uccauuggucucugugcccaggugguuuuggaucccuuggagcagcgcuaaugga

SEQ ID NO: 4166929 - RNA, 79 nt, Human
uccauugguucauuuuuccaccuccuaggaaguuaaugaguuucacacagggucggaaagagugauaaaacacagagga

SEQ ID NO: 4166930 - RNA, 58 nt, Human
uccauugucacugcuuuagguucaggcuuuuaucaucuugaacuucaacuacaaugga

SEQ ID NO: 4166931 - RNA, 130 nt, Human
uccauuuacagaggccagcucugggugaaggguaccauugaaagaugucgaagaacccaguaccauugacaguaagccuggugguaacccuucaccuguaagggcauggagaggaaccaguguuagugga

SEQ ID NO: 4166932 - RNA, 91 nt, Human
uccauuuaguauguuuuuauuguguaaaugugggaguguagguuuugaaagccccuauguuuuacaguauugaaaauuccaaacuaaagga

SEQ ID NO: 4166933 - RNA, 64 nt, Human
uccauuucuagccucugaaguaggagguggcuucuccaugaggaaccaggggcuggagauagga

SEQ ID NO: 4166934 - RNA, 64 nt, Human
uccauuucugaggauggcauuauucugauuaauuuagucagacugaucaucuaucagaugagga

SEQ ID NO: 4166935 - RNA, 63 nt, Human
uccauuuucuugcucuagguaaccucuggaaugaacauuacagagauagagcaaggaagugga

SEQ ID NO: 4166936 - RNA, 72 nt, Human
ucccaaagcuuguugggucaguuuugggggacugcauuuucaugaaccagagcugcauccagcagguugggg

SEQ ID NO: 4166937 - RNA, 62 nt, Human
ucccaaagucagugcucagucguccuugcccuccaggacuuuggcaucuagacauuguugga

SEQ ID NO: 4166938 - RNA, 63 nt, Human
ucccaagagcucugggauaaggacaggaucaugaccaaacuucucaaugagcuuuuuaaggga

SEQ ID NO: 4166939 - RNA, 59 nt, Human
ucccaagagggguuauuaugccacugguucucaucgggggcuaaaggcccucuguggga

SEQ ID NO: 4166940 - RNA, 119 nt, Human
ucccaaugcaaguauuaagagcuggggccuucggagcaugauuaggucaugagagccccgccuucaugaauggaaucaaugcucuuauaaaaggcccaaguuacauuuucuggauggga

SEQ ID NO: 4166941 - RNA, 102 nt, Human
ucccaauugaacauucauuuucucuagggagaguuguuauggguuaaccgauugagggagccaaaauaagucuccguauaacaugaaaaugauuuccaagga

SEQ ID NO: 4166942 - RNA, 74 nt, Human
ucccacacaggcagcggcuggcucagugcaacuccagagacuaggagcugccugccaugccgcugguaagggga

SEQ ID NO: 4166943 - RNA, 130 nt, Human
ucccacagcuccucaacagccugccuaagcccgguggcagcucgggccucccucucccgggcccucaaucuugccuccccgggaagggcggcccagugccccaucaggagcagguuggggaggugaccug

SEQ ID NO: 4166944 - RNA, 58 nt, Human
ucccacagggcuucucuguacagagugagugccucguacuugagaagucuccugggga

SEQ ID NO: 4166945 - RNA, 119 nt, Human
ucccacggcuguggggggucucagggcagaggcccauggucauggcugugggacucucaggguggagggcuuguggucguggcugugggggucucugggcagaguccauggcugugggg

SEQ ID NO: 4166946 - RNA, 67 nt, Human
ucuuagcuguucccucacugcagucacugcaagcagccuggugcaguccaaagggagcagagcugga

SEQ ID NO: 4166947 - RNA, 59 nt, Human
ucuuaggauuccaguucagggcaucguaagcuacacagaucccagucuagguccuagga

SEQ ID NO: 4166948 - RNA, 79 nt, Human
ucuuaggcucggcuuagcaguuaaucugagccaagauugucuaaaauaaucuuagauaaacugcuccccuucccugaga

SEQ ID NO: 4166949 - RNA, 92 nt, Human
ucuuagguaauuugaggaauaaauuggugucauuugcauucuauuccagaagacaaaccugcugcuauuuuauccaguauuuuauccuaaga

SEQ ID NO: 4166950 - RNA, 79 nt, Human
ucuuaguaaccuuauuuaguaugcuugauacaacagcaaggcugaacucaagcaacugaauucuaaaaggaagcugaga

SEQ ID NO: 4166951 - RNA, 61 nt, Human
ucuuagucacagaggugagaaacuucauuuaguuuggucuuaugccucugucccacuguga

SEQ ID NO: 4166952 - RNA, 82 nt, Human
ucuuagugaaaggaguauauaauuaauuggucugguggucuccacucaaccagugauauguguaauugguuucucacugaga

SEQ ID NO: 4166953 - RNA, 102 nt, Human
ucuuaguuucuccaacuacaaaaugugcaaaguaaaguaauuuuccaaauacauuaaaaaguugcacaacuuuguauacggguggaaagaggcuuguugaga

SEQ ID NO: 4166954 - RNA, 130 nt, Human
ucuuauaaaguuguguaaaacaugguucuuuucucaaaaugcuuccagauugguaggggugucaaacauguucauuccuauuaugggguagaaaccaguaagugaaucaaggguuacggaaauucagaga

SEQ ID NO: 4166955 - RNA, 71 nt, Human
ucuuauaaucucuauuuuaauguuagugcuggucaguugugccuacacuccaaaagaaggaggguauaaga

SEQ ID NO: 4166956 - RNA, 87 nt, Human
ucuuauaccucaaauccaacaucccuuccuagcacuuggugugggggaccccaggccaagugcugggacaggugugcagguacaagg

SEQ ID NO: 4166957 - RNA, 78 nt, Human
ucuuauauggcagaauuucuagcagauucuauaaauguaaugcaugaagugagcgaagaaguuuuguccaaaauaaga

SEQ ID NO: 4166958 - RNA, 129 nt, Human
ucuuaugguggguguuguaaugcuuuuauuuugcagacucuacuggggccagugaacaaugagggaaugaaguacaucauuccacauguuagcugguuaaagucauggcacuuggcagccuccuugaga

SEQ ID NO: 4166959 - RNA, 66 nt, Human
ucuuauuacucagcaucaucuuucugcacaagcugaagcugcaguguuuggaugcugagucugaga

SEQ ID NO: 4166960 - RNA, 76 nt, Human
ucuuauuaucauguuaauuagugggagggcuguugagguuuuccacuucauuaccuacuaauuucaagauaaauga

SEQ ID NO: 4166961 - RNA, 101 nt, Human
ucuuauugucagggacuagccaacuuagaaagaguuuucuccccuacuaaggugauuucauuuuuucugaguggaagcaauauuucccugauuaaguaaga

SEQ ID NO: 4166962 - RNA, 71 nt, Human
ucuuauuugaucaggaaggagagggauguugcucacccucagcuucuuggauuaauccagcauuuauagga

SEQ ID NO: 4166963 - RNA, 62 nt, Human
ucuuauuuuaaagugaagggucuugucauuuuaguguaagagccauucaaguuaaucuuaga

SEQ ID NO: 4166964 - RNA, 74 nt, Human
ucuuauuuuaauguugaagaugcugaccauguggugauucuuuacuauuaaauacucuucaaauugaaguuaga

SEQ ID NO: 4166965 - RNA, 57 nt, Human
ucuuauuuuguuagaugcuguacagcaaguaaaagcuguagcuucuuaagaauaagg

SEQ ID NO: 4166966 - RNA, 63 nt, Human
ucuucaaaguguuuuccaugcaaugaagcacuugcuguguugaacugaaugcacuacuggaga

SEQ ID NO: 4166967 - RNA, 81 nt, Human
ucuucaaauccuacagugucuggucauuucugcccaagauaccuuugguaauuuaauuucagauaucugucuauuuggaga

SEQ ID NO: 4166968 - RNA, 95 nt, Human
ucuucaagaacaaauauuguccacaucacucacuugucauuuauuguuaguugacguguguguguguguguguguguguguguaucugugugaga

SEQ ID NO: 4166969 - RNA, 72 nt, Human
ucuucaagauccccucugaaguguguguagcacuaguugcucuaucuuugcuugagggaaagagcuuggaga

SEQ ID NO: 4166970 - RNA, 86 nt, Human
ucuucacagugcuggauaaugcauuauaagaaauuuucgugaauauacuugaaagucauuuagccuuaucucccacucagugagga

SEQ ID NO: 4166971 - RNA, 78 nt, Human
ucuucagaagcuaauuaauaugagacaagucaugaagguagguguccucaugauuauauuaauggcuucauaaggaga

SEQ ID NO: 4166972 - RNA, 73 nt, Human
ucuucauaugagaucuccaagucaauaucacuggccaggucccugacacugguuggcugagauccauaggaga

SEQ ID NO: 4166973 - RNA, 63 nt, Human
ucuucaugggcaggaacuuggagacggaaccacaagaauggucuccugagaggcucuuggaga

SEQ ID NO: 4166974 - RNA, 57 nt, Human
ucuucauguacuuacugagcacauaccaugugcugggcacugucuagguacugagga

SEQ ID NO: 4166975 - RNA, 56 nt, Human
ucuucauguauuugacaaccauuuaaucacuuuaucugguauguuuggccugaaga

SEQ ID NO: 4166976 - RNA, 64 nt, Human
ucuucauucuuuccuuaauugaugcucagccacaaaaaguucguugucaugaggaaggagaaga

SEQ ID NO: 4166977 - RNA, 94 nt, Human
ucuucauugucaucaagucucuuccucugccaaagaacaauugaucccugcaacuucuagcagagggaagaggcuuuccaaggacagcagaagg

SEQ ID NO: 4166978 - RNA, 67 nt, Human
ucuucauuuuacaggcagaccugucuaacuacaagccagacuuggguuuucuccuguaguuugaaga

SEQ ID NO: 4166979 - RNA, 129 nt, Human
ucuuccaaucauggguuuccugugaauccucccucauucuuccucuggccuccuuucagcaagaacgcgaccccacugagguggcugaagagugggugaggguuuccagaggccaggcacucugguaga

SEQ ID NO: 4166980 - RNA, 59 nt, Human
ucuuccacuugcaaguuuauggaaauaucaguaugucaaaauaaauaaaaagugggaga

SEQ ID NO: 4166981 - RNA, 57 nt, Human
ucuuccagggagccucaaaccugauuaacggguuagaaaauagggccuguggagcga

SEQ ID NO: 4166982 - RNA, 63 nt, Human
ucuuccagggccugcuuucuucuguucgugauagaaucaucccaguguggcaggccauggaga

SEQ ID NO: 4166983 - RNA, 63 nt, Human
ucuuccagugcuguguagagcuggauacauguacagcccugccuucccaugcagcuggggaga

SEQ ID NO: 4166984 - RNA, 69 nt, Human
ucuuccauuuucccaccaucuccugcaauaccuccucuucccuuaggcuuuccugggcagaugagaaga

SEQ ID NO: 4166985 - RNA, 72 nt, Human
ucuucccaauauucugcuuuuauguuucauccugcaggcaccuccucauauagagcaaggaugucaggaagg

SEQ ID NO: 4166986 - RNA, 61 nt, Human
ucuucccagagguugagucacuuaugcugcugagcacaggaauuuugaccuuugggugagg

SEQ ID NO: 4166987 - RNA, 57 nt, Human
ucuuccccuucauggcagcagccaggcccucccugcacaggccuugaagggagagga

SEQ ID NO: 4166988 - RNA, 89 nt, Human
ucuuccucaaauaucuggguguguuacaaugaugccgacaucauucugguuuuggaauucaaguuguagcuuagccagcauguggaagg

SEQ ID NO: 4166989 - RNA, 64 nt, Human
ucuuccucaauguaacaacccccaucuuccagaguacacagggggcagcguguggacaggaagg

SEQ ID NO: 4166990 - RNA, 56 nt, Human
ucuuccucaccauccuccaucccuccagcuaacaaagggcagaagguguaggggga

SEQ ID NO: 4166991 - RNA, 67 nt, Human
ucuuccucagcuccaaaguccaagacugggugccaggcccagugugguucuuuggagaaaggcugga

SEQ ID NO: 4166992 - RNA, 80 nt, Human
ucuucgugauaugcuggcuggaggagggagguugugagaacaaauugcuaacugucagacuagaaucaugucuauggaga

SEQ ID NO: 4166993 - RNA, 70 nt, Human
ucuucuauaggagcagaaagucauucacaauguaaauaaacaguuggaagaauguuugccuuauaacaga

SEQ ID NO: 4166994 - RNA, 70 nt, Human
ucuucuaugaggcaggcccugaaugagucacugagaaggcaguugaauacaugguuccugcucucgaaga

SEQ ID NO: 4166995 - RNA, 72 nt, Human
ucuucucaucagaguggggacuaauaacagugaccuccccgccagguccuguguguugccggcugaagaagg

SEQ ID NO: 4166996 - RNA, 76 nt, Human
ucuucucguucagguagagcuccaccaccuucaggcagacgucaucgcucacgagguggugcagcuggcgggagga

SEQ ID NO: 4166997 - RNA, 108 nt, Human
ucuucucguuucuugcaucuggccacugacuucugauucucucuggaugguuaucaucuugcagucuagagguagaggcagugggaacuuuguuuaggaucuugaaga

SEQ ID NO: 4166998 - RNA, 59 nt, Human
ucuucucucagcucgucaaagucauucuccauccagcuuugauccguugcuggugagga

SEQ ID NO: 4166999 - RNA, 84 nt, Human
ucuucucuggaggccguuggcccuuacugguccuauguauguuggaaagaucugagguucugccgaccugguuuccagcccuga

SEQ ID NO: 4167000 - RNA, 107 nt, Human
ucuucucuuccaucauaguuuuacuaaggacucuaaguucuauuguugacuuguauuggagcaggaagucuauggcugugacuuuggauggaauauaacaaagagga

SEQ ID NO: 4167001 - RNA, 76 nt, Human
ucuucugagugggaagaauucugcaacacccuguagcuugucgcugcaaugaauuacuucccaaacuucacaaaga

SEQ ID NO: 4167002 - RNA, 60 nt, Human
ucuucugcuuccaaauucagggcucuuuucacucuaccauccuggcuuugcagcaugaga

SEQ ID NO: 4167003 - RNA, 101 nt, Human
ucuucuggugcuuuccuccugacuuuaaaauaacaaguuuagaaggccauuucuugauuuuccaguuuaaaugucacgggaugaacuuccaccauggaaga

SEQ ID NO: 4167004 - RNA, 74 nt, Human
ucuucugugguguaggucacaguuaggaugaaucugaccucaucuuaauucugugucuucacuagucacuaaga

SEQ ID NO: 4167005 - RNA, 63 nt, Human
ucuucuuaugugccauuaucuccuuucccuacucaugggaguaagagacauguagauagaaga

SEQ ID NO: 4167006 - RNA, 68 nt, Human
ucuucuucugguuuauguggcaaggacuaucauaauuaauuuuuccucugaacauugaugggagaaga

SEQ ID NO: 4167007 - RNA, 61 nt, Human
ucuucuugaagcagagaaauacuugaacuuuuguuuagauuaugcucugcuucaaucaaga

SEQ ID NO: 4167008 - RNA, 68 nt, Human
ucuucuugauucaucucagcagagcuuucccaagggcauccagggccagcugaugagaaugaggaagg

SEQ ID NO: 4167009 - RNA, 84 nt, Human
ucuucuuugguguuuauuugugaaucauuuaucuacuuuauagaacaauugguagaguuauccuucacagguauauucagaaga

SEQ ID NO: 4167010 - RNA, 84 nt, Human
ucuugaaauggcauuauuugguuugauccaugugagcacucaauauauuauucacaugucaaaaacuacauaaaaacauuuaga

SEQ ID NO: 4167011 - RNA, 70 nt, Human
ucuugaaauuccugccaggauuccuauucugucucagcuugggauccaguucuaggcuaggggaguaaga

SEQ ID NO: 4167012 - RNA, 60 nt, Human
ucuugaaggcuuggacuugaacugggauccuuucuggcucucaaguuuugcuugacaaga

SEQ ID NO: 4167013 - RNA, 58 nt, Human
ucuugagggucuggaucugcugcuggaaggccagcugcaccggcuggaccacugagga

SEQ ID NO: 4167014 - RNA, 60 nt, Human
ucuugaguguggacagguguccuggacagguaggugucuggaugccacgaagcaccagga

SEQ ID NO: 4167015 - RNA, 71 nt, Human
ugaagacauugcaugauaaugcugcaaccauaaaaugaaauauuauguagcuguuaccaguuuugucuuca

SEQ ID NO: 4167016 - RNA, 117 nt, Human
ugaagagaccauuugacaacuucaaaaaucacuaaguuauaguguggagaacaaaaauccuacucugaauugaagugauauuaagauuuuggaaaugaaaauucauagggcuuuuca

SEQ ID NO: 4167017 - RNA, 56 nt, Human
ugaagagagcugucaguuagaaguucccuuggucuucucacugucugcuuuguuua

SEQ ID NO: 4167018 - RNA, 116 nt, Human
ugaagauagugugaugcuauuuaaaguagcuuuguagguacaguuaguugaguaaacaagcugccuuaugucuauuaguauauuuugucaagauaguaucacauuuccccucuuca

SEQ ID NO: 4167019 - RNA, 86 nt, Human
ugaagaucuaaauaugguuauguaaucaguuguucagacaagagaaacguagauuaauugaauuagauaaucccaguggucucuca

SEQ ID NO: 4167020 - RNA, 80 nt, Human
ugaagaugucagcaggggugguugcuucuaagggugucucucuuuggcuugcagaugaucaccuuccugugacaucuuca

SEQ ID NO: 4167021 - RNA, 71 nt, Human
ugaagcagaaacaaucugauuuagggggcagucagauaagagacuguuaaaguaauuaauugucuauuuca

SEQ ID NO: 4167022 - RNA, 71 nt, Human
ugaagcagagaggaaucuagcauuacaaaaacuguuaagucagaugagcucuaagauccccucaagcuuua

SEQ ID NO: 4167023 - RNA, 79 nt, Human
ugaagcagcauuuacauucccccaauuaccaaugggaugaguuucccugggaaggagaggggaguggggagcugcugca

SEQ ID NO: 4167024 - RNA, 64 nt, Human
ugaagcccuuuaucaaaagagagagaauaaaaguauuuucugacugguguauaauagggcuuua

SEQ ID NO: 4167025 - RNA, 58 nt, Human
ugaagcuagaauguccauauuuaaucaagggaugagugaacaggaaaagcuggcuuca

SEQ ID NO: 4167026 - RNA, 94 nt, Human
ugaagcucugcggugcacugaacagcccuguuaagucuguucugcuacugguauuuugagcaggagggccuguucagugcacugcagagcuuca

SEQ ID NO: 4167027 - RNA, 106 nt, Human
ugaagcuuggccugcccaacauuuagcaagaugcccuggcuuucuacuaaaaggaacuugccuuaucuuuuaaauuaaaauuguggcauaugaauagccagcuaca

SEQ ID NO: 4167028 - RNA, 62 nt, Human
ugaaggaaaugacggcagaagauaugacaagugccaucuucauuucuguguuaauuccuuua

SEQ ID NO: 4167029 - RNA, 56 nt, Human
ugaaggaagaauaggcaguguugugacgccauuaacuugcucugauuuuccuguca

SEQ ID NO: 4167030 - RNA, 64 nt, Human
ugaaggcauuugaguuggugagcccuaauuuaaccucccugggucaccauuuuuuuugcuuuca

SEQ ID NO: 4167031 - RNA, 123 nt, Human
ugaaggcucucuugccuggcuucacaagcugacuuagagcaguuggcagcuguauucaccgcucaccaucaggaucacuguucucaacuuucuucggcagccggaaagagauaaacaccuuca

SEQ ID NO: 4167032 - RNA, 71 nt, Human
ugaagggagacuagaguugaacuauuugccaucaaugaugaugacuaauugauaacucuguaauccuuuua

SEQ ID NO: 4167033 - RNA, 83 nt, Human
ugaagggagggcggcagaagacacucccucucgguucaugcaaaucgcugggggaacuucagccaauagucacuggcucuuca

SEQ ID NO: 4167034 - RNA, 57 nt, Human
ugaagggcuguuuuacauugauaaggauuugcugcaaauguauaacagagcccauca

SEQ ID NO: 4167035 - RNA, 73 nt, Human
ugaaggucgauugauuuccucuacuagcaauuaugccucauaauuguuugcugaaggagaaauuggcauuuua

SEQ ID NO: 4167036 - RNA, 63 nt, Human
ugaaggugcucguuauggccaguggaaggaugcuuuuaacacagagauggccagggcacauca

SEQ ID NO: 4167037 - RNA, 72 nt, Human
ugaaguaagcaugggaaucccacaggguacaaggucccgcauacccuucugggauuuccgaugcccucuuug

SEQ ID NO: 4167038 - RNA, 129 nt, Human
ugaaguagcauagaaaugaugcuguguucucaggacaucauaucaggaggcauguaauagacuauugucccaggauugugauguuaacuuugaucacuuggcuaaggugguaucucuuagcugucucua

SEQ ID NO: 4167039 - RNA, 57 nt, Human
ugaaguaggcagcaugcugagaucaaggagcuuuacucagaaucacugucuguuuca

SEQ ID NO: 4167040 - RNA, 57 nt, Human
ugaagucuuggcugaaaacccucaauuacccuuugggggcaguuugcuaagccucca
